United States Patent 6,562,958 (NUCLEIC ACID AND AMINO ACID SEQUENCES RELATING TO ACINETOBACTER BAUMANNII FOR DIAGNOSTICS AND THERAPEUTICS) - sequence listing, part 2

SEQ ID NO: 2150 - DNA, 1410 bp, Acinetobacter baumannii
aagcttgacgttgccagaaaaattatctccagggattgtgttgccttaacactagggaaagaaaaaatgaaaggatatgaagtaaattttgatggtttagtgggaccaacacatcactatgcgggtttgtcttttggtaatgaagcatcgaccaaaaaccgcaataatttgtctaatccaaaattggcggcgaaacaaggcttattaaaaatgaaagctttggctgacatggggatgaaacaaggtgtacttgctccgcatgagcgtccacatgtcccgatgttacgccgtttaggttttaccggagatgacattagtgttgtggctcaagcaatgcgttattccccagagctactgtcatctttaagctcagcttctccaatgtggactgcaaatgctgcgacagtttcaccttcggctgatagccaagatgagcgcgtgcattttactgcggctaacctgaacaataaatttcaccgttcaattgaagctgaaactacaagccaagttttacaagcgatctttaaaaatgaacgtcattttgtacaccatgaagctttaccgcaagtggctttgttcggtgatgaaggagcagcaaatcacaatcgtttaggtggtgattatgctaaacgtggtattcaggtgtttgtttatggtcaacaacatttaaataatggcttaccgggaccaaaacgttatccggctcgtcaaacgcgtgaggcaagtgaagcaattgcacgtttgcaccgtttagatgatgcacatactgtttttgttcagcaaaatccggatgtaattgatcagggcgttttccataacgatgtgatcgcggtaagtaaccagcaggttttattccatcatcaacatgcctttttaaatcaagatcaggcctttgctgaaattcgtcaaaaaatggcaagcatcggtgaagactttatttcaattgaagtgcctgaaaaccgtgtgactgtggacgatgctgttgcaacatatttatttaatagtcagattttgactcgtccagatggcggaatgaccattgttgtgcctgaagagtctcgccaaaatgctgcagtgtggagctatttgaatgacatgattcaaatgggtacaccaattgatgcaattcaggtttatgacttgcgtgaaagtatgcgtaacggtggtggtccggcttgtttacgtttacgtgtagcattaaatgaaaccgaattaaatgccgtaaatcccaaagttctcatgaatgatcaattgtttatgacacttaatcagtgggtagataaacactatcgtgatcgtttagcacaagaagatttggcagatccgcatttactcatggaaagccgtatggcacttgatgaactgactaaaattttaggtttaggttcggtttatcctttccaaaaataa

SEQ ID NO: 2151 - DNA, 510 bp, Acinetobacter baumannii
ctgaaaagcttatataaaaacatacatacaatctttggggaaaaggctatgaatgcacaaaaaggttttacattaatcgaacttatgatcgtggttgccattattggtattttggctgcgattgcgattcctgcttatcaaaattatgtagctcgttctcaggctacagctggatattctgaaattagtaacatgcgtacgggttacgacaccgaattaaatgatggtacagcgattacctctctttctcaagttggctttactgcgacttcatctggcgcatgttcagccataggtgttacaaattttggtaacgatggcgcagctactaacgctattacgtgtactttaaaaggaaatccaaaaatcgctggaaagattatttcactttcacgttcagcgaccggtgcatggacttgtagtacagatattgccactactgacgaattcttaccaaaaggatgtacaggtggtggaacaccagccgttggtgcaattactactttgtaa

SEQ ID NO: 2152 - DNA, 504 bp, Acinetobacter baumannii
aaaattttagttttatttggggttctggggatgaggggaattattccgcaagaagggttcaccttggtcgagctaatggtgacgattgcggtcatggctattattgcactgatggctgcaccatcaatgtcaaatttattagaaagtaaacgtttagatgctaatcaaagagacttaatcaacactttatcagaagcgaaaagtcaggcaattttaggacgtcagaatgtttctgttaacttgaactcaacagcttcaaatacacccacttcattaaattggcagacagcttctaataatactcttgagctaaaaaatatagccgctgatggtacgcaaagttctttaacgactaccactttagcttttaacgcaaatggagtagtggcaaatataactcaagatacgcttttatctatttgtaattctagaataaataaaaagaaagtcattattttgaccaagcttggcactttaatttttaaggccgaggagacttgttaa

SEQ ID NO: 2153 - DNA, 906 bp, Acinetobacter baumannii
aaatatttagtttttcgagtagggctgctgaagccgatccaacgccttgtaactgatggactgaagtcatgtcccctcaacgagttctctatgcatatattatttatcggttatggtaaaacatctcagcgtgttgctaaacaactatttgagaaaggacatcaaattaccacaattagccgtagtgaaaagacagatccttatgggacacatctcgtacaggatatttttacgctcgatttaagcgaaattgcacctgtagatgtagtgtatattttactttctccagacgatagtactgttgaaggttatcagcatacttatgtggatagtattgagcctattcgtcaggctttaaaatcgcatccggttaaaagattaattgtggtgtcatctacgcgggtatatggtgaaaattctggtgaaacaattgatgaccatagtgagattcacccaaacgatgcccaagggcatatcttgcacaatatggaattgctatggcaaaagtattttccgtcacagtgcgtgattgtgcgtcctacagggatttatggggcttctattgatcgtctaaaacgaatggctgagcacacgcaaacctatccaaatattcactatagtaaccgtattcatattgatgatttagcaaggtttttggtatttttagctgattttgaaaaaccccataaaagctatcttgttgctaataatgcacctgtacctttgcatgaagtcttactgtggtttcaaagtcagttagatttaccgctacttaccttagattcagctcatgtttcaggcaaaaaaatttatgcgaaacatttgtttgagacgggttttcaacttgagcatccaatttgctttaatgactatttattatgtttaaatgctcatggtacaaattaa

SEQ ID NO: 2154 - DNA, 426 bp, Acinetobacter baumannii
gctatgtcagttaaatatcaaggatcatgtttatgtggagctgtgagctatcaaagcgatgcagagccacgttatagttttaattgccattgtcgagattgccaaaaggcaacaggttcggcctatgcaccaatcgctttttttcatcaatctgaattgaaaataagtggcgaactaaaatattttgagacattaggttcttctggtcgtcccattaaaagagccttttgcccgacttgtggttctcaactttttggcttacctgaacttgttcctgaaatgatttcaatacgcgcaggcactttggatgatccaagtctctatcatcctaaagcggaggtttttgtgagtcagacctatgcgtgggacatgttgaacccaaaccttaaacactttgaaaaaatgatagagaagagcaagaaataa

SEQ ID NO: 2155 - DNA, 669 bp, Acinetobacter baumannii
agcgctggcttcctaaagctcctcgatacgcatatgtttaagtttttaaacccacagtatctttttcagttgctgtccccttgcctactttgcgaaataggaacacgggaaaaatactctctttgtaaagaatgctgggaacagctaccgtggcttaagcaaaccattcagcgcaatgatcagtctgttcttgtggcctgtcactacgcctatccaattaaccggatcattcagcagtttaaatatgaacaaaaattacattaccaaaccttacttgctgaagttttacagcaattaaaatttcctaaggtacaagcgattgtacccatgcctatttctaaacaacgtttaactgaacgtggttttaatcaatccttattactcgccaatcttttgagtaagcaattaaaaataccagtttggcagcctgtacaacgcttaaatgagcattctcaaaagggattatctcgactcgaaagatttgaaaatattgaacagcaatttgttgcgctcactcaagaaaaacggcgttatcgtcgtgtactgattattgatgatgtaatcacaacaggaagttcaattcacgctttaagtcaggcgctaaaacagctagggtgtacatctattcatgccagttgcctagctgctgcttcatctacatcatattaa

SEQ ID NO: 2156 - DNA, 1290 bp, Acinetobacter baumannii
cgctgcccagtatgttattataccgccaccaaatttggcctttgtagcggagccgtaatgagccaacatctttcactacctaaagataaaatccgtttccttttgttagaaggcgttcaccaaaacgcagtcgatactttaaacgctgcgggttataccaacattgactatcgcaaaactgctcttgaaggcgaagcgcttaaagaagcaattaaagatgctcactttattggtattcgttcgcgtacccaattgactgaagaagttttcgaagctgcaaataaattgatcgcagtaggttgtttctgtatcggaacaaaccaagtagatcttaaagcagcgatggcacgtggtattcctgtatttaacgcaccgtattcaaatacgcgttcggttgcagagctcgtacttgctgaaactattcttcttcttcgccgtgttcctgaaaagtcagcggcttgtcatcgtggtggttgggacaaatctgctgtgggttcttttgaaactcgtggcaaaactttaggtattgtgggttacggttccatcggttctcaactttcagttcttgctgaaagtatgggtatgcatgtcatttattatgatgcagtcactaaattaccaatgggtaatgctcgccaagttggttctttagatgaacttttagcaactgctgatgttgtgactttgcatgtaccggatgttccgtctacacgtaacttcttcactaaagaacaatttgcaaaaatgaaagaaggcgcgatcttcttaaatgctgcacgtggtacatgtgtagtaatcgaagatttagctgatgcaatcaaatctggtcaccttgcaggtgcggcagttgacgtattcccgaaagaaccaaaagcaaatggtgaagaattccagtctccacttcgtggtttagacaacgtgatcttgactcctcacgttggtggttcaacaatggaagctcaagcaaatatcggtttagaagtagcagagaaatttgttgcttactctgataagggtatgacactttctgcggtaaacttcccagaaatcgcgttgccattgacagcgggtcaacaccgtttactacacatccacaaaaacgtaccgggtgtattgtctaaaatcaacaacttgtttgctgaacaaggcatcaacatttctggtcagtcacttatgactaaaggcgacatcggttaccttgtaatggacgtagatgcttctgcttctcaagaagctttagatatgttgcatgaagttgaaggcacaattcgcgtacgcgtattgttctaa

SEQ ID NO: 2157 - DNA, 435 bp, Acinetobacter baumannii
ggtttggcagtgaagaatggtttttctttaattgaaattatggtcgtggtagcaatagttgcaattttagcggctatagccaccccttcatatttacaatatttgcgtaaaggacatcgtactgctgttcaatccgaaatgatgaatattgcgcagactttagagtctcaaaaaatagtaaataaccgttatccttcggatgcaactatacaatcaatttatggttctaatgtgagtcctatacaaggtcaggctctatataagttagcttttgcaactctaaatgattcaacttgggtacttactgcaatacctatttctactagctcacaagcaggtgatggaattatttgtttaaatgaccaagggcaaaaattttgggcaaagggtgccacagtttgtgcactatctgcttcatcgagttggaccgagtaa

SEQ ID NO: 2158 - DNA, 333 bp, Acinetobacter baumannii
atgacaaaagttgctggtctagaccaattatctgtaattaatcaaaaagtagttggagagggcgaagtcttacctcaagttgtgcttaaagatggaagtcaggtgcaaacgggaactgtcgcgacgatgctgcataatattgaactctataatgcggggcaaagagggcaaattgaagaagagttgaagatcgcaattccaactttagttaaagtgggcttatttgatttgtttgaagtagatgaatggattaagggaacaaatgcaggccgtacatttgttggaatgcacgctaaggcttatttacaacaaaaagaacaagagaataattaa

SEQ ID NO: 2159 - DNA, 711 bp, Acinetobacter baumannii
tttttaagagtaatgttcatgtataaaacattgaccacttgcctactagtaacttgtcttggcttaagtggatgtgcaacttctattttatcgactgccctgccgaatgagacgactgaggtccaaacaactattttaaaaacagatcaaattattgcacttgggcaagccgttaaaaaccagcaagaacaaggcgtcgtatttataggtcaagactttaattatttaatgaccgaaggaagttcggaatttttaaatatcattaaaaatattcctgtaaatcaaagaactttaattattccatctcctctgctacttgaaatggatgatcctacgcattttcatggcgaactcaagtttcaatacaatattcccacttcaaaactctctgatcaacagaaagaaaatttaaaaaatttaggatttaaaaatcattttatggttatggagaaccaaacacagcttttatatccctacgctattattcgttttaaaggccaaatttatcaaaccagtcctactttaaaagttcaacaaacgattccaactccatatccaatcgccttacaacaaaaagatgaaataaccaagaaacatccgtttaaacgtgtaacgcgtatggcgctttatcctttagcgatggcatttgatatagtgacggtagctccttctctcatcttgtcagatttacgaggtgactttactaaataa

SEQ ID NO: 2160 - DNA, 2589 bp, Acinetobacter baumannii
gaagtaggagttcttatgtccaagagtgggtttggtcaaatgtatcgtcggctttcgagtaaactacttgacctcgtggtaacaccacatgttcttggggaggttcctactgaaccagtatcagcaacaacagaaacagaagcgaagaccgagcgccaaaaagtagtgtgctatgtcttgcaaaaccattctcgcagtaatgctttagtggtggatggagaaactcgtcgcttaaatttaaagccagcgctagatccattagtcatcggtactcatcaggaaaaagcttcagttttatttttacagcacaatgatgaaaataatctactaaatccccctcctcatgcttttccgccacgtttaattaaactgatcgaagttttacaagcaaatcctgaactcgatatagaactggttccggtaaccgttttatggggtcgttctccagataaagaagactcttggtttaagttgttattctcagatacatgggcaacaccaagtacagttaaacagcttgtgaatattggtttgcatggtcgccaatcttatttggaattccatgaaccacagtctttacgtgacctcgttgaatatgctcagaagcattatccgaacctttcgccagcgacttatattgttagcactttaaatgactaccttgatcgccaacgtgaagttgtcttaggccctgacttatcagaccgccgcaatgtcatgcagtcggtattaaagtctcgtgatgttcaagaagccattcgacgcgaaagtattcgcggtaaaatcagcatgcttgaagcagagcgtcgtgcgattggttatgtgaatgaaatcgtatctgattattctcactcagcagtacgttttgcagatttggcgttaacacgtctatggactcagctttatgacggcgtagaagttcataacttcagtactgtccgagagcttgcaaaagactatgaaattgtttacacaccatgtcaccgtagccacattgactacttactactgtcttatgtgatttataaacgtggcttgatggttccgtatattgctgcaggcgacaacctaaacttacctttcgttggtcagcttttacgtggtggcggtgccttctttattcgccgctctttccgtggcaatggtctttatacttctgtatttaaagaatatttatatagtattctttctcgaaacacaccacttgaatactttattgaaggtggacgctcgcgtacaggccgcttattaccaccgaaaaccggcatgctcgcaatgacagtccatagtcatttacgtggccgtgccaagccgattgtatttgtgccaacttacattggttatgagcgccttatggaaggttccacctatgtaggcgaaatgcaaggtaagccaaaagaagccgagtctatttttggtattttaaaaacactccgaaaaattgaacgtattttcggtaaagtacacgttaactttggtgaacctgtttttctagatgacttgcttaaacagcataatgctgagaacgtttatattgaaaagaacgatgacccagtgccacctgctgtttcagaagcagtaaacagttctgcaaatgcgattttagaaaatattaaccgtgcggtagtgattaacccagtttctttactttcaattatcttgcttgcaacaccaaagcatacgcttgatgaagaaatctgtattaagcagcttgaagcttaccgcaatttagcatcaaatttcccttacgatcagcgtacagaagtgacgccgctctctggtaaggaaattattgcttatggcttaaagcttaaattgattaagcgtgtacagcatgcccttggtgacattattgcgattgaagataaccaagcagttctcctcacctatttccgtaataacattttgcatgcattcgttttaccttcattgattgcatctcttgttgaacataacgggaaaattagccttgctgatttaagcaatgtcatctatacgctttatccattcttaaaagccgaactattccttaaatggaaaagtagcgaacttaaagaacagattgagcaatatgcagatgcattggttcaatcaaatcttattcaacaagatgacgaaggcaatttaattagctctgcaccgaatactgaagagcataatcagcttgttgtattagcaacacctgttaaacaaagccttgaacgttattacatgactttagctttaatcactcagcgtggttcaggcaatatttcagcaaaacaagttgaagaattaagtcatttattaggacaacgtttatcagttctttatgaatttaactctcctgaattctttgacaaagcattgttccaaagttttatcaaagttttaactcaacaaaactacattcgaacgaatgaccaaggccaaattgagtttgatgataatttccgtcagatggcagcaggcgcacagttggtgcttgatgaagtaacattacaaatgttgcaacacatcacaacctttaccgatgaagagttaaaagaagctcttgaagcaatggcttctcagcaagctaaacgccgtttaaaacgtaaaaaagcttaa

SEQ ID NO: 2161 - DNA, 2328 bp, Acinetobacter baumannii
agcgataaggttttaaaaaaggttatgcatttaaaatatctcagtttatgtttatttagtttgggcttgacggcatgtgcacaacacggcgtgcgtccacaggtggcatctgcgagtttagagcaaaaagccattcaaagtgttaatgcgatgtatgaatacccaagttatgattatcgcggaaactttaaaattaccgttgatccttcacaaataaagcaaaatgtaaaagctgagaatactgctaagctagatgctgaattacaaaagaaagttgatcaatatttacgtgaacaaaaagttgccttaagtaaagcacagaaacaaaccttatatgcggcgattgcaaacgaacaaggtgatttgggactgacttcctcagcacgttctgaaaaaattaataccgtattatttaatttgttaaatgatcttcagtttagttatgacggctcgatacattatcgtcaaaaaatgggttcatttaatttaactgctagatatgaaaaaccgacacttttagttcaggcaaaattgccaatggtgcttgatcttgagaattataagttttacataaattattttggtttgatgccatatttggtcaataaagataatcaaaataatttagcttatgttgatttctcaaaatataaagccttttttaaaaatgtcgatcagaagaagtttattgaataccttaaagcttcaagtgctgtttcataccgattagctgaaccgcaaaacctacaacgtgtatcgttgactgaggctgatcgtaaagcaggggcggttgaaagaattcgtttaaagacgacggttgagcaactacttttagaagtagatttgtttgggcaagttaatgaaaaatatcttcaaaaaagtgttttaggtcttgatgaggaaaaacttgctgaaacgcttgccgcagagattgctgcttctgatgcgaaaaaaggcactgcaggtaaagaagaacaaaaggtttcttctgatgacgccgctgctgttagccaacagttgtactcccttgttaatgctcatttaggcaatacctctacttctgaagatgaggaagtagagtctgcttctagtgaagaggcgagtgatgtagctgtagcagagactgaacaaacctcagaaaatgaagaagtagttgcactgacggaagatcaatgtattgaattaaaatcgcttaaaaaaccggtcgctttaggggatattaattattgccaaatctacggtattgatgtcctagatcagagcgatacaagtattcaaaaagcgcaaatcaagtctcgtcaggacgctttaaagcaaacttttgaagcttataaccaaaaccagtttattaatgatgaagcattcaaagctctttggttaaaacataaggatgaaattgaacaagctttaccgaagcaaagaaacccaatcacaattgatgtggctttagatgacaaaggccgtgcagtcaagatggattacgatgttgattatacgccagctgagtttaagcaccgcttcaatattaaagcagatatgcaaattctgaattatgggaaagcgacttcaattgatcagcagcagcttaaacaagctaaatctgtggctgaagcaagtaaaggttctatgctggaaaactttattaaaggttttagtgaaaagcttgggcaaagtgatgtttcagaacaccctgtgggcacacatagtgatgtacaagatttagatgcaaatctggctgtacttgcagataaaacctatgatgcaacgcatgcttatgacaaaacttataaagcagtatttattgccaaattgactgccgaaaaaccgtcatatattaagtattattcagttcaacagctacaagaaattgctgaggtttatgcttactggttctctgatgaagatacatataatcctcaaggaaaagccttagagcgtattaccgctttacagaaacaacatcatcttgaacaagatgatcagtttgaccacgagttaggacgtgctgtagatcatattgtattaacgactatacaaggtaaaacagggcgtgaagcttggcagaggctacagaagcaatataaacagccggcccaacttttctcaaaacagtatcagttagagtttgaaaaacaaaatggtgtttctgctgaagaaaagcatctgttatcagaaacggctgatattttagggaatgtttatgtggctgctcgtaaaaaacagctttcggaaaaaacaattcagaacttaaaacctgaacataatgaatttatcgattatgaaattttccgagaagtttataagcaaatggttgccgctaaaaaataa

SEQ ID NO: 2162 - DNA, 426 bp, Acinetobacter baumannii
attgttttattaaacttgagaggtataaaaatgaatagttctatcgaccaagatccaaatcgtactttaacacttattttatatgtactttatattgttgccatttttacaggcggcttacttgcgataattgctttaattattaactatgtaaaacgctctgatgtgcaaggttcaatttttgcgagccactttacatggcaaatcagaacattctggtggtacttggcttggaatattattgcctttttgccgtttattttcttgttctttacgggtgaaaataccgatttatttgcgggtgttgctatctcatcgactgtgttctgtgtgggtgtaattggtgctgcgtggatctggattgtatatcgtgcaattcgtggattgattgcgctaaatgataaccgtccgatgtatcaaccttaa

SEQ ID NO: 2163 - DNA, 672 bp, Acinetobacter baumannii
atagccctattcatttgtacgctgttaaatatgtctgaagcctctgcccttcttgataaaacttctattcagcagctccctccttttgaaaatcttaaccatcaaaatattgtggtgattgaaaatggcgagcaatgcaaaactattgaagaagaattaaaagcagcgacctttttaggatttgattctgaatctaaacctacttttcaggtaggcgaagtatcaactggcccacatttgattcagctggctacagaacacaaagcctatttatttcatgtcaatttatcgactttaaaatttttacagcccattttgtctaatccaaaacaaattaaagtcgggtttgggcttaaaaatgataagcatatttttcacaaaaaaggcatagagcttgaaagctgcgttgaccttgctaaaggttttagccactttggttttaaacaacaaatgggtgtacaaaaagccgtagcactattacttggtcagtatcttgccaagtcgaagaaagtcggaacttcaaattgggcgcgaaaaccgcttacttcacaacaaatcagttatgcagctgctgacgcctatgctgccctattggtatttctcgagcttaaaaaaagaaaagtattaccgatacatatttctgaaaaaattcaaaccgcacttcaaaggtaa

SEQ ID NO: 2164 - DNA, 210 bp, Acinetobacter baumannii
aactattcatttttatacctctcaagtttaataaaacaatttacttttatgatccccgcaaaacgtttaaaggagaaattagccacaaaatcaaaagtaaatgaaagaatatggtacaaaaataaatcttacgaaatggttgtttttgtgttttatgtctcagtttttgttgtgcccaccacgcagctggccatccccctaagaaactga

SEQ ID NO: 2165 - DNA, 261 bp, Acinetobacter baumannii
agggcgacattctacgtgattttcaccctgaaagaaagattaaattttgagttatccgcagttttgaatttaaattactcggtccaactcgatgaagcagatagtgcacaaactgtggcaccctttgcccaaaatttttgcccttggtcatttaaacaaataattccatcacctgcttgtgagctagtagaaataggtattgcagtaagtacccaagttgaatcatttagagttgcaaaagctaacttatatagagcctga

SEQ ID NO: 2166 - DNA, 246 bp, Acinetobacter baumannii
ttttataaatttaaagtgaaacttaatatgagacatgaattaagagaaatttttattaagggatgcgacgagaaaattgaaaagaagggagacaatgtcggtctgtctttttatgctttttttaaaaataagaacgataaccctgagttactgatggaagcagcgcattggtggattatggtgcataagctagatcacttcgagaaggctgttaagattaaagaattggttttgagtgaaagctaa

SEQ ID NO: 2167 - DNA, 258 bp, Acinetobacter baumannii
aacagaaaattcactgagcttatccggcgcttccgtatgcatacttccaatggctttaatttgtcgtttcggcactcaagaaacgagagccatttttgtaataaaagagagagccaattgcaaaatttatacgcaaaattggccctttctgtagaagatgctggtaaatggctctttgtttttattttaatcagattgaatttctttagttttgttcagagattaacaacgcttttgtgcctgtttccaaagctctaa

SEQ ID NO: 2168 - DNA, 951 bp, Acinetobacter baumannii
atgatgaaattgctatcttttttgaagaataaggctttaggttcttctattgattataaaattcttccacgcaaggtaaaatttgactggaaagatacccctgtagactggattccaaaccaaccgtttgcaagttattttattaatgaaattaacaatatcttgcctgctggagagttctggttttgccggctctataacaaggttttacctcgtattactgatgaaaaacttaaacaggatgtacaagcatttattcgccaagaagcaatgcatgcaaacgcacacacttctgccaataaagaatatttaagtgcacgcaatattgatatccagagaaatctggacattatgaattatctatttaccactgctttggcagataagccttttgacaaagaagttccgcaattcctgcaagagcaatgggatttatttcgtttaggtgttatcgcgacagttgagcacatgacatgtgttctaggtaaatatgcgctttataacaaacgctgggaagagttaggcgcagatccagaaatggtagacttggtaaaatggcatggttcagaagaaattgaacaccgcacggttgctttcgatttatatcgccatttaggaggcggttatattccacgctattatttaagtcttgcagtaattgtgcttgtgttagggctatgggtagacggcgctgcacatattatgaagcaagatccacgttttgctgatgctgccaaatctagatttttcccagcttgggttgctctagaatggtataaaattagccgaaaagataatcaagttttaccaaacccaatctggcttattgctcagcaaattgactacctcatgccgtggtatgatccagttaaagaaggtagcactgaagatgcggtaagttatttatcgcagtcgccagcagccaaaagagctgaattacaagcagcttaa

SEQ ID NO: 2169 - DNA, 213 bp, Acinetobacter baumannii
gcgcggatttccttgttgcccgcacctgcctatgtctttgcagtcgtggaattattgtgggtcagcttgtgtagttttcaaaagcgattgcaagttagcagcttttggttttacaagccagaatttacggctgtagaagtcaaactcgttgcggattttgtaagcccaagcactacctgtttccttgatatgctcgtcaataatacgcaataa

SEQ ID NO: 2170 - DNA, 1419 bp, Acinetobacter baumannii
aacatgtcttctatttttttaaatcgggtgagccatcccgacttattgagctgtaacgttaagataacgttgaaaaaggttgtaactatctcaagcctgtctattgtcatgttattggcgggacaaatggcaaatgctgcgactgattttcaacagggctcttatacccaaaaagcagcttttagttttgaacaggcattagcgcgagcacaaagctatcaaattcaacaaggtgtttggcaggcacagcagcaaatggctgaggcgcaattaaaacaaagtcgcttatgggcaaatccaagtctttctattgagcaaacaggtttgcagagtgaccaagaaaaagaactcgcgattggcatctctcaacctctagatatttttgggcagcgtaaggccgcacagcatttagctaaagtagaaatgtcaaaggttgacttggccgaacaacgttataaggctgagcttgagttaatagttaaatatttctggtcacaagtggccttgcttgaacttgaaaagtctctcattggagaacagttagcagttagccaagagaacttgtctgcatcggaaaagcgttatcaggcagggagtattgctcaggttgatgtagatcgagtacgtatgtctcacttggaaaaccagcgtttatatcagcaggtcgatttgaaactacaagttgctaaacaacaactggccaacttatggggcggtgattcaaatcagttccaactatctcaaagctctaatcagctgtgggtattggcagcggatgtagagtctggtcaagatcggcaaaacaatttgctagagcgctcttttcaactagatgctcttgcgcagcaagccactattcaacagcttaaggcaaaagcaaggccacaacctacggtaactttgggggtgaataacactcgttctccagagcagcgtacggaaaatcaaatccgtttaggggtggaaattcctttaaatcttttcaatcgtcaacaatacggaatcaagattgctcaggccaagcaagagctgtctcaacgccaacagagcttttatcgacagcagaatcaagcggatattgaaactctgatgtcagagttaaaaggcttacatattcagttcaagcaattaaatgatcagcaagttcctcttgccgttcaggttcaacaaaaaacattgcaaggtttccgtttgggtaagtttgccgttaccgatgtgcagcaagccacaatgcagttgcaagatgtgcgcttacgtaaagtcgagctattaaaacaggcttggcaaaattcaattgaaattcaaagtttacgtctagggctagagccagaacagatcatggcgaaagatgccttaatgcaacttaatcaacgtgcttggcaacaagctcaaacttttccaactcaggcaggagaataa

SEQ ID NO: 2171 - DNA, 1494 bp, Acinetobacter baumannii
ctcacggaatttaccagtgagattgttatgctgaccatcgttcaagaagcgctaaccttcgatgatgtcttattacttcctgcctactctactgttctcccaaaagatgtctctctaaagacacgtttaactcgcggcatttatttaaatatcccattagtttcagctgcaatggatacagtgactgagtcacgtatggcgattgcaatggcccaaaatggtggtatcgggattttgcacaaaaacatggatattgctgctcaagctgcagaagtacgccgtgtgaaaaaattcgaagcgggtatggtgaaagaccctatcactgtaagccctgaaactacagtacgtgaactgattgcaattacctctgctaataacattagtggtgtacctgttgttaaagacggcaaggttgttggtattgtgacaggccgtgatacgcgttttgaaaccaatttagaacaacctgttagcaacatcatgacaggccaagatcgtttagtcactgtacgtgaaggcgagtctaaagaaaatattcaagcattattgcaaaaacaccgtattgaaaaagtcttggtcgttggcgagagcaacgaacttaaaggcttaattacagtgactgacttccgcaaagctgagagttatccaaacagttgtaaagatgatcttggtcgtttacgtgttggtgctgcggtaggtacaggtgctgatacaccaagtcgtgtggaagcattggttgaagctggtgttgacgtcattgttgttgatacagcacatggccactctgctggtgtaattgaacgtgtacgttgggtgaaacaaaacttccctcaagtacaagtgattggtggcaacattgcaactggtgatgctgcattagcattattagatgcaggtgcagatgctgtaaaagtgggtattggtcctggttctatctgtacaacacgtattgtggctggtatcggtatgccacaaatttctgcaattgacagcgttgctagcgcactaaaagatcaaattcctttaattgcagatggcggtatccgcttctctggcgatatggcaaaagcgatcggtgcgggtgcaagtacgatcatggttggttcattacttgcaggtactgaagaagcgccgggcgaagttgagtttttccaaggtcgttactacaaagcatatcgtggtatgggttcattaggtgcaatggcgggagcaactggttctgctgaccgttatttccaagattcaaaagcgggtgctgagaagttagtaccagaaggaatcgaaggccgtgttccatataaaggcccaatgggtaacatcgttcatcaaatgatgggtggtttacgttcatcgatgggttatacaggttcagctgtgattgaagatcttcgccaaaatgcgaaatttgtgaaaattacttcagcaggcatgtctgagtcacatgttcatgatgtaacgattactaaagaagctccgaactatcgtgttggttag

SEQ ID NO: 2172 - DNA, 255 bp, Acinetobacter baumannii
atggccaattctggtttatatcgctcgaaccgacaaagcatgatcgccggtgtaatgggcggtattgctgaacgatttggttggaatgcaaatttattacgcattattttcgtgttagtttcgataatgagcgcggcttttccagggattttagtgtacttagttttatggttggttattcctaaaaaacagccagaacaagtgcaaggttatcaacaacctgttcgcactgtacgagaagaacaaatacattaa

SEQ ID NO: 2173 - DNA, 540 bp, Acinetobacter baumannii
ttcctcatgtctcgtgtggctaaagccccagtaactgtaccaaatggtgtaacagttactcagaacggccggcaggtcgaagtgaaaggcagcaaaggtacattgtctttcaacctgcatgcgctggtcgagctaaaacaggaagaaggtaaacttcaacttgctccagctaaagaatcgaaagatgcttggatgcaagctggtactgctcgcgctgtattgaacaaccttgttaaaggtgttagcgaaggcttcgaacgtaagttgcagctagttggtgttggttataaagctgcggttaaaggtacagttgtaaaccttaaccttggttactcacacccaattgactacgctttacctgaaggtgtaacagcggaaactccaactgctactgaaatcattttgaaatcagcaaacaagcagttgttaggtcaagtagcggcagaaatccgtgcataccgttctcctgaaccttataaaggtaaaggtgttcgttattcggatgaagtcattcttcgtaaagaagctaagaagaaataa

SEQ ID NO: 2174 - DNA, 1383 bp, Acinetobacter baumannii
tctcgagtgtctatgtctcctagttcttcaggtcatgtcaacatgatgaaaggtcagccatttcacgtgaaatatcgtgaaattattcgccggatgagttttctaatcggtgcattgctggtctttcgactaggagcgcatattccagtaccaggcattaataatgctgcgttagaaaatttatttcatgcaaaccaaggaactattcttgggctattcaatatgttttctggcggtgctttagagcgaatgtcgattcttgctttaggaatcatgccttatatttctgcatcaattattgtgcagttaatgtctacagtgattccttctctcgaagccttgaaaaaggaaggggagcaaggtaaacgtaaaattaatcaatatacgcgtcagggtacattattacttgcagtggttcaggcagtaggtatgtgtgcaggtcttattggacagggtattactctatctagtggtcttgctttttatatacctgcagttacatcacttgtcgcaggaactatgttcttaatgtggctaggtgaacagatcactgaaagaggtatcggtaatggtatctcaatgattatttttgcaggtattgttgctggtttgcctaaattaattatgcaatcagtatcatctgtcgataatggtcaaacaagtttaattggtcttgttatctttggtcttttgtctcttggtgtattggcagcgattgtgtttattgaaaaagcacagcgtcgtattccagtaaactatgcccagaagcagcaagggcgtcgtatatttacagctcagcaaacacatctaccgttgaaaattaatatggctggtgtgattcctgcgatttttgcgagttctttactcttgttcccagctagtttgggacaatgggtaggaagtgcagatccgaatgctggtttaattaaacgtagtttacaagatttagctttagtattgtcgcctggacagcctttgtatttggtgctctttggtgcgttaattatctttttctgttacttttatacggctttagtatttagccctaaggaagtatcagaaaatctaaaacgcagcggagcttatgtgcctggtattcgcccaggtgagcaaactgctcgttacttagatcatattcttaatcgtttgacgtttattggtgcgatttatattacagtcatttgtttgatgccaatgattctacaaagttcttttggtattccattctatttgggtggtacctcattactcattgtagtcgttgttgttatggactttatggctcagctacaagcgcatttaacttctcatcaatatgacaatcaaacattaatgagaaaaacgactgctcagtattcggcgacggggctggaagtaccgcgt

SEQ ID NO: 2175 - DNA, 549 bp, Acinetobacter baumannii
gttgaaaaggcaatggccagacttaaagcacgttacaacgacgaacttaaagcgaagttcaagaaagaacttagcattaagaatgtgatggaaattcctcgcatcacaaaaatcactcttaacatgggtgtaggcgcagcagctactgataagaaattattagacggcgctgtagctgacatgcaattaattgctggtcaaaaaccagtagttactcttgcacgtaaatctatcgctggtttcaaaatccgtgatggttggccaattggttgtaaagttactttacgtggcgaccaaatgtacgaattcttggaccgtttgatctctattgcaatccctcgtatccgtgacttccgtggtttctcagcgaaatctttcgacggtcgtggtaactactcaatgggtttgaaagagcaaatcgttttccctgaaatcgatttcgacaagattgatcgtattcgtggtatggatattactattactacgactgctcgcaccgatgacgaaggccgtgcgcttatgcgtgcattcggcttcccgttcaaataa

SEQ ID NO: 2176 - DNA, 444 bp, Acinetobacter baumannii
gccatgactctgcgtttaaatgagcttgcacctgcagaaggtgcaaaacgtgaacaccgtcgtttaggccgtggtatcggttctggcgtcggtaagactggtggtcgtggtatcaaaggtcaaaaatcacgtaaaagtggtggcgttcgtccaggtttcgaaggcggtcaaacagcgatttatcgtcgtttacctaaattcggtttcactagccaaatcgctttaaaaactgctgaagtacgtttgtctgagttaagtaaagtggaaggcgacatcgttagccttgaaactttaaaagctgcgaatgttgttcgtcgcgatcaaattcgcgctcgtatcgtgctttctggtgaaatcactcgtgcattcactgttcaaggtgttgcattgactaaaggcgctaaagctgcaattgaagcagctggcggcaaagtcgaggagtaa

SEQ ID NO: 2177 - DNA, 396 bp, Acinetobacter baumannii
atgagtatgcaagataccgttgccgacatgctaacacgtgttcgtaacgcacaaatggctaagaaacaaactgtttctatgccgtcttctaagttgaaagttgctattgcaaatgtacttcaacaagaaagttatatttcaaacgtagaaattgctcaagaagagacaaaatctactttgactattactttaaaatatttcgaatgcaagccagttatcgaaatggttaagcgcgtaagccgtccaggccttcgccaataccgtggtaaagataaacttccaagcgttaagcaaggtttaggtattgcaattgtttctacaagcaaaggcatcatgactgatcgcgctgcacgtgctgcgggcatcggtggtgaagttattgcttttgtttcttaa

SEQ ID NO: 2178 - DNA, 183 bp, Acinetobacter baumannii
tcaatcatgaaaacgattaaagttacccagactaaatcttcttcacatcgcttgaaaaatcacaagctttgcttacaaggtttaggtctgcgtcgtattggtcatactgtagaagtgcaagatacgccttctaaccgtggtatgatcaacaaagtctactatatggttagtgtagaggaataa

SEQ ID NO: 2179 - DNA, 375 bp, Acinetobacter baumannii
gaagaaataaggcgcgaggttcttatgaacgaaaagaaacaatcccgtttgcgtcgtgcgaaaagcacacgcttgcacatccgtgcattgggtgcgactcgtttgtgtgtaaaccgcactccgcgtcacatctatgctcaagttatttcagcagatggtggcaaagttttagcgcaagcttcaactttagatgcatctttacgtagtggtactactggtaatattgaagctgcgacgaaagttggtgctttaatcgcagaacgtgctaaagcagctggcgttactaaagttgcatttgaccgttctggttttaaatatcatggtcgtatcaaagccttggctgatgctgctcgtgaaggcggcttggagttctaa

SEQ ID NO: 2180 - DNA, 519 bp, Acinetobacter baumannii
aggcggcttggagttctaatcatggcaaaagttgaacaaaacgaaggtctcgttgaaaagctggttgccgttgatcgtgtagccaaggttgttaagggtggtcgtatcttctctttcacagcattaactgttgtgggcgatggtaatggtcgcgtaggttttggtcgtggtaaagctcgtgaagttccagctgctatttctaaagcacttgaagctgcacgtcgtaacatgatcactgtagaccttgctggtactactttacaacaccctgtgaatgctcgtcatggtgcaagccgtgtatacatgcaacctgcttcagaaggtactggcgtaatcgctggtggtgcaatgcgtgccgttcttgaagctgcaggtgtacataacgtacttgctaaatgttatggttctactaacgctgctaacgtagtaaacgcaacttttaaaggtttgcgtgatatgacttctcctgagaaagtcgctgcgaaacgtggtaaatcagtagaagaaattcaagggtaa

SEQ ID NO: 2181 - DNA, 315 bp, Acinetobacter baumannii
gaggtcgatatggctaagaaaggtatgattaatcgcgaattgaaacgcgaaaaaactgttgctaaatacgctgcaaaacgtgctgaattaaaagctactattgcaaatgtaaatgcgagcgacgaagaacgtttcgaagcgatgttaaagttacaagcattgccacgtaatgcatctccggtacgtcttcgtaaccgttgtggtttaactggtcgtcctcatggttacttccgtaagttcggtttaagccgtaacaaattacgtgacacagtaatgcaaggtgatgtaccaagcgttgttaaggcaagctggtaa

SEQ ID NO: 2182 - DNA, 651 bp, Acinetobacter baumannii
gtagtaatgtcgagtatcaattacgatgaattaatgcagcctgtattagcatttttaggatgtcaaaccccaaaagaatggttggatgaggctgttaataatttagacatcttgatgcaagatcatgctaactgtgagaaaaaggcagcgggtacagccatgaacttgatgttccgctatagtttttttacggacctacaagttaagcttgcccagcttgtacgtgaagaaatgcttcactatgaacaagttctagaatttatgacaaaacgtgggcaagagtggaaaggtttaagtgctggacgctatgcaggtggcttacgaaaagaaatccgcacatatgaaccagaagctctaattgatgtactcgtgattggggcttttgtagaagcacgttcatgtgaacgcttttatgcgcttgctccgcgtgttgatgatgagttaggacgctactaccgttacttgcttaagtcagaatctcgtcattttgaagactatttagcactagcgcttgacgtcgcaaaaaatgccaaaatgaaagatcctgaagaagatattcaacagcgtattgaacatatccgtgaagttgaaaagaatctgattttgactccagatgatactttccgttttcatagtggtatccctgcataa

SEQ ID NO: 2183 - DNA, 1101 bp, Acinetobacter baumannii
ggggtcaagtcgtcgttttgccgagcaggcagcagcggcggaaattttaaagttattggagcaataacctgcatgtcgatgcattctgatcaaatcaatccagattcaaacgaaaaccaagatccaaacaatctgattgatcaattttttagttccaaaggcgttacaattccttcggattttaagagcggatttgtggcgattgtaggacgtccaaatgtgggtaaatctaccctcatgaaccatttattgggccaaaaactctctattacttcacgtaaacctcaaacaacacgccataaaattattggtattgattcacgtgaaaaaatgcaagcggtttatgtcgataccccaggtatgcataagaaagaagtacgtgcaatcaataaaatgatgaaccgtgctgcgcattctgcgttacgtgacgtgaatttagtcttatttgttattgatgcccagaagtggactcaaaatgacgatttagttcttgagaaactcaagaatgctgatatgccagttattttggtgattaataaagctgatacttttggagataagagagagattctccctttaattcaagaacgtgccaaacttatgaattttgctgagattgttcctgtttctgcactccgtggagcaaacttagagcacttaagtgaaacgattgaaaaatatcttccttatcaaccacctttatattcattcgatcaaattacggaccgttcagagcgcttcttggcaagtgaaatcatccgtgaaaaaatcatgcgtcagttgggtgaagagctaccttatgatttaacagtacaaattgaatctttcaaaacggaagaggcaactgttaatgaaaaaactggtcgtttaaaaccagcatgtacctatattgatgcaactatttttgtggatcgtcctggtcaaaaagcaattgtgattggtgaaaaaggtgccaagcttaaaacaattggcatggatgcacgtaaagacatggaaaaaatgttcgaacaaaagatcatgcttaccttatgggttaaggtcaaaggtggttggtctgatgatgaacgtgctttaaaaagtttaggatatagtgatatctaa

SEQ ID NO: 2184 - DNA, 591 bp, Acinetobacter baumannii
ctttttattccattgatggagatgatgatgaaatcaattaaatatttggcctttcctctacttagtgcagcacttgtcatgacaggttgtgcaagtcgtaagccagcaacaacggcaactacaggtacaactaacccaagcacagtaaatacgacaggcttaagtgaagatgctgcattaaatgctcaaaatctagcaggtgcttcttcaaaaggtgtaactgaggcaaacaaggctgccctagcgaaacgcgtcgttcacttcgattatgacagtagtgatttatctactgaagattaccaaacacttcaagctcatgctcagttcctcatggcaaatgcaaattcaaaagttgcattaactggtcatacagacgagcgcggtacacgcgaatacaacatggccttgggtgagcgtcgtgcaaaagcagttcagaattacctcattaccagtggtgtaaaccctcaacaacttgaagctgtaagttatggtaaagaagcgcctgttaatcctggccatgatgaatcagcttggaaagaaaaccgccgcgttgaaattaactatgaagcggttcctcctctattaaaataa

SEQ ID NO: 2185 - DNA, 681 bp, Acinetobacter baumannii
accacgttgttgatttttaggttctcattatggcgcatattttttgtaatgagcgtaactggtgagttcataaaaagtgaaaaactaattatgtatacatttgactatctcgtttttataggtcgttttcagccatttcatttggcacatatgcaaacgattgaaattgcactgcaacaaagtcgctatgtgattttggctttaggttctgcccaaatggaacgtaatataaaaaatccgtttcttgcaattgaacgagaacaaatgattttatctaatttttcattagatgagcaaaagcgcattcgttttgtacatgtggttgatgtttataatgatgagaagtgggtaaaacaggttaaatcattagtaaatggtgtaatagaaccgaactcgaaagttggtttgattggccacttcaaagatgagtcatcttattatttacgactatttccagaatgggtgatggtcgaacttgatagcttgaaagattcgatttctgccactccaatgcgtgaagcctactatcagggcaaaattaaaacggatgcatttcccaaaggcaccattcaatttttggaagaattccaaaatacaccgttatatttacagctacagcaaaagtttttacaggcagaccattcaaatattgaggaaaccgtgtcgtctcataaagaatga

SEQ ID NO: 2186 - DNA, 1371 bp, Acinetobacter baumannii
ggcggccgtccttctgttgatttccttttaaagcaaggtgtgcagtttaccttagatgaagatgaacagcttcatttgactcgtgaaggtggccattcgcagcgccgtattattcattctgctgatgcaactggcaaagctatttcaaccactttggttgaacgcgccaaagaacgtaaaaacatcactatttttgaaaactatattgcgattgatttaatcacgtcgcataagttaggtcatacagagcaggcaaatcgtgctattggtttgtatgcactagatgaaagtactgaaaaagttcataccttccttgccccatttaccgcacttgcttgcggcggcgcaatgaaagcttacctttatacatctaatccggatattgctactggtgacggtattgcgatggcataccgtgcaggttgccgtgttgccaatatggaatttaaccagttccatccaacctgcctttaccacccgcaagcacgttctttcttaattactgaagccatgcgtggtgaaggtgcttacttacgtttaccagatggcgaacgttttatgctacgttttgacgatcgtgcagagttggctcctcgcgatattgtggcacgtaccattgaccatgaaatcaagcgtctcggtattcgacatgtgtggttagacattacacacaaatcacctgagtttattaaagagcacttccctacactttatgcacgattgcttgagttaggtatcgacatcactaaagacatgattccggtggtgccagctgcacactatacttgtggtggtgttgtggttgactcaaatagccagactgatattgaaggtctatatgcaattggtgaaacctcttatacgggtttgcatggtgcaaaccgtatggcgagtaactcattacttgaatgcttcgtttatggcatgagtgcagcaaaagatatcgaaagtaagtttgataaaaacttcaaattaccggaagtaccaacttgggacgattctcaagtaaccaatccagatgaagatgtcgtgattttacaaaactgggatgagttacgttcgaccatgtggaactacgttggtattgtaagaaccacaaaacgtttagaacgtgctttacaccgtattgagatgttaaagcgcgaaattactgaatattatcaagattatcgtgtcagcaagaacctgattgaactacgtaatcttgtacttgtttctgaaatgattgttcgttgtgctatgcaccgtaaagaatcacgtggcttacattacacacttgattatccggaaacttcgagtgagattcgtaaaacggttctgacgcctccaaactttgcagtagagcaacctttggtgaataccagtgtataa

SEQ ID NO: 2187 - DNA, 741 bp, Acinetobacter baumannii
agaattggaacaagactaaaaaaacaaccggcatatgtaactatggcaacaaacattgaatcaaccctgcatatttctgaccttattttacaagcaagtccagtcgtccagttggtcatgctgattttattgttagcatcaatttttagttggtacctgattgccaagttacatatgagttataaaaaagcacgccaagatgatgaacatttccaaaaaatgttctggtctggtgctgaactcaatacgctttacaacaacgcacaactcaattcaaaacgctcaggccttgaagatatcttttatcaaggattaagtgagttttttaaactcaaaaaacgccaagctcctacctcacaaatgatcgaaggaacagaacgtattttacgtgtcggtttaagtcgtgatcagggtagtctggaatatggtttaggtactttagcaagtatcggttcggttgccccatatatcggtttattcggtactgtttggggaatcatgaatgcttttattggtttggctgctgttgaccaagtgacgttagcgacagttgcgccaggtattgccgaggcccttattgcaactgcaattggtctatttgctgcaattcctgcggtattggcttttaaccactttacggctaaaagcgaaagtgtctactctgatcgtgcattatttgccgaagagatgattgctttattgcaacgtcaatctgtgggttcgtcacaggaagatgcataa

SEQ ID NO: 2188 - DNA, 3885 bp, Acinetobacter baumannii
agtcacattgcggtaaggttcacaagacctgcccgtggagccaaaatcaacatgtttatcgtggccggtgcagcagcacattcttcttttaagaaagctcaactattaacacgtttatcgtcaattagttctgttcaatcttttgacagccaatgggtctatttgtttgatcaagcgctcaacgagcagcaacatcaatctgctttgcaattattaaatgacggtgagtcttttgaacttcgtcaacctgcaagtgatgagattcagattttagtaacaccacgtgtgggtacgatttcaccttggtcatctaaagcgactgacattttcaaaaactgtaatactccagttcaccgtttagaacgtggtcttttatttaccttaaaaggtgtttctgaaatttctaatgaagtaaaacaagtacttcatgaccgtatgactgaaactgtttttgcacaaattgaagatgcaaaagcactgttttcagaaacagcaccaaaacctttaaattcaattgatattttaggtcaaggtaaagaagcattagtaaaagccaacaacgaatttggttttgcgttatctgaacaagaaattgattatttaactgaagcatttactcgacttggtcgtaacccaaatgacatcgagttgatgatgtttgcacaagcaaactctgaacactgtcgtcataaaatcttcggttctgaatggacaattgatggtgaaaaacaaccattatcattgttccaaatgattaaaaacacttataaagaatctccaactgacgtgttatcggcatataaagataacgcatctgtaattgttggttatgacacgatgcgtttttatccgaaagcagatgaaaacggtcattttgtttacaaatataagagccaagctgctcacattttaatgaaggttgaaactcacaaccacccaacggcaatttcaccatttgctggtgcagcaacaggttcaggcggtgaaatccgtgatgaaggtgcaactggtcgtggtggtaaaccgaaagcaggtttaacaggctttacagtttctaacttaaatattcctggttttgaacaaccttgggaagaaaactacggtaaaccttcacgtatggcatcgccattacaaattatgattgaaggtccattaggtggcgcggcatttaacaatgaatttggtcgccctgcattaaatggttatttccgtactttcgaacaaaacgtaaatggtgaagtgaagggcttccataagccaatcatgatcgcgggtggttacggtaacattcgtcctgaccatgtagaaaaagatgcgattcaaccgggtgacttgctcattgtattgggtggccctgcgatgttaatcggtcttggtggtggcgcagcctcttctgtagacagcggtacaatgggtgaaagccttgatttcgcatctgtacaacgtgaaaacccagaaatggaacgccgttgtcaagaagtgattgatacttgctggcgtttagaagacttcaacccaatcgtgtctattcatgacgtaggagctggtggtttatcaaatgcaatgcctgagcttgtaaacgatcatgagttaggtgcagttcttaaccttcgtaagattccttcattagagccgggcatgagcccaatggaaatctggtcaaatgaagcacaagagcgttatgttcttgcaattcgtccagagtctttagaacagttcgaatcaatctgtgctcgtgaacgttgtccatttgccgtgttaggtgaagcaactgaagctcgtcacttaactgttgaagatccattgttccaaaacaacgcagttgatatcccaatgcaagtgatgcttggtggtacaccgcgtatgcaacgttcttatgaaacaattgaacgtaaaggtaacgaattcgatgcttcaaaagttgatttgaaagatgcgattttccgtgtattgaaaaatcctacagttgcgtctaagtcattcttgatcaccattggtgaccgttcaattacaggtatggttgcacgtgaccaaatggttggtcgttggcagattcctgttgcagatgcagcagtaacgactaccagcttacaaggcttcactggtgaagcaatggcaatgggtgaacgtccaccagttgcattgttaaatccagcagcgtctgctcgcttggcagttgctgaagcaattaccaatattgcatgtgcaaacattgaacaaattagcgatatcaaactttctgcaaactggatggctgctgctggtcaaaaaggtgaagaccaagcattgtttgaaggtgtgaaagcaattggtatggaaatgtgtcctgctttgggaattgcgattcctgtaggtaaagactcactttcaatgcgtaccacttggaacgacaacggtgaagataaagctgtaacatctccaatgactggtgtaattactgcatttgctccagtagctgatgttcgtaagactttaacacctgaacttaagaatttagaagactcagtacttgtccgtattgatttatctaaaggacaattccgtttaggtggttcgattcttgcgcaagtatataaagcaattggttcagtcactccagatgttgatagttttgatgatttcaaagcgttctttgctttaattcaagactggaataaccgtggcttgattcaggcttaccatgacatcggtgatggtggtttactcgcaactgtagctgaaatgatgttcgcttcgcgtttaggtgtagcattagaagatcagactactgctggtttatttgcagaagaaattggtgcagtagttcaaatcaaagcagctgattgggaagctttacaagcagaagtagctgcttctagcttaaaagatgcaattgctgtagttggtcgcgtaaataatactgatcaattatctgtaaatggcttaactttagagcgtgcagagttacaacaagcttggtctgaagtatctcatcagatccaacgtttacgtgataacgttgaaactgctgaccaagaatttgctttaattactgataaatcacatcaaggtttgattgctaaacctacatttgatttaaatgaacctatcgaagcaccgtttattaatagccgtcgtccgaatatggcaatcttgcgtgagcagggtgtaaatggtcatattgaaatggctgcagctttcgataaagttggctttaacacaattgacgtacacatgagcgacttacttgctggtcgtgtgagcctaagtgatttcgaaggtttagtgacttgtggcggtttctcttacggtgacgtaatgggtgcaggcggtggctgggcaaaatcagttctgttcaatgcgaagttacgtgatcagtttgagcaattcttccatcgtgaaggtacgtttagcttaggtatctgtaatggttgccaaatgttgtcacaattagcgccacttattccgggtgctgaacactggccacgtttccaccgcaatatgtcagaagtttttgaagcacgtagcgtaaacgttcgtgttgaaaaatcagtttctgtattacttgatggtatggaaggttcaattctaccgattgctgtagcacatggtgaaggccgtgcagttgctagcgaagctgatattgcaagcttaaatgcagcgaatcaagttgcattgcgttatgttgacagccacggtaacccgactcaacattatccattgaacccaaatggttcaccggaagcgattacgggcgtaacgtctaaagatggtcgtgcaacgattatgatgccgcaccctgagcgtactttccgtgctatccagcattcttggaaaccagaagagtggactgaagacggtgcttggttacgtatgttccgtaacgcacgtaagtttattggttaa

SEQ ID NO: 2189 - DNA, 1461 bp, Acinetobacter baumannii
acatattgttacgcacaattccaaagcattgtgatacaaaagttttattcttattctcgtagaccaattgtgggtgagcaccgaatgaaatctcgctatttacaacaaggaatgtatgcagcggtatttacagttgctgctgttcaagcaaatgctgctgttgatttttcaaacctcgttgaacaagttagtccggctgtggtgagtgtaaacgttgtaaaaaaaatgactcaggatgaactgctacaacagcaagtacctgaaattttaaaacgtttctttggtaatcaggtcatcattccacagcaacaaggtcctcaagagaaaaccgcatatggtagtgcgttctttattagtaaagatggttatttacttacgaaccaccatgtaattgaaaatgcttcccgcatcagtattactttaaatgaccgtcgtgaaattgatgcaacagtggtcggtagtgatgagcggacagacgttgccttattaaaggtaaacggaactaactatcctgctttacgcgtaggaaatgttgaccgtttacgtgtaggagagccggttttagcaattggttcaccatttggttttgattattcagcttcggcaggtattgtcagcgctaaatcacgtaacatgagcggtgaaacctctgtaccatttattcaaactgatgtggcgttgaaccctggtaactcaggcggtccattgtttaaccaaaatggtgaagttgtcggggtgaactcacgtatctttagtggtacgggtggttatatgggcttatctttctctattccaattgatgttgcgatggatgtagctgaacagcttaaaacgaaagggaaagtgactcgttcatacctaggcgttatgatgcaagatattgaccgtaaccttgcagatgcctataaattgcctaaaccggaaggtgctctgattactcaggtttctccaaattcacctgctcaaaaagcagggcttagagctggcgatgttattctaaaattaaatggtgcttctgtactgcgtactagtgatttgctttatgcattaaataaagtacaaccaaaccaaactgttcagtttgaagttttacgtgatgataaaacccgaaatatctcggcaacactagcaacagcacctgatgaaacaccagctaccggtaatcaagcctctgcttctaaaggtccagtattgggaatgagtattcgtgatctcgctgtgccagagaaaaatgctttaggtataaaaggcggtatttatgtacaagatgttcgccgtggtggattagcatcattgtcaaatatcattcctggcgatgtgattattcaggttaataatactcaaattctaaatagtcaggattttgcaaaagttgtttcgaatttgccgaaaaatacagttgcgcgagttgggattattcgtcaaggacaacgagcaatgcttggtttacgtattcagtaa

SEQ ID NO: 2190 - DNA, 822 bp, Acinetobacter baumannii
aaaagaatctatgctcttgaatataatttttgtcacaagctgaataaattaaaaacagagccttttcttaaggagaaaacgatgaaagtattacgtgttttagtgacaactacagctttacttgctgctggtgctgcaatggcggatgaagctgttgttcatgacagctatgcattcgataaaaaccaattaattccagtaggcgctcgtgctgaagtaggtactacaggttacggtggtgctttgttatggcaagcaaacccatatgtaggtttagcattgggttataacggcggtgacatttcttggtctgatgatgtaaaagtcaatggatcaacttatgaccttgatatggataataacaacgtttatttaaatgctgagattcgtccatggggtgcaagcactaaccgttgggctcaaggcttatatgtagctgctggggcggcttaccttgataacgattatgatttaactcgtaacgttgatgcgactcgttcattccgtgtaaataaccaagactttattgcgggtgctgatggtgtcaaaattaatggtcaaatgtcatataaaaatgatattgctccatacttaggttttggttttgcacctaaaatcaataaaaactggggtgtattcggtgaagtaggcgcttactatactggtaacccaacagttaagcttgtttcgtcaggttctgcagttacaactggtgatcaatcacttgaagaggcagtaaatgcggaagctcgtaaaattgctaacgatgataaatacaaatggttgccagttggtaaagttggtgtgaacttcttctggtaa

SEQ ID NO: 2191 - DNA, 639 bp, Acinetobacter baumannii
ttctttgttctaacgataaggagaacagacatgacacacactgtaattgttccgggtgtaggtggaagtgaacatcaacattggcaatcttggttgcagcgtcaactcgtgtctagttctcgcgttgagcaaaaaaactgggatagacccgtattaagcgaatggattgagcaattcgttaacacagttcaagcagtacaaacaccagtccaaattgttgcgcatagtttcggctgcctaactagtgttgctgccttagcagagcatccagagttacaacttcaagttaaaaaactgattttggttgctcctgcaaatccggcacgttttggtgaagcgggatttgcccgtcatagtttgactgactacaaagattattttcatcagctaaaaattaatgtgcctgcaacgctactcattagtgaaaatgatccatggttagacttttttgatgctttacagcttgcgaaatcttggcaattaaccccgattaaccttggacaagtcggtcatattaatgttgcttcaggctttggtccgtttcctgacttactgaatcatctacttcctgaagactcgatgtgtagccactcatctattgattcggtaaagacacatttctctttgaaatttgcttaa

SEQ ID NO: 2192 - DNA, 924 bp, Acinetobacter baumannii
atgaactttcaacaattaagaattatccgagaaacagtacgccaaaactttaatttaacggaagcatctgccgcgttatacacctctcaatcaggtgtaagtaaacatattaaagatttagaagatgaattaggcgtacaacttttcgtccgtaaaggtaaacgtctgctgggtttaactgaacccggtcaatcactccttagcattgtagaacgcatgcttgtagatgctgaaaatattaaacgtcttgccgatgactttaataaagtggacgaaggtactttaacgattgcaacaacacatactcaagcacgttatgtattaccaccaatcgtcaatcaatttaagaaactatttccaaaagttcatttgattttgcaacaagcaagccctgtcgaaattgcagaaatgcttttacaaggtgaagctgatattggcatcgcgacagagtctttaacaactgaagaaaatttagcaagcattccatattatcaatggcagcacagcattattactcctcaagatcacccacttacacagctcgataaaattgatcttgatgctttatctgaatacccactgattacttatcacggcggttttacaggtcgttcaaagattgataaagcatttgaagatgcacaaattgatgccgatattgtaatgtctgcgcttgatgccgatgttatcaagacttacgttgaactcggcatgggcgtcggaattgtcaatgatgtcgcttacgatgcagagcgtgactatcgtttaaaacaaattaaaactgatatctttggtgtcaacaccacatggattgctgttcgcaaaggccatttattacgtggttatggttatgagtttatttctttatgctcacctgatgctgacattaaagcattgaaaaaaattgcctatccagatgaataa

SEQ ID NO: 2193 - DNA, 201 bp, Acinetobacter baumannii
ataccgctgcatacattccttgttgtaaatagcgagatttcattcggtgctcacccacaattggtctacgagaataagaataaaacttttgtatcacaatgctttggaattgtgcgtaacaatatgtttatttgtaaggcatcctcatcacgtttattttacacattgcaattttttaagctaattgcaatttttctgtga

SEQ ID NO: 2194 - DNA, 1821 bp, Acinetobacter baumannii
cccatggcgcaagctaaaaaatccgttgatatcaaaaatatccgaaatttctcgattatcgctcatattgatcatggtaagtctactttggctgaccgttttattcagatgtgtggtggcctgcaagatcgtgagatgcaagctcaggtcttggactcaatggagctcgagcgtgaacgtgggattaccattaaagctgcttcggtgacgttgtactatactcatccaaacgggcaggaatatcagcttaactttattgatactccgggacacgttgatttctcttatgaagtatctcgttcattagctgcttgtgaaggtgcgttattggttgttgatgctgcacaaggtgtagaagcacaatcagttgcaaactgttataccgctattgagcaaggtctcgaggtccttccaattttaaataaaattgatttaccgcaagcagagcctgagcgcgttattcacgaaattgaagaaattatcggtattgaagcaaccaatgcacctacatgttctgcaaaaacaggcttaggcgttgaaggtgttttagaaacattagttgatgttattcctgctccaacaggtgaccgtgaggctcctttacaggcattaatcattgactcatggtttgataactatttaggtgttgtctctttagttcgtattaaagatggtcgtatccgcaagggcgacaaaatgttggttaaatctactggtcagactcacattgttacatcggtaggtgtattcaaccctaaacatactgaaactggcgtgcttgaagctggtgaagtaggctttgttatcgcgggtattaaagatatttttggtgcgccggtaggtgataccatcacgctttcaacaacccctgaagtagcttcacttcctggttttaaaaaggttaaacctcaggtttacgcaggccttttcccaattgatgcaagcgattttgaaccattccgcgaagccttacaaaaactacagatcaatgactcggctttattctttgaacctgaaagttcagatgcgcttggttttggtttccgttgtggtttcttgggcatgttgcacatggaaatcgtacaagagcgtttagagcgcgagtatgaccttgatttgatcagctcagcgccaacggtagtgtatgaagctgtcactaaaaaaggcgatacgatctatatcgatagtccatctaaaatgccggatggctctgttgttgaagatttacgtgagccaattgcagagtgtcatattcttgtaccgcaagagtacttaggtaacgtcatgaccctatgtattgagcgccgtggtgtacaaaaagacatgaaattcttaggtaatcaagtttcaattacttttgaaattcctatggctgaagtggttatggacttctttgataagcttaaatcatgttcacgtggttttgcttcacttgactataactttattcgttttgagagttcatctttagttaaggttgacgtgttaattaatggtgagaaggtcgatgcgcttgcaatgatttgtcaccgtaatgatgctcgtcatcgtggtattgctttagttgagaaaatgaaagatttgattccacgtcaaatgttcgatgtcgcaattcaggctgctattggtgcacaaattattgctcgttcgaccgtgaaggcgatgcgtaaaaacgttttagcaaaatgttatggcggtgacgtgtctcgtaagaagaaactacttgcgaaacaaaaagaaggtaagaaacgtatgaaacaagtgggtagtgtagaaatcccacaagaagcgttcttagctgttttgaaagtagaaagataa

SEQ ID NO: 2195 - DNA, 1407 bp, Acinetobacter baumannii
gctatgaataaaaatcaaaagcctccttttaaacaaaatgcaatagcattgagcttcacccttggagttcatgcaattgccattgttggcttgctttttttaggcttgagtaaaccacctgaacaaccaaaaaagctgaccactgttttagttaaaccagaagatttaccaccacctttggcaaaagaagttgagcaaccaaccgtagcagaaaatcaggctgaagaagttctaagcccgattgtggatgaaactcttcctcaaaatcttccagccgcccctcctcctccaacagcacaacaacttgctgctcaaaagcaaaaagctgagcaggcacaacaagcaaaattagctgaggaaaagcgtaaagctgaagaagctgctaaagtaaagcaagctgcagagcaacaacgtttagaggaagcacaaaagcaacaggctgaagctaagcgtcaagcggaggctaaagcgagagctgaagctgaacaaaaacgaaaagccgaacaaaatgcaaaagctgaggccgatgcgaaagctagacaaaaagcaactgaggaagctaaacgtaaagctgagactgaagcaagactaaaacgtgaagctcaaaaagctgaaaacgctaaacttcaagcacaacaagaagctaaacgaaaagccgaagcagatgctaaagccaaacagcaaaaagctgccgaagacgccaaacgtaaagctgaatcagatgctaaggctaagcaacaagcagctgataacgcgaaacgtaaagccgaggccgatgcgaaagctaaacagcaaaaagcagctgaagatgctaaacgtaaagctgaggctgatgcaaaagccaagcagcaaaaagcagctgaagatgctaagcgcaaagctgaggccgatgcgaaagctaaacagcaaaaagcggctgaagatgctaaacgcaaagctgaggccgatgcgaaagctaaacagcaaaaagcagcagaagacgctaaacgtaaagctgaggctgatgcaaaagccaaacaacaaaaagcagcagaagatgctagacgtaaagccgaaattgaggccgaagaaaaagctgcatctgctaaaaaagctcaagaagaagctgcccagaaaaaaggtgaagctaaaaaaattgcatcttcggctaaacgtgattttgagcagaaaattcgtcgtgcttgggatgttcctacaggaagcagtggtaaaactgttagcgttagatttaccctgtctgactcaggtagtgttagctcgattgttattacacggtcaagtggagatgatgcattggatgcaagtatcaaagctgcaattcaggcgtctgctccctacccaatgccatcggatcctgatgcaagacgagaagcgcgaagcgttacctctactttcagagcacaataa

SEQ ID NO: 2196 - DNA, 1332 bp, Acinetobacter baumannii
ctatgctacaaaatcaccagtcacaaaaataccttcaatgactttaaacctatgaaaacgagccgcaaacaccttctagccttaacgctacttacagcattaagtcctcttgcaccaacagctgcctttgctcaattacatttagagattgcaaaagcacctgatcaggcgcctaaaatcgctattgtgccttttaataacgacaatggactttatcctattgttgaaactgacttaaaccgctcaggacgtttcacaagttcatcaaaaaatttacctgcgaatgccgctattaaccagattcaagcatctgattggcaagctgcgggtattccttatgttgttactggacaaattaagcaaacagctgacgggtttgaagtccattaccaactttatgatgtacaaaaacagcaatatcttctgaatgagttgttaaatgttcctgcttcacgcatacgtcaagcaggacatatggtaagtgacgctatttatcaggccttaaccggaattccaggcgattttagtggtcgtatcgcttatgtattacgtaatcctgccactcctgctgaacgttataccttacaaatcgccgatacagatggtgaacaaccgaaaactgttctctcttcacgtgacccgattttgtctccggcatggactcctgacgctaaaaaaattgcttatgtttcttttgaaactaaacgtccagccatttatttacaagatctctctactggaacacgtgaagtacttacgagttttaaaggcttaaatggtgcaccaagcttttcaccagatggcaaatcaatgctatttacagcatcgatgaatggtaaccctgaaatttatcaaatggatttatcaactcgccaagtcaaacgcatgacaaatgactcgggaattgatactgaagcgcgttacacaccagatggaaaagcttttatttttacatctgaccgtggaggctctcctcaaatttatcgctatgattttgggaatggctcagtaaaacgcttaacatttaaagggtcatttaatgctcgtggcactttaagtgcagatggtaaaaaaattgcacttgtgcatcgaccaagtggtagtaactataaagttgcgatccaagatattaatacaggcattgtcaatattcttaccccaaccagtttagatgaatcaccaagtttctcaccaaatgggcaaatggtggtttatgcaactcgtgaagggaaccgtggtttactgtctatcatgtccactgatggtcgtttccgtatgaatttaccgagtgagcaaggtgaagtacgtgaaccagcctgggcacctaaataa

SEQ ID NO: 2197 - DNA, 306 bp, Acinetobacter baumannii
gaatgccgaaaaataaaaattatcttactttatttgtgttgcatttatgcttacaagccccattttacgtggtatgttgtttgcataacaaaggaatgtagatttaggagaatcgaaatgacaactaagaagtttgatgcgaccccaacagcaggtgaaccaatcaatttagaagaaatttcgaaagaaagtgttcaggaagcttggaaagattatgaggcaaaacctgaatataaagcttttaataagcatgatttgattgagtcaatgcaacattcagaagaagagcaaaacaaatcttcttaa

SEQ ID NO: 2198 - DNA, 462 bp, Acinetobacter baumannii
agtgggtgttttgtgagcagtattttcgatttacatattcaggttcagccacagcatattgatgctttagggcatgttaacaatgtaatgtatgtccagtggatgcaagacgtcgctgctgctcatgtggaaacattaggggtaggagtaaccaaatatctagagctaaaacatgcaatggttgcggttgaacaccatgtgcaataccgtaaagctgcgtttgaaggtgaagaaattgtactgcggacatggctagatgatattaatgctctatattcatttcgtcagtatgcctttttccgtccttctgatcaggcaattttgttcgtcggaaataccaaatgggcatgtattgaaattgcttcaggtcgacctaagcgtatgtcgccgacttttacacaggcttataaacctcttgattcaagtataaatcctttagattttactgtttcatatgcctga

SEQ ID NO: 2199 - DNA, 798 bp, Acinetobacter baumannii
gttcaactgaaacagttgattatttctaaggatataagaatgttagcattagttacaggcgcatcagcaggttttggttatagtatttcaaaaaaactgattgagtcaggctataaagttattggatgtggaagacgcgcagaaaaattagaagaactacaaaaacagcttggcgaaaatttctacccactcgtatttgatatgactgatacggcagaaaatataaataagttatttaaagaattaccaaatgaatttcaaatcgatcaaattgacttactagtgaataatgcaggcttggcattgggtctagagccagcagataaagcggatttagatgattggtacaccatgattgataccaatgttaaaggccttgttacggttacccgattaattttaccaagtatggtaaagaagaaatcaggcttaatcattaatatgggttcaattgcaggtacatacccatatccaggtggtaatgtatatggggcaacaaaagcttttgtagagcagtttagtttaaatctacgtgcagatttggctggtactggcgtgcgggtaacgaatattgagccagggttgtgtggtggtaccgaattttctcttgtacgttttaagggagatcaggagaaagctaacagtctatacgataagaaaaatccaattttgccggaagatattgcaaatacagtagcatggatcgcatcacaaccaccgcatattaatattaaccgtatagaaatgatgccaacgactcagacttttaaccctttaaaagttgtagaagtggaataa

SEQ ID NO: 2200 - DNA, 183 bp, Acinetobacter baumannii
gcgagggtgaagcccaatgatagaccaaacccaggcagcactcgggatcgctgcgacatgatatttcctcaaagagaaaagcctgctgaaaccagtaagcgaataaataaagataaatggcgcggtataaagctaggtattaagcaaatttcaaagagaaatgtgtctttaccgaatcaatag

SEQ ID NO: 2201 - DNA, 594 bp, Acinetobacter baumannii
aataactcgaactcaggcattgctatgaatctactaaaagtttgtactttattgccttgtagccttgttattgctgcctgctccgttaattcatcaagcactcctcctacactgagctcttctacaccacaagttcaaaaatcatcgatagaaataagctgccaagatttacaaaatcctgcttaccgacaagctgtgcttaatgcaattaatgaaattcgacaacatcctcgtcaatgtggtcagcagtatttttctgcagctaaacctttaagctggaataataatttatatcaaggtgcaagtgctcactctaaagatatggcaaataacaactttcttgggcatgttggctcaacaggtttagatttaagagcgagattaaaaaaatatcatatgctgagtaaagccaatggtgagaatgtcgcgagtggacaaaaaactttaaatgaggtcatggctaaatggatcgccagtcctctgcattgcagtaatatcatgaaccctagatataccgaatatgccattgcatgtgcttctgaccagtctgctaaacaaagaagctattggacacaacaatttgcaggtttttaa

SEQ ID NO: 2202 - DNA, 696 bp, Acinetobacter baumannii
atcattccgaatatggagaaaaatatgcgccctcgtgccattgttttactttcaggcggcttagactcaaccacttgcctagcttgggcacaagcgcgctatgaatgtattgctattagttttatgtatggtcaacgttcaaccactgaacttgatgccgcaaaagcattagctcagcgtgcaggtgttgaacaccgtgtaattaatatcgatttagccaatttaggcgggtctgcacttacagatcataacattgctgtaccagaacaattacaagaaggtattcctgtaacttatgtaccagcacgtaacacaattttcctctcttatgccttagcagcagcagaagtttttaatgctgaagcaattgttatcggcatcaatgctgttgattattcaggatatcctgactgtcgcccagaatttattgatgcttttgccaatatggctcgtttagcaactaaagctggcgtggaaggaaaacctcttaaatttgaaacacccctgttacatttatccaaagcgaatattatacgtttagggattgaacatggcgtagactatagtcaaacggtatcttgctaccaagcagatgctcaaggacgtgcgtgtggtaaatgtgacagttgccgtttgcgtaaagaaggctttatcgatgctggtgttaccgatccaacacgctatataccgcaataa

SEQ ID NO: 2203 - DNA, 1080 bp, Acinetobacter baumannii
ttcgtaaggaatgaaatcatgagtattcaagttaaaaatattgaaaaacactttggtgcattccatgcgcttaaaaatatttcactcgatttcccagagggagaactggttgccttactcggcccatctggctgcggtaaaacgacgctacttcgtattattgcgggtttagagtcagcagatggtggtcaagttttactagaaggcgaagatgcaaccaatgtacatgtccgtgaacgtcaggtcggttttgtttttcagcactatgctttattccgtcacatgaccgtatttgacaatattgcctttggtttacgtgtccgtcctcgtgccacacgcccatcggaagccgaaattaaaaaacgagtgactcgtctgcttgatttggttcaattgggctttttagcagaccgttacccagcccagctttctggtggtcaacgccaacgtattgccttagctcgtgcacttgccgtagaacctcgtgtgttattgcttgatgaaccatttggtgcactagatgctaaggtccgtaaagaattacgccgctggttacgtaacttgcatgatgagctgcatatcacttcaattttcgtaacccatgaccaggaagaggcacttgaagtagcagaccaaattattgtgatgaataaaggtaacgtcgaacaaattggttctccgcgtgaagtttacgaaaaacctgcaacaccatttgtatttgatttcttgggtcaagcaaatcgttttgaaggtgaacatgcaagcggtattatccgtattggcaatgatcgtatcgaattaccgaccacagttcaggcaccgcaaggaaaagtaattgcttttgcccgtccggatgagttacatattcatgcgcaaccacaggcaaatacaattgaagcaacttttgtacgtgaagtctggattgctggaaaagtagtggcggaattacaagatcgtaatggacgtttaattgagattgctctgagcagtgaagctgcaaaacaacatgcatttaaaccaaatcaaactgtttgggtaagtgcatctcaacttcacctatttgcagatcaagttgcttaa

SEQ ID NO: 2204 - DNA, 465 bp, Acinetobacter baumannii
gaaatgtctgagaatattcacctgccaaatcaggttttcccaaccacacacggcgaagttaatttggctgaagtcgataatgaatggctgattatttacttctaccctaaagactcaacgccaggctgtacaacacaagctgtcggcttttcttgtttaaaagatcaatttgatgctttaggtgctcgcatttttggagtatcacgcgactcggtaaaagcccatcaaaactttacagaaaagcaggcactgacaatcgatttaattagtgacaaagaagaagtactttgcaaacactttgatgtgattaaagaaaagaatatgtatgggaaaaaagtaatggggatcgaacgctctacttttattttccataataaagccttagttaaaagttaccgtaaggtgaaagcagctggccatgctgaacaggttttagaagatttaaaagcattacaaacagcttaa

SEQ ID NO: 2205 - DNA, 1029 bp, Acinetobacter baumannii
atcaatgatgaagtaaacacacctatgcaagaccgtctaatcagtggaacagaaaaacctgaagatcattttgatcgggctattcgaccgacttcacttgccgattatatcgggcaaccagtcgtacgcgagcaaatggaaattttcatcggtgcggctcgtggtcgtggtgaagcactcgatcacacactgattttcggtccaccgggcttaggaaaaaccacgcttgccaatattattgcgcgtgaaatgggtggcaatctcaaatccacttcagggcctgttttagagcgtgcgggtgatttggctgcaatgctgactaaccttgaagaaggcgatgttttatttattgatgaaattcaccgtctttcaccagtgattgaagaaattctttatccggcaatggaagattaccaacttgatatcatgattggtgaaggtcctgctgctcgttcaattaaactcgatttaccaccttttacgctcgttgctgcgaccacacgtgctggcttactcacctcgcctctacgtgaccgtttcggtattgtgcaacgtcttgaattctattctgtagaagacctaactcacatcgtgtcacgatctgcaaacctcatggatgtacccattacagtggagggtgcagaagaagttgcacgccgttcacgcggaacaccgcgtattgccaatcgtttattacgccgtgtacgtgactatgcacaagtaaaaggtacaggcgaagttaaccatgaaatggcacaacgtgcgcttgatatgctcaatgtcgataaagctggtttagataccttagaccgacgttatttaagtatgctgctagaacgttttgatggtggacctgctggtgttgaagcccttgcagctgccatggctgaagatagcggaacacttgaagatgttattgaaccttatttaattcagcaaggttatgttatgcgtactgcacgaggtcgcattgcaaccaaccaatcttatttgcagtttggcatgacgccacctgagcctaaaaactaa

SEQ ID NO: 2206 - DNA, 717 bp, Acinetobacter baumannii
aaaatagccgattgttgtcaacctcccacctcttttcaacgttatataagagatatattgaagataaggtgggcacgtccaatgacaggattttccatctccatggatttagcaccgaaaaagtctcgatcggaaacatctagtgctcatgccagcacggctgagcaacgcctaaaggttttcatgcaagatgttactggtcgtgctttagtgatgatggaaagtgctacccaaggtcaacaaggcattgctatggacttggttcaagaagcatttattgctttacacaagtcttacgccgatcgaagtactgaagaatggtatcccctattttatactattctaaataacaaacttcaggattggcgccgcaaagaagcacgtcgggcaaacccattttcattcttcaaaaaagttagtctagacaatgatgatgaagaaatcattgatattgtcgatgaaaaagcaatcaatccagcagattttctagatcaagcagtgaccatagaagagatccaggaagcgattgcaaaactacctgttcgtcaacaacaagcttttatgttacgtgcgtgggaaggttttgatacccatactacagcgcaaattatgaactgcaccgaaggtagtgtaaaaacccattatcatcgagcaattcagggacttagagagtatttagcgcatttaaatcccatgggaggttccaatgaatcatga

SEQ ID NO: 2207 - DNA, 561 bp, Acinetobacter baumannii
gccatgcaagaccaatggaaaactaacgcacataacagaccgtcaattgtctcctttagtggaggtaaagacagctctcttgcactttatcatgccatgcaaaccggtaacgtaattggtttaatcgttatgctggaagagcaaggacaacgctcccgttcacatgcaatgccacttgatattatccgggcgcaagctcaagcaattggcttacctgtatttatggcatcatctagctggaatgactatgaaaataaattcatcaacttactaaatgaagccaaacaaaaaggtgctgaggtactggttacaggtgatttagatatgccggaacatggttgttggcatgatcgtgttactcaatcagtgggccttaaattaggaatgccgctctggctacggccccatcgtgaagttgttgaagaatttattcaacttgggtttcagagtgtagttgtgactgtaaaccttaaactcgggatgaaggtggaagatttaggtcaagtgttatcgttagaatatatacaggaacttgaaaaccgtggaattgatccatgttga

SEQ ID NO: 2208 - DNA, 834 bp, Acinetobacter baumannii
ggtcctgtggattttgattttaatttaattcttgttcctgttacgctgattttatttgcagtgtggttgctagataagcttgtttttaaacagcgtgcaaataaagggcgagagaacgaaaattttgttattacatgggcctatgacttttggccggttttagctgttgtgcttgtacttcgctcatttctttatgaaccatttaatattccatcagactctatggttccgaccttagagactggcgattttattttagttaataaatttgactatggtgtccgtttacctatcgtcaataaaaaagtgattgatatcggtgaaccgaaacgtggtgatgtcattgtattccgttatccgccacaacctactattagttatattaaacgtgtaattggcttacctggtgaccatattgtttatgatcatggacaattgattattaatggtcaaaaaattcctaaagtaccaacacagtttagtcgcgaaaaagatgctttagatacaccaacttctatttatcataaagaaacaattggtgatcatacttttacgatgcgtgagcttgaaggcgtaaatgttgcgcgtcaggcaccatttatcaactatgttgataatggtaaatatgcaaaccaagacggtttatattgggaagtaacagttccgaaaggacattactttgcaatgggggataaccgtgatcaaagtgctgacagtcgtttctggggcttcgtacctgaagaaaatttaacaggccgagctttctatgtctggatgcataaagaacctggtttccacctgccaagctttaaccgaaatgggaaaatagattaa

SEQ ID NO: 2209 - DNA, 339 bp, Acinetobacter baumannii
atcccatgggaggttccaatgaatcatgatgatttcactaaaaaggtgacatccaaactcgatagtttggctcatcaccataaaaataaaacagtggtgatgaatcatgtgcttgaccatatccaacaaaaaccagcctcttattatagtgtctggaaaatgactggttttgcacttgcagcggcgattactggttttgttattttaccaaattcagtagatatgcttgataagccacaaaatcaagtcgttgtaaatcctaaattatcgccacaaatggtagaagatttagaaatgctcatggtgttgggtgaggataaagttcaacatggtagctaa

SEQ ID NO: 2210 - DNA, 420 bp, Acinetobacter baumannii
ccgaaatgggaaaatagattaaaaacaaccattaggaaaacaaaaatgcgtaaggcacaacagggtacttcgtatttagcaattttatttggggtggtcatatttgcaattgcggtgaaagccgtacttgcagtttggccagcatattgggatgatcgtgtgattaataatcagattacagagcttatgcaacaaagctcggctgatatcacaccccaaaagtttatgacacagatggaccaacgactggaaatgaacaacattcgtgatctgcattttaaagagattgctgaagtgtttaaccagccaagtctaacagtcaaaaagaaatatgaggtaagaaagcctttcttactgaatattgatttagttttaacatttgagaagagttttgacaaaacatcagttcaagctaagtga

SEQ ID NO: 2211 - DNA, 1146 bp, Acinetobacter baumannii
gacgatacttgtataactctagatcaacgggggcttattagatctgtaactaataagttatattatcagtcaggtatcaaaaatagttgtgatattggttcgattgagctaatgaaactgactgctggagatataaaagatttaggcaatgattcttttactgatcgaatttctacatatcagactcgatatgataatgtacaagaaaatcttaagaaccaagctttttcatatttatggccagtattaaaaataagatcggtagaatataaaaatcttcttgatcaaactaaagcaaatgcaaagtatcgtgctatttatatagatttgaaagctaaaggattgcctttacctaatgagggtgctaatcacacattaaaattctttaatacaactgattataatattaatgttgaaactattggaacaggtttaatagacgataaagtttataatattaaggataaagaagaggatatacttaaatgtgaatggaactctgctttacagcaaattatattttatcgtttagatgacagaattacccaagcaggtgattacaactattgtaaatatacagtaagtactaaagatggttctattcaatcgacaggtttattagaggctcgttttgataatattgctcctgtagctactaatgaaacggtttcattcaaatatttggctaatgaaattatccctataaatttacttaaatatgcaaatgatgatggggacggaccagcgaatactcttcaaacaaaacctaataagcctcaattttgggtcaatgataaaggtgttgagctaccaatttatcttccaagtaaaagttcaaaagatggtatttttaaagtagtaaaagcggatcgagaaggtccatgccctaataatgataaagataatacttgttatggcggtaatatctatattcaagctagtaatgtatttaataccttcaacgataccttaacttattatgtatatgatgctgatggtaaaatctcaaatgagggtactattaagttgataagtacagcaaccacaactgatgattcacgtggcggtggaggtggcggaagtattggaatcctttctatcgcatcactactaagtttaattgcttatagacgttatcgtaagtga

SEQ ID NO: 2212 - DNA, 540 bp, Acinetobacter baumannii
gacttagtatgcaatctgctaaactgccccgtatttaaaagcagatgtatggctttggatagaactgatattttattcaacagtcatattttaaatataaagctctatagtgaactaaaacggaatactctcatggcgaatcattttgaattcaacattcgtgtttatattgaagatacggacgcaggtggtattgtttaccatgccaaccacattcgctatatggaacgtacccgtacagaatggctccgcgctgctggcgttgaccattactggcatcaaaaagactacaactttgtggtatataaaattgacgtaaaatatatgcgtcctattttaatggatgacttaattactgttacagcacgtgtagtttcatgtaaagctgcgtcatttgtgttgcaacaaaatatttatcgtggtgaaatcttgcttgcttctggtgaggttgagttggcatgtttaagtaaagatctaatgccacgtcgtcttccagaagaaatacgtgatcttattcgtaaagaattggaacaagactaa

SEQ ID NO: 2213 - DNA, 426 bp, Acinetobacter baumannii
aaatgctcatggtgttgggtgaggataaagttcaacatggtagctaaaaagttagcacttatcctttgttcattaagtttcttgcaaacaagctttgcaggtttcgaacgtttctggattttttcgaaagatgccaatacgcaagtagatgatacttggaatgctctatctgaagaagagcaacgagctgtaattaaacgttatcaaagcttaaaggaattaccatccaaccaaagtgctaacttgcaacaacgtatggattggtttaaccagcttccagatgcagaaaagcaaaaaatgcgtgaagcctggcaaaaaatgagtacacaagagcgtaatgatttacgtcaacggatgctcaaagcaagtgctgatgaaagaactgctatacgcgaagaatatataaataaatatttagagcactaa

SEQ ID NO: 2214 - DNA, 1029 bp, Acinetobacter baumannii
aatatgccacgtatttatctgactcattttgatgcttgcgcacaggagcgtttttttatgtccaacctcacattgtcccaatttttacaacaagaaaaagggaatcttacacctgagttggctcaagtcatcgacacaattgctgcgacttgtaaaaccattgatcaagccttacaaaaaggtgccttggctggaattttgggtagcgcaggtaacgaaaatgttcaaggtgaaacacagaaaaaacttgatgtgatttctaatgactatttaatcgatgctttaaaagtccatcctcacgtcggtggtcttgcatctgaagaacttgatgattttacaccagcacaagaaaacggcgaatacttggttctatttgatccattagatggttcaagcaacattgatatcaacatgtgtgtcggaacaatcttctcgattcttcctgccaaaaatgcggttacacaagcacaagatttcatgcaggcaggtattcaacaagttgctgctggctatgtgttatatggcccatcaactatgatggctttaacagttggaaacggtgtagctttctttacgttagatccagaaactcaaacattcttacttaccacagagaatgttcaagtatcagcagatactcaagaatttgctattaatgcatctaaccaacgccattgggaacaaccagtaaaacaatatattgaagagttacttgcaggtaaaacatctgtacgtgaaaaagacttcaatatgcgttgggtcgcatgtatggtgggtgatgttcaccgtattttatgccgtggcggtattttcctttatccatatgacttgaaagacccgaaaaaagctggtcgtttacgtttaatgtatgaagctaacccaatgagtatgctcattgaacaagcaggcggcgcatcaactactggccgtgtacgcattctagagattgaacctacagaacttcatcaacgtgttcctgtgattatcggttctaagaatgaagttgaacgcgtaacaagctatcattaa

SEQ ID NO: 2215 - DNA, 1068 bp, Acinetobacter baumannii
agactagcgctattctgcgttcatgttttgaacatttcgtattttttgaggggttatctcatgcgtttttctcagttaaaagtcggggttattgctgcattactttctgtttcatcgtttgcagctcaagaattcttaaacgtttcttacgatccaactcgcgagttatatacagatttcaataaacagttcggtacttactggaaacagcgtaccggtcaagatattgagtttaaacaatcacacggtggttctggtaaacaggctcgtgcagtgattgatggcttaaatgctgacgttgtgacattagctcttgcagctgatatcgatgaaattgcagaaaaagcaaaattgcttccaacagactggcagaaaaagttaccgcaaaactctactccgtacacatcaactatcgtgtttttagttcgtaagggtaaccctaaacaaattaaagattggggtgacttaatcaagccaggcgtggaaattattacaccaaacccgaaaacttctggtggtgcacgctggaactatcttgccgcttgggcttgggcaaaacatcaagcaggtggtaacgatgcaaaagcgcaagagtttgttcgccaaatttataaacacaccaaagttttagattcaggtgcccgtggtgcaaccactacatttgctgaacgcggaattggtgacgtattactggcttgggaaaatgaagcacatttagctatccgtgaacaaccaggcaagtttgagattgtgacgccatctttatctattttggctgagccaccagttgcaattgttgaaaaaaatgcagcgaaaaaaggcaacttaactattgcaaaaggttacctcaactatttgtactcacctgctggtcaagaaattgcagcacgtaatttctaccgtcctcgcaatgcagctgtactcaaaaaatacagcaatgtatttaagccattgaaacttgtcaccattgataaagagtttggcggttggacaaaagtacaaaagcaacactttgataatggtggtgttttcgatcaaatcgtgaaaatcaatagtgcagagaagtaa

SEQ ID NO: 2216 - DNA, 843 bp, Acinetobacter baumannii
aacgtgaagctcaaaaagctgaaaacgctaaacttcaagcacaacaagaagctaaacgaaaagccgaagcagatgctaaagccaaacagcaaaaagctgccgaagacgccaaacgtaaagctgaatcagatgctaaggctaagcaacaagcagctgataacgcgaaacgtaaagccgaggccgatgcgaaagctaaacagcaaaaagcagctgaagatgctaaacgtaaagctgaggctgatgcaaaagccaagcagcaaaaagcagctgaagatgctaagcgcaaagctgaggccgatgcgaaagctaaacagcaaaaagcggctgaagatgctaaacgcaaagctgaggccgatgcgaaagctaaacagcaaaaagcagcagaagacgctaaacgtaaagctgaggctgatgcaaaagccaaacaacaaaaagcagcagaagatgctagacgtaaagccgaaattgaggccgaagaaaaagctgcatctgctaaaaaagctcaagaagaagctgcccagaaaaaaggtgaagctaaaaaaattgcatcttcggctaaacgtgattttgagcagaaaattcgtcgtgcttgggatgttcctacaggaagcagtggtaaaactgttagcgttagatttaccctgtctgactcaggtagtgttagctcgattgttattacacggtcaagtggagatgatgcattggatgcaagtatcaaagctgcaattcaggcgtctgctccctacccaatgccatcggatcctgatgcaagacgagaagcgcgaagcgttacctctactttcagagcacaataattttgtaagagttacatgctttaaatag

SEQ ID NO: 2217 - DNA, 816 bp, Acinetobacter baumannii
agcaaggatagtacgatgacacttagctgtattcaacaacctcatcaacatttacaagcaaatttagaaggtggcgtactcaccttagccataaatcgcccagaagcaaaaaatgcattatatggcgaactttacttatggattgccaaagcacttgatgaagccgaccaaaataaagatgtacgagtaatcattctacgtggtgccgaacatgactttaccgctggtaatgacatgaaagattttatgggttttgtacaaaatccgaatgctggtccagcaggtcaagttcctccatttgtactccttaaatctgctgccagattatcgaagccgcttattattgcagtaaaaggcgtggcaattggtattggtgttacgattttattacaggcagacctcgtttttgccgacaatacggccctctttcaaattccttttgttagccttgggctttctcctgaaggtggtgcaagtcaattattggttaaacaagctggttatcacaaagcagctgaactactgtttactgccaaaaagttcaatgcagaaactgctgtacaagctggtttagttaatgaaatcgttgaagatgcttatgccactgctcaggcaactgcccaacacttaacagctttaccgcttgcttcattaaaacaaaccaaagcattaatgaaacatgatttagatcagattattgaatgtattgaccatgaagcagaaatctttatgcaacgcgttcaatcaccagaaatgttagaagctgtgcaggcatttatgcaaaaacgtaaaccggacttttcacagtttaattaa

SEQ ID NO: 2218 - DNA, 930 bp, Acinetobacter baumannii
cttacttcaagcatgggcaaaccgtcgtacagggagaaatgtcacatgaacctacataccgacagcaatgcacttgccttgaaattgcaatctcgtgacgcgacacgtgaaccaacttgggtacgttatacgctcattacaattgcactgatttttttccttagctgcctcatgttgccacttattctggtttttgttgaagcatttaaacaaggccttgaagtctatgttcaagctttaattgatccagatacgttatcagcagtgaaattaacactattgaccgcagcaattgccgttccgattaatgtgatatttggtgttgccgctgcatgggctgtttccaaatttcagtttaaaggtaaagcaattttaaccaccattattgatatgcctttttcggtttcccctgttattgcaggtttaatgattgtactgattttcggtgctcaaggctggttaggcggctggctcatggaacatgacatcaagattctatatgccgtacctgccattgttttagcgaccatctttattacagttccatttgtggcgcgtgagttaattccacttatggaagcgcaaggaactgaagaagaggaagcagcgattgtactcggtgcatcaggttggcaaaccttttggaaagtcacactccctaacattaaatggggtctgatttacggcgtgattttgtgtaatgcccgtgcaatgggtgagtttggggcagtatcagtagtttccggccacatccgtggtgagaccaataccctgcctctacatgtcgaaattttatataacgagtacacctttagtgcagcttttgcggtgtcctcactacttgctttcttggcactattaacactgattttaaaaacctggttagaactacatcaagacaagccagaaccgcattcaactgattcgtaa

SEQ ID NO: 2219 - DNA, 429 bp, Acinetobacter baumannii
agaataacaaggatgaaaagctcaaaagaagaaattgtggcatttcttgaaaaggaattcccacaaagtttggaacattgcacgattgaatcagtcacttctaaagctgccgttgtttattatcacgttgaccaaagacatcaacgtccgggaggtactatatctggcccgactatgatgactttggcagactttgctttatatattgcaatactcggtgaaattggaattattggtttagctgtaaccaccaattttaatattaatttcctgagaaaacccgcaggtgatcaagacttacgcagtgaatgtaagctcatgaaagtaggaaagagcttagtcgtaggtgaggtctggatttattcagtagggcaagaggaacccgtggcacatgtgaccgcgacttactcaattcctcctagaccataa

SEQ ID NO: 2220 - DNA, 708 bp, Acinetobacter baumannii
catttgagaagagttttgacaaaacatcagttcaagctaagtgatcctcgcttactcagtcgaatcggttatcaatttaagcagcctgaattgctacagttggctttgactcatcgttcggtgagtcataagtataactacgaacgtctggaatttttgggcgattcactgttggggatgattatcgccaattatttataccatgcgtaccctcatgaaaatgaagggcgcttaacgcgtatgcgcgcgactttagtacgtcaggaagcattaggtaaaattgcaaccgatttgcaacttagtcggtgtttaatattaagcacaggcgagttgaaatctggtggtcatcatcgtgagtcaatattggctgacacagtggaggccattattggtgcaatttatcttgatagtagtgatctgaacctacttaaagatattgtgttaaaatggtataccccttatttagatcatattgagccaacagatcaactcaaggatccaaaatcacgtttacaagagtatctacaagcacgtaaaaaacctctccctgtttacgaggttgtagatattcagggtgatgcgcctcatcagcactttaaagtcgaatgtttggtagatggtttatcaaaaattcatggtgaggggtcaagtcgtcgttttgccgagcaggcagcagcggcggaaattttaaagttattggagcaataa

SEQ ID NO: 2221 - DNA, 798 bp, Acinetobacter baumannii
cgcccttttggatatttccttatggcggttatttttttagaatcaaaagacaatgcaaaaattaaacatttgcgtggtttaattgaactcaatagcgcccgaaaaaagcatcaacaaacagttcttgaaggtacccacctttgtctagcttggctacaacaacagaaaaaactcttttcattgtttacgactgaacaagccttagaacatcccgatttaaagaaaatcattgaacttcaccaaggtcatgtctttattattagcgaagttttatataaagacttaagtactttaggtaacactcttccttgcttggctattatcgatttaccgaaaactgcatcaaccattgactatagcgtagatacgttaattctagaaaatgtacaagatccgggtaacgtaggtacattgttacgttcagcggcagcagcaaatataaaacagattatttgcacacaaggctctgcctcactttggtctccacgagttttaagagcaggtatgggggcacattttagcctgtcttgttttgaaaactttcaattgaccgatattcttcctaaatttgatattcctgttttcgttacaagctctcatcgctcgactagcctttattcaaaagatctttcaaaaccatgtgtttggattttaggcaatgaaggacaaggtgcaagtgattatgctttagaacatgcacaatcagtgactataccgcagccaggtggtcaagagtcattaaatgtagcaattgcaggatcaatttgtttttttgaaatggttcgccaacgccaataa

SEQ ID NO: 2222 - DNA, 831 bp, Acinetobacter baumannii
ataaaggacggattgagcatgtggtgttttaaaaatggacaacctgtagagaccattcctttattggaccgggcatttcattatggggatggctgctttaccacaattcgtgtttttcaaaataagattgagcttaaagcacggcactgggaacgtctaaaacttgcttgccaaaaattatctttggttgcagattttgagttaatcgaacaaagtttgcagcatctccaaaatcagaatctcgtgctcaacgggactttaaaaattgtgattagccgtggtgaaggtgatcgtggctatagtttgccaaagcatgcggcagatatttatatctggttttatccaaaagcattggagcagttccagccagattttatacagtgtggtgttttaaatcagactttaggtttaaccatgccgagtttagttgggcttaaatccttaaaccgtcttgagcaggtattgctaaaaaaagaagcagatcaacaaggctgggttgaagctttagtaactgatgtacaaggttatattgttgaaggggtaagcagtaattgttttattcgtttaaatgatagatggattactccggaacttcgctataatggcgtccacggtgtgatgcgtgcagaaattttggcgcgtatgcagcactacggaattgcctgtgaagtcagaataattgagctagatgaagtaccacaaatacagagtctattctttcgtaatgctttacatccaatgcgagtagttactcaaatcagtgaacaaattctagagtcacaggcgtgcctaaatttatttcatactcttaacttgaatcagattcattaa

SEQ ID NO: 2223 - DNA, 315 bp, Acinetobacter baumannii
gtaaaaaggggtgtcattagcggacgttttaaattgatgcgaatggacatgcctaatcaacagacaattcaccactttgacgtgattattgtgggcagtggcggtgctggtttaagtctggctttatcgttaccaagtcattttaatattgcagttttggctaaagctgctttaactgaagcaagtaccttctatgcacaaggtggtgttgctgcagtacttgatgaaactgactctattcaacaacacattaatgacactatgattgcaggtgctcatttatgtgaaatggatgcagtccagcatactgtataa

SEQ ID NO: 2224 - DNA, 735 bp, Acinetobacter baumannii
gatttttttatggctgcattgcttggtgtaaacatagaccatgttgctactttaagacaggcgcgcggtactgcttacccagaccctgtagaagctgctcttatttgtgaacaagcgggtgcagaggggattactttgcatttgcgtgaagatcgcagacatattcaagatgatgacgtgcgccgtatgcgtccattattaaaaacacgtatgaatcttgaaatggccgtaactgatgaaatggttgagtttgcgaaagaaattcaaccgcaacatgtgtgttttgtaccagaacgacgccaagaagttacaacagaaggcggtttagatgtagtaggtaactttgaaaaagttaaagctgcaactcaagctttagctaccattggttgtgatgtttcactctttattgatgctgattttgctcaaattgatgcagccattgcttgtggagcgcctactattgaattacataccggggcttatgcagatgcaacaacagagcaagaacaacaagaagaacttgctcgcattgtaaaaggtgtggaatacgcagcttcaaaaggtttggttgtaaatgctggtcacggtttgaatctgaaaaatattgctccaattgcggcaattccacaaattcatgagttaaatattggtcactcaattattgcggaaagtgtttttgttggactagtacaggcggtgaaagacatgaaaacagcgattcaggcagcaggataa

SEQ ID NO: 2225 - DNA, 426 bp, Acinetobacter baumannii
gtaaaatttatgaagttgttaaaatcaaatcttattctttcatctttattctcagcagctgcacttatggctggttcagctcaagcagctgaaaacccagttcaagcagcatataaaagcactaacgttaaaggtgcattaatcaacgtttgtaaagaccaaactgcaaaaggcggtaaattaagttcagctgaagtaagcaaattctgtagctgccaagttgaagcgcaaggtaaagtgactgaagcacaaaagtgggaaattcaaagcgcaatcaatgcgaagaaaagcccaagctctttagcttttgtacaacagcaaaaccgtgaccttaaagcatgtttcggtcctcagttaacaactaagcttgagaaactaactgaagaagcaatgaaagcagctcaacaacaagctcctaaaaaataa

SEQ ID NO: 2226 - DNA, 528 bp, Acinetobacter baumannii
tcgtgcattatttgccgaagagatgattgctttattgcaacgtcaatctgtgggttcgtcacaggaagatgcataatggccattcaacgttcagggcgctttgagcgcataaaaaaaccattaaaaagtgacatgaacgtcgtgccttatatcgatgtgatgctggtacttttagtgattttcatggtgactgctcccatgattaccagtggtattaaagtcgatttacctcaggcaaataatcatccaattgaatcaaaagatatgccagccatggtcacgattggtaaagatggcaatatttaccttcaatatgaagattacaaagataatgagccactttctcttgaaaaacttgagtctgttttaagtgaagcacaaaaacaagctgagcaggaaaacaaacaacttacagttttagtgaatggtgataagactcgcccttatggagaagtcgtatcattgatggcaagtttacaagaagcaggtttaactcaagttggccttctgacagagcctttaaaataa

SEQ ID NO: 2227 - DNA, 189 bp, Acinetobacter baumannii
gttcgagttattttaatatttttatcatacgccaaattaaaatggctgagcaatttatgtgcgtgtaaaaaagcgagtattcaactcgcttttttgttactcaagcttattaagctgtttgtaatgcttttaaatcttctaaaacctgttcagcatggccagctgctttcaccttacggtaacttttaa

SEQ ID NO: 2228 - DNA, 609 bp, Acinetobacter baumannii
aattacgctatgatcggatgtttaattggcgaagtgtttgccctagaagccccaactgtcttactgaatgtaaatggtgtgggctatgaaattgatacaccactttcaacattttgccaattacaaaaaggccagaaagttacgctatggacgcatttggtcgtccgtgaagatgctcagcagctttatggttttagtgatgctcaagagaaaactattttccgcaccttactaaaagtaaatggtgtgggcccgaaaatggcattaggtattctttctacgttaagtgttgaattgctggtacacacaattgaacatgacgatgtgaatactttggttaaagttccgggtgtaggcaaaaaaacagctgaacgtttaatgattgaacttcgtgaccgttttaaaactttggcacaaggaacttctagcgcggcggccctgcctcagattcaatttgtttcgaactcacctgttgcagaagcagaagcagccttacagtcactaggttataaacctcttgaggcacaaaaagctgttgcggcggttaaagccgattacactgaatcagccgatattattcgtgctgcacttaaatcaatgatgaagtaa

SEQ ID NO: 2229 - DNA, 693 bp, Acinetobacter baumannii
catggatatatgattcaccatcgtaaatatcgtgaaaaaagccatattgtgcatctcttcactcaagaatatgggcgggttgatggtattttaagacagactccgcctcctcaatatcagccaatccgtttgcaagccacaggcaaaagcgagctcaaaaattttacaaagctggaaatactaaatcagccggttttcttttttggcgatgctttttttgcagggttctatttaaacgaaattgttcttagactttgcccactagaagaggcaatgccacaaacttttgaacaataccagttaacgctgcttcaactccagcagctatcttctcatgaaaatccggatttatttcttagacagatcttgaggcaatttgagcatatcttgcttgcagagctgggctatgcgattgatttctcaattgatagctcacaaaaagaaattttgcctcaacagttttatcagtttcaagtgaatgaaggatttgcccccattgttcaggcaagtcgctcatcgttgtcaggaaaagcaattttatccatgctggattatgagcagggacaggatttttctcacgaacaattgcaattattaggtaaactataccgtcaaatgattacatcgcttttaggtgaccgtcccctaaaaagtcgacaattgtggattcaaaatactcaaactcaatcgtaa

SEQ ID NO: 2230 - DNA, 1344 bp, Acinetobacter baumannii
gataaggatatgtacaaaaaagctgctttaatttttccacttgccctaataagtcaattgagcctagcggattgggtaaaagatgctacacaacaaaatgaaaatcaggtcattcaattaagacaacacatccatgagtaccctgaactaggcaatatggaatttaaaacatctgcattggttcaaaaagaattaaagtcttatggcattcaagtcaaaacaggttatgcaaaaacaggagtaatcggcattttaaaagggaataaccccggccctattattgcgcttagagcagatatggatgcgctacctatggaagaaaaaagtggtgtgccatttgccagtaaacaaaaggcaatttatcaaggtaaagaaacttatgtgatgcatgcttgtggacatgatgcacacactgcaatgttattaggtgcagcaaagatattggcggccaataaagataaaatatcaggcactgtagtttttgtatttcagcccgctgaagaaggtggagcagatatcgataacttcacgcatggtgatcaaatcggctcaagaaaaatgattgcggatggtgcatttaaagactacaaaccagaagctatttttggcatgcatgtcatgtccggcatgaaaagcggacatctatattataaagatggtgctattttaaacagtgccgatcacttacggattcaggtcaacggcaagcaggtgcatggctctaccccttggttaggcagagatccaatttatgcatcagctcaaatgattaataatttacaaagtcttattagtcgaagaaccgacttaacccaaggtatgggcgttattagtattggcaatattcaaggcggtacagctggaaatgtgattcctgaacaggtcaatatgatcggtactattcgatccaataacgaacagatccgagaaaatatcctaaagagcttaccagctctggtggaacataacgctcaagctaatgaggtaacagcaaaagttgaaattgcgccttatgctccagtaaccatgaataataaagctcttactcaacttatccagccaacattagccaaaactgttggagattcgaatcttcatgttttggaccataatgcaagtgcaagtgaagattttgcctattatgggaaattaatgccctctttcttcgttttcttaggagcaacacctgaaaatcaggacttaagccaagctgcaccaaatcacaacccttcttttatagtagatgataaggctttaaagacaggaaccgagctacatataagattcgttttagattatccgaatatcgctaaacaagttcaggctgcatggaaacagtcttaa

SEQ ID NO: 2231 - DNA, 858 bp, Acinetobacter baumannii
tgtaaaatctttaaaattttttatggaaggaagatcatgtctcagctttctacgatcattgagcaagcatttgaagaccgcgcaaatttcactgcagcagattgcccaagcgaaattcgccaagctgttgaagaagcaattgctggtttagataacggtacacttcgagttgcagaaaaaatcaatggtgaatgggttgttcatcaatggttaaaaaaagctgttttattatcatttaaacttaatgacaataaaccaatcgagtcatgtgatcttcgtttctacgacaaagttgaaactaaattctctggttggactgaagagcaatttaaagctgcgggtgttcgtgttgttcctcctgctgttgctcgtcgtggtagtttccaagctaaaaatgtggtgttaatgccatcttatgtcaacattggtgcttacgtagatgaaggcacaatggttgatacatgggcaactgtaggttcatgtgctcaaatcggtaaaaacgttcacttatcaggtggtgttggtatcggtggtgttttagaaccattacaagctaacccaaccattattgaagacaactgctttatcggcgcacgttctgaaatcgttgaaggtgttattgtcgaagaaggctctgttatttctatgggtgtttatatcggtcaatctacacgtatttatgatcgtgagactggtgaaatccattacggccgtgttcctgctggctcagttgttgtaccaggtaacttaccgtcagctgatggtaaatacagcttatacgctgcaattatcgtgaaaaaagttgatgcacaaacacgtgcaaaaacaagtttgaacgatttgttacgcgctgactaa

SEQ ID NO: 2232 - DNA, 1086 bp, Acinetobacter baumannii
atcagattcattaatatgccgaagccacctgtgaatgcgaaagcaaaaaatgctaaaaaaaagggcaagaaaacagcatctaattttccaaaaaagttagtgctgattggctgttttatcgttttaatttctatttttgctattttatggtcaagtttatttaaagcttatcctattgaagggaaaaagcagatgctatcgatcacatcaggtgagacctattctggttttattgatcgcttagccaaagaaaataaaatccatttcccaattgtacttaagctttatcaaaagtttatgattcatgacagtatgaaagctggtgtatatgagatagagcagggaatgagcgtaagacaagtattagagatgttatctgatgctgataatgcccagatgaaccgtgttctagtgattgaaggaacaacttttaagcagctgattacagcactaaaaaacgataaaaatgtaaaaaatacgatattggatttaccagatgaccagcttatgaaggctttaggtattccttatcatcatcctgaaggcctgtttgcacctaatacttatttctttgctaaaggtgagactgataagaaaatcctgaccgatttatatcatcgtcaaatgaaagccttagatacggcttgggcaaagcgggcgccaaatttaccttataaagataagtatgaagctttaatcatggcttctattgttgaaaaagaaacgagcctcgatagcgaacttacacaagtttcaggggttttcgtgcgccgtttaaaactcggtatgcgtttacagactgatccaaccgtaatttatggtatgggtgcaaactataagggtaacattactcgcgaagacttacgtacaccaacaccatataatacctatacaattaatgggttaccaccaactccaattgcgctgccaagccaaaaagccattgaggctgcgttacatccagatgattcaaataacatctattttgtagcgactggtaatggtggacataaatttacggcagacttgcaagcacataaccaagcagtgcaagagtatttatccgtgttgagatcgaagaaataa

SEQ ID NO: 2233 - DNA, 843 bp, Acinetobacter baumannii
ggaaatatcatgtcgcagcgatcccgagtgctgcctgggtttggtctatcattgggcttcaccctcgcttacgtttcttttattgtgcttattccattagccgcagtctttatcaaatcatttggaatcggatgggacggactatgggaaattttaacctctgagcgtattttaaaatcgcttcaactcagctttagttcagccttaattgcggcgtttattaatgttgttttcgggctacttttagcttggtgccttgtccgttataactttcccggaaagcgtctggttgatgccttagtggacttaccttttgcacttccaacagcagttgcaggtattgcgttgacctcactctatgcgcctacaggctggattggtcaatatttagaaccacttggtattcaggttgcatatacccctatcgggattacgctagctttagtgtttatcggcattccttttattgttcgaaccgttcaaccggtattaagcgatattgaaactgaacttgaagaggcagcttccgcactcggtgcaaatcgttggcagaccattaccaaaattattttaccaatattactccctgccctatttacaggctttgctttagcatttgctcgcggtgtaggtgaatatggttctgtaattttcattgcaggtaaccagccttttaaaactgaaattgctccgcttatgatcatttctcgcctcgaagaatatgactatgcaggtgcaacgactattgcagcagtgatgttggttctctctttcattattttatttgtcattaacttacttcaagcatgggcaaaccgtcgtacagggagaaatgtcacatga

SEQ ID NO: 2234 - DNA, 1341 bp, Acinetobacter baumannii
atggaacaaatgcgttggttagaactgctatctgcagttcgtttaggtagtaaaaaaagcagtacagagctggctcgaagcccatttcataaagattatgaccgcattatattttcacaaagttttcgtcagttaaaccgcaagactcaagttcatcctttagcacagcatgatggcattcatacccgtttaactcactcgcttgaagtttcctgtattggccgttctatgggcatgctggcagccgaaaaaattaaagatgaattgcctgtctggatttctcctgccgatgtcggtgcaattattcaagcggcctgccttgctcatgacattggtaacccacccttcggtcatgcaggtgaatatgcaattcgtgaatggtttgacgatgcctcacataatgattttttaaaaaaattaactcccgaagaagaagccgatgtccgtcagtttgaaggcaacgcccaaggattacgcttattaacccgtattgactatcatccagatgatggaggcatgcgtttaacttacgcgaccttaggcgcttatttaaaatatccttggctttcaaaaacaatcgcgtctcaaggtgatcgtccatcccaccaacgagcgaaatttggttgttatcaatctgaaaaagaaattttaaaacaaattgctgagcagctcggacttattcaattaggtgaatatcactactgccgtcatccacttacctatttattagaagctgctgatgatatttgctatgccctcatcgatttagaagatggcattattctaaatatgctgaattaccaagaggttgaaccaatttttctgaacttgattgcagattatggccaacctgaagagctatcactcccaagtagcacatggcaacaaaaaatttcggcattgcgtggccgtgttatgaagcgtctggttgatgaagtcactacagcttttgccaaacatcattatgaaattattactggtcagctcaaaggtagtcttttacagtactgttcgcctgatattgcggcaggtattgaaacagccaaaaatctggcacgtgcaaaaatctttgaacacccacaaaagtctggtttagaaattattgctcaccaaagtttgcaaactattcttgatgcatttgttcccttaacgatgccgcataaatctttaagctttaaagaacagcgcttaatgtctattcttaatttgtacggtgctcgctttagtaataaccactacagcaatatcatgcaggtactcgatattatcagtaagttttcagatcatcaggcttatagcttggctcaagagctacaaggtaataaaatcggcttgttttaa

SEQ ID NO: 2235 - DNA, 1215 bp, Acinetobacter baumannii
agaagaaaaatgaagtcaaaaatccatttccgtgagtttgcactgttgatggcattactcatgtctatcgtgtctttttcgatagatgcggtgttgcctgctttaggtgaggttggacgagtttttgaattaaagaataataatcagacccagtgggtcattattggtattttctccggcatgacaatagggcagttgattgcaggaccactttccgatgcgattggacgaaaacgtattttatttaccggtattatcatctactttttgggaagtttattgtgctttaccacacaaagttttgaatggtttttagtaggtcgctttattcagggtattggggtttcaggtccttatgtcgcctcaatttccattgtgcgagataaatacagcggtgctcagatggcccgtattatgtccttaatcatgatggtatttatggtcgctccagcgattgcaccaagtctgggacaactcattattcacttctttggttggcgtgatatttttgttttatatatgatctatgccacagttgttggagcgtgggtcgctttacgattagaagagacgttacttcctgaaaatcgtttacctatgcggttacaagcatttcaagatgggttcaaagaagttgtaagtaataagaccaccatgagctatttgttatgtgcaggcttttgctttggtggatttattggttacttaggtacttctcagcaaatttttatgcagcagtttggtaaaacagggcaagagtttagtgcttattttgctgtgcttgctggtgtaatgggcattgcttcatttaccaattctaaaattgtcatgaagtttggtatgcgtccaatctgtatttatggctttctcggtttgtgcttaatttcattaattttcttagggattcaacttataggtgtgactgtagcattttggatgtttatgctttatgcctgtattttatttttattatttggaactttatttggtaatttaaacgcgattgcaatggaacctatgggacatgtagctggtatggcatcagctattattggtgcagcttcgtccgtattgtcacttattcttgcctctattattgggcaattatataacggcacactaattccaatgacttgcggttttgtcattttatgtggtttagcatttatgatgacagtatatgagaacagatatttaaagaaatcgaatgtttaa

SEQ ID NO: 2236 - DNA, 609 bp, Acinetobacter baumannii
ggaaaagagatgtttattagctttgaaggcacggaaggggtaggaaaaactacactcattcgaaaaattcatcagcattttgaagaacaaggtaaacaagttgttttaactcgagagccgggtggaacatcgctcgctgagcaaattcgttcgatgcttttagcagtgaatcatgatgaaaatatgagtcatgataccgaactgctcttaatttatgcggcacgagctcaacacttacaacaagttattttgccggcattagagtctaataaaattgtattaagtgaccgttttaccgatgcgagttatgcttatcaatgttccggtcgtggtttaagccaagacaaattacagcttttaaaccagaacttcgtttcacgtatgccagaagtgactttttggttagatgcaccgattgaactcggtatgaaccgtgcacgtgaacgcggagctttagaccgttttgaacaggaaaagttaagcttctttactaaggttcgtgaaggatatgaaaccttatggaaagctgagcctgagcgtattaaacgtttagatgctacacaaagccctgatcaggtgttcgagcaagctttacaatatttagcataa

SEQ ID NO: 2237 - DNA, 330 bp, Acinetobacter baumannii
gtcattctattcatgttaaagctgatttattacgtacctgagtcacatcttgagtcgactaaacagtctatatttgcggccggagcaggtgggatagggaactatgaacaatgtgcttggcaagttaaaggaatagggcaattcaagccagttaaaggagctgacccttatataggagagctaggtgaacttgaacaagttgacgaatggcgtgttgaaacgatcgtgcttgaagaaaaggcaagtgcagtggcaaaagcattaaaggcaagccatccttacgaagagcctgcctttgagtttattcaaatcatagaagttgatttttaa

SEQ ID NO: 2238 - DNA, 726 bp, Acinetobacter baumannii
tgtggtatttctagaatggcttccttacgttcctctgcaattcctgtctctgaccctgcgtccggtctacgcattaccgagattttttactccttgcagggtgaagcaaatgcctctggcctaccgactgtatttattcgtctcacaggttgccctttacgttgtagttattgcgacaccacttattcttttgaaggtggcgaacgcctatcacttgagcacattattgaaacggctgaaaaatatcaaacgccttatatttgtgtaacaggcggtgaaccacttgcacaacccaattgcttaattttattacaacgtttgtgtgacgccggttttgacgtttccctagaaaccagtggtgctcttgatgtatcaagagtagatccgcgtgtttcaaaagtcctcgacttaaagaccccaacttctggtgaagaacaccgtaatctcatcagtaatcttgaccatttaacaccgcgtgaccaaatcaaatttgtgatttgtaatcgtgaagactatgaatggtcaaaacaacaagttgaacaatatcaactgcaaaccaaagtcagtactgtctggttctcccctgcttttgcagttgaaaaaggtgctgttggcctgccacgtttagcacgtgatctggcacagtggatactggatgacaaactgcctgtacgtttccagcttcagttacataaactgctctggaacgatgaatcaggtcgctaa

SEQ ID NO: 2239 - DNA, 1536 bp, Acinetobacter baumannii
ggtatcggctcaaaaaaccatttgcttctttttcaaatagcttgtatatacatgtttgtatttgtttatacaaaaatggatctaataatagaaaagctcttaaaggataaggagagtgttatggactcatcagctgggaaatcgaaaagcggatttgttgaaaaccgaagtattgactttattcctgaaaatgaaaggcatggcagtatatttgcccaatttacgctttggttcggggccaatttacagattacagctattgttacaggtgcattagccgtcgtattaggtggtgatgtattttggtcaatcattggcctctttattggacaatgctttggtgctgccgtcatggctttacacgcagctcaaggtccaaaactcggcctcccacaaatgatttcgagtcgagtccaatttggggtatatggtgcctgtatccccatcattcttgtttgtcttatgtatattggctttacggccactggtgaggtactcgctggtaaagcaattgctcatctagcacaggtgagtaatacaacaggtattttaatctatgcttgttttattattatatttgcgacaattggctatcgtttaattcattgggtaggcaaagttgcaagtgttattggtttaattgcttttgttattattttaactcaaattttagctctctctaatatttcagaattgcttgctgtacggcattttagctggtcatcatttttattagcagtttctctttctgcttcttggcaaatttcatttggaccttatgtagcagattattctcgttatcttcctacaaaaacctcttcaacacgtgtattttgggcagttgggcttgggtctttaataggttcccaaatttcaatgatgctcggtgtattcattgctcaagtctcgaatggtggttttgttggaaatgaagttcagtacgttgtaggcatgaatccaatcgctcttgtgattacttttttatattttagtattgcattcggaaaggtcactttatctacacttaatgcttatggcagttttatgtgtattgctaccatttggaacagttttaagccaagtgctcaaatttcaaaattaacgcgacttacaattgttcttgcaatggtaattatctcaacatttattgcagttgtaggtgaacatacttttttaagcgcattcaaatcttttattttgttccttcttacatttttcattccttggagtgcaattaatttagttgattactattttatttctaaagaagaatgcgatgtaaatgccttatatgacccaaatggtaaatatggccgctggaacacgattggaatcgcttgttattgtattggtatcttacttcagttgccctttattgatagtaaattctataaaggacaaattgccgaaatgttgggtggagtcgatttatcttggctagtgggattgttatccactgcagttttatattatgtacttgccaaaagagctcaaataaaaatttcaaaagctcttcaacttgaacgagtaaaataa

SEQ ID NO: 2240 - DNA, 273 bp, Acinetobacter baumannii
cggataggctcaccttcagcaatatgccctgcaataattgcttctctaatatatttgacaataacttcagataccgaaggcattgcaccaagatttgatacattaaaagatggtagcgtcacgaatattctcttaacctcaaaatatgacacaaacaaaaggatgataattttagtcatccaccataatgaaattattgctttgaaagcatcattttcggtacgacttatccttcatataaagcttttaaaaactatttttatatcactataa

SEQ ID NO: 2241 - DNA, 483 bp, Acinetobacter baumannii
caattgagattgaggagggtaaaaatgccaaagtatttagccgtggctgaaaaggtttataagaatattaaaaaagacgacttattcaccaatgaccttacacaaaatctgaattgtttaatcagtcagatacgtaaggccattaaagggactgagtttaaacttaagttcaattatattgattttgacgagcagctcacgaagcctcttagtgaatgtaaagtcaaagttgatctaagtgtaatgccgaagtttgaaaacgaaggagagtatttgctctggttagcaagttttatcgagcgaattaccgatggtggaaaacctaaatttccaccaatttcacaattaattccgcacggatttaaaatttctaaagaatcatttcctgtgactgttgctcctcctaaagaagagcatgcagatatgattattaaatattttaaatcggaagattttatgaaaaccaataaaactccttcgtaa

SEQ ID NO: 2242 - DNA, 498 bp, Acinetobacter baumannii
ggaaacctatccatgagtaacatttatcagtttgaagctgaattgttagagggagatattaaacaattcgctgattacaaaggtaaagttttattaattgtaaatactgcaagtaaatgtggttttactccacagtttgcgggcctcgaaaaactttatgaaaaatataaagaccaaggtttagaagttttaggttttccctgcaatcagtttggtgggcaagatcccggaagcaataaagagataggtacattctgccagcgtaactatggagtgaaatttcctatgtttgccaaagtagatgtaaaaggtcctgaagctcatgtgatctttagatatttaacccgtgaagcaaaaggaattttaggaagcagtactattaaatggaactttaccaagtttttagttggtaaagatggttcggttttaaatcgttatgcgccaacaaccaagcctgaagcattggaagctgatattgaaaaagcattagcgagttaa

SEQ ID NO: 2243 - DNA, 1326 bp, Acinetobacter baumannii
ttttcgagattttttataacagtcagattttattatctttttatcttaaaacttctgcaaatattgagatttggacaaatctttttctggtttatacatgacgcaaatttaatttttatttttaagaggagaaaaattcttttgtttaaacattctcaaattttgaaaaaaacattaattacaacgtctttaattacattcagcctctcaagtcatgcagcgcttacctttggcaatgctgaagaaggtcaacttaaagtaagcggtactgttcgagccaaatatatttatgattttgactctgaaccgtctaccagtaaattttcctttaatgacgccgtattatggttagattacaactccccgaaatggattggccgcctagattatcgggtttatgaatattacgggcatttaggtgatgccaattggcttaccgatgcgtggttgggttataaaattaatgacaaaagtaaaattattgctggcttaaaccccgttccttttggcttgggtcgcttttggggaaatacttattatttaggcattgccaatagtaccggttgggaagatgtacacaaccttggggtgaaatatgatttcaatgatggaaccaatgaagcacaactcgccttttatcctacagatggtggcacctatagaggtaaaagcaaagactcgagtcgttttagtatcaaccctgtcaatgcagatgactctgtaccgcaaggcactaataccaaagaaaagaactcaattgttgttcgcggtgctcatacctttaagaatatcttaggccaagaaaatttctctactcaacttggcgcctccgcatggtattccaccattgaaaataagcgttcagggcaagatggcgatcgccaagtttattcggtttttagcaataccaattacaaccaatggaatttacagcttttggctggttatcaagacattgataatgccgacacccaatataaagatcatctgactttgggcggtttcgattattcatttaactcggcaaccaaaggtcagatttattcagcagaactgagctatttatttcctcagcagtttggccccattacctctgttcgtccgtacttgaactatagttcttatcgaaaagagcaagatggttttaaagactctacccgttttattcccggcattgcctttaactatcaaaaattgacagtacaagccgagttgctgatgggtaaacacgatccatatctaggagacagtgaaggccttgcggctggtggaagcaatgataaatggaataaaaaagcatttgtgatttttgcttattacttctaa

SEQ ID NO: 2244 - DNA, 897 bp, Acinetobacter baumannii
tgcattggattcataccaaagcgaagtttctcaatattcgtaatttctggaaatcttatgagtttgtttgacgacaccgccgtgtcaaaacaattagcacaagtgcgtattgtcatggtcaataccactttaccggctaatattggcagtgctttacgcgcaatgaaaacgatgggcttgagtaagttggttctggtttcaccaaaaacatatccacatccagatattcaggcgcttgctgctggtgcacaagatttattagaacaggttgaaattgttgaaacactcgaagaagcaattaaagattgccatttagttttcgggacaagtgctcgaagccgtactattccatggcctttgttagatgttcgccctgcttccaaagaagcaatcaaggcagctgctcaaggacaacaaattgcgatcgtttttgggcgtgaagatcgcggtttaaccaatgaagaattggctttggcaaattatcaccttactattcctgtaaactcggactatggtgtacttaacgttgctcaagcgattcaagtggtttgttatgaacttcgtatgtcggtattagagcaaaaagaagttgcttctgatgctgggcaaatgccgcttgctcaaggtcaaagcatgcaatgggatgagccgttagtgactcagcagcaaatggaagagttctaccctcatttggaaaaaatgctcaccgaaattgaatttttagatccagaaaatccacgtttactacctttacgcttgcgtcgtttatttggtcgtatacaattagatcgtatggaatatcatttacttcgcggtatttttagtcgagtccaagccctcacaagcggcaaatggaaaaaagcatcatcggacaaggaggatcaatccaatgcttaa

SEQ ID NO: 2245 - DNA, 1506 bp, Acinetobacter baumannii
ggacacacatccattatgagttattttgatcccaccctcatcatgtttatggtgtacatcgtagcaatggtacttatcggcttatttgcctaccgtgctacaagcgacttctctgattatattcttggtggtcgtagtttaggcagtttcgttactgcattatccgcaggcgcatcggacatgagtggttggttactcatgggcttaccaggagcgatttatctttctggtttatctgaagcgtggattgcaattggtctaattatcggtgcttggcttaactggttactggttgctggtcgattacgcgttcatactgaaatccaaaataatgcactcactctgccagactattttacaagtcgatttgatgaccagaaaaagatacttcgtattttctctgccgttattatcttggttttcttcgctatttactgtgcttcaggcatggtagctggtgcccgtttatttgaaaatttattcggtatgtcatataccaccgccatctggttaagtgctattgcaacaatcagttatgtttgtattggtggtttcttagcaattagctggactgatactttccaagcgggcttaatgatttttgccctcttgctcactccaatcgtgacttacctcgcaattggtgacacaactcagtttgtgacgcttattgaaactgctcgtccacatgcatttaacatcatttctgatttaagtgtggtggccgttttatcttccatggcttggggtttaggctattttggccaaccgcatatccttgtacgtttcatggctgctgactctgtaaaatcaattcctgctgctcgccgtatcggtatgacctggatgattttatgtttagtcggtgctgtcggtgctggtttctttggtattgcttacttccagcaacaccctgaacttgcaggtgtggtaagtaaaaaccctgaaactgtatttatggaattgactaaaattttattcaatccatggattgtcggtatcattctagctgctattttagctgcggttatgagtacattaagctgtcagcttttggtatgttcaagtgcactaactgaagatttgtacaaaggcttcattcgtaaaaatgcatctcaaaaagagcttgtatgggttgggcgtatcatggtgcttgcaattgccgttctagcaattgtgcttgcgggtaaccctgacagtaaagttcttggccttgttgcttatgcttgggctggttttggtgctgcatttggaccactcatcatcttgtcattgttctggaaacgtatgactttagaaggtgctttagcaggtatgatcgtaggtgctgttgttgtaatcggttggaaaaaccttttcgcaagcactggtgtttacgaaattattccaggctttatctgtgcatttatcagcatcatcgtagtaagcttgatcagcaaagcgccaaactctgatgtgactggtcgctttgagcaagcagataaactctataaagaaagtacataa

SEQ ID NO: 2246 - DNA, 543 bp, Acinetobacter baumannii
tcaatggcatcgtatgcattgttagaacaagcacgtcatttgcaggcattggttctggatgttgatggtattttaagtgatggctttgtgacattaaccaacacgggcgatgaaattaaatcattcgacattcgtgatggtttgggtatgaaacttgcgcaacaagcgggtatgaaagtcatcattattactgggcgaaaaagtaatatcgttgaaaaacgtatgtccgatttaggtgtcgatctggtgttccaaggccgtgaagataaaggttcggcgctacgtgaagcgtgtgcacagtttaatatcctgccttcagattgcttatatatgggtgatgattggccagatctttcagcatttgccattgccggaatgagtgttactgttccaaacgggcatgaggaagtgcgccgtcgtgcggatttggtaacacaggcgatgggtggccgtggagctgtgcgtgaagtttgtgatatgttgctgatcgcaaaaggcatttaccaagaacttcttgaaaaatatcttgcagtaccgcattaa

SEQ ID NO: 2247 - DNA, 3894 bp, Acinetobacter baumannii
aatagaggattgttgaattttcaggaaaatttatctgtgctgaatggtttaaatatagatcaatgggtgatggcgagagatcgttaccgtttaaatcgtttacgtaaagataaaaaagccaatactgcagagattgaaaaattatttgaacagtctaatgcaaaagttagacagcgtttggaacgcttaccaaaaattaaattaaatcaggaacttcctgttacccaatatgctgaccgtttaatagaagcgattcaaaagcatcaggtcattattgtggctggtgaaacaggatcagggaaaactactcagctccctcaaattgcaatgttagcagggcgtggcttaacgggcatgattggtcacacccagccacgtcgtttagctgcacgtagtgtgtcgcagcgtattgcagaagaagtcggcgaaaagctcggcgaatcgattggttttaaaatccgttttaatgaacaaggttcgcaagattcgattgtccggttaatgaccgacggtattttgcttgccgagttaggcaatgaccgcttcttgtctaaatatgacaccatcattattgatgaggcgcacgagcgctcactcaatatcgattttattatgggctatttaaagcagttactgccaaaacgcccagatttaaaagtcatcgtgacttcagcaactttagatgtaaatcgttttagtaactactttaataatgcaccaatttttgaagtagaagggcgtagttatccggttgaagtgcgttatcgcccaatttcagaaatgaatattggtggtagtgatgacgacgagttcgatgactttgaagaaaacctgccgcgtgcagtcgtacaagccgtagaagaatgctttgctgatgccgaggaaaaaggccatccagaacatgcagatattctgattttctcaagcacagagcaagaaattcgagaattgcaggaaaccttacaaaagtacgggccgagacataccgaaattttacctttgtatgcacgcttagccgtttctgagcaacaaaagatttttagcccaagtggaaagggccgccgtattattattgcgacgaacgttgcagaaactgcactgactgttcctaatattcgctacgtgattgatagcggctttgcacgtatatctcgttataactaccgttcacgcgtgcaacgcttaccgattgaggcaatttcacaagctgcagcaaatcaacgtaaagggcgttgtggtcgtgttgctccaggtgtgtgtattcgtttatatagcgaagaagactttttaagtcgtcctgagtttaccgaacctgaaattaagcgaaccaacttggcatcggttattctgcaaatgcagagcttaggtttaggtgagctggaaaactttgatttcattgagccgccagatttccgtctagtcaatgatggtcgtaagctactcattgagttaggtgcgctgaacgagaagaaaaacgaactgaccaaagtcggccaaatgatggcacgtatgccgattgattcaagactcgcacgtatgattgtgggtggggctcattttggtgtactcaaagaaattttggtggtggtcagtgcacttgcagttcaagacccgcgtgaacgtccagcagataaacagatgcaagctgatcaaaagcacgcattattcaaagaggcagattcagattttctgttttatttaaaactttgggatactttaaatcctaaaggtgaagcaggaatgtcggaaaacaagcgtcgtcaatttgctaagcagcatttcttaagctggttacggttacgtgaatggaaacagacacaccagcagctagttgagctggccgaaggtttaaaacttagttttaatgaaaagcctgcaaattatgaaaatttgcaccgtgcgttactaacaggtttattgtcttttattgccaataaaactgatgaacgtaatacctttatggcagtacgtcagcaaaaggcaaaagtttttccggccagcacattgcacaaaaccaatactgcgtgggtgatggcttttgagatggtggaaacctctcaagtctatttacgtacattagcaaaaattgatcctgaatggattttgcttgctgcacgcgacttattgaaatatcactatttcgagccgcattggtctaaaaaagccggtattgtaaatgcttatgcacaaatttcattgtttggtttaattattgaaccgaagcgtttggttaattttgagaaagttgatcaacctgctgcacatgagattttcttacgtgatgcattaaccacaggaaatctgggtacagttccaccatttttaaaacataacttgcttaaacttgaagaagtagagcgagttgaagataaattacgtcgccgcgatttggtggtcgatgaagaaacgatttatcagttctatgcggcgaaaattcctgaagaaattgcgagtcgtcgtagttttgaagactggcgggcaactgtagaagcaaaaaatccgcgttatttatacgtggaagatgatgcgctttggctcaatgaccgtccgaccacacagcaattccctgatcatttacataatggccagttacgcttggcaactacttatcgttttgacccaagccatgatgaagatggcgcaacggtccaaattccggtacaggcattgcctcaggtagatgaaaatatttggtcgtgggggattccaggctggcgtttggatttaattgaagccttattgaaagccttaccaaaagataaacgtcgtaacctcgtaccgattccagatacggcgcgtaagctcatgcaaggtattgatgctgtacatttgcgacaacatatctttagctatctggcgtttgctttacgtggtgagcagattacggaaaaagatttttcatttgaacgcatagatccgtatttggtgccttttattaaggtgattgatgaaaaaggtaaattgatcgccaaaggccgtgacttggctgagttgaaggctcgttgtcgcgtagaaacgcatcgtccggtgaaacagcaaaaaggtgaatttaaaaccttccctgaaaactttacctttgaagcttcacagaaggtgacaggtgttgttgttaaacaatatcaagctttagtgtcaactaaaacttttgccgaacttgaagcgaaagatgagtccggcgtggttatacaaacatttaacgatcaggcagaggcgattaaacagcatcgagaaggtattattcgtctagtccatatgcaacttggcgatttggttcgccagttgaaaaagcagatttcaaaaccgcttgcgttggcttattcacctttaggtgataaagctaaacttgagcaaatgctggtatacgcgactttacaaatggcaattacgactttgccaatcaatgctgatgaatttaatcaactgctagaacaggtcaaaaaacaatttttgagctatgggcagcaagcacttgagcaattaagtgatatttatattcagtggcaacaaatccgtcgtcaacttttagtacttgatccggacgtatttggacgcagtatcgatgatattgaagaccagttagatttaatgtcacttggcaattttgtctattgtcagccagttgatctttggcaggaatatccacgttatttaaaagcgctgctattgcgtttagatcgattgccaaataatctacagcgagatcatgctgctattgacgatgtcgatccatggatggacaaggtatttaagttcaaaaatgatccaagaatcaaagaattgtatttgatgctggaagaattacgtatttctttattttctcagccgatgaaaaccaagatgcctatttcgccaactcgactacaaaagttatgggatcgtttgggaatcagttaa

SEQ ID NO: 2248 - DNA, 438 bp, Acinetobacter baumannii
agaacaaaatctatgtgtgaatgtcaaaatgtcggtgaattttttgtatgccctgacagcttttcaaatattttcagcaataactatgaaatgaaaaataggtttcctcactacattattgaagaagctccatgcgaagaaactcatccaaaatttgactatagcgagttttattatgcctgctctgagtgtgagcaagcatggtatttcgagtgttatccagatacaccgacagcacctgtttttggaattaaactttcagacgtgaaccaaaccttaagccaaaatcgaataaacagtattaagcaattcttagttgttttagctcatgaaggcttttcagaaaacaagtgcattcataaaggctgtacggactattcacttaacggaattaacgtatgccttaatcattttggttataagttgagtacccgataa

SEQ ID NO: 2249 - DNA, 1077 bp, Acinetobacter baumannii
ataaggaaatcagccatgagccaatttgtaccattaaaagtaaaaagtattacaccgcaaaccgatcaggcaatttgtattgcatttgacgttgtacctgaacaacaagaacaatttcaatttcaaccgggacaacatttaaccatacgccatttaactgaagcgggtgaaatccgccgttgttattcaatttgtagctatgcgggcaaagaagacatcagtattgcggttaaaaaaattgatcagggtcaattttcaaactgggcaaatgaccatttaaaagtgggtgatgtgcttgaagtcatgccaccacaaggtgtgttttttcaaaaagcagccaagatgggcggacaaaactatttaggcgttgcggcaggcagtggtatcacgccaattctatcaattattaaacaagttttatttgaacaacctgaagctaactttaccttgctctatggcaatcgctcatggaaacaaaccatgtttgccgagcaaattatggatttgaaagatcagtttaaagaacgctttcaactcatcaatattttttctcgtgagttcaacgatagtgaactcatgaacggtcgtattgatgcagaaaagcttaagcaactttttgattatgaagtgcttgaaacaaactttgaccatgtgtttgcctgcggcccagatgaaatgatgaatgccgtagaaaatactttaccgaactttggtattgccaaagagcgcatccacaccgaacgtttccatacgggacaagcgcgtaaacgtagtgttgaagcggatgcaaaccgtaaagaagaaaaagtaaacatcattttagatggccgtgaactgattgtttctgtggctcaagatgatgaaagtattcttgatgcggctttacgtgctggtgccgacttaccgtatgcatgtaaaggtggggtgtgtgcgacctgtcgctgtaaggtgctttctggcgaagttgatatgttccttaactatagtcttgaagaagatgaagttgaaaagggctatgtgctgagctgtcagaccttaccaaaaggctcaaatgttcgcttgagttttgatgaatag

SEQ ID NO: 2250 - DNA, 540 bp, Acinetobacter baumannii
caatctgaatcaaagataaggatatattcaatgaacgctaaattaaatactgaaactccacaaagttttatctcaaatggttcaaatacatccttttcggccgaagatattcttgctaaagcacagcaatacgcacaagaacacgaactaaattttagaggcagtttatcacctgttgacgcatggcagctcgtacaacaaggagaagcagttttagttgatgtgcgtaccaatgaagaacgtaaatttgtgggttatgtccctgaaagtatccatgttgcatgggcaacaggcacatcatttaaccgtaatccacgctttttaaaagaacttgaatcaaaagttggtaaagacaaaaccattcttttgttatgtcgtagtggcaaccgttcagcacaagctgccgaggccgcatttaatgctggttttgagcacatttataacgttcttgaaggcttcgaaggtgatctaaatgaacagcaacagcgtaatcagaaaaatggctggcgcatccaccaacttccttggcaacaagattaa

SEQ ID NO: 2251 - DNA, 243 bp, Acinetobacter baumannii
agtactgaatctccaaaaattgtcgaaataagcgaagttccacttaaggtttcattctttacaacagaatcaattatttgctgtatttttgcactcatactcatgtcttggcgtttagtttcagggtatagattctataccctgaatgatcttgatgttaagcaatctgacgcatatcgattacccgctttgccttaccttccgaacgaggtaaggtcgcttctgtcacaacctctacagtaa

SEQ ID NO: 2252 - DNA, 1029 bp, Acinetobacter baumannii
aatcaccgatctcaaccagagatcagatcaattattttgagtcaaactcgtatgcctaatcctacagatttccaaagcagtgcattagcgacattgcgcattgagcaacaagccatagatgtattagcaacacaaattgatgaccgttttaatcgtgcttgtgaaatattattacaatgcaaaggtcgtgttgtgatcacgggtatgggtaaatctgggcatattggccgaaaaatggcagcgacatttgcttcgacaggtactccatctttttttatgcatcctggcgaagcagggcatggtgatttaggaatgctggttcgtggcgatgtacttattgcaatttccaactcgggaaaaagcgatgaaatcatgatgttaatgccactcattaagcatcttggtgtacctcttattacgattagtcgtgatgataaaggcccaatgccgcaaaatgcagatattgctttaactctaggtgagtctgacgaagcatgccctttaggcttggcgcctacttcaagtacgacagcgactttggttttaggcgatgctttagcagttgctttacttgaagctcgtggttttactgctgatgactttgctcgttcgcatccggcaggtgcgttgggtaagcgtttactgttacatgtaaaacatttaatgcatacaggcgacgaattaccaaaagtttcacctgagactccaatgaatcaagtgctttacgagatctcaaataagcgtttaggtttgacaacaattgttgatgaacaagaccatctactcggtatttttacagatggggatttacgtcgtctcatcgataaacaacaagggtttgatgtaaatttacctgtgtctgaagtgatgacaaagaaaccgtcaacgatctctcaagaagcacgagctgtagaagctttacaacaacttaaccagaaaaaaatcagtcagtttgtggtagtcgatgaccagaacaaagtgattggtgtaattagtatgcatgaccttattcaggcaggggtgaattaa

SEQ ID NO: 2253 - DNA, 486 bp, Acinetobacter baumannii
tcctgccgatcgaggagggcaactaaacacggaattactgaagcagtatcacgtgcaaacggctataaaggcaatatgaaagatttgccgattgatgtggccaaagcaatttatcggaaacagtactggattgaaccacgttttgatcaagtaaattctattagcttagcagtagcagaagaacttttagacactggtgtgaactgtggtatcaacttcgcaaaaccacttttacaacgtgctctaaacttgctgaataaccaaggtaaagccgggtatgcagatttgaaagttgatggcgtttatggctcaaatactttgggtgctctaaaaacctatttggccaagcgcgggaaagaaggcgagaaagtcctggtgcgagtcctcaacattatgcaaggtcagcgctacattgaaatctgtgagcgtaatccaaagcaggaacagtttttttatggctggatcgctaaccgaattttattatga

SEQ ID NO: 2254 - DNA, 1170 bp, Acinetobacter baumannii
aaagggagatcacagatgatccgtgatgaagggatgttggagcagttactttcaacaattcgagattttgtaaagaatgaattgatccctcgtgaaaacgaagtggtagagaaagacaaaattccagatgacattgtgcagcaaatgcgtgagctgggtttatttggcctcacaattcccgaagaatatggtggcttaggcatcactatggaagaggaagtcagagttgcatttgaacttggacaaacttcaccggcttttcgttctttaattggtaccaataacggtattggctcaagtgcaattttgattgatggcacagaagagcaaaagcagaaatatttaccacgttacgcaagtggcgaaattattggttcattttgtttaaccgagcctgaatctggttctgatgctgcctctttaaaaaccagtgccgtaaaagatggcgatttttatgtattaaacggcaccaaacgttttattaccaatgcaccccatgctgcaacttttaccgtaatggctcggacgaatcctgaaattaaagggtcgggtggcatttcagcttttttagtcgaggccaatacaccgggcattacattaggcaaaattgaccaaaaaatggggcaaaagggttcacatacctgtgatgtcatttttgaaaattgccgtgtacctgcttctgcactgattggtggcgtagaaggtgtcggttttaaaacggccatgaaagtgctggataaagggcgtttgcacattggtgcctatagcgtgggtgttgccgaacgcatgttaaacgacgcattgaactatgcgattgagcgtaagcagtttggtcagcctattgcgaactttcagcttattcaagccatgcttgccgactcaaaagccgagatttatgcagctaaatgtatggtcctagatgcagctcgccgccgtgataatggcgaaaacattagtacagaagcatcttgcgcaaaaatgtttgcgactgaaatgtgcggacgtgttgctgaccgctgtgtacagattcacggtggtgcgggctatatcagtgaatatgcgattgagcgtttttatcgagatgtgcgtttgttccgtttatatgaaggaaccacgcaagttcaacaacttattattgccaaaaacatgattagggaagctacagcctaa

SEQ ID NO: 2255 - DNA, 630 bp, Acinetobacter baumannii
gaaaatatgtctacgcgaaagccccgtcaggcacgagccaaagtcactgtcgataccattattgaagcaggttttattgctgtagcattgcatggaccaagtggtaccactacacgtcatattgcagaaattgcaggggtgagtgtggggtcactctatgagtattttaaaaacaaagaagaaatctatgatgcgatgaatcactactttgtgagtgaaattttagacatgattaaagagctaactcctacaattttagagttggagttagaacctgttattgaaatgattttttatacgttcagtgatttattaaagaaaaataatgaccgttatttaaccgttttacgttatgcaggtgagttgcaatatgataaatatattccaaaaattgaacaggctttaatggaagtcatcatgaagtatatgatgcataatcctaaatatttaaaaattaataacttacctgtaattacctatatttgtattaatagcggtatttttaacgttgcaagacatcttattttacccaacccatttattagttttgatgaaatggtacagggactaaccactatgattatgagttatatcaataccgaaatggcacgctcagaagatcaatcataa

SEQ ID NO: 2256 - DNA, 795 bp, Acinetobacter baumannii
gtcatgatgtcaaaaaccctgcagctgtcaaataaccgtattgctcactattttgagcaaggcgaaggagagcctctggttctgatccatggagtgggaatgcaagctgcggcatggtatccacaaattgaatatttttctaaacattatcatgtgatttcagtagatatgccgggacatggtcaaagcaccaaattaccggcagacgcaaaattacaagattttgttgaatggaccatcgaatttattacagccttaaatttaggcccggtaaatttagcagggcactcaatgggatcactcattacgacaggcgtcagtgttacccgtcctgatttagttaaacggatggctgtactcaatggtgtgtataaacggacaccacaggcacgtcatgcagtcatccaaagagctgaagagttaaaaacaggccgtattgatgttgaaactccgctacaacgctggtttggtgaaagtgaagtcgagcgtatagctgctgccaaagtaaaaacttggctcgaaaatgtcgacttgtctggttataccactgcgtattctgcgtttgcacaaggcgatgaaacctatgcagatgactggtcaaagatcacttgccctgctttggtgttgaccggtacggatgatccgaattcaactgcagaaatggcattacagatggcaaaacaggcaaagcatggcactgcaattgtcattgaaaatgaacgtcacatggtgaacttaactgcacctgacaaagtgaataatgcaatgcaagcgtggttggaaaccaacgtttaa

SEQ ID NO: 2257 - DNA, 954 bp, Acinetobacter baumannii
tgtaagatgtctgacaacataaacatgtatggaaacttgcaaatggatgctcttgagttaaaaaacattatttctgatggtttactgtctttcccggtaacagatttcgatcaaaacggagattttaataaatcttcttatgcaaaacgtcttgagtggttagctccatacggcgcaagtgctttatttgctgcaggtggtacaggtgagtttttctcattaactggcaatgaatattctgaagtaattaaaactgcggtagatacatgcagaggcagtgtaccgattattgctggggcaggcggtccgacacgtcaggcgattgaacaggcaaaagaagcagagcgcttaggtgcacacggtattttgttaatgccgcattacctaactgaagcaagccaagaaggtttgatcgaacacgttaagcaagtatgtaactcagtagactttggcgtaattttttataaccgtagcgtttcaagattaaatctcgattcgatccaaaagttagctgagatgtgcccgaacttaatcggttttaaagacagctctggccaaatcgatatgatgacggcagtgactcaaactattggagaccgtttgtcatatttaggtggcttgccaacagcagaagtttttgcagcgccatataaagccttaggttgcccagtttattcgtcagctgtatttaactttattccaaagactgctatggagttttataacgcgcttcgcagtgatgactttgaaacaaccaatcgtttgattaaagatttcttcttgcctcttattaaaattcgcgaccgtaaatcaggttatgcggtaagcatgattaaagcaggtgccaaaattgttgggcatgatgcaggccctgtgcgtccaccattaagtgatttaactcaagcagactatgaagatttggctgctctcattgcgacacttggtccgcaataa

SEQ ID NO: 2258 - DNA, 246 bp, Acinetobacter baumannii
gtagatactttagaagctatttttaatgaaaacaatggatattgtgctcatttttcactgacagttaggtctatattttttatatctttttttaccgtacttatagctgtttttcatattaaagtccttttagttattcattttacaaataaaaattataatttattgatttttaatatatttctatatctctatttatatattaaaaatcaaaaaaagtgctttgcatttttattcataagctga

SEQ ID NO: 2259 - DNA, 1587 bp, Acinetobacter baumannii
gcgttatggtctctcttcaaatgtatacaaggaacgatcatgctgaagcctctcctaataagaatcagtcctctcgataatgtagccattgtggtcaatgacggtggcttaccatcctctacatatattgaagaataccaactcaccttggttgatgaagtaccacaaggacataaggttttattggagccgttaaagcaaggtgaagcaattgttcgttatggcgaaatcattggctatgccaataaagatttaaccgcaggttcttgggtgaatgaagccgttacccaaatgccagaggcacctgagctagatgatcttgaattagcaactcgccccgatcctaagcttcctccactgaccggatatacatttaaaggttataaaaataaggatggcagcgtcggcacaaaaaatattttaggtatcacgaccagtgttaactgtgtagagggtattgtcgattatgtcgttaagattattgaacgtgatttacttccaaaatatccaaatgtagatggtgtagttggattaaaccatttatatggttgtggtgtggcaattgatgcacccgcagcaattgttcctattcgtaccatacataaccttgcactcaaccctaattttggtggagaaattatggtggtgagtctgggctgcgaaaaaatgcaacccgaacggcttttaaatattcctaaagaaaacaaatatattcctctagcaaacgaagatattattcagttgcaagatgaacgccacaacggttttgaaagtatggtgaaccatattttaaccgtggcagaacaacaccttgaaaagcttaatcaacgtactcgagaagaagttccagcctctgaattagttgtaggcatgcaatgtggtgggagtgatgcattttccggagttacctctaaccctgcagttggtttcgcagctgacctgattgtgcaatgtggcggtacagtcatgttctctgaagttacggaagtccgcgatggtattcacctacttactccacgtgcagcaaatgaacaagttgccaaagatctaattcgggaaatgaaatggtatgacgattacttagcagcaggccaagtggaccgaagtgccaataccacaccaggtaataaaaaaggtggactgaataacattgtagaaaaagcgatgggatcaattgcaaaatcgggccgctcaccgattgtagaagttctcgcaccgggtcaaagaccgactaaaaagggtttaatttttgcggccaccccttcgagtgactttatctgtggtacgcagcaaatggcatctggtattaccgttcaagtctttaccacaggtcgcggtacaccctacgggctggcagccgtacctgtcattaaaatggcaagccgaaacaatattgcaaaccgttggtatgacctgattgatatcagtgctggcgatattgcgattggaaagaaaactattgaagaagtgggctgggaactttttgagctgattttacgcgtggctagcggtgaaaaacaaacgtggtcggaccgttggggtattcataactcactcgctgtatttaaccctgcaccagtgacctaa

SEQ ID NO: 2260 - DNA, 1200 bp, Acinetobacter baumannii
aggtccactttcattatgactataggcatgatgagaaacgcactctataccccaaccattattttaatggcaattgccgcaggcatttgtacaggtggaaattattttagtcagccacttattcattcaattagtctaagcctaaatttaactgaaacaactacagcgtgggtgccaactctagcccaaatcacctacgcatgtggcttactctttttaatgccattaggggacatcatagaaaagcgtaagctgctatttatctttatgttattggcttcaagtggattaattattagcggtttttcgcacaatatttatcttttactgcttggcactatcattactggtctattttctagtgcagcccaactgttgttaccacttgctgcaagtctggttccaattcaacaaagcggccgtgttgttggcttcctactgagcgggctcatgatgggagttttactcgcccgctccctttctggactgatgtctacactttttgcatggaatattatttatctggtcagtggctttctgttacttgtgattgcctttattttgcatcgtaatatcgggttatttccaccgaccaaatctgaaaactatgcgaaaaccattcgttctttaccacagatttttattcaaaatcgacggttaagaaccagaacttatattggtggttttacatttgcatgcgtgagtttaacctttaccaccatgtcgttgcttttggctccggcgccctatttttttagcgactttaccattggccttttcggttttgttggcgtgttaggaactttcgttgccaatttttcaggtaaatttattgaccaaggctatatccataaaatttcaatttattgcggcgttggccttatattaagttgggttctgttttcacttttaccctaccattttgctttttatattattgccttacttattctctacgcttctctttctgctgtacatgtcaccaaccaaagtattgtatttaaacttaatcaagaattacgttcgcggtttaatgccatttatatgacgggttactttgctggcggcgctttaggcacaacggcaggaagttatgcttggaaacactacggatggacaggtgtctgtattttaggcttaatttttgccattgtatgtctttattattgtgtgcgtgatgcaaaaaatcagcacaattaa

SEQ ID NO: 2261 - DNA, 1002 bp, Acinetobacter baumannii
ttgactttgttttttgtgtatcgaaaaatagatttaagggtgatgcctacagggaatgaaagaatggaaaacaattaccagaaatttgaacaaaatattgccaatgaaattacgatcgaggctaaggatcaaatgcctgatgcctaccgcaaaacattgattcgtcaaatcgggcaacatggccattctgaaattgtaggtatgttgcctgaaggaaattggattactcgtgcgccaactttaaaacgtaaagcggttttgctcgcgaaagtacaagatgaagcgggtcatggtttatatctgtatagcgcagcagaaaccttaggtgctgaccgtgatgacatgatggaaaagttgattaatgggaaaatgaaatactcatcaatctttaactatccaactttgacttgggcagatgtcgctgcaattggttggcttgtcgatggggcagccattgtgaaccaagttgcgctttgccgtacttcatatgggccatatgcacgtgcaatggtacgtatttgtaaagaagaaagtttccaccaacgtcaaggttttgaagccatgatggctttggcaaacggtacaccggaacaaaaacagatggcacaagatgcagtgaatcgtttctggtggcctgcactcatgatgtttggcccaagtgatgagcactctccaaacagcgcacaaagcatggcgtggaaaatcaaacgctttagtaacgatgaattacgtcaaaagtttgtcgataacaccgtacctcaagtgttgcaacttggcttggaagtaccggacccagatttaaagttcaatgaagaaacaggccactatgagtttggcgagattgactggcacgaatttaatgaagtgattgccggacgtggaccatgtaatcacgagcgtatcgaagcacgccgtaaagcatgggaaaacggcaaatgggttcgtgatgcagcagtggtctacgcgaaaaaacagcagcttgaagcgaacaaagtggcttaa

SEQ ID NO: 2262 - DNA, 681 bp, Acinetobacter baumannii
tattatttgttggaattttccttgaactggcagtatatccatagtgtgttgccgcaatttttctctgcaactttgaccacgctgaaaatttcaattatcagcattattctggcaattattgtagggctaatttgcagtattttaatcacatatcgcgtgcgggtgctaaatagaattgcccagttctatatagagttatctcgaaatacccctttattaattcaactgttctttttgtattacggtttgccaaagctcggtatcaaaatcgatggtttcacttgcggtgtgatcggattgacctttttaggcggaagctatatggccgaagcattccgagcaggtttgcagtcggtggccaaagggcagattgactctgcaaaaagtattggtctacaaccgactcaaatttttagatatgtcattttccctcaagcacttgccatttcaattccagcaataggggcaaattgcctatttctgattaaagaaagttctgtggtcagtgccattgctgtcgttgaactgctttttgtcaccaaagacttaattggcatggactataaaaccaccgaagctttgttcttactcatcatagcttatctgattattttattgcccgtgtctattttaaccagttatctggagcacagaagtcggaaggtgagccatggaacttga

SEQ ID NO: 2263 - DNA, 657 bp, Acinetobacter baumannii
acccatctgtttatcacacggacaataacaatgaataacgagcattttaagctgtatacagattcacaatttctaagtccctatgcatttacagtttttgtagggctacatgaaaaacaaattccatttgaaatagcaaccatcgacttaggtcagcaaggccagtttgaaacatcttttgtagaaaaatcattaacagctaaagtgcctgtacttgagcataacgattttgccttatcagaatcttctgccattttggaatatcttgaagagctttatccagacacagctatttttccaaaagatattcaagcacgggcaagagcacgacaaattcaggcatggctcagatcggacttagtggcactaagaactgagcgtccaaccgatgttatttttattcagcccacctccactccactttcagaagaaggcaaaaaaacagccgagaaacttttctttgttgcagaaaaacttcttgtgtctgatgcggaatttctttttggttcatggagcattgtagatgctgaacttgccctgatgttgcaacgccttattcaaaatggtgatgctgtatcagagcgcctaaaaaattatgtattacagcaatggcaacgtccgtctgtacaaaaatggcttgccttgcgacataaataa

SEQ ID NO: 2264 - DNA, 756 bp, Acinetobacter baumannii
ctcatgactttggttcaaattccgaaattaactaccactttggaagatttcttaaaaaatctggaaagtatagaaccattgtttgatgctttatcttcggtggtttttttcatcaaaaataccgaagcacgctatgtctttgtcaatcaaacattagtaaatcgctgcggtctaaaggataaaactgcaatattgggaaaaacctcttctgaagtttttcctcattcacttggaaaaatatatacatcgcaagacttgcaagttattcgccgtggtaaaaagttaacagagcaattagagctgcatttatatgcaaaaaatcagtcgggttggtgtttaacttataaagaacctttatttgacgcggatggaaagttagtaggaatagcgggtatttctaatgatttaaatgtacctgaaaatacacatcctgctttttacaaaatggttcaggttgaggaatatattaaaaagaattacgccgaaaccattactttggcgcatttgaccgcaattgctggcgtgtcggtggctcagttagaacgttattgcaaaaaaatataccatttaacgcctcggcaaatgattagcaaaattcgtctccaagtcgccactgaactgcttgcgactgacttaccgattactcaaattggtttgcgctgtggttataccgaccatagtgctttttgtcgtcagtttaagttgcatacaggcatgtcacctactttgtatcgggcctctatcaaaaatatttag

SEQ ID NO: 2265 - DNA, 954 bp, Acinetobacter baumannii
acggaagatcctatgaattttaagcctttggcatatatccttcttgcgacctcaagtttaacagcgtgtaccatggcacctgtaaaagaacaaaaaattgagccgtttgtttttaaggaaccagagcttacacctccattttatgcattaaacccatttaattatgatgctccgcctgcatttgaagttgctttaaaagaagctgctgcacagcctgtaaccaaaatggttgtaactcgtcaggacgatccaaccaaaacacttacattagatacggataaactgattgtacgtacagtcaacaactcacaacgttcaatgaagtacgcagttttagcgggcgataatgaaattgatgtaactgaaattgatgacttcttacaacttgttgaaggtaaagcgcgtcactatccgcctcgttttactgaccgtcaagaacgtaaaggctttgaaagcaaacttaaggaagttactcagcgcttagatactttagctgctaatccagatgcttcatttgatattcttattcgtgcttttaaagcaagtgtacttgcccgtaaccttgatttaggtactgctcataccactaagtctttagaatatgcacaaagacttttaaaaattaatccagatgatgctgaagcgaatttctggtttggttttggtttgtctgaaggtggtggtcaacgtgaggctattccgtatttagataaagctattaaaggtaatgttcaggaagcatatttagccgctgcaaataactatattgcaatggaacaaaagaagaatgcgattcaaactctaaaaaattacaaggttaaataccctgatgaagctgaagtagcagaccgtttaattcaagaaattgaaaaacaaggtcgctggaatgtatggcaagttttaacaaaccctgctatgtcttctgctaccccaagcgcagctacaaaaaagtaa

SEQ ID NO: 2266 - DNA, 201 bp, Acinetobacter baumannii
gcaataagtccttgtgtcatggctgtgccgagtagacccaccgcaagcattcctgtcaaaagaacaattgtagagtgggcaaaggcaactattaacaatgcagatattaaagccattaactgtatagccattaaccgacgccgatttacaagatcacccaacggcactaaaaacacgagggcaagtgcacaacctatttga

SEQ ID NO: 2267 - DNA, 1371 bp, Acinetobacter baumannii
agagatatgtttaaagctgaaaaagtcctgtggggcgaaggtttatttttaagacctcaacatttccagattcaagatacctatcatgaacaacgtttaaatcacacggttcgtgctgttgtgccattttcctatggcgttcaaaaacttagttttgatgaagcacagttaagtacgcatattcttgcacttgaatcggtagaaatgatttggcaagacggtgaaatatatcaagcgcctgcttatgatttattacctgaacctattttgcttgatgagcttaatttacgtggtgagatggtcatctatttggcattaccagtattacaagccaataaacaaaatttaatcgatcaaaatcaatcacaaaaggggcgctatcaatcacatttggttgagacccatgatctgttcacaaacgcgacagaggccgatatcagcttattacgtcgtcgagctgtgtttaaattattagatgcacatagtaatcctgatcataatttagatggtttcctgtatttgccaataggcaaaattaaacgtcagagttcaggtgcttttgaaattgaccgcaaatttattccgcccattttgcatgtcgatgcatctgagaccttggtttcaaatttaaaaagaaccttgaatgttattaaggcaaaaattaaaacgattcaaaccaataaccgagaaaatgagcagaaattaattgaattccgttcaggtgatatcgtttcgttttggctggtaaatgctttaaatactgctcatgctggtctgagccatttcttgcaatatccgcaaattcatccggaacgattattctttgaattgctacgtttagcaggttcattattaactttctcgacagcttatgaagttgatcagttacctgcatataaacatcataatttgcaagagagcttcacccagctcgacacaattttacgtgatttactcgatacgattatttcgagtcgttacatcagtattgcccttaaagaaattcgcccttcttattgggtgggaagtctcgaaaccgataagattactcgagataccagactttatattgctgtatcaagtagcgcgatgcagacccacgagttgattcaaatcgttcctttacgatttaaaatcggtagtactttagatgttgaacaacgtgttgttgcagcattaccggcaattccattacaccacttaatccaagttccaactgctattccagtacgttcgggtgtgagctattttgaaatcgaaccacatcatgaactctatcaacgtatgttggattcagaaacgatttgtatttatgttccggctggattccaagatatcagtattgagctgattgcggtcatgaacgcttag

SEQ ID NO: 2268 - DNA, 1572 bp, Acinetobacter baumannii
aaacagatgttagatcaaaacattaaaactcaattaaaagcttacctagaacgtttagaaagtccaatcgaattagttgctgctttagatgaatcagataaagctgctcaaattaaagaattagtaactgaaatcgctgagctttctgacaaggtaacagcccgttttgacggtaacaatacacgtcgtccaagctttggtgtggctaaagcaggtgaacaaccacgtgtgttcttcgcaggcttaccaatgggccatgagtttacgtctttgatcttggctttgttacaagtgtctggctatgcacctaaagtgtcggatgaagttttaaatcagattaaaggcttaaacctcaaagctaactttgatgtattcgtatcattaagctgtcataactgtccggacgtggtacaggcgcttaacctgattgccatttataatccgaacaccacggcaaccatgattgatggtgcattcttccaagacgaagtggaacaacgcaaaatcatggctgtaccgatggtattccaggacaatgaacacattggtcaaggtcgtatgacccttgaagagattgtggcaaaacttgataccaactcagctgaaaaagacgcagcagcactcaatgccaaagatgcgtttgatgtattggtgattggtggtggacctgcgggtgcaacagctgcaatctatgcggcacgtaaaggcattaacacaggtatcgtggctgaacgctttggtggtcaggtcatggataccatggacattgaaaacttcacttctgtgcaaaagactcaaggtcctaagtttgctgccgagatggaagcacatgttcgtgaatacgatgtggatattatgaacctgcaacgtgtcagcaaaatcacgggtgcagaccaaacagcaaatggcttggttgaagttgaacttgaaaacggtgcaaaacttgaatcgaaaactgtgatcctttcaacaggggcacgttggagagaaatgaatgtaccaggtgaagctgaataccgtacccgtggtgtagcgtactgtccacattgtgatggtccattgttcaaaggcaaacgtgttgccgtgattggtggcggtaactcaggtgttgaagcggcgattgaccttgcaggtattgttgagcatgtaactctggttgagtttgacactaaacttcgtgctgaccaagtcttgcaaaacaagttaaacagcttgccaaacaccactgtgattatgaatgcattaagcacagaagtattgggtgacggttcacaagtgactggtcttaaatataaagaccgtgcgactgatgaagagcatgtggtcgagcttgcagggatctttgtacagattggtttacttccaaacactgacttcttaaaagacagtgaggttgagttaaccaaccgtggtgagatcattgtcaatgaccgcaacgaaaccaatgtaaaaggtgtatttgctgcgggtgactgtactactgtaccgtacaagcagatcattattgctacaggtgaaggcgctaaagcatcactctctgcgtttgattacatcattcgttctgggcagtaa

SEQ ID NO: 2269 - DNA, 1572 bp, Acinetobacter baumannii
aaacagatgttagatcaaaacattaaaactcaattaaaagcttacctagaacgtttagaaagtccaatcgaattagttgctgctttagatgaatcagacaaagctgctcaaattaaagaattagtaactgaaatcgctgagctttctgacaaggtaacagcccgttttgacggtaacaatacacgtcgtccaagctttggtgtggccaaagcaggtgaacagcctcgtgtgttctttgcaggcttaccaatgggccatgagtttacgtctttgatcttggctctgttacaagtgtctggctatgcacctaaagtgtcagatgaagttttaaatcagattaaaggcttaaacctcaaagctaactttgatgtattcgtatcattaagctgtcataactgtccggatgtggtacaggcgcttaacctgattgctatttataattcgaacaccacggcaaccatgattgatggtgcattcttccaagacgaagtggaacaacgcaaaatcatggctgtaccgatggtattccaggacaatgaacacattggtcaaggtcgtatgacgcttgaagagattgtggcaaaacttgataccaattcagctgaaaaagacgcagcagcactcaatgccaaagatgcgtttgatgtattggtgattggtggtggacctgcgggtgcaacagctgcaatctatgctgcacgtaaaggcattaacacaggtatcgtggctgaacgctttggtggtcaggtcatggatactatggacattgaaaacttcacttctgtgcaaaagactcaaggtcctaagtttgctgctgaaatggaagcacatgttcgtgaatacgatgtggatatcatgaacctgcaacgtgtcagcaaaatcacgggtgcagaccaaacagcaaatggcttggttgaagttgaacttgaaaacggtgcaaaacttgaatcgaaaactgtgatcctttcaacaggggcacgttggagagaaatgaatgtaccgggtgaagctgaataccgtacccgtggtgtagcgtactgtccacactgtgatggtccattgttcaaaggcaaacgtgttgccgtgattggtggtggtaactcaggtgttgaagcggcgattgaccttgctgggattgttgagcatgtaactctggttgagtttgacactaaacttcgtgctgaccaagtcttgcaaaacaagttaaacagcttgccaaacaccactgtgattatgaatgcattaagcacagaagtattgggtgacggttcacaagtaaccggtcttaaatataaagaccgtgcaactgatgaagagcatgtggtcgagcttgcagggatctttgtacagattggtttacttccaaacactgacttcttaaaagacagtgaggttgagttaaccaaccgtggcgagatcattgttaatgaccgcaacgaaaccaatgtaaaaggtgtatttgctgcaggtgactgtaccactgtaccttacaagcagatcattattgctacaggtgaaggcgctaaagcatcactctctgcgtttgattacatcattcgttctgggcagtaa

SEQ ID NO: 2270 - DNA, 1386 bp, Acinetobacter baumannii
gaccacgtgtttattagtgtatttgatctttttaaaattggcatcggcccatctagctcccatacagttggaccaatgcgtgcggcatacagttttgtggaagatttattgaagcaaaacgatttacaagcaacggttagagttcaggtgaagttatacggttcgctgtcggcaaccggtgttggtcatgcgacagataaggctgttctgttaggtttaatgggttttgatcctgaacatattgatacccaagtaagtacaagcttgattgaagatgttcttgaaaataaagccatccagcttaatcagcaaaagactatttcttttgactataagcatgatgtgctttttttagatgaatctttgccttatcaccccaatgcaatggaactgattgcgtataacggggctcaagaaattttatatgcagaaacttactattcggttggtggcggttttattgttagccaaaggcaattagcaacaactcaaactgaaactaacgacgttaaggttccatatccgtttcacagtgcggctgaacttttaagcttatgtagaactcatcatttatcagtgagtgagttaatgcttgaaaatgaaaaaagctggcgtagtgaagctgagattcgtagcaagattatggaaatctggaaagtgatgcagcaatgtattcacaacggattaattaatgaaggcatattaccgggcggattaaacgtaaaacgtcgggctaaaaaaattcacgataagttattaaataagaaaaacttaaacctgattgtgacgacttttcatgcgatggaatgggtcaatttatttgccttagcggtaaatgaagaaaatgctgctggcggtcgagtagtgacggcacctacaaatggggccgcaggaattattccggcggttttatattactacgtgactttctctaaagacttttccgaagataaagtggttcgcttttttttaagtgcggcagccgttggcattttatgtaaactcaatgcttctatttctggtgcagaagtagggtgtcagggcgaagtcggctcggcgtgtgcgatggcttcggcgggtttagccgagattttaggagcatcacctgagcaagtggagcatgcggctgaaattgggcttgaacataatttagggttaacgtgtgacccgattggtggtttggttcaggtgccttgcattgaacgaaatgcaattgcagccgtaaaagccattaatgcagcccaaatggcacttcatgatgacgatgaacactttgtcacactagataaagtcattcagactatgaaggaaacaggtaaagatatgtctgagaaatataaagagacttcaaaaggcggtctcgctgttaacgccattgagtgttaa

SEQ ID NO: 2271 - DNA, 738 bp, Acinetobacter baumannii
attgtttaccctattcggaacatatcaagcatgacttcaaatttttcacaactcagcacagatgctttatctccggggcaactacctgaatccgttaaagcattgttaaaacgtgctcacatcaacagatatccaaaacgaaccacaattgttgatgccggaacagagtcaaaatctttatatttaattttaaaaggctcagtttcaattattttacgtgaagacgatgaacgtgaaattgttgtggcatatttgaatcctggtgacttctttggggaaatggggcttttcgaaccgaaccctcaacgtacagctgaagttcgtacccgtgatgtctgtgaaattgcagaaatttcatatgacaacttccacgaactgagcaaacagtatccagatctcagctatgccgttttcgcgcaactcgttcgtcgtttaaaaaatacaactcgtaaaatgaccgatcttgcatttattgatgtgtcaggtcgtattgcgcgttgcttaatcgacctatcttcacaaccagaagcaatgatcttgccgaatggccgtcaaattcgtattactcgacaagagattggacgcattgtcgggtgttcacgagaaatggttggccgtgtattaaagaccttagaagatcaaggtatgattcaaactgacggtaaagctattctaatttttgatacttcattagaagaaaccccagtcactgacgaagactacgatgacgaagaataa

SEQ ID NO: 2272 - DNA, 948 bp, Acinetobacter baumannii
tctacttacccaataaagaaaatctttagcgttatgaattcacctgtttatttgaatgcgctccgtgcttttgaagccagcgcacgccacaaaagtttttctgctgcagcaacagagttaaatgtgactccggccgcagtggggcaattggtacgtacactcgaagattggttaggttttccgttgtttcatcggcaaactaacggtaaaaatcggcttattgccaccgaacttgctgagtcagttttacctgatattcgggcaggttttgataagctcactttggctttggagaaattaaaacaagattctctatcaggtgttcttaatattgctgtgagtccagcatttgctgaaaaatggctattaccaagaattgatcattttcaaaaacaatatccagatattgatattcgtttagacattaacttgaaaaccgtagattttttagaacaaaaagttgatgtgggggtgagatatgggcaaggccaatggcaaggtttagaagccgttaaacttatggatgaagaggtttatcccgtatgttcgcccgcatttttaaatgaacattcatcgcttttaacgccgagcgatctaaaaaatatcactttaattcatgacctttcgatggaaaaacatcaacaatttccggggtggcaatcttggctaaaaagtgtaggtttgaatgacattaatattagccgtggtatgcaaatcaacagttcatctgcagttttacaggctgcaatggaaggacatggtgttgcgttagcgcgtagtgttatggtgcaaaaagatatacaaaccggacgtttgatacgattatttcctcaaattaacttctcatcgcccttttcttattatttggtgtaccgatcacaatacgcaaatttacctaaagtcaaaatctgcctagattggttttttgaagaaattcatcgaatataa

SEQ ID NO: 2273 - DNA, 876 bp, Acinetobacter baumannii
gcagattaccccagcacaagttcaagctttgtatcaaggagagcaagtatgaatatcgccgttgatacattaaaagcatctactcgtggtgcacattggtttaaagcacttacgcagggttttaagacagttgaaggttttccagcttcgatttgggtggctgatggtcagattgatcagcaagtggtgcgcgtgattaccgttgtgcaagataccaataatctgttcccacgggcaaaacaaggagaagttggattattagaaggctggagtttggcaaaagtagtcgatgatgtgatccaagccgatgcacaggctgaaactaaacgcgctattttatgtctggttgatgttccaagtcaggcctatgggcgtcgtgaagaattattaggcattcatcaagctttagcgggtgcagtagatagctatgctagagccagattggcaggtcatccaattgtgagtttattggttggtaagtcgatgtctggtgctttcttggcgcatggataccaagccaatcgtattattgccttaaaagattcaggtgttatggtgcatgcaatgggtaaggaatctgctgcacgcgttaccttacggtcggttgatgagttagagcaattggcctcaagcattccaccaatggcttatgacattgaaagttatgccacgcttggtttgttatctgaactgttatctgttgaaaaccctgaacaaccgacaaacgatgatcttttgttagcgaaacaggcaattgctcaagcgtttaaagaaattaatgctgagcaatcgagaggactggaacaaagactgcatggccaaaaccgtcaaatgtctaaaaaggtccgtgaattattgcgtgagcaatggtcatga

SEQ ID NO: 2274 - DNA, 996 bp, Acinetobacter baumannii
aatctataccctgaaactaaacgccaagacatgagtatgagtgcaaaaatacagcaaataattgattctgttgtaaagaatgaaaccttaagtggaacttcgcttatttcgacaatttttggagattcagtacttcatcggggtggaaacattagtcttgcaagcctgattcagttattagagctgtttggttttaatgaccgcgctgtaagaacctctgtttttcgtttagttaaaaatgattggttatgttcagacaaaatcggcagaaccagtttttatcgaattaccgattcaagccgttcgacttatttgcaggccgagcaacgtatttataacgaccagatgaaagagtgggaccattattgggatcttattctgatgtctagcctcgatactgaaaataaagcgttgttaaagaaagaactcgaatggttaggatttgccaatatttcgacaaacttaatggcttatccgggttgtaaccgtattgaactgcaacgcttgttggttgacttaaatatgagtgagcaagtggtggtgtttaaagccgaaaccttgcagctctttaataattcggttgataccattggtcgtatgcttagaaccaactggccaattgatgaattacgccaaagatatctacagtttctcgatatttttagagaaattggtgtgctgctgatgcaggaaaacgaacaactcgaacctgttcaggcctttcaaattcgaactttgctcattcattattatcgacggattttattgaaagacccagcactaccgcttgagttgttgccaactgactggcctgcgattagtgcacgaactttatcaatgaatatttataaaaaagtatttgaacctgcggatgaatacttcttgtctgttgccgcaacagcagaaggaccaatgccaaatgccacagcacattattggcgccgtttcggaggtttggtggcaacaaatgagaggttaaatcatgccttgttatag

SEQ ID NO: 2275 - DNA, 690 bp, Acinetobacter baumannii
aggcatttaccatttgatttgaatgtcgaattaactacagactatataggttttagaatggcaaaaactccacaaacaagagaagagcttaaaaagcatcttcgtgaaaatttagcatttctcaatgtatcaaataaatcgtttgatgagggattgcatgcagaagcgaagaggcttgctacaactattcgtgtattagtacatgacacacttaaatcaaaatctttattagagcaattaggtgtaaaaaatgatttaaagtttttaaacacatcttatgaatatagtcctactaatttgatgccacatacgggtttagttatgatgcgcatgacttctaatggtacaagctatctggctcccttacatgatggtccaccagacaggtatacacaacctggattggaatttagtcagtggtgggatcagcttgttattgatgataaaagtggtggagtttttactagaaaaaatctaattctatttatggcaaatcaagatggtggtgcccatgtagatccatcactcgattcttcatatgctgcactaaagcgcgataatagcgttggctgggtttatagtgatggaatatctgaacatcctattactgatattgaattgcatagtgttcggcaaattgcatatgaacttattgagactttaaagccactagatatcaatagcctttaa

SEQ ID NO: 2276 - DNA, 297 bp, Acinetobacter baumannii
gttaggctacccatttattcgtttttagttaaatttgatttatttcacttaaaaaataacgttgagcttttgatagaaacttacttaaagctaaatgtattcaatgttttcattcttctaaaatctacaaatataaaatactgtaaattgcatcaaccgcccttaaggacggttgatcgttataaattaaaagtaattgaaggtaatttttataacatcacacgtggttactgtgctgcattcacaccaacaataaactggctacaattagaaccttcagaggcattacctaattga

SEQ ID NO: 2277 - DNA, 225 bp, Acinetobacter baumannii
aatttctcgttcatctctgtattaaatgcctctttaaaaagaagcattttctaccctatttttattctaatccgtattattcttcatcctttttcaattgtaatccttaaaaaatttatctcattatttataaaaataagatgcatccatttcaattcttggagaaatatattcttctacccaatccaaccatgcgcgtgttttggcatcaataaaatggcgtga

SEQ ID NO: 2278 - DNA, 960 bp, Acinetobacter baumannii
atttctatacctctagatatttacaatatgacgaaacctgaagcgcagtatcaatcagggcaatttcaattttcctttctatcattaaaatattggggtatctggttcacagcttttattctaatgtttcttgcgtacttgccttgggcaatccagtggcgtttagcaaaactattttcaaaaattgcttggacactattgggttctagaaggaaaacgactttaagaaatttaggtgcgtgttttccggaaaaaacacccgagcaaattgaggccaaggctaagtcggtttttaccgatacgatgattggtatatttgaagccttaaatgcttggtattgtcctgcatggtttaaaaaaagagttcatatagaaggtttggaacatctaaatgacaatcgggatcggggcattctactgttaggcacgcatagcacattactcgatgccggaggtgctgcatgtacactattctttgatatggatgtggtgtatagacctcaaaataatcctttcatggatttcctcattcatcgtagtcgcgccagggtttataaaaaccagattgcaaaagacaacatgcgtagcttaattgaaaaactcaaaaatggtcatgcaatctggtatagccctgatcaggactttggtttaaagcaaggtgtcatggcttcattctttggaatacaagcagccacagtcacggcacatcgaagactcatggatatttcaaacgctgttgcaataccattatatttttacagaagcggggatattcgagatcctcaatacaatgtactggtagaacctaaacttgaaaattttcctagcgaatgcgaagtgaatgatgctgaacgtgtcaataaaattattgaaaaccagattcggatcgccccaacacaatacatgtggtttcatagaaggtttaaaactcgtcctgctggtgaagcgaagttttactga

SEQ ID NO: 2279 - DNA, 1449 bp, Acinetobacter baumannii
aaagttgcttttgctgcactagggagggtggatctaaaaaatatgagggaacgtctttcttgtgaaagaaaggcaaattttaaaggatctattttagataggtacataacaaaaaggatgtcgagacttttaagactacttaaaggtctaaaggaaaatttcatgatgaaaattttaaatacaacggttcaaaaaagcttgttggcagtttctgtgactctgcttatgtcttctgcttttgcaggccaagtaaaccctgaaatagagcaacttcgccaagaaataaaagaactacgagctatgctacaaactaatatggaggctcaaaaatctttagctcaaaaaagagtagaacaagctgctactgtagttactcaagctccacaacctataaagcaaacattaactaaatctggtgcggaatttaacttatacggttatatacgagcagatgcttcttatcaaattaagggtgcatctacgatgtataacaatattagtggcgttcctcttgaaaatacgccagaagaatctgcacagaaagaccagttgcacagtactgtgtatgtgacccgcttcggattgaattttaaaacacctacagccgttggtgatgtaggcggaaagttagaaatggacttttttggggcggctacacgtgatcagtttcggatacgtcatgcctatttaacttttgataaatggcttattggtcaaacatggtcgacatttattgcccctgaatattacccagaaacaattgatgcgggtacatttgtaggtagtgcattattaagatcgccgcttgttcgctatagcgataacttaacggcaaatacaagttttgcagtatcagttgaagacccgaaatatactgctgtaacagatccagataataaaatgcgtttacctgctttagtcggacgtttaaatcataaatttgccaatggtttgatgctttcaggccgtagttttgttgcagaaaaaagaactaacaatgatagtgagtgggcgtggggtgtaggcttgggcggtaaatatcaaattacccctgatacattacttaaagccgattattaccatgtcaaaggtgatggacgtttcttgctatggagtaacagtggctatgcaatagacgatcaaaacaatatgcatagcaatgaatttgacacagtttctttgggtatcactcatcaatttacaccgcaaattcgctcgactttaggctacggctatatgaaggctaaagatgataaccgttttgctgaattacagcgtactagtaccacccaaaacaaacagctttggcaaggttgggtgaatgcactttataacccgtataagccgattactttgggtatcgaatatgtttatggagaacgagaaacattcgataatcgcaacgggattgataaccgcttcaacatgatagcaagttatgatttttaa

SEQ ID NO: 2280 - DNA, 1590 bp, Acinetobacter baumannii
gctaaatcacccaaccctatttttccgtttaatttcaaatatagatcaataatcaggatgatcgacatgacttatgatattaaaagcatggctgtgattggtgtaggtgttatgggcagtggtattgctcaaattgctgcacagtcaggtcataccacttatttatatgatgccaaagcaggtgcagcagaacaggctaaagaaaaactggctgctacatttcaaaagttagtcgacaaaaataaaattacatctgagcaagcagcagcggcaaataaccatttaattgttgctcatcaaattgaagatttaaaaaattgcgacctcattgtagaagcaattgttgaacgtcttgatatcaaacaaagcttgatgcagcagcttgaagatattgtttcggataatactattttagcctcaaacacctcttctctttctattacagccattgctgcaaattgcaagaagcctgagcgtgttgtgggttatcacttttttaaccccgttccactcatgaaagtggtcgaagtcattcgtggtttaaaaacagacccacttattattgatgctttaaacgatctgtctcgtgcatttggtcatcgccctgttgtagcgaaggacacccctggatttattattaatcacgcgggccgagcttatggcaccgaagcactcaaaatcttaaatgagaatgtctgtgatatcagtgaaattgatcgaattttacgtgacggcgtaggatttagaatgggtccttttgaattactcgatttaactggtcttgatgtctcgcatccagttatggagtcgatttatcatcaatactatgaagaagctcgctacaaaccaaacccgctcaccaaacaaatgcttgatgccaagcaacttggacgtaaggttaatcaaggtttttataactacgaaaccggctcaaaaacaggtgaacaacctgcgaagtttgtagagcgtttagcaaaatatccaaaagtttggattgcggcagatttcttagacgataaaaaacagctcgaagattatttaactcagcaaaatattaccctagacaccaattctgaaccacaaacagatagcttatgtttacttgcttgttacggtgaagatacaactcaagcggctactcgccttggggttaatccagaacaagccgttgctatagacatgctttatggcattgcaaagcaccgcaccttgatgccttcactcattaccaaacctgaataccgacaagccgctcactctattttcaatctagatggaaatctggtcagcatgattaatgaaagtattggctttgttgctcagcgtgttttagcgatggtcattaatttaggttgcgatattgcccagcaaaatattgcaacggtagatgacattaatgctgcagtacgtcttggcttaggctatccatttggtccaattgaatggggcgatcaagtcggcagtgaaaaaatcttacttattctgaaccgtataacagcacttacgcatgacccgcgttaccgccctagcccatggttacagcgtcgtgtcgcacttcatttaccacttacttttactcacgagtcttga

SEQ ID NO: 2281 - DNA, 414 bp, Acinetobacter baumannii
aggagaaaacccatgtctaaacaaatggatcaggccattcaaagtgtcattgacttacatgttttaatagaaaatgtttttacaggtcaaaatgcagaacaaagtctcacaccacttttaaacagttttgatcaaaattttaagatggttacggttcaaggtcagagtattggtttagccgaagttaagaacttatttagtcaaaatattggaaaaaagccctctttaaaaatcactattcttaaaagcatagccttatacgaatttgaaaattactgttgggtgcaatatcaggaatatcagcaaacaagtgaaaccgaaacagtaaggacttccacagcctgcattaaagtagaaggcgaaaaatgttattgggtttacttacatgaaactttagttccctcatcttcttaa

SEQ ID NO: 2282 - DNA, 390 bp, Acinetobacter baumannii
cggctgcgaccacggcctcggccacctgaacggccacgatcatcatcttcatcgtcgtcatcacggcggctgcggccacgacttcggccacctgagcgaccgcgatcatcatcttcatcgtcgtcatcacggcggctgcggccacgacctcgaccgcctgaacgaccgcgatcatcatcttcatcgtcgtcatcacggcggctgcgaccacgacctcggccacctgaacgaccgcgatcatcatcttcatcgtcatcatcacggctgcgaccacggcctcggccacctgagcgaccgcgatcatcaccttcgtcgtcatcatcacgattgcgaccacggccacgaccgcctgagcgaccgcgatcatcatcttcgtcgtcatcatcataa

SEQ ID NO: 2283 - DNA, 606 bp, Acinetobacter baumannii
agttttttgcctatggtgtcatttttatttattggacttgtagtcactattttgttgactccaggaccaacaaatacattattagcctcggctggtatacaagcaggggtaaagcattctcttaagttgattccggcagaggtaataggttacctgatcgcaattacctcatggggtgttttacttgaatcggtgtctcatttcattccatggcttccagccatattaaagctgatgagtgcgggctttatactctatcttgcttttaaactctggatgacatcgtctgaagatattaatttagaccaaccgcttattacaccaaaagctttatttcttgcgacacttttaaatccgaaagctttactttttgcttcagcgatttttccacatgcagcgtgggaagttcctcatttatattttattcacattgttgtctttttatctttaattaccccaattgcttttttatggattatgtttggtacagtattaatctcaaataaagtcacttggttaaatcaacgtaacttacaacgtattgctgcatttattttaactttttttgccatgccaatcggctattcagcgattagctcattttag

SEQ ID NO: 2284 - DNA, 1497 bp, Acinetobacter baumannii
gtgcggaggccgatcatgaataatactcaatcagcagcaatgccacttgttgaaaatgaagaagttaatcttttagattcgattgttgaacaaagtcgtattgcacgaaatgaagaagaacattctcgtgctaaaagcttaattggtgagcttgctaaagaagtaatggcaggaaccattactgtttctgaaaatatgactttatcaattgataagcgtattgcagaaattgatgctctgatttcaaagcagttaagtcagatcatgcacaatgaacaattccaaaaaattgagtcaacttggcgtggtctttattacttttgtcaggaaacgccttcaaatccgctcattaaaattcgtatgctcaatacgactaagaaagagttggtaaaagatttccaaggtgctacagactttgatcaaagcactttgtttaagaaaatctacgaagaagaatacggttcttttggtggtgcaccatactcagcattaattggtgattttgagtttgatcgtactccatctgatatgtatttgcttgagcaaatctctcatgttgcagcggcagcacatgcaccatttatttcagctgctagtccgagcattttaggccttgaatcatttacagatattgatcgtcctagagatgtttcaaaaatctttgaaaccgctgaatatgttcaatggcgttcgttccgtgatagtgaagactcacgttatgttgcattgactttacctcatgtcttgggtcgtctcccatatcatccaaaagaaggtactgcgacagaaggctttaattttattgaagatgtttctggtgaaaaccacaatgaatatttgtggatgaatgcagcttatgcttttggtactcgcttaacaaatgcatttgatatgcatggttggtgtgctgctattcgcggtgttgaaggtggtggtttagttgaaggcttgccagtacatacttttaaaacacaagatggcgaagtggtattcaagtgtccaactgaaattgcaatcacggatcgccgtgaaaaagagttaagcgatctaggcttcattccgttagtacattgtaaaaatacagattacgcagctttctttggcgcgcaatcaactcaaaaacctaaaaaatatgacaatgatacagccaatgcaaactcggctttatcaagtcagattcagtacatcatggctgtttcacgtattgcacattacttaaaagcaatgatgcgagataaagtgggtagctttgcttctgctggaaatgttgaagcattcttaaatgagtggttgtcacagtatgtcttacttgacgatggtgcttctcaagaagcaaaagctcaatacccgttacgtgaagcgtctgtaaaagttgtagaagatcctgctcaaccaggtcactacaaatctgtggttttcttgcgaccacatttccagctggatgagttgtcggtttctttacgacttgtcactgagttacctcagtcctcaaattaa

SEQ ID NO: 2285 - DNA, 1197 bp, Acinetobacter baumannii
gcaatcgggcctaaagtaatgaagcagtctggagctttcttggctcgtcccatgcttattttgacagtcgctctggttggactcaatttaagaccttttatgaccagtattggtcctttagtctcaaagattcgagcaggtactggattaagtctacaaggaatagctttactcactttattgcccatgatgttgatgggacttattgcctttattggtccaatcgtacagagcatcgttggagaacgcagagttgttttgggtgctttgctgactatatgtattggatgcgcacttagatttttatttcctacagctgagggcgtaattgctagtgcaataattattggtttaggcgtcgcgctgatacaggctgcttttccaggaattattaaacgagagtttagtcaacatatcgggcctatgatggggctttattcagctatgcttatgggtggtggcgcactaggcgcatggttggcacctgtgatttccaatataacgggtctatggtcactggggctggctttctttactatacccgctgtattagcattagtatcaacatttatttttttaccctccattgtaagttcgactgcccatctgtcacctgtaaaaacattattaaagaaacctagaacatggttgttaatgctgtgttttggtttggtcaatggtggctattcttcggtggttgcgtggttggcaccttcgtttcaagatcatggctggagtatttctcaaagtgggaaattgcttgccttacttgccttgagtcaagcagcctcggctctgtctttgcctattttagctaggaaatataaagatcgacgtccgtggttgtggtttactctattcatgcaatttgctggctttgcaggacttgcttttatacctgaatttgcatctgtgttatgggcaatttgtttaggaataggcttgggaggttgttttgccttaacacttattgtggcattagaccattttgaagagccgaacaatgcgggtgctttatctgcacttatgcaaggaggcggttttttacttgctgcaataccgccttggtttgtagcagctttgcatgactttacagggacttataaggcaggttggatttttcatttatgtagtgtgatattggttattgtgttagtggtaaggttagctccaagaagttataacaaaattcactaa

SEQ ID NO: 2286 - DNA, 1281 bp, Acinetobacter baumannii
ggtcatcagttaacccgaataattcaatttaatggactagataagatgaataattttgcagtttctcgtggtgactttaacgagtggatggttccagtatttgcaccggcaaatttcattccggtacgtggtgaaggttcacgtatctgggatcaagaaaataaagaatatatcgattttgcaggcgggattgcagtaaatgcattaggtcatgcgcatccagtggcagtcaatgcgttaacagaacaagcaaaaaaactttggcacgtcggtaatggttataccaatgaaccagtactacgccttgctaaacaactcactgaaaatacatttgccgataaggtattcttctgtaactcaggtgctgaagcgaatgaagcagcattaaaacttgcgcgtaaagttggactcgacagcggtgttgcaggtaaaagtggcattgtggcatttaacaatgctttccacggccgtaccttatttaccgtttcagcgggtggtcaacctaaatattcacaagactttgcaccacttccaaatggcattaatcacgttgcctttaatgatttagaagctgccaaagcagtcataaatgaacaaacttgtgcagtaattgtagagcctgtacaaggtgagggcggggttattccggctgatatcgaatttttaaaaggtttacgtgaactgtgtgatcagtttggtgccttacttatttttgatgaagtacaaacgggtgttggccgtaccggtgcactttatgcctacatgaactacggtgtgattccagatgtacttacgactgcaaaagcattgggcggtggtttcccggtcggtgcaatgttaacaactgacaaatttgcgccgcatttttctgtaggcacacacggtacaacttatggcggtaatccactagcaagtgcggttgctggcgctgtattcgagtttattaatactccagaagtacttgaaggtgtgaaagagcgtcacgactactataaaaacgctttaaatcaattaaatgaaaaatatgaagtctttaaagcaattcgtggcagtggtttattgctcggatgtgttttaaaagacgagtttgctggtaaagcaaaagatattaataaccttgcgggtgaagaaggtctgctgagtcttattgctggtccaaatgttgtacgttttacaccttctttaattattccatttgctgatattgatgaaggtttaaaacgctttgaacgtgcgcttgctcgctttgtggaaattcaaaaggatgaacaagcagcatga

SEQ ID NO: 2287 - DNA, 948 bp, Acinetobacter baumannii
gctgtttttacgttggttacaaaaacagttttctccttggtatggtcagcagttgtagtaaagaagatgaatacagtagtagcaaacttaaatatagaagtgatcaagcctaccattggcgcaattattcacgatattgatttgaatgcgttaaatgaacagacaacgcaacaaatccagcaggctttgcttgatcatcaggtcattttttttcgaaagcaacaattagctccgcaagcacaagcagacttggcacgtagttttggcaccttacatgtgcacccgatttatccttcaattgaagatgtacctgaggtgatggtgctcgacagttggaaacaagatttgcgtgacaatgaactttggcatacagatgtgacttttagtaaaactccacctttaggttgtgtgttgcaagctattaaaattccacctgtaggcggcgatacattgtggtcgagcaacatagcagcttttaaaggacttccgcttgagttacagcgaaaactacgtggtttaactgcaacccacgatattcgtaagtcttttccgcttgagcgttttgcccataacgaagaagaacgtgaaaagcttttgcaaacctttaagcgtaacccaccagtggttcacccagtggtgcgtactcatccggttacaggtgagcctttgttgttcgtaagtgagggttttaccacacacattaatgagttacccgaacaagaaagtgagcaattacttaacttcttgtttgaacatgcgacccaagagcaatttcatttacgctggaaatggcaagacggtgacgtcgcgatttgggataaccgttgtacgcaacataaagcactatttgattatggcgatgcccatcgcatcatgcaccgcgcaactattaatggcgatgtgccattttataaagaagaacaacaaccagagttagcagagacttaa

SEQ ID NO: 2288 - DNA, 768 bp, Acinetobacter baumannii
gccatacttactcaaacaggcaatctaaaaatgaatatttcaagaaaaacagctctggttactggcgcatcacgtggtattggccgtgctattgcagaacgcttagctcaagatgggttttatgtgattattaattatgctggcaataaagcgcatgcccaagccactgtagaacatattattgagcaaggtggtcaagcctcagctattcaagcggacgttgcaaatgaacatgaggtgagccgtttatttcaagaagctaaagcgattaacgggcaattagacgttgtggttcatagtgctggtattatgcctatggcaaaaattacacctgaaagcctgccagatttcgataaagtgattcataccaatttacgtggcgcgtttttaatattggcgcatgcggccgaaacagtaccagatggtggtcggattattgcgctttcaaccagtgtaattgccaaatcttttccggcatatggtccttatattgcttcaaaagcaggtgttgaaggtttggtacatgtgttagcaaatgagttacgtggacgcaatatcactgtaaatgccgttgcgcccggcccgacaggcactgaccttttttacaatggaaaaactgaagagcaagtggcagctattgcaaaacttgctccattggaacgaatcgggacacctgacgaaattgctggcgtaattgccatgctggctggtccagatgggcgctgggtaaactctcaagtcattcgtgtaaatggtggatttgcttaa

SEQ ID NO: 2289 - DNA, 885 bp, Acinetobacter baumannii
ggaggcgttacctacatgaacactaaagataacgtctatgaatatgacaaagcagagcttaaacctgagttaaatgtgcaaacagaaaatgcttcatttctatcgttattttttgagaagcatcgtactttggcggtcagcataatcagtgtgggaagtgtagttgcactctggttcctcattactgctttgcatgttgtacctgaactgtttttaccgagtccacaggcagtctggcaaaaatttatatcggtcagccaagaaggctttatgaaagcaactttgtggcaacatttggcagccagcatttctcgtgtatttttagctttgattgctgccgtggtgattggtgttccgctgggtttgtggatggggctgaacaaatgggttcgtgctgttctagatcctttggttgaattattacgtccaattccaccgttagcttatttgccgttacttgttatttggttcggtattggcgaaaccacaaaagtacttttgattttcttctcgattttggcgcctgtcattattagtagtgcgcatggtgtgttaagccatcagctaaatcgtgaacgtgcggcattgtcattaggggcaagtcagtcacaagtcttttggcatgttattttaccaacggctttgcctcatattattaccggtattcgtattggtcttggggtgggctggtcaacattagttgcagcagagttggttgcagctgaccgtggtattggttttatggtgcaatcggcagcacagttcttaattaccgatacggtgattctgggcattattgtgattgcgattgtcgcagttagttttgagctgtttttacgttggttacaaaaacagttttctccttggtatggtcagcagttgtag

SEQ ID NO: 2290 - DNA, 1281 bp, Acinetobacter baumannii
cccatggttacagcgtcgtgtcgcacttcatttaccacttacttttactcacgagtcttgaaaaggaatttctcaatgttaaatgcatatatctatgatggtttacgtagtccatttggtcgtcatgcaggtgaacttacctcaattcgccctgatgatttagccgcaactgtcattcaaaaactactagaaaaaactggtgtgccgggtgcggatattgaagatgtgatcttaggcgacaccaaccaagcgggtgaagatagtcgtaatgtggcacgaaatgcattattacttgcaggtctacctgttactgtaccgggccagacagtaaaccgtctatgtgcgagtggtttaggcgctgtgattgactcagcacgtgccattacttgtggtgaaggcgaactgtatattgcaggtggtgtagaaagtatgtcacgtgctcccttcgtgatgggtaaagcggaaagtgcttatagccgtgatgcaaaaatttatgacaccaccattggttctcgctttcccaataaaaaaattattgcgcagtacggcggtcattcaatgcctgaaacgggcgataacgttgcagccgagtttgggattagccgtgagcaagctgatttatttgcagctcaatcacaagccaaatatcaaaaagccaaagaagaaggtttctttgccaatgaaattacgccaattgaggttttccaaggcaaaaaattgccacctaaactcgtttcagaagatgaacaccctcgcccaagttcaacggttgaagcactcacaaagttaaaaccactctttgaaggtggcgtagttacagctggtaatgcctcaggtattaatgatggtgcagcagcacttttgattggttcagaagctgcgggtcaaaaatatggtctaaaaccaatggcaaaaatcttatccgctgcagcagctggtatcgagccacgcattatgggtgcaggtccgatcgaagccattaaaaaagcagttgcgcgtgctggccttactttagatgatatggatattattgaaattaatgaagcctttgcttcacaggttttatcttgtttaaaaggtttaaatgttgattttaatgacccacgtgtgaacccgaacggtggcgcaattgctgttggtcatccacttggtgcttcaggcgctcgtcttgcgttaacagtagcgcgcgagttaattcgccgtaagaagaaatatgccgtggtgagcctatgtattggtgtaggtcaaggtcttgcgatggtgattgaaaacgtttcataa

SEQ ID NO: 2291 - DNA, 822 bp, Acinetobacter baumannii
cggtgttctaccacctcgtcgggggacattgtaatggcagatttcaaagcaaaagagattttattaaacgcctttgacatgaactgtgttgggcatatcaatcatggcttatggacacatccacgtgatgaatcacaccgctttaatgaactgagctattggacagaacaggccaaaactttagaaaatggtttatttgatggtttgtttatagctgatattaccggtgtgtatgacgtctatcaaaacggtatagatctcactttaaaagagtccattcagcttccgagccatgacccgtctacactcatttcagcaatggcggcagtcactcaaaacttaagttttggggtcactgtgaacttaagctatgagcatccatatcaatttgctcgccgctttgcgagtcttgaccatttaactcaaggtcgtattggctggaatatcgtgacgggttatctagatagtgccgaacgcttaattggccaaaaaggtttaaaagaccacgatgcccgctatgaacaagccgaagagtttttagaactttgctacaaatattgggaaggttcttgggaaaacgacgcagttaaaaaagataaagcacggcgtgtttttacagatccatctaaggtccataccattcaccaccatggaaagtattaccagagtgaaggtgtgtttttcaggtatctccttctgtgcaacgcactccaaccctatttcaagcaggtgcttcacctaaaggtatgcagtttgcaacacgtcatgctgaatgtgtatttattggcggtgacaaacccgaaaaaattcgcgaacaagtga

SEQ ID NO: 2292 - DNA, 768 bp, Acinetobacter baumannii
tttttggagttcacttccatggcgggtcattctaaatgggccaatattaagcatcgtaaagcgaaacaagatgccagtcgcggtaaagtttttactaaatatattcgtgaaattgtcactgctgcaaaacttggtggtgcagatcctgccagtaaccctcgccttcgtgctgttgtcgaaaaagcgctttctgtcaacatgacacgagataccattaaccgtgcaattcaacgcggtgtgggtggtgaagataatgatgatttaaaagaagtaacctacgaaggttacggtgtaggtggtgttgctgttcttgttgaaacaatgacagacaacctgaaccgtacagttccagatgttcgccattgtttcagcaaaactaatggtaacttaggtaccgcaggttctgttgcttacctatttactaaacgtggtgagattacttttgacgatgtttctttagaagataagatcatggacgttgctttagaagctggtgcagaagatattgaagtttcagaagatgaaattttagtaatcacttctccagagacttttggtgaggttcaagatgctcttgcagctgctggtttaaaatcagacaatgctgaagtagtgatgagcccttctactaaagcagaaatcactgatattgatcaagctaaacaagtgatgaaactcattgatatgcttgaagatttagacgatgtacaaaacgtttatacaaacgttgagtttagtgatgaagttttagcgcaacttgatgcctaa

SEQ ID NO: 2293 - DNA, 588 bp, Acinetobacter baumannii
atgccaaatactattttcttacaaagagttgctgatttatatgacacctttaaacagcatgactcacagcaatccgatcgtctacaaagatatcgtaatatagaagtagaatctgctcagctaatttcccagcttattcgtatgcagcaagccaagtctattttggaaattggcacttcaacaggatattcaactttgtggcttgctgaagctgcccaagcgactggtgggcaagtcattacagttgaaattgatgcaaagcgaagtgcagaggcaaaacgtcatgtagctgagttagagctcagtgaaattgttcaattttgggtaggagatgcagccgattacttaaaagcagctcaggaaaaatttgattttattttgttagacgctgaacgcgatgcatatgaaaattattggccagatttaaaacgcctaatgaagcctaaaggtggggttttagtcgttgataatgtgatatctcatgcggcagaagtaaatcgatttatagccttaattaaaaaagatccggattacatgagtagcattttgcctgtcggcgcaggtttgtgtttagtggtcacaaaatag

SEQ ID NO: 2294 - DNA, 1722 bp, Acinetobacter baumannii
atgatgaatacagaaaaattattgattgctaaccgtggtgaaattgctgttcgtattattcatgcttgccgtgatatgggaatttcttcagtcgcgttatatgcagatgatgacactggcagcatgcacgtcgaacttgcagatgaagcatggggcttggctggtgcgactgccagtgaaacttatttaaacattcctgccattattgaggttgcaaagaaatcaaaagcaacgatggtacatccgggatatggctttttatctgaacgtgccgaatttgcccaagcggtcattgacgctggcttaaaatgggtagggccgtcaccaggtgccattgaaaaactaggcgataaaattgaagcacgtaaaattgctgcttcagtcggtgcgcctttggttcagggtacgcaagatccactcaataatgcagatgaggctttagcgtttgccaaacaatatggtttacccattgccattaaagctgcgtttggtggtggtggccgtggcttaaaagtcgcgtggaaactcgaagaagttaaagagctttatgagtcggcagtacgtgaagcaaaagctgcttttggccgtggtgaatgttttgtcgagcaatatcttgataaaccgcgccatgtagaagcgcaagtgatcgccgaccaacatggaaacattgtggtgcttggcacacgtgattgttcattgcaacgccgtaaccaaaagttagtcgaagaagcaccagcaccatttattagcgatgagatttatcagcaaattttaagctcggcaaaaaatatttgtcaggctgcaaactatgtgggtgcaggtacagttgaatatttactcagtcgtgatggcaagctttcattcttagaagtaaacacacgtttgcaagttgagcacccagtgaccgaagaaacctcaaaagtcgatttggtcgttgagcaaattcgcgtggcacaaggccatgagctttctattaaagaaacaccaaaagcacaaggccataccattgagttccgtattaatgccgaagacccagcccgtgggtttattccggcctttggtgtgttgagtttgtttgaagcgccatttggtcatggtgtacgagtggacactggcgttcgcacgggttcattagtatctagccacttcgactcactcatggcaaaactgattgtcactggtccaacccgcgaagttgcaattgcccgtgcgaaacgtgctttgaaacaattcaaaattgaaggcgtggcgtcggttttagacttccaccgtgcggtactcaatgaacctgactttaccgataaatttaatgtacatacacgctggatcgaaaatgactttaaacaagagttaatgccaaccaaacgtggcattccaaaccatcaacaaccaatgttgctgagctacattgaaattgatggcaagttacaccgtctaggtttacctgcgggcatgtttgcacaagggccagcaaccgccgttcaagcccaaacagccgagccagaagtgagtgccgcgcatttactggcacccatcaatggtgtgattagcgcttggaaagttgaaaatggtgagcaagtcacagaagggcaagtggttgccattatggaagccatgaaaatggaagttcaagtactggcacatcgaagtggtgttattcagattggtgccgagaaaggcgcgacctgccatgcagaaactgctattgcgagtattcactaa

SEQ ID NO: 2295 - DNA, 747 bp, Acinetobacter baumannii
ggtaaaagtacaatgaaaattaaaattattaatcctaataccacccaaagtatgactgacaaaattgctgcatcagcaaagatagtcgcaaattctgatactcaaattattgctgtgagtcctcaaatgggccctgcaacaattgaaagttattatgatgaagccctaagtgcagtaggtgtgctaaaggaaattcgccaaggtgaatttctagatgtagatgcttatgttattgcctgttttggtgaccctgcgctttatgctgcccgtgaaatgacgtcagcacctgtgattggtattgccgaagcagctatgcgaactgcaagttatgtcagtactggttttagtgtagtcacgacattacaacgcacagtgaatatgagctggcatctggctcatcgctatggggctacaccattttgcaaaaatattcgagcttgtgacattgcagttgaagagttagagcttcctgactcagatgcttatcggaccatacgagatgagtgcaaaaaagcactcgcagaagataaaagcgatgcaattgttttaggctgtgcaggtatgagtgatttatgcctaaaactacaaaacgaattgggagtgattgttattgacggcgttgcagcagcagttaaacaaactgaaatgttagttcagttaaatttaaaaaccagcaaagttggtgattgggcctcacctcctgtaaagaactacacaggcatattgtcaggttttggagtacgctaa

SEQ ID NO: 2296 - DNA, 1752 bp, Acinetobacter baumannii
atgaattacaccaacaataaacgaattttgacccactccactttggtgcttgccatgcttggtgctttggcaggctgtggaagtgataatgatgacacaacggctccttctacaaacaaaccacctcagttatctcctgctgttggcgtaaaaatgacaggaagctgttcagacttactcggatttcagtacaacaataccgttattagctcagctacccttcaagaagcaggtacattgactgtcgccaacaaaccgattggcgcacattgtttggtcaaaggttatatggatcaacgggtaagccctgtcgatggacaaacttatcaaattggttttgaaatgcgcttacctgttgattggaacggccgtttcctctatcaaggtaatggcggaaccgatggcaatttagtccctgcaacaggtcaggtcggcagcggcggtccactcaccaatgccctacatgatggttttgcggtcatttcttccgacgcaggacataatgcttcacaaaatccaatgttcggtttagatcctcaagccagaatcaactacggctacggtgcgattaccaaactcacgcctatggcaaaaaacctaattaaagccgcatatggtaaattgccagaccgctcctatgccggcggtacatctaacggtgggcgtcatgccatgattgctgcaactcgtttgggtgaccaatatgatggaattttggcaagtacaccaggttttcacttacctcgtgcagctgcggctcaactctatacagcacagcagctccgtcgtgtcgcaacagatgaaaatgacctaagtaccgcacttactctttcagagcgtaaagtattagcaaaagcgattttagatcgatgcgatgctttagacggtgttgcagatggactggttcaagatgtcgaatcttgtcgtacagcttttgatattcataagcatgtacccgtttgctcaaacacaagagatggtacttgtttaagtaccgaacaaattgatgtattagccaacatttaccgtggtcctgtaaattcggctggacaagcactctatgcaacccaaccttttgacccgggtttaatcggcagtaactgggcaagctggaaatttgaatcttcggtgggaacagcgcgtgaccccgttgcagtcggcattctttttcaggttccaccagacccaactgtgactcaaaactctagacaatttgcctttaattttaacttcgataccgactatccaaaactatcggcaaccaatgatgtctataccgaaagttccatgtcattcatgatgccacccgatgaactcaatctagataaactccgtaatcacggtggaaaaatgattgtagtacaaggcacagcagatggcgttttctctgtagatgacacccaaaattggtacgatcaactgctacaacactataaaaatgatgcgaaaggtacagcgcctgaatttgcgcgtttctttagagttccgggtatgaaccatacccgtgatggcattgcgaccgaccaatttgacgcattgactgctttagttaattgggtcgaatatgggcaagcacctgacaaaatcattgcaactgcacgcggtgcaggtaacccgagtggtcaagtgaatactgaacttcctcaagactgggcaccagaccgtacccgtccactttgtccttacccactgattgctcgttacaatggtcaaggcgatagcgaaaaagctgaaaactttagctgtaaataa

SEQ ID NO: 2297 - DNA, 453 bp, Acinetobacter baumannii
gaaaaagacacttcaactaacacagtgttttacccacatatagatttcgcactattcactgcgtcgctcaatgatgaaagacaggaaaattttatggaaaaaacactgcaatgtccgaaatgtggttctacagaaattgaaacacgtgatcatgacaaattacttaaaaccactggcggtgttttattaacagctgcaggcactaccgcaggtactgtaggcggcgccgcaactggtgctactgtaggggcagcgattggtactgttgccggaccattaggtgtaattgttggtggaactgtaggaacatttgtcggtgcaatcagtgcaggcattactggcggtgtggtaggtaatatttttggtaaaaaagcaggcgtaatgattgataaaaatatatttcaggactatcgctgcttgaaatgtaaataccgttttaaacagaagaaataa

SEQ ID NO: 2298 - DNA, 1236 bp, Acinetobacter baumannii
cttatgagcacttcacgagtaaagctaactaagtcatttatcgatcaacttgaactcacaccggctatttatcgtgacagtgagattattggctttgctattcgtgtaaataactcttataaaacttacattgtggaaaagaaagtaaaagggaaatcaattcgttgtaaattaggggattacgaaaaaattactcttgaagatgcccgtatacttgcacagcagaagttaaaagagttaactgactcaaaccctttaagcattaaaaataataaaatattaaaaaatagtttaaatgagaaaattgatcagccttatctcaaagaagctttccaagtatatataaatcaccacgagttaaaagaaaggacattagccgactatagagaagttatagaaaaatatttaatagacttaagtgaacttaaactgattgatattactgaacagaggattgaagaaaagtatattcagctatctcagtatagttatgcaaaagctaatttatctatgcgtgtacttagagcggtctatcgtttttcaattaagtattatcaaaataaaaattgtgaagtaattataccaaggataaacccagttaatttgttaaagaagaaacagctctgggaagaaatcccacctcgaagaaactatatcgatgtggataatttaaccaagtgggtgcaagcaattattgaatataaaggtaggggacaggaaaatgaaacaaataaggattttttattaacacttatattaacagggctttttaggaatgagtgtgaatctttacattggaaaaatatagatttagaggaaggaactctgtcttttttaaatccatacaataatgtgtactataaaatttatatgggaaactttctttggcatctgatgaaaaaacgaagaatacaaaataaaggagagtgggtttttccatctgtaaaatctgaatctggtcatattattaatatttcgaaatttagaaaaaaaattaatgagcaatgtaatctttcttttacttttcaagatctacgtagaacattttattttgtgttaaatcatttaactaataaaccattagttagcaaaagaacagaggggtatgaagaaaagctagacgttaagaatattgctcatgctcaggatatgcgtaatagaatgaacaaggttgagcaaattattcttggtccctatcgagatgaacttattaaatctatcaatattaacctataa

SEQ ID NO: 2299 - DNA, 552 bp, Acinetobacter baumannii
tttaaaggcactctcatggctttactgattttagctcatccctactacgctcaatcaattgcaaataaaacgattgtgaatgaactcgtaaaaacctatccggaccttgaagtgcgagatattttccagctttatccggactataaaattgacgtcagcgctgaacaagaagcgttgttacaccatgacaccatcattctgcaatatccaatgttctggtttaatatgcccgcaattttgaagctatggtttgatgaagtttttacttatcagtttgcttatggctctcagggcgacaaattaaaagataaaaaagtcattattagtatgacggtcgggcaaaaagaagcgaacatggtgaacgaccaagaaaacttaatcgatagctttttaaaagcggttcaacattcaattcaatatacgcaaatgcagttaagcggcacatttttgctttatgacgtatcgcctttgtcaggcaatccagagtcaaaaattaaattagaagcggttgaacatggccataaagtattaaaacatttgaccgaagcataa

SEQ ID NO: 2300 - DNA, 1758 bp, Acinetobacter baumannii
cgatataggttgattgatcgaaattccataaagcgtttttatagattcagaacaaaactgcgatctataggtaagtacatggaaggatcagttcagaataaagaacgattatggacaaagcggcgtcatgccaaacaattaaaactagagatggcaaaccaatataccgatggtgtggtcattccaactcaagacattattaaagttttagaaaccttaattacaccgggtgacaaggttgtactcgaagggaataaccaaaagcaggcagatttcctttcgcgttctttggctcaaaccaatccagatgttttgcatgatttacatatgattatgccgagcgttgggcgttcagaacatcttgatctgtttgaaaaaggcattgcgcgtaagctcgatttttcttttgctggcccgcaaagtttacgtattagtcagttaattgaagatggtttactagagattggtgcgattcatacctatatcgaactatattcacgtttgatagtcgaccttattccaaatgtggtgctctcagcgggctttatggcagaccgtcaaggcaatatttatacaggtcctagtaccgaagattctccagcacttattgaacccgcggcttttagtgatggtattgtgattgttcaggtgaatgaactggtcgatgacgtctcagagttaccacgtgtcgatattcctgcttcttgggtggattatgtagtggttgcagaccagccattttatatcgaacccttgtttacccgtgacccgaaacatatcaagcctgtgcatgtactcatggcaatgatggcaattcgcggaatttatgaaaagcataatgtgcaatcgttaaatcatggcattggttttaacactgcggcgattgaactgattttaccgacctatggtgaatctttaggtttaaaaggaaaaatctgccgaaactggactctgaatccacatccaaccttaattccagcgattgaaacaggttgggttgaaagcgtgcattgttttggtaccgaactcggtatggaaaaatatgttgcagctcgttccgacgtattttttacaggtcgtgatggcgctttacgttccaaccgtatgatgtgtcagcttgcaggtcagtacgccgttgatttgtttattggcgcaactttgcaagttgatggtatgggccattcttcaactgtcaccaaaggtcgtttggctggtttcggtggtgcaccaaacatggggcatgatccacgcggacgtcgtcatgatacacctgcatggttagatatgcgtttgcaaggtgccaatgaaaccgaaacttatttggcacgtggtaaaaagttagttgtacaaatggtggaaaccttccaagagggtggcaagccaacttttgtagatcgtctcgatgcgattgatgttgctaaaacggcaggcttacctttagccccgatcatgatttatggcgatgatgtgacccatttactgaccgaagaaggcattgcttatctatataaagcaagcagccaagaagagcgtcaagccatgatcgttgcggtggcaggcgtgactagtattggtttaactcaagaccctaaaacaacagcccgtttaagacatgaaggtctggtggtattccctgaagatttaggtattcgccgcaccgatgccacacgtgaacttttagcggcgaaaaatattgccgacttggtgacatggtcagatggcttatatcaaccacctgcaaaattcaggagttggtaa

SEQ ID NO: 2301 - DNA, 891 bp, Acinetobacter baumannii
aagaacaggttaaagatgaaagaaggtcaatcaagtcgtactgccgaagccgctgctgctttacgtgcgaatcactttaaaaatacgacaaaccctgtattttcagatccctatgcttttgaaatgaccagtaaaggttggaaaaagcttttatctacaccactcattgttaaattaatgaattcacccattttaaaccgtaccttaggtttattgagtggacaggttgtcggtcgatcacgttatgccgaggacttacttaatcaagctgttcaacacaatattgagcaatatattttggttggagcgggtttagactcttttgtgctccgaaaatcacagcattatccaactttaaaaatttttgaagttgaccatcctgatactcaggctgccaaacaatctaaactcaaaaaattaggcgaacttccctctactgttgaatttgtttctattaactttgagaaagaatctatctctgaagcgcttgcccgaagtcgctatgtacgaaaaactccggctttcttttcttggttaggcaccactcattatttaaagccggacactacgctacaaactttaaaaagtattgctgaatttgctgcaaacggaagcgaagtggtactcgactattcaaccgactttcaggagctaaacggtattgagcgacttgggagtatgggtgttgcacagtttacccatttgctgaaagaacctttactaggtcagtttaaaccttctgatttacatcaggcggttgaaaaaatgggttttgaagtagtcgaagacttgtctggtgaagctattactgaacgttatttttataaccgtgccgacaatatacgccatacatcggcaacacgtttgctacatttacgtttaaagaaataa

SEQ ID NO: 2302 - DNA, 945 bp, Acinetobacter baumannii
aggaatataacaatgagtgaaatggatacgattaataaaatgcgtgaactacgtgatgctttcgggtcatttatgacaggcgttacggtggtcacaacctgtaaagaagatggaacgccacttggctttacagcgaactcttttgcttcggtgtctttggacccagctttacttctagtgagtatcgccaagacatcaagcaattatcataactttgcaaataccactcattttgcaatcaatattttggcagaagagcaaaaggatgtttcaaatacttttgctcgtccaagcgaagaccgttttgcaaatctttcatggtcaaaaagcgcttgccagaacccgctgatcgatcatgtcagtgcatggtttgactgtactacctaccaagttgtcgatgctggtgaccatgcgattttaattggtaaagttgaagattttgcttcgaccggttttgcaggtcttggttattatcgtggtggatacttcactccggccaaactttctgccgaggtgatctctggtcctaaagtggtgatgagtgcaattattggtcatgaaaataccattttacttgaagaaactgccgatcataaatggactattccacatgtcatggtagataaagacggtgcagataaagcgctcgagaaaatctttgcacaatatcagccagatgcttctgccaacttcatttactctgtatatgaaaacgttgaaaaccagcagcaatatatttcatttttatgcaacacacccgtagctcaagccactaaaggtcagtttgtcgatttaaatgatcttgaaaagctagagtttgtagacagcgctttagaaagtatgttgatgcgctatcgcaaagaaaaccatttgaaaacttatggtgtttattacggaaatcagacaacaggtacagttcgtcaaatcgttaaagaggaagtttaa

SEQ ID NO: 2303 - DNA, 456 bp, Acinetobacter baumannii
ttcgatataacaaacaataacaattttaggatgaacatgatgaacaataagcaagggtgtgtgctgggaattttaagttgtatagcggtattaccgacgaatctatgggctgcgcagcctatgaatgaaagtgcgcttgcaactcaaacaggagcagtaacggcagctctacccgtaattattgcgaaagctcaagatgatgcgaagaagccagaaatagagcaacgtcaagttcggcaaacactaggggataactatttacagcaggttcgatggaattcactgcgcacaagtgtgttatcaccttatcaagaacaaaagcaaaatcaggtcattgatggaaaagagaagaaaaagttagaaatggttgctctgccagaaagagctgatcgatttacacgttatgattttgagtcaaagaatgtacatggtgaagttatcattaccgtgaagtaa

SEQ ID NO: 2304 - DNA, 1248 bp, Acinetobacter baumannii
gaagatataactatggctaatactagatatgaagatgataacaatagttcaggtacttcaaatcgtggatttgcaagtatggatcctgaaagagtcagagaaatagccagtaaaggtgggcgagctgcacatgccagtggcaatgcgcatgaatttacttcagaagaagctcgtgaagctggccgtgctgcacatgccagtggtaacgcacatgaatttacctcagaagaggctcgtgaagctggtgctttaagtcataaaaacgatgatcgtaatggtcgtggtcgcagccgttatgatgacgacgaagatgatgacggtggccgttcaagtggtcgaggccgtggccgcagtcgttatgatgatgacgacgaagatgatgatcgcggtcgctcaggcggtcgtggccgtggtcgcaatcgtgatgatgacgacgaaggtgatgatcgcggtcgctcaggtggccgaggccgtggtcgcagccgtgatgatgacgatgaagatgatgatcgcggtcgttcaggtggccgaggtcgtggtcgcagccgccgtgatgacgacgatgaagatgatgatcgcggtcgttcaggcggtcgaggtcgtggccgcagccgccgtgatgacgacgatgaagatgatgatcgcggtcgctcaggtggccgaagtcgtggccgcagccgccgtgatgacgacgatgaagatgatgatcgtggccgttcaggtggccgaggccgtggtcgcagccgttatgatgacgacgatgaagatgatgaccgtggccgttcaggcggtcgaggccgtggccgcagccgttatgatgacgacgatgaagatgatgaccgtggccgttcaggtggccgaggccgtggtcgcagccgtcgtgacgatgacgacgaagatgatgatcgtggccgttcaggtggccgaggccgtggtcgcagccgttatgatgacgacgatgaagatgatgaccgtggccgttcaggtggccgaggccgtggtcgcagccgtcgtgatgatgatgacgaagatgatgatcgcggtcgttcaggtggtcgaggccgtggccgcagtcgttatgatgatgacgatgaagatgatgatcgtggtcgttcaggtggccgaggccgtggtcgcagccgtcgtgatgacgatgacgacgatgatgaccgccgtggccgttcagatggtcgtggccagaactctcgtaatcaaaaacgcgatgcttatggacgctttacgtcttaa

SEQ ID NO: 2305 - DNA, 414 bp, Acinetobacter baumannii
aaaaagataacaatattcgtttttttaataatagcctttcaaaaggagaatattaaaatgaatagctcacaagaaccaaatcaatctctgtttaatcaagcatccacctctattcaagcctgctttgaatgtatgtttgcttgtaaacattgtgcctctgcatgtttacaagaagagcatgtgcatatgatgcgtgagtgcatcaaacactgcttaacctgtgtagaaacctgtcagttatgcacatctttagaattaagacattccgaacttgctgaacaagccatgcagttatgtgctaatgcatgtcaactatgtgcagctgagtgtagtaaacacgaacatgagcattgccaggtttgtgcaaaagcatgtttagcgtgtgctcaagcttgtcaggcatatcgtgcttaa

SEQ ID NO: 2306 - DNA, 984 bp, Acinetobacter baumannii
actggtgcaacaatccgtaatttaggaaaagatatttacgttatgcgcaaaaatctcgatggtggacttttgcatgcaatgcatgcattcctgaaagtgattgatagcgggagtttcacagcagcagctgagcagatggatctgaccacagcacaggtttcacgtcttatcagcgagctagaaacacgcttaggtacaaaattaatacaacgctcaacgcgccagcaggcactgactgatattggtgcaacttatgcagagcgttgtcggcaagttatttcaatggtggatgaagcagaggcagaagtcaccggaacggcatctaaacctaaaggtcgtttacgtgtattaagtatgggaagctttgggcatcactatgttttccctgtcatggctgagttttgtaagcattatcccgaattaaccgtggaatatacgacctcacaatacgttccagacctgttggcaaaaggggtggatgtcagtctttatctcactgaatcattaacagattctcgttttgtggcacgtagaattggcactattttttctgttttatgtgcttcatctgcgtatctagaaaaacatggtgttcctaagtctccagaagacttaaaaaatcatgcctgtttacgcttggtaaacccgtctattacaccagattggcatttgttaaatgccaatggtgagtcttgtcaaatcgacattggggggcaactcattgcagataaccctgagttattgttagatgtggtgcaacaagatatgggggtcgcgttattgccaatgttttcggctttagacgcggttcaaaatggaagattatgtcatatcttgccagagtggcgttcgcctgatattggggtttataccttattgccttcacgccattttattgatgccaaaacacgcgcatggttggattgggtagaagaatatatttctccaagaattgaaatggatgcatcttatttttataaataa

SEQ ID NO: 2307 - DNA, 735 bp, Acinetobacter baumannii
aacttagcaacaacaaaacttgagatgtgccaagcacagtctttacggctttgctgtgcctttttttctcccaaaaagggcacaggcttttttatctctacatacaacaaaaatttttataacggtaaaactatgccaaatttagttctcccaacacgtaccttatatgttgtaaataaagcaattgatctgtttcaccaccgtggatttcaccttattggcgtcgacagaatagtgaaagaatcagaaattacgaaagcgactttttataattatttccactccaaagagcggcttattgaaatttgccttatggtgcaaaaagaaaaactccaagagcaagtagtcgcaatggtcgagtatgacttaagtacccccgcaatagataaacttaaaaagctttattatttacatactgatttagaagggccgtattacttattatttaaagccatatttgagattaaaaatagttattccaaagcctatcagaccgcgatgcgctatagaacatggctaaaaaatgaaatttatagccagcttagagtgctaaacgcggatgcttcttttaatgatgccaagctatttgtatatatggtggagggcacaatcattcagcttttaagctcagatggggcaatcgagcgggaaaagatgttggattattttttaaactcttttgttagaaattttagtccatgtatgtttactcatgtcgatgctagcaaatgttag

SEQ ID NO: 2308 - DNA, 348 bp, Acinetobacter baumannii
tttaaagggtttatggagtatataaaattgtcataccatcatcttaactttgaagatcgtactgcattaatgcttgagtcaagaaaagaaggcttttcagccagaaaatttgctgaacttattaaaagacatcctagtacgatctatcgtgagcttaaaagaaatagcatcaatgacgtttatcaagctcaatatgcttctgataacacttttgctagacgtagacgtggtcacagaaaactcaaaatcgattcaatcctctggaaatttattgttgaagcgatccgttgtttatggtctcctcagcaactagcaatcttcatcacgaggcgccggcatccgcgctag

SEQ ID NO: 2309 - DNA, 342 bp, Acinetobacter baumannii
tttaaagggtttatggagtatataaaattgtcataccatcatcttaactttgaagatcgtactgcattaatgcttgagtcaagaaaagaaggcttttcagccagaaaatttgctgaacttattaaaagacatcctagtacgatctatcgtgagcttaaaagaaatagcatcaatgacgtttatcaagctcaatatgcttctgataacacttttgctagacgtagacgtggtcacagaaaactcaaaatcgattcaatcctctggaaatttattgttgaagcgatccgttgtttatggtctcctcagcaaatagcaaagcgtttaaagacccttcctgattag

SEQ ID NO: 2310 - DNA, 597 bp, Acinetobacter baumannii
ataattaaaaccagaggttctgtcacacatagaacctctttttatttcgggaaattcatcatgaagaaagttgtaacactactctgcggaatttgtctcattggcctaactcatgccgcaactcaatataacccaccacctattcagcttgagcctttagcaaaatttagtgttgatctaaatgcgcctgtttgggaattaggcacgaccagtgatgcaggtaaacgccgaattattcccattacaggtgggacatttgaaggcaaatcccttaagggccgcattttaaataatggtgcagattggcaaatcgttgacagtaaaggactggccattattgatacgcgatatttgttggaaaccgatgacggtgcgcttatttaccttcaaaccaaaggttaccgccatggctcggcagaaacgctaaaacagcttgcccaaggcaaagatgtcgacccgaaaaattactatttcaaaattaccatgcagtttgaaaccagctcaccaaaatattcatggcttaaccagaccgttgctgtaggcagtgcaatgcggttgggtaaagcagttatttatgatgcctataccctgaaataa

SEQ ID NO: 2311 - DNA, 1815 bp, Acinetobacter baumannii
aaggaaaaaactatgcctttatacaaagctccattacgtgatatgcaatttgtactgcatgaaatgcttcaaacagaacagaactatcaaggtttaagcaaatatcaagaaagcgtaaatcgagaattaattgatcaatacttagaggcagcagtagatttttgtgaaaatgaattggcgcccataaatcaaaatggtgatcaggaaggctgtcatttaaatcaaggcgtagtcacaacgccgaaaggttttaaagaagcctaccaaaaatatgccgagctaggttttacttcattaaccgccgatccggaatatggtgggcagggcttgccgacattgctgcggattgcgatttctgaaatgttatgtggttctaattgggcttgggcaatgtatccgggattgtctcatggcgcaatgagaacaattgagcatcatgggaccgagcaacaaaaacaaaagtttttgactaaactcattagtggggtttggaccggaacgatgtgtttaaccgaatcacatgcgggttcggaccttgggttaattagaacgaaagcagaaccaaattcggacggtagctactcaattacaggcgaaaagatttttatttcagcaggagaacatgatctttctgaaaatattattcatattgttttagcccgtttgcctcaggcacctgcagggaccaaaggtatttctttatttattgtgcctaaatttaatgtgagtgatgatggtcaggtgctggaccgtaataaagtcgtttgtagcgcgattgaacataaaatggggattcatggcaatgccacctgtgtactgaattttgatggcgcgaaaggttatttgattggtccggaaaatcgcgggctcaattgtatgtttacctttatgaataccgcacgtattggaacagccgtacaagggcttgctgcttctgaaatttcatttcaaggcgcattaagttatgccaaagagcgactcgccatgcgctcgttatctggtccccaatatcctcagaaaaacgccgacccaattattgtgcatcccgctgtacgttcaatgttaatgatacaaaaagctttttctgaagggggccgtgcgttggcttattttttagctcagcatgtcgatattgttgaaagctcaaatgatcaggaacagcaaaaacactccgatgaattactagcttttttaacacccattgctaaggcctttttaacagagtcgggtaatgagtctgcaaagcatggtgttcaagtatttggtgggcatggctttattgttgagcatggtatggagcaaattgtacgtgacgcacgtatctcaaccttgtatgaaggaacaacagagattcagtctctagatctgctggcacgtaaagtcctcaagtcggaaggcaaacttttaaagaacatgactgatttaattgatcagtttattagccagcaccaatccaatgaagtgctgaaaccttatctagaaaaattagctgagcttaagcagcaatggctgtcactgaccaaattgattgcagagaaagccaagcacaaccctgaagaaataggagccgcttcagtagattatctttatttttccagttacgttgtgttcgcgtatttgtgggctcgaatggcacaagttgcccatgaaaaattagaatcgggtacacaagaggaagatttttataaagcaaaattaacgacagctaagtttttctatcaaaagcttttgcatcgtacacagagccatgccgcttctattgagtcaggagctgaatctgtgatggagctcgatcaagatgcttttgcattttag

SEQ ID NO: 2312 - DNA, 249 bp, Acinetobacter baumannii
ccaccattgaccaaaccaaaacacagcattaacaaccatgttctaggtttctttaataatgtttttacaggtgacagatgggcagtcgaacttacaatggagggtaaaaaaataaatgttgatactaatgctaatacagcgggtatagtaaagaaagccagccccagtgaccatagacccgttatattggaaatcacaggtgccaaccatgcgcctagtgcgccaccacccataagcatagctgaataa

SEQ ID NO: 2313 - DNA, 1398 bp, Acinetobacter baumannii
tattttatgactaagaaaattagttttaatgcttttgaaatgaattgtattgcccaccaatctcctggattatggcgacatcctcaagatcgatctgttgaatataaagatttagaatattggacagatttagcacaaattcttgagcgtggtttttttgatggtatttttattgcagatgtgcttggtatttatgatgtttatcatcaaagtgctgaacatgccttaacaggtgcagtacaagttccagtcaatgatccgctacagattatgccagcgatggcagccgtcacaaagcacttgggttttggtgtcacgacttctatttcctttgaacatccgtatccttttgctagacgtattagcacgctagaccatttaaccaaagggcgagtcggttggaatatcgtgacgtcttatttggaaagtggttcgaaaaacttgggcctaaaaactcaggtcaatcatgacaatcgttatgatattgctgatgagtacttagaagtcctttacaaactttgggaagggtcttgggaagaaggttcggtactgcgcgatcgtgaaagcggtatttttgctgaccataaaaaagtgcatccaattcagcacgagggtaaatactttactgtaccgggcatccatatttgtgaaccatcaccacagcggacgcctgtactttaccaagcaggcgcatcttcacgcggacagaagtttgctagtcaaaatgccgagtgtgtattcatagcagcgccgtctaaaattgccactaaaaaagtggtacaaggcattcgccaaaaattggctcaagaaggccgcgatccgtactctgttaaaatttatgcgcttttgtcgattgtcactgatgaaaccgatgcaaaagcacaggctaagtttaaagaatatcaaagctatggaagctacgatggggcattaacattgctgtctggctggtctggtgtcgatttttcacaatatcaaccgaccgataaagttgaatatattcaaaccaacgcgattcaatctttattagactcttatgtaaatgcagatccagaacgtgtctggaccattgaagaaattgcaaactggaacagtttaggtggtaatggacctgtacttgtaggttcggcagaaaccgtttcggatgctctagagcaatgggttgaagataccgatgtcgatggctttaaccttgcctatattttggcgcatcaaacctttgctgatgtggtcgaatttattgtgccggagttgcaaaaacgaggggtttatcaaacttcatatacacaaggaactttaagagaaaaattatttggtgctgggccatatttgcctgaaaatcaccgcggtgcaaaatatcgtaatctaaaagagttaaaacttgctgaggcgagttaa

SEQ ID NO: 2314 - DNA, 762 bp, Acinetobacter baumannii
aactatccgacaggagtggctatgaacactgcaagttatcataacaatcaggcgatttggaccgaacttttacccggaggacatcactggtcgggtcgtattcaaaagggaactattcttaaatttacttcgcttggcgctcaggcaaatgtttctttgttttgtgtaaatgctgccgatgtgcttgaacgtttcaacatgcccgacagtttaaaagggcaacacactgcctatttaaaagcttccaatgtattgtactcggaccttggtcgtgtcatggcttccattgttcgtgatgatcatggttggaatgatgcactttgtggcccaagccgaccagaacaaattgaaaggcaatttgggatacgtacatttcaagatgcccgcaatgatatgtaccaaaacggcttagacagcttactcattgaaatgtgtaaatatgggcttgccagccaagacctgagtgccaccgttaatctattttctaaagttgcaccagatgaaaacggtgctttgtcttatgtcagttctgataacaccaatcaaagcattgaattgcgttttgaaatggactgcttagtatttttatctgctgcgccgcatggtttagacaccagcccaagctatcaacctgccgatattcaactcagtttatttaaagccaattcactaacagacagcgatatttgtcgtgatgcatgttcgcaaaatcagcgcgcgtttcaaaacacagcccgctactacgcacttagcaatatttaa

SEQ ID NO: 2315 - DNA, 1992 bp, Acinetobacter baumannii
tctatgacgacccctttaaacgaacgtcgtattgcaaacgcaattcgtgtattggcaatggatgctgtgcaacaggcaaactcagggcatccgggtgctccaatggggatggcagatattgctgatgtcgtctggcgcgagtttttaaatcacaacccaaataatccacaatgggcaaaccgtgaccgttttgttttatcaaatggccatggttcaatgttgcaatatgctttgcttcatttaacaggttatgatctttcaattgaagatttaaaacaattccgtcaattgcactcaaaaactcctggtcatcctgaatatggttacgctccagggattgaaacaacgacaggtcctttgggtcaaggtattgcgaacgctgttggttttgcattagcagaaaaaactttagctgctcagttcaataaagatgacttaaaagtagttgatcactttacctattgtttcttaggtgatggctgtttaatggaaggtatttctcatgaagtatgttctttagcaggtactttacagcttggtaaattgattgcttattatgatgacaacggcatttcgattgatggtgaagtagaaggctggttcagtgatgacactgaagagcgtttcaagtcttatggttggcaagttcttcgtgtagatggccacgatgctgatgcgattcgtcaagcaacagttgaagctaaagcagaaactcaaaaaccaacgattattatttgtaaaacaattattggcttaggttctccaaacaagcaaggtaaagaagactgtcacggtgcaccactgggtaaagatgaaattaccttaactcgtgaagctttaggttggactgaagaagcatttgttattcctgctgatgtatatgctgcatgggatgctaaagcaaaaggtaatgaagctgaagcagcttggaatgaagtatttgctcaataccaagcaaaatatccaacggaagcggctgagttacttcgtcgtattagcggtgacttaccagcagaattttcagctcaagcagatgcatttattcgtgaaacaaatgctaaagctgagactgtagcaactcgtaaagcgagccaaaacacattacaagcatttggtcctttattacctgaattattaggtggttctgcggacttggcaggttctaacttaacactttggaaaggttgccaaggcgttcaagaaaacccggctggtaactacgtgtattatggtgtacgcgagttcggtatgactgcaatcgctaacggtgttgcattgcatggtggcttcattccttacgttgcaacgttcttaatgtttatggaatatgcacgtaatgcagtacgtatgtctgcattaatgaagcaacgcgtgattcatgtatatacacatgactcaatcggtttaggtgaagatggtccaacacaccaaccaattgaacaaattgcttctttacgtggcacaccaaacttaaatacttggcgtcctgctgatactgtagaaacagcaattgcgtggaaatctgctttagagcgtaaagatggccctacagcacttattttctctcgtcaaaacttaccattccaaacgcgtactgaagagcaaatccaaaatgcggcaaaaggtggttatgttcttgctcaagagaaaggtgagttgaaagcaattattattgctactggttcagaagtttctttggcaatggaagcttatgctcaacttgaaggtgttcgtgttgtttctatgccatgtgcagaagagttcatgaaacaagatgctgcatatcgtgaagcagtattaccagctcatattcgtgcacgtgttgctgtagaagctactcacgttgactactggtggaagtttgttggtctggatggcaaagtaatcggtatgacaacttatggtgagtcagcaccagcaaaagacttgttccaattcttcggtattacaactgaggctgtagttgctgcggtgaaagagttaactgcttaa

SEQ ID NO: 2316 - DNA, 1164 bp, Acinetobacter baumannii
aaggacgagactatgattcgagatcaggaaaccttaaatcaacttgttgatatgattcgacaatttgttgaaggtgtattaattcctcatgagaatgaagtcgctgaaacggatgaaattcctccagatatcgttgagcaaatgaaagctctcggtttatttggtttaaccattcctgaagaatacgaaggtcttggcctaacaatggaggaagaagtctatgtggcttttgaattgggtcgtacctctcctgcttttcgttctctcattgggaccaataatggcattggctcaagtggcctgattattgatgggaccgaagcacaaaaatcctttttcttaccgcgtttagcacgtggtgaagtgatcagctctttttgcttaaccgaaccggatgcaggttctgatgcggcatctttaaaaaccagtgcagtaaaagatggcgatttttatgtgttaaacggcaccaaacgttttattaccaatgcacctcatgctggtgtatttacagtcatggcacgcacaaactttgacattaaaggtgctagcggcatttctgcttttatcgtcgatagccaaactccgggcatttctcttggcaagcgcgataaaaaaatggggcaaaaaggcgtccatacctgtgacgttatttttgaaaattgtcgcatcccagcttcagcactcattggtggtgttgaaggtgttggttttaaaactgctatgaaagtactcgataaaggccgtttgcatattgcggccttgagcgtcggtgcagcaacacgaatgctagacgattctttaaattacgccatcgaacgcaagcaatttgggcaaccaattgccgaattccaactcattcaagccatgcttgctgactccaaagccgagatttatgccgctaaatgtatggtcttagacgctgcacgcctacgcgatgcagggcaaaacgttagcacggaagcctcttgcgcaaaaatgtttgcaaccgaaatgtgtggccgcgttgctgatcgctgcgtacaaattcacggcggtgcgggctatatcagtgaatatgccattgaacgtttttatcgagatgttcgtcttttccgtctttatgaagggaccactcaaattcaacaagtgattattgcccgaaacatgattcgcgctgcgtcttaa

SEQ ID NO: 2317 - DNA, 771 bp, Acinetobacter baumannii
aaagaggagacattaataaaaatggagaaatcaatgtcatcgaatgcaccaaaaaaagccgtagaaatgagcaatgatgaaattgatgaccatatatataacgctattgtagatgctattttaaatcgacaactcgcaccaggcgcacgtttagttgaagcacctttatgtgaagcatttggtgtaacgcgaggagtgttaagacgtgttttcgtcaaacttgcacatgataaggttattgaaattcagcccaatcgtggggcactcatcgcaaaacatagcacaaatgaaacaaaagaagtctttgaagcacgcagcatgctggaaatcgccactgtaaaaaaactagcacaaaaatctcatcgcctagatttgagtgagcttcgaagcttagtagatcaagagtctcatgaacgtttagctggaaattgggcagagtggattaagctatcaggtcaatttcatttaaagctgattgaagctaatcaaaatacgatcatgaccagttatttgcagacacttattgcgaggacttcgttattaattggcttatatgaaattccaaaacataataattgttcggtagatgaacaccgtgcaattttagatgccattgaacaaggcgatgaaaaacgagcaacgcaattgatggaagaacatttagaacactacgcaaccacatttattgaagaaaacagtgcagtatctgccgagcaaaatttattaaatttatttaaaaataagagaattgaaacacctcaaactaattaa

SEQ ID NO: 2318 - DNA, 204 bp, Acinetobacter baumannii
gaaattcggaccttcgtaaaaacagtctacaggacaaacttctacgcaatcttggtatttacatttaatacaattttcagtgacaacaaaggtcatggcgacagctacctaaaaaatatggtttcatttcgaatagcttattttaggcaaaaaaggggtaaacaaacaattgcttttattgatattgtttatttatacatatga

SEQ ID NO: 2319 - DNA, 918 bp, Acinetobacter baumannii
ataaattttgctatgtcttattttgatatcaatcgttctggcgagttagcaatttttataagggtggtcgagcttggaagtttttcagcggtagcaagagcatgtaatatgacgccgtctgccgtaagcaagttaatttctcgtttagaaaaaagattgggtgtcaggttactcaatcgttcaacacgtcagtttcagcttaccagtgaaggatgccagttttatgagcaaggcattcaaatactcaatgacttagacgaactggaacaagcggttactgcaaatcatataccgaaagggcgaattagaatccataccagtttttcatattggacacactttttattgccttgtattagtttgtttaatcaacgttacccggaaattgaattagaagctcatttgagtgatgaagtaattaatttggttgaacaaagaattgatgttgcgattcgaacaggacctttgaaaagttccaatttggtggcccgatcgcttggcagtacttataaacactatgtttgctcacctgtatatattgaaaagtacggttgccccgaacatccagatgaactacatgaacatcagcttttagatgtaagttatcagcgccagaacaaaacctggttatttaaaaaagcaactcaggaaatcagcctaaccccctctaaagttttaaaagtaaaccatggcgaagcaattttacagttggcactggcaggtgccggtattgctcaactaaatgaattccagattcgaaatgctttacagcaaaaacaactcgtcaaaattcttgaagattggaatattcatgcttctgaagaatttcatgctgtctggattggccatgataagtatgttcctaatcgcgtacgtacattcttggattttttggtagagcatgcctctataaattag

SEQ ID NO: 2320 - DNA, 684 bp, Acinetobacter baumannii
caaactcttgcttttttttcagtatgtattatggtataccataatacgaatgacaagataatttacttgcaaggaagagcaatggaactcatacgtaaaactgtacttcatgtagaaaccacttatgtagatggcggcaaagaagcagccaagcctttaaaaatggtggcagcagcagcggtaattaaaaatccgtgggcagggcaaggttatgtagaaaacctaacaccggaaattcgtcgtattgcgccaatcttaagcgagcatttaaccaagcttattcttgatgaagtcggttcgggtgaggctgttgaagcttttggtaaaagtgcagtggtgggcttaaatggtgaacttgagcatgcatcagctttaattcataccttacattttggtaatacttaccgtagtgctgttggcgcgaagtcttatttggcatttaacaatacccgtggcccagcaaatgcgccgattttaattccaatgatggataaaaatgacgaaggccgccgttctcattacttaacattgcaatttgcaattccagatgcacctgctgccgatgagctggttgttgtgattggtgcagcaacaggtggtcgaccacatcatcgtattggtgatcgttataaagatttggaagagttaggtcatgatgtcaaaaaccctgcagctgtcaaataa

SEQ ID NO: 2321 - DNA, 1077 bp, Acinetobacter baumannii
gtatgggttgctatttctggtggggctaattggggcggctgtaacgtctgggctagccttgataatacgacctatgaaatgatcgggactatttatggatctgcacgttatgggcagcttgttacaccaattgatgcagatgattcgactttacaggttgagttaaatacagcgagccagattttcagtggaaccttagaagatgctcaagccgaccagacactttgtaaagtgggggatgagtattttaattatcaagtggccacattaaacggatctggtttatataccttaagtgatgttctacgtggacgctttgatgatgcacaaagccataatgctggtgagccatttgttcgtttggataaagctatattcaaatatccatacaatgacggtttagtagaaaaacagatctttttaaagttcaccagctttaatggtttggaacgtaaggagcaggccttagatgaggttacggcgtatagctatactctaagtggcggacgtccagcaggtgttaaaggtctttcgcttcaatctccgtttgtggggactacttttaaagttcaatggcaaacttcaactggtgcggatggctatcgtgtacaagtctggtcgaatggggcaatgattcgtcaagttgatacaaccaatacggattatagttattcgatcgaagaggccaagcaagatggtttaggccgagcttacacaattcgagtggccagcaaaaatggtgatcaagttagtacctttgctgaattgagtattagtaatcccgttccgccagtacttctcaatgtgtacacagcagcaactgtagattctattactgtgaattgggcacctagtgaagtacctgatctgaaagagtatgctgtatggctaagcgctacacctaactttgatccaactcaagtgccgccatcatggactggtacagaaacaactacaacttttggaggactacaaccaactaccccatattacattcgtgttgctgcacgtgatgtatgggaaaacacagtctggaactatacaaatcagattactcaaagtacttctgaagcttaa

SEQ ID NO: 2322 - DNA, 777 bp, Acinetobacter baumannii
aggaataatgccatgtttgtagatttaaatagtgatttgggcgaaagctttggctcatggaaaatgggtaatgatgaccagattttacctgtcgtgaccagtgcgaacattgcttgtggttttcatgctggtgatccgctcggcattttaaaaacagttcgtaaagcagttgagcttggcgtgaccatcggtgctcatgtgtcttacccagaccttgttggatttggccgtcgtaatatggatttgtcacgtgacgaactcattgccgacgtgctttaccaaatttctgcactcgatgggttagtgaaagtagctggctcaaaagtgcagtacgttaaaccacacggcgcgctttacaacaccattgctcatgaccaagctcaggcagcagcagtgattgatgccattaaaatgtataaccctgaactggttttggtggctttggcgggttcaaacttagtcgagcaggcacgtgcggctggtttaaaagttgtgtccgaagcatttgcagaccgtgcctataacagtgatggttcattagtttcccgccgtctagaaggtgcggttttacacgactcggcatttgttgcgagccgtgtggtgtctatgcttaaaaatggtggggtcgactcaattgatggtgtatttaccccaattcaggctgacacgatttgcttacacggcgataccgacggtgcactagaaatgtcggctgccattaaagccgagcttgtaaaaaataatattgaaattcgcccatttgtaaataaagcataa

SEQ ID NO: 2323 - DNA, 306 bp, Acinetobacter baumannii
tttttctattttctaaataaaaacagtgaaatatttatatcaagttatataaatcaatcttttatttttgcaattgacccaccacaatgctcagcttatgatgctcgcgctgaccaattttgtcagtcggttttagcagaccgtctacctaagtgcactaaaaacacgttttttggtgtgacgcccctcgtgcctttgatggaggaacgggagtgggacacccttgggtgtgctggtttcttaggtatcagtctgctaaccctctttcgtttcgccaccataataatgagcaatgagtgggcataa

SEQ ID NO: 2324 - DNA, 336 bp, Acinetobacter baumannii
gtagctgtcgccatgacctttgttgtcactgaaaattgtattaaatgtaaataccaagattgcgtagaagtttgtcctgtagactgtttttacgaaggtccgaatttcctagtgattaatccggatgaatgtattgactgtgcattgtgtgaaccagaatgccctgcaaatgcaattttctctgaagatgagctaccagaaggtcaagaagtatttattgaattaaatgctgaactttctcaaaagtggcctaacattactcaaattggtgaacaacctgctgaccgcgaagaatggaacggcaaaccagataagttacagtatctagaaaaataa

SEQ ID NO: 2325 - DNA, 1260 bp, Acinetobacter baumannii
ttaactcacgctgcactaagtcaggcttcaatcatttcgcgggtatggggtgaaggaccttctgaacggtatgatgaattggcaagtaacttcagaccgacttttgcccgtattaaagaaggggctttaatccgtgagcagcagcatattttgccctatgaacaacttcaatggcttaaggatattggttttacacggttaagacttccaaaaactcatgggggctttgatgcaaccattcctgaactatttgcattactcgttgaacttgcagaggccgactcaaacttaccgcaagctttgcgtgtgcattttggtttcactgaagatgtgttggtaagtaaagacaaaacgtttcaacagcgttggcttagccgaattgccaatggggaaacagtcggtagtgcatggtctgaaggcgggaaagagtcaatcgatcagtttgaaactcacttatatcgagacagtgacggaaaaattcgcgttaaaggcaaaaaatactacaccacagggagcctatatgcagactgggtggatgttggggtaacagatttaaaaggagagtctggctcagttgttgttcgccgtgaagatgaaggcgttgaaattgtcgatgactggaatggttttggtcagcagcttactgcaagtggtacggcatatttccacgatgtattggtcgatgaagctgaaattttacctgacgatgaccgttttaaatattcggcggcttactatcaactggtccaactggcaatcattacaggtctagggcgtgctgcaacctatgatgtttctcaagctgttgcgaaacgtacccgaaactacacgcatgcaaatgcccaatttgtaaaacaggatccgcaaattttacaagtagtaggacaaattcgtggcgcggcttatagtgcaggagcgattgttgaaaaagttgcacaaagcttacagcgtgcttacttggctgcatttcaaaataatgagcagcttgaagaagaacaaaatgcacttgccgagcttgaaagtgcgcagtctcaaacggtcattaccgatctaattttaaatgcttccacgattttatttgacgctttaggtgcttctgcaacagacaaagatttaggtctagatcgatattggcgtaatgtacgaactctagcttcacataacccgagagtatttaaaaatcgaattgtaggtgattttagtgtgaacggcacattaccaccgtatcaatggcgaatagggaatgttgctaaacaataa

SEQ ID NO: 2326 - DNA, 1491 bp, Acinetobacter baumannii
acacccgacgcgtttatgcgcttcattgacatattaggatatcaagaccttttaaatcgtagcgaaggtcttgatgacttccaccctttggaaagtcggagaacggacatgccacgtattcctgtaatcaataccagccatcttgaccgtattgatgaattacttgtagacaatatcgatacaggtgaatttaaacttcaccgctcagtttttactgatgaagccttatttgacctcgaaatgaaatacatcttcgaaggtaactgggtttacttggcacacgaaagccaaattccaaataataatgactactacacgacttatattggtcgtcagccgattatcattgcccgtaaccgtaacggtgaacttaatgccatgatcaatgcgtgttcacaccgcggagcacaactttgccgttacaagcgtggtaacaaagcaacgtatacttgccctttccacggctggacttttaataactcaggtaaattgctcaaagtaaaagacccaactgacgcaggttactctgactgctttaaccaagacggctcacacgaccttaaaaaggtagctcgttttgagagctacaaaggcttcttatttggtagcttaaatcccgatgttccttcgcttgaagaatttttgggtgaaaccaccaaaatcatcgatatgattgttgaccagtctgaacatggtttggaagttttacgtggttcatctacctatacctacgaaggcaactggaaactcactgctgaaaatggcgccgatggttatcacgtttctgctgttcactggaattacgcagcaacaactcaacaccgtaaagaaactcaagctgccgataacatccgcgcgatgagtgcaggttcttggggtaaacaaggcggtggctcgtatggctttgaaaatggtcacatgttgctttggacacaatgggcaaacccagaagaccgtcctaacttcccaaaagcagacgaatacaccgaaaaatacggtgaagcgatgtcgaaatggatgattgagcgttcacgtaatctttgtctgtacccaaacgtttatttgatggatcaattcggttcacaaattcgtgtacttcgtccactttcggtcaatcgaaccgaagtcaccatttactgtatcgcgcctaaaggtgaagcacctgaagctcgtgcacgccgtatccgtcaatatgaggatttctttaatgcttcaggcatggcaacaccagacgatttagaagagttccgcgcttgtcaggcaggctacgcaggtattgcccttgaatggaatgacatgtgccgtggttcaaaacactggatttatggaccggacgatgcagcaaacgagattggtttaaaacccatgttaagtgggattaaaactgaagatgaaggcctgtatctggcccagcatcaatattggttaaagaccatgaaacacgcgattgctacagagaaagaaattgctgatcagggagaaacagcatga

SEQ ID NO: 2327 - DNA, 1167 bp, Acinetobacter baumannii
caaatgcgcgctcttacttaccacggtgcagaagacgttcgagtagaaacggttgcagacccgattatacaagaaccagatgacattattttacgtgtgactgccacagcgatatgtgggtccgacttacatttatatcgaggcaaaatcccaaagactgaacatggcgatatctttgggcatgagttcatgggcattgttgaagaggtcggtccagccgtcaccgcagtcaaaaagggcgaccgtgtgattgtgccatttgtgattgcctgtggtgaatgtttcttttgccaactcgacttaaccgctgcatgtgagaccaccaatacaggtcgcggcgcgattatcaataaaaaacagattccaccgggtgcagctttatttggctatagtcatttatatggcggtataccgggcgggcaagcagaatatgttcgcgtgccaaaagctaataaaggaccttttaaagtacccggctcactgtcagatgaaaaagtgcttttcttgaccgatattttgcctacggcttggcaggccgtgaccaatgcccaagtgaaacgtggctcaaccgttgcaatttatggtgctggtccagtcgggctattaagtgctgcttgtgccaagatgcttggcgctgaaaaaatatttatggtcgatcacaatgaatatcgattgaactatgcggcggcaacctatgacgctattccggttaattttgatgaagtcgatgcagccgaatttattattcaaaatacggacaattatcgtggcgtcgatgcggtgattgatgcgattggttttgaggcaaaaggcagtgtcattgaaacagtcctgaccaatttaaaacttgaaggttcaagtggtgcagcgcttcgtcaatgtatagctgcggttcgccgtggtggtgtggtgagtgtaccaggtgtctatgcaggcccgattcatggttttttatttggtgatgcttttgataaaggcttaacttttaaaatgggccaaactcatgtacatcaatatttgccgcaactcttagaattgattgagcgtggtgaattaacacctgagacgattattacccaccgaatgaaattagaagatgccgcagaaggttatcgcatttttaatgaaagagaagaggactgccgtaaggtgattctgcttccttaa

SEQ ID NO: 2328 - DNA, 351 bp, Acinetobacter baumannii
cgaatatattttgttgaagatatgatcaaccaagtcgatttctttaaatgtctatctgaccaaactcggttaaatattcttaaattagttctaaataaacaaaatatttgtgtctgtgagctaaccgaacagcttgagttgagccaacccaaaatttctagacacttagctttgttacgaactcatggcgtattactggatgaaagaaaaggacagtgggtttattacagcttaaatcctgatttacctgtttgggctttagatattttaaaggtgatagaaaatgacgagagtgggacaaatgtaaaacaacaagatcagcctttcatcacgacaacgtgttgtgattaa

SEQ ID NO: 2329 - DNA, 2025 bp, Acinetobacter baumannii
tccacatatttgaccataatgtttgttagaaaaagaaactcagcgctcttcacggtcatactcctcggttcaatcctgagtggatgtcaggtcgtcaatgttaagcaacaagctctcaacgttactattgcaaatgagcgtaatagtattcttacccaagataaactaagtgaagcaagtcttaatgttttgtccatgtcagggcaagaagctaaggcctgtacagactcccctgatacttgtgttaatcaacttaaaaatctgccccaaattttagatgaacagctgttatcggctgcaagtgaaatgtatctggcgaaagcaatggctttgtcagattcttctgaatgtaaaattagtcgtttcactaaacataagccaactgaagaacaaaaagttattcaaaataaatatgatgaatgcttagatcaacagttaagtctactcgataagagtatccgttatagctatgcttatctgttttctacaaaacgtcagccaactgatcgtatttttgataatagacaagttcagatacgcgacttctataatcaagcgattgccaaaatggtcagtgtgtatgatttaaggtatccacaaaaaaatgtggtagagccacaaatccatattggtaagagtgtatattcaattgattttgagtttcatagacaattatctggccaaaaattagaaaaattaatttcaagttataacttaaatttctcaggtttaagaacaatcaaccgtcgtgatggtttcggttccgaatttgtagctgtcttcccaagttcaggcaaagaagacattaatgaatacattttagatccacttaattacagctataaaaatggtgtaaatccaaatattcaccatgcacgttatttagcggcaactattgttgcagagcctaaacatgctaaaaccattcaagaaattattaatgacccagaatttgtgattcgggtctatgatccttatcgaactgataatattaatgtcgctggtaagcaatatcctttagctgcaaacttctcagctccttatggtctgtggttagctgaaaacaacctaggtgtagcggcttatttaagcttgattgatcgtgatcagcacttaaccatgccgcatttatatatgcttgaaccttataatccaaacaaaaaaattattgtgttggtccatggtttagcaagtagccccgaggcatggattgcgctcaccaacgatgtcatgggtgatactgttttaagagataactatcaagtttggcaagtcttctactcgaccaatatgccaattctggaaagccggttccagatttatgcactcttaaaacaagcgttcggttcgttaaacccaagtgatcctgctgcgcatgatgcggtgcttgtaggtcatagtatgggaggaattattagccgtttacttgtaagtgatgctgatattactaaacctgccttggagatgatgacgatccgtcagcaaaaccgttttaagaaacatcctatggtgactgaacggctgcaaatgcattcaattagtaactttgatcgtgcaattttcttggcatcgccacaccgaggtactgattatgcagatcgttggtttaccttggcagcacgtaaaattatccgcttaccgggtgcttttttatcagctgttgcaacttcgctcaccacagaaaatttagatattaaagatttcttgaataatattgataatggcctgattcaaaatggaccaagcgacttaagccatcaatctaaatttatggaactcactgagaatattaatccccatcaagggttaatcttccactcaattatgggcaacattaccaaaagtgatgatccaaatgtaattaccgatggtattgttccctataaaagtgctcacttagaaggtgctaaatctgagaaagttctaccgggtggacactccattcagttaacaccacaagccgtattagaactacgtcgtattttacgagagcatttagttgaacatggtttgtataaaccatga

SEQ ID NO: 2330 - DNA, 297 bp, Acinetobacter baumannii
ccagtgttagcgaaaaggcttactatccttaattccatctactctcatgctgagttatctactccttcatttattattaactctccacgacaacaagatattgattctgataattatcatcatatgcttaatattttaattagtaatacacctgacgatgtacagttaattattgcgggagtgcaaaataactttattaacagcattaaaggaaactttgaagaaattaaccccgaatcaacacttttaactgcagaagagtatgaacttgccaatttcttaatcttacatagttaa

SEQ ID NO: 2331 - DNA, 3483 bp, Acinetobacter baumannii
atgaatatagctacaaaagtcactccaaatattattgcaacaaaggatgtgtcacttgaagataaatatgtaagtgataacggtacagcatttatgaccggcattcaggcacttgttcgcttgcctcttgcccaaactcgccgtgacgcgatcaatggttatcatactgctggttttatttctggttatcgtggttcccctattggtaactatgataatttcctttggcaagttgaaggattacttaaatcccataatgtcgtatttcaacctggtgtaaacgaagacttggctgctaccgcaatctggggtacacaacaagcaaatctttcaggtcaaggcaaatatgatggagtgtcttcatggtggtatggtaaaggcccgggtgttgaccgttcaggcgatgtactccgccatgctaacttagctggtacctctgaacgtggtggtgtcgttgctttatttggtgatgaccactcatgtaaatcttctacagttccccaccagtctgaacatgtcatgattggttgtggtattccaattttctacccaacatccgttcaacaaattttagactttggtgttcacgccatcgcagtttcacgtttttctggtctttggacttccatgaagctagtcagtgaaattgtagaaacttccgcttcagttcatgtcgacttagaccgtgtcactcctgttataccagaagatgttaatttcccagagggtggcgttaacattcgttggccagatcatggcatccaacaagaagaacgtctttataaatatcgcttaccagctgttttggcctatgctcgtgcgaataaaatcaataccgtaacatggccttgtgaaaatgcccgtattggtattgctgcaagtggtaaaggttatttagataccattgaagccctacgtattttaggaattgaagatgaaacagcccaacagcttgggctacgtgtttatcaagttggtctaatctggcctttagaaccacaaggtattcgtgaattcgccaaaggtttagaagagttgatcgttattgaagaaaaacgtccaattcttgaaacacaaattaaagatgagctttactcacttcctgatgaccaacgtcctcgtgtcattggtaaagcaactgacggcaaaggtgaatggagtacctctattgaagaagcaccactcattggtcactatgagtaccagcctgaaccgattgcaaaaatgctggctgctcgcttcttaaaactagatattccagaaagcttaaaagtacaaattcaaagcagaatcgacttattgctaaaagcagagcaagaatcaaaacgtgttattgaccttgctgaacgtaaaccttatttctgcagtggttgcccacataactcatcaacagtcgttcctgaaggtagccgtgcattaggtggtattggttgtcactatattgctgtttcgcttgaccgcggtaccgaaacattctctcaaatgggtggtgaaggtgtaagctgggtcggtgcatcaccttttaccaatgaaaaacacatttttgctaaccttggtgatgggacttacttccactcaggttacttggcaattcgtcaatctatcgctgcaaaaaccaatattacctataaaatcctctacaacgatgcagtcgctatgacaggcggtcagcatgtagatggtcatttgagcgttgcacaattaactcgtcagctcgatgccgaaggtattaaaaaacaagtcattgtgactgatgaaatcaaactgttaaatgaagaagatggtattgcaccaggtgtagaaattcgccaccgtaatgaacttgacgcagttcaacgtgagctgcgtgaaatttcaggtgtaactgctttaatttatgtacaaacctgtgccagtgaaaaacgccgtcgtcgtaaacgtgatgcttaccctgacccagctgaacgtttattcattaataccgatatttgcgaaggctgtggcgactgttctaaaaaatcaaactgtttatctattgagccagtagaaacagctttaggcactaaacgtcaaattaaccaaagtagctgtaataaggacttcacctgtgctgaaggattctgcccaagctttgtgactgttcatacacgtgatatgaaacgtcctgctaaatttgaaggtattagcgcaggatggccaacgtccccaatcattcctcagttatatgatgttccaagtcgtattatggtcggcggtattggtggtacgggtgttgtgactattggtgcacttcttggtatggcagctcacctagaaggcaaagcgacacgtgttatggatatggcaggtcttgcgcaaaaaggtggtacggtttattcatatgtacaacttgcagcaagtgatgagcaaatttcttcaaccaaaattccagcaggtcaatgtgaattactcattggtgcagatgcggtagttgctggtagtggtgcagccctctctcgcttaaaagaagatgctctagtcattgtgaatgaagacagcactcctacttctgagtttattaaatctcgtgactggtatgcgcctattaccgatttaattgatcgtcttcgtggtcgtgttcgtcaaggtcaactggtttctctaccagcggctcgtattgcgacacaactcttaggtgattcaatctataccaatcagttattactcggtatggcatggcaatctggtcgcattccgctattacgtgaaagcattgaaaaagcaattcgcctaaatggtacggctgttgaaaagaacatcgaagctttccgagtgggttgtcatcttgcaagtgacccgactttagctgctcgtttacttgcagcaatgccaaaaactaaaactccgcaaactttggctgaacttgttgaagaccgttctgctcgtctaacagactactggaatgaagcttatgcagctaaataccgcacacttgtagaattggcagctaaaaagttaccagaagagttaacgggtacgattgcaactcagctttacagagtcatggcttataaagatgaatatgaagttgctcgtctactaacaggtaaaagcttcaaagaatcgatcgaaacccaattcggtaaaggcttacgtttaacgtatcatcttgctccgccagcgttacttggtggcctgaaaaatgtccgtaaacgtgcgtttggttactggatgcgcttcccaatgatgatgcttgctcgcttacaatggcttcgtgaaactttccttgacccatttgcacgtcaagaagaacgtcaacacgaacaagcttggcgtgaccgttatatcgcatttgttgaagcacttgttgaagcaccagacaatcataacttggcagttgctgaacaaattgcaaaattaccggcagaagttcgtggttatgggcatatcaaaatgaaagcaatggacgctgcaaaacaacgttgggatgaacttaccccaacactgctaaaagtccgtaactaa

SEQ ID NO: 2332 - DNA, 690 bp, Acinetobacter baumannii
aaaatcatagcaacaacaaaacttgagatgtgccaagcacagtctttacggctttgctgtgcctttttttctcccaaaaagggcacaggcttttttatctctacatacaacaaaaatttttataacggtaaaattatgccaaatttagctcttccaacacgtgccttatatgttgtaaataaagcgattgatctgttccatcaccgtggttttcaccttattggcgtcgacagaatcgtgaaagaatcagagattacaaaagcgactttttataattactttcactctaaagaacggcttattgaaatctgccttatggtgcaaaaagaaaagctccaagagcaagtagtagcaatggtggaatatgaccaagactcaagcgtgagagacaaactcaacaaattgtattatttacatactgacttagaaggacagtattacctgttatttaaagccatttttgaaactaaaaatacctactccaacgcatatcaaactgctattagatatagaacttggctgaccaatgaaatctatagccagcttagatcgttaaaagcagattcttcatttcacgatgccaaactacttctgcatgtaattgaaggaactattattcaaaggctcagttataacgatgtagatgagcgggataagcaattcgaatatttcatagcaatgctttcgtag

SEQ ID NO: 2333 - DNA, 915 bp, Acinetobacter baumannii
gaactgtatttctctatgcaaaatcagactgcttcaaacctcccctctacacaacttggaaaagcactgctttgtcttatgacgtcggcattattgttttccattatgggagtgtgcattcgttttgcttcacaaacggtggacaatgcgaccgtcgtgttttttagaaatgcagtaggtttatttatttttattccgatgctctttaaacaggggctagattttattaaaacagataaactctggatgcatacttggcgaagcattgtcgggctagccgctatgtatggttttttctatgccattgcgaacttaaaactatcgaacgccatggtttttagttattcatctcctatctttattccactcattgcatggcttttcttaaaagaaaaaattaccaaatcgatgatttttgccgctatgattggactcattggggttttatttgtcgctaaacccgatcaaggtctatttaacgcattatcttttattggcttgggtgcatgctttttatcagcaatggcctttgtcaccgtaagagctttaaccagtacagagccacctgaacgtattgttttttacttttgtgtttttggtagtttaatttcctctattccgatgttttggcattggcgtattttcacttggcatgaactagccctgctcattgccgcaggacttttagctaatattagtcaactgtttatgtcttatgcctacagcttagcgccggcaggacaaattggcccaatgaattacattgccattatttttgcaggaatttggggatttgttttttggcatgaattaccagatctattcagcattatcggcatatttattattttatttgcgattttgctctgtaatccatttttgcagaaaaagttactttctctatttaaggtctag

SEQ ID NO: 2334 - DNA, 186 bp, Acinetobacter baumannii
aaggtgtatttgctgcgggtgactgtactactgtaccgtacaagcagatcattattgctacaggtgaaggcgctaaagcatcactctctgcgtttgattacatcattcgttctgggcagtaaaactggtcaaatcactatcatttttaattcaagcctagcattacaaaatgctaggcttttttaa

SEQ ID NO: 2335 - DNA, 1257 bp, Acinetobacter baumannii
tggattatggctacaaattacaaagacggtctttctcgtatacagcctcatacgtggaaaatagcatttatttttgcatttctagcactattggtagatggtgcagatttgatgctgctgtcttatagcttaaatagtattaaggcagattttggattaagttcagtacaagcaggtatgcttggcagttttacattagcaggtatggctgttggtggaatttttgggggatgggcgtgcgataaatttggtcgcgtgcgcattgtggttatttctattttaactttctcgctcctcacctgtggcttaggtttcacccaaagctttcttcagtttggtattttaagattttttgcatcactgggtttgggttcactttatatcgcctgtaataccctcatggccgaatatgttccaacccgttatcgcactacagtactgggcactttacaagcaggttggacggttggctacattgttgcaactttgcttgcaggctggattattcctgatcatggctggcgcatgctgttttatgttgcgattattcctgttgttattgccgttctcatgcatgtgcttgtaccagaaccagaagcatggcaaaagtctcgactacaacaacctgttgtgactcaaaacgcatcgaaaacctcggcatttaagcttattttccaagataaacgaaaccgtaatatgtttatcttatgggcattaaccgcgggctttttacagtttggctactatggcgtaaataactggatgccgtcatatctagaaagtgaactgggtatgaagttcaaagaaatgacggcttatatggtaggtacatataccgccatgattttaggtaaagttcttgcgggcatgatggccgataaattagggcgtcgttttacctatgcctttggtgcaatcggcactgctattttcctacctttaattgttttttataactcgccaagcaacattctatatttactggtcacctttggtttcctctacggcatcccgtatggcgtaaatgcaacctacatgaccgaaagttttgcgacagccattcgcggtacagccattggtggtgcttataacgtcggacgtttaggcgctgcattagcccctgcaacgattggttttttagcctctggcgggtctattgggttaggttttgtcgtcatgggcgctgcctacctcatttgtggtgtgataccagccctattcattaaagaaaaaatatacgaccctcaaaagtcgtaa

SEQ ID NO: 2336 - DNA, 1125 bp, Acinetobacter baumannii
gaaaagcaggcgtattcggcaaactttatacttcgtcacttcataaggatattttcgatgttgactaaaactgttaaatctttcggtttagcgatgggcttattagcctgctctctcccactttacgcaaaaaacaatgttgttgttgtcgctactggcggtaccattgctggtgctggcgcaagctcagcaaatagtgcaacttatacggcggcaaaagttccagttgatgctttaatcaatgcagttcctcaaattcaagatttggcgaatgtatctggtatccaagcattacaagtagcttctgaaagtattactgacaaggaattattacaaattgctcgtcaagtaaatgaacttgttaaaaagccaactgtaaatggcgttgtgattacacacggtacagatactttagaagaaacagcatttttcttaaatcttgttgttcatactgataaaccaatcgtacttgttggctcaatgcgcccatcaactgctctttcagcagatggtccacttaacctttatagtgctgttgcattggccgcttctgatgatgcaaaaaataaaggcgttatggttctcatgaacgactctatttttgctgctcgtgatgtaactaaaggcattaacattcatacaaatgcttttgtaagccaatggggtgctttgggtacacttgttgaaggcaaaccatattggtttagacaatctgttaaacgtcataccaatgcttcagaatttaatattgaaaatattaaaggtgatgctcttccgacagtacaaatcgtttatggttctgactctatgcttcctgatgcttatgaagcatatgcaaaagctggcgctaaagcgattattcatgcaggtacaggtaatggttctgtagcgaaatatatcgttccaacattacaaaaccttcatgacaaaaacggtattcaaattatccgctcatcgcgcgttccacaaggttttgtattacgtgatgcagaacaacctgactctaaatatggttgggtagcagctcatgatttgaatcctcaaaaagcgcgtcttcttgcggcgttggcacttaccaaaaccaacgatgcgaaagaaattcaacgcatgttctggcagtactaa

SEQ ID NO: 2337 - DNA, 1335 bp, Acinetobacter baumannii
tgtaatgaggctattatgggcaaaaatgttgtggtacttggtacccaatggggcgacgaaggtaaaggtaaaatcgtcgacctgctcacagatcaggcggctgcggtagtacgttatcaaggcggacataacgcaggtcatactcttgtcgtaggtggtaaaaagactgtattacacctcattccatcaggcattttacgtgaaaacgtattgtgcttaattggcaatggcgtggtgctttcaccagcagcattaattgaagaaatgggaattttggaagctgagggtgttccggttaaggagcgtctacgcatttctccaaactgtccacttattttgcctaaccacattgctcttgatcaggcacgtgagaagaaacgtggtaacgctaaaatcggtactacaggtcgtggtatcggccctgcgtacgaagataaagttgcgcgccgtgcagtgcgtgttgctgaccttgttcgtggtggtgcagcgttagaagaaaaactagccgaaatgctagagctacataacttccaattgactcagttctacggtgtagaagcggttaaatttgaagacgtattggctctttgcaaccaatggcgtgaagttcttgctccattagtgattgacgtaacaaaagtattacatgactaccgcaaagaaggtaaggctgtaatgtttgaaggcgctcaaggttcacttctagacatcgaccacggtacttatccgtatgttaccagctcaaatacaactgctggtggtgtaagttctggttcaggtatgggtcctttacatcttgattatgtattaggtattacgaaagcttatacaacacgtgtaggtgctggtccgttcccaactgaattggtttacgatgctgcaagtgattctggtgacccaattggtaaacatttgggtactgtaggtcatgagttcggtgcttctactggtcgtcaacgtcgttgtggttggtttgatgctgaaatcttacgccgttctgtagatgtaaactcactttcaggtatttgcttaactaaacttgacgttttagacggtttagaagaagtgaaaatctgtgtgggttatgaaaatacagattcaggttgtgtaggttcttctgatgcggtttccttcgaatgcttgaagccaatttatgaaactatgccaggttggagcgagtcaactgttggtttaacgagcattgaccaattacctgcaaatgctttggcttatgtaaaacgtattgaacaattaatcgaatgtccgattgatatcgtttcaactggtccagaccgtgcagaaacaatcattttacgtcatccattctctgcgtaa

SEQ ID NO: 2338 - DNA, 858 bp, Acinetobacter baumannii
agaagagaggcaaaaatgaaccgtgttattgcgtgtattgactcatcaccttgtattaatgctattgcagatgcagcggcttgggttgcgaaagcaactggacgagagcttgtattattacaaattctagattactacccggcaagttatcaccttggtgaaattagtggcgtaatcggctttgaaagcaatgcaatgttgcttaaagagttagctgaattagagcaaaaacaaagtgaactcgctttagattacagcaataatttactcagacatatctctgacttaattaaagaaaaacacggaattacttgctcaaaaattcaggaaaaaggggattttttagagcaaagttttaatctcttacacgaaaacgatattgtgattttggggcgggtgggtgaaagagccgccgaaaaacataaaccgattggcagcaatgttgaaaactttatccgcggtgcaaattgtacggttttgaccattggtgaaaactttaaagtaccgacacgttttatttttgcttatgaatactctccgacatgccaaaagatgatgcgccgtattgcgcaaagtgatctattacggactttacagtgccatttagtttatgtcggtgaccatcctgaaatattgaatgaaccagagcattacttgaaacaagcggggctagatgtagtgaccgtttatagatacggcgatgtggcgcaaaatattttagagtaccaacaagagcacggcattcaaattattgtgctcggcgcatttagccatagcaaaatacatcagttcttcttgggaagtattgcaaccacgattttccgtaacgcgactgtaccattacttgtggctaaatga

SEQ ID NO: 2339 - DNA, 1728 bp, Acinetobacter baumannii
cgaacaagggcacgcactatgttaaatgaagctgcttcagcggttttaaaaacacagccgcgtcgaaaaactgaatattcattaagatcaaatgttgctttagcagccgttgcaatcgctttaactttagcgattattgctcctttaatgatgttgtttgaaactgcattttttgatgaaaatcaaaattttgttggtcttgaaaatttttataactattttgcaagtccagctttactcagctctatatttaactcggtgtgggttgcttgtgctgctactgtcattacagtatttcttgccagtatttatgcttttgctctcaccaatgtgaatataaaaggaaaaagcttctttaaactggtggcttttttaccgattttagcgccttcacttttaccttctttggcactggtttatttgtttggtaagcaaggtgtgtttaaacctttgctgggcgatatacaaatttatggtccaatcggtattttaatcagttactgcttttggctatttccagcaattttaatgttgatgatggtgtcttttcgcagtgtcgatcagcgtttaattgaggcatctttgtcgctaggtaaaaatatctggaagacgcattatcatgtcacactacctgcaattcgttatggactcatcagcgcaagtctagtggcctttatttatgtgttgaccgatttcggaattccgaaagtcattggcggttcatttaacatgatggcgcttgatgtctataaacagattattgggcagcaaaacatgagcatgggtgcggtcatttccatcttgttattgctaccagcagtttttgtgttcattttcgatcgtattcaaagcaaacgccatgcacggtttcaagcttttcaggctaaaccttatgtttcagcatcgaataaaaaacttgaagttgttctaagcatattttgtggtttggtttcaggttcgattttactgattatctttacggcagtgctggcttcattcattcagtcttggccttatgatttgtctttgaccctagcacattacagttttgaatatgtcgatggtggcggttgggcagcgtactttaactcggttcgcatggcactctttagtacggtttttggaacagcactgatttttatggtggcactgttaaccgaacgttttaaagcacatccactcattaaaaattatgtacaggctttggttttattaccccttgctgtgccggggctggtcttaggtattgcctacattttgttttttaaccagcaaagtaacccgttaaatgtgctgtatggaaccatgaccattttggtgatttcaaccattgtacattattacaccgtgccacacctcactttaaccaatgcgattaaacaaattccgctgcagctcgatcaggcagcacaaactctaggaacatcgaagtggaaaaccttttggaaagtgtatttgcccatgtgttttccagcgttatgtgatgtatcggtctatgtttttgttaatgcgatgaccactgtgtcggctgccattttcctttattcaccagacactagtttagctgcggtggctgttttaaatatggatgatgcgggagacacggtttctgctgttgccatgagcattctaattttaaccacctcatgtgttgtaaaactcattcactggttatttacccgaaaaattatggcaagaagtcagcaatggcgtgaaagcgctcactaa

SEQ ID NO: 2340 - DNA, 450 bp, Acinetobacter baumannii
atttataattttttttgggtagttgcaatgcaaacaagtgtacattggctagagaatgttgcttttgaagcgaaatcagagagcggtcatagtgtagtgatggatggctcacctgagtacggtggtgaaaaccgtggaccacgtcctatggagttgatattaatgggacttggtgggtgtgcttcgtttgatattgtgactattttaaagaaatcccgtcaagatgtgacgaatgtcgtatgtcagcttaaagctgagagagcagatgcaattccggcagttttcaccaagatccatttacactttgtagtgacaggtaaagctgtaaaagaaaaacaggttgcaaaagcagtagagctatcagctgagaaatattgttcagcaagtaaaatgctttcagatggtggcgtagaaattactcacgattttgaaattattgaagcagcataa

SEQ ID NO: 2341 - DNA, 1527 bp, Acinetobacter baumannii
tcatataatttatttattattaaagcatttacgacggttgctataaattggagtaaatattacatgagtaagaataatggaaagcaattcctggaaggagatcttcttggtagtcaacatatgactgagcaagaagaagagaaattgcagcgctcactgacaaatcgtcatattcagatgatcgcaattggtggtgcaattggtactggattatttatgggttctgggaaaacattaagtgtttcgggtacttcaattgttttaacctatttaattattggttttttctttttcttcgtaatgcgggcaatgggtgaattgttgcttgcgaataccaattttaaaacattcgccgattttgcaacggcttatctcggtccgtgggcggggttcttccttggttggtcctactggtgtaactggattattactgcgattgccgatgtaatcgtgatcggagggtacatgcagttttggtatccagatttacccgtctggattccggcatttacttcattggcgatcttaaccatactcaactttgtggccgttcggctttttggtgaacttgagttttggttctccctcatcaaaattactgcaattattctatttattctggctggtatttatttaataggtacagggtttacttcaccaaatggggttaaagcctcgatgagccatttgtttgaaacagagtcgatgttcccttatggtgtaacaggtttcttggcaggctttcaaattgccatctttgcatttgtgggtattgagcttgtcggtacaaccgctgctgaaaccaaagacccgcatacttcacttccaaaagccattaactctattcctttacgcattttattattctatgtaggcgcattggtttgtattattgccgtcacatcatgggcaaaagtttcaccagaaaaaagtccatttgtagaaatgtttactttggttgggttaccaattgctgcgggtttaatcaattttgttgttgcgacttcggctttatcttctgcaaatagtggaatctttgcaactagccggatgctatacggtttggctttagacaacgatgcacctaaaagctttagtaagctctcaaaaagaaaagttccaattagaggactcgtattttcaatggcgtgcgtaacggttggaacatctattttatttattgttccaaacgttatgactgcatttacgattatttcagcgctcacttcaattttatgtatttttacatttatgttgattgtgctttcgtatatttattatcgtaagaaaagccctgaactacatatccagtcaaaatataaaatgccaggtggtttatttatggcatggatgaccatgttgtttttagtgtttactatcgtaattttggctttagaccatgatactttaattgcgcttgagtgctcaccaatctggtttattggtttgtttattgcctataaatataaaaagaaaaagatgttgcagcttgatattttaaaagctcaaaaggttgattatatttaa

SEQ ID NO: 2342 - DNA, 435 bp, Acinetobacter baumannii
aataataatttttataacaccaacaaaaaggatggacccttcactatggatcaaaaaattttagaacacttaccgcccatccatcagcatttgggtggacataatatccattggaatgaccaaaacactgaactcaccatccattacacggcgctagaaagctttaccaatccacgcggcaccgttgaaggcggcatgatctgcgccatgcttgacgatgtgatgggactttttgcatatctcgccaatgaccgtaaaccagctactaccattaacttaacaatggattttttaaggccctgtgctgtgggcgaaatcattacaaaatgccgattcattaaacaaggcaaaactgtactgaatcttgaaagtgaagcttggcaaaacaacaaaatgattgcacgaagcacagctaattttttggttttagattaa

SEQ ID NO: 2343 - DNA, 1236 bp, Acinetobacter baumannii
aaaaataattttgtcaggatgattcgcatgagcgtgacactcggtaccccacttcaatcttctgcattcaaagttttattgttaggttcaggagagcttggcaaagaagttgtaatttccctacaacgccttggtgtagaagtacatgcagccgaccgttatgatcatgctccagctatgcaagtagcacatttttcttatgtgttaaacatggcagatccagcccaattaaaacaactcattgaaaaagttaaaccaaatttaattgttccagaaattgaagcgattgcgacagaagttttactggaaattgaagcaaataaaactgcaacagtcatcccatctgctaaagctgtaaacctgaccatgaaccgtgaaggcattcgtcgtcttgcggctgaagagcttggtttacctacttctgcttatcgttttgctgactctctagaaagtttccgcgccgcttgcgatgacattggttatccaaactttgtaaaaccagtcatgtcatcttcagggaaagggcaatctcgtgtgaaaagctttgacgaggtcgatgctgcttgggaatatgcgatgcaaggtggtcgtgttaaccaaggcactgttattatcgagtctcaaattgattttgactttgaaattacactccttaccgttcgcgctaaaaaccctgaaacaggtgaaattgaaactcactactgtgacccaattggtcatcgccaagatgcaggcgactatgtagaaagctggcaaccacaacccatgactcctgcagcactcgaggaagccaaacgtgttgcaaataaagtgactacagcacttggtggctgtggtatttttggtgtagaactgtttattaaaggcgacaaggtttggtttagtgaggtttcacctcgtccacatgatacaggcctcgtcactttagcatctcaatttcaaagtgaatttgaattacatgcacgtgcaattttaggcttacctgtaaatacagcacgtcacagtgttgccgcaagtgcggtaatttatgcaggagttgacgctaacaatttaagttatagcaatctgaatgtggctttagctcatccagataccgacttacgtttgtttggtaaaccagaaggcttcaaacgtcgtcgtatgggtgtggcaactgctcgcgctgaaaatactgatcttgcccgtactttagcgaaagaaaccgctgatcaagtaagcgttcaaactaactcttaa

SEQ ID NO: 2344 - DNA, 201 bp, Acinetobacter baumannii
aatgtaaatttgttgctgtgtatatatgaatatccctatatgattcatttcaaatactgcgctgaaagtttttgtttagtgacccgtttctgtttggaagcgggttttttaatttctaaacctcatttgcttaggacgctttacgagtcaactggccggacggattacggcataggaagccccgctaaatatcgattatag

SEQ ID NO: 2345 - DNA, 669 bp, Acinetobacter baumannii
ggattttttctaaaccacgggcgaaacctttggaaaatagtttgccgagataagcatatggcttttaacatttttattgcattttggagtgtctccattctttttattattacgccaggggcagactgggcctacgccatttccgcaggtattaagggtaaagtcgtcgtccccgctgttgcaggtatgctattcgggcactttattacgattttattggtagcggctggtgttggtctgcttgtagcaaataacccaactgctctgatgattcttactgttgcgggttctgcctatttattatggatgggaataaatttattacttacccctcctactccgaacaagtctggttctgaaaaggctcagtcatggttgagatgggctaccaaaggcgtttacgtgagtggattaaacccgaaagtttttttgctctttttagcgctgcttcctcaatttattgacaccactgcttcatggtcagtaacgacacaaattcttgcctttggtgttgtccacataattagctgcgcgattatttacttaatggtgggttatggttcagaggctattttgaaaaccagaccacaggcagcccaattagttggccgtttttcgggtggcttgatggtcgttatcgcaacgtgcttattgattgggcaaatttaa

SEQ ID NO: 2346 - DNA, 573 bp, Acinetobacter baumannii
ataaagttttacatgaatttacttcttattgtggttctgggcgcgattgttgaaattgccgtatggattggcgtagcacagttcatcagtggatggtatgtgtttttctggttcattattgctttctttattggtctaacgcttattcgtaatagtacggctggtattatgccgcaattacaacaaatgcagatgactggacaattgggtaatgatccgactgtgactaaaaaattagcttatgcttttgctggttttttattaatgttgccaggtttggtatcggatgtattagcgctcttaattcttattccgggcgtacaaactgcgtttcgtaatattgcaatgagaacactggcaaaacgtcagcaagccatgatgaacaaaatgatgggcggcatgggtggtgcaggtgctggtcaaaacccatttgcagatttaatgcgtcaaatgcaggatatgcagaatcaacaaggtggtggtagccaatatcatgattcaagtgttattgatggcgaagcgagagaagttactccagaccacaagaaaattgagcataaaaataaagattaa

SEQ ID NO: 2347 - DNA, 852 bp, Acinetobacter baumannii
gaattaatttatcttgccaattccatcctgtttttgaaattaaaaatgcgcttaaaacatattatattaacaacttgtctttttagctcgactctagcaatagcggagttaccccaagactcaagaagacccggtggtattgcagttattcctttaacttcggatattactcaggtcacttttcaacacaaaccggttttaattagccaagaaggacagcagcgttatgctgttttcggtattccgttatctactccacttggtagtgttcaactcgataccaataaagcccctattcaaatagaagttaaatcctatccatatgctgagcaacgccttaaagttaccaatcaagactatgtaaatcccaatcaaagtcaattagaccgttacgctcaagaagctaaagaacaaaatgatgtttatagttcatttacgcaaagttcgtggcaagccttaccaaaatttatacgcccaacttcgggtaaatttaccaattcttttggaagaaaacgcttttttaatggtgaagaacgtgctccacactcaggtctagacattccagcaccaataggccaaaaagtagttgctccagcagacggcgtagtcgttcaaacaggtcattatttttttaatgggcaaactgtattaatcgatcacggtcaaggcttaattagtatgttttgtcatttaagcgagataaaagtagaaaaaggccaacatattcgtcaaggggaaactttaggtctcgtcggtaaaacaggacgtgtcacaggcccccatttacattggggaatgagccttaacaatgcacgggtagaccctcaactttttttaaatacgactcactaa

SEQ ID NO: 2348 - DNA, 1551 bp, Acinetobacter baumannii
ataagaaattttataggtagtacccatatgactgctcaaatgaaaacaaatgcatcagcaaaaaaagctgtcaattcacctcaccatatttacgatacctttattgtcggtgccggaatttccggtatcgcagcagcgattcgtctcgaccaagttggctataccaactataaaattattgaaaaagcaggacgtgtgggtggcacttggcgtgaaaacacctatccgggctgtggctgtgatgtaccgtcagctttgtattcttattcgtttgcacctagtgcaaaatggagtcacttatttgcgcgtcagccggaaatcttaagctatttagaagatgtaagtaacgagtttaatatcacgtctaaaattgagtttaacaacgaactactcaatgctgcttgggatgaatcacgccatttgtgggtacttgatacaactactggtcaatatctatcgcgaactgttatttttgcaacaggcccaattaccgaagcccagattccacgtcttgaaggtttggatacctttacaggtgaaatgttccattcagcgaaatggaaccatgattatgacttaactggaaaacgtattgccgtgattggtactggtgcatctgccatccagtttgtgccccaaattcaacctaaagccaaagagctatttgtgttccaacgtacagccccttgggtattaccaaaaccggatacagacttaggtgagttgagtaaatcaattattgccaaatatccagcgattcaggcaagttggcgtaaaagtgtagcgctaaccctcaacgcgattaattttggtttacgtaacccacttgcgctaaaaccagtaaatatactcggcaagcaattacttaaacttcaaattgcagaccctgagttacgtaaaaacgtaacgcctaattttgatattggctgtaaacgtattttgtttgctaacaattactaccctgcactacaagcaccaaataccacgcttattccacatggcttagttaaagttgaaggcaatacggtgattgcagctaatggcgaacgccatgaagttgatgtgattatttggggtacaggttttgaagtatctcacccaccaatcggcaaacgtgtgtttaatgaaaaaggccaacgtttaaatgatttgtggaaaaatagttcaccggaagcttacttaggaaccaacattgaaaatgtaccaaatgcattcttagtattgggaccaaacgtactggtttatgactcatttattggtttagcagaagcacagctcgactatattgtagatggcttgttaaaaattaaaaacaaaggaattagcaagttaaatgttaaggctgatgtaattaaaaagcacaacgacttggtgcaaaagcacttacaaacaactgtattcaatagtggtggctgtaagagttattaccttgatgctaacggtcgcaactttgcagcatggccgtggtcattgaaaaagcttaaacaacgtttgaaaaaattagatttgaaggattatgaagttacatatcaaatgtcaaagacacattaa

SEQ ID NO: 2349 - DNA, 318 bp, Acinetobacter baumannii
cgaaattcttattcagagtctgctactgatggctatgatgaaattggtattaatatatattatgatagtgctgataaaactatagcattagaattttatgaacccgctcaagttgcttttaatggtatagagatatttaatatttctgcgtcagaagcttataaactaatggcttcattagataaagatattgctattgatggggatggtctaacttcatttaaatttgggataggcttttatgagccgaattatgaagaagaaccatttttaccagttgaagcaattataatatttatagaaggatattatgattaa

SEQ ID NO: 2350 - DNA, 750 bp, Acinetobacter baumannii
aggcttacttacaggctagaaaacgtcttcaacataagcatatctaaagagcataatgacatgaatatctggtcaattctttgtctcatctggactttggccgcctatgttgtggcaaagcgaatctatcaaaaacatccaaaactttggttatcacccgcaattagtgtgcctgtacttaccatcattttgatgacgatttttggaatttcataccaaacttattcagaagatacccagtggattgttaatttattaggtcctgcaacggtagctttcgctataccgatttatcgttatcgggaaacgattcgtaaaaacctcggagttcttacgattgcgattattgtgggcatgagtgtaggcgtgatgactgcttataaaatggcgcagtggttccactttagtcctgaagtcactaacagtttgatggcacgttctatttcaacaccttttgccatgattttagctgaagatattcatggttcggcagcattggtttccctatttaccgttattaccggtttggtcggtatgatttgtggcgatgcaattttggcaattactaaaattcgttctaatgtggcaaatggtgccgcctttggtaacgcagcgcatggttttggtacagttagagcacagcagcgcaatagtgaagaaggtgtaattgccagtttaaccatggtcattgcaggtattttaatggtactcattgggccatttgcgattcatctatggttgctgttgtaa

SEQ ID NO: 2351 - DNA, 318 bp, Acinetobacter baumannii
agtacttattatttacatactaatttaacaggactcaactatctattatctaaagctatttacgagactaaaaatacctattcacacgcctatcaaaccgtaattaactataaaaacatggctgtcaataaagtttacagacagcttagaacactcaacattgataactcttttcctaaaattaaattaattagtcttttgaaatgtataaatattttaaaccaaacattcaataaaagactttttctatctagatttatagatataagaaattttttaattaattttgaaaaagaatataaaaaacaaaaagattga

SEQ ID NO: 2352 - DNA, 711 bp, Acinetobacter baumannii
gtgcattattacaccgggaatttttgttcagcacgttgtaaaagtaggagatatctaatgtcagttcaaaagcgttctcgtgaagatattgccaaactcattgccaatgacattccggaaggttcttatgtcaatttaggcattggcttacccaccaacgttgctaaatttttgccaaaagacaaagaaatctttttacattcggaaaatggggttttggcttttggtccaccaccacaacctggtgaggaagatcaagatttggttaatgccggaaaagaacttgttactttgttagacggcggatgctttatgcatcatggcgactcatttgacattatgcgtggcggtcatctggacatttgtgtgattggtgcattccaagttgcggtaaatggagatttggcaaactggcataccggtaaagcagatgatgtgccggcagttggcggtgctatggatttggcagttggtgcaaaaacgatttatgtctatatggagcatgtcactaaaaaaggtgagcccaaaattgtaaaagaactgagctatccaataacgggtgagcagtgtgtaaaccgtatttataccgatttatgcattattgaactcaaagaccaaaaagcttacgtcaaggaaatggtagacggcttaacttttgatgaattacaggcagtcactgactgtgaactaatcgatgcacgtgtagcctaa

SEQ ID NO: 2353 - DNA, 2712 bp, Acinetobacter baumannii
gtattaaattatttaaaaatattgagagtaatgatgagtagtttaaaaattttaattacaaaactttctacagctgcacgcactgctttagaaaaatctgctaatgcttgtgttcttcagcaaaactacgaaattgaaattgaacatttatttttagagttacttaatcagtctttagaaaacgatttaaaaattttattaaaaaaatataaaatctcagccgatgctttagcagatgatttaaaagaaacaatttctcaattaccaaaaggtaatacacgtactccaatttttgctaaatcaattgttcgtttatttgaacaagcttggttattggcttcagcagaacaaaatcctgtcattcgtagtggtcatttactggttgcattattaactgcacctgacctctatcaaattgcaacgagagcttcgagtttattcgatcttttcccgatagactcaatgaaacataagtttctcgaaatttgtgaaaaaagtgtagaacaacaagaagaatcaaaaacatcttcacaagcagatgaattagaacaagccgtgactccaactgcaaaaactcaaaaaacacctgctttagatcaatatacaattaatttaactgaaaaagcgaagaatggtgggattgaccctgttattgggcgtgaatatgaaattcgtttgatgctcgatattttaatgcgtagacgtcagaacaacccaattttaactggtgagccaggtgtaggtaaaacagctgtagttgaagggttggctttaaaaattgctcaaggtttagttcctgaagcattaaaaaatgttcatttgcacgttttagatatggggcttttgcaagctggggcaagtgttaaaggtgaatttgaaaaccgtttaaagcaagttattcaagaagtccaatcatcggctcatcctattattttatttattgatgaagcacatacgcttattggagctggtggccaagcggggcaaaacgatgctgccaatcttttaaaacctgcacttgcacgtggcgagttacgtactattgctgcaacgacatgggcagaatataaacagtattttgagaaagatgctgcattgagccgccgttttcaggtggtaaaggttgaagaaccgaccgaagaagttgctgtagatatgttacgtgcaatgattcccgtaatgcaaaagcactttaatttacaaattgatgatgaagcaattgtaacggctgtacatgcctctcatcgctatattagtggtcgtcaactcccagacaaagcagtaagtgttcttgatactgcggcagcgcgtgtagctttgacccaaaatgcacagccagtcaaacttgatcaattaaaagcacaagaacataacttaaagcttgagcaacagattttggaaaatgaacaccgtcagattccaatacatcatgaaagattagaaaatctgaaaagccaactagagtcattacaaagtgagatccaagagactcaggaacaatggcaaaaagaattagagctagttcgtaaaattcaggaattagaagcgcagagccattctaatgagtctgaagcctacgatcagattaatttaatacgcaaagaccttgctgatattcagggacaacagccgttagtttttgagcgagtaaactctcagattatcaatgaaattatttctgattggacaggtattcctgttgggaaaatggtcaatgatgaaattaagcagattttaacgcttgaagataaattaggtgagcgtgtaatggggcaagattatgcacttacacaattagttcaagggattaaaacttcaaaagctaaattagaagatccaaataaacctcaaggggtgttccttttagtcgggcctagtggggttggtaaaactgaaactgctttagccttagctaatgagttatatggcggtgaacagcatttaatcacgattaatatgtctgagtatcaagaagcacatactgtctcttcgcttaaaggtgcacctccaggctatgttggctatggtcagggtggggttttaactgaagctgtacgccgtaatccttatagtgttgtgttactcgacgaaattgaaaaagcacatagcgatgttcaggagttgttctatcaagtatttgataaaggtactttagaggatggtgaagggcgcgttattgattttaaaaacacgacaatcttattaacttcaaatacgggctcgagtgcaattatgcaggcatgtttaaatcagcctgtagaagaatggcctaccgcagaagatttaatcgaacatttaaagccgagtttatataaacagtttaagccagcctttttagggcgtatgagagttgtgccatatttcccattgcatgatgatttattggttcgaattattaaacataaattgggcaaaattactgctcgaattgaaaaacaatatggaacggaagttcaatattcagatgacttggtcgagttgctactcagccgttgtactgaagtggatagtggcgcccgtaatgttgataacatcttaaattctacagttttacctgctttggcaactgaaattttagtggcgttagcagatcaaaaattgccgaaattgatcatgattgatgcaaaagatgacgagatccaatatttactagatcctgtggcgaagcctgctaaaaaacggactagtaaaaagttgaaatcagaagtttaa

SEQ ID NO: 2354 - DNA, 1215 bp, Acinetobacter baumannii
acgcaaaattacctcaataagcattgtagtgaaaggaattccacaatgaaaaaaagctatttacaagcagctctaagcacagcattaatggctgtaatctatccgagttacgcaggtataagttttggaaacaccgatgatgaatacggcaagctcaccgtatccggctatgttcgcgctaactatcaagataaacactatggagagtctgcttctgatcaaaaaattcgttttgatgctgcgcagttaaaactggactacgagcgtggaccgttatttggtcatgcggaatatcgttgttatcaatatgaccgtctatgtgatttttctacgttgattgatggttatgtagggtacaaattaaataaaacagatcaagtggtggcaggtgttcagccgattccatttggaccgggacgtttttggggcaatagcctatatggaagtatgagcacaaccgcaggtttagaagacgttcataatcttggtttgaattatcattttgaattgccgacagcaaccaagtttgatgtggggtattttgcggtagatggtggaaactacacaggctctacccaagattcaggtcgctacactgcaaattatgtgagttcagacgatccgaataaaaccgatttgcaagaaaagaacatgtgggtaggccgagtgactcaaaatataaatcttggaattaatggattaaccacacaactcggtggctcctattggacatccgatattgaaaataaagccacttcgagtgatgggcgccgtcatgcatgggcactttttggcaaagccaattatggcaatttaaatgtgacccttactggcggtaaaaatgatgtaactaatcaggatcagcttaatcctaatcagtcactcatggggtcctacgacaccgaatattatgtagctaacaaaggaacattctatacagcagatgttggttattctttcaaaaatgttaagcagatcggaaacattacgccgtactttatgtacagccattacgataaagatcaggacagtatgaaagattcgattcgtaatattattggtgtgtctattgaccataaacagctatcgttggtggctgaatacatcatgagtaaaaatgacccattcattgggggaactcaagattcattggcaaaaggggatgataaccagtggaataagttgcttaacttaacgctgttttattatttctaa

SEQ ID NO: 2355 - DNA, 1059 bp, Acinetobacter baumannii
gaaggaaattatagaagggtgtgcttaccacacccttttttctttagatgtggagttaatatgaatcaagtcgagctgattcagaccttaccaaaagccgagttgcatgtgcatattgaagggacctttgaacctgaattaatgtttgccattgcacagcgtaatcagattcagattccttacaaatctgttgaagaagtaaagcaagcttataactttcacaatcttcaatcatttttagatatttactatgctggtgcaaatgttcttgttcatgagcaagatttctacgacctagcatgggcatattttgaaaagtgtgcagaagatcgtgtcgttcatacagaaatgttcttcgatccgcaaactcatactgaccgtggtattgcttttgcaaccgtgatcaatgggcttaaacgtgcatgtgctgacgcaaaagacaaatttggtatcagttctcagctgatcatgtgtttcttacgtcatttaagcgaagaagctgcatttgaaacgcttgagcaagctttaccgtttaaacaagatattatcgctgtaggacttgattcaagcgaagtaggccatccaccagctaaatttgaacgtgtttttgctaaagcacgtcaagaaggcttcttaatcgtggctcacgcaggtgaggaaggcccacctgaatatgtatgggaagctttggacctgctcaaagtaaaccgtattgaccacggcgtgcgttctgaagaagacgaacaattaatggctcgtttaattaatgaaaaaatgccattaacggtttgtcctttaagtaacttaaagctatgtgttgttaaggatatgaaagatcacaatatccgccgtcttttacaaaaaggcgtacacgtgactgttaactcagatgatccttcatatttcggtggttatatgaatgataatttctttgccattcaacaggcattagatttaaccaatgatgagttgaagcaactcgcaattaactcttttgaagcctctttcatttcagatgaagagaaacaaaagtggatttcagaaatccagaaaatctaa

SEQ ID NO: 2356 - DNA, 192 bp, Acinetobacter baumannii
ctgcgcgattatttacttaatggtgggttatggttcagaggctattttgaaaaccagaccacaggcagcccaattagttggccgtttttcgggtggcttgatggtcgttatcgcaacgtgcttattgattgggcaaatttaaaagtcattcaacgaaaagttactggcctcgatttcaggtcagtaacttaa

SEQ ID NO: 2357 - DNA, 1389 bp, Acinetobacter baumannii
cgccggcttctttattcagcgcatagtattttgagtaactcatcttcccaattaaaacgtggacttaaaaatcgtcacatccagttaatcgctatgggtggtgctgtgggcacaggactatttttaggctcggcacaagtcattcagtctgctggtccttcaatcattttgggttatgccattgtcggtttggttgcatttttaatcatgcgccaaatgggtgaaatgattgtagaggaacctgtagtcggctcttttagctactttgcacaaaaatactggggaagatttcccggttttttatcgggctggaattattgggtagtgtacattttggttgccatgaccgagcttaccgccgtggctaaatatgtacattattggtggcctcatatccctgcttgggtttcagttttatttttctttgggctggtcacttgcttgaacttgggcaatgttaaattttatggcgaatctgaattttggttagctattattaaggttgctgcggtcatttcaatgattgtgtttggcttatatttactgcttaccgcgggtagtgactctatcgctagcttttcaaacctatggcagcatggcggatttttccctcatggattctcgggcctattttatatgctcgcttttttaatgtttgcatttggcggtattgaactcattggaatgacggcagctgaagctgaaaatcctgaaaaaagtattccacaagccattaaccaagttattttccgaattttggttttttacgtggcttcgctggcaattattatgtcgcttattccatggaatcaactggaccttggcggtttagataagagtccatttgtcatgatttttagccaactgggcattggttgggcagcacatttactgaactttattattttgactgctgccctttctgtttataacagtgggatgtatgccaacagccgtatgttgtacgggctagcagtccaaagcaacgcacctaaagtttttgcaaaagtaagcaaacaaggtgtacctacatccgcggttatcttttcttctattttgatttttgggtgtgtattacttaactatttcataccagaagaagctttaagctatcttatgtacatggctgtagcagctttggttttaaactgggcaattattagttttacccatttaaaatttaaacgttcgatgaagcttgaaaataaagttgccaaatttcctgccttattttcacctttgagtaactatatcgttttgacttttattggcatgattttatatatcatgtggactcaaggctttgaaaagtcggtaattctcattccaatctggatcgcctttatgtttgggctatatacaattttgagttggaaaaaatcactctaa

SEQ ID NO: 2358 - DNA, 462 bp, Acinetobacter baumannii
ataaaaggttatatcatgaataataaaaaaattgtaatagactacttagataaaaacaatgaactctcaaaagagttaatatggggagagatgtgcaagactgatcaatactttgttagaagtattcctttctttgcgcctaaccttgcatttaatgatcttattcaggttgaaatggatgataaaacgctctattttgatgatttaataaagccatctaataattcaacattaagaattgtatttttatataacgatattaaatatattgaaaaaatattaactactttggagtctcatttatgtggttgggaggggtttgaaggtggactctattatgcaattaatatacctaaaaaggttgattatgctctaattaaaaaatgtttagatgataagagtgattttcttgattatgaggaatcatgcttgtcagataagcattcaagtgatttgttttag

SEQ ID NO: 2359 - DNA, 867 bp, Acinetobacter baumannii
acggagaattttatgaagtcttttaaaaataaagtcgcagctgtgacaggtgcgggttcaggtattggacaagcacttgccattgcattggccaaacaaggttgccatcttgcactttctgatattagtgaagccgggttagccaaaacagtcgaacttttggcaccttattctgtcaaagtcaccactcaaaaagttgatgtagctaagcgtgatgaagttgccacttgggcaaaggcagtggtagatgagcatggccaagttaacctgatttttaataatgctggtgtcgcaatagggagtacggctgaaggtgtgagctacgaagatcttgaatggctcattggtattaatttttggggcgtggtttatggtaccaaagagtttttgccttacttaaagcaaagtggtgatgggcatattattaatatttccagtatgtttggcttaacagctcaaccgacccaaagtgcttataacgcaagtaaatttgccgttcgtggttttactgaatccttgcgccaagaacttgatatgcaaaatgctggtgtgagcgcgacttgtgtgcatccgggtggtattcgcaccaatattgccaaagctgcacgtatgaataatagtgtccagtctttaggaatggacccgctaaaaagccaagatgctttcgataaattacttcgcacccctgctgatgatgcagctcaacaaattttggaagctgttcgtaaggaccgtcgtcgtttacttattggagccgatgcaaaagccgttgatgtgattcagcgtattctgccgcaaggctaccaaaagatctttgcagccgcgacagcttggcaaactcgcctactcaacaaatcagcaaaataa

SEQ ID NO: 2360 - DNA, 270 bp, Acinetobacter baumannii
aagctcttctatcacaacacacccactacgcttaagttcttgctgaaattacatattgctgcgttgttggttttaacaatgcatcaaatacaacaggttcatataaggggtgaatatttagataagcctgaatacttaaacataatgcgcccatattatgtccatctaataacatctctacccgtatttgtcttagccgaggttcatgagctgctattgattgctcaatggattggcaaattttatcccgatccagagggttggctgtag

SEQ ID NO: 2361 - DNA, 315 bp, Acinetobacter baumannii
aaaggaattctgattatggaaacacttcattttgaatttgtggccacagagccacctgtaaaaaaagcactagtaggatgtgtaggctctggcgatttagaaattttgatggaacctggtgaaacaggcaaagcttctattcacgtagtgacttcggtagacggcagtgcagcacgttggcacaatctttttgaacggatttttactgcgcaaataccgccagcggtcaatattgatattcatgattttggtgcaactcccggtgttgttcgcttacgtctggaacaagcattggaggagattgctcatgactga

SEQ ID NO: 2362 - DNA, 1530 bp, Acinetobacter baumannii
gcattctcctattcatttataaaacgattaaaaaacaaagtattgcaattagtaatgcttattaattttttaaggaacttcgtcatgaaaattatttctaaacctcaacttttaaaagatgtggaatacaaaccaagtcagtctttacaagtgggtaaagaatggagctggttaaatccaaaacatgcacaatttgacgcaaccacggttaacggcacttcggtagataacccagcaaactactatgaaagttccctctcgaattggcatacatttgacagtttaaatactgacatcgagtgtgatgtggtggttattggtggtggcttattaggttcatcaactgccttacatttagctgaacaaggtgtagatacggttttattagaaaaaaatcgtattggtagtgcagcttcaggtcgaaatggtggacaactcaccccaggtttagcacgttgggaagctcaagaaatggccgatcgactcagctacgaagatgccaaaaaactatggcattttacctctactgaagcgatgcaactgattgataatatctcggaaaaataccaactcaactttgaccgtaaatacggacatattactgccgccgttcatgagggacatttggttggcttaacacaaggtgccgatgcccgaaaatacttaggtgaagaccacacccgtattgtaggtaagcacgaactcatggactatattaagtctgactactatacaggtggtttaattgatgagttaggtggacaaatccatccgttggctctaaaccgtggcttaatttatggcttttgccaaaacggcggctctgtgtatgagcaaacagaagttatttcaatagaagaaaaagcagatggtatttatgttcacacagtaaatgcagtcgtaaaagccaaaaagtctgtggttttagcggtacaccatgcttcatttaaacttttatctgaacagaacaataccactattccgttttacacttatgtcgcgaccaccgctcctttagagcttgataccaaagagcttctgccatttggacatccggtttatgacactcagttccagattgattactaccgccctgtctttaataaccgcttattatttggtggccaaggtacaggaacatgttggggaccagagaaaactctaaattatctagagcatcgaattcatacggtgttcccgcaaattaaaaatctagagatggattttgtgtggagtggaactactgatttaacggtaaatggtgcagtcgatagccgtaaatttggcaacaagttcccgatttatgcagttcacggatggagcggtcacggcgtggcacagacagtacgtattggtaaagccattgccaatgactttgttgggcaatctaatgactttgaaatgttatctaaaattgaccaccaaaatattatttttggtcgtacccttgccccagttgttattccactcgctaaaagcatgtatggcctcggtgcaatgattaatccgggcaaaatggtttctttctaa

SEQ ID NO: 2363 - DNA, 189 bp, Acinetobacter baumannii
taccagccctattcattaaagaaaaaatatacgaccctcaaaagtcgtaaagagatccatcacaaaaaatcctattggttctgtgcctataggattgatggtactaacgatctaaacatgtgttttagatggttagcaggaaataaggaatttactcctcaaagttattccttatttccacatatgtag

SEQ ID NO: 2364 - DNA, 795 bp, Acinetobacter baumannii
gtgatggactatcaaaatattattgctgaagaaaaaaatggtgttggctacctgacatttaaccgcccaaaagcactgaatagctttaacgttgatatgcaccgtgaagtggctgaggttttaaacctgtggactaaaaatccggatgttcgatgtgttgtgattagtggcgaaggccgtggcttctgtgcagggcaagacttaggtgatcgtgtagtagacccaaacgctgaagctccagatttaggatattccattgaaacttactataacccgctcattaaaacgattgtaaatatgccaaagcctgtgatttgcgccgtaaatggcgtggcagcaggtgcaggggcaaatattgcactggcatgtgatttggtgattgcagccaaatcggcaaacttcgtacaagcattttgtcgcttaggtttggttccagactctgcgggtacatggtttttaccacgtgccgtaggccatgcacgtgcgatgggattggctttgttaggtgacaagttgccggcagaaaccgcaaaagaatggggcatgatttgggatgtcgttgaagatgccgagcttaaaacaaaagtgactgaactcgcagagcgtttagcgaaacagcctacatttggtctgtctcttattaaaaaggccattcatcaatcaagcaataacacctttgatgagcaaatgctgttagagcgagatttacaacgtattgcgggtcgttccgaagattatcgtgaaggggtacaagcctttatgaataaacgtgaaccaaattttaaagggcgctaa

SEQ ID NO: 2365 - DNA, 621 bp, Acinetobacter baumannii
attatgagctataaacgatcatctttaatgcaagagcggatggagcaaaatcgaaagtcgattttgagttcagccagaaaaataatttcagagggagggttcaaagacgcacaaatacaaacaattgcagagcaagcgggtgtatcaagtggtctggtttatcgctacttcgataataaaagccaagtgctaatagaagttttgtctgatgccattaatacagaactattggtgattgaatcgattaccgaaagtgacttatcggcaaagcagaaattacacaaggcggtggcaacctttgtgaaacgggcactgaatagtcctcagcttgcatattcactcatgtttgaacccgtcgattcaacggttgaacatgagcggtttcgtgtgaagcaattgattaaacaaagtattaaaaaaatacttgcggatggaaatgcaagtggtgagtttgtcttggatgatttaaacacagcagcactttgtgtagtcggtgctatgacttatgtggtggttgaacccctagacccagctcaaaatacaaagtttgatcatgcgtataaagactatttttcaaaacagattgctgacttttgtgtggatgctgtgcagaaaaaatag

SEQ ID NO: 2366 - DNA, 1005 bp, Acinetobacter baumannii
gaggctggctatagaacagtgagtggaaagaatatgaagaccaaaattacagaattatttgaaattgagcatccaattattcaaggcggtatgcattatgttggttttgcagagcttgctgctgcggtttcgaacgcgggcgggttaggtattatcactggcctgactcagcgtacacctgaaaatctggcaaaagaaattgcacgttgccgagaaatgaccgataagccttttggagtaaatttaacctttttgcctacggtaaatactcctgattatccgggttttgtagaggcaattattaaaggtggcgtaaagattgtagaaacagcagggcgtaatcctgaacaggtgatgccatatttaaaggctgctggtattaaagtaattcacaaatgtacttcggttcgacatagcttaaaagctcagcaaattggatgtgatgcagtttctgtagatggttttgagtgcggtggtcaccccggtgaggatgacgtgccaaatatgattttattgcccttagcagccgatgcattagaaatcccgtttgttgcctcaggtggtatggcagatggacgttcgcttgctgctgctttagcgatgggagccgatggaattaatatgggcacgcgctttattgcgactcaggaagctcccgtacatgcaaatgtgaaacaggcgattttgaatgcaaccgaaagagatacgcgtttaattatgcgtgctttgcgaaatacagaacgtgtcatgaataatgcggccgtagaaaaaatcgtggcaaaagaaaaagcactcggcgataacattaagtttgaagatattatggaagaagttgcaggggtttatccaaaagtcatgattgatggagatgttaatgcaggagcatggtcatgtgggctggtggctagcttgattcatgatattccgacatgcgatgaactggttagccggattgtcaaagaggcagaagatattattcgcggacgtttatcagggcttttataa

SEQ ID NO: 2367 - DNA, 582 bp, Acinetobacter baumannii
tttcaattatatggaaatgtaatgtcaaaaaaagaagatattataaatactgctttagaactttttaaccaaattggttacaatgctacaggggtagacaaaattattgctgaatcaaatgtagccaagatgactttctacaaatattttccatcgaaagaaagtttaatcatggagtgcctacatcatcgaaatattaatatacaaaattcaatttatgaaaaattaagcttacatccagatgtaagtccaattgagaaaatacatctaatttttaattggtatattgactgggttaatagtgagaattttaatggttgcctatttaaaaaggcttttattgaagtgtgtaaacaatacacctcaattcgtgaaccatttcaagaatatacaaactggtttataaatttattaaatagtttattagtagagctagatattaaagaccctactccacttactcatatcatcatttcaattattgatggtattattattgatgggacaattgataaagatctgattgatccctctaagaaatggcaatatattgagtatttgattaaaactgaaaatccttaa

SEQ ID NO: 2368 - DNA, 195 bp, Acinetobacter baumannii
aagacttctctcaacagccaccttcgggtggcttttttacgtctaaaggaaagtgaaatgaacatcgaacaatatcttgatgatttaattgaacgtgaaggtggttacgtaaataatcctgccgatcgaggagggcaactaaacacggaattactgaagcagtatcacgtgcaaacggctataaaggcaatatga

SEQ ID NO: 2369 - DNA, 714 bp, Acinetobacter baumannii
cttaagttatatatttgttataagttagctggtgcgatcattatggctcttaaagaccgtttaaaagattcaaggattaaagctaaaaaaacacaggcagaggttgctgaagcagtaaagatgtctcagcctgcttatcaagctttagaatcggggaagaatttaaaatctgcttttcttccactcattgcacagtttttaggtgtagatgcttattggcttactacaggaaactcagaagactcttttagagaaagtgatgtatttagtcctactgtcgtgaataacgatgcagcagaccaatatgtctggatcgaagtagttgaagcgagtttttcttgtggtacaggcgaatcaatcgaatttcattttgatgcaattaatgggaaaattcctttccccgcttcattctttaaagaaaaacgtgttgctcaggaatgcatgcgtattatcaaagctaagggcgatagtatgaccgattacatcaaagatggtgatctggtcggtattgatatttctcaaacagaagtaattgatggtgaaatctatgccgtttattttgctggtgaaggcatgattaaacaaatttttaaagaggcagatggctctttaattttgcatagtttaaatgaaaaatttagagaccgacgtgtcaccgaagagaacggtaaaaactttaaggtcatggggcgtcagttctggagagcgggctaa

SEQ ID NO: 2370 - DNA, 471 bp, Acinetobacter baumannii
agccatccatatttaattagagaaacatttcatatgaaaaaatatttattattaattttattcagcttttattcggttcattcatttgcttcggacaagctacatggcagtgtttggaaaactattgatgatgccaccaatcaaccgagagcactggtaaaatttagccaagacaaaaacggagttctatccgcaaatattgaaaaaatccttgttccaagcgaagccaataaatgtacgatgtgtgaagggacttataaaaataaatctttaattggcttaaccattgtcaaaaatttaaaaaacgtaggtcaaaataaatatgacaaaggatctattctcgatcctcagtcagacaagacttatcgctttagcgtaaccgtatcaccagatggggaaaaacttaccgctcgcggctacattggtatttctgcaattggccgaaaccaaacatggtatcgagttaaataa

SEQ ID NO: 2371 - DNA, 960 bp, Acinetobacter baumannii
aagcttacatactataaaagtaaaggaatttttaagacaggacgaaacgtgaatttaaagaatcttgaagcattttactgggtggtgactttaaatagcttcaataaggcagcaactaaattacaaaccacgcagcctgcggtatctcaaaaaatcacatctcttgaaaatgaattaggttttaaagttttagaccgaagcttacggcagtttaaactgacccataaaggcatgactttatttaaatatgccgaaaagtttatgcgcttagaaacagatctggtcgcagaacttaccgaaaaccagcacctgactggcaccattcgtttaggcgtttctgagaccattgtgtatacgtggttggttgaatatatcgaaaaagttcaacaggaattcccgaaagtttcggttgaaattgtggtagatctgacccctaacttgcaagagggggtacgtacaggcgatttggacatggcctttttgcttgggccaactttggcttttgaatgtattgagcagtcgctttgtaactttgaactgagtttcttggcggcgccatcttttaaaggtggaattgggcaaatgtcttttaaagctttaatgtcgcataccattttaacctatcccaaaattacctatccctataaagaactaaaggcaaaaatgaaagaaaaggggattgatgaaccactttctattaccagttattctttagcgacgttattgcgtctagcagagcaaggtttgggtattgcggtcgtgccgaccttaacggcattaaaggaaattaccgacggacgattggaaatattaaatacgcccattcgtttaaaaacctttcatttcacgtctatttatattcatggtaatgacgttgctttgaaagaaaaattaactgaagtggcggttcaggtttcagaaagtgccatgaaaagactcaatgaacaaattaaaaaataa

SEQ ID NO: 2372 - DNA, 1179 bp, Acinetobacter baumannii
acacaacaatatttgatttttatgacatcttctttgaaaaaaatagctttattaaaacagggcttaggaaaaaatagtccattcgcagcaggtaggcaaggaacattagaggcgattgagcatttaggttatgtacagattgataccatatctgtcgttgaacgtgctcatcaccatatattgtggagtcgagtgccagattatgatttaagccatttaaacagtttggttcgtgagcggcagattttcgaatattggtatcatgcggcatcttatcttcctatgaaagattatcgatatgcattaccggcaatgatgtctgtcagaaaaggagaaagtcgctattttaatagaggcgatcaacaccttatgaatgaaattctggcacgtgtacgtgccgaaggtaaaattcgattaagggatatcgataagaaaaataaagagagtttagggaattggtggaataccggtccaggccgccgtgcttttgagcagttatatatgcaaggtgacctgatgatctgtgaacgtaacggtatggaaaaagtttacgatttgactgaacgctgcctacctgaaaatattgatttaagtttgcctacgctttacgaatatgctcagtatttatttaataatacgcttcgagctcatggtgcatttacgtggaaacaattggttcatttaaagaaaaatgatttaaaagaaaccatgcgtgtcgtgctaaaagagcagattgatgcaggtgttgtatcagcgattaaacttgctgatggacaaactttatatgttgatgtaactgcaatagagcaacaattggatactgattttggtctaaaaatactttcgccttttgataactctcttattcatcgtgaccgtttaacttctttatttgaatttgattatcggatcgaatgctatgtgccagcggccaaacgggtatttggatatttttgtttgcctattctttatcaaaatgagttagtaggacgaatcgactgtaaagcacaccggacagtaaaagaactagaagtgattaatctacatttagaaaaaacggtaaaagataaagagcatttcttttttgaattagatcaagaactcaagcgttttgcagcatttaatcaatgctcaactgtgaatgataaggtagtcaaactcattcgcagcaagctttaa

SEQ ID NO: 2373 - DNA, 1110 bp, Acinetobacter baumannii
aattttaaatatagagttcatatgaagtttaacttaaaaagaataagtggatttttaattattacatctactcttattttaactgcttgtagtggtgaaggctcagatcaaaatacaaatgatcaagctgaaagtaatttagaaaaagaagacactatttataaagtttattatcaaccttcggatatttcttcaggtatctatagtgacttttttgaaattacgccatattcaattaagaataatgagattttctttgcaaagtcacataatcagccattagaaactgaacttttaactgagcagaaagttttaaataaagggaccttacaaacgaatatcgtgaaaaggttaactcctagcagttggtcttatgagagaatccctaatctaaaacaaaatttaaaatttgagattgtaaaattagatggagaaaacatctttgatcgtgtattgccaggctataaagaatataataatttagaaacgagccttaataatcaacttgataaaaatttaattgacttctatcaaaactataagaatgttaggttcccaaaaaatagttactgttatcgtctaaaagagtctcaatggaatcaatcttatatttcatatatttctagttttaatacaaatccttcatttagtgagagaaaaaagtcaattatcgaaagatataataacctaggcctagataaaaagtattttaggcttataaattcgcagtggtatggttataacttagttgttttagaaaacctagaaaatggtgatgtccaaagcacattaggaaataataatgatcagtctgctactattgattttgtatcaagcagcttatggaatgctgataaaagtttggcttttgagaagtcacatctttattcgacagatgacaacccgcttaatagcgtacactcattaattgctttaaaacagaagttaaaaattgcagatcttgaaaaaggttgctttgcttttaacactcaagcagctcaagctattcaaaagttaaatttggttaattggaaaccgggtgatagttcagttattgccccattctttggtctaagaacttttattgataatagaagtcaaaaacaataa

SEQ ID NO: 2374 - DNA, 285 bp, Acinetobacter baumannii
acacttaaatatgagttagattcagtttttggtatggagacatgcgaaatgaaaaatcaacgtgatgcagttttaggttatgcagatgaacaacatgcttactatatccgtcttattgaaaatgatgcggtattaggcgaaagctatggaattttctgtgaaaatccggaaagtgaagcagccgaaagtattatgacgacactatttttaaagaaatcattttggttaaatggctcagaattcacagatattgtaaaaggcttacatccccttacccattcataa

SEQ ID NO: 2375 - DNA, 2265 bp, Acinetobacter baumannii
acaccaaaatacgttaaactttgcatcgttaatatttatatgttttggtcaatcgagtttatgaatacctctttacgtttaaaccactattggattacttgtgctgatggtttagaaaccctcttacaagaagaaatagaacagcttggcaccaaagtgacagaacgtaaagcaggacgtttaatcattgaaggaacgcttgaacatgcttaccgtatttgcatgtggtcacgtcttgcttcacgtgttttacttccaattcatacttatgaacttgaacgtacccacgatgcgcgtgatgtagcagaagagctttatgaaggtgcaattagttttgattggtcacttatttttgcaccacaaagtacctttgcaattcgcttacacgcagagcgtgaaattaaggtaaatacgcagtttgcaacccttcgtgtaaaagacggtgttgttgattcctttatggaagctgtaggccgccgcccaagtattgataccaaacaaccggaaattacattatatgtgcttgcgggcaaaaccgagcatacatattgcctagatttatctggtgattcattacataaacgcggctaccgtcgtttcatgacagatgcaccaattaaagaaaacctcgcagcggcaattttgcaaaaagccaagcttcaggaacgtaacccggaaatcgtacttgacccaatgtgtggttcaggcacatttattattgaagcgttaatgattttaactgatcgtgcgccgggtcttgtacgtcgttttggttttaatggctggcatggtcatgaccgtgaactttggctttcactcaaagcggaagcagcagagcgtcatgaaaaagcacttgaacaaccgttacctaagttttatgcatacgatgctgactgggaagctgtaaaagcaacacgcgaaaacattattgcagcaggttttgaaaagctactaggcgatattcaaattgaagagcgcactttagcagactggccagatttcggtgctgaaaataaaactgcttttatcgttaccaaccccccgtatggtgagcgcttaggtgacaaagcttctaaccgttctctttacttaggcttatctgccctcttacaaaagaacttcccaaatcaatatgcagcaattattgccgcacaaattgaacaagcggatgttttagcatttgaagcaccagaaacattacgcttaatgaatggtaaattaccgatttatgttcgtttcggtacagttaaacctgaaaaagtcactcaacccttcttggcaaactggcaagctcaacctgttgaaatggaagaagctcaagactttgctaaccgtttgcaaaagaacatgactgccttgaaaaaatgggcaaccaaagaaaatatttattgcttacgtttatacgatgcagacctccctgactttaaccttgctgtagacttatacggcgaccgtttacatgttcaggaatatgcaccacctaaaaagattgatcctgaaaaagcaaaaaaacgttttaacttagcgcttgctgctattcgtgcggtgacaggattaaatcgtgatgcaatctttattaaaacacgtgcgcgtcaaactggtaccaatcagtacaccaaacaaagtacagccaataaacgtttcatcgtgcaagaaggtaaagctaaaattttagtgaacctgactgactacctcgatacaggtttgttccttgaccaccgtcaaatgcgtttacgtattgctcaagaagcacgtggtaagcacttcttaaatctttatagttatacctcgacagccagcttacacgcggccttaggcggcgctgcaagtacaaccagtgtagatttatctaatacttacttgagctggtcaaaagaaaacttcgttttaaacggtttaacggtagatcatgcagacgaacagcatatgttctttgcaagtgactgttttgaatggttaaaagaaggtcatgaacaatatgatcttatttttattgacccgccaacattctctaattctaaaaagttccacggtacttttgatgtgcagcgcgatcacgtctctttaattaaacgtgcaatgaaccgcttaacaagtgaaggtacactttacttctcaaataactatcgtggttttgagatggatgaagagatcgaggctttatatgacgttgaagaaattacttctgaaacgattggacccgattttaaacgtaatcaaaaaatccaccgtgcatggaaaattcagcatcctggattaagttaa

SEQ ID NO: 2376 - DNA, 354 bp, Acinetobacter baumannii
atcacaaaatatagtgggatgaagatgggtgctttaaatggaattcgggtgcttgacttaagtcgggtattggctgggccttggtgtggacagattcttgccgatttaggcgcagaagtcatcaagattgaacgaccaaaagtcggtgacgatacccgttcttggggaccaccttggatgaaagatgactcaggccaagacactcaagaagctgcttattatcagtcaaccaaccgcaataaactatcggttgccatcgacattgccagttctgaaggccaagaattgattaaagcgcttattcaagataccgatgtcgtgattgaaaactacaaagcgggttctttaaaataa

SEQ ID NO: 2377 - DNA, 1302 bp, Acinetobacter baumannii
ggatattggtatatgacgacaacactaaaaaaggtagtcgcggcctccatggttggctccgtagcagaatggtatgaatttttcctgtatggaactgcttctgccctcgtctttggcgaacttttctttcaacaaaccggcaatgctatagatggaattttggcggcctttgctctgtatgccgttggctttttagcacgacctctcggtggcctcgtgtttggtcactacggcgataaaattggacgtaagaaattattgcaaattagcctgattattgtcggtatcactacttttttaatgggctgtattccgacctttcatcaaattggctattgggcacctacactcctagtgatactgcgtttaattcaaggttttgcttttggtggtgaatggggcggcgcagttattttagtttcagagcacagtccagatgatcgcagaggttattgggcaagctggccacaaactggtgtaccgctcgggaatttagtagccacactggttttattattactttcaaaaaacctctcacccgaacaattcctagactgggggtggcgctgtgcattctggttctcagcagtcgtggtactgattggtttatggattcgaaaaaatgtagacgatgccgaagtgtttaaagaagcacaggccaaacaacagcttcttgaaaaacaacaactcgggattattgaggttttaaaatatcataagaaatctgttattgcgggtatcggtgccagatttgcagaaaacattttatactatatggtggttactttttcgatcagttatttaaagttagtcgtccataaagatacttcgcagatcttactgctcatgtttggtgctcatctgatccatttctttattattccttttatgggacatttaagcgatatatttggccgcaaacctatttatcttattggggctgtacttactgctttttggggttttgtcggctttcctttaatggatacaggcaatgactggctcattatgttagcaattgtgcttggtttatttattgagtccatgacctattcgccttactctgccctaatgactgagttatttcctactcatattcgctatacggcgctttcattttgttatcaagtcgcaccaattatggcaggttctcttgctccattaattgccttaaccttactcaaagaatttaatagctcaattccgatttctttatatttggttgccgcaagtctgatttctattgtctcgattttgcttgtgaaagaaaccaaaggccgatctctagcttttaaagattaa

SEQ ID NO: 2378 - DNA, 678 bp, Acinetobacter baumannii
actgattggtatttatacaatatagttatcagatcacaaggatatgaactaatgaaatttctaaaatttttaacttttagcacgattcttaccttatccgcacatacctatgcgacagtgggtggtggacaaaaaattgaagtattgggctatcagcaaaaagagaagaaactttatgtattaagacattatgaagatggccgaggacgcctaccacaactatattattatctattaaatagtaaatcgcctgataaactgattgaagttaaatctctctatatcaatccaaaaacacataagattgattatgatcaagatagtacagcgtttaataaggcacttaataaaattaaaaagaatttaactcctttgatcgtaagtaatagtaagaccgtaaaaattcaaacattaaaaacacatcagaatcaggtatcgttttggtttgatccttcaggaaagatcacgcaatataaaacagaatatgttgtaaaatcgccgtctttacaaagtaagacccatgttgcggttcattacagcaaagcaataaaaatttcccaaaattatagtgtgcctaaacaaaataagaggttggttgtcgttaaatatttgggggttccagaagaaactggttacgatattgaagaccctgttttactactacctataaaaaaataa

SEQ ID NO: 2379 - DNA, 1611 bp, Acinetobacter baumannii
ctgtttaggtattggagctttaaaatgagtaaaaataacggtcggcagtttattaatggtcaacgcgttgctgtaaatgcgccagctctagaaagtatagctgcaaaagactatcaaccaacaggttatgtatttagtcaggcaacacttgaagaagtagatcaggctgctcaagctgcacataacgcttttttagtttatagccaaacgactcaagaacaacgtgcctcttttcttgaagaaattgcttgccaaattgaagcattgggtgcgaacttgcaagaggttgcttcacttgaaacaggtttgccacttgctcgtcttcaaggggagacaggccgtgttactggacagctaagactatttgctgaacttttacgccgcggcgatttttatggtgcccgtattgatgtggcattgccagaacgtaagcctttaccgcgtgtcgatttgcgtcaatataaagttggggtaggaccagttgccgtatttggcgcgagtaatttcccactcgcattttcaactgcaggcggtgataccgtagctgctttagcagcaggatgtccggttgtctttaaagcacactctggccatatggcgactgctgagcttgttgcagaagccattgaaaaagcaattgaagtttgcggtatgcctaaaggcacattcaatatgatttttggcggccgtattggtgcaaatttggtggaacatcccctcattcaagcagccggttttacaggttcacttgaaggaggaatggcgctttataaccttgcgcagagccgtcctcagccgattccattttttgctgaaatgtcgagtgtgaaccctgtggtggttttacctgaagcacttcattcacgtggtgaacaaatcgcacaagatacggttgcttcttttaatatggggtgtggccagttctgtacaaaacccggtctaattttaggtgtaaaaggccccgagtttgaccgctttattacagctttagttgaaaatatgcagaaagctgtgcctcaggttatgttgaatgaaggtactttaaaaagctatcgaactggtattgatgcattaataaatgaagttggttttgaggtcattgcatcgggtcaggaacctgagttggtttctcaagcaaaagcacatctgtttaaagcggaccaatctgttttattatcaggcaacccaaaactacaacatgaagttttcggaccgatgtcgattgtgattgcggtcgaagatgaagccactctgttgaagggtattgaagctttaggtggacagcttacagcaaccattattggtgatgaaaacgaattgtctaaggcaggcgagcttcttgatttgttaactcgtaaagctggccgtgtattgtttaatggtttcccgacaggggtagaggtatcggatgctatggtacatggtggtcctttccctgcaactagtgatgcacgcggaacttcggtaggtacgggagcgattgagcgtttcttgcgtccggtatgtttccaaaatacaccacaagttttattacccgatgcattaaaagatagtaatccactacagattactcgtctggttaatgggcaattaactcaggccaaaatttaa

SEQ ID NO: 2380 - DNA, 453 bp, Acinetobacter baumannii
aatcaagatttaaaattaacatataatatttgtgagaaaagaatgatgcaacctactcatacacactcaacgctacaatatattcatatttctgtacctgaaattttactcagtaatattgaaataaaaaactcttggcaagattataaccaagaatggagctatagattagacccgcctcacgcaagccatccttttcagagagacttgtatattattaaatcaaaaaatattgaaacggaagatataaaaaaattactagataatgttgttaaaaacaataaaaataaagatgacttaaaaaatatagtcgaagcggaaacagtaataaaagaaattttagatttatctaattatatacctatagaaaattggctaaatgatacaggtaatcgatcaattgttgaaagtatgattgataaaaataaggttaagttattagatattatctaa

SEQ ID NO: 2381 - DNA, 1227 bp, Acinetobacter baumannii
atgaagcatctaatcaaatttgtcagcactgaaactcaactacttggtaactgtttaatgaactctagcttgtcgttattacacccgtatccatttgaaaagttaaaccaactttttaaggatattaccccagcgaaccttcccttgattcctctatcaattggcgaaccgaagcacccagcaccagagtttgttaaacaggctattattgataactttaaccatctatccacttatccaaacagcaaaggcttacctgagcttcgccagagtattgcagactggctaactaaacgctttaaacttaacagtattagcgctgaaaaccacattttgccagtgtctggtacacgtgaaggtattttctcttttgtacaggcattaattaaccgtgaagatgcaccgtatgtggtaatgccgaacccgttttatcaaatttatgaaggtgctgctttactcgcaggtgcaaagccatacttcattaattgcacagaagaaaatggctatttaggtgactttgatgctgtgccagcagaagtttgggaaaagacagcccttctttttgtatgtacaccgggtaacccaacaggtactgtgctttctaaagaacaatttaaaaagctgattgccttatctgatcaatataatttcgttattgcgtctgatgaatgctattcagaactttggtttgaccaagctcctacgggcttattagaagtatgtgcggaacttggccgtgatgactacaaaaactgtatcgtttttcattcactttcaaaacgctcaaacttaccgggtatgcgttcaggttttgtagcgggtgatgctgctttattaaagccatatttgcaataccgtacctatcacggcgcagcaatgccagtacaacatcagcttgcctcaattgcagcatggaatgatgaaagccatgttgaagaaaaccgtaagcaatatcgtgcaaaatttgacttatttcaatctgagctaggtcatttgcttccattacaaaaaccagatgctggtttttactattggttaaaagtgaataatgatgaaacttttgccaaaatgctgatggaaaaagcacatattaaagtcttaccgggccgttatttatctcgtgataccgaacaaggtaacccaggagctaaccatgtacgtatggcgttagtggcagatttagctcaatgtgaagaagtagttaagcgtttaaaagcgattttgtaa

SEQ ID NO: 2382 - DNA, 558 bp, Acinetobacter baumannii
gtaagtcttcacatgccattgattattggaattgatccaggttcacgcttaacagggtacggaatcattgaaaaagatggtagtaaactacgttttgttgatgccggtacaatccgaacggaaactcaagagatgccagagcgtttgaagcgtatttttgctggtgttgagcgaattgtgaaatttcatggtcctactgaagctgcggttgagcaagtctttatggcacagaaccccgactctgccttaaaacttggtcaagcccgtggagctgctatagccgctttagtgaatttagatttacaagttgcagaatacactgcacgccagattaaacaatctgtagtgggatatggtgctgccgataaagaacaagtccaaatgatggtaatgcgtttacttaacctgaccattaaacctcaagccgatgcagccgatgctcttgctgctgcaatttgtcatgcccacgcttcaggaagtatgagcaaactaactgtcttgaatgccttaggtggtatggctcgtggacgaagtcgctctagtagccgtagacgctaa

SEQ ID NO: 2383 - DNA, 501 bp, Acinetobacter baumannii
aggaaaattcagatgaatggcccattattaagccttgatcgtaccgatttaaaaattttggatattcttcaaacagatgggcgtatttccaacagtagattagctgaactcgtcaatttgtctccaacagcagttatggcacgagtgcagaagctcaccaaagatgaattcatcttaggttatgaagctaaattaaatccggttaagttaaatgcaaattttttggtttttgttgaagtcttactcgataaaaccacacctaatgttttagatgagtttattgacgcagtcgtgcattatccagaaatcgttgaatgccatatggtcagtgggggatttgattttttaattaaattacgcagtggaagtatggaggagtttcgacgtatcgcagggcaagtgctatggcaattacccggtgtaaaagagacccgtagttatcccgtgatgcaagttgtgaaagatagttcaaaaattaaaatcaaaactaaaaataaataa

SEQ ID NO: 2384 - DNA, 915 bp, Acinetobacter baumannii
gcgggtgttcacttggaaagtaggagcaaaataatgaacgattcaacatttaacgcgcatgaatactttcaaaaaatttatgaacgtcctgtgattttagaagctaaacaactgagccaagtttttaaacatggtcaaactgaacgtactgttttaaataagctcgatttaaaaattcataaaagagaatttatttgtgtgattggcccttctggctgcggtaaatcgacgctaagccgtgttattgcaggtttagacccataccatagtggagaagttttagtagacggcgaatgtattacgggaccatgtcctgaacgcggcatggtgtttcagggctatacccttttcccttggaaaaccgtaaaagaaaacgtgatgtttggtccgcaaatgcgcggggctagtcaaatgacagccgaagctcaagcacgcgaatggatcaatattattggtttagaaaaatatgaaaatcagtatccataccaactttctggtggcatgaaacagcgcgttgcgattgctagagctttggttaatcaacctaaaatattactcatggatgagccttttggtgcactcgacccgcacacccgtcaaaaaatgcaaaagcacttaatggatttatggcaaaacattgatatcaccattatttttgtgacccatgacatggatgaagccattttgctggcagaccgaattgtggcactcaaagccaacccgggtgaaattaaggaaattattgaagttaatttacctcgcccacgctcactcgatttaatgagcacacctgagtttaaacaacttcggacacgagttgattatctggttcacgctgaagaagacgagcttgacccagctttacaagacttacccaaaataccgcgtatgactcaggtcagtacagaaaaataa

SEQ ID NO: 2385 - DNA, 1317 bp, Acinetobacter baumannii
caagcctctcagggtcatggcttatatggaacaactatggcattaatcgttcaaaaatatggcggtacttctatgggtacccccgagcgcattttaaatgttgctcgtcgtgtgaagcgttggcatgatcacggtcacaaggttgttgtggtcgtatctgcaatgagtggtgaaacaaaccgcttacttgccctcgctaaagccattaccgaaacacctgacccacgcgagttagaccaaatggtttcaaccggtgaacaggtgacgatttccatgttagctatggcacttaattcgattggtgtggaagctaaatcctataccggacgtcaagtcggtattaaaactgacagtgcatttactaaggcgcgtattgagtcgattgacacagatgtcatgaccaatgacctagatgcaggccgtgttattgtagttgcaggcttccaaggcttcgatgccaacggaaatactacaactctaggacgtggtggttcagatacttctggtgttgccattgcagctgccctaaaagcagatgaatgccaaatttatactgacgttgatggggtttatactacagaccctcgtgttgcccctaaagcgaagaaaatcgatcgtatttcttttgaagaaatgctagaaatggcatcattaggttctaaagttttacagattcgctcagtagaatttgccggaaaatatcaagttcctttacgcgtattatcaagttttgataatgatgacgacggcgcatttgacgacgaatttaaagaaaatgtaggtacactcattactactgaggcagaagacactatggaacagccaatcattgcaggtatcgcttttaaccgtgacgaagcaaaattaacaattttaggtgtacctgatgaaccgggtattgcttctaaaattttatcaccagtaagtgatgccaacattgaagtggatatgatagtccaaaatgttgaagaagatggcacaacagatttcacgtttactgtaaaccgtgttgatttagcaaaagctgaaaaaatcttaaatgaaactgccaaaaatattggtgcacgcgaagtttcaacacgcgatgacatcgttaaagtatctatcgtgggtgtaggtatgcgctcgcatgcgggtgtagcaagcaaaatgtttactgcccttgctgacgaaggtattaacatccttatgatttcaacatctgaaattaaggtttctgtcattattgatgaaaaataccttgagcttgcagttcgttgcttacataccgcttttggtttagatcgtgaacatggtgaaagcagcgcacgcgcttaa

SEQ ID NO: 2386 - DNA, 1437 bp, Acinetobacter baumannii
ttgatatctcacaaacggagaatgaaaatgcctgttgtagtgaaaaaacgattattagacttattacaagataatcaacaaaattattatgaattgtttgtttttttccttgatcctgatgtttctagctttgagaaagagaaaaaggctagagattttcttgttaaagagatagataaactagagatgaaggaaatagattttccttcggatatcaatttgattaaggcatggtgtgaaaacgataataaaaaaaattgtcaggaatttcaggcatatttaaatcgtagacaatctggtcaagatagagagtattttaagaacgtcgctcaggcatttgagtttttaataaaggtgtctccaaccaaaaaagtagacggtgcatggctatatagctcagtgcattattggaatgatcctatttttcatgaattaattattacttatctcgaagagcttgggttaggtgagccaaaagcaaaccatgtctgtatctatgatgaccttttacgcagtctagggctagacagtttcgatctgcttttagaagacgagtattatcatcaagcagttgtgcagcttgctctgggttatgcacctcctgagtttattcccgagattgtgggttttaatttaggctatgagcagttaccactgcatcttttaatttcgaattatgagcttgctgaattaggtattgattctaaatactttaatcttcatatcactatcgacaatattgacaatggtcatgcctataaagccattaaagttattgaagatatttataataaatatagagataaagaactcttcttgaccaagctaaaacgtggttttgcccttaataatcatggggtatcctcttcaaacattataaaaaatttaaatactgaagactttgtccatagaattttcaaaagaaaggcgcttgtcggtcagttaattcataacgaaaccagacagtttgggtgcaagaccattaatcaatggttatcaaatcccgatgacattgcaggtttaattactcatttaactgatcacaaatggattaagtttaataccgaccctgaacagagcgtattctggcgaatgattaatgaagaaaatggaaaaatgtttggggtgtttaaccctgtagagcgccaaattattcatgactggattgctggtagtgatcattcttctaacttcttggcatacagcagagaactaaagaatagccagcgtattcaggactatttatttagttatatctcggatggcgaacttgatgcactacaagagcgcgtccaacaatcaagtgaccttgccataaagatttgcaaacttactccgtttcttgccccagattctcatcataaaagtattggtctttggagtactcgtaaatacgtagaactcctttttccttatttaggtacgtttaaaaactag

SEQ ID NO: 2387 - DNA, 960 bp, Acinetobacter baumannii
tacttcaatcaattttcagtgaatcaaggaaagcttgtgactcaatggaacattaatgcggttgtacaaggtttacaacaagcaaggcatgactggcgtcagcaacagcacaggacaaaagaatttgggggccgtgaacttccatctaaagaagctttaaaaactattttagatgacctgtgcggcattttatttccaatgcgtttaggccctgccgacttacgtcaggaaactgaagattcttatattgcctatactttaaatcgggtactaacagctttacatgctcaagtacaactggctttaaattatgaagcaaaacgtcatttgagtcattcaagcccagtgcagcagccacaagaacttgctcaaactattgtgcaggattttgccaacactttgccctctatacggcgccttttagacggtgatgtgcgggcggcttatgaaggtgatccggcagcacatagtgtagatgaagtattactctgctatccgggcatatttgcgattatttatcaccgaattgcccatcagctctatgctcaagtgcctttattgtcacgcattatttcggagttggctcactctgctacgggtattgatattcatccgggtgcacaaatcggcaaaggatttttcattgatcatggtacgggtgtggtaattggtgagacttgtgtgattggggaacgcgttcgtatttatcaggccgtgacccttggagcaaaacgctttgaaaccaatgatgatggtggtttgaaaaaagactatatacgccatccgattgttgaagatgatgtcgtgatttatgcaggcgccactattttaggccgtattaccattggccgagggtcaattattggggggaatgtttggctaacccatagtgttgctgcaggtagccagattttacagtcaccgaatgagtcttatcaaaaaaatcatattgctggttaa

SEQ ID NO: 2388 - DNA, 339 bp, Acinetobacter baumannii
atcaggaatcataggctcaggatgaagctacaacccactatttcaaaaaccattttttattcttttttatttgctataggtggttcacccacattagcaatgctgattatttatggtcaaaattataatccggacttcttcatgacggcatttatgagtctttctgtcctgattgcttgtgtcctcattcctgttgttctcatacaaaacagttatttactctggaagaggaaaaatcctaatcttgaagagaaagttaagactttaagtcatgtttatcttggtttaaacataatatgtttaatattctggatttatttgatgactttatctaattga

SEQ ID NO: 2389 - DNA, 996 bp, Acinetobacter baumannii
gaaaacgatcaagcttgctgttttcagatcagtcatcctaaaggaaaatgtaaggatacttctatgaaaacagtaaaaattttggactctcatactggtggtgaaccaacacgattagtgcttgaaggttttcctgatttaggcacaggagatatggaaagccgccgaaaaatattatcagaacaatatgaccatttccgtagagcaaccatgttagagccgcgcggtaatgatgtgttggttggcgcattattgtgtaagccagtgaatcccaaagcgagcgcgggtgttattttctttaataacacgggctacctaggcatgtgtggtcatggcacgattggtttagtggcttcgttagcacacttgggaaaaatacaagttggtacacacttaattgaaactccagtaggtgatgttgaagcgacactgcatgaagatcattcagtgagtgtgcgaaatgtaccggcatatcgttataaaaaagcagtcgaagttgatgttgaaaaatatggaaaagttactggtgatattgcatggggcggtaactggtttttcttgattaatgatcatggtcaacgtgttgcaagtgataatttagatcaacttactgaatatgcgtggacggttagacaagcgcttacggcacaaggaataaccggtaaagatgggcaagaaattgaccatatcgaattatttgcaagtgacaccgaagcagacagtaaaaatttcgtactttgcccaggcaaggcctatgaccgctcaccatgtggaaccggaaccagtgcgaaaattgcttgcttggccgcagatggcaaacttgagccaggaaagttatggaaacaagccagcattattggtagccagtttattgcctcgtatgaacaagcaggggaatatgtgattccaaccattcgtggtgaagcttacatgagtgccgaagcaactttatttatggatgaaaatgacccatttgcttggggtattcagctatga

SEQ ID NO: 2390 - DNA, 1248 bp, Acinetobacter baumannii
ggaatggatcacatgagtattgtaaaaattgaaaatgtacgtgtgttagacccaatccaaaaaacagacagcgtacaaactgtatatattcaagacggtaagctcattgccccagtcgatcaggttgaacaaaccattgatggtcagggtaaatggttaatgccaactatggttgatttgtgcgcacgtttgcgtgaaccgggtcaacagcagcatggaacgttgaaatcagaaggtaaagctgcacgtgctaacggtattttgcacgtcattacgccgccagactcaaagccgattgtacaagacaacggtgcgctcattcacggcttaattgaaaaagcttggcatgatggtggtattcacatgcatatcatcggtgcccagactcaaggtctaaatggtaagcaaccagcaaatatggcaggccttaaaaagggtggctgtactgctgtttcaaatgcgaatgctgcttttgaaaatgacgatgttgttgttcgtacattagagtacgccgcgggtcttggtttaaccgtcgttttctatgctgaagagccacaacttgctaaagatggttgtgctcatgaaggctttattgcatcacgtcaaggtttaccaatgattcctgcaattgcagaaaccgtagcgattgcaaaatatctgcttatgattgaagcgacaggtgtcaaagctcactttggtttgttgtcttgtggcgcttcggtcgaattaattcgtgctgcaaaagcaaaaggtttaccggttactgccgatgtagcaatgcatcagttacatttaactgagcaactaattgatggcttcaattcacttgcacatgttcgtccaccattacgttctgagcaagataaagagcttttacgccaaggtttaaaacaaggtgtaattgatgcgatctgtacccaccacgagcctttaagcagttcagctaaaatggctccatttgcagagacgcaaccgggtattactgcatttgatacttatgtggctttaggtattcagctcattaatgaaggtctatttgaacctttagaatgggtaactaaagtgacaagtgctcctgcacaggtagcaaatatgacagctcgttggcaagccgaagcagggtgggtgttagtagatcctgagttaagctggactgtaagtaaagacactattttatctcaaggaaaaaatacccctttactgggtcaaaagcttacaggtaaagtcttacagacttttgctgtttaa

SEQ ID NO: 2391 - DNA, 1101 bp, Acinetobacter baumannii
ttaaactgtcatataaagctgttgaaatacgatcatcaaataattgcattcgatggtttgcagatgaaacagtatattcaacagacaattaaactcggtactgcatcagttttaggtgtagtggtcgctattcaaatgggatgttcatcagcaacatcaaaacaatcagaagaaattacagtctatacggcagtggaagccgaccaacttaagcaataccaagaggaattacacaaagcctatcctgaactcaaagtaaaatgggtacgtgattcaacaggtgtgattaccgctaaacttttggcagagcagaaaaacccacaagcggacgtggtttttggtgtagctttaaccagtttgctggtcatggaaaaaaaagacatgcttgagccttttaaaccagaaggcatccaaaacttaaaaccagaatttgtaagccaaaaacctgtaccgacgtggacgggtatggatgcatgggaatctgcaatctgtgtaaataaagtcgaattagaaaagcgtaaattaccaattccaaaaacttggaaagatctaaccaacccgatttataaaaacctcattgcgatgccaaacccagcctcaagtggcacaggctatttagatgtcacggcttggatacaaatttggggtgaaaagcaggcatgggattatatgcaggctttagataaaaacatttcacaatatcctcattctggttcaaaaccttgcaagatggcagcacagggcgaaatcccaattggtgtttctttcggctatccggcatttaaattaaaagcagagggtgcgcctttagaagtggtttatccaactgaaggtttaggctgggaaatggaagcctcagcgattgtgaaaggaacgaagaagctaagtagcgcgcagaaatttataaattggtcggtaagcaaagcggcaaacgaagcctatgcccataacttttcaatggtggcctataaaggcattgaaaatactactatggacttcccgaaaaatcttcctcaaatgctcgtaaaaaatgatttttattgggcggccgagcagcgtgaacgtattttggctgaatggtcaaagcgttttgaaaagtga

SEQ ID NO: 2392 - DNA, 195 bp, Acinetobacter baumannii
cagaccagtcatctaggaactggcacgcccgaaggcgtccctcctccgtcctaccgctacgaagggggacgaacgagttcaccaccaaaaaattacttttttgatgttctagatgaaaacggtctgctaaaaccgactggcaatgtaggccagcaggcaaaggatagtattcgctattgttggcgtcaagcgtag

SEQ ID NO: 2393 - DNA, 1902 bp, Acinetobacter baumannii
tgcgctttccatggagtgaaagaaatgcaaatgaatgccactcaatcacaagaccgcgaacggttcgtaaaattagggcaacatgatattcattatcaccataaagatgacacgctctatatcagcccaaaagagcaattaaaaccgtatccacaaaaactgacagatcgtttaattcattttgcacaaaccaaacccgaccatatttttgcagcaaaacgcaatgctcaaggcgaatgggtcaaactgagttatgcagaagttctacaacgcgcatggcacattgctcaagctttgcatgctcgtaatttaagccaagaaagacctctggtcattttaagtggtaatgatctcgaacatttaacactgtctatggctgccatgctggcaggcgtgcctttctcggctatttcccctgcctactctctgatttctcaagactttggcaaactcaaacatgtgtttgaagtgctcacacctggtatggtttatgccagcgatggacaagcttttgccaaagcgattcaggcatgtattacgcctgatattgaagtggtgaccaataaaggaatagtgggcgatcagatctgcacgtcttttcaatcgctgttagatacaccagtttcaaatgttcaagagttttatcaaacccttgatgaaaaccagattgccaaatttctgtttacatcaggttcaactaaattacctaaggctgtaccgaccacacatttaatgttgtgtgttaatcagcaaatgttattgcagactttccctgagtttgaagaaacaccgcctgtcctactcgactggctgtcttggcaccacacatttggcggcagtcacaatgtcggcatcgcactctataacggcggtacgatttacattgatgatggcaaacccgttgcaggaaaatttgacgaaactattcgtaatctcaaagaaatttctccaactgtttatttaaatgtgccaaaaggttgggaagaactcaccgaagcgttagaaaaagatgaagaattaagagagcgcttttttgccaaagttaaaattttattctttgccggtgctgcactttcagaagcgggctggaacagactcgataaaattgctcagcaacattgcggagaaaaaatccgcattatgagcggattgggcatgaccgaaactgctccctcttgtgcttttacaactggcccacgcgtaatggctggctttattggttaccctgctccgggatgcgaaattaagctagttccatgtggtgacaaacttgagttttgcgttcgtggcaaacacgtcatgaaaggctattggcgcttaaaggcggaccaacaaagtactatttttgatgatgaaggctttttccatacaggcgatgccgttcgtttagtcgatgtcaatgatccaaccaaaggcctaatgtacgacggacgaattgccgaagactttaaactcaatacaggcacttttgtgaatgtcggcacactacgcaacaaagtgcttattcaaggtaatttactcatccaagatgtttgtattactggttcaaacctgaatgctattggttttctgatttttccaaaattagacgcttgtgctcaatatgcaggtcttaagctgggcgaatattctgcagcagagatactgcaacaccctaaagtccaacaatggttccgccaatttttaacgacctttaataaagatgcgactggcagctcaaatacagtctcaatgctttatttaatgaccgagccacctcagttagatgccggcgaagtgaccgataaaggcaacctcaatcaaagcagtattaccaagcgtcgtgccgctttaattgatgagctttatcaaaagcagactgataacccgctgattattcgggtgcccaccttaaaacaataa

SEQ ID NO: 2394 - DNA, 747 bp, Acinetobacter baumannii
tttaatttccaaatacttttaagcgcgcttattctagtgccaaattgttatgcaattcatttttatttggagtgtttcatgcgcaagtccctcatatggatcaatctgatcattgcgatgggcgctttgggttttacaaatgcggtaaatgcaaaagatgaataccctttacacatggcagctgcaaatgacgatattcagttaataaaacatattttgtctcaaaagaccttaattgatgcacgtgatgaaacaggttcaacagcattaatggtggcaacaagagcaaacaatatacatgctgctcatatgttgattgaggccggcgcagatgtaaatgcgaaagataatatacaagatagtccttatttgtatgcaggcgcacaaggttatttaaaaattttacgaatgacactcatgcatggtgccgatttaaagagtactaaccgttatgggggaaccgcgcttattccagcagcagaacggggccatgtagaaactgtccgtactttaattgccgcaggtgtaaacgtaaatcatgtcaataatttaggttggacagctttactagaagcaatcattttaggtaatggcaaatccaactatcagcaaattgtggcgcttttgctaaaagctggtgccaatccgaatttggcagataaagatgggatcacaccattacaacatgcacgtacaagaggatatcgcgaaattgaaaaactccttcttgtagcaggtgcaaaatag

SEQ ID NO: 2395 - DNA, 855 bp, Acinetobacter baumannii
aataaattccaaaataagcatcataaaaggaatatagttttgatatgcgaaacaaggaattcaaaaatgagtgtgtcaacagggaataatttcgtagaagtcgacttttctattcaaaaaatagcggttgttaaaattaaccgcccagaagcaaaaaatgctttaaacggtgaagttcgcaaacaactcgcacaagcttttaccgagttaagttttaacgatgagatcaatgcggttgtgctcacgggtggtgaagaagtctttgctgcaggtgcagatctaaaagaaatggcaaccgcaacttccacagaaatgttattgcgtcatacagaacgttattggaacgcgattgcccagtgccctaaacccgtgattgctgccgtaaatggttatgcattagggggtggctgcgaacttgcaatgcacgctgacattattattgcaggtaaaggtgcaacctttggccagccggaaattaaagttggtttaatgcctggtgctggcggtacacaacgtttattccgtgctgtaggtaaattccatgccatgcgcatgattatgacaggcgccatggtcaaagccgaagaagcttataccatcggtcttgtttcacaagtcacagaagatgaccaaacgattccaactgccatccaaatggcacaaagcctcgcaaaaatgccgccgattgccctgcaacaaattaaagaagttgcgttgatgagcgaggatgttccattaaatgcaggcttaactctagaacgaaaagcattccagttgttgttttctacggaagataaaaatgaaggcgttcaagcttttatcgaaaagcgtaagccgtcgtatcaaggtaaataa

SEQ ID NO: 2396 - DNA, 216 bp, Acinetobacter baumannii
gattgcatccaaaatagcgtcgctaatttggtcggccattttatcgggatgaccttcgcttacagattccgaggtaaaaacagcgtactcgcgcatgaaagtcctatcttggttatttcaaaaagacataatatgttacatcgacttgagcttgaggaccagttcatactgactaaaaagcatgaatttctttcatttctactatgttttaattga

SEQ ID NO: 2397 - DNA, 1563 bp, Acinetobacter baumannii
gctttgatccatgtttttaattcatgtggatcaatttgttgcactgcaatgcgtgatgtgttggaagatgtcataaaccgaaaaatgcaagaggataagaatatgcaggcggtagtttaccatagccaagatatccaggcatgggagcaacgttggtttgctgcgcaaaactcatcattaggtttaatgcaacaagcagcttggtcaatcactcaacaactcattgtactttttcaaaaacaaaattttaagaatattgctgtttggtgcggacagggcaataacgcaggtgatggatattttatagcgagttatttaaaacaggcgggattccatgtagagatatttgcggctgagttgggtgaatcaactgatttacaccatgctgtcgattttgcgaaagaaaatgatgttcaaatataccaaggttttgaggccaacagaacatttgattgtcatattgatgcgttgtttgggattggtttaaaccgtgaattaaacggttattggcaacacgcgattcaacaatttaatgggcaagcagggctaaaaatttcgattgatataccaagtggtttacatgcaaatactggctctactttaccttgtgcaatacgggctgatcatacatttactgttttagggcttaaagcaggattgtttaccggccaaggtaaagaatatgcaggacaaattcatttaattaatttaataccaatagaccaagagctgaaacctcttgcttacttgacgccaacacatatcaaacttcctaaacgtttggcttttggacataaaggaagttatgggcatgttttggtgataggtggacatgagcaaatgggcggggccgtcattatggctgctgaagctgcttttcatgcaggggcaggcaaggttacggtagtttgtcatcgcaaccatcatcaggctattttgtcgcgagctcctaatattatgctgcgtgatattaatgatttcgatgaagacggtattaaagaaattttatctcaggttgatgcagtatgttttggaatggggttaggtcgtgatgactgggcacaccaaatctatcaacagtggtttaattatttaaatcagacttcacatttagaagttgtattagatgcagatgccctatggtttctcgcaaagcagcctgaaaaattgagtttacatatttatgcaacacctcatccgggggaggccgctacattacttggttgttctacttggcaaattgaaaatgacagaattgctgcgatttatacgttgcagcaaaaatatgcaggccagtgggtgcttaaaggagcaggcagcttaattttagaagataacttgtatatttgtacgcaaggtaatgcaggtatgggaactggtggaatgggagatgtgttggcgggcatgattgcaagcttaaaagcccagttccataaagcagttaccctacatgagatcgtaaccctccatgctcaggcaggtgaccaacttgccaaacaaggcatgcgcggtttacaagcttatgagatgaaccaagcaattactcaagtagtaaatcaataa

SEQ ID NO: 2398 - DNA, 228 bp, Acinetobacter baumannii
agacattaccatgctctttgtaagtttgagatgcttgttatttctactcaacatacaaaatataagattattaattttttagtattccaagaaattcattttgaatttaaattttttaaaaatatctacaaattttttgctcactacgtagatataaggtttatcagtatctctagcaatataattagacaagtagattctttaagagctcaaaaatcaccctactaa

SEQ ID NO: 2399 - DNA, 801 bp, Acinetobacter baumannii
attcggctacaatactcaatctttcaagtttttataattggtttactgccaaggtgtattgtgtcaaatcaacaacagatggctgctcaaacagcaactttttggcaaggtgccaaagatagtcaagccatcgttctcacctacttaccagtttcttttgcctttggcgtttctgcatctcagtttggttttacaccatgggaagcattttttctttcttgttccatgtatgcaggtgcaagccaatttttagtggtcgcacttttagcaagtggttcttctatatggttaaccgctttaacagtcattgcacttgatatacgacatgtactttatgggcctgctctttataatttaattcccactaaattaaatttaaagaagacagccgtttgggcttggggtttaacggacgaagtttttgccagtggtatgatccaactttcacagcgcagacaacaatggtccgagtcttggatgttgggcttaagtctatttagctggatgtcttgggcaagtggttcattattaggcgggttatttgcagatcaagtcgcacaccttccaaagtttttacaagcagctttagatttcttattacctgctttatttttaagttttttattagcggcatttgaacgaaagcatagccttgtagttgctgtatcgttagtggtgtcagctttggcatgttattggattaacttatcagcggctatctttattggcattctttcaggcattttagcaggtctatttaaatattatgtgctgaaacaatttgatgaggtcgaagcttaa

SEQ ID NO: 2400 - DNA, 294 bp, Acinetobacter baumannii
aagtattcacaaccttattttttttttgttaagatcattaacattaaaaacatagagataataataatgatcaataaagtattaatagtgttatgcgtgagtattgtatttgtattagggtattgggcatatttagatacccaaaataaaagacatcaagagctcatgaggatcatccaagaagctgaaaaaaatttacagaccatcgaacgtaatcctaaccgtgttagtcatagcaatttagcttcatataatttgcaaaaatatatcagtgataaaaaagtttttttctaa

SEQ ID NO: 2401 - DNA, 1335 bp, Acinetobacter baumannii
ccctcaaaacacgcttacccagcagtaaacataaatgcgccgaggactggcgcatctttttggaaatggattatggaattcgtacaccgttttaaaccatgtaatttagcaataactacattattcggtttattaactagctcaagtttatgggcagcagacaccactcaacaaagcgaagatgaatggaaattcacgctaaagaatgcctatatcaaccgtaattttgacaatgatgcactcaaagatacgggtagctggtctcaggcagcctcattattttataaatcgaaaatgcatgacacccctctacaaattgcagacaagccaattacgattggtgccgatgcttctgttcaatacgctgtgcgcttgagttcagataaacatgttgcggacactgttttgccttttaataaagaaacacaatctcaagcatcagatttcttaaaatacggtgcaaccttaaaactgggctatgacaaaacccttttaagtgtgggtgaactctggttagacctgcctgtaacggctgtcgatgctagccgacaattgcttgcttcttattggggaaccaaccttaaatcgcaactttcagatcagctttatgccgaaattggtcgggttgaaaaagtttcgccacgaaatgaagaagactttaaaaagttttcattcacggcaaatggaatgaccaaagaatctgatggcttaaattatattgacctacgttatcaatttacgccgtctttaaagggcgaatattattttggtaatttagaagatctctacaataaacactatgtagggcttgagcatacgtggaaacaaccaacttttgccctgacctccaaatttaaatattttaatgcgaaagatgatggcaatacctttgatattgatgcgcaaaacatcggggtgctagaaacacttaaagtaaaaaatcatacctttggtttggggtaccagcagattatcggtgagtcggcttatccattaccagatggttttttaccagaaacttatttcattaactggaatgccactggcttctttaaagaagacgaaaggtcttatcatgtgatgtacggctacgactttaaagactatgtgcctggcctaaatgcaatggtgaaatatgtttatggtcatgactttaaagcagccaatggcgagaaaaaccacgaaaccgagtcgaatgtgattttaaactatgcgtttcagcagccattgttaaaaggctttgccctgcaatatattcgaattgattacaacgtaaaacatggcaatgactttggtgaagatcgcttgtttgtaaactacactaaaaagttttaa

SEQ ID NO: 2402 - DNA, 690 bp, Acinetobacter baumannii
cagcaattgcacaatttgaggtacttggctatgcaagaccagctcattgatttattaattactggaactatagataccttgctcatggtaggtgcatctgcatttattgcctttttaattggcttacctatcgctgttattttagtgagtacttccgaacatggcattcacccatcacaaaagattaatcaggctttgggttgggtcatcaatatcactcgctcagtaccttttcttattttaatggtagcacttattccactgactcgctggattgtgggtacaagttatggcgtatgggcagcggttgttcccttaacgattgcggccattccattttttgcccgtattgcagaagtcagcttacgtgaagtcgatcaaggcttaattgaagctgcacaagccatgggttgtaaccgcaaacaaattatctggcacgtacttttaccagaggctttgccaggtattgtggcaggctttacagtgactattgtgacaatgattaactcatctgcgattgctggtgctattggtgcaggtggcttaggagacattgcttatcgatatggttatcaacgttttgatatgcaaattatgttggctgttattttagtattgattgttttagtcatgttagtacaagcgactggtgatgcattagcccagcaactcgataaacgtaaagtttaa

SEQ ID NO: 2403 - DNA, 444 bp, Acinetobacter baumannii
aagattatgcaaggtttaaaacgtcgtattgtttatgtttcttcttatgaaattattggaatggtgatttcatcagtaggtttggctcttttggccggagatagtgtagagcacactgggccactttcagtgatgattactactattgcggtaacgtggaactttatctacaacattctttatgaaaaatgggaggctcgccaagaaagtaagtcgcgtacggttaaacgaagaattgcgcatgcgattggatttcaaattactttagtaatgttcttaattccgcttattgcgtggtggatgaatatttctcttgttgccgcattttggttagatgttgcatttattattgtcattccaatttatacattcatatttaattggacattcgacaagttatttggattacctgcctctgcacaaccaagtactgctcaacagtag

SEQ ID NO: 2404 - DNA, 1617 bp, Acinetobacter baumannii
ataaggatgcatcttatgaaccaattacaaagcaagattaatgttcgaagcgaagacttcaaaacaaaccagcaagccatgcaaacattggtcacagatctcaaacaagttgcccagcgtattgctttaggtggtggcgaaaatgcccgtcaaaaacatttgtctcgaggtaagcttttaccccgtgaacgtattgatcaactgattgatgtcggcacggcatttttagaaattggtcagttggcagcgtacaacgtttatgaagatgatgttcctgctgcgggtgtgattgcgggtattggtcaagtcaacggcgtaacttgcatgatcgttgccaacgatgcaacggttaaaggtggaacgtattatccccttacggttaaaaagcatttacgcgcacaagaaattgctgaacaaaatcacttgccttgtatttatttagtagattcaggcggtgcctatttaccaatgcaagatgaggttttcccagaccgtgatcacttcgggcgtattttctataatcaggcacgcatgtcgagcctaggtattgcccaaattgccgtggtaatgggtagctgtaccgcaggtggtgcgtatgtaccagcgatgtctgatgaaacgattattgtccgtaatcaaggtacaattttcttaggtggtcctcctctggtaaaagctgcaactggcgaagtggtaagcagtgaagatttaggcggtggcgatgtacacacacgtctttcaggtgtagctgaccacttagctgaaaatgatgaacatgccattgcgattgcacgaaacattgttgctaacttaaataaaaagccaaatgagttaaataagcaaattgatgaaccattatttgatgcatcggaactctatggcgtggtgccaagtgatgcgcgtaaacctttcgatgtgcgtgaagtcattgcacgtattgtagacggctctcgttttgacgagtttaaagcccgctttggctcaacacttgtaacgggtttcgcttctctctatggcatgccagtcggcattattgccaataacggaattttattttctgagtctgctcaaaaaggtgctcactttattgaactgtgcacacagcgcaatattccattgttatttatacaaaacatcactggctttatggttggtcgccagtatgaaaatgaagggattgccaaacacggcgctaaactggtgatggcagttgccactgcaaatgtccctaaactcaccctaattattggtggttcatttggtgcaggtaactacggtatgtgtggccgcgcttattcaccacgctttttatggacatggccgaactctcgtatttcagtgatgggcggcgaacaagcagcgagcgtactctctactttaaaacgagatcaaattgagcaaaaaggtgccgagtggtcagcgcaagaagaagacgagtttaaacaaccaattcgtgaacaatacgagcgtcaaggccatccatactatgcttctgcccgcctttgggacgacggtgtaattgatccagctcaaactcgtcatgtacttggtttaagtcttgcagctgccatgaacgctccaatccagccaaccaaatttggcgtgttccgcatgtaa

SEQ ID NO: 2405 - DNA, 999 bp, Acinetobacter baumannii
acggcagtgcagcacgttggcacaatctttttgaacggatttttactgcgcaaataccgccagcggtcaatattgatattcatgattttggtgcaactcccggtgttgttcgcttacgtctggaacaagcattggaggagattgctcatgactgatatcgagagcttgttaaataaacaagattttattgagctgagtgcgagagagcgtgctaaagcattattagatgaagggacttttcgagagttattggacccatttgcccgtgttatgtcaccttggctcgttaaacagaatattgtgccgcaagccgatgatggtgtagtgattgcaaagggaactattcaagaacagccagtagttttaatttctattgaaggtttatttcaaggtggcagtttaggcgaggtgggcggtgccaaaattgcgggtgccttagaacttgcggttgaagacaatctaaaaggcattccaacagctgcaattttattgttggaaacgggtggcgttcgtttacaagaagcaaatctgggcttggctgcaattgctgagattcaagctgcaattgtgaatttacgtcagtatcaacccgtgattgccgtggttgctggtagtgtagggtgttttggcggtatgtcaattgcagctggactatgtagctatattgtaatgacacaagaaggacgtttaggtctaaatggcccacaagtgatagaacaagaagctggtgtacaagaatataacgccaaagatcgtccatttatatggagtattactggcgggaaccaacggtttgctagtggtttggcagatgcttatgtagacgatgatcgccagaaaattcgtcagcaagtcatcgcttatttaactcaaggcgtacctcatcagcatcgtagttcaaattactcattctatttagaaaagctacaacaagttgatactgctgagcagattaccccagcacaagttcaagctttgtatcaaggagagcaagtatga

SEQ ID NO: 2406 - DNA, 195 bp, Acinetobacter baumannii
ctaatgcagcaagctcttcaacaaccgcaaactttgtgtattaaacacttagcaaaaaactatagtaagcgttgggttgtcaaagacgtctcttttagtatgcaaagtggacagattgttggtttgcttggtcctaacggtgctggaaaaaccaccagtttctatatggtggttggactagtgcgcatggcataa

SEQ ID NO: 2407 - DNA, 813 bp, Acinetobacter baumannii
acgatgcagcagaacaacaaaacccaaagcgagcttaaaacaggcacaattcataagtattttgatagaaatatactaacgctcaccatgagtaatgccactaaaaagaatgcaattaattatgaaatgtatgcagctttaagtcaggcattagatcaagctgcaatcaatcaagacattcatgtggttgtgcttactggtgaagactccgcatttaccagcggcaatgatgtaaacgcatttgaaaaacgagataccaccagttccgaaccacccgcttcgattgttttcttaaaaagcttagcaacgtttccaaaaccgattattgctaaagtaaatggtgtggcaattggcattggcagcactatgcttctacattgcgaccttgtgtatgcaagccaaaactctatttttcagttcccctttgtgaatttggggcttgtacctgaagctggttcaagttatatcttgccaagattattgggctttgctcgagcttcggaaattattttactcggtgaaaagttttcggcggaacaagcaaaaaattatggtctggtaaatgaaatatttgaagccaatgagctggatcaagtggttgaagatgtggcaattaaactcgctcacaaaccaagccaagccttacagctcagtaaaaagttactaagagatatgccaattgatgatctactcaatcgtattgaccatgagtcgactattttctcgcgttgtttacaaggttccgagtttaaagaagcattaagtgctttcaaagaaaaacggaaaccgaactttcacaaccaaacagcctaa

SEQ ID NO: 2408 - DNA, 570 bp, Acinetobacter baumannii
tgcgcatggcataaaggtgagattcatcttgatgacctagatatgtcagacctagcgatgcatgaacgtgcgcgtaagggtattggttatttacctcaagaagcatctatctttagaaaattgacgattgctgaaaatattatgtcgatcttagagacacgtaaagatttgaataaacagcaacgtcagcagcgccttactgagttattaaatgactttaaaattagtcatattaaagattcattgggaatgagtgtatctggtggtgaacgtcgtcgtgcagaaattgcacgtgctttggccgcagatccgaaatttatgcttctggatgagccgttcgctggtgttgacccaatttcagtaggcgatattaaagatattatccacaccttaaaggatcgcggtattggtgtcctcattaccgatcacaatgttcgtgaaactttagcaatttgtgaacgtgcttatattgtaagtgaaggctcggtaattgccgaaggcacaccacaagaaattttagacaatgaacaggtacgtaaagtctatttaggtgatgatttcacagtttaa

SEQ ID NO: 2409 - DNA, 768 bp, Acinetobacter baumannii
ggggaatggcaaatgaatcattcagttttatctaaattcttattacatattggcgatagccaactggttttatctcagcgtttggctgaatggtgcgggcatgcacctgagctagaaattgatattgccttagcaaatatcggcttggacttgttaggtcaagcaagaaactttctgactttggctggtcaatatgatgaagctcaacgtgatgaagaccaacttgcgtatttccgtacagaacgtgagtttttaaacctcttgttgtgcgaacaacccaatggtgactttgcacaaacgattgtacgccagtggttgatggaccattaccatcttcatttatttacggctttagcgcaaagctcacttcccgaattaagtgcgcttgctgtgaaatctttaaaagaagtgaagtatcacatccgcttttcaacaagctggatggaacgtttaagtttaagtacagatgaagcacatcaacgtgtgcaagacggtttaaataatttatggcgctttaccgctgaattatttgaactgagtgcagacgaaaaagcattagttgcagaaggtgtgattccagatttttcaaatgaaaaagaacaatggaaccaaaccattgcagatgagcttaagcgttttgaattaaatgttgctgtgaacggtgcttatcgccgtggtgcgaaacaaggattgcataccgagcatttgggttatttattggctgaaatgcaatgtattcaaagaacttatccgggaatgacctggtaa

SEQ ID NO: 2410 - DNA, 456 bp, Acinetobacter baumannii
ggtgtttttaaaggtaggtttgtgaatttttatacaatttatccgtctgagtatattgatagagatttttcttttgatttgaaagggaagcaagaaattattgttgattattttaaatttgacttaagtaatcaatttttaaaaaatcctagaataaatttagattatgacaatattttttctgatcaattgaatgaaatattggatacggatttttattattcatcttcaggaattttacttttttcaaaaagattctttaatgaaatgaaggaagttcttgcagacgaatgtgatttctatcaatgttatgtaagaaatcaagaagcagatatttatgccatgtatattaaaagaaaaaataatttattagatgaagatgactttataaaaaatgatcttgtaatagatgactttttattgttagagatactgataaactatatatctacgtag

SEQ ID NO: 2411 - DNA, 1251 bp, Acinetobacter baumannii
ttgcattttaaaactagattgaatggagttaggacaatgaaagcttctcttgcctcttctacttcatccgccgaaagtgataaaccgctttcaagcatgcctcgtggcgtaattttgctgtttgctatagcaagtggcgcaagcgtagcaaatgtctattatgcgcagcctttgctcgacatcttggcgagtgactttaatgttagccatgccgccattggtggtgtagttacagccactcaaataggttgtgcacttgccctcgtgtttttagtgccgttgggtgatcttgtaaatcggcgtcggttaatggctatacagttaatggctttaatatctgcattgttaatagttgcctttgcccactctacaattgttcttttgacaggaatgcttgcggtgggtctactcggcacagccatgacacaaggacttattgcctatgctgcaagtgctgcggccccacatgagcaagggcatgtggttggtactgcacagagtggtgtgttcattgggttactacttgcccgtgtattttcaggaggaataagtgatatagcgggttggcgcggcgtgtacttttgcgcagctatcattatgctcatgattgccttaccactttggagacgactccctcatttaaatgttcagcctgttaccatgcgctactcgcagcttctaacttctatgttaaagctactgcgccaagaaaaagtcctacaagtacgcggtgtattagccttactcatgttcgcggcatttaatattttctggagcgcattggtactaccgttaagtgcaccaccctataacttttcgcatactgtaattgggtcttttggactgttcggtgtaatcggtgctctagccgccactcgtgctggccaatgggcagaccgcggatatgctcagcgcacaagcttggcagcactgttaatattgttgctcgcatggtggccgctttcacttatgacctactcactttgggcgctgatgattggcatagtattgctcgacttaggtggacaagccctgcatgtgaccaaccaaagtatgatttttcgtactcgcccagaagcgcatagtcggcttgtgggtctatacatgctcttttatgcagtaggtagtggactgggtgcaattagcacaacagcgacttatgcttatgcaggatggctcggcgtatgtagtctaggcgcatgtgtgagtttattggcgttattattttggtggagaacgatgaagctataa

SEQ ID NO: 2412 - DNA, 243 bp, Acinetobacter baumannii
gtaatatttaaggtagtacgtatgtttgtatattttacagatggaacttgcattaatgattctgagatttatggtgtaaaagccaaatatgagcaaaataagtatgtagtggaagttactattaagccgacacatgtgctcgctacaacaccgagtgtacaatttaaaaaagaaatttttgatgatccaattttagcaaatcaatatcttagtcataattttaatatgccaccatttttttaa

SEQ ID NO: 2413 - DNA, 738 bp, Acinetobacter baumannii
atcagatttaaaaaccaaattcatgaatggatcattcatatgacaaaacttgtggtattttccggcgccggtatgagtgcagaaagtggaattcgtactttccgcgatagtaatggtctctgggaaaattatgatatacaacaagttgccactcccgaagcgtgggaaagaaatccagctttagttcaacgcttttacaacgaacgtcgtaaaaatattttagaagcccagccgaacgaagctcatcaatatattgctaaactacaagactattatgatgtacaagtcattacacaaaatattgatgatttacatgagcgtgctggaagccaaaatgtcttacatctacatggcaatattcgactagcgaaaagttctgggccagatgcacaatatacaactcaattttatgaagttaatggttggaagctcgatttagaacaggacttttgtccagatggttacccgcttcgccctcatgtcgtttggtttggtgaagctgtacctgcttatgaagaagcaattcgtttagtacaaagtgctgatatttttattgtaatcggttcgacattaagcgtatatccagttgccgccttggtccatgagattcctcattataccaaagcgtattatatagatccccaagcagatcattctcgtgttccacctcaatataaattattaaatatgacggctacagaaggtatgcacgagttatttcatcaattgaccagttaa

SEQ ID NO: 2414 - DNA, 732 bp, Acinetobacter baumannii
aaaatgtttaaagatattctaagaagattcgcctttttatttgtatttttgccagcattgccagcaatatggtatggatgtcaatatgctttttatttaggacaaacagaagcaataggagcctcgcttgctgaagcaggtttaagcaattatgaagttactttttttggctctttaacgtttacagagattttatttgaatcctttgataaaattaaaatagctttccataaattaatattaatttttattaaagtcatatcttttttaacgttaatgtttatttcgttatggattggctaccacccatctcgtcgatatgaaattaaaagctttatttatttgaaatactctgctttgaaattttactatacctataattataaaacaccaaagccaattaagcttttagagtattactactttactatatttgttctttttttactcaccataggttttgcttttatacacaatgcatataaaaaaggtgagaaaaatattaaagaaaatttatatcaaatttacataaagaaagactattctttctcaggcactgttactgaaggtgataaaaaatataaagcatataaaatagtttgtggtaattacaaatgtattggtttagatcttgataacaatagaaatactaccttccttcctgaacaatacaaacaaaattttgattatcaaactttcaaggataaatttaaggaaaagaagagcagttga

SEQ ID NO: 2415 - DNA, 237 bp, Acinetobacter baumannii
tttattattaaattgcaattatcgagccaacttttccaagtaggacacgtccatttgcttcacttattatttatctgtttcgcagaattaatacctttaaaactgctcacatgtttctactttaatctatgttttaatcttctgtctattattaagctcatctatttacacttaaatgtggcaattattgattacaatgtaaacacatgcacaataaagtggcttaaatttttctaa

SEQ ID NO: 2416 - DNA, 1608 bp, Acinetobacter baumannii
agaagaattaaaaaggataagcaaatgcgttttttatcggtaaacgccgattgttttctaattgagcttgcgagcttagaagaaacattggcgttgtacaataaattgcaaaatacgcaattgaatggaattaaagacttagtccccgctgcaaaaacaattttggttttttttaatgagatcgaaaccaattttaaaacgctagttgcttcaattcagagcctcaaagttgattctggatttgagcgtagcggccaagaagtgattgtgccgattcgttacgatggcgaagaccttgcgcaagttgccgagctacaaggtttgtctgttgctgatgtgattagaaaacatcaccaaagcgtgtggaatgtggcttttattggttttgcgccgggctttgcttatatgagcagtcccgataagccttttaccgatattccacgcttaacggttccccgtaaaaaaataccgtcaggctcgttgggcttggctgggaaatactctggtatttacccaaaagacagtccgggtggctggcagctgattggtacaacatcggaaaaaatgtgggatttagagcgtaaaaatcctgcattgctgttaccgggcatgactgtacattttgaagatgtcacgcatcgtccaactacggtgaatgtaccgcagcaaatcacgtgtaaggctgagccgaaacaatctctgccactgtttacgatcactgcgccaagtttacaaatgctcattcaagatgaaggacgtttaaatcagaccaatattggtgttggtgtggcaggtgcaatggatttatctgccatgcatagtgccaaccgtattgtgggtaacccaaccgatacacctgtcattgaagttttaaatggcggcctaaaagccaaaatgcagcatgcaggtgttattgcggtggcaggtgccatttcaaacattcgtgtgaaatttgccgacggtcaaaccgcggactttgcaagctatcaaccgattgatttagatgaaggcgatgaatttcaaattcagccaccaacagcaggcttaagaaattatttggcagttcgtggtggtatagacgttgaaccaatactcaatagtgcttcgtttgacagcttggcagtattagggccagagcctttaaagcttggagataccatttaccaaggacaggtgaaggcagccaatattagcgtaaatgaagtgggtaaaagtaatttgccaaaagctggcgaagtcgttgagctagatattgtgatgggcccacgtaccgactggtttgaacaagacagtattgaactgctctgtcagcaagaatggctagtgaccaatgaaagcaaccgagtcgggctaagactttcaggtgaacagcctttaactcgcaaaattacccatgaactggaaagtgaaggcacatgcattggcgctttgcaaattccaccgagtggtcagcccgttttgtttatgaatgatcaccctttaacgggcggatatccggtcattgcctcagttgctaaacaccattgggatttggtggcacagattccggcaggttgccgcatcaaatttaaaaaaattgccgaatttacagattttgagaatgaatga

SEQ ID NO: 2417 - DNA, 540 bp, Acinetobacter baumannii
gtcatggttaaaaatgccttacaagctcagttactcaaagctggtttagttgacaataaaaaagcgaaaaaacttaccaaacaagctcagcatgagcagcgtactggtcaaagcaatgaagcagaaattaaagctaatattgaaaaagctcaaaaagagaaacaagcaaaagatcaagctttgaatctagaaaagcagcagcaactcgaagaaaaagcattaaaggcttcaatcattcaaatgatcaagcaacacaaaattgtagattttgccggagatgtggcttatcaatttattgacaagaataagattaaaaaggtttacctatctcagcaagtttataatgcacttgttacaggcagtttagtgattgctaaagatcaagatcaatatgcttaccttcctaaagccttagctgaaaaaattgatcaaaaaatgaaaggatttattttgatcaataatgctgagaaaaatgaacaaactactgatgaagaagatccatatgcagcatatgtaattccggatgacttaatgtggtaa

SEQ ID NO: 2418 - DNA, 411 bp, Acinetobacter baumannii
aacatggttaacactgcccaagcacaaagtacttctactccttatcgagtaacgcttaccgatccttcaggccatcaatggtttgcagatgaacccaccgataaaggtggaaaagatacagctccaaatccggttcagcttttattatcggctttaggagcttgcactacaattacactagaaatgtatgcaaatcacaaaggcatcaaaattgagcatgtacaagttgatttagcattaaatccaaatggtgatccagaagcaggtcaaaataatattgagcgtaaaattactctaaaaggtgaatttactgaggatcagcataaaagattattaaaagttgctgaaaactgccctattcataagcttttaacatctaatattacgatccaaactgaacttaacatttaa

SEQ ID NO: 2419 - DNA, 219 bp, Acinetobacter baumannii
tttatgtctaatactactggtacagtaaaatggtttaatgaaactaaaggtttcggttttattcaaactgatgaaggtaaagatgtttttgcacatttttctgagattcaaacacaaggctttaaagttcttttagaaggtcagcgtgttcagtttactgtaacacagggtaaaaaaggcccacaagcttcaaatatcacaattgtgacgaatgcttaa

SEQ ID NO: 2420 - DNA, 924 bp, Acinetobacter baumannii
ccataccctaaaggtattcctatgctcgatttatataagcttcatgcctttgtagtggtggttgaagaaagaaatattactcatgcagcaaaccgtttgtttattcaacagccacctttaacgcgtttacttaaaaaacttgaacaagaactcggtacacagttacttattcgtcaaccgcgcgggattgaaccgacggaagcgggtttagcattatttaaagaagcacaacttttattagaacatgcccgccatattcctaaattggtccaagatgttagccaaggtaaaactggacaactcaatattggctttacaagttccgcaggtttgcatccgctcatttcactcgtattacgttcatatcgggaaatgtaccctgctgtgcaaaccaaacttgaagaagcaggcagtcaaaagcaactggactggttaatttcagaaaaacttgatattgcttttttaagagcgccgattagccgagatattggtttgaagcatcttcatatattaaacgagccaatggtggtggccttacctatcggccatccgcttacacagaagaaaaaaattagtttaagtaacttgtcagaggaaaattttgttttataccgtcgctcttcagggcaaggcttatatgacaatattttatatagctgctatcaggcaggttttagtccgcgtattattcaagaagcgccgcgccctactgcgaccctcaatttagtggctgccggtattggaattagtattgtgcccgcttcaatgcataacttttgggaccatgaaatcgtctatcgcgagtttgatgattcgataaaactaaatgcgcctatttacttaattacacgagaaaatgaaaactcagctaaagtgtcaaacttcattgaactcatgcaaaaactattaccaataatgacctaa

SEQ ID NO: 2421 - DNA, 1059 bp, Acinetobacter baumannii
aacacgcctaaggaagaaggagctaaaaagatgctgttaaaagttggtgaattggctaagcaaacaggacttactgtccgtgctcttcatcactatgacgatattggtttacttcagccttcggcccgttccgatgctggttatcgattatatacccgtaaagacattactcgtttgcatcaaattcaagcattacgaggactggggatgtcgctagccgaaatctatacggttcttgaagatcccaatctagcacttttaccaattattgatcagcagattcaagcaattgatcaaagactggcagagcagaagaaattgcgaaatcagctaggacaattgaaatctcagctcatcaatggtgaagaacttgatttggaggattggctaaatatgctggagcttatagcaatgtacgagaaatactttacgcaagaagaacttgaaaagcttacatttttacaatcaggtactaaaacccaccaagaatggcaagagttaactcaagctgtaaatacggtatttaatgctggagaatcatctagcagtgaaaccgctcaaaagctcgcccataagtggatgaaaacacttgagcagaatacgcgcaccaatccagaatggcttgttaaattaaataacatcaattctgcagaacctgaatttcaggaaaaattaggagtaatgccagaagttgttgagtttttacttaaggccttttcagagagtaagctgagtatttttgctcgttatttatctgataaagagtttgcttttttaaaggaaaattatgttcgcgaaatgaaaaaatggcctcaattattggtcgatattgagaaattgattgacgctgaggttaaaccgaatagtgaaggagcaaaacgtttggcacagcaatggctctctatgctacaaggttatactggcgaaaatccaagcactcaagaaaagatccgttcagcaatgcaaaatgaaccaagccttgctgacggtacttggctcaaaccggttaccctacactttctagaaaaagcagtagcagcattcaagcatagtgcttag

SEQ ID NO: 2422 - DNA, 189 bp, Acinetobacter baumannii
atagcttgtttccttaaggtatgtacgatgaaaatgtacttgttatctttggctgtagggttgcttgttggtgtcttatattatgttttaaatgttaagtcaccagctccacctcttgttgcattagtcggtttattaggcatggtaataggagagcaactgcttccttttatcaaatcctatttttaa

SEQ ID NO: 2423 - DNA, 1434 bp, Acinetobacter baumannii
aaaatggctaaaactcaactacaacacttcattaacggcgaatatgttactagcaaaggaaatgatttcttcgatttggtaagcccagtcactggtgaagtctatgcacaatcgccgaatgcgaccgaggcagaagttgatgcagcttatgctgctgcaaaagaagcatttaaaatttggggacgtagtacaccttcgactcgtcaaaaagcattacttaacttggcagatgctattgaagcaaatgctgaccgtttgattgaagctcaaagccgcaatacaggtcagttaaaacatttaattgcatctgaagaagtaggtgcatcggcagatcaagttcgtttctttgcaggcgctgcccgcttactcgatggcacagcaactggcgaatatttagaaggtttaacttcttctattcgtcgtgaaccagtcggtgtggttggtcaggttacgccttggaactatccactcatgatggctgtttggaaaattgctccagctttagccgcaggtaatactgtcgtattaaaaccaagtgacaccactcctgaaagtacccttttacttgcagaaattgctgcaccattttttccgaaaggtgcatttaacgtggtgttaggccaagcgcaagttggttcaaaagttgtatcacacaaaacccctgctcttgtttcgattacaggttcagttcgcgccggattacaagttgctgcttctgctgctgcaaatttagcaaaagctcatcttgaacttggtggtaaagcacctgtactggtttttgaagatgccgatcttgataaagccgttgaaatgattgctttaacaggctatttcaacgcaggccaagactgtactgctgcaacacgtgtgattgtggctgaatctgttcatgacgagtttttagctaaactcgttgaagctgcaaaaaatacccgttttggcgatccagatgatcaagacgcgctttatggcccacttaacaatgccaatcaattaaagaatgttaaagcgtttatcgacaacttacctgctcacgccaaagttgaaacaggtggcaaacaagcagaccgcccaggtttctattttgaaccgactgttattagtggtttaaaacaacatgatgaagccattcaaaatgaaatttttggaccagtgattaccgttcagaaatttacagatgaaaatgatgccattgaaaaagctaacgatgttgaatatggcctagcttcaagtgtttggaccaaagaccatgctcgtgcaacacgcctgtcacgtgaacttgatttcggtacagtttggattaatacccatattcctttaacagcggaaatgccacacggcggcttcaaaaagtcaggatacggtaaagatttatctggttacggttttgaagaatatacccgtgttaaacatgtgatgagttcaaacgaataa

SEQ ID NO: 2424 - DNA, 1227 bp, Acinetobacter baumannii
ctgcattataagcatacagagaaagagttaatgaattttgaaacttacgtgaaagagaatttcattgcaactttcaacaaattatttagaaaacaatcatctaacctattaactattaagtactatccagaagatctatcttttaatgaattcaatttaaaaaaagaaaaaattttagctgaggttttaaatgacttggctactaaaacatattcacctacatccctacatcctagctttctagaaaagtcagatgggtcattaagattaatctgtattccctctataaaagaccgagtcatacaaaaactcattttaaaatatattaaagaacatcacgaaagtaagtatattttggctactaatcatgatttctcagctaaaatttcagaagctggagcaataaaagcaagaactaaagctttaattttgagaaaccaaaatccatatgtgttaaaaaccgatatttcatctttttttgataatttagatcgtcgattagctataaaaactgtcaaagaaaagcttgatatacctgaaataaattatttactggaaagaattattaaggtcgaaacaagatttcaaaaagataatttaaacaatgaaaaagaaaacgctcttttgaaatcaaaaaaaggcaaaggaattagacaaggtatgcccatgtcatcatttcttgcatcactttatcttcatgattttgataattttattgagaaagaaaatattaaatgtgtaagatatgcagacgacttaattattttttgttcatctcgtaaacaagccttaaattatctagaaaaagtaactatagagttagaaaaaataaaactaaatattcctcctttggaggataaatcaaaaactcaaatagtaaaaaataaacctattgatttcttagggctggaatttagatttggtggtactaaatttaaagcctatgtgccggatgtagtttttaaaacaattcatcgtaaattagaagtctatgattctctaaataaaaatctcaaaaataaaaaagatttttctgatgtaattcaagatataaaatacatctcaaatggatatagtgcagctttccctgatgcttgtaatattagtgaactagaatatgaaataaatacgaagaaaataattattttttcaaagcttttaacatcacttggattagatatagaacgccttagtgctcgtcaaaagaaattcttttttagcatataa

SEQ ID NO: 2425 - DNA, 1020 bp, Acinetobacter baumannii
agcgtccataagcatcgcgtttttgattacgagagttctggccacgaccatctgaacggccacggcggtcatcatcgtcgtcatcgtcatcacgacggctgcgaccacggcctcggccacctgaacgaccacgatcatcatcttcatcgtcatcatcataacgactgcggccacggcctcgaccacctgaacgaccgcgatcatcatcttcgtcatcatcatcacgacggctgcgaccacggcctcggccacctgaacggccacggtcatcatcttcatcgtcgtcatcataacggctgcgaccacggcctcggccacctgaacggccacgatcatcatcttcgtcgtcatcgtcacgacggctgcgaccacggcctcggccacctgaacggccacggtcatcatcttcatcgtcgtcatcataacggctgcggccacggcctcgaccgcctgaacggccacggtcatcatcttcatcgtcgtcatcataacggctgcgaccacggcctcggccacctgaacggccacgatcatcatcttcatcgtcgtcatcacggcggctgcggccacgacttcggccacctgagcgaccgcgatcatcatcttcatcgtcgtcatcacggcggctgcggccacgacctcgaccgcctgaacgaccgcgatcatcatcttcatcgtcgtcatcacggcggctgcgaccacgacctcggccacctgaacgaccgcgatcatcatcttcatcgtcatcatcacggctgcgaccacggcctcggccacctgagcgaccgcgatcatcaccttcgtcgtcatcatcacgattgcgaccacggccacgaccgcctgagcgaccgcgatcatcatcttcgtcgtcatcatcataacgactgcggccacggcctcgaccacttgaacggccaccgtcatcatcttcgtcgtcatcataacggctgcgaccacgaccattacgatcatcgtttttatgacttaaagcaccagcttcacgagcctcttctgaggtaa

SEQ ID NO: 2426 - DNA, 789 bp, Acinetobacter baumannii
atgcttaataaattaaagaagttaataggacttgtcggcttaacatcactttctacagtaagttgcgctcaacaagatcaagaagctatctggcaaaatgtgtataacactagaactcaatattatgaagaaaatataggtaaattaccggatgatattctaaaaatagctcacatggctggtgtttggcctggtggtggtttatatgtaattccagctgataaaattggcaaagatattacggtctattctacttttggacttacaaactctgatatgcctgctcaagcaactgtttcagatgtaaaagttgagaaagataatttaggacgagttgtttcaagttcagcaaatgtaaaatcaaaaacacaaactgcggctctctctggtgcagcaggttatggatatgaattaatattaatgactaaagataaaaatgctgaatggccactttggtttttacaatgggcagtacaagctgaattattaaatgatgcaggctttctaaaaagagttgaaaagtataatggattgactgtagaagccatatcagttggagaaaatgagaatgacaaaattaatgtcttaatcaccaaagcccaaaaacctctacctcttggtacacaacttccaaatggaaaaatggagtttctagtcgcaatagttattacggatgaagaaatgaaatggtctatgaaaaatggacgaaatgaattagctagtaagctcatggaagcaggggttggtcaactcagtgatcgaaatagaccatctgtcataggtcattaa

SEQ ID NO: 2427 - DNA, 1071 bp, Acinetobacter baumannii
atgcctaataatgtttataaaaatacaaatgctattatcgaaggaaattatgataatacatccttaggtgccaatacatatttgctgggtttgaccagtttatttgatgaaatgggtttgcaaggccattcaatatccgatgttttatctggcacaaatatttcgccagatgcgatgaatcaatcctctttatatatttcccaagtccaaaaaattcagctatttcaaaatattcaaaaactatctcacgatcctttaattggactacgcgcaggacaaaagcagcggttgtcagattttggggtgtatggctacgcactatattcttcgcgtaattttagacaagcggtagagcttggtattcgacacattaagcttgcagggcctattttaaagaagtcattttatattcgagatgatgttgccgtttttgaagggcaggacattattgcactgggtaagcttttacctttagtgtgcgagttttggtttagctccatgcaaactttaattgaacgggtacttgaaggaccatttcaagcgaagaagcttttgttgccctatccagcgcctgactatgcagaagaatatgaaaaagtgtttcgttgccccgttcagtttaatgttggggtgatgcaatggcattttgatttaaagtggctcgatgtaccttgcccaaatgccaacccgattactgcggacatgtgtaagtcgttttgtgagcggatgctaggtgctgctgaacttgaggaacctgagttggtgaaaacgattcgtttaatactattggatggaacggggctttttccatcagctcaagaaatggctgaacgtttacatatctcaaagcgtactttacaccggcgcttggcaggttttgatttaacctatcaagaattgttagatgagactcggcgccgtcttgctgatgaatatttgcgagagacaactttaaccatagatgaaattgctgagagaattggcttttcagatacttctaactttcgaaaagcctaccgccattggacaggtatttcaccaaatgagtatcgtgagaaattagttttataa

SEQ ID NO: 2428 - DNA, 786 bp, Acinetobacter baumannii
aaccataataacaaaggaatgaaaatggccaggaaagtattaattagtgcaggtggttcagggattggacgatgcattgccgaagtctttttaaacaatcaggatgaagtttttgtttgtgatattaatgctaaaagcctagaacaatttcaacaagattatccaaagctacatatatatacctgtgatttggctgatcatgagcaaattaaactgatgtttagtcaaaccattcagaaacttggcggtattgatattttagtcaataacacaggcatctccggcccaaccgttgcagcggatgagctaagttttgaagattggaacacggtgattaatttaaacctgaatagcacttttttaattacccagttagccattccctatttaaagcaagcacaggcaggcgtgattataaatatgtcatctattgccggacgcttaggctatccatatcgattggcctattccacttcaaaatggggactgattggttttaccaaaacgctttctatggaactcggtgcagataatattcgagttaacgctattcttccgggtgcagtcgatggtgatcgggttcaacgcgtattacaggcccgtgccgatgtagcgcagacctcacttgaagaggtgactcaaaatgcactgaaaaatcagtcgctcaaatattttgtcaatccaaagcatattgcagatttatgcctatttttagcgtcagacagtggtcgctcaatttcaggacaaatcttaccaattgatggtgataaacaatgcttaagctaa

SEQ ID NO: 2429 - DNA, 951 bp, Acinetobacter baumannii
aatccaaataacttttgcctcatgagcacaaatcaaagtctggttcttttaaatgaaatggcgactttcgttaaggttgtcgagtcggaaagtttttctgaaactgcaaggcagcttggtacaacgccttctgctgtcagccgcgcgattgctcgtttagaacgtgctttaggcactcgcttactttatcgaactacgcggaaacttcgtttaagtgaaagcggacaacaggtttatcaacgttgtttagatatggtaaatgcggcacaagcagtcatggaaagttcaggtcaatttcatgttgaaccagaaggtattatccgtatgagtgttccgaaagctgtaggacattttatgattcatccgcatttacccgaatttttagaacgctacccgaaaattgatatacaaatgcttttagaagatcgctatgtagatctcattgatgatggggtcgatttagcacttcgaattacagagcaaccaccgggtggccttatgggtcgaaagctgattgatattgatcacttggtttgtgctacgcctgaatatttagcaaagcatggcacaccaaaccatcctcatgatttaaagcagcatgaatgtatctacttgggcgaacaagccagtgactcaaaatggaaatttcaacaaggaaataaatcgataagtgttgccgtgcgtggtcgttatgcagcaaatcatacgggtgtgcgtttgagtgctgcattacagcattttggtattgcgagcttgccatacttcgttgcacgtcatgctctacaacaaggtactttagttcaggttttaccagattggtattttaagacctattatagcggtgggctgtggttactctatccaccgacacggcatgtcccgcctaaattgagtgtgttgattcaatatttggcagataaactagcagtagagccgactttaaaaatttag

SEQ ID NO: 2430 - DNA, 1068 bp, Acinetobacter baumannii
agaatgaataatttgaattttaaaacgctaaagaagtattggctgcgattcgtgggtattgctgtaatcgcaggcgctttagtattggcatttgcttggaccgctggtctatttggacatcgaacaacatccaaaacttttttgggtgacacattaaaaaactttgatcccggatatcgacgagcacacggtaaaggtatttgttttgatggcacttaccatagtaatggtgcggcagcagcactctctaaagccactgtatttgccaagtctgatataccagcaattggccgattttctattggaagcggtaatccgcatgcggcagataattctaccgcaacagtgagtatggctttattactttctccagccgatcattcgcagtggcgtatgaaattaaacaactttccttatttcccgacacgaaatgccgaaggttttttggcgcagcaaaaagcatttaaaccggttccgtctactggtaaacctgatccagcccttgttgaggcgtttttaaaagaatatcccgaagcgcgtaaatctattgaacaaaaggccaagatgccattaaccggtagttttagcggtgcagaattttatgtcgtaaatgcttttatattgcgggcagccaatggacaagaacagccagtccgttggtctatgcgtcctcattcaaaatttattagtctgacgaaagaacaacatgatcaagctgatcatgatttcttatttaaagacatcaaaaaacgtttggctgaaggaccgctctattgggacttggttttgcaacttgccgagccgggagacccagtgaatgacccatctcagccttggccaaaagaccgtaaagaagttatagccggaacattagaagtcaaaaatgtaactgatcaggtaaatggcgcttgtcgtgatattaactttgacccaactttggtgccaccgggaattgagttatcagatgacccagtactcgcagcacgagcggctatctattctcagtcttacaatgctcgattacgtgaaattggatttggcaaagcaacagatgccgtgggcaaatag

SEQ ID NO: 2431 - DNA, 447 bp, Acinetobacter baumannii
ttcatcgataaatttgtcatgactgagctagtgaagatttaccataaccctgcttgcgggacctcgcgcaatacattggcgcttattcgtcatgcaggaattgaacctatcgttattgaatatttgcaaacaccaccaagtacagatgaactaatccaactcattaaggactcaaacctaactgtacgtgaagcaattcgtaaaaatgttgaaccctataaagatttagagttagaacaagaccattggaccgatgaacagttaattgattttatggtgcaatatccaattttaattaatcgcccatttgtggttacaccaaaaggcacgcgactttgccgcccttctgagatggtactagacattttagattcacaaaacttaggctattttgcaaaagaagatggtgaagtgatcattgatgaacaaggccgtcgtttaaagtaa

SEQ ID NO: 2432 - DNA, 468 bp, Acinetobacter baumannii
gcaaaaagtaatacagggtcaagattaatgctttatttagaagatttaaaaattggtgatcgttttatcagtcgtgagtatgaaattacacttgatgaaattaaacaatttgcaagccactatgaccctcaacctttccatacagatgaagagttagccaaagaagatcctatctttaaaggtattgccgctagcgggtggcatacctcggcaattactatgcgcttatggactgaatgcatgccgattcatggtggactagtaggctcagaatctagtctacgttggccacgccctactcggcctggtgaccgtattcatgttgaagctgaaatttccgccattacgccatccaaaacaaaattggatcgtggtattgtaagctacgttacgcaagccttaaatcagcatggggatgttttacttatttcaacgacaaaaatcgttgtctttaaaaagaatgtttaa

SEQ ID NO: 2433 - DNA, 855 bp, Acinetobacter baumannii
ctaaacttcaaattcaatcttataagtcttatgaacattaaagccctcttacttataacaagcgctatttttatttcagcctgctcaccttatatagtgactgctaatccaaatcacagcgcttcaaaatctgatgaaaaagcagagaaaattaaaaatttatttaacgaagcacacactacgggtgtcttagttatccaacaaggccaaactcaacaaagctatggtaatgatcttgctcgtgcttcgaccgagtatgtacctgcttcgaccttcaaaatgcttaatgctttgatcggccttgagcaccataagacaaccaccacagaagtatttaagtgggacgggcaaaaaaggctattcccagaatgggaaaaggacatgaccctaggcgacgctatgaaagcttccgctattccggtttatcaagatttagctcgtcgtattggacttgaactcatgtctaaggaagtgaagcgtgttggttatggcaatgcagatatcggtacccaagtcgataatttttggctggtgggtcctttaaaaattactcctcagcaagaggcacaatttgcttacaagctagctaataaaacgcttccatttagcccaaaagtccaagatgaagtgcaatccatgctattcatagaagaaaagaatggaaataaaatatacgcaaaaagtggttggggatgggatgtagacccacaagtaggctggttaactggatgggttgttcagcctcaaggaaatattgtagcattctcccttaacttagaaatgaaaaaaggaatacctagctctgttcgaaaagagattacttataaaagtttagaacaattaggtattttatag

SEQ ID NO: 2434 - DNA, 738 bp, Acinetobacter baumannii
aattcattcaatatatttttcatcacaaacaatttaatatttattatgttttttattttaagaaaaaaacttcaaaaaatcggcattattttcgtagcaatcaacttattagcttgtagccatcaaccagattttaaagatcttaagcatttagcagaaagtggtgatgcaggagctcaagcgaaacttggcgaattatatgtagagggacaggttgttcctcaagattataaaaaggcttttgaatggtatagcaaagctgctaatcaaggaaattcagaggcacagaataatttgggagcaatgtatgctcttggacaaggggtagagcaaaattataaaaaagcattcgaatggtatagtaaagctgctgaacaaggagaagtgaaagcacaaaataatttaggtgcgtattatgcaaatggagatggtggcgttaaaaactatcagaaagcattcgaatggtatagcaaagctgctgcacaagataatgccgaagctaaatactatttgggtatactttatgaagaaggctatggggtaacccaagattataaaaaggcctttgaatggtatagcaaagctgctcaacaggaaaatgacgaagcacaatttactgtagggatgatgtactacaaaggtgagggtgtacagcaaaacaatgaattagctgaaaagtggctaagaaaagcagctgaaaatggcaataaggatgctttatcgctatttgaagaatag

SEQ ID NO: 2435 - DNA, 1398 bp, Acinetobacter baumannii
gcccccctcaatttcaattttaacgctccaaattgttgtatttattttaaacagaacccgttattcatagacaacaattgccatgcttgggtagcttttatactatctagtttcaacccatcatttatagtttatatgtctgatcctcagctctctcttagtgaatatctcggtacagtgcaggaagtcatacgcctgacttttgacgagcctgtatgggtgagagcggaaattcgtaatttaaatgttaaaggtggacattattatttagagcttgcagaaaaagatgctgacaccgacaaggtcattgcaagctgtaaagcaaccatctggaaattttcagcaagtaaaattgttctaaagtttgaacgtgaaacaggtattgagttagctagtgatttaaacgttttaatcaaaattagagcgcgtttcgatccacaatatggattttcagtcaatattgaagaaatagactcaagttttacacttggagaaattgcaaaacgttatcaacaaattgtagaacgtttaacgcaagaaggtttgattcataagaataaacttctccctactccttttgatatacaaaatgtattagttattgctcctcaaaatgctgcgggtttaggtgactttaaaaaggatgcagatgctttagagagaaataaggtttgtcattttgtttatcaaaatgcgaccttccagggaaatacggctgccgtcagtcttatggagtcgttggcaacaggtttaaaacaatgggcaaataattttaactttccacccgacctgattgtaattattcgcgggggtggcgctgtaaatgacttagcttacttaaatgattatgagcttgccgccctattctgtaaacgcagcgtgccgatttgggtcggtattggacatgaaaaagatcgtactatccttgacgagattgcacaccgttcgtttgatactccaagtaaagtgattgcgggtattcgcaaccatattgttgaacgtgtacaggaagctgtagacagcctgcaaacaatcaaactcttgtctcaacatcaaattacgacctatcaaagtaagagtgatcaatatctacaacatattaaatcctctgcccaagctcagcttaattcagctcaccagttccttgagcagataaaggaacgcattcaatttgtttcacagcaacaagttaaattttctttgtcgcaaactgaatcccttatgcgagaaatcctcttgcaaaacccgaaacagattcaagcaaaaggttatgcaattgtaagatcagaaggcaaagcaattcgttccattcaccaaatcacaagctctaccattactgttgatatgcaagatggagcaattaacgctaatattaccgaggtaattccaaatgaatga

SEQ ID NO: 2436 - DNA, 1080 bp, Acinetobacter baumannii
cattcaatcaaaaatcttacaggaaaaacaatcaattattatgacagaggcagtctgcaaatgaaaaaaatgcttataaagagcggtttactcatcactagtttttttatttataaccaaacctatgccaactgtactttaagcaagggctttaccacagtcgatattccaatgacgattggaactattgtagtacgcccgaccgatccaatcggaacagttctccaaaagaatacttttactatttcacccaataattcgactgcaacttgcaaccgtgccagtgaccaaattacagcggcacttccattaaactatcctgttagctcgattggaaataatgtgtatgcaaccaatattccgggtataggtattcgactttatagagaggcattcgactctacagatttttctggatattacccttataaacgcaccttgactcctaatacaacatatacgctttcaccaggctattttgtcatggaagtgattaaaactgctgcaactacaggttcaggtgcattagttgctggtcgttacagtacctattatgtaacaggacaacaaaatcgtcctttcttaacaactacagtattgagcagctcccctattcttattgcatcatcttcttgtgaaattcaaaacggcatagatacggttgttcagcttcccactgtgatgaagtcaggttttagagctattggatcaactcaaggtgagaaaaactttaatttatcgattctttgtaatggtggggaaaataactcgggtgtaccaacgagtaatacactgagtttaagctttgactacatttctgacacttcaaatagtcaggttattaataacagtgctgctgactcaactaaagcgaacggagttggtgttgaattgttatggaatatgaatggcgcgaacaattctattcgaaaaggaaacaaactagatattggtacagtaagttctaaccagacagtacagtacgatattcctttaacagcgcgttattatcaaactgcttcgaatgtaacagccggtgaagtcaaagctaatgcaacggtaacgatccaatatgattag

SEQ ID NO: 2437 - DNA, 783 bp, Acinetobacter baumannii
aaggagatcaaaatgaataagcaagaaatgaaagacttggtgactaaagcccatcacgaactctttaatttgcatgacaccactgctctagaccgttatttttctgaagactttatagagcactcaccactcgttgcaaatggtatttcaggtcttcgtcaattggtagaagattgtcccgatatgcaacacgaagctgtacgtgtactagcagatggtgacttggttgcaattcatggccgctttcaaggcttagatgaaaacccattggttggttttgatatttaccgagtaaaagacggcaaaattgtcgagcattgggacggccttgtggcagaagctgcaccgaatgtaagcggtagaactcaactagatggtccgactgaaatcgtaactcaccatgacccagagaaaaaccgcgagattgtgacgtctttcttcaagaagtcattaattgatggaaattatgaagcctttaaagaatataccgacggtgatcagttcattcaacatagtccagatattggtgatggcgttaaagccgtgattgattttttgaacaatatccgtaatgaaggacaaggtttggtatactcaaaaacgcatcgctccattgctgatggtcaatttgtattgacacattccgaaggcagtattgccggaaatcgacatgcctattttgaactatggcgtgtagataatggcaaaattgttgaactttgggatgcaatacctgctgtgcctgaagatgaacaggctgtccatggttatggcgtgttttaa

SEQ ID NO: 2438 - DNA, 1221 bp, Acinetobacter baumannii
tcaggagtcaacatggaagacgttttaatttgcgattttattcgtaccccaattggacgatatgcaggtgccttaagtgctgtacgtgcagatgatttagctgcattgcccatcaaatatttaaaagataaacacccgaacctaccgtggaatacggtagatgaagtatttttgggatgtgccaaccaagcaggtgaagacaaccgtaacgttgcacgtatggcaacactcttggcaggcttacctgatacagtaccagccatgaccgtcaatcgtttatgtgcttctggcttagatgcggtaggacttgctgcacgctcaattaaagcaggcgaagcgcagtttgtgttggcgggtggtgtggagtccatgagccgtgcgccatttgtacaagctaaaccgaccgaagcctttagccgtacacctgaaatttatgacaccaccattggctggcgttttgtaaataagcaacttaaagcgcaatacggcaccgacagcatgcctgaaactgctgaaaatgtagctgaaaaatatcagattagtcgtgaagaccaagatgcgtttgcattgcgtagccaacaaaaaaccgctgctgcacaacaaaacggtttctttaacgatgagattttgcctgtcgagattgtagatcgtaagaaaaacgtagttgtggtgaaccgcgatgagcatccgcgtgaaacgacacttgaagcactcgcaaaactaaaagccccatttaaaaaagaaggtggttcggtgactgccggaaatgcctctggtgtaaatgatggtgctgcgtgtgtgttaattaccaaccgtgaatttgcaaatacatatggtttaaaacctttagcacgcgtgataggcattgcaagtgcaggggttgaacccaaatatatgggtataggtcctgttccggctgtacagaaaattttaaagcaaacaggtttaacgctagatcagatggatgtgattgagctgaatgaagcattcgcagcccaatctttggcttgtatgcgtgaacttggtttaaaagatgacgatgaacgcgttaacccaaatggtggtgcgattgcgttaggccatccgctcggtatgagtggtacacgtttggtgattaccgcaacacgtgagctaaaaaaacgcggtggacgctatgcactttgcacgatgtgtgtaggtgttggacaaggtgttgcactgattttggaaaacttaaattaa

SEQ ID NO: 2439 - DNA, 1038 bp, Acinetobacter baumannii
aacatgaccaaacaagggctttcctttttagatcgaaacctgacgctatggatttttatagcaatggctttaggtttagcgattggagttttctttcctcaggcatctgtgtctttaaatgaattaagtgtagataacgttaatattccaatcgcaatcggtttggttttaatgatgtatccgccattggcaaaagtggactatgcggctttaccagaagtatttaaggataagaaaaccttaactttatctttggtacaaaactggattattgctccagttttaatgtttatccttgcgattgtttttttgcataactatccggagtatatgactggccttattttgataggcttggcacgttgtattgcaatggtattggtctggaatggcttagcttgtggtgacaaccaatatgttgcagctttggtcgcctttaacagtatttttcagattttattttttagtacctatgcatggttgttcttaactttcttgccgccatattttggtgtggcaggacaagtgattgatgtcaatttctggaccatcacacatgctgttttggtgtacttaggtattccattcttaatggggttcttgacgcgtttgattttagtcaagtcgaaagggttagattggtatcaaaccaagtttttaccaaaaattagtccattaagtttagtcgcgttactctttaccatcgtggcgatgtttagtttaaaaggtggcgatgtggtgagcttacctttagatgtattacgtattgcgattccactcacgatttactttgtagtgatgttctttattagtttctttatgagtaaacggatggggaataattacccgcgtacagcggcaatttcatttaccgcggcaggtaataactttgagttggctttagctgtagctattgcaacttttggtttagcatcacctgtagcatttaccacagtgatcgggccattggttgaagtaccagtgttgatctcactggtttcggtttcgctttggttaaagaaaaagtattactcttaa

SEQ ID NO: 2440 - DNA, 1032 bp, Acinetobacter baumannii
tccaaagacaactttaactgtttgattcgacgctgccttgtatttaacaaattttatagggtgtcgaaaatggtcgctcaagctatccgaaatattatttctcctaaatcagttatagctcagtatcaaaagatagatttctcaaataaaggaactatcccaattcgccatttaaatatcggatttgatggtaaagaaattgatatcgagttttacgtcaacaaccagtttgcaactttgttctttgcaacgctttcggtttttttgacctatggtgaagatctggtgatagaaacagctcgtcaccaccgtgaatttattcaagatccgattttaaaacagcgtgttacatcgctgattggtcaagaagccatccattcaaaattgcataatgagttcaatgatgcaattaaagagctggaatatccggtcgatttttatcgtttcttgggtgagaacttctttaaatatgtgttcttaaaattcccgcagccattaaagctttcactcatggcgggtattgaacattttacggcggtacttgccgaatacatgatgaagcatgaaaagaatttctattataccgacgatgccaaaagtcgtgccttatggatgtggcatatgcttgaagaatctgagcataaagatattgcttatgacgtctatcaggttttaaacggtaattatccgttacgggcaacgggctttttaatggctttcattactattttagggcttattccaacagcaactttatttgtacctctactgcgtaagccaaaagaactgttgaccagaaaattctggaaagatgcacgtcgtggcgtcaacttaatttttagtccaaaagatggcgtatttggtagcaccattggtcagatttttgattacttacgtccagacttccatccaaatgatcatgacacgaccgaatatctggagtactacaaaaagaaattacttaacgagggcggtgcaattgcgccttactttgtgaaggaattcacaccaccagttcgtgcagtttcataa

SEQ ID NO: 2441 - DNA, 900 bp, Acinetobacter baumannii
ataagacttttacaagaacgagagggtgaaataatgacaacattaacatttcaaaacgtgaagcatattttggctgcatctttactgagtttgggtttggttgcatgtgataaaggaactcagtctactgaaaaatcggccgataccacacaaactacgtcaagtattgaacagatcaaaaagaatggtgtggtacgaattggcgtatttagtgataaaccgccgtttggatatttagatgctcaaggtaaaaaccaaggctttgatgtagaaattgctaagcatgtcgctaaagatctactcggtgatgaaaacaaagttgagttcgttttaactgaagcagctaaccgtgtcgaatatttaaaagccaataaagtagatattatttttgcaaactttaccgttacacctgaacgtaaagaagtggtcgattttgctaaaccttatttaaaagtggcactaggtgtggtttctcctaaaagtcatccaattaccgatgtggctcaacttaaagataaaaccttgctggtaaacaaaggtacaacggctgattcattcttcaccaagactcatcctgaaattaaactacaaaagtatgagcaaaacactgaaacttttgatgctttaaaagatggccgtggcgctgcgcttgcccatgataacttgctggttttagcttgggctaaagaaaatccaaattacaccgttggcattaccaatttaggtgagcaggacttaattgcaccagcagtgaaaaaaggcgataaagagttactggactggttgaatcaagatttagagaaactggcaaaagaaggtgtgattcatcaggcttatgaaaaaactttaaaaccagtctatggtgatacgattaatccaaaagatttattggttgagtag

SEQ ID NO: 2442 - DNA, 684 bp, Acinetobacter baumannii
aggacacgcaaaatggcaaaagactttaatagccctaaagtagtcgaaggatatgatgtgcatattcgtaaattaattccgggctatgaagtgatccaccaacaggtggatgccattttgcagtcggtgttgccaccagatgctcatatcttaattgtgggctgtggtacgggttacgaactcgattatttacttaaaagacatccaaactggcaattcacagcggttgatccatctttaaccatgttgcaaaaagctcaggaacaggttgagattttaggtaaatctacccaagtcacttttgtacatggtgatacttcagcactgcctttggaaccatgtttcgatgctgcactttctattcttgtggctcattttattgcagatgacataaaaccagccttctttaaggatatttatgatcgcttaaaagagaaggcgcttttacttacctatgacctcatgacttgtgtaaatccacagcagcttcaagcattacattatttgtgtttggctcaagggttaacagaagaacaatgtcaaaaaatgttggagcgtatggcggaggacttttttagtttaacgactgaaggatatataaaacttttggaaaagataggctttgaaagcgtacagccatatacgcaaattttaacttatcaagggtttattgcaaaaaaataa

SEQ ID NO: 2443 - DNA, 759 bp, Acinetobacter baumannii
aataggcgcaatatttataagcttttgatttttcttatgcggaagtttttgcagagcatgctgcccctatgcataatccctgcgattatggtgggttgcgccagctctcctcaacacacaacaacaggcaaaacctctccaaacggtaagcgcatctttattcctcaagagcgcgttattatcgaacgtcctattccacctaaagttgaacctgcttcctatcgcgcttggttaaatacaggcgatcattatgaacgtgtacgcgaatatgaaaaatttctggcgcgtcatgatgtggcaggtatcgtaccaagttttgaattattaagatccgctcgtgattggcagaagtgtggccgttcagaatatgcggtacctaaccgtgaactttggaataattctttatcgaccttacgtgtctttaaatatcttattgccgcaaaagttttaaccgactttgaagtaacttcagtttaccgagacttacctttaaatgaatgtgcaggcggcgcaagttcttctaagcatttatttaactctgccatcgatttccgtattgggccagaagttccacagccacaagactatgcgtttattgaaaatacgaagtttaaattgtgtcagttctgggctcagcacggccaaagtttaaatttaggtattggattatatagttcaggacaaatccatattgatactcaaggctatcgtacttggggacctgacttaacccgcaatacatcaatgtgtaatttctaa

SEQ ID NO: 2444 - DNA, 276 bp, Acinetobacter baumannii
gcgtttagcaaggagataaacatgctgattctgacccgccgtgtcggggaaacattaatgattggggatcaagtcagtgttactgtgcttggcgtcaaaggaaaccaagttcgaattggtgtaaatgcaccaaaagaggtttctgttcatcgcgaagaaatttatcaacgtattcaacatgaacgtgcaatgcatgaacaccttcaacatcttgatcaagattatcaagtttcatatgaagatgataattatgcacagaaaaacttcaatcgttag

SEQ ID NO: 2445 - DNA, 645 bp, Acinetobacter baumannii
tccattagcaatctgtgttgtggtagcggcaattatcagcattgcttttctaaaaattcctttatttttgactatgctgattttacttgcgttttattcagccatcatttggagacgtgtgtaatgggtgccgtactacttactttagcaatcatttttactcagttgtctcttattgcatttggtggtgggaatacgattttgcccgaaatgcaacgtcaagtagtcgatattcatcattggatgacggcgcaagaatttagtgcgttgtttgccatggcacaagctgcacctggtccaaatatgatgattgtacctttggtagggtggcatgtagcagggttgtctgggctattggtgacgtctactgctaaatttttaccgtcatctcttattactgtatttgtgatgagaggctggtcaaaattcaaagataagaaatggcgccgtgttttacagcttgctttacaacctgtcactgtggggactgtgcttgccagtgcatggattatttctgaagcagcggcaataaatactttacttatcattatggtagtcattgcaactttattatctttaattaaaaaagttcatccattgcatgttttgattgctggggctgtatttggtgtggtcttactctag

SEQ ID NO: 2446 - DNA, 306 bp, Acinetobacter baumannii
aaatgtagcaaacctattaaaacaacaacggttgaagtgagggaaggagggttacctatgctatatcaatatcattgtgcttgttgcgacaaagttgtgtcatcaactgataaatcatgtccatattgcggttcacaccatattcgtagtccatatggcctatggatgttttgtgtgatggcttgtctagcagttgttgtcgtattcaaagttgttcatctttatatccagaatcatcaagacacacctgtgcaatcgactctgttagatgtattaaatgaaggtgataagagcacaaaacaataa

SEQ ID NO: 2447 - DNA, 270 bp, Acinetobacter baumannii
tctattttaaaacaaatgtcatttcctacgcttgacgccaacaatagcgaatactatcctttgcctgctggcctacattgccagtcggttttagcagaccgttttcatctagaacatcaaaaaagtaattttttggtggtgaactcgttcgtcccccttcgtagcggtaggacggaggagggacgccttcgggcgtgccagttcctagatgactggtctgctaaccctctttcgttctgccaccataatcatttagcagtgatctggtag

SEQ ID NO: 2448 - DNA, 1392 bp, Acinetobacter baumannii
gcaattttaaaaagttggcactctttttgttatgcacatattggaaatcttttatatccaatgtggggaatgcctgtgaaaaatatcaaaacattaattcttgcaatgagcactatcagcttaactggtgtagttatgccagctcatgctgctactgatgcagaagtagatgctttacgcaaagaagttagtgagttaaagcaactggtccagcaattatcaaatcagcaaaaagcggtaactgtagtaaatactccaacagttccgccaactacaattacagcaagctcacccgttcctcagagcaaaccaggttggatgcaaatgcctgatggccaaacgcaagtcaagctttatgggaatgtccgtgtagatgcaacctatgactttaaggggtcaaatggcagcatttcaaatggtgctaactatcctttgaataaagatgacccaagacaggactccttaaatgtatctgcagcaactacacgcattgggttagatcttactcgacctacacaatacggcgatttaacaggcaaaattgaagccgattttatgggaggcaatggcgataatggcagtggaactttccgtgtacgccatgcctatatgtctttaggcaaatggttagctggtcaaaccacttcacctttcgtcaatacagatacttctccagaaacactacactttaccggtgcagtaggtacaggaaccacacgtactgtacaggttcgctatactcaaccaattaatgctcaacaaaaaatattagttgccttagaaggtggtgatgttgaaaaagtgagtaatgctgctggaggaagccgtttccctgctctaacaactcgttatgatttcaaaaccgcagataataaaggcttattacagcttcatggtcttgcccatgaaaatcgagtagcgcctaaagatagttcatctgaagaaaaatttggctggggtgtaggcatcggcggcaagtacgatatcacgcctcaggatagtgtcgttgccaactattatcatgttaaaggtgatggccgctatttatcttatagcaactctgcgtatgcatacgatacaactactcaagatatcaacttaggtgaatttgatagtgcggtgatcggctaccaacggaaatggagccctattcttcgttctacttttgctgtaggtggtattcaatataaagatgatagcgtctatgcaaatagtaatttaaccaatactagctataacaaagaaatttataacgctttggtcaacttaatctggaatccggttaaaaatattgatttaggtgcagaatatacttacggccagcgtgaaacttttgcaggtgataaaggtgattactcccgcataaatttattagcaaaatataatttctaa

SEQ ID NO: 2449 - DNA, 1086 bp, Acinetobacter baumannii
gacactttaaaacaccgatgcgtccacttagtgcagttgatgaaaatattgacagcaaacaaaactctggggagaaccgtcatgattgatctttctttaatatgggtcggtattatcggtttaggtgttttaatttatgtggtcatggatggctttgacttaggaatcgggattatgttccccttcattaagaatagtcaagaacgtgacgtgatgatgaataccgtcgctcctgtctgggatggtaatgaaacctggatggtacttgggggtgctggcctgtatgcagccttcccgctcgtctattcaacggttttatctgcgctctacctgcctattattttcatggtgattgccttgattttccgtggggttgcttttgaattccgttttaaagctcatcggaccaaacacctttgggacttagcttttatttggggttcggttttaacgagcttcctccaagggattattttaggggcctatattcaaggtattaaaaccgaaaacggtatttttgccggtggcccttttgactggcttactgcattctccattttcacaggtattggtgtagttgccatgtatgccactttaggctgtggttggctcattttaaaaactgaaaaaggcttgcagcaacgtatgtatgagctgatgccaaagttaattattgcgctgctcattatctttggtgccgtcagcttatatacgccgttaacacaccccgaaattgcagatcgctggttctctttaccaaatctgttttattttagtccagtgcctattttggtcttactatttgttggcctgattttatcggcatgtaaaaaacagcaagaccacaaaccatttatatataccttggcattggtcttccttgcctttactggttttgtgattagtttgtggccaaatatcattccaccatcagttacgatttggcaagcggcagcgcctcattccagccaaatgtttgctttagtgggtgcgcttattttgattccaatcattattacttacaccattgtgtcttactgggtattccgtgacaaagttcgtgtaggtgatgaaggttatcattaa

SEQ ID NO: 2450 - DNA, 1332 bp, Acinetobacter baumannii
ttcgatttaaaaaccaaacaaggcagacacaacaactatgccttgttgaaaacaaaaaatgttatttcaggaagaaatgctatgtcgaaattatggatgtactctacccttatgctctcaggttcagtgtgggctggcagttttattgataacagttcagtagaactcaccacgcgaaatttctattttgaccgcgactaccaagagcaatctgcttaccctgctgccaaggactggacacaaggttttattcttaaagccaattcaggttataccgaagggactgtcggttttgggctggatgtgcttgcaacggcaggctttaaactcgatgctgatgccgagcatggcggtacaggaaacttacctagagacacgcgcaccaatgagcctgccgactcgtatggcgaaattggggtcacagcaaaagcgaaaatgagccagaccgagctacgcatcggtacgctcatgccaatgaatcctgttttagtagcttcacctgctcgattgcttccccaaacctatcgaggcatttcactcaccagtaaagatattaaagattttgatttacaggcagcctacctcgataaagtgaatcatcgtgattcgaccaactatgaaaaaattaaaatttcaggtgtaaatggtcgttttaaaagtgctgaaacggatggactctattatttaggtggaaattatcagtttaatcctgcactcaagctcaccgctttttacatggacgttgacgatctttataaccaaaccatggtcggtgccttacatcaacacaaaattaatgacactactaattttagctcgcaattacgttactaccgcagccgagatgacggacaagcaaaagcaggcttagtcgataatgacctctatcatgcgcatttcgaacttaaacatcaaaaccataaatttatttttgggactttccaacatcatggcgacaccgcgtttccgtatttaacgggaggtgaaacgggtctactcattgatacatggccgggcgagtttttaaacccaaaagaaaaagcctatagcttccgttatgaatatgactttaaagattatgttccgggtttacgttttatgactcgttacaccacaggtcacaatatttatgcacccaatttaggcggaaccaatctaaaagagcgagaaacagactttgatttaggctacaccgttcaaagtggctggttaaaaaatctagggttacgcgcacgctacgccatttatgacaacaacatgctctctacagccaatatcaaacctgtaaacgaaacccgtatcaacatcgactacacatggaaatttaaataa

SEQ ID NO: 2451 - DNA, 1032 bp, Acinetobacter baumannii
agcaccttaaagatggcacctattttgcttaagaatattacgttttatgaaaatcgtaatactgatcaaaaatggggagctctcgatatgggttatgttgcaaaggaatttacgcaaaagaacaagctgattctcagtatttgttctttcgtgattccaatatgtctttggtgcgcaatcagttacttaccttttgtttggcatcctcaagtacaaatcacaagttcaggcagtgttccttacttacaagtaggaagtcgcgttgataaaaatgtgttctatctcgaagcacaaaatgcagtcaatcgagattctgcaccaccacaaggtattttggttaatccaatttatttacccgctccccatgaagtcgctaaggctttggtcaccgcatttaccacaccacatgaacaacctgattcgccatggtttcatcaaagtttatggcacagtattaaactggtattttcagctttttttatctcttccttaattggaattccactgggtattttgtgtggtttttctaagcggatatccctgttaacagaaccgtttgtcgagtttttccgttacttacctgcacctgcatttggtgcgcttgcagtggcaattttagggattaatgacgcacctaaaattgccattattgtgatcggcactctttttcagcaaattctcattattgccaataccacacgaatggttgatcgaagcttaattgaagctggttatacgcttggcaccaataagctcaaaagtttattccatgtggtgatccctgctgccttacctgatatttaccgtgacttacgtgtgctattgggctggggttggacctatttaattgtttcggagttgattggtacgacttcaggtattacatggttcattacccaacaggcacgctatcaaaactttgacaatgtttatgcggctattttgattattggagtgattggactggtctgtgattgggtattaatgaaattaggtgagcgggtgttcacttggaaagtaggagcaaaataa

SEQ ID NO: 2452 - DNA, 261 bp, Acinetobacter baumannii
tttatattaaaaaatttaatatacaggagttttttcatgaagagattaaaagttgttattaaagatcagtttgaccaagaaagtattgctttagcaaaggttagacctgcgaacgatcagaaattagagctgtataaaagtgtagagcatatcgaaattgatgacgatattattctaccgaatatggatttactgtatgaaaacccaaaagatggaaaaatttataaattagtcggcccgtttaatgaagatgaattatag

SEQ ID NO: 2453 - DNA, 216 bp, Acinetobacter baumannii
aatatattaaaaaccgtggtaaagaaggtgaaaaagtgctggtacggcttcttaatattatgcaaggccaacgctatattgaaattacggaaacaaatccgaagcatgagcaattcttttatggatggcttgctaatcgtatcagcttataaaaaagccaacttgctaaagctattgagttatagccttacaagttggctcactttcataaaatag

SEQ ID NO: 2454 - DNA, 615 bp, Acinetobacter baumannii
attaagttaaaggatattggtatgaaagctattttaacgaagaaaattattagctgtatcgcaattagtggtgttttaagcttcagtgcatttgagattatggcagcgaatcaacaaactataaatgatgggaagaatcactctaaaatattaaatgaaaaccatgaaaatttaactgatagtcaaattttcaagatattaagtacagctaataatggtgaaattaagcaggcaaaaactgcattaccaaaattaaaaatggatgaagctaagaaatatgctgaaatgatgattaaagaacattcagccaatgaaaaaagtgcacaagcgttggcgaatcggttacagttgatttcacaaaccagtaatcttagtaaatcattgcaaaatgatagtgataaaattgttagtaagcttaataaaataacatcagatactgataaaaattatatgatgagtcaagttaaagttcaccgtaaagttttgacgataattgataagcagttaataccaaacacgaaaagttctgaattaaaaaatatgctcgtacaaacacgcgatgctgttgcgaaacacctaaaagcagctgaagatatatttaaaaatatgaaataa

SEQ ID NO: 2455 - DNA, 942 bp, Acinetobacter baumannii
gaagggttaaaagcgagcaccatggataaatttgataccttgcaactttttacccgcatcgtagagctgggtagttttagtcaggcagccgatcagctaaatatcccacgtgctacagcaagtaatgccattaaagagttagagagtaatttacagtgccgtttactagagcggacgactcggcatgtaaggccatcactagatggacaggcattttatgaacgctgcacacaaatattatcggaacttgatgatgccgaatcatctttacgcaatgtaattgctcagccccgtggtttattacgtgtcgatttatcaggcgctcatgcgactaaaattgttttacccaatatcgatcaatttcacgagttatactccgacattgaactggtaatcagtacgggggatcgcttggttgatctgatcagggaaggcatagactgcgtggtgagagcggggcgtttagatgattccactttaattgctagacatttggtcgatatgccgcaagtgatttgtgcaagtcctgactatttaaataaacatggaacgccagagcaaccagaagatttgttatcacattattgtgttaatttcttttcgacatcaggcgggcgaaattatccatttgaattgatggtgaatggcaaaaaacaagattattttttgaaaagttggatcgcggtaaatgatgctgaaaactatgtattatctgccttacagggggctggcttaattcaagtaccgcgctaccatgtggcaaatgaattaaaaaatgggcgactagttgaggttttatctgagtgggaaatcccgaagatgtcagtttctgctttatatccgcagcatcggcagctctcgccacgcgtacgagtttttgtcgcttggctgagtgagttatacacgggctattttgccaactttgaatacccgcaaaaatga

SEQ ID NO: 2456 - DNA, 954 bp, Acinetobacter baumannii
tttcagctaaaatcatatataaagttaacagctttcagctctactgatatcaaaatgaattttaatagtgaaaatatcgaacttttcttaaccgtattagatactggatctttctcggccgcggcacgtaagttaaatcgagtgccatcagcagtgagtatggcaattgccaacattgaagcagaacttggttatcacttatttgaacgtacacaccgcaaagttattcctaccgcggcggctttagcattggaacctcaagcccgcattattgctgaacagcttaggctattagctacgcatgcttatgaactttcacttggtcttgaaagtaaattaaaaataggtgtggtttcagatgcgaatactgaattactttttaaagccataaagcaactagcagagaagtttccccttcttaacctagaaattattacagctcctcaagatgatattctaaatttactttatacagaaaatattagcctttgccttgcaggttcaaatctcaatataaaaatgcgtgaaagcctacaattagtaatgacagaaacagttattgctacgatctctgctcatcatccgtttttaaaagaacagaataagttaaacacgattgaagagttaattaatattcggcaaattgtggtcgcaagtagtgagttggatatggaagattcacgttcaatcattggggcaatgtactggaaaacgaatagcttacaaacagcaattaatatggtcgaagctggcttaggatggggaaattttcccttatctttggtaaaagaaaagattgagcaaggccatttagttcaattagattttaaaaatacgaaaaatcatttgcctttatctatttatctcatttggcttcaagataaaccgttatcgaaagcagccagagagcttgtccagattgttcaagcaaacttatctcaaacttgtcattaa

SEQ ID NO: 2457 - DNA, 2553 bp, Acinetobacter baumannii
acaggcataaagacgatgtcagaatggttcatatccagtatatgctttaaaaagcgcactacatattatttagtattgagtctcgcaattaatatccccttaactgtatatgcatcagacaatatgaatagggaaaatattttaaaagctgactttgatactaattttttagtgggaaatgcacagaaaattgatattggtcgatttaagtacggcaatcctattttaccgggtgaatatagtcttgacgtctatattaatgggcagtggttaggaaaacgaaagtttgtttttaaaagtactcgttcgaatgagaatgcaaagacctgttttaccccagatatgcttttagaatatggagttaaaccagaaattcttcatcatgaagtaagtagtacctttacctgtaatgacttggacaagtgggttaacgatgctttttatcaatttgatacttctcgtctgagacttgatatttcaataccacaagttgctttacaaaagaatgctcaagggtatgtcgacccacgtttatgggaccgcggtataaatgcagctttttttgcatacaatgcttctgcctatcgtattgtaaataataaccatgaaacaaatcatgcgtttatgggtacaaatgttggtctaaatctctatgattggcaattacgccatactgggcagtggaaatggcaagatcataatgaaatacaagaaaaggtttcttcctacacatcaaataatacatatgcccaaaaggcttttcccaagctcaatagtgttgttactttaggtgattattttaccaataataatttttttgatgccctaccttatcgtgggattaacatatcaagtgatgaccgcatgcttcctaacagtatgctcggatatgctccccaaattcgaggttatgccaaaaccaatgcaaaagtagaggtacgtcagcaaggaaatttaatttatcaaacgactgttacacccggaagttttgaaattaatgatctttatcccacaggcttcggtggcgaattacaagtctctatatatgaaacaaatggagaaattcaaaagttttctattccttatgcttctgtcattgagatgttaagacctaaaatgagccgatattcttttactttgggacattttagagatgccaatatcaatctaaaaccatggctagtgcaaggtaaatatcaaagaggtattaataactatttaacaagctatacaggctttcaggcaactgaaaactaccagtcttttttaataggtagcgcatttgcaaccccaatcggtgcaatttcatttgatgcaactcagtcgtcagctgagttcgaacaaaagcccacccttaaaggacgaagttatcgcttaagttataaccgactatttactccaaccaacaccaatttaactttagctacgtatagatattccacagaaaattatttgaaattacgcgattcaattttaattcgagacttgcaacaacaagatattgatagcttttccgtggggaaacaaaaaagtgaatttcagatcacattaaaccaaggccttccaaatcaatggggtaatttttatttagtaggctcgtggattaattattggaaccagcctaatcgtaatcaacaattccaatttggatatagcaatcaatttaaagatctgacttacagtatttctgcaattactcatgagcttgaccaagaaaatcaaaattctggtcatgaaacgcaatatttgttgtctttatcttttccacttcaatttaaaaaaaataccgttaattttaatagttctatttcagaagatagccgaactttaggaatgagtggttatatcggaaaccgctttgattatggctcatcaatttcatatcaagatgcaggacagacaagcctaaatatcaatggcacctaccgtactaactatacaactataggcgcttcttttggtcagtccgatacataccaacaagaaatgatcaatttaaatggaagcttggtcgctcactcacaaggtattttatttggcccagaccaagtacagaccatggtattggtatatgcgcctcaagcgactggtgctcgagtcggcaatacctctggtctaagcattaataaacaaggttatgctgtcattccttatgtaaccccctatcgcttaaatgacattagccttgaccctcaagggatgccatcaactgttgaacttacggaaacaagtcatcgtattgccccgtatgcaggatcaatcactaaagttaacttttcaacaaaaacgggatatgcagtttttattagcacccaaacacctaatggcggccatttgccatttgcagcacaagtttttaatcaaaacaatgaaatagtcggaatggtagcccaaggtagccggatttatttacgtactcccctaactcaagatcatctttatgtgaaatggggacaaagtaatagtgaagaatgtcaacttgattatgacattcaatcaaaaatcttacaggaaaaacaatcaattattatgacagaggcagtctgcaaatga

SEQ ID NO: 2458 - DNA, 345 bp, Acinetobacter baumannii
aattcaataaaatatgagggaattctgatgacagatcaaaatacagatcatgctcaattggtagctggcgatcataactattctgactctcgctggcgcgaaagctatcttactcgaccttattatcaagaagcgcaattaactacaccagatctagattatgatcgtgatttctctgcagcttatgaacttggtcatcgagctcgttctgaatctaaagaaggaactcagtttgaagatatggaaggcagcttgcagcaaaaatgggaagagctaaaagctgagtcccgcctaaaatgggaacacgctaaacaagcgattaaagatgcatgggatgatatgtaa

SEQ ID NO: 2459 - DNA, 948 bp, Acinetobacter baumannii
aatacaataaattataaaatatttatgaaattttccaaaaaagacttgaatgtaagtttaactgatattagattaaatcccagaacagcaagaaatcattcaaggagtatgaagatgagttatgaaaaccgctgggaaaccgtagatgttaaagttgaagatggaattgcatgggtcactttaaaccgccctgaaaagaaaaatgccatgagcccaaccctcaatcgtgaaatgattgatgtgcttgaaacccttgagcttgatcaaaatgctaaagttttggttctgaccggtgcaggtgactcttggacagcgggtatggatttgaaggaatatttccgtgaagtcgatactcaaccagagattttccaagagcgtattcgtcgtgactcatgtcgttggcagtggcaacttcttcgtatgtattcaaaaccaaccattgctatggtcaatggctggtgctttggaggcggtttctcacctttagtggcatgtgacctagcaattgcagcagatgaagcaactttcggtttatctgaaattaactggggtatcccaccgggcaaccttgtaagcaaagccatggcagatacggtaggtcatcgtgcatctttgtattacatcatgacgggtaagacttttagcggtaaagaagctgaaacgatgggtcttgtgaataaaagtgtaccgcttgcccaattaaaagcagaagtgactgaacttgcaaattgcttacttgagaaaaaccctgtggttcttcgtactgctaaaaatggctttaagcgttgccgtgaactgacatgggaccaaaacgaagattacttatatgccaaactcgatcaatgtatccaccgagataccgagaatggtcgccaagaaggtttgaaacaattcttagatgaaaaatcaattaaaccgggtttacagagttataaacgtactggttaa

SEQ ID NO: 2460 - DNA, 2007 bp, Acinetobacter baumannii
ttcgcaataaaaaattatagtatttttttgaaaaaattagtaaaattcttatatttccttgataaaactaatttccttatgacagatattcgcaatattattaaattagcaaatacatatgaatttacccaattagaaaaaattctaaacaaagtagcaatacaagatttggagcaaatactccaacaaatcaactatcatgtcaatttaataaatcaacgccaaaacaataaaagtaaaaaaatcaatgaattcagaacaaatttagaaagatattacaaaaacaaaggaattaaaactaatttatttgacaatattagagtgattgaatatttatatagacaaattttagaagatagaataaaaatactaggaaaatataatagcgaagatataattcacactcagttttcattaataaattatttataccatcaaatattaaaacatacagacaccataaaagagaaagaatataaatattttgaaaatcttatgaatgcaaaatcagaatattttaatggagatgatttagataaacatattgaagagctatcaaaagttttttatatgactttaatgatatcttcatatgaaaataattggtttaacaaaaaatctcatgaggcaataataccttatgaaatattcaataaaaataaagaaaaaaataaattagatgaagaaataaaaatatctgaagaacttgtttttaatacaggattttgggatataacagaagatatagattttaaattacgtttctttaaagatgaaatagttatagaaaatggtaaaatttattataccaataaaatatgggaggaattaggtaattatgcattaattgcaaaaataagacaacaaagaatgctggctcaaaaaactttcgaagcaagtgcaattttatataattttggattaaaagattcagttaaacttaactatttaagtcttcaagcacaatttgaagatttatattacgatgatatcgaaaaggataatattcaatacaaaaatctaactcttaaagaatggattaaatcattattagcatttaaagaaattgtaaaaaatgagggttttaatttaataagttttgatcaattttttaaggtattacaaaaacatggaattcctacttctaaaaatagaattgtattagaaaattttacttttagatcgaatagtaaagatttatataataaccctattttaagattctcaaataatcaaatactaatattcccactaactatgctttaccctgatatcattactattcttaactctatactttcagaaaataatttagcaatcaaagataaaggttacgactttgaaaattatgtttttaattatcttttagaaaaatctgctcatcttgataactttaatgttactcaaccaaaatttaagaacaaagatggagaatttcagtatgatgtattaattgaatgggaaaactatatttttataattgaatgtaagaatagatctatccccaacacaacagcaatgtctcttaaagattttcgagaaaaatctaatgaatatattaaacaaattttgcgattaaaagaagggttattaaatcatcctaggcaacacaacattaaccttaataataaaatcattgtacccattttattgaactcattacctttttcattagattattcaatttcagatatctactttttagatttgtcatgtttttcagcttttttcaataataaaaacttatatttgcaatcatcttttcaaggaaaaattcaaaaagagcgtatagttcatactaattggtcatcagacaaaccttctgtcgatgattttttgaattttataaaatctccattccatgttagccagctcaaatcatgccttagagaacatattacttttcatacaattggaaattatgaaattgcattagaaagaaaatactttgatcttcattctgaagaatatgagaaaatattagaagttaaaaaaaatatgcactga

SEQ ID NO: 2461 - DNA, 1491 bp, Acinetobacter baumannii
atgaactcaaaggtaaatactaagctgctagaaatgcagttagagcgagaactctgtgagaaagaacatttattctttacacgtcgttttttcttgcctcgtatgggttttaagttttcagtcaattggcatcatgaatatattgccgacaagattgacgaggtaattgcgggcaaggttaaaaacctagttattaacgttcctcccggaagcggtaaaactgaattactaacaaaccttattgcacgtggcatagcgcgtaatgctcgatcccgctttctgtatttgtcattctcacagtcacttgtagaggatgtatcagctacagctagaaatattgttaagtcggaagactttcagaacttatggcctgtaaagatttctaccagtacggatgctaagtcgagctggaaaaccaccgttgatggttatgatgctggtcatgtttattctgcttcaatgggtgggcaggtcactggtcgccgtgctggtacattagctaatgagggctttaccggtgcgattattctggatgacccattaaagcctgaggatgcatttagccaaacagctagacgtaaagctaaatctgacacgccaattattctgatcatgcaacggttgcacgttgaagatccgaccaactttgtgctgacgggaaatgtgcctggtgaatgggaacagatcagtattcccgcgcttatcgatgatgagtacatcagtaagctaccagagcacatacagcgcaaaattccacgtgatgttgaacgtgatgagaaaggcagacaaagctattggccgttaaaagaatctttactttctttgcttcagctggagaaaggtggggaagataaagacggcgccacagtgtcacgctacacctttgctagccaatacatgcaaaaccctaaaaagctaggtggtgatcttgttaaggctgaatggttcggtcgttatgaggaattaccacttcttaaatggcgggcaatttgggcagatacagcgcaaaagacaaaagagcataacgacttctctgtgttcttatgtgctggtcttggctatgacaataacctttacatcattgatgtgaagcgcggcaaatgggaagcacctgaactattgaaagaagctaaggcctttatcaataagcataaggacagcaataccaagatcggcaaactacgctatatggccgtagaggataaatcgagtggtacaggattgatccaatccatatctagacaaaccacattacctattcgggcaattcagcgtgatacagacaagctcacacgaaccatggatgtagtgttctacgttgaagagcgccgtgtctggttgccagcagaagcaccatggcttttgaactacattgaagaaattgaagggctcacggctgacatgtcacatgaccatgacgaccaatgggacccgaccattgatgcaattaatgactcattagccaagaagccaactgtatttgatgattag

SEQ ID NO: 2462 - DNA, 282 bp, Acinetobacter baumannii
tctatgtcaaatgtgggaaatatacaccgtgaaagtaagaattgttcattagtcgcaaagatagtaatgatattgggagtaatttggggaattgcatttatagttgcttttggtcaagttgaaacccgaaatgaatatcttgagatcattaatgtctggtcaacaaagatgatagttataggctgtttaattattctgaatggcttaggtttaggttatttaattctcaagattagttgtattttaaggaatcaagaaattctattaaatgaaaaaagatag

SEQ ID NO: 2463 - DNA, 525 bp, Acinetobacter baumannii
ctcatgtcaaatctggagcagaaactgagccaatatgcggcttatcatttaaatcatcaaaatattttgacgcattttataggcattccactcatcgtgttttcaattttatgtttaacagcgagggcaggaatcgatattggtaattttaaagttactttagctatggtactgattgcagctagtacgatctattatttatttctagataaagtttttggcttaatcatgctcatgatattggtggctgtgtatccattagcgagccaaattgccgaactttctttaggacaatggttggctgcaagtattggtttctttgtggtgggatgggcttttcagtttgtggggcattattttgaaaagaaaaaacctgcttttgttgatgatgtaataggacttgcaattggaccactatttgtattggctgaatttatatttatgttaggttttagaaagcctttgcatgagcgaattttacacgaggcgcgcagtaaacgagagatgatggatttaagccattaa

SEQ ID NO: 2464 - DNA, 495 bp, Acinetobacter baumannii
tcaatgtcaaaacaattagaacagatgaaaatccgcctatcggccgttgcacatggggtgcaaatcgctgtaggtgatgcctttaatttagataactttgccaagttgctgctaaagcttgaatcaattgatgaaatgacaccgcaacttgccgaagctcaagcatacgccaagtatttaccaatcgaaggtttggaaggtgcggttattggttcagcaagtgtcttgcagcgtaaaaaaggtgtagggcgtggtaagcgattctcaggtcaaggtaatgacgtgccattagcagaagtgatgtatgactctcaagcgtcaaatggttatcagggcggaaatgaagagccgggtaatgtgaatgcaccatctatatttgagccaccgctggatcttacggatggcaagaataagtatgggttgctatttctggtggggctaattggggcggctgtaacgtctgggctagccttgataatacgacctatgaaatga

SEQ ID NO: 2465 - DNA, 1467 bp, Acinetobacter baumannii
gtgagcacaaaagaactcgatcataaccaccgttatgaaattaaatctcccgatgatgtttcacaattaatttccaaatttgcagggaagggtaaatcgaataaagttatttggttggcactgattggagtatttattgatgcctatgatctaacaacgctctctttcggtattgagcaagtcatctcagagttttctttaagccctgtcatgactggtgtggtggcttcagcaattgtccgcggaaccattgtgggtaacctgattggtggttggctgacagataaaattggccgttatcgggtcttcatggctgacatggtgctgtttgtcattgctgcaattgtcgcgggctttgcaccgaatgtatgggttttgattttagccagatttattatgggaattagtgttggtattgatttgcctgtcgcaatgtcatacttatctgagttttccaaatttaacggtagtagcaacaaggcagcgcgtttagccgcatggtgcccaatgtggtatgccgcttcttcggtgtgttttggcctagttctggcgctttattttcttttaccccctgagcatagcaactggttatggcgagcatctttaatttttggagcagtgccagcgttactcattatttttattcgcggtaaatatttaactgagtcaccaatctggcttgcaaaccaaggcgatttaaaaggtgcagctcaagttctacaagaatcctatgcaattcatgcagtcgctacagttgaaaaagtagaaagaactgctgaaaagaaaaagcgcgagggttttacagttttatttaataaaacctatttgccaagaactattgtggccattgtgattcatatttcggtggcatttcagtacacgaccattgctttctttttaccttctattttaacgcgtttctttcataccgatgtcttgacgaccattaccaccacgcttggacttaatttactatttgcatttacgggtgggttgttaggggtatttgttgccagcagatttaaatctcgtcatgtattgcttacaggctttttactccagtttattgccctgattgctttggcattcattggtgaacccggtaatagctttttactctacaccgcaattggtatgctcggtttgtggctttttgccgaaggctttggaccaggggcacaaatgatggtttatccaactatggcttatccagcttcgattcgtggcgttggggttggctttaaccgtgcggtaacaggtgttgctcaagcgattgctttgtttgttttaccgatctggatggcgggatataaaaccgatgtttatctgattatttctatctttgcgtttattcctttaattgtgattggactactaattaagtttgagcctaccgcccaagatgttgatgttattgatgaagataaaacagaacttcctctcaataattcaccagtaatcgactag

SEQ ID NO: 2466 - DNA, 1563 bp, Acinetobacter baumannii
acgataacaaacaagatcaacaagataagcatgattggatataaccaaagaagagtaagagggatatgtagaaagcaggctttcctgaaagggcttatgcttttaagtacactacatgtacctgtcgtgatatacgctgctaagccaagtgagcaataccacaccctgaaagagaacttgtcacaactttttgtccctaaaagtagtgatgactttaaagttgccaaaatgcacaagcttagtaattttaagctagaccgttctattgtgcaggaatttcctactgttcaacttaatgataatcgagcttcatctttttctaacttgccatctagaacgatgacattgcaagatgcggtaaaaattgccattcagcgtagccccgatatttcacaatctattgcaactttagcaggtcaaaattcaggagttgacgttgctaaagccggttactatccccagctttcaggagggattacgactggtgatttaagcagtggagaacgaggtcggcagttattaaccttaagtgctactcaaatgctttatgacttcggtaaagtcaaatcaggtgttgatgttgaagaagcgaaagttcaggttgaacaagccaatgtcttggttagcgttgatactctagctttggatgttgcacagaccattgtgaatattcagcgttatctacagcttaataaaattgctgagcagcaaatcgccggtattcgacgtattcaggaaattgctaacctgcgtgcaaacgctggtgtcgcaagtcaagccgacccaattcaggcgcagtcatacttacaggcagcgcagtctgctttgattgctcagcaatcattattacgtcaataccaacagcatttaagaaccttattaggtgcagatgttagtcataccggatggattatttccgatgatctcgtgaagcaatctgatctttatggtgaacctgagtttaatactattccaaaaatgattgccgcacaggcaggtgttgaggttgcaaaagctcaaaaacaacaaacccgtttaacccgatatccgaccttggctgtgaaaggttcggtaagtcaggcgattaatggtaaaaacccgaataacgataaagatgacggtttgtatagttcagtcatgcttgaagcaaccagtcagttttaccaaggcggtgctaccgcttcacaagtaaaaatggcaagttatgccgaagaagctgcaaaagccaaagtgaattcggtgtatatggatgttctggaccaaattagaacaagtcgcgaacagattgaaaataaacagcgtcaaatgcaggttttggcaagtcgccaagcaacaacggttcgtacacgtgaactctatcaagagcagtacaagctcggtacgcgttcattggtcgatttattaaatgctgaacaagctattcatagtgccaattcagaactcgaatcagcacgttatgacatttatagcagcattgttcagtacattgaagcaacaggacgttcccgccaagcctatggcttaaataatatttcaattcaggggttcgaagtacaaccatga

SEQ ID NO: 2467 - DNA, 483 bp, Acinetobacter baumannii
atgaaagcaaatcaggaatttttacgtcaagccattgagcttgcttataacaatatagaaaaaggtggccgaccatttggcgcagtaattgtaaaagatggcaaagtaattgcttcaggtgttaatcaaattttgacaactaatgatccgactgcacatgctgaactattggcaattcgtgcagccagccaagttctaggaaacgcgaatttagaaggctgttcggtatttgcaagcgggcatccatgtcctatgtgtatggctgcaatgcgtttagcgggtataaaaacagttaactatgcttattctaatgaagatggcgcaccatttggtttatctacagctgaaatatatgccgatcttgtaaaaccatttgctgaacagtctatgaaaattgaatatgtgcccgttcgatttgaagaccgtaccgacctttatgtgttttggaaaaattatcaagctaagcaatcgggcctaaagtaa

SEQ ID NO: 2468 - DNA, 576 bp, Acinetobacter baumannii
acaatgcaaaataaatctaacgataatgctccacgtcattttaatttgactgctcgaatactgcattggcttatggcggcagcaattctggctatgctatttattggggtaggaatgaccacctcaatgacttggcgtccgtggttaattgatattcaccgtcctttaggaatcgcaatcttactattggtcgtcataagattaataaatcgactctgttatccaattccacctttgccgccgactgtaccgcgctggcaggcgtttcttgcccatgcatcacattggctactttatattttgatgtttagtttgccattgctcggatgggcgatgctatcggcaggtaattggcctgtcactttatttccgggttgggatcttccacctatagcaccaaccaactctacgctttacgcttggttccgtactctacacggaattttggcttggctattatttgctgtcgtcattggtcatttatctgctgcattattacatgcatggatttatcgcgatggcgtattttcgagtatggctttggggccttcttctaaaaaagaagaagctgattag

SEQ ID NO: 2469 - DNA, 366 bp, Acinetobacter baumannii
aatattaaaaatgaaagagaggagaatttagccatgtgtgatattgataatttaaatggaaaatttgttaaatatgatcaattatactctattaatatatattttgatgactttgatggagtctataatttagatatggttttagccaaagatttatcggatatatatagtgaaaaaataaaaattagattctttaatattactaatctttgtctgaatgatgttggtaataggtttactcagttttgtagaatgtatattgagaaaaatttagatggatgggatggtgttaaatacaacttaaatcaattagaagaggatagaattctctttaaattttttaactttgaattgttggaagagtaa

SEQ ID NO: 2470 - DNA, 468 bp, Acinetobacter baumannii
aagattaaaaaattgaagataatatttaaaggaagaataatggaaatttcattaagattcgcgacccctgccgatctcaaagctataaacgaacgctatgccgaaattgattttgtagcatcacatgatgatgaacttattgtactagcttctattgatgagaaaactgttggtcaaggtagagttgtgggtattgatgctaacagtggcgagcttggcggaatttatgtttttccaggcaatgaaggattaggaatcgcccgtaaggtagttgatttcttaattaaaaattcagatttttctatgctttactgtttaccctttgccgagttagaaggcttttatggctctatgggttttgctgctgtgaaagacatggctcaggttccagaagctgtgctaaaaaaacatgagtggtgtaacagtaattacgacaaaccggttttgcttttagaaagaaataaataa

SEQ ID NO: 2471 - DNA, 708 bp, Acinetobacter baumannii
gcagttaaaaaatctaaaatatataaaaatataacttattttttaattatggctattcaacgtcaaaaactcgaactcccatctggacataataaattattactccattcttgctgtgctccctgctctggagaagtaatggagtcattaattgagtctaatataaacttttctatattcttttataatcctaatattcatccggtaaaagaatatctcattcgtaaagaagaaaatatccgcttcgcagaaaaacataatattccctttattgatgcagattatgacaccgataattggtttgcccgtgctaaaggtatggaaaatgaacctgaacgcggtatccgctgtaccatgtgttttgatatgcgcttcgagcgtaccgctttgtatgcatatgaacatgggtttagtctaatcagcagctctttagggatttcaagatggaaaaatatggcgcaaatcaatgactgcgggattcgcgctgcttcacactatcccgatattcagtactgggactacaactggcgaaaaaatggtggctctagccgcatgattgagattagtaaacgtgaagaattctaccagcaagaatattgtggctgtgtgtattccctacgtgatacgaatcgctggcgtatgagtaatggtcgagatcgcattaaaataggtgttaagttttatagtaatgtaatggaaaatgattaa

SEQ ID NO: 2472 - DNA, 792 bp, Acinetobacter baumannii
tcaaataaaaataaacgtggagattttatgcgggttttgtatcagtttcctttgtctcattattgtgaaaaagctcgctggttgttagaccataaagaacttgattacgttgcacataatttgattcctggatttcaccgtgcttttgcacaacttaaaacaggtcaaaatttgttgccgattttaaaagatgaccatcgctggattgctgagtcgactaaaattgcgctttatctggatgatacttatccggaacatgcacttttacgccgtgatgaacaacttagacagcaaactcttaaaattgatagtttggcagatgaacttggggtgcatgtacgtcgttgggcacttgctcatactttagctcaaggtgatcatgctctagagattatgatgggcgaacaaggctacttacgacagtttgagaaaatatcaaaaccgtttctcaagactctagtcaagaagaattataagcttgaagaagagctcgtaagtcagtcaaaaggacgcatggatgaactcattaatgagttaaaccattatttaattgaaaaccaagcacgttatatggttggtgaccgcttaagcctcgctgatatttcagtatgttctatgcttgcacctttattagaaataaaaggtacaccatgggaaagggaagaagatggggaagtatcgcctgattggagtaattatcagaaatatttacttgatttgccgcttggacagtacgttttaagaatatatcaaactgaacgtaatgcacgggttgactggcgaggaatttaa

SEQ ID NO: 2473 - DNA, 189 bp, Acinetobacter baumannii
tggttaaaaaatcatctttttcattttattatttataatcaacaaattacttttattacccctgcttttccatatagttatccacaagatttgcggataactatatgcaaatctcatcatttagccacaagtaatggtacagtcgcgttacggaaaatcgtggttgcaatacttcccaagaagaactga

SEQ ID NO: 2474 - DNA, 1320 bp, Acinetobacter baumannii
aaatcaaaaaaagtgctttgcatttttattcataagctgagcataagtcctcgtttagtggaaaaatatttcttttgtaaggtaatgacagtaatacaaggtgtcattatgtctaattctctatctaaaacgacggcatacgtccaagtcattcaaaatgatcaacaagcaattaatgctgcttatcaagtggctgattttgctttagagggtcgtaatacacgtgatcaacaacgcttattaccgcatgagcaaatcgaaagctttagccaaaaaggcttaggcggaattcgtattgcaaaaaaatacggcggtgctttcgtttccaataaaacactggcacaagttttccgtattttaagtaaaggtgatgcaaatgttggtcagattccacaaaatcagattagcctgttaaacctgattgaaatcatgggtacagaacaacaaaaacaatttatcttttcagaaatattagccggtaaacgtcttgccaacggcggtcccgaacgaaatacccatgactcaaaaaccttaaaaaccacgcttactattgaaaacggcaaatattttttaaacggcgaaaagttttattcgacgggaacaagttttgcgcattggctcgcaattaaagcgattcatccagaaggccatgtggttttagtcattgtgaatcgagatgctcaaggcattgaagttattaatgactggaatgggtttggtcaacgtactacagcgagtggtacagttaaattaaatcaagttgaagttaatcctaaacttatttttgatgagcgattattaacacaagttccaacctatcgcggtgcgtattcgcagttattacaagtggcaattgatgtcggtattgcggaagctgcttttgaagatactttatcgaccatacacaaagcgcgcccaattattgatgcaaatgttgaaaaagccagctttgaacattacaccctacaagaagtgggtaaattaaatattttactcgatgcggcaattttactgcttgatgaagctgctgaatatttagatgaacttgatcaacttcaaacggtgactgacgaacaagtagcaaaagcttcaattttggtcgcagaagcaaaagtctatgccaatgatgcggctctacagatctctgaaaaactactagagctaggtggtagccgttcaagcttaagccaacacaatttagatcaacattggcgaaatgcccgtgtacataccttacacgaccctgttcgctggaaattacatgccattggcaattattaccttaatggtcatttccctgcccgccatgcctggatttaa

SEQ ID NO: 2475 - DNA, 192 bp, Acinetobacter baumannii
atcagaaaaaaagctttcaaaatatatcttattcatcagttctacagtttttatctttgttttttatacgtttttttagatgaaaagaattttagaataaagactattcttttttatgtatatcgtatacgatatatgaagaatgattggacagctattgatacccattccataacttttgagatggattaa

SEQ ID NO: 2476 - DNA, 1284 bp, Acinetobacter baumannii
aaaatgaaaaagacaccattgtgggtgggggtatgcttgtgcccattatttagtcaagttgtgcatgctgagtttatagcagacagtaaagctgagctgacgctgcgtaatttttacttcgaccgagactataaaaaagacccatatccctatacggcggccagagattgggcacagggtttaatttttaaaggacagtcgggttataccgaagggacagttgggtttggtgttgatgtgctcgcaatggcaggttttaacctgatgggaagccgtgctgatgactatgcacgtagtggcttactcccagttaatactgacaactcgcgtgacgactattatggaaaaataggcattacagggaaggctaaatttagaaaaaatgagctttttgtgggagatttagttccacagttaccgaccatattttcatcgccagcgcgtttgtttccacagtcttatcgcggtatccgttttgtttcaaatgaaattccaaatcttcaactcgaagggttttatgtcgacgaagtacggcagcgtgactccattcgttataccgatgttggaacagacaatatcaatcatcgatttaacaaagctgccaccactgactcgttttatactttaggtggaagttatcagttaaaagactaccgtttacgtgcttatcatgctgaactcaaggacatttaccagcaacaatttttgggctttaacggcaaacaacctttgaatgaccagcttaactttttaagtgatgtgcggttttttaatagtgaagaaactggaagtaaaaaaataggagaggtcgataaccgacatattagtggcttatttggtttgaactatcaaaatcatacggtttctttgggctacatgcagtcgtttggctcgactggtctgccatttttgtcgggaactgaaagtccggttgtgcttgattttatgagttcggactactcaaataaagacgaaaaagtctactcgattcgttatgaatatgacttcaaaaatgcacggataggggatgtttcattaaacggactacgttttatgacccgttatgctaaaggtgaagatattgatttactgcaatatggcgatcagcgatttaaagaagattcgctagagtttgatttgggttataaaattccagaaggcaagttaaaaggcttaggaatgcgggcccgcttttctcactaccgtaatgacatgccaacgaatatgactttccactcggcaaatgaaacacgtttgaatgtcgattacacctttaaattttaa

SEQ ID NO: 2477 - DNA, 1320 bp, Acinetobacter baumannii
aagatgaaaaaattaattttagctgcagcttgtgctgcggcttcagggactatttttgcaaattcttcagataccacagaacaaagaattaatttgctagaaactgagctgcaaaaattaaaagcagaacttgctgctcagaaacaaactcaaaataatttacaggtcaaacaggttaagatcgaagagaacattgaaaaaactaaagcaacggtaacagaaaagcctgttgctccttcatgggtcacttggacggataacgtcaaggtttacggtattgcccgtattgatgcagcggtggattttaaatcatcgcctgattcgggtggtagaacgaccagcagcctgtaccgaacaccttttgaaagtgaaaaacgttcgaatcatgcacgctctgatgcgatgattaatgcaagccgattaggtgtttattttaatagcccaaataaagcggttacagggaatatcgaagccgatttctttgatagttctaacatgggaacgggggatggtaaattccgtatccgtcatgcattttttacctataaagactggacttttggtcaaacatggtcactcatgtctaacatggaaacccgtacagaagctgtcgattacacccaatttgtggggacttcttatacacgtactcctcaaattcgttatgactggaaaattgatgccaataatgatttaaaagtagctttggaatatacaggttcgagagtatcggcatttccaactttaacgggtcgctatacctttaaacaggggcctctaacggcacttgctcaaggctttattaatgaaaagtctacagatgtcgcaactgccacagtgaaaaaagtaagctggggtgctggaggcggtttaaaatatcaactcacgccacaacaatcagtacaagcaaattatcaatatattgtcggtgatcaaaaatttatgccgtataccacccaaagtggtttggcaaattcaacaaatttaaatgccgcgggtgatttttctttaaacgaagacaaaacagatttggttatgaataagttgaatagcattaatattggctattcatataaatttaatgagcaatggcgtgcaaacctatcggcttcaatgtttgattatgatgacgacacggcttatgccaaactcaacccagatgccaacaaacgcttaactgactatgccgcgaacgtcttttattcacccattgagcaaatggatattggtatggaatatcatcaaggtaaacgagaagtgtttgatggcagaactgctgatgtatcacgtgtaaactttgtttcgatgtataaattttaa

SEQ ID NO: 2478 - DNA, 4884 bp, Acinetobacter baumannii
tttgagaaaaacatgtcacaaaattcagtcgttgctcctttaaatacttttagtcccaaagatttaactgcaaaaaaagcagaagttgataaatggtttagggaatatacaaatggtgtggttacagttgaccgacttgagacaatctgtagaagtgtccctgttttaggtagtgcctttgctattggcgatattattattgatattataagtatgatcaacaaaggtggtcttgataaagttgagatctttgattggttaaatttgggaattgatgtcattggattggtgccaatgggaccagttggtccttcggtacgtagtgcagcacggccagcattattttatgtaaagaatgaatcagaaaaaattatcaaagcacaagcaaagaaattaggcaaaaaaacattaacttctcaagaagtaaaaaaagctttaagtacagggtttaaagacagcgcaagtgtatttttaacgaccattatcgctgaaaatgtagcgggtactttagaaaactttgctaagaagggacagagtttacttaatcaaatactaaaagaagttggtaactggattgtcttattaacaaaaactattgatgatggctttaagaaattagtaagtggctctttaaatggacttccaaaccttaagcgagcgggccaacagtctttaggagttataaaaggaatatttgaacttgatggaacccgtatagtaaacaatgccaaatatgctactgaaaacgttgcaaaaactgtgggtaaagggtatgtcaatttagccaatttagcagtctccgatgaagcacgagctaaagttttagctttaggcgcaaaaataaggtctataggtcaagttgctcaagcaaaagtaaacggtttaagtgaccctaatactttatggactattggttggctatttagcattatgggaatggttgctgcaaaacatcggcaaaagagagcgcagattaaggccaaagaaacaacaaaggccaatgcaagtcatccatcaactgcgactgacaaatcaaataaacaagctcatgccgagaacaatgccaatcagtgtaaaaactgtatgggtggaactggtggttcaattacctttgcaatgggtaccgagttctttactcatgttgatgcacaacttggcggaataattcaggacagcattagccgtacctatgtttcaaacctttaccagatggatgatgctatatttggcgcacgttgggttactccatttactacaaaaatttctcgtaaatttaaatatacttcaaagaaaaaagaccataaagactatttaaatgggcttgaatacatctgtttagatggtcgggcaattgatttgccagacctaaagaagggacaaagtatttatgatccgattgagcaatacacttatacagttttatcagatcagctgcatttaattgcctacggtgaagacgagaaacgctattatgaaaaatacggtgaggactatcgtctatcctatatagaacgtaaaaatggtttcaaagtcgctttacgttatgaccatgtttctacggataataaaacgattttatcggacattttatttaaacaggacgataacttgctggctcatttagctttgcaattaactccccaaggtttggtttccgatatttggaccatcaaaaatggccaattagatcgtgttttggcaagttatgattatgatcaacaaggtgatttggttcaggcaacaaatgagtttgcagcttcttattattatcaatatacccatcacttaattacacgttatacagatcttacacatcgtgggatgaacctaaaatgggatggtattttacctacttcaaaagccattgaagaatgggccgacaatgctagtcgtgcttcaaagctggagtgggataaaaatatccgaaaaacgacagtgttagacgttgaggggaatagcactgaacattactacgatattgatggctatacttaccgtattgtttatcctgataattttgaagagtgtttctttcgagatgatgcgaaaaatataacactccatattgctaaagacggttcgaaaacttcttacacttatgatgagcgtggtaatgtcttgactacaactcaagatgatggtgcgacaagttattttgaatatgatgaaaaaaatcaactcactggtatggttgatgccgaacagggacgttggtttaagcaatatgatggttctggaaacctgatcaaagaaattgatccacttaagcatgaaactgcttatgtttacaatgcgatgggcctagtcacttccattacagatgctaaaggtggaagtaagtcacttaaatatgatgatcaagggaatttaattagttatacagattgctcaggtaaagagaccaagtggcaatatgatgagcgtggtcgtgtaataagcattgaaaatgcattaaaccaaaaagttgagtatttttatactgaacttaccttagaaaatcgggaaccaattataaagggtttacctctgaatgcttttggtcaacttgaaaagattaaacatgctgatggcacagaagaacacttcattcatgatgctgaagggcgtttactggcgcatgtagatcctaaacagaacatcactcgctatgaatatgatgaggcaggtttaattctgtctcgtacagatgctctaaaccataaattaaaatataaatgggatcgattgggacgtctcacccgactcattaatgaaaatggtgccagttaccaattcttctatgatgtcgcaagccgactcgttaaagaaattgactttgatggtaaggaaacggtttaccattacgatgaaaagtcgggccaacttgcaaccagtattgaagttgcatctgcttatggacaagacctcaaagaccgagctgcaccgaaagaccgaattcaacaatttatttttgacagtatggggcgtttagaacagcgtacagcgggttatggtcattatggtttagaacttgaagaaaaacagactgaagaatttgcctatgattatatggggcgaatcattcaagctaaaaatgctcaaagtaatttacaatggttttatgatgcggctggcaatttagtacaggaacaccagcaagattataaaatcaataaaacagcggtgtggaaacaccaatatgacgaaattaatgatcgaatcaaaacaactcgtccagacgggcaggttattgactggttgacctatggtagcggtcatgtacaaagtttaatagtgaatggtcaagactttgttagctttgagcgtgatgatttacaccgtgaaatcgcacgtcactatgccaacggagtgagtcaagaacagcaatatgacttagcaggtcgtttgaaaagccaaatgatgttaagtgaacatgaaaatggctatcaaaaccaatataagcgccacaacaatgcattagagcagaccagtcaactggtacagcgtctttatcaatatgacaaaacaggtgagctaacggcaattcgagatacacgccgtggcaatattgcctataaatacgatcctgtagggcgtttacttgaagcgagcagtaagttaggtaaagaaacatttagttttgaccctgcgagtaacattctagattcataccatagtcagaaagttcaaagccattcacaaaagctagacgaaacgagttatggttataatcgtttggttaataatgtagttaaagaatatttagaccaacaataccaatatgatgcttatggacaactcatacgacaaaaaacgagccaaggtgatttaaaccttgagtgggatgtctatggccgcatggtaaagagccgtaatagtcaatacacggcagaatatcgttatgatgctttaggccgccgtattcaaaagtggagtaagcatcaccatactggtcaagagcagaacatcatttatggatgggatggcgatacgcttgcttatgagtcgacagaggaactgactaagcattacatctatgaaaaggacagtttcgtgccaatgctacaggctgtttatttaagtccaatagaattacaccaaactccagattggtcagatagaccttataatatacaccgagacccgctttggaaaactgaaaaagagggtaaagaatttgatgatgtatggttctatcactgtgaccacttaggtacgccgcaagaaatgactgaccatacaggtgcaattatttggaaagctgaatataaagcttggggcgagtgtaaagcagaggaagccaagtcgaatttcttcgaaaatagtgaaattatttcaaataatatccgttttcaaggacagtattttgatgaagaaacagggttacattacaatcgctatcgttattattcaccgtatgtaggtaggtttgtcagcaaagacccgattggattgttgggtggtaataatgtttatgtatatgctaagaacccgattacatggatagatagtaagggattatgtagtaccaccttaaacagaaatttaggaggagtaaaaggtgatcatttacaagctcatcatattattcctgaagaaatttgggccaagcgcaaagattttttagatgatattggtattggcggaaatagagataaagcagaaaatggcgttttaatgcctgacagtgaagctaaggcaaaacaaatgaagcgccaattatatcattgtgggtcacatccaatttattctgcaggtattaatcaaaagttaggacaaatacagagagaatttgaaagtaagaaaataaccgcttctcaagctagagataaagtggcaaatttacagtcaagtatgagacttgttttaataacacctggtacaaaaccaatcagattaagttag

SEQ ID NO: 2479 - DNA, 1647 bp, Acinetobacter baumannii
ttgaccgaaaatgattgggagattgatgttatgagtgtatctgaacatccaaatctggacactgtgcaaggtgcagattcacaaaaagcagtgaatgaaaccttagaagattatactttacgttacgctccacacagctttcggcgctggagtcccaaagttgttgctattactgcacttggtggtattgcctatcttgctgacttttctattggtgccagtattggtatgtcttatggaacaaccaatgctgttttctccattttatttgcagcgattattatcttcttaaccggcattcctttagcctactacgcagctcgctataacatcgaccttgacttgattacccgcggtgcaggttttggttatatcggttcggtcctaaccagtatcattttcgccagtttcacctttattttctttgcccttgaaggttcaatcatggcgcaagggttattgctcggtttaggcattccgctttgggcaggttacctcatctcaaccgttatggtcattccactcgtcatttacggcatgaaagctttaagtaaattacaagtctggactacccctctttggctcgttctaatgattggtcctgtagcctatctgatttaccaagaacctaccttagttagccagtttgcaacttttacaggtcatgaaggttttgcacctgtagatatggcagcgatcatgcttggtgcgggtatatgcttatccctaattatgcaaatcggtgagcaaattgactacctacgcttcatgcctgcaaaaacaaaagaaaatagcaaagcatggtgggctgcagttatttcagcgggtccgggctgggtgattttaggggcgattaaacaaattattggggcatttttaggtttctatttactcactaaaataccgggcgtaaacagcactgaacctgttcaacagtttaatgcggcgtttcatgacatgcttccgggctgggcggctttaacacttgcggttattttggtggttatttctcaaattaaaattaatgtgaccaatgcttactctggttcccttgcatggacaagtgcctacactcgtattagcaaacattatccgggtcgtattgtctttgtgatcgtaaacttggcaattgcgcttgctttgatggaaggcaacatgtttgcggtactgggtaaaatcttaggattctattcaaactttgcgattgcatgggttgtggttgttgcaacagacatttcaatcaacaaatatgttttaaaactttcaccaaaagaaccggaataccgtcgtgatatgctctacaacgtaaaccctgtcggtatggttgcgttccttgtatcagcaggtttatcgattgcagcattcttcggcttactgggtagtttcttggcgccttactctccaattattgcacttgtacttgcttttgtattaacaccaatcatgggtctattaaccaaaggaaaatattacatcaagtcacacgatgacggcgttaaagaaccacgttacgatgctgaaggtacacccgtagcaactgtttatcactgccgtgtatgtgagcaaggttatgagcgtccagatattatgttctctcataaacataacggtacgatctgttctttgtgtaaaacactcgatgcttaa

SEQ ID NO: 2480 - DNA, 195 bp, Acinetobacter baumannii
gaattggaaaaaggacttttgctattgctgcgccgatctgtacagaaactaaagataaaaatgcggctgcaaatgccataccttgtttggagtttgtctcaatcatcatctttactattggggggaatgattgaaattttaattctctataatcaatatatttcttctatttttcacggtaaaacgattaaataa

SEQ ID NO: 2481 - DNA, 393 bp, Acinetobacter baumannii
attatggaaaattttttaacttcaaatgggctagctgccgcttttaacctttatggcaccgtcatgatggtggctttagcagtgagcttagtcgttgcagtagttttaattatgcgatttccacgttcacctcaagaatgggtcgttggtttgatttgtacggttgtttcaagcttgactggtggctccttcattatcatgaaatggaatttacatgagtgggtgacagatatatggggaatgatcactttaggtggattcttctttatttgtggcttacctggttgggcaattgtgaggtggatatttaatttcattaataaacaagaaggaaaaaccattgttgaagtcatgcaagatctaaaaaaagcgaaagatgatatccaaagctaa

SEQ ID NO: 2482 - DNA, 603 bp, Acinetobacter baumannii
aggatacgaaaaatgcatcttaaaacattaagcttcggtttagcagtagcattggcaagtacagttacattagctgcaccagtggactataaaattgatccaacacacacagctactgttttctcgtggaatcacttcggtttttcaaccccaagtgctaacttctcagacatccaaggtgtaattaaagttgataatgctaaaccagcaaactcatctgtaaatgtgaccattcctttaagcagtgtgaatacaaacgtacctgctttagataaagagttccaagaagaagcttggtttaatgcggctaaatatccaaacattactttcaaaagtacgaaagtagaaacgaaagacaaaaagcatttcaaaattactggtgatttgactgttaaaggtatcactaagccagttgtacttgatgctgtcttaaataaacaaggcgagcacccaatggcaaaagttccagcgattggttttaacgcgacaacttcgttcaatcgctctgactttggtttaggtaactatgtaccaaacgtgggtgataagatcactgtaaacattacaactgaagcaactgcggctagtgcagctaaaaaataa

SEQ ID NO: 2483 - DNA, 612 bp, Acinetobacter baumannii
aaaaagcgaaagatgatatccaaagctaatagctatttggccctaataaagacgaggacaactcttatgaatattgagcaatatttagatgcactaataaaacgcgaaggtggctatgtaaatgatccacttgatcatgggcatgcgactaaatttggaattacacaagccattgctcgtagttatggttatcaaggtgcaatggagaatttaacgttagagacagccagagaaatttataggaatcaatattggcttgagccgcgatttgatcaagttaatttgatcagcacacttgttgctgaagagttattcgacacgggtgtgaattgtggtattagtttcacaaaaccacttttacaacgtgcattaaatttattgaataggcagggcaaagaaggctgggtagaccttaaggtagatggtgaatatgggccagccactttgcaggctttaataaaatatattaaaaaccgtggtaaagaaggtgaaaaagtgctggtacggcttcttaatattatgcaaggccaacgctatattgaaattacggaaacaaatccgaagcatgagcaattcttttatggatggcttgctaatcgtatcagcttataa

SEQ ID NO: 2484 - DNA, 216 bp, Acinetobacter baumannii
tttaggagaaataatatttcggatagcttgagcgaccattttcgacaccctataaaatttgttaaatacaaggcagcgtcgaatcaaacagttaaagttgtctttggattatttcttgcaatctttaactgctctagaacaaaaatttgctcgaatacatctgccttgccatgttttatgaacttaagtattgttaagttcaccaaatcagattaa

SEQ ID NO: 2485 - DNA, 516 bp, Acinetobacter baumannii
tcagggagaaacagcatgagtactcaagacaaagcaactttagaaaatattgctcagtttctttatcgtgaagctcgctttttagatgatgaacaatgggatgactggcttgaatgctatgcgccagaagcttctttctggatgccagcttgggacgacgacgatagattaactgaagatccgcaatctgaaatttcacttatttattatccagaccgtcaaggtttagaagatcgagtgttccgtattaaaaccgagcgctcatctgcaaccatgccggacacacgcacaagccacaatattgccaacgttgaagttctcgatcgcgatggcgacaaagtcactgttcgctttaactggaataccttaagtttccgttacaagacaaattacagctatttcggtatgtcacgttatgtgatcgatttttcaggtgatcaaccaaaaatcttgagcaagtatgtcgttttgaaaaatgactatatcaatcaagtcattgatatttatcacctctaa

SEQ ID NO: 2486 - DNA, 975 bp, Acinetobacter baumannii
aggtatggaaacctgatggaactaagacatttacggtattttgtggctgttgtagaagaacagagcttcaccaaggcagccgaaaaattatttattgctcaaccgcctttgagtcggcaaatccaaaatttggaaagtgagcttggaattcaactctttgagcgaggaagccgccctttacagaccacaccagcagggcatttcttttatcagcacgccgttaaacttttgtcgaatgctgaagaaataaaaagtatgaccaagcgtattggtctcatcgaaagaagcatgaccattggttttgtcgggtctttactctatggtttgttgcctcgaatcatttatttatttcgtcagcagcagccgcatctaaatattcagctcatggaattaagtacaaccgaacagttacaggccttaaaagaaggccgtattgatgtcgggtttggacgtttaagaattagtgatcccgctgtgagacgaatacttttacgcaaagagcgtttggtcgttgccgcgcacaccagtcatccaattgcacagcgcacagaaggggtatatctggccgatttgattgatgaaaagatgtttatgtatcccacctcgccgaaaccgaacttctcaacccagcttttgaatatttttgccgaacatagtttggttcccaaaaatatgcatgagatacgggaaattcaattggctttgggcttagtcgcagcgggagaagggatctgcattattccagcaagtgccgataccattcgattcccacacttaaactatattccgattttagataacggcgcagtcagcccaatttttattactgcacgggcaatggaccgaagtgaagacttacaatcattgttcgattgtatttatcaggtttatgacttagaagggataccttatcaacgaactgtttttacacttgatcagaacccgatagatgattcaaatggtatcgatttttaa

SEQ ID NO: 2487 - DNA, 783 bp, Acinetobacter baumannii
aatccattgaagtcggctcatgcgtttcggcaaaatgggtaccacaaatggctcaaagtgacgagctatttatgcttttaccccaaacaaccgatgtgcaatttagcctgcttactccaaatattaaaggttttgaaactgctcaagccggtaggatgcaaagaggttgcggtttttaccgcagtttctgaaagttttacccgcaaaaatatcaactgttcaatggacgaaagctttgaaaaatttagcgatgtcatggccgcagccaaagcacataacatccgtgtacgcggttatgtctcttgtattgtcgattgtccttatgaaggcgcaattgcacctgagcaagtggtaaaagtcgttaaacgactctatgacatgggctgctatgaagtgtctttaggtgaaaccattggcaccgcaacacctgatcgcgttcaaaaggtatggcaagcctgccttgctgaactcgatagcaaggtattagctgggcatttccacaacacctatggcatggcaattgccaatatttatcagtctttacagcaaggtattcgtgtttttgattcgtctcttgcaggacttggaggttgcccttatgccaaaggcgcctctggcaatgtatcaaccgaagatttgttttatttgctgtcacacatgggttttgaaactggcattaatttagaaaaattgatgcaagccagccaaaatattagcaatgtattaaaccgaaaaagcttgtcgaattatgcaaatgcgtattggcaaactaagtgtgcatag

SEQ ID NO: 2488 - DNA, 1275 bp, Acinetobacter baumannii
atgaatctgaatataagaggacatttaatgaagaactttctcaccaagaaaatgtacgcaactagagctttattttttgctgtaggtgttacggctttgaatgtttcccctattgttatttctactactcatgcagcgacagaacaaaaaatggataatttatcgactacactttcattaatttttgcagataaacccatagaagcttctttatttagccctcaatttttaggacaagttcccatcacacaaattcaaaaaatcgttgataatttaaaagtctctttaggtgctcttaaaaatattaatgtttcaaatggctctgggactattgatttcgaaaagggagaattacccgtttcaattagcttaaatgagcaagaacaaattagtactctttggtttagtgcgcctcattttaagacaataagcctagacgaaatggttaaaggtctacatgaaaatgcgatcggtaaaacttctcttttagttattgtagataacaagcctgtggttgtagaaaatgataaaacccctatggctgtcggttcgacttttaagttactagttttaaaagcttatgaagatgcgataaaaaaaggcgaattaaaaagagaaactattgtttctttaaaagaaaagaatcgctcgttgccaacaggagttttacaaaacttgcctgctggtacacctataaatctcgaacttcttgcgcagttaatgatacaaattagcgataatacagcaacagatagcttgatagatgtattaaagaaacctcgtatagaagcgttatcacctagaaattctcctctgctgacgacacgagagctatttcaactgattgattcaagtaatgaaaagctcagaaataagtttaaaacaggaacaaagtcggctcgtctggaagcactctctgagctagacaaactgccactaccaagtgtgagtagcattggaaaatcggctacttggcaagatgctgaatggtatatgtcagcccatgagatttgtcctcttcttgaaagtgttcaagatgctccggctctgaacagttctttaaatccactttttaaaaatttaaattggcaaaagattggtttcaaaggtggttccgaatacggcgtcatcaacttttctgtaattggaaaaactcaaaaaggtcataacgtgtgtgccgtatttaccgcaaatggaaatgagccacaacccgaatcaaaactagcaatattatttacaggcatacttcaagctgttgattctatgagtcattag

SEQ ID NO: 2489 - DNA, 669 bp, Acinetobacter baumannii
ttatttatgaatcttaaaattgaaaacccgcccgtaactttacgagagctgtgtttagataaagtgcgtaatgccattattacgggctatttcccttcaggaaaaagactggttgaaagaacgttatgtgaagaacttggcgtaagccgttctgtcgttcgcgaagtgattcgttatttggaagcagaaggtttagtcgagattttgccaaacaaaggccctattgtttcgctacttaactgggacatcgcttcacaaatttatgaaattcgtcttttgttagagcaaagtgctgtggttgactgcactaaaaatctagatgaaaaaactgctgaaaaattaaagcttctattagaagatcttaaagctgcatttgctgccgatgacatcaatctgattattgcgacctcaacccagctttatcaaaccatctttactacagccaatcaccatattgcttgggaagtggttcaacgtttaaacggtcgaattagccgtcttcgtgccatgaccatgaaatcgacaaagcgtgaaatttcaggttatcaacgtattaaaaatatgtgtgaggccatctatcttcacaaagaccctgaaaaggcaaaacaagcggttgctgaacatattgctgaagctgctgctgtcgcaaaaaatattttagatgcgtga

SEQ ID NO: 2490 - DNA, 675 bp, Acinetobacter baumannii
ataaatatgaagtattttgttttaagtgcgacgcaaagtagtctttgtccaatttcacttgtggatgatgctgttctatatatgaataaagagcaagctagccaaaatatcgaatgtggatctttaccgtggtatagttataaaactagcaaaaactgtgatttacctatcgaaggtgtacttatcttaaaaagtaaaaaaatagaaataagtattagaaatataaatgaaaatatatatgttgttgatgagatttttaaaaatatttttggaaaatatattaattctgattttataagggttgaagtgttgagtgagagtttggaaaaaataaataacaaaaattattatatttttagatttaatcaaatttttgattttaaaaatgtcttagatttaaataagtcaacttatagattggataatgattttttagttttagaaaaggcagagtttttaagtgatttagatattgatatattgaaaattgataatatggattctgctcaagatactttttttatcagtgagttcgttaaaaaagaaattgaaaaaaataaatatcaaggtataaatatttttgaacttactttggctcaatggagagattctgatgatttcagttttatgtttttgagcgaagatgaggtgaataaatttgtatggccaatttag

SEQ ID NO: 2491 - DNA, 207 bp, Acinetobacter baumannii
tggagtatgaatatgaaactacttattgaaaatatgacttgtggtggctgcgcacgtggtgtgacagcaacgattcaggacatcgacccaaatgcaaaagtagatgtagacttagcgaccaaaatcgtgactgttgaaagcagtgaaagcgtcgataaaattaccgaagcacttgaagaagatggtttcccagcgaaagtgcaataa

SEQ ID NO: 2492 - DNA, 957 bp, Acinetobacter baumannii
aggagcatgaacatggacgttatcattcaaaaaattcaccagctcacctcgactattcgtgcatttgaattggttgcagcaaatggtacggagctgccgagttttgaagcaggtgcacacattgatgtgcatctaaaaaacggcctcacccgtcagtattcactttcaaactgctgcactgaaaaacatcgttatgtcattggtgttttacatgatgccaattcacgcggtggttcacgttgtatccatactgaatatcgtgaaggcgacctcttaaaaattggtgaaccgcgtaatttatttgaaattcaccctcacacaaagcaggcggttttatttgcgggtggtatcggtattacccctattttgtcgatggcatatcggcttaagtcggccaatattccttttgaattacattacttcgttcgtagtcatgaaatgattgccttctatggcaacttaaccgagcactttagtgaccaaatccattttcatattcaagatcaaccagacaccgaatgtaatatggtagaggctttaggccaagcttcacctgataaacacttatatgtatgtgggccaacagggtttatgcagtttgtcatgaacgcggccgaacaagctgggtggcatagcgaacagttacatcaagagcattttgtcgcgcaaaaagcagatacgtctaatgatgaagctttcacgattgaagtgaaaggtacgggccgccgaattgaagtattgccagagcaaaccgcaacagaagcattaattgcaaatggttttgatattcctgtttcatgtgaacaaggtatttgtggtacgtgtattacccgcgtggtagaaggcacgccagatcatcgggatctatttatgaccgatgaggaacatgcactaaatgaccaatttacgccttgttgttctcgtgcaaaaactaaacatcttgtgattgagctttaa

SEQ ID NO: 2493 - DNA, 786 bp, Acinetobacter baumannii
gttggcatgaaaattagtttgttagggagtgggcgtgttgccttccatttggcaaaggcacttttggctaagggacataacatcgtacaagtctatgcacgtgattttgagaaaaccaagaagtttgcagagcaaattcaagcgaaagcatgtcagtctcttcaagagtttcaaccaagcgatttaattattctagctgtttcagacagtgctattactgaacttgcaacgcaggtacacgagttatttcccgaaatgcttatggttcatacttcggggagtacagacattcaagtcatcagtcaggtacatgaaaaggcaggggtgttttatcctttgcaaacgttcagtcttgaaagagacgttgattggcaagccacaccattatttgtagaggcgaccaataaagatgacttagcaatactttctgatttagcaaatagcctaagtaagcaagtgtatcaatacacctccaaacaacgtttaactttgcatttggcagccgtatttgcctgtaatttcagtaattattgttttgatatggcaaagcaagttgtagatgcggagcaggtcgactttggcttgctttacccattaattctggaaacagcaaaaaaagctactgaaaatgatccaaagcaaatgcaaacaggacctgcaatgcgaggagatcagaatatcttggtaatgcatcaaagcttattagcccaagcaaatcgagatgatttaaaacaggtttatcaacttttaagtgatggcatcgtaaagcgccatcactcatcttaa

SEQ ID NO: 2494 - DNA, 429 bp, Acinetobacter baumannii
attttaatgaatcaactagaattaattctaaaaacctttcatgagtatgagtttaaggaaggtttagatgatttattctatttatcaggtaactttctcaaagaaatttatccaacgattatgctcgaatatgaccaagatacagcattcttcatggctttaaaaaccttattagaaagtggtgatatttctctattttataatctaaactttgaagactcatctagagatggcgaattgctaactggatcagcagaagaacaaattaagcagttaaaaaaagtctggatcggcagtgatgctatcaataagatggatgaggaaaataattacataggatggtacttcttaatacagtgcccttatgcattagctcacaaaatttatgataaagatggaaacttcgaacattggttttgtactggctag

SEQ ID NO: 2495 - DNA, 774 bp, Acinetobacter baumannii
ataacaatgaatcaaaaatatcaaattaaactttcacaacttataaaaggctgttttatatatacaattgcgaattatgctttagcacagcctatagttgtagaaggtatagtgccaaatgaagcaagtaaacaggctattttaatgaaaatgcagtctgtttatggtgcagatcaggttgtcgataaaatacaagttcgaccagttgccgctccaaatggatggagtgactctgtcacacgagtgattacacctgatcttaaaaaagtttctcagggtaagttaagtgttaatggaacccgatttgaactgaccgggaaaatgctaaatccgacagaaatacagccaaccattcagtcttttcagagtttggtacagcctccatatcaattattttcccagctttctgtaaatcaggctgagcagaagattattgatgatgctttaaaaaatcgaattattgaatttgaatctggtagtgcaatattaactgaagctgggcaaaaaattcttgatgaaatggctgtggctttaaataaagtgggcgggaaaaaagtcaaaattgtggggcataccgatagttctggtgatgcgaccaaaaacttaaaactcagccaagatcgagctttagcagttaaaaattatttaattagtaagaatattcctgctgatcatttatctaccgaaggtttaggttcatctaagcctgtagcggacaatacttctgcggaaggtaggaagaaaaaccgccgaattgagttcaccgttttatag

SEQ ID NO: 2496 - DNA, 201 bp, Acinetobacter baumannii
ttccaaatgaatgataaagaactgacttttaaagaaggtcatgacattttaaagcgaaatgccgaattacttgaatctcaggaaagcccggatattgataatttgatgaagattgttgaagaatccattggtgcttataaagcttgcaaatctcgcattgaagcagtccagcaagctttagatgaaacttttaaagaataa

SEQ ID NO: 2497 - DNA, 483 bp, Acinetobacter baumannii
actcgaatgaacttagatcggctttatccatacggatttcgttcaactttatttgatcgcttaattccagaaagtgaagattatgcaaaaggtctttctattcagcaattaagagaatctgtagcaaaggatttagaagatttgctcaatagtcgggtagcaaagttagatcatgtgattgatgactatccacttgtaaaaaaatcgatacttcagttcgggattattgattttgtgggactttctacagccaaccctctggatcgggataaaatttgccaatccattgagcaatcaatagcagctcatgaacctcggctaagacaaatacgggtagagatgttattagatggacataatatgggcgcattatgtttaagtattcaggcttatctaaatattcaccccttatatgaacctgttgtatttgatgcattgttaaaaccaacaacgcagcaatatgtaatttcagcaagaacttaa

SEQ ID NO: 2498 - DNA, 189 bp, Acinetobacter baumannii
aacttgatgaatactgttcaacatctttataggactaaattatattttgcagtattttataaaatacatacaaatctgtctatttcattagcagtgaattttaagtgtaagagacacttcttatcagtgcataaacaatattttcgaaacttaaatataataaaaataatgtttaattttatatattaa

SEQ ID NO: 2499 - DNA, 234 bp, Acinetobacter baumannii
atgattgtgaatatagtaaatgagtggcaaatcgccacagccgtaaatggcaatgaaattaatgtgaggattgttcctcacgtccgtaagcaaaactcgcttgatggttatcgttgggttgaggttggaaagaaaattcagcttcaaactggtgaagaaattgagttaaaccaagacggaaaaagcttttatgctgggtttaatcaactttatcgtttaaatacatattgttga

SEQ ID NO: 2500 - DNA, 2682 bp, Acinetobacter baumannii
ccaaattcgaaaatatggagtgacttggttgtgagtactcgtttaatgacatctgctgaaattcgtgaagcatttttgcgctactttgaaacgcaagggcatacacgtgttgcatcgagttctcttgttcctgccaacgacccaactttattatttacaaatgctgggatgaaccagtttaaagactgttttttaggtcttgaaaaacgtgattatgtacgtgcaacaacatcacaaaaatgtgtacgtgcaggtggtaaacataacgatttagataatgttggttatacagctcgtcaccatacattctttgaaatgttgggtaacttctcatttggtgactatttcaaacgtgatgctctcaagttcgcatgggaatttttaactagcgaacaatggcttgctttaccaaaagataaactttatgtcacggtttaccatactgatgacgaagcttatgacatctggaataaagaaatcggcctagcaccagaacgtattatccgtattggtgataacaaaggcgaaaaatacgcatcagataacttctgggcaatgggtgatacaggtccttgcggtccatgttcagaaattttcttcgaccacggtgaacacatttggggtggtttacctggttcacctgaagaagacggtgaccgtttcattgaaatctggaacaacgttttcatgcagtttaaccgtactgctgatggcgtacttcacccactccctgctccatctgtagatacaggtatgggcttagagcgtatttctgccgtattgcaacatgttaattcaaactatgacattgacctgttccaacacttattaaaagctgctgcaaacatcattggtattgaagatgaaggtcagccttctttacgtgtagttgcagaccatgcccgctcttgctgcttcttaattgctgatggtgtaaacccaagtaatgaaggacgtggttatgtattacgtcgtattatccgccgtgctgtccgtcacggtaacaagcttggcgcaacaggtacgttcttctacaaaatgttgcaaccattaattgaagtgatgggacaggcttatcctgagttagaagctcgccgtgaagtcattgaagcaaccttaattcgtgaagaagaacagtttgctaaaaccttagagcaaggtttaaaacttcttgaaggtgaacttgctcagttaaaagataaaactattccgggtgcgactgtatttaaactttacgacacttacggtttcccaacagatttaactgctgatattgcacgtgaacgtggctttattattgatgaagcaggttttgaaattgaaatggctgcacagcgtcaacgtgcgcgtgatgctggtaaatttgctgttgactataacaacattgtaaaagttgaaggcgaaactcaattcgacggttataccaacacaaccggtcaaggccagattgtagcgatctataaagatggcgtacaagttgatgaagtttctgaaggcgacgaagcacttatcgttttaaaccaaactcctttctatgctgaaagcggtggtcagattggtgatactggtatcttcaaaaacgaaacaggtatttttgaagttcaggatacgaaaaagtctggtggtgcctttgttcatcaaggtattgtgactgttggtaaccttaaaaccagtcaaaatgtagaagcgattgttaaagcagacattcgtgaagctactgcgcgtaaccactcagcaactcacttgttgcatgctgcccttcgtcaaattttaggttcacatgtacaacaaaaaggctctttggttgcaagtgatatcttacgttttgactttgcaaatgaccaacctgtgtcatttgaacaactacaacaagttgaacgtctcgtaaatgctgaaatcattgcaaatactgctgtaacaactgaactactcgacattgaaactgcgaaagcaaaaggcgcaatgatgttgttcggtgaaaaatacggtgatgaagttcgtgtgctctctatgggttcagtcattgacgagaaaaacttctcaatcgaactttgtggcggtattcacgtaaaacgtacaggtgatattggtttattcaaaatcacttctgaaggtggtgtagctgccggcgtacgtcgtattgaagcagtgaccggtactaaagcattagaagtagtacaaaaagctgatcatgatattcagtacattaatagcttattaaaagcacagaaagaccaaacggttgagcgtgtacaagccaatgtagaattggtttctgcattacaaaagcagattgaacaactcaaccaaaaattggcaaacttccaagcggctgatttgattgaccaagttcaaactattgctggtcgtcaaacgcttattactactgttcagggtgttgatgccaaagcgcttcgcaacttacatgacagtgtcaaatcaaaattagagaacgcagtgattgtgttagcaggtgtagagggtgacaaagtcagcctgcttgcatcagtcgcgtcgcaatacactgcaaatctaaaagcaggtgatatcatcaaacatttagcgaccgagttaggtggtaaaggtggtggtaaacctgacttagcacaaggtggcgcgccacttaacgagaagtttggacaagttatggcagcattacctgcttggcttgaacaaaaataa

SEQ ID NO: 2501 - DNA, 573 bp, Acinetobacter baumannii
aaagtaacgaaaatgaaccatgttgagattgccgtgcagaaggatactgttcctacttgcacagagttatttttaggttttttaacattaggtttaattggatttggtggtgtgctgcctttagcccgtaaagttattgtagagcaaaggcattggttaagccctgaaaaattcactgagttacttggtctgtgtcaatttttaccgggcggcaatattattaatttatcggttgcgattggcatggagtttcgcggtgtccgtggagcagtgagctcactcattggtttaatcttcgcacctaccgtaattgttgtacttttacattatgtctatgagcagttccaagacaacttaatggttaagcacctttttgaaggtttaggagcagcagcagcagggcttctggttgcaacaggtttgaaaatgcttaagcccttattacgtaatccattagcaatctgtgttgtggtagcggcaattatcagcattgcttttctaaaaattcctttatttttgactatgctgattttacttgcgttttattcagccatcatttggagacgtgtgtaa

SEQ ID NO: 2502 - DNA, 936 bp, Acinetobacter baumannii
ttcatggcgaaaaataaagacaaagcccaacttgcacttggggaccatgcggcccgtcaactggccaatgcaactaaaacagctccccagctttctacaattactccccgctggctgactcacttacttcaatggattcctgttgaagcaggtatttatcgcctaaaccgtgtcaataataccgatgatattcaagtcgcttgtacacaacgtgatgaagcaactttacctcaaacttttgttgattatgaccctgagccacgggaatactttttaaatggtgtatctacagttttagatgtgcatacacgtgtagccgacctttacagcagcccacatgaccaaattaaagaacagcttcgcttaaccattgaaaccattaaagaacgtcaagaaagtgagcttatcaataaccctgaatacggtttactggcaagtgtgacagatgaccaacgtatttcgactttaaatggcccacctactccagatgatcttgatgatttgctacgtaaagtctggaaagaaccgggatttttcttagcacaccctgatgcgattgcagcatttggccgtgaatgtacacgccgtggtgtaccgcctccaacggttagtctgtttggttcgcaattcattacatggcgcggtattccacttattccatcaaataaaattcctgtagaagatggcaaaactaaaatcttgctgcttcgtgttggtgaaaagcgtcaagggattgttggtttgttccagccgggtcttgcgggtgaacagtcaccagggctttcagtacgctttatgggaatcaaccgtaacgctattgcgtcgtatctaatctcgttatattgctcacttgcagtactcactgatgatgcgttggcagtattagatgatgtggaggtggacaaatatcatgactacccagttaactacaagtaa

SEQ ID NO: 2503 - DNA, 573 bp, Acinetobacter baumannii
tttattgagaagaaaatgatcgattttgttaaagaactatctgcctgccgtgttgagggaacaaaacttcctttttatcctgaaaaagtacaaggttatactgagaaagaggtagagttgattgctaaaaatcttaatcttgatatacatggacaatttagagaatttcttcttcaaatggggaggtgttctgggggattaatatggagtgatgagttctatatgtataaaaatttatggaacccaaacaagtttagacatgctcaacaatctgaaaaagaagatttgggttatatattaacaagtaaaggtaaactagatcctgttgatatgaaaatgttttacttatcaagagagtatgagacatatttttactatctattaactgctgaaaatgatgactttatatggtcattacatgatgctgacgactgtgtattagaaaaaacaaatataactttattagagtatttaaaagattatgtttttgaaaaaaataaaagaaatcgatttgtagattttggtttaacagaagaacaaattaatagatctattacaggtcgtttgttatag

SEQ ID NO: 2504 - DNA, 804 bp, Acinetobacter baumannii
caggtggagaaattatctatgtcaaaccgtcaaagatttaccgataaagttgtgattgttacgggtagtgcccaaggtattggccgcggcgtggcattgcaagttgcagctgaaggtggacaagtcatcatggctgaccgctctgaatatgttcaagaggttctcacagaaattcagcgtgcaggtggtgaagctgtcacgattaatgctgacctagaaacctatgcaggcgcgcaagctgttgttgcaaaagctattgaacactatggtcgggtcgatgtcctgattaataatgtaggtggcgcgatctggatgaaaccttttgaagagttttccgaagaagaaatcatcaaggaagtgaatcgctcattgtttccaactttatggtgctgccgcgctgtgctacccgccatgattaagcaacaatcgggtgtgattgtaaatgtatcttccattgccacccgtggcattaaccgtattccctactccgcatctaaaggtggggtaaatgccctaacagcatcgcttgcttttgaacatgctaaagacgggattcgagtcaatgctgttgcgactggtggaaccgaagcgccacctcgcaaagtaccacgcaatgccaacccgttaagtcaaaatgaaaaagactggatgcaacaagtagttgatcaaacaaaagatcgaacatttatgggccgttatggcacaattcaagaacaagtcaatgcaattttatttcttgcatcagacgaagcatcgtatatgacgggatcggtcattccggtcggaggtggagatcagggttaa

SEQ ID NO: 2505 - DNA, 918 bp, Acinetobacter baumannii
atcgtatggaatatcatttacttcgcggtatttttagtcgagtccaagccctcacaagcggcaaatggaaaaaagcatcatcggacaaggaggatcaatccaatgcttaaacagcttaaagaagatatacaggctgtattcgcgcgagatcctgctgcacgaaatacactcgaagtacttaccacttacccgggtatacacgctttacttttgcatagacttgcacatgaattgtggaaaaaagattgcaaaggtaccgcccgttttgtttcgtcatttagtcgttttgcaacgggtattgaaattcaccctggtgctaaaatcggcaaacgcttctttatcgatcatggcatgggcgttgtaattggtgaaactgctgaaattggtgatgatgtaacgctataccacggtgttaccttaggtggtacgacttggaataaaggtaagcgtcacccaactttagaagatggcgtggttgttggtgctggtgcgaaaatcttaggtccatttacggtaggtaaaggcgccaaagttggttcaaatgcggtagtcacaaaagcagttcctgctggtgtaacagctgttggtaaccctgcacgttatatctataaagatgccgacaaaactaaagataaagatgaagaacgtcgccgtgattatgcacaaagtattggttttgctccgtatgcgactactgctgatcaatctgacccaattttagaaggaatgcgagttttacttgaccgtattcagcacaatgaaacgcgtatgaataatttgtgccagcgtttgtccgaacttgacccaactttcaaaaaagaaagtcaagatgaacagccttttagtgatgaagagctaaaaattcttgaagaagttcgtcgtgaatgcggtgcgcaaaacaagacatcaaaaacgtaa

SEQ ID NO: 2506 - DNA, 420 bp, Acinetobacter baumannii
cacttaaggaatactcgcacgagtagggagacgtttgtgcaaaaaatggaaaccactgcggttgatcaattcgcagagctattgggtgtacaagtgctgcatcgcagttttgatgaagcgcgttgcaagcttaatgtaaaagacgaacacatgaatgccttaggcggcgtgcatggtggcgtcatattttctttagccgatattgcttttgcgatggcttgtaatgcaggggatgcgccatatactggcctacaagctgatattcgctatatgagtggtgcgaaagataaggtgttatttgcaacagcaaccaaggtcggaagtagtaaaaaatttgcgcattatgaagtgttgataacagacggtttaaataatagagtcgctttatttacatctacgtgttataggcttgcgccgtga

SEQ ID NO: 2507 - DNA, 825 bp, Acinetobacter baumannii
agcataaggaagagcgcaatgtataaggatattaaagtcgacccagctcagcttgaagccgcattagatgcacgtttaaaaatccgtgcaggtttcgataaaccaaccgcgggtatggctgcgggtatgacgcaggtcaacatgatttcggtgccaaaagagtgggcgtatgactttttactctatgcacaccgtaacccgcaaagctgcccggtgcttgatgtgctcgaagaaggcatctatgcaactaagcttgcagcagattcagacattcgaactgactttccacgttatcgcatttggaaagatggcgaaatggtcgatgaagtgaccgatgcgagagaaatttataacgctcatcctgatttggtgactttcttgattggttgtagtttttcgtttgaaacagctttgcaagaagcgggtattgaagttcgccatattcatgacgataccaatgtgccgatgtatctaagcaatataaagtgcgaaccggcagggcgtatttcaggaaatatggtggtttccatgcgaccaattccatctcatcaaattagtgaagcagtaaaaattacagcgcgtatgccaagtgtacacggcgcacctgtccatattgggcaccctgaaagattaggcattaaggatgtaaataaacctgattttggtgatgcttcacgcatagaagcgggtgaaattccagtgttttgggcttgtggggtaacaccgcaagcagcagtcatgaactcgaaaattccttttgccattagtcatgctcctggttacatgtttattaccgatattcctgaccgcgcttggataggctaa

SEQ ID NO: 2508 - DNA, 366 bp, Acinetobacter baumannii
aaaaaaaggaattttaaagttatgaatgaaaatgcagaacttataaagtacattgatgtcgctgaaagtgtttatgagcgggtatacgaaaataaccaaatttctaacagcttggttgttaacttaaatcgtgtaatggacgaaataaaaaaacaagctaaagaaaaaaatttgaagttgaaatatccttctattgattttgaatattgtttaagtctgcctttagcagatagagatgtaaaagtagatttaagtttgattcctcattttgagtatcgtgatgaatgtattttgtggctaacaaactttattggaaaaattagtgtgcctcaaaagatgaataggcaacgattaaactctcgttaa

SEQ ID NO: 2509 - DNA, 363 bp, Acinetobacter baumannii
attagaaggaaaaacacaatgaataaattacttgttgctttaggtcttgctgcgactgttgcccttgttggttgtaataaagataaagctccagaaactggcgcgactacaggtgaacacttagaaaatgctgctcaacaagcaacagcagatatcaaatctgctggtgatcaagctgcgagcgatattgcaactgcaacagacaacgcttcagctaaaattgatgctgctactgaccacgctgctgatgctactgctaaagctgcagctgaaacagaagctactgcacgtaaagcgactgctgatacagctcaagctgttgaaaatgcagctgctgatgtgaaaaaagatgctcaacactaa

SEQ ID NO: 2510 - DNA, 303 bp, Acinetobacter baumannii
gttatagggaaatacgatatgtctgcgtactggattgctcatgtcaccattcatgatatggaacaatataaacaatatatggccactgctccgcaagcttttcaaaagtatggtgccaagtttcttgcgcgtggcggtgcctcggaagtcttagaaggacaagagtttgaacgtcatgtggtgattgagtttccagatatggaaactgcacgtgaatgttatttttcacctgaatatcagcttgccaagagcaagcgccaaggctgctgtgatgtcatggtgagttttgttgaaggaatctaa

SEQ ID NO: 2511 - DNA, 2676 bp, Acinetobacter baumannii
atttttcgtttttttaagggtttattacgcatgaatagcgctgaaatcatggctgatctctccaaccacactccaatgatgcagcaatatctcaaagtcaaaaaagactatcaacatgcgttgctgttttatcgtatgggcgacttttatgaattgttctttgaagacgcgcatttagcagccaaacttttaggtattaccttaacccatcgaggtaaagcaaatggcaacccgattccaatggcaggtgttccctaccattcagccgaaggttatttggcgcgtttagtaaaagccggccgaactgtagctatttgtgagcaagtcggcgaagttactggcaaaggcccggttgagcgcaaagttgttcgtattcttacaccgggtactttaaccgacgacgcactacttacaagttatcaatcgtctaaccttgttgcgctatgtatccatcaaaaccagatcggttttgctttactcgacttaagtgcgggtatttttaaagttcaacaacaagactacaaaccggaacaacttccaatcgaactggctcgcctcatgccaagtgaaattttgattgatgaagatctggttgacccgaatattatcgaacaaattaaaaagcatttagattgccctgtaaccaagcgcccgaatgtcgattttaatttaaacaatgcgcaaaaaaccttatgtgaccagttctctgtatcaacactctctggtttcggactagacccgttacctttggctaaagccgccgcggcagcacttattcactatgccaaagaaactcaaaaaacggcgttacctcatatccgttcaattcttttagaacaaagttctgactttattgcgctcgacccaatcacgcgccgtaacttagaaattattgaacctttgtttgagcatggaacttctttatttcagcttgtgaacgattgccaaaccgcaatgggtggacgtttacttagccgaacactcatgcaacctgttcgtgatacagcattacttgatgcacgtttagatgcgattgagcaattgattcaaggctaccatgaaagccctgttcgtctggtacttaaagaaattggtgatattgaacgtgttcttagtcgtgtggcgctgggtagtgcgcgaccacgtgatttagttcaacttcgtcatgcttgcgcgcaaattccatttttaagaaatgctttagcacctgttgtacaagcaaagaaatctaagttattaggacagctcgatcaggaattgggtgactttaaagcgcttcatcaacatttaatggctgcgattgttgaaaatccgcctgtattacttcgtgatggcaatgtaattgcagaaggctatgatgctgaacttgatgaattacgtcaaattcgtgatcatgcaggtcaattcctcattgatttagaaataaaagagcgtgaacgtactggtattagcaccttaaaaatcggttataaccgtgtgagtggttactacattgagctgactcgcgctcaagccgagcaagccccggccgactatatccgccgtcaaaccttaaagaatgctgagcgctacattacgcctgaactaaaaagttttgaagataaagttttatccagtgagtcgcgtgcattagctcgtgaaaaagcattatttgaagctttacttgaaaaccttcgtgaaaatattgctcacctacaaatgatgagttcagcaatcgcacaaattgatgtaattgcaaactttgctcatcaagcgcgtttaaataattgggcacgccctgaatttacaccagaaacaggtattaagattcaaggtggccgtcatcctgtagttgaagcgttaagtaaagcgccatttacaccaaatgatactttccttgatgtacagcaccgtatggcaattattaccggtccaaacatgggtggtaagtctacctttatgcgccaaacagcattaattagtttgcttgcttactgcggtagttacgttccggcacgagctgccaaacttggcccgattgaccgtatttttacccgtattggttcagccgatgacttatcgacaggcaaatcgacctttatggttgagatgactgaaacttcacaaatcttgcaccatgcgacgaatcaatcgctcgtgttaatggatgaagttggtcgcggaaccagtacctacgatggtctttctttagcgtgggcttgtgtggttgatttaactaaacgcgttaaatgtctttgcttgtttgcgactcactatttcgaattaacagagttgggtagcgaacccggtattgataactaccatgtcactgctcaagagttaaatggtaatctcattttattgcataaagtccaacaaggaccagcgagccaaagtcatggtttacaagttgcaaaattagccggtattccagctaatgtgattaaagaagctcagaagcgtttacgtattttagagaagcaacaacaacagcacttacaaactagtgttcaaagtgatttgtttgcaactttagattcagaagttaccccaagcactcaagttatagagaaagtgattgaagttgaagtctcttcacctgccctcgatttacttaagcaaatcgaagtagacaacctgactcctcgtcaggcacttgaacagctttatgagctaaaagcagcgcttaattcataa

SEQ ID NO: 2512 - DNA, 744 bp, Acinetobacter baumannii
ctcatgctttttcgtggtcgtaaatttttttggggaatggcttgtcttcaagcattaattgctactacagggcatgccgaaatagtacttcatggtacacgtgtaatctatccatcagatgctcgagaagtaaacttacaactcagcaataacggtacagcaccttccttggttcaagcttggattgatgatggaaacgctaaatcaactcccgatgaagcgaatgtcccttttatcattacaccacctatttcaagagttgaaccctctaaagggcaaactttacgaattactgcactacctaatgcttctcaattaaaccaaaataaagaaagtgtattttggcttaatgtattagatataccaccaaggccggaaggtaaaaaacaagaaaataatgaagtattaaccaataattttcttcaattagcgatacgttcacgaattaagttcttttatcgaccagtaagtctaaaagaaaatattaatacattaagtgaaaaaattcagtgggtaaaaaatggtgaaaacttgcttattaaaaaccctactcccttttacattacaataagctcaatttttcaagaaataaatcatcaaaaaacagatttattaaaacagggtttaatgctctctcctttttcagaagatcaaataaaacttaaaaatagcaatataacaaatatgagctttgtttatataaatgattatggtggaagaattgaacaagtaataaggttctaa

SEQ ID NO: 2513 - DNA, 726 bp, Acinetobacter baumannii
atcatgtttgatatgcgtttatctcatgagcgtggtgcagcacatcatggctggttacagtcaaaacacacgttttcatttgcaaattattgggacccgaaacaagtaggcttttcagatttgcttgtgattaatgacgatactgttgctccatcgaaaggttttggtactcaccctcaccgcaacatggaaatcatttcttatgtgcttgaaggtgcgttagaacataaagattcaatgggtactggctcggtgattgtgcctggtgatattcagttaatgagcgcaggccgtggggttgcacatagtgaatttaatcactctactcaagaaaacgtgcacttcttgcaaatttgggtagttccaaatgaagtgaacacaacaccgggctatcaacaattgcatatttccgaggaagacaaacgcggcaaattgcacttgatgatttcaccaaaaggtggcgaaaaaactttatccatcaaacaagatattaatatttattcaggtctttttgatggtgaagaaacagcagagtttgcaattcctgaaggtcgttatgtttacctacatgtggcaaaaggccgtattgatgtaaacggtaaaacctttaataccggtgatgctgcgcgtattcgtgatggaggcaagttatcatttaccaatggtgacaatgctgaaattctgatttttgatatgcgtccggaagaaattccaaccatgccataa

SEQ ID NO: 2514 - DNA, 1251 bp, Acinetobacter baumannii
agagttcttgagatgaaactttatcaagccaccctattttctttggttttatttacgagctttgcacaagctgatgcagaaaacagccaatggattaccacttggtctgcgagccctcaaaaagtctggaataaagacttcgtttttccaacactcattccagagcaagtatctaatcagactattagacaaaagagcaaaattagtttgggcggtgaagctgttcggctcgtttttaccaatcaatatggtgaacagccactttatattgatcaaacaacgattggtttagcgaacgcagcaactctaaaatctaagagcacctatcccgtttatttttctggtcaacttaaagcaagaattttacctggcaaacaactcataagtgatccaattcagttgcctgtacccgatcatgctcaattggtggtgaatagctttattcaaaagcctacaacgtttaaaacatttcattgggatgccaaacaaactagttggctgattagtggaaatcagacaacaagtttaactacgccaaccgatgccaaaacaacgacggcacggttattactatctgcaatagaggtaaagcccaaacaaaaggctcatgtagttacagttgttggagactcaattaccgatggggcgactgcaaccttagatgcaaatacaagatggaccgattttttagcgaaacgtttatcagcacaccatgtagccgtgattaatagcggaatttcaggaaatcgattacttaccgatggtatgggcgatagggttttaaaacgcttaaacagtgaagtatttcaatattcaggggttaaaactttaattgttttggtcggtatcaatgacatttcatggcccggtacagcttttgctcctaaacagcaaataccttcttttgaagcgctcactcaaggttatcgacgtgttgtaagtgaggcccataaacataatattcaggtgattggtgcaaccttacttccgttctctggtgctttgcctaatacccctttagataattattatcaacccaacaaagatcaattacgtcagcgcattaaccactggatgagaaccagtcatacctttgatggtgtgcttgatcttgatgaaggcttaaaagatccaaaacatcccaatcgattaaatccaatttatgattctggagatcatttacatcctaatgatcgaggcaatcagcatatggcagaattggtagatttagatcaaattattaaaaattaa

SEQ ID NO: 2515 - DNA, 1095 bp, Acinetobacter baumannii
atgagtattgatatttctgaactacttaaacccattaatgacagcttgctttgtggtgaggattattcattttctaatgaatttcacgagataaagaaagccagaacacaggatgatctattattagatcagggggattgggttgctgaacggaagcaggcagattgggactttgttgcgaagagtgtaagcactttgctcattgaaaaaaccaaagatatccgtctattaacttgggtaatagaagcctggactcatctaaatggttttgaaggcatggtaaagggaatcactttaactcataccatgctgaaccaatattggcaggatattcatccgattattgaagatgatgatttggatcagcgtattggtttattacaaggtcttattaatcagttgccaatgctgttgaagaaagtacctttaaccaatacagctccttattataacttgcttgattacgataattttctatatcacgaaaatatacgccgtaagcaaacagaagagtacgagagtcagtcaggtccatctgaattagaacaatttgatcaagcgatctttaatacctctaaaacctttcaatactcaaattatcaagagtttaattcggttttaacggagtggaatgttttaaaacagacactcgaccatttaatgggattagattcaccgagttttgctgcaattgattctgcatttgaaacaatacacagcactttacgtaaaatttacaaagcagaggcttttggtactgggcttgcgccgagtcaagaacaggccgctgtcatcacgacaccgtctatggaaaatcaagtgcctgtacaaatcgtatcagaccagcctatgtttcagccacaagcacaaactcacttggccaatcgcgagcaagcaatgaaagtgctgcaagaaatagctgattattttcaagcaaatgagccacatagtcctgtgagctatatgctccaaaagaccattaaatggagccaaatgccgctgcatgaatggttagcacaagtgattaaagatgagcatccattgcaaatggttcaggaaatgttaggtgttcaacctaaaaatgaatatgaataa

SEQ ID NO: 2516 - DNA, 879 bp, Acinetobacter baumannii
ttcatctctgatgtgaaaatttgcacaatgattgattgggaaaatttacattacttttcagttttttctgaagagaagacactttcagctgctgcaagaaagttaggtgttgaccatgctactgttgcaagaagaattgcccagttagaagataatttaaaactaaaattagtggaccgtagacctcgtacttatattttaacttcagagggggaacgtctggccaaaatcgtgacacgtatgatggaagaaacattttctattgaacgtctagctcaggcaggacaacaggaaattagtggagtagtttcggtaagtctaccgccagctacggctgcacatttggtaatgcctcatcttggtaagttttatcgtcaatatcctgagctacaattgagaatactcggtgatgttcattatgcctccttacagcatcgcgaagcagatatcgcagttcgctttggacgccctaaagatgattatctaattgcacgtaaagctggtgaagttccttttggcatatatgcagcccaagaatatttggatgctatacaagaagaaaactatgaatggatttgcgttgaagttggtggagttcaaggacaaaaacagcaaaagctaaaacaacggttaaattataaagagccggttatggttacgaatcatcctgagcttcaatggcgggctacttgtggagcagttggcttagctgtactacctgattttttaggccagcaaggtcatttagtaaaattacctgatgatgacccaatgagtgctgaaatttggttagtaattcatgaagatctgcggagtagtcctgcagtaagggtagtgatggattttcttttagattgttttgaatcttttcgtgtttaa

SEQ ID NO: 2517 - DNA, 477 bp, Acinetobacter baumannii
cttattactgatgatcggttaggaaacccaatggcgaactctaaactgatgaaagatgaaccttgtcctgttgcgcgctgtgtcaatctcataggggatcgctggtcactgcttattgtgcgcgatgcttttgatggaatgcgccgttttggagatttccagcgcagcttgggagtggcacgaaatattctttctgaccgactaaaaaaattagtcgatgctggtgttcttgaactacaagatgcttcagatggcacggcttatcaagaatatgtattgaccactaaaggggagagtttgttcccagtgattgtggctttacgacaatggggagagcacaacctatttgaaagtggtgagcgtcattctgtgttaattgataaaactacaggtcagcaaattccatttatgtcaccagtcgcggcagatggaacagtgttgagagcttctaatactgaagtgcaaaaggtgaaataa

SEQ ID NO: 2518 - DNA, 615 bp, Acinetobacter baumannii
ctgatgactgattctttactcaagtaccgcgagcaacataaacaccgtttaaattatatgccatggctatattggacattgaaacccaaacaccgtgtttgggcggaagaatggcaaaaagaatatcaggcttatttaatggatatggaaacggtcgagatcggggagaactgttttatttcaccgttagcccatatttttgccgagccgggacggaaaattaagattggtgataattgttttattgcggcagattgtagtttgcatggaccgcttgagattggtaatgaggttgcaattaaccaccactgtattttagatggtggtcgagcaggcataaaactacatgatcaagttcgtattgctgcttattgtcatctctatgcatttgatcatggcatgcaactcgaccgtccactttaccaacagcctgttcgctcacagggtatcgaaattgaaaaagatgtttggttaggtgcgcatgtggggattaaagacgggattaaaattggaaaacatgctgtagttggcatgaatagtatggtgacaaaggatgtggagccgtaccatattgtgggaggaaacccagcaaaatttatccgtttaagagaataa

SEQ ID NO: 2519 - DNA, 249 bp, Acinetobacter baumannii
gttgtatatgaaggctctatgagtttttggcaaaagctgttcttggcagatcaacagcataacgagcataaaaaccaaactgcttgtgttgaaaatgactgctcatgtaaaactaatgaacaacttctaagtgcgcttgcgcaagcgactgatgaagatgtcattaagggaatcaagaaagttcttatttcccgtggttatagccgaaaagagttaaatgaactcactcaaaaaccatctattcattaa

SEQ ID NO: 2520 - DNA, 531 bp, Acinetobacter baumannii
aaggtatatgaaatgtttgataaattaatgacagatcaagaaattaaagcgaaattatttgaaagaactagcgaaataaagaaatttggcaaactacctcagctcgatgataattatttatcttttttaggtaaatatagagaaatagaaattacacctgatattataattttggggtacgaaacagcattaaaagaaaatcaatatcttcatgaaaattatcctgaaattagtgagaaagtttggataattggtcgtaccggtcaaggtgatgaatggtttataggtaaggaaaaaaataatatcttgttttatgaccataaccaaggggagtatttgaatattaatcagtttatagatatgagaattacttttgaagactttcttaaaatggcattttcttatcaacaacttgaagaaaaattggatataaacgaagagcttaataaagttgaacaagatcaatttaagaaattagtcaattctattaatgaaggtttatatgaaagatatccctttgaatatttttag

SEQ ID NO: 2521 - DNA, 696 bp, Acinetobacter baumannii
atattggacctaatttatattaaccgattaaaagaaaacacatggtttagtgtgcttccggaagtattccaaaagtttattttagaacatggcaagcaaattacttttgagaaaaatagctatgttttccacgctcaagatgaatttgatggcatttataccgtccttgaaggctcaattagcttgggttatgtcgatgtaaatggtaatgaagcactttctgcgattgctgagccgattatgtggttcggtgaaatatctttaattgatcatgagccacggtcacacgacgcgattgctttgaaaaaaagtatagttctgcatattcccgcaaaaccattaaatgagctactaaaagaacatccatattattggtattattttgcacgtttaaccagccaaaaactcaggtacgttttcttagaacaaattgcgatacaaacacgcagtatttctcaaaggctggcacaacgtcttctgttcattttagaaggatacggtaaccatattcttattcaagatcatcacattcagatttctcaagagcaattagccaacatgctgactatatctaggcagacgatcaaccatgaattgagcctacttgaaaaacagaatattattaaaattgcttttagaaaaattgagattttagatattgaaaaattaaaagtaattgctcaagttcattcataa

SEQ ID NO: 2522 - DNA, 2541 bp, Acinetobacter baumannii
ccttcccatgatgggaatctgtatgctcaatacagaatattaaattttgcagatttgcagaggtgtttgatggactcaaaaaccacaaaattgccagcatatagtgaaacactctcaattgagggcatgacttgtgcctcctgtgtaggacgtgtcgaaaaagcacttaagaaagtcgaaaatgtagagattgccaacgttaatttggcaacagagaaagccgttgtttattcaaatcaaccgattcagcgtgaagcactggttaaagcagttgaacgagcaggctatgatgttccaaaagctgcgccagtggagttgtctattgagggtatgacctgtgcatcttgtgttgcacgtgtagaaaaagcccttaaaaaagtagagggcgttcaaaacgctacggtcaacctagcaacagagcaggcttgggtacaggcagatccatcagtcaatgttgaagacttaattcgtgctgttaaaaaagcaggttacgacgcgaaagcatctgaaaaaaatcaagatgagcaactcgataaaaaagcgtcagagttagatcagctaaaaaaagatttgatcatttcgattgtgttagccttacctgtgtttattttggaaatgggttcacatctcattccagcttttcacatgtgggtcatgcacaccattggtcaatacaatagctggcttttacagtttgttttaaccacattagtgctcgtttttcctggtcgccgtttttaccaaaaagggattccagccttatggcgtttggcgccagatatgaactcgctggtcgctgttggaactttagctgcctacagtttctcagtcgtggcaacctttatgccgcaggtattaccacaaggcacggtcaatgtttactttgaagcggctgctgtaattgtcagtttaattttactcggacgttattttgaagcaaaagctaaaggacgtacttcacaagcgattcaacatttggtgggaatgcagccaaaaactgcccgcattcagcgtgatggacaagtggtggaagttgcagttgccgaagtggtcagtggaactattgtagaaatccgtccgggtgagcgtgtgccagtcgatggtgaggtggttgaagggcacagctatattgatgaatctatgattacgggtgagcctgttcctgttgaaaagagagtaggacaacaagtagttgggggtacagtcaatcaaaacggtactctaaacattcgggcaaccgccgttggttcttcgtctgtactttcacaaattattcgcatggttgaacaagcccaaggttctaaacttccgattcaggggttggttgataaagtcactatgtggtttgtaccggctgtcatgctaattgctgcaattactttcttggtttggtttatttggggaccagagcctgcgctaacttttggcttggtgaatgctgttgcggtactgattattgcgtgtccttgtgcgatggggcttgcaacaccaacatcgattatggtcggtactggacgtggtgctgagctaggtgtcttgttccgtaaaggtgaagctttgcagcttttacaagaagcacaggtcgttgccgttgataaaacgggtacactcaccgaaggtaaaccgacactgacagactttaatgtgcaatctggctttgaacgtaaccaagtgctgactttagttgcctcagtcgaagccaagtctgaacatccaattgccctcgcgattgtacaagcagcagaaagtgaaggcataaacttattaccagtaacagcatttaactcgattacaggttcaggtattgaagcggaagtttcaggccataaagtacaaattggcgcagaccgttatatgcaccaacttggtttagacaccagctcattccaagcaattgctgctcagttaggtgaagaaggcaaaacaccactctatgttgctattgaccagcaacttgcagcaattattgccgtggcagacccaattaaagaaacaacctatgctgcgattgaggccttacatcagcttgggttaaaggttgccatgattacaggagacaaccgtcatacggcgcaagcaattgccaaaaagctgaacattgatgaagttgtggccgagtttttacccgagggcaaagtggatacagtccgccaactgcaaaaacaatatggtcgcttagcttttgtaggtgatggcattaacgatgcgccagccttggcacaagcggacgtgggcttagccattggtacgggcacagatgttgctattgaagctgccgatgtggtgctgatgtcaggtagtttaaaaggcgtaccgaacgcaattgcgctaagtaaagcaactatgcgaaacatacgccaaaacctgttctgggcatttgtatataacgttgccctgattccaattgcagcaggtgcgctatatccagcatttggtgtattactttcacctatgtttgcagcaggcgcgatggcactttcttcggtctttgttttaggcaatgcgttacgcttaaaacgctttcatgcgccagtacagtaa

SEQ ID NO: 2523 - DNA, 1053 bp, Acinetobacter baumannii
aaaattgatgagagcaacggaacgcatatgaaaattacctcagctcgtcaagatcaaggtattccaggagtctatggcttattgctattagatgtagtttcacgttggggatacaacgatgaaacattatttgctccttttcatcttactagtgagcaattggccgatcctgaatatcgtatttcaacacccgtagcaaatgagctggttaaacatgccttaaatcttaccggtgaaagtacactgggttaccatattggcactcaaatgcgtatttccattcacggatttattggctacgcgataatgacagccaaagatattacagaagcgattgctctcgctgcccgttttatccaattacgcttaccttttttacaattatatttttctactttcggaccaaaagccacattacaattgcaatgtgatattgagttagagcctcttcgtactgagatcgttttaggtttaactattggtattatgaccatggctaaagcgattacgggtattgaagatttagcaggcgatgttgatttagactttccagaaccggaaggttttgataagtatagaagcaagctaagcagcaccatccgctttaaccagcctcatctaatctctagttttgataaaaaatatttaggttttaagttagttaatgccgatccaatcgcaagtcaaattgctattaaccaatgtgaagcggaactatctgctttaggcgaacgccgccgtctagccatgcgtgtacgtgatattttaagtaattctgaacaacattacttaagcatagaaaatgtagcagaatatttacatatgtcagatcgtaccttaaagcgacaattggcagccgaaggtacttcattttctactttagtagatgaagttcgatatcgtcatgcgacctctctgctttcgcgtacagattatagtcttgaacaaattgcagatgaacttggttactcggatgtcgcaaatttcagtcgcgcttttaaacgctggagcggtcgcagtccgagcaactggcgcaaagacccctatttataa

SEQ ID NO: 2524 - DNA, 1230 bp, Acinetobacter baumannii
aacaaggatgaagttatggatattttaaagacacaggttgcaattattggttctggaccagcagggttattgcttgggcaacttctatataaagctggaattgatcatattattgttgagcaacgtagtgctgaatatgtggcttcacggattcgtgcaggaattttagagcaagtttcggtcgacttactgaaacaagcaggcgttgatcaaaacttaaaagaaaaaggattaccacattcgggcatcgaaatcttaaccaatggtgaaaagcatcgagttgatttggcagcgcttacaggtggtaaacaagtgactgtatatggccagaccgaagtcaccaaagatttaatggctgcgcgtgaagcggcacagctcacttcattttatgaagctcaaaatgtacaagtaaaagatttctacacggcaccaaaagttgagtttgagtaccaaggtaaagcttttcaaattcattgtgactttattgctggttgtgatggctaccacggtgtctgccgtgccagcgtgccagaagacaaaattaaaacctttgaaaaagtttatccgtttggttggttaggggtgttggccgatgtgccacctgtagccgatgaactcatttacgtacagtcagagcgtggttttgctttatgtagtatgcgttcagaaacacgtagccgttattatttacaagtccctttaacagatcacctcgaagattggtcagatgaaaagttttgggatgagttaaaaaaccgcctagaccctgaaagtcgtgaaaagttactcacaggaccttctattgaaaaaagtatcgcgccgttacgtagctttgtgaccgagccaatgcgtttcggaaaactatttttagcaggtgatgctgcgcatattgttccaccgactggagcaaaaggcttaaatctcgctgcatctgatattgcttatttatcaagcgcactgattgaatattatgccgaaggttcggaacaagggataaatgaatactctgataaatgcctacaacgcgtatggaaagcagagcgtttttcttggtggatgactcatttattgcatcgttttgaaactgaaagtgagtttgatcacaagattaaacaagccgagttaagttatgtacttggctcgatcgcaggtaaaaccacattggctgaaaactatgtcggattaccttatgagattaagcaaattgatagttttaagcacgcaagctaa

SEQ ID NO: 2525 - DNA, 717 bp, Acinetobacter baumannii
catcgaagtgacgtttttgatgatgtgtggcaacgaatgtcttcaggacaacaagttttactaaaactaagaaaaatgattatttcaggggaacttgaaggcggtgccagaattgccgagattcctactgccgagttacttggcgtttcacgccagcctgttcgtatagcctttcggttgctcgaacaagaaggtctcctcattaaaaacccaactcgtggttacacggttcgtgaaatttccggaaaactggtgcatgatgcacttgaagtgcgcggtgtgcttgaagggttggctgcaaaaactttggcagagcaaggcttaagcgaagagcaaaaaaagacgctgcaacattgcattcaagaaacggaacaactctttaatgaaacagacgagtttggtgatgctgagctagaacgttatcaccattttaatgtcatctttcatgacactattattgagggagcgcaaaacgttgcgcttatccaagccttagcaaaaaacaaccaattgccaatggcttctgcccaagccattacctatgaccagaatcaagctttatcggaatatcgccgtttgcactatgcacatttgcagcattgttcgattttcgatgcattggtaaatcgtcaggcagggcgtgctgaaacgttaatgcgcgaacacagtagtgtggtgattttaggtgaaaccctaagaaatgttctcagcgcttaa

SEQ ID NO: 2526 - DNA, 864 bp, Acinetobacter baumannii
aaaatgagtgattcaaactatattcctccacaagtttggcaatggactggagagaaaaccgatttaaaccaacctacctcaggtgctcgttacgaacatacacttccagtaggaaaacatccgctccaactctactctttagcaacgcctaatggtcaaaaagttactattttgcttgaagagcttttagcgttaggacataaagatgctgaatatgatgcttggctgattaaaatcggagaaggacagcaatttggtagtggctttgtagacattaatcccaactctaaaattccagcattggttgaccatagccaaaacccgccattaagagtgtttgaatctggctcaattttgctttacttggctgaaaagtttaaagcgtttattccgactgatattgctgcacgtactgaatgcctcaattggttattctggcaaatgggcagtgcaccttacttaggtggtggttttggacatttttatgcttatgcccctgttaaaattgaatatgcgattaaccgctttgcaatggaaacaaaacgcttacttgatgtattagatcagcatctggcaaaaaacgaatatttggcgggttctgaatatagcatcgctgatattgcagcattcccttggtatggtggtcttgttaaaaactgggtatataacggcgcggagtttttaggtgtcgatcaatataaaaatgttcaacgttgggcagatgcgattttagcgcgccctgcggtacaacgtggccgtatggtcaatcgtacctttggtgatttaactacgcagttgcatgaacgccatgatgcgagtgattttgagaccaagactcaagataaattgcagaatcagtcttaa

SEQ ID NO: 2527 - DNA, 291 bp, Acinetobacter baumannii
gatatggacgattggcaatgtaagtattgtaatggttacattatggttaatcattcaaggatagaggtaggggaaaaagtttactttttggtatataaattcgatgcaaaaaatgaaagaaaaaaactatataaaaaaggaactgtaattgcacgttgcgatagtattttacatatcgaatcaagaaaaaagacatataaaatagaggaggctaaagtctatcctttaggtgcacctatgccatttgtttataatatgttctggatatgtggttgtgaaaacagaccataa

SEQ ID NO: 2528 - DNA, 624 bp, Acinetobacter baumannii
aatggaggcgatatgccaaaaaagaaagaattcgagcatggcggtgcacgggaaaacgccggccgtaaagcacagttcaatgaacccactaaagtgattcgtgttcctgaatctcaagtcaactttatcaaaaattggttactgaataatgtcaaaaccgataaccagacagatttcacttcaaaactaaagatacagcaggtccatccgaacaacgataaaatttaccatattcctttggcgacagaacgtgttgctgcgggtttcccatcaccagcgcaagatgatattgagcaagcactcgatttaaatgaatatttaattagaaatgaaaatgccacgtttattgtgaaagctaattcgttgtctatgttagatgccggaattgatattgatgatccgcttattgtggaccgtagtattcctgctaaatcgggcgatattgtgattgcacttatcgataatgatttcactgttaagcgcttaatgattgatacccaatttcagccccctaaagtgtggctaaaagcagaaaatcctgattatcaaaatatttatattgaagaggggcaagaactggttatttggggagtcgtgacgtataacctcaaacgaatgagataa

SEQ ID NO: 2529 - DNA, 699 bp, Acinetobacter baumannii
tggagtttagacgtgaataaatcacttttagaacaactatcaccaaccaattgtcaggttatttttattgatcatcagccgcaaatggcttttggggtacagtcaatagatcgccaagtattaaagaataatactgtagggttagcaaaagcggctaaaacattcaatattcctgtcaccattacaacggttgaaactgaaagcttctctggtcatacctatccagaacttttagatgtatttccagatgctccattactagaacgtacttcaatgaattcgtgggatgaccaaaaagtacgtgattcgcttgcaaaaaataatcataaaaaagtgattgtttcaggtttgtggactgaagtgtgtaataacacctttgcttttggtgcaatgcttgaaggcgattatgaaatttatatggttgcagatgcttctggtggtacatcaaaagaagcacatgattatgccatgcagcgcatgattcaagcgggtgttgttccggtaacttggcaacaagtcttactcgaatggcaacgtgattgggcacatcgtgatacgtatgatgcagttatggcaattgtacgcgagcattctggtgcttacggtatgggcgttgattatgcctatacgatggtacataaggcacctgaacgtacaacttcaaaacacgaagtacttgcaccagttcctgcaaaataa

SEQ ID NO: 2530 - DNA, 888 bp, Acinetobacter baumannii
tacggtttagactacgagtctttatctgcgattaatcctaaactggtatattgctcgattacaggttttggtcaaaatggcccaagagcagaagagcccggttatgactttattattcagggcatgggcgggcttatgtcagtcacaggtgagcgtgatgatttgccgggtggtggaccacaaaaagtaggcgtcgcattttctgatttagccacggggctttattctacgattgccatacaagctgctttactcaaccgccatgtgacgggtttaggccaatacattgatatggctttgcttgatgttcaaattgccacaatggcaaatcagggaatgaactatctttcatcgggtaatatccctaaacgttatggcaatgcacacgccaatattgtgccttatcaagtgttcaaagcttctgaccgtgatttcattattgcatgcggaaatgacactcagtttattcaactctgtcgaagtattgggttacccgatttaccaaatgatgtacgttttgcccgaaatgcagaccgaattaagcatcgcgatgaaattatcggaattttacaaactcactttttaacaaaaacagcagatgaatgggtagatgcaatttatgctgctaaagttcctgtcggtgtgattaataacttggaacaagcttttcaagaaccgcaagtgattgcccgtgaaatgttagtcgagatgaaccatcctcaacgtgaaaaactgaaggtaattgggtcaccaatcaaactttctagaacgccagttgagtacaaaacagcacctccgctgttgggtgagcatacgcaggccgttttggggcgaatagtttcttcagaaaaactagcagagcttaaagaaaagggcgtaattgggtag

SEQ ID NO: 2531 - DNA, 1035 bp, Acinetobacter baumannii
aatatagtagaatatcgctatgatgcattaggacgccgtattcaaaagcgaagtaaacatcatcataccggtggtgaacataacatcatttatggatgggatggcaatacacttgcttatgagtcgaatgagcaaattaccaagcattatatatatgagaaagattcatttgtaccactggcacaggcggtttatgcagaagaaatagagcttcatcaaacacctgactgggcagataagccttatagtttacaacgtgacccattatggaaagtaaccaaaactgcaaaagattttaaagatttttggttctatcattgtgaccatttgggtacaccacaagaaatgacggatcatacaggtgtggtcatttggaaagctcaatataaagcttggggtgagtgtaaggtagaacaggctaaatcagatttctttgaaaattcagaaattattagtaataacatccgtttccaaggtcagtattttgatggggaaactgggcttcattacaaccgttattgttattattcgccttacgttggacgttttattagtaaagacccgattgggttgctgggtggctctaatatttatgcttatgcacctaatcccgtgggttgggttgatcagcttgggctagcaaaaacaccaactcgaactctgcaaaaaaattggaaaaattatgtaggttgtaaacatactaatttagatattcatcatggttttcccgaagaatatgcagaaagatttaaaaatatagctggtatcgatgtgaataatccacaatattattataatcttccaaaagaaaagcatactaaatctcctggtattcatactaacagttcgcgtactggtcagaattggaataaaacttggggaggaattttaaaccaagttgaagctatgaatttatcacaagctgaatcgaaggaaatcttggagcaacgcttgagagcattagcaaggaaagagcgtattggaaagcacaatgctacagctgttaagggtgcaaacttttgtcaattacagtaa

SEQ ID NO: 2532 - DNA, 624 bp, Acinetobacter baumannii
caaggatcagatatgaaattatattattcgccaggcgcatgttctttagctgcacatattattttaaatgaaattaatgttgattttgatttagaacgagtaaatttaaaaacacataaaacagaaaaaggtacagattattatgaaattaacccaaagggatatgtaccagctttagaaattaatccgggattaattttaactgaaaacgtagcgattttacctttccttgctcagcacgaccctaaacaagatttgattcctccttcgggcttaggccgtgcgaaagtattggaatggttgggctatttaaattctgaattgcatgatgcatacgcggtattttttggggcaccgttaacaaatgatgaaaaaaccaaagcttatgctgaaatcgaccgtcttttaaaatatatcgataattatttggctgagtcggattatgactatttggtaaatgataattttggtccagcagatgcgtatttatttgttttaacaaattggtcaaactcaattgagcatgatttaacgccatataaacatattattgctttacgtaataaagttgcagaacgtcagtcagtacaaattgcgatgcgtgatgaaggtttaatttcataa

SEQ ID NO: 2533 - DNA, 666 bp, Acinetobacter baumannii
gattttccagactgttttacagatgaagctgttatggaagtttttttagttattgcatttactcattttttagcactcttatcaccaggtccagatttctttcttattctcactagtcttctacaaaaaggacgccgttatacatatggtattgttctaggaatcactttgggaaatgctttaattctggctggatgcctgtttagttttatgttgcttggaaatctaagtagtatcttacttttaatatttaaatggcttggcgctttgtatttggcttatttgagttttctttgttttaatgcagcccgatctacagttctaaatttctcaaccgatgtaaataatttaagtgaccaagcagaagataagcacaacaaaattaaaagcttggtattaggtttgcaatcgagtcttctaaatccaaaaaatattatgttttatagtagcttaatgctgcttatacaacataaatttagtttatttcaaaaactgcttatgagtgtatggatggtcagtgtggttttaatctggaatatcttatgggttaaactgctggcaaacgatcgaattttaatcaaaattaagcgctctgcaacaggtttatattattgttctgcagtagcttttattctttttgctgtgcttttgattacatataaatag

SEQ ID NO: 2534 - DNA, 1188 bp, Acinetobacter baumannii
aataaccaagataggactttcatgcgcgagtacgctgtttttacctcggaatctgtaagcgaaggtcatcccgataaaatggccgaccaaattagcgacgctattttggatgcaatcttaaaagaagacccatacgcacgtgttgcttgtgaaacactggtaaaaacaggcgctgttgtacttgcaggtgaaatcacaacaactgcgaatattgatgtagaagctgttgttcgccaaactgttaacggtatcggctatcaccattcagatttaggctttgatggttcaacttgtgctgtaatcaacatgattggtaaacaatcaccagagattgcacaaggtgtagaccgccaaaaacctgaagaccaaggtgctggagaccaaggtttaatgtttggttatgcaagccgtgaaaccgacgtgcttatgccagcccctatttcttatgctcaccgtttaatggaacgccaagctgaacttcgtcgttcaggcgcattaccatggttacgtccagatgcaaaaagtcaggtaacttttgcttatgaaaatggcaaacctgtacgtttagacgcagtagtactttctacacagcatgatcctgaaattactcaaactcagcttaaagaagctgtaattgaagaaattattaaaccgatcattcctgctgaaatgttccatgcagcaactaaattccacattaacccgactggtatgtttgttatcggtgggcctgtgggtgactgtggtttaactggccgtaaaatcatcgttgatacttatggcggtatggctcgtcacggcggtggtgcattctctggtaaagatccatccaaagtagaccgttcagctgcgtatgctggtcgttatgtagctaaaaatattgttgctgctggtcttgcggacaaatgtgaaattcaggtgagttatgcaattggtgttgcagagccaacttctatttcaatcaatacttttggtactgcaaaagtttctgatgagttaattatccagttagtacgtgaacatttcgatttacgtccgtttggtattactcgcatgcttaacctaattcaacctatgtataaacaaacagctgcttacggccactttggtcgtgaaggttcagatactgcatttacatgggaaaaaactgataaagttgaagcacttaaagatgccgcaggcctttaa

SEQ ID NO: 2535 - DNA, 1845 bp, Acinetobacter baumannii
tttcagcaagaacttaagcgtagtgggtgtgttgtgatagaagagcttttaccgttttatgaaaaacaattacaagaatttggtcaacaatctcgggaatttgcccaaaaatatccaaaaattgctcagcgcttatctttaaatcaagagcaaattgatgacccacatattgaacgtctgattcaggctttttcgctgattgctgctcgaatcgataaaaaactaacagacagttacgatgtttttactcgttctttatttgaggtgatgttccctcaatacttacgacattttcctgcgtgttcagttgttagttttgaagatattaataagattaaacagcttacagaacctcatcttgtacctcatcatacggttttgaaatctcgtagtttcaaaggggtgcagtgtgagtttaatacaactcaagatgttaaattactacatattcatttaagtggtttagattttaaaactacacctagtgcacatatgcacttaaatcaaaatgcgacgttgagccttaaatttgaaatttttaataatgctcatgcttgtttaactgatgagaagcttcctatttatttggatgctatctctaattttcctctacaggtccttgatagtattttcaaaaaaggaaccagttttgcggttaaatatggacaaacaattgtagaattgagcaagaatccattcgaattgattggttttgcagaacaagaaagtttattaccgcttgatcaacatacccatcatgcttatcgtttgttgatggaatacttttgtttcccggaaaagtttagttatcttaagctcgatttagattttttaaagcgaatacctcagcatgtatccgaacttgagcttttaattcatttcaaattaaacttaaatgatcaagccgttgttagaaactattctgagctaaatattgcaaactttaaattatttactaccccagtaattaatttatttgaaaaatatgctgaaccccagaagatagttcataagcaattagaatatcctttagttacagatgcacatcatcctgagttttatcaggtatattcaatacttgagatgaatatggtgcgtgaaaaaacaaatcaggaagaaagctatgttcctgttttgccgttttttgcgatgagccattaccacaatgatacagctcgctttttttactcagtgaactatcaaaagttacagtccaatttcgttgaaatgggctattccattatttctaaaaatttaaatccattttcaacgcgctcagattttattagcaccaaattattatgttcaaaccgtgatttacctcatgaagcactggggcagtctaataacgtattaaatttaaatgatagtagcttggcgagacgtgccattgttttaaaacgacctaccaagccttataagtttgaacaaggccaaagtgaacagtggcgtgtgatctcgcatctttcattaaatagcttagcgcttatgaaaggggatgctgtttctcatgttaaagagctgttggctttatataacttaccgcagtcaaaagaaaactatttaattatagaatcaattaaaaaattagaattttctcttacccataaacttgtagatggtaaaccatttccaatgtttgtaagaggagtgaaagctgaattacaaattgattcatccgtatttagagggcatagcttatatatttttagtcagttattaagtcgtgtttttaatttaaaggttcaaattaatagttttgttgatttggtggttaaggattattcatctcagcaggagttataccaatgcagtcagaacgttggtggcaagactcttctgtaa

SEQ ID NO: 2536 - DNA, 201 bp, Acinetobacter baumannii
tccaataaagaagacatcatgcttctaaaccgtaaacactcacttgtctcatgttttgatttagaactattagaaacacacccagttaaaattaaaagtagtaaagtaaagcaaaagaatttcataaccgattctttggaatttagtttaaaaaaatcccgccaattttttaatgagcgggactttaaaaaaatagcttaa

SEQ ID NO: 2537 - DNA, 1482 bp, Acinetobacter baumannii
ggaagcaaagatggtgctattcttgtggggcacggttgtataggacaaaacatgtctcagaaaaaaagtgtgcttttccagcaactattaccagttatcaaacagtatcagcaatcgggctttacccatgaaaaaattgttgaattacttaaagatcaacatgatctgaatttggtaacagtcaaaacatttaaaagttatttataccgatatgcaaaagtgaatccagctatgtctaaaaatactgctactctccaatccatgccaacttcacgagaaattaaaaaatcatcgaagcttgagcatgtttgttatgacattcgcggaccagtattacgagccgccaatgaaatggaagagcaaggacataaaatcattaagctgaatatcggcaaccctgctccatttggttttgaagcaccacaagaaattattaatgacgttgctttaaacctaccaaatgcaattggttatgtagattcaaaaggtatctttccggcacgtaaagcaatctgccagtactaccagcaaaaaggcatcttaaatatgcacgttaatgacgtgtatatcggtaatggtgtatctgaactcattgtcatggctatgcaaggcctactcgatgatggtgatgaaatgctcattccgatgccggactatccgctttggacagctgccgttaacctgtcaggcggtacagccattcattataagtgtgatgaagaaaacagttggtatcctgatattgccgatattgaaagtaaaattacttcaaacactcgtggtattgtcattatcaatccgaacaacccaactggttcggtatatccacgtcatgtgcttgagcaaattgtggcacttgcaaagaaacatgacctgattttatttgctgacgaaatttacgacaaaatcgtttacgatggcattgaacatgttgctgttgcttctttagcaggcgaccaattatgtatttctttcaatgggctatcaaaagcatatcgtattgctggtttccgttcaggctggatggcaatcacaggcgataagagccgtgcagcagactatatcgaaggtctggatatgttagcttcaatgcgtttatgtgcaaacgtacaagctcagtatgcaattcaaacggcgcttggtggctatcagtctattaatgatttgatccgaccaggtggacgtttatatgaacagcgtaatatcgcatgggaaatgttaaatgaaattcctggtgtaagctgtgttaaaccagaaggcgcaatgtattgtttcccgcgtcttgaccctaacatttacccaatcgaagatgatgaaaagttaatgttagatttacttcgtgctgaaaaagtactattagttcaaggaacaggttttaactggccaacaccagaccatttccgtgttgttttcttaccggcagaaaacgaattacgtgaagcaattggtcgtttaggtcgtttcttggccaatcgccgttaa

SEQ ID NO: 2538 - DNA, 489 bp, Acinetobacter baumannii
tcaactggagaaaagagaatgtctttaacccctcaagctattccgggtatgcgtgctcgtttgcacatgcccgaagaaatcttatctttaccagtcgcgggtaataccgtgttaagtgacggtgaagtggtggttcagtccactgatggcaaaactgttactgcggtaactggtgctactaatacaaagtttggtgtggtggttttacagcacgtcggcaaatcaggaaaaaatgccttaggtaaagaagcatatcaagcgaaagactgtgcaccgatcatgcaaattggttctatctgggtaaagccaaccgcacctgtgattgatattaacgcaaaggtatatgtgcgtattgccaaccctacagcgcaagcgccgcttggatcactttcttctgcagcattagattcgacagaactacctaatgcctcatgggaaactattacgggtccagatggcttggcaatccttcgattacgtggagcataa

SEQ ID NO: 2539 - DNA, 936 bp, Acinetobacter baumannii
gaatatctggatgttaatatggaaatagatgaagaactgactcttaaaaaaatacagatttttttggcctttatgcgctgtggcaacttgtctaaaaccgcggcagaaatgcaactgagtaatgtcagtgttcataaagcactacactctttagaaagcgctttacgttgtcctctttttaaaaatgaaggccgtaacctcattcctttaaaaagtgcttatgtatttgaagaacgggcgcaaaaaatcgtacaagacatttttattaccgtaaataaaaccagagaagccgctggctttgcagccaaggttttacatttaggatctctttattctttgacggtaaacacaattccaaatgtgattagcggtctcaaactcagacgtagtgagcttgatattcaactgttgctgagttcaaatcaggatttggtgaaaaagctcaaagcaactgagctggatgcaatcattgtagctttaaatgaaaccacacaggatgatgattttgaaattttgccgatgttttcagacgacatttttttggccgtcaataaagattcaaaatatgctgagtttaaagatattgatttaagccttttaaaagaagaaacttttttaactttaaccaagggttttgcaactcataacgacagcgacatcatttttaaaaaagccggtttttcacctaaagttgctttgcaggtcaatgatatttttaccttaattagtatggttagctcaggtgtaggtttcgcactattacctggtcgtatttctgcggtttatgaaagttcggtaaaacttattccgctaaaacagcaataccacatgcaacaagaaatcggtctggtctttttaaaaagtaaagaacgcgatccaaacttacttgctctgattgctgaatgtcgtatgtttgcttctaattttaaaagatag

SEQ ID NO: 2540 - DNA, 201 bp, Acinetobacter baumannii
gaaattagttttataaatagtgatgagttgaattatatggataaaaaggatggcgatttaagttttgaaagttttaaaaatacaaataaaccaaatttctttggtgatattgagtatatttactcaatttttaaaattaaagaactccccgtagatttgctttttaagattctaaatttagttttcctgatttccttataa

SEQ ID NO: 2541 - DNA, 729 bp, Acinetobacter baumannii
gtttgtatggaacaggaccaagctcgcatacctaaatatattcctattcgcgatgcaattgcccatgacattgaatctggcgtattagaagcccacgcaaaactcccatctgaaagagtgctttcggaacaatttcaaaccactcgagtggctgcacgtgaagctttgctggctttggaaactgatggtctgatttatcgactagaccgccgtggttggtatgttcgttctcctcgtattatttatcacccacaatcgactaaaaactttaatcagttcgtgattgaacaaggctatgaaccttcgaccgaagtgatttcgagtgaactgactcaggctactttttgggatgccaagcatttaaaagttgaaaaaggccatccgatttattcagtttggcgacgtcgttgtattaatggtcgacctgttttggttgaacatttacgtgtgaatgccgagctttttcccgagtttctaactcacgatctcaagcaatccattactttactgatggcaaatcaatataactgccatatcaccagagctgatattaatctgtacccaaccgctttatcagaacagcaggccaaagcactgcatgtcaatgtgggcgcgcttggtttatatatttgtcgtagcaacagaaatgaagagggcgtgattaccgatgttgaccaagaatattggctacatgatgttttagatttacatttcgaagcgcgagtataa

SEQ ID NO: 2542 - DNA, 897 bp, Acinetobacter baumannii
ttatccatggatcgattagactgtatttccacttttgtaagtgtcgtagaacatgggaattttagtagcgcagctagagcactcgatatttctcgtgatttggtagccaaacgtgtttgctatctcgaaaatgatttaaaaacaacgctattaaatcgaacaaccagacaaatgaatctgaccagttgtggggaaaaattttaccaacattgcaaggttatattgagtgaatttgaatgggcaacttacgagattagctataaccagcaatatcctgaaggcgaactcaagctcaatacgcccatgtcttttagcaacattttccttcaacatatcatttcagactttattgagaaatatcccagtattaaaattgatttgtttatgacagatcagctattagatgtgaatcaacacaaatttgatctgaccatacgcttagatggatctgcgccaagtttggcaaatagtaaaattttaaatacctatcaacgttatttatatgcaacacctgaatatttcaatcaacatggattacctacttctttagaagaacttaaagaacataagtttctaatttactatcaagatagccgacataaaaaattgatttttcaaaaagatcagaaagaagtgtcttttaattgtttccctgtgatgacgtgtaataatggtgaactattattggatatgtgtttaaaagatcacggtattgtttttcttccagagtttattgcagagccttattacaaagaaggtaagttacagaaatgtttggaagattataccagtcagccacttcacttatatgtcacatggccaaatcgtaagattttatcgaagaaagtaaaactatttattgattttttaacacatcaaatcattcccataaaataa

SEQ ID NO: 2543 - DNA, 1338 bp, Acinetobacter baumannii
aaagacatggaaaataaagcgtcttccttaaaaaaattatcgctatggcaagtgacaattattggtattgcctatatgacccccatgacggtttttgatactttcggtattgtttccggaattaccaacgggcatgtccctctcgcatatttgcttgctttaggtgctatgttgcttaccgcttggagctacgcaaggtttagtcaaaattcggaaaaatcaggctcagcctatagttatactgccgaaagcttaggacccaaaagtggtttttttgtcggttggtgctctctactcgactatctgttattaccactcatcaatgtgttactggctgcaatttatctcaccgcactgattccaagtttgccttattggttttgggtgctggtatcggcgggccttgtgactttagtcaactgtttccgtattcggttacttgccaacttaagcctcgtgtttgtgttcgcaccgattatcctcatggttatttttgtatatttagtggtccagggtattggctctactcaaggttacgaacatgtacttaccttggctccgctatggcatggtcagcaatcactgttaccacttgttgctggggcctccgttctatgcttttcattcttgggttttgatgcggtcaccaccctttcaaatgaaaccaaacaacccaccaaaaatattccccgtgcagtcatgttaaccacacttgctggcggagctattttcttcacagccgcttggtttattcagctttattttccaaacaatgtccgttttcaccatccttcagaagcgttaccagaaattgtgctttatgtcggtggtgctttatttcaatccatcttcttatgcggacaaattatgaacactgtcgcctctggccttgcctcacatgccagtgcttcgcgtttactgtatataatgggtaccgacaatattttccctaaaaagtattttggaaccatccatagctctttagggacaccatttttctcggttttatttgtcgggcttatttcgatgtcggctattttcttagatttagctcaagttgtcagtctgatcagttttggtgcgcttgttgcgtttacagccgtaaacttctcagtttttatgaaattttatattaaagataaacaacgctcaggttttaaaaataaatttctaaacctatttttaccgctgttatcggtcatcagcattatttgtttatggctcaatctcgactcgtcttcactgacttttgggtgcttctggttagctttaggcattctcctattcatttataaaacgattaaaaaacaaagtattgcaattagtaatgcttattaa

SEQ ID NO: 2544 - DNA, 1260 bp, Acinetobacter baumannii
gctcaaatggatgaggaacgcattaatatgtctttactgaaatcttcttttttatcagatcgccaatgggccattgttgcctcaatttttatgatggcgacctctgcaatggggccaggatttttaacccaaactgctgtatttacagttaagttaggtgctgcatttggctttgcaattttaatttctattttgattgattatgtcgtccaacaaaatatctggcgagtggtgacacttacccagatgcgtgcatctgatattgccaataaagccttaccgggtagtggttatttactggcatttctggtgattttaggcgggtttttctttagtgtcggtaatattgcaggtgcagctttaggtttaaatgcactttttggcctagatacaaagtggggcggtattttaagtggcgccttagccattttgatttttgcctctaaaaaagccacgcttgccatggataaaagcatgatcgtgttgggattgcttaaaatcttgctgattattattgtggccgtcattgtaatgcctcctgttgggcaagcagttcagcaaacctttgctccagaccaaatcgactttgccattattactacgattgttggcggtacagttggtggttatatctgttacgccggagcacaccgtttactcgataaaggtgctgttggacctgaaaatattaatgaagttgccaaagctgcgactaagggtattgttgtcgtcggcatcatgcgttatgtgttgttcttagcattcttaggtgtggtggtaagcggtgctcatattgatttagccagtcacgatgccaatccggcagcccaagcattccaatatgcagcaggtacatttggttttaaattatttggtttaattttctgggcagcaggtattagtagcacgatcggcgcagcatatacttcagtgtcattctttactgcatttaaaaagaacttaacaccaaaacagaccaactatacgaccattacctttatcgcattagcgttattgctctatgtgttattgggtgcaactccggcaggcttactcattttcgtaggtggttttaacggattggtgttgccaattggccttacaatttttgtgtatgtcgcagcgtgccgtaaagatttaatgggtaattataactatccaaaatggttgcttattttaggtggattaacatgtctgttaacgtggtggatgggctatatgtcatttacgacagtatttaattatttgaccaaactttaa

SEQ ID NO: 2545 - DNA, 1224 bp, Acinetobacter baumannii
ttaaaaatggaaaaaatagttgagcccaatgcagaaaatatactgtcaaaaagctttatttttatcatggcaatgacatgtggaatttgtgcgggttcaaactattataaccagcccttaatctattcaattgcagatgcattaaaagttaatgccgatcaagtcgctttaactattgtgattagccaactgtcctacgcagttggcctttttatattggttcccttaggcgacttttttgaaaagcgcagttatatttgcttgctcatgtgctgtacggggcttgcacaagtagggctatccttaagtcaaaccttgccagctttatacggttttacctttttagccacattcttttcgattgcgactcaagttttagttcctttcgccgcaggtttagccagcccgaaaaaaagccctcaagttgtaggtactctcatgagtggtttgtttttgggaatattattggcgcgctctattgcaggcttactttctacagtttggtcttggcatgcggtttatttaattagtggaatcgtcattttggtgtttgcatgggtaatgtgggtgaagttaccagttgcgcgcaaatcccaccaactcaatattctacagatttatggttcattattttcattagcagctcaccagccgcatttattacgccgtggttttgctggtggaattggctttggaattttggctcttatttttaccaccatgacttttattttggcgaatgagccttatcactttaacgatttccagattggtttatttggaattgtgggcttggctggcgtatttgcgactccttgggcaggtaagaaaattgcggcagggcttgagaataaaattgcagtgatttgcatggggttattaatgagtgcatggataccactattttttgcgcagcagtctctggttgcctacgctgttggtgtgattatggcgtacttcggtttgtcagcatttcatgtgcttaaccaaaatttggtctatcgaatttcggccgaggcacgttcccgtattaattcaatttatatgaccttatattttggcggagccgccttaggttcttttattgcggtgtatgcttggaaacattggggatgggaagcatgtgcagccttaggtttagcgatggcaatgttaagtttcttgattgatcgcttagatttttatgaaatgaacaagatagcaaagcaagaaaaagctccataa

SEQ ID NO: 2546 - DNA, 786 bp, Acinetobacter baumannii
accgaatcggaggtaaagttcatggttgaattattattaaaagacttaacacatttaggtttaattacagcttttgctttaattgccttaattatgtggctgtcgaccaagctctctaaatatttaaccaatggacgtgtgcatgcttcagcaattgcgattgtaattggtttgattttggcatggtttggcggaaaaatgacaggtggtgaaaaaggcttgactgaccttgcactttttacaggtgtaggactcatgggcggtgcaatgcttcgtgactttactattgtagccacagcatttgaagtacaagcgactgaggccaaaaaagctggatttattggtgccttctctttatttctcgggaccattttgccatttattgtcggttgtatgtttgcgtggatttttggctatcgcgatgcggtaagtattaccacaattggcgcaggtgcagtgacttacattgttgggccagttacgggtgcggccattggtgcgagttctgaggtcatggcgttatcaattgcaactggcttggtgaaagcaatctgtgtaatggtttcaacaccactcactgcgaaatttatgggattagacaatccacgttctgcgatgatttttggtggtttggcaggaacggtaagtggcgtgtcagctggtttagctgctacagaccgccgtttagtgccttacggtgcacttacagcaacttttcacacgggccttggttgcttaatgggtccaactattctgttctttgcggttaaagctttggtgggttaa

SEQ ID NO: 2547 - DNA, 1413 bp, Acinetobacter baumannii
caaaatagtttattaaaaaataacgcgatgcttcacaaattggaggtgaagaaaatggatacgagcaaggttaatattaatgagttaattgataaagccagttttacatcttttcattggaaagttttaatctggtgcttacttattattatttttgatggatatgatttagttatttatggggttgctcttcctctgttaatgcagcaatggtcattaactgcagttgaagcaggcctgctcgccagtgccgctctattcggcatgatgtttggtgccatgattttcggcacactttcagacaaacttggacgtaaaaaaaccatcctgatttgtgtcaccttatttagtggatttacctttataggtgcctttgctaaaggaccaactgagtttgctattttgcgctttattgcaggtctaggaattggtggcgttatgccaaacgttgtagcacttatgaccgaatacgcacccaaaaaaatccgcagtacattggtcgcaattatgtttagtggctatgcaattggtggcatgacatctgctctactcggtgcatggctcgtaaaagatatgggctggcaaatcatgtttttaattgctggtattcccttgttactgctcccactcatttggaaatttttgccagagtctctcgcctttttagtgaaatcaaatcatagcgaacaggcaaaaggtattgtgagtaaaattgcgccagaaacgcagttaaacgccaatacacaactggtgttaaatgaaagtacaacaacagatgcacctgtccgtgcgcttttccaacaaggccgtaccttcagcacgtttatgttctggattgctttctttatgtgcttactcatggtgtatgccttaggaagctggttgcctaaactcatgctgcaagctgggtattcgttaggtgcaagtatgttgttcctctttgcactcaatattggcggtatggtcggtgcaattggtggtggtgctttagcagacagattccatttaaaacctgttattaccattatgtttattgtgggatcggcagctttaattctgcttggcattaatagtccacaatttattttatatagcctaattgcgattgctggtgctgccaccattggttcgcaaatcttactctacactttcgttgcacagttctatccgacagcacttcgttcaactggcatgggctgggcatcgggaattggccgtattggcgcgattattggaccagttttaacaggtactttactttcatttgaacttcctcaccaaatgaatttcttggcgattgcaattccgggtgtgattgctgcacttgcaatatttatggtcaatctaaaagcctctgttgctgcacaaacgccatcaacttttaaccctcaaaacacgcttacccagcagtaa

SEQ ID NO: 2548 - DNA, 228 bp, Acinetobacter baumannii
aaacatcaggatcaaggaaaaaaacaaacaattcataataattttgttgattatcttgtaataagtctaataatcgttttttcactacaacaggcattttcattctccgtttgtgagatatcaattaccatacgtcaccctaactataatcgagttttaagtttgttattttgcgttattaaaaaacaaggtaaatacaataaatttaaaaaattcatagacatataa

SEQ ID NO: 2549 - DNA, 1251 bp, Acinetobacter baumannii
tcaataaaggacaacacaatggaaaaaatatcaggacagccttcaagggcaaaaatcacgttgctactgtgctttgccatagcaatttttgaaggctttgaccttcaatcaatgggggtagccgctccacgaatgcgggctgagtttatgttagataatgcccagatggcgtgggcatttagtgctgcaattttgggaacactcccaggcgcaatattaggtgggcggtttgccgatattgtcggacgtaagaaaattctgatttttagtatcttactttttggaattatgtctttgctaaccgcctatgcggccaattttagtctgttactactcattcgtttttgtaccggtttgggaatgggtggggcgctacccatgatgattacgcttgcttctgaagctgtacctgaccagcacaaaggtactgcggttagtgtgatgtatagcggcattccttttggcggcttactcacttccgtcgttgccatgtcattggcaggcgatgcagagtggcgtcatattttctatatcggggggattgcgcctattttactaatcccactgattatgcgctttttacctgagtcaaatgattacctgcaacgtaaagttcaggcgcaaaaaaccacaccattctttgaggttttatttgccaaagagcgtcgtatgtcaaccattcaactttggataagttttttctgcacgctggtggtactgtatttcttgttgaactggttgccgttactcatgggtgcacaaggcttatcaaaactacaggcgaactatgtacagatgggctacaacgttggcggaattttaggttcaatcctcatgggcgtattgcttgataaattacgcatgagctttgtgattaagctaatttatctcggcattttattttcgctgtgctgtttagcaatttctccaaccgttgctttacttgcactttcggcagtgggttgtggcttattcattgtgggtggacaatcggcgttgtatggtttagctgccatgtattatccaaccgaaatgcgtggaaccggagttggcgctgcggttgcaatcgggcgtattggttcgtttgctggacctttaatggctggttttttactctcgcttgggcaaagctcgaccatcgtgattggttcaagtattccagtgattttaattgcagcgatctctgcattacttcttgtcaaaaaacctaaacagcctgtacatttagtacaaagctcaggtgctcgctaa

SEQ ID NO: 2550 - DNA, 966 bp, Acinetobacter baumannii
ggtcacgaggaagatatgaaaggaattaaaacaatcggtgtggttggtgtcggtgtcattggtgcaagctggacagcattatttttatataaaggctttaaggtaaaggtgtatgacccttacccaatagacgaagaattatttaaaaagagaatacagacaaatcttagtgatttgctcgctttagatcagcaaacagattcaagtcatcatttacaagatatttttctaaatttagagctttataacaacttaaaagatgcggtgattaatgtcgattttattcaagaaaatgcaccggaacggttagatttaaagcaaaatttatatcaagaaatcacttcatattgccctgaaaaaacactaattgcttcaagttcttcaggtctaaaagtttctgactttcaaaaagatgcaactcatcccgagcgtatttttttaggtcatccatttaacccacctcatctattacctttggttgaaattgtgggtggaaaattaacagatccgcaaattttaaagaaagcttccgagttttatcaaagtttgggtaagcatccgattgttttaaataaagaagttaaaggacatgtagcaaatcgtttacaagctgctttgtggcgagaggcattttcactggttaaagaaggggtgtgttcggcagaagatgttgatatcgcaatcaccagtgggcctgggctgagatgggctttatttggcccctatataaatatggaacttgccaatcagaaggggtttaaagaggcaattcaccatttaggaccacctatgaccgagtggtggaatgatatgcaaaattttcagcactctgaagaaactactgagttgctagaagaacaaactaaagaacttttaacacattataaggatgtcgatttatctcaaaaaagagataaaggactagtcgatattttaaaattgagacaacaattagagttagattaa

SEQ ID NO: 2551 - DNA, 2451 bp, Acinetobacter baumannii
acatttttactcatgaaaacttttcaattaaaaacactttcggtttttttaagtgcattaggtgcattttcatatagttctgttgctcaggcacagctcatgtttagccagtatgttgatggtagcagtaataaaaaagggttagaaatttataacccggatggtactactgttaacttggctgattatgaaattcaacaatttaataatggtggaactgcaaaaacagctaccttccgtttacaaggtacgcttgcaagtaaacaaaaatttttggtggggcgttcagaattacagacagaacttggcaataaagtaaatcaagtggctgcattgtcttttaatggggatgatgcagttgtgcttgtttataaaggcacacctgtagatcgttttggccgtattggggagcgacctgaggcaggatggggaactgctgtttcaagcttgggaaatagttttaaacgtattgaaactgaaaatccagctttgagtattgatccgacagcggcatttgatttggaccattcatggacagcatgggcaaaccgaaatgattttacaaatctatcaggtactactactcagcctcctattgaaacggtcagctgttcaagctctgatacaccaattgccgatttagtaacatcagcacaaaaccagacttataccgtgcgtggggtaattactgccgactatcgttacgcaaatggtttctcaggtttttatgttcaaacacctgatacgaaagcacgtgcaaatgtgagcaatgctatttttgtttatattccgaatagtagtgcggtgaaaggtggacaaattggtgatgaggttattttacgtggtcgtttaacgagctatcaaaatcagctacagattgaccaattacaacaagatattcaaacctgtaatagcaatatggcaaatcaggttcaacccattagccttgaattaccattttcgagcttaacagccggttcaacccattctccgcagcgttatcaaggcatgttggtgaaattgcctcagactttaacggtgagtgagaattataattatggtcgttatggtgaactatctttaagtttaggtcgcttatatattccaaccaatttatatccagcgctatctcctgaagctaaagctctagctcagaaaaatttattatctaaaattatttttgatgatggttataacaaccagaaccgtacgccatggttacctacaaattttagtgttgccaatacattgcgttcaggctatcagcttaaaaatgtcgaagggattttagagtatcgttttaacggttggcgcgtacaaccagtgcttggacgtacgcaaccagaagttattactcaaaccaacccgcgtcaaaatattattacgaaaaatgccaatcatattcgtgtagcttcatttaacgtcttgaactatgacaatggtgcaacaggtttcccaacagagcgtggtgcaaacacacaagcagagtttgataaacagcaccataaaattgtgagtgcactcaaatcgattgatgctgacgtttacggtttaatggaaattgccaacaatggctatggcccaaacagcgcaattgctcatttaacgagtgcactaggtccagactggaaatatgttattcctgaaaatctggatcgtttaggtaatgatgttattgctgttgcgattatttataacagcaagcgtgtgaagcctttaaataaagctgttgtgcttgatttaggtgataaaaaccgaacaaccttagctcaaactttccaagctgttcgtggtaataaaatatttactgttattccaaaccatttgaaatcaaaaggatgtagtggagtagatgccagctcttctgatgcagatcaaaatgatggtcagggatgctggaatccaacccgtgtaaaagcagttgatcaaattgtgcagtggctagcaaaaaatccaacgcaagtgcctaagcaaaatgctttactcgttggagacatgaacagttatgcaaaagaggcgccgattttggcatttgaaaaagccaattataaagtcttactcaatgacgctaaagttgggcaaggcgctcaggcgtacagttatgtttttggtgtggcaagtgatgcaaatggtaatggtggagtgggtaacttagaccatgctattgctgatgcagatttatatccaaaagtagttcgtacttttgcttggcatattaatgctgacgagccgacggttctagattacaacgaagaatataaaactgatgagcaaaaagccttgttctatggtgaagatgcctatcgttcttcagaccatgaccctgtgattgtcgatctagatttaaatggcaaagactcgaatcagccaaatgataaccagaaaagtccaattttcgatttcttatctcaattaatggaatggattagtcagctttttaaacgtagttaa

SEQ ID NO: 2552 - DNA, 1053 bp, Acinetobacter baumannii
agaggaagtttaatcatgcgtttttcattatttgtgcatatggaacgtgtttctgatcagcaaactcagaagcagctttatgatgaaatgattgagctttgtcagattgcagaccgtggcggtatgcatgcggtttggacaggcgaacaccatgccatgaactttaccattgcaccaaacccatttttaaatctggtcgatttagccaataaaaccaaaaatgttcgtttaggtacaggcacggtggtagcgccattctggcatccgattaaacttgcaggtgaagctgcaatgaccgacattattaccaatggccgtttagatattggtattgctcgcggtgcctattcgtttgaatatgaacgtatggttccgggcatggatgcatggagtgctggtcagcgtttacgtgaaatgattcctgcgattaaaaacctttggaaaggcgattatgagcataacggtgagttttggcagtttccaaaaaccacctcggcacctcaaccgcttcaacaaccgcacccaccaatttgggttgctgctcgtgatccaaatagccatgaatttgctgtgcaaaatggctgtaatgtacaagtaacgcctttgcatttaggtgacgaagaagttgaaaagctcatggggcatttcaatgcagcttgtgaaaagttcaatgaaattcaacgtcctgaaattatgttgctccgccatacctatgtggcagatagtgaggaagatgctcaactggcagcagatgaaatcaatacttcctataactacttcggcgcttggtttaaaaatgagcgtgaaattaaccaaggtttaattgcacctttaagtgttgaagaaattgctgcacatcctttttatacaccagaagcgatgcgcaaaaataacgtgattggtcaagcccaagaagtcattgatcgcttaaaagcctatgaagcaatgggctataacgaatattctttctggattgatacgggcatgagctttgaacgaaaaaaagcctcattagaacgtatgatcaatgaagttatgccggcatttgcatag

SEQ ID NO: 2553 - DNA, 2118 bp, Acinetobacter baumannii
aaaaggagtttggtcatgcttgaacaagcacacctagaaggaacctcaactgacacagattttcagcagtctgagcatcaactgcctcatcttgcttcttatgtctatggaacatggcattcgtctgacgaagaattacgtaccgtttatcatgccattacaggtgaatcgatttatgccgtaagtagtcatggcatagatatgaaacgtgttgttcagtatgccaaacagaatggttcagaactggctaactggacgtttcaccaacgtgccaatgcattaaaacaaattgcccaacatttacttgaacgtaaggaagacttctacaaacttgcttatgcgacaggcgcaactcgtaaagatgcgtggattgatattgaaggtgggatccagacattatttgcttattcaagtctggttcgccgtgaactcaatgatgaaaaaattattactgaagatagctggattcaattatctaaaaatgggactttcggtgctaagcacattttaagtcctaaagcaggtgttgccgttcacattaatgcttttaactttccaatttggggaatgcttgaaaagattgcaccaactttacttgcaggtgtgccatgtattgttaaacctgcaaccgatggtgcccaattaactcaagcggttgtaaaagccattgaagaggcacatgtattaccaaaaggctcgctacaactcatttgcggtcagacttatgacctgttagaacagttaggcccacaagactgtgtcacgtttacgggttctgcttacacaggccaaaaactgcgtaaccaccctcacctcaataaatattcgattccatttagcatggaagccgactcggtaaacagtgcaattttaagccctgaggcaaatgaagaaactgtcgatttatttgtgcgtgaagtcttccgcgaaatgaccaccaaagcaggccaaaaatgtactgcaattcgtcgtgcatttgttcctgaaaatttattagcgactgtggaagagaagctaactgccaaacttgctaaagttgtggtgggcgaccctcaaaaagaagaaaccaccatgggggctttagcgagcattaaacaaaaacatgacgttgcagaaaaagttgccgaactcagcaaagatgcaaaaattgtttttggtggcaacgatagctttacatttaatgcagaccatcctgaaaaaggtgcttttttcgctccaactttattggtgtgcgaacaacctttacaagcgacgaatgttcataccacggaagctttcggtccagtatgtacactcatgccatatcaaaacattgaagaactagctgaccttgtttcacgtggtgaaggtagcctagtggcttctgtcgttaaaaataacgatgagaatattgagcagattattcaaaaaattgcgccttggcatggccgtgtgcatgtacttgatgcagagtcagcaaaagaaagtacaggtcatggttctccacttccgcatttagtacacggcggccctggccgtgcaggtggcggtgaagagttaggtggtattcgcgccgttaaacactacatgcagcgcactgcaattcaaggctcaccaaacagcctgacgcaaattacccattcatggactgctggctcaaaagttaatgaagaccgcgtacatccatttaaaaagtcttttgatgagttagtgattggtgagcgtttattaacggcgcgccgtacagtcaccgaagcagatattgtcaatttcgcgtgtttaagcggtgactacttctatgcacatactgacaaaatcgcagcggccgagtctttctttggtgaacgtgtggcacacggctacttcattgtatctgccgcagcaggcctatttgtagatgcagcacaaggacctgtgattgccaattatggtatggacaacttacgttttgttgaaccggttaaaattggtgactcaatccaagttgaactcacctgtaaacaaaaaacacctaaaccacaaaaagacccgtctcagcctgcacatggcgttgtggtatgggatattaaagtcaaaaaccaacgcggtgaacttgtcgcaacttacgacattttaactttagttgctcgcgaggcttaa

SEQ ID NO: 2554 - DNA, 366 bp, Acinetobacter baumannii
gcaataatactcaacaaggcactgattaacatgaaaaaattatcaacaattcttacagcaggcgtattggctatgttaagtgtttcggcatttgcatgcccaaaaggaactcaactacaaggtggtactggaccaaatcacaaaggtggaaaatgtgtagcagtacatggaaaagctacagctcaaaaagcaaagaaagaggcaactaaaactaaacaggaagttaaaaaagacttaaccatgcaaaagcatgatgcaatgaccagtgcgactcatgcacaacatgaatcacatcaaatgactcaccaaatgaagcaagatgctgtaaaaactgtcaacacagctaaagctgcaacaaaaccgtaa

SEQ ID NO: 2555 - DNA, 342 bp, Acinetobacter baumannii
cggacaatacttctgcggaaggtaggaagaaaaaccgccgaattgagttcaccgttttatagggataaggagaagaatatggctagcccttacattacgattggatgcccaacgacaggtggagggcaagtcatttctggtaatagtgcatttttaattgagggaatcgcaattgcatgtgtaggtgataaagcaacttgtccggcgcataaaacggtttctacgattgtttccggtgacccaaatatgcaagtgatgggaaaagcagcagcaagagtaaatgattcattatcgtgtggctgtaaattattaccgaaacaaagtttggttaatcaagggtag

SEQ ID NO: 2556 - DNA, 3063 bp, Acinetobacter baumannii
ttaggtggtttatgtcgcacttcaagttttactctgcctggtgtagcagatcaagaagaattgactagacttgttttgcgtaagattgtaagcaaagagttgagtgataaagaacgtgaacgtatttcgggtactgggtggttagcgtcttttactgtaaacgaaaatggatgtttaagtgcagatagctatgcaccagccagttatgtatatggtacccaggctttaagtcacggagagccccttattgacttaaatgcaagacttactagagctaaggaggagtttgctcagcgttgtcatcgcttagttcaattgaaagaggattatcgatgttcatggaaggatttgcaaagtgaaacggatttaattagatctatttttgctcatgatgagcagattggattagattggcgagtcgtagttgctacaaagcgattacctagaaaaaaagcgttagaggatattgaacaagaggttaattatctgaactcattttatttagatgatttagataaaatgctgaaacaaagttcattaagtcaaccatttggccaagcgttatctacatatctcggggcttcaattattcatgataagcgaatagatattttaaaaaatcatgaaattatgggaaaacttgtctgtgcagccaatttacctattgcgcgttggcctaacgcaccagatagacctttagtgttggcacagcaggcggtagttgctcatatagaaaactcattgaaaaatcaagatggtattctcggtgtaaatggaccgccaggtactgggaagacaactttactgtgcgatgttattgcgacggttattactgacagggctaagcgaatttctgcactttctacacctgaagctatatttaaacagcctattcagcttatgggacgaagattttcacccattgttgaggagttggtgcgagatagctcaatagttgtcagtagcaacaataacaatgctgtaaaaaatatttcacaggagttgcctgctactagtaaattagacaagcggtatgaaacagattctttatatttctctgaagtcataagtggagtttttgatagtcaacgagttcaggatgaaaatcaaaaaacaattcctgcatggggtttaattgctgcggctttaggtaacagtacgaatcggagatcttttgctcgtgctttttttaaagaggatcatattgctgagaatgatgaggaggagagcaaaaattcatttatatcgatgaaacaaatacttgaggatgcaattcctcatattagtgcttattgtcggaaatggcacacagtcaaaagtgaattaattgaattaattgaagaattagagaaaaagcgttcagttttaataaaagcagagcaggcttcacttgttatttcagaatgtatggagaggaagaaagaattatcggaaacgattacgctcaaaaatgaagaattaaataagcatcaagatttatatcgtcaaatacagggagagttacaagaccaggctattttaatacaatctaaacagcaaatattagggcaaattcagatatcacatggacctcggttatgggatcgtctatgtgcattatttggttaccggactcaccgtacagaagtctatgataagcgaattagtgaagcaactttatcattacaagaaactaccgctcgctatgaaaagctcatcaatgataagacatcaagccataaaattataaaaatttgcgagcaggagttattgaaattaaatgatgagcttcttgtaataaggcaaaaatgcgacaagttgatttccgatttacaggcggtacacgctttaggggtaagacatgtcattgggcctgatttttggaaattatcgtttgaagaattgcataggacttcagtaaatacttcagaaattatcgatgatattcgtgcccgtatttttattaaatcgatacagctacacagactaacgattttatctaatgccaaaagatttttaagtaatttgagaatggtcgggcaaatgctttcaggaaataccaaaggtctttcccttcatgatcgtcctgtaatttgggacagcctgttttttgtggttcctgttgtttccacaactttagcttcatttagtcggctttttgcaggcatgggacaagatagtttagggtggttattaattgatgaggcaggccaggctacacctcaatctgcagcaggtgcaatctggcgaagtaaaagggctattttaattggtgaccctttgcaggttgaaccggtatttacactaccagatagtgtagttgagattctacgcaaacaaaatgatgtggatttatcttggtctcctgtcttcgaatctgtacaaacaattgctgacagaataacgccatttggttcatggattgatgatggtagtggagataatcaatcaagaatctggactggtatgcccttaagaacacatcgtcgttgtgatgaccctatgttttctattgcaaacagtattgcttatgggggtcaaatggttcaggggcgtgttgatcgcgaaggaaagcctacaccagcaaatatagcttatgatattggtgtgagtacatggatgcatgtagattcaatagattttgctcatcctgttaattctgaagaacttgatgtattgattgattctttaagaaagcttgaagaaaagcgaaaaactacaattaatagttcaaaaattaaaatatatgtcatttcaccttttagaaaagttattcaagcgtgtaaaagcagtattgaagaggcaggaataaaaggcattgaatgtggcactgtacatacttttcagggtaaagaggcggatatcgtatttttagtattaggtacagcgaaggatcgtaccggggaaggagctagagcttgggcttcctcaagtccaaatttattaaatgttgctgtgacacgagccaagagtcgtttgtatgtgatcggtaatgtggatacttggtctaaaatggactatttttcaacactcgttaatatacttccagtgaaaacggtaaatatatctaagacttatacttaa

SEQ ID NO: 2557 - DNA, 1578 bp, Acinetobacter baumannii
ataaaattttgtataggcagaaaaattatggtcactaaacctagaacaaatacacgcacccgtaaaacccaagaagttgcacatatttatgacacttttattgtcggtgcgggtatttctggtcttgctgctgcaattaagctaaacgaagcaggcttaactaattttaaaattattgaaaaagcaagccgcgttggtggtacttggcgtgaaaatacctatccgggctgtggttgtgatgtaccttcggctctgtactcttactcgtttgccccaagtgcaaaatggagtcacttatttgcacgtcagccagaaattttaagttatttagaagatgttagtcgtgagtttgatattgagtccttaattgaattcaataccgaactattaaaagcggaatgggacaatgtaaaaaatgtctggaaactagagacaagctctggtttatatattgctaaaacagttctatttgctacaggtccaattactgaagcccagattccacgtcttgaaggtctagatacctttacaggtgaaatgttccattcagcgaaatggaaccatgactatgaccttactggaaaacgtattgcggtgattggtactggtgcatctgccatccagtttgtgccccaaattcaacctaaagcaaaagaactgtttgtattccaacgtacagccccttgggtgctgccaaaaccagatacggatttgggtgagttgagtaaatcaattattgccaaatatccagcgattcaggcaagttggcgccagactgtagcaggcaccttaaatgtcatcaattttggtttacgcaacccaaaagctttaaagcctgtcaattttgctgcgaaacaactgttaaagttacaaattaaagatccggttttacgtaaaaacgtaacacctaattttgatattggctgtaaacgtattttatttgccaataattattatccagcattacaagcaccgaataccacgcttattccacatggtctagttaaagtggaaggcaacaccgtggttgcagctaacggtgaacgccacgaagtagatgtgattatttggggtacaggttttgaagtgtctcatccacccattggtaaacgggtacataatgaaaaaggggaatgtctggcagaactctggaaggactcctcaccggaagcttacttaggaaccaatattgaaaatgtaccgaacgcatttcttatgctagggccaaatgtcttggtttatgactcattcattggtcttgctgaagcccaactgcaatatattgtagatggtttattgcaaatgaaagcgaaaggtattgctaaactttctgtaaaatcagaaataattaaaaagcataatgagcttgtacaaaagcatttacaaaccacagtattcaatagtggtggttgtaagagttattaccttgatgcaaatggtcgcaactttgcagcatggccatggtcattgaaaaagcttaaacagcgtttacatcatttaaatttagaagaatacaatatcatctatgaagctgatcttgtaaaagtaaaacctaaagttgaagaagtcgcaggttaa

SEQ ID NO: 2558 - DNA, 639 bp, Acinetobacter baumannii
tcacagctttgtataaaagtgattaaactttattggatcagcgtgaatatgcaacaaacaaataaacgctaccctttaggggctcatcttattgtaaaacatctcggctatagccatcatggtatctatgctgggagaggtcgagttattcattattcgggcctcgcacatttcatcaaaaaacggcccattgaaatcacttccctagatgccttttctcatggcaagaaaattcatgtacgttcttacgatgcaccacgctacagaggaaaagttgttgtacgacgtatgcgttcacgtatgcatgaaaaccattatcatttgattattaataattgtgagcatttatgcagttgggcgattactggtatcgaaagtagtactcaagttgagcgtatgatgcatcgtttaaccaccattggttacgtgagttcaatcatgagctatatgaatggcatgatgctaaccgtagcaaccacctgctttgctcttgttctttatattaaaaagaaattacgtgatcaggcaaaaatgaatattccgacttatcaatttctaagagaaaaagccgaaaaaagaaatatagacccaacctcacctttagtctttatagaaccagataaaaaagaaactatctaa

SEQ ID NO: 2559 - DNA, 906 bp, Acinetobacter baumannii
agggcttcttgctgcaattgcgagctactgcgaaagccatctaaatcaagctgtaacagtataatttttattaaattaaggggatacatcatgacaaccaacaatacacaaattcaggctgtggtttttgactgggctggtacaacagtagattttggctcacgcgcaccaattttggcttttatagctttatttaaagacaataaagttgaaattacggttgaagaagcgcgtgccccaatgggcttagaaaaacgcgaccatattgcagcagttttaaaaatgccgcgtgtagcagcggcatggcaggaagtatatgggcaagctgcaactgaagcagatattgatcgtttatataaagactttattccgtatcaattaaattctattccgaaatgttctgctttaattccgggtgcattggaaacgtttgaaaatattaaaaagcgcggtgcaaaaattggcagtaacacgggctatgcatccatgatgattggtcgtttggttaaagatgctgccgatcagggctatcgaccagactgtattgttactgccagcgacgtgaaatatggccgtccatatcctgaaatgctatggaaaaacttaattcaactcgatgtatccgacatcaaaaccgttgtaaaagtagatgatactgtggtgggaattgacgaaggtttaaacgcaggttgctggacagtcgggcttgcgattagtggcaatgaagtcggtttaagctatgaagagtggagcgcattatcggccgatgaacagattgttctaaaagataaggcataccaaaaaatgaatgcgtcgggcgctcactatgtgattgatagtgtcgctgatttgccaaatgtactcgatgatattgaacgccgtttagagcagggtgaacgaccttaa

SEQ ID NO: 2560 - DNA, 609 bp, Acinetobacter baumannii
atcatgccttgttatagtattgacggtgttatcccagtcgttagcccagaggcttttgtacacccaactgctgttttaattggcgatgtgattattgaagcgggcgtatatgtagggccatttgcttcattgcgtgccgattttggtcgtatccatattaagcaaaatgccaatatacaagatagctgcaccgtacatggttttccgcaaagcgtgactttagttgaagaaatgggacacattgggcatggagcaattttgcatggttgccgcattggaaaaaatgttttggtcggtatgaacagcgtaattttggactatgctgaaattggtgaaaacaccattattggtgcaaatagcttggtcaaaaccaaagatattattccggcaaatgtattggcaatgggtagtcctgccaaggttgcacgtgatttatcagaacaagaaaaaaagtggaaaacccgcggtacgcaagaatacattgagcttgcacagcgctgcttaaactcaatgcaagaggttcagcctttagcttcagagttggatgaccgcctgacctataaggactttagttcttcaaactatcaaattaaacaagatagcgtttaa

SEQ ID NO: 2561 - DNA, 1509 bp, Acinetobacter baumannii
tttatgtattgctccactatcaatgcagaagatctcaacaggataatgatcatgcagcttaatgaactcgctttatttcgtcagcaagcttttattgctggaaagtggtgcgatgcagaccatcaacaaacatccaaaattttaaatccggcgacattagagattattggtactgtcccaaatatgggcaaggctgaagccgagcgtgccattgaagctgccaaagaagcttggccgttatggaaaaataaaacagcaaaagatcgatcaattattttaaaaaaatggttcgatttaattatttcaaatgcagatgaattggcttttattttaacgagtgagcaaggaaagcccttagctgaagccaagggtgaaattttatatgctgccagttttattgaatggtttgccgaagaagcaaaacgagtgtatggagatattattccaagcccatatccagatgctcgtattgttgtaaataaacagcctattggcgtcgttgcagctattacgccgtggaattttcccgctgccatgattacgcgtaaggttgctccagccttggcggcaggttgtccttgcattgtaaaaccagcacctgaaacaccttttactgctttggctttagtggacttagctgtgcaagcgggtgtgcctgctgaaatctttagtgtgattacaggtgatgcagttcatattggggatgcgatttttgaaagtgatgtcgtacgcaagtttacttttacgggttcaacaccagtcggcaaaatgctgcttgagcgttcagcaaaaaccttaaaaaaagtttccttagaattgggtggcaatgcgccgtttattgtatttgatgatgccgatttagatgcagcaattgagggagcgctcattgctaaatttagaaatgcagggcaaacctgtgtgtgcgtcaatcgatttttagtgcaggctggcatttatgaaaaatttattgctgccctaagccaaaaaatccaaaactttaatattggtaatggattagaagcagggcacgacattgggccattaattaatgccaatgcggtgaaaaaagttgaagctcatattcaagatgcattagataaaaatggtcgtcttgtggttggtggtaaaaagcataaagcgggtgaattgttttttgaaccaacactgattgcagatgttaccgctgatatggatgtggcaacccaagaaacgtttggtccgctagcagctgtatttaaatttgaaaccgagcaacaagcagttgaaatggcaaatgcaactgaatttggtttagccgcatattgttataccaaagatttaggccgtgcttggcgaatgagtgaacagcttgagtatggcatggtcggaattaataaaggccttatttcaaatgaagttgcgccttttggtggaattaaacagtctggtttagggcgtgaaggttctaaatacggtattgaagattatctggaaattaaatacaccttgtttggaggattgaatatatga

SEQ ID NO: 2562 - DNA, 669 bp, Acinetobacter baumannii
gccatggaacttgattatctatttcaagcgagtcacctcgaacgtttaatgtggggactttgggcaactgcaaaaattgcatttatttcagtgtttttctctgcaattttcggcacagttttcggcgtcattatgacttctaaaaacatagtcgttaaatcgctgtgccgcctgtatctagaagccattcgaatcattccaattttagttttgctgttcgtgttttatttcggctttgcgacatggtttaactggcagttttcagcaatgtgggtatgtgttgttgtgtttgttttatgggggacggcagaaatgggcgatttggttcgtgcagccattacttcaattgatcagcatcaacgtgattcggcctatgctcttggactaactcatgttcaagctttgatctatgtcatttttccgcaaagtctaaaacgagtaacaccaggcgcgattaacttatttacccgaatggtgaaaaccagctctttggcagtcctaattggtgtggttgaagtcattaaagttggccagcaaattattgaaaactcgctgttgaccgtgccgagcgcttctctttggatttatggctttatttttattttgtattttctgatttgctatcccttatctcgtttggcggcacatttagaaaaggtctgggagtaa

SEQ ID NO: 2563 - DNA, 396 bp, Acinetobacter baumannii
tgttttagttgtaattcaataaaagatcatctggagtttggttccatgaacaacatgaaatacacgtataaaccgaattattttttctttgctcataaattagtcttgtttttaaaagactatttactcaaacatcctactgaacagaacacgacgtttaatttacaaacaatttatgatgtctttagccacgatctagcctctagcacaacaaatctagaaggtattctaaacattgcggatgagtatgttttagaaacagaagagggccttttaccattgattagtagccactcaatcaatttaaagaatcatgtactttctttagagttttcacctaaagcgttaacaagcttattgtcggggcgttcattagtgaatccgaaggctgcttag

SEQ ID NO: 2564 - DNA, 570 bp, Acinetobacter baumannii
ctttgtacctgcttcagaaatgtgggagtggataagacaggttttctagatccaaaatcaaaattatttaatccaaaccatttacacttatgttcatttcgatattcggatatagcggtgatatgggctaaatttggttttaaaaagcaaggccgtcaaatcattggcacaactgaaaagctcatgatcaatgctggtagttggaagaaagagcgacaagaagaacaattcattgaatggtttgaatacatctccgaatatctcatcacttttgatgcttcatattcacagattgctagtgttgttaacttttgtgtcttagttgagcatgagctttatcacattgcgtataagaaagatgagtggggaacatctgcatataaccaagaaacaggtgtgcctaaattagctatacaaaagcatgatgttgaagagtttactggcgttgtacgtagatatggtgcaagtgaggacgtcaaaagaatggtcgaagcagctaatacaagacctgagatgtcgcgagcagatgttcactacgcatgtggcacttattacttgaaggtggtttaa

SEQ ID NO: 2565 - DNA, 1131 bp, Acinetobacter baumannii
actaccgcctgcatattcttatcctcttgcatttttcggtttatgacatcttccaacacatcacgcattgcagtgcaacaaattgatccacatgaattaaaaacatggatcaaagctcaagctttagacttgggttttgctgattgtgtcattgccaaaccagatgctcaagagcaaatgccacgttttttagaataccttgaacgtggttatcatgcagatatgacctatttagaagaaaatctggaaaagcgagcagatccaactttattggtgcctggaacaaaaagtattatttgcgtacgtatgaattatttggtggaatcaccaaaaccacgatatgtacctttcgaaccaaactctgcgattattgcccgttatgctcgtggtcgtgattaccataaggtgatgcgtggcagattaaaaacgttagccacacgtatccgtgaaaaagtgggagattttgaatcccgcccttttgcagactcggcacctatttttgagaaatcattagctgaaagtgctggaatgggctggacaggtaagcatactttgctcatccataaaaagtcaggttcattctttgtcttaggtgaactatttacatcactcgacttaccttttgatgaacctgctacttctcactgtggttcttgtagtgcgtgtattgatatttgcccgacacaagcgattgtcgaaccttatatgttagatgctagacgctgtattgcttatctcaccatcgaatataaaggaatcattgcagaagaattacgtgcaggcattggtaaccggatatttggttgtgatgactgccaattaatttgcccgtggaatagttttgctaaaacagcgtctattcccgatttcaatcctagacatggtttagataatattagtttgcttgatatttggcagtgggacgaagctacttttttagccaatacagaaggcagcccaatacgacgtacaggttatcaatccttcaaacgtaatatcgctatcggtttaggcaacgcaccgtactcaaaagaaattgtagatcagctaaacaatggtaaaagtttacatgacgaaatcgtcaatgtgcatattgattgggcaattgaacagcaacttaatcaactttag

SEQ ID NO: 2566 - DNA, 951 bp, Acinetobacter baumannii
  unsure (552): Identity of nucleotide sequences at the above locations are unknown.
aaatcttgctgcataaaaatttcagagtttgagtcacttcatatgagtacgccaacagaagcaaaattttccctgacttattatacgggtttcttatctgtactatttgctgcttttctatggggtacggcaggcacagcagcatcttttgcaaagggcatcagtccacttgtaattgctactatttctgtgggcttcggtggtttaattcacacatttttaagtttaaaagctattaaaaaagattaccgaaagctttttgactataaaactaaagttttgattgccgtcattgtttctattctttgtccatttgctttttattcctcggtctcattagctggtgtttctattggtactgttatttcaattggctgcgcccctttgttctcagttatgcttgagtggctattagataaacgtaagctttctttaaaatggcttatcagttttattcttggttttttaggagtcgttttattttcatatgcaggcgaacacagtcaccaacatcaaggcgtccaatccgaacggctatcaggtgtatttttnggcttgctctcaagtctgagttatgcaacatattcatggattatgaaaaacttaatccataaaggcatcgactcaagagctgccatgggcgtgatctttgggatttcagcagttctgttattacctactttattaattacagcaactcacctatttaattatccaaataatatttgggtagccctttatatcccaatcgtacctatgttcttaggctatttattttttagctttggtttaaaacgtattccagccagtcaagccatgacgttagctttggtcgaaattcctgtggcagctttattggcagttgttgtcgtaggcgaaagtttaacaatgaatagttatttaggtttaattctcattttcctatgcgttattgttcttactaaaaaataa

SEQ ID NO: 2567 - DNA, 225 bp, Acinetobacter baumannii
gcttttagactgattaatttactagggcatatgaaacgttactggaaacaaaccgattcaatagcttcacgttggacgaccgaacaagactgttttttaatagaaaataattcactttctatagatgagctaaaagagcatttaccattttctgaagatgaaataagagttcgtagatcagttttaggactcgtaagacgagatcagcaaatgagaccgtattaa

SEQ ID NO: 2568 - DNA, 624 bp, Acinetobacter baumannii
tttttattatgctttatttcatttatggcttttacgattgcatcacccgttacttttgaagaagaaattaaaaaaagtagatttcaggcgattgctgcgccagtagaaaatgaacagcaagtgaaagagtttttagaattaaataaagatatctcgaccacacatcaatgttgggcatggaaaattggtcataacgttcgctttaatgatgatggggaaccatctggtacagcgggacgtccaattctggcaactattgaaggaaatgacctgactaatattattgtcatggtgaaccgctggtatggcggtataaaactgggaactggtgggcttgttcgggcatatggtggttgtgccggacaatcgttattgttagctgaacgtattgaactgattgccaagaaaacgattcatttttcttgtcattttaatgagtgggccatttttcagtatgaactgacacagcagcaaattgaatatcaggaaagctatactgcaacaggtgtcgatatcgaagcgagattacaggttcaccaaattgaaccactcgctctaaaactacgagatgtgactcgtggtcgcgaagaattaaaagttgaggaggaattgactgatgactga

SEQ ID NO: 2569 - DNA, 645 bp, Acinetobacter baumannii
attgttatgtggcagttgtatggacatgagtttttaacgctagctcttattcactttatggcggtgattttaccgggaccagattttgtgattacggtaagacaaagtgtacgttatggctatttgattggttgtctgactgcaattggtattggtgtcggaatttcagtccatgtgttttatacactggttggtattggctttttgattcagcaaagtgaatggcttatgtcactgatcagaacagcgggggcggcttacttagtgtatttaggatggcagtgcttacgtagccagccgaataccaatattgaaattaatggccaattagacagtgacacgccgagtttatttaaagcgtttacaatgggttttctcactaatgcgttaaaccccaaagccaccatcttttttctggcaatttttacgacgattgtaagtacgaccacaccaatgaaagttcaggttttttatggggtttggatgtgtatggtcaatgccatctggtttatggtggtgagtgtactgtttgcacagcctatcgtacgtaaaagatttttggagtttggggtttattttgagagggtgatgggagtgttattaattggaattgcattgagattgatttggggattgtttaattaa

SEQ ID NO: 2570 - DNA, 417 bp, Acinetobacter baumannii
tatttgaggtgtgagatgaatatcggtcaggcatccaaacattcgggtatttcggcgaaaatgattcgctactatgaagaaatcggtttacttgaagcagctcagcgttctgcttctggctatcgtatttattcagaaacagatcttaaaactttaaactttttaaaacatgccagagagttaggtttttcatctgaacaaatgaaagagcttatttcgctttggaaaaataccgatcggcatagtgcagaggtgaaagctttaaccgtaaaacacattgccgaattaaagcaaaaaattgcccatctacaagaaatggttaatattttgcaggcttcagctgatgattgctgtggtgaccagcaggcttcgtgtgcgattttagaccacattgaaaaaggtgtaggcgtaagttaa

SEQ ID NO: 2571 - DNA, 1026 bp, Acinetobacter baumannii
cacaacctgctgcgggagttaagccatgacatggaaactaacctctacattcaaggaggagcattgatgcatacattaaaaacaactcctctgtattacgggaaaagccctgcgcgtggtgatttcttaaagacaaaaggtcaatatgccttaatacaggtacttgatcagtggataacagaagcattggaatatgcaatgcagtcaaatatgttcaaagaggcatatagtaatttgccttcattggatttctttattgcaaatccacaagagaacatgttcttggctgctaatttgttggcgagcgaagacagttcaggccgagcttttccgatggtactcagtcatttacttgagattgatttgccatatgaaaatttactatatgcaccttatagctataagcatgtcttaattgatttatttcaaaataatcgtgcattaagagggattaaagattctgatttattatttggtaagctaaatcatttaccaaatcaaattcaggttttatctgaacgtgaatgtgtaggtttttatgaaaatcataccatgcattcatttgctcagttaatgaagctaagtatttatgagttagctcaaagcatgattggtttaggattactactacaaccaattttacaaaatgggactagccgtttaaataaagtcttgattctaccgattaataatcctgcttattgttatgaaatagcggcattctgggtcagtattatttgtcggtttttaaaacagcataataccgaagtattaattgggttgttacatcgggagcagccagtattattctttggttttcagggtgctgatattttagctcttagcgatatttttactcagaatatggatagcaaacattgggtttctttaatacaagctcaatggattgatacttatttggaacagaatgctggtttagcaacgctagaacaatctttatgtcaacgccaattaagtttaaatcaaggtttaaaactatttagacagacttttttgggtgaataa

SEQ ID NO: 2572 - DNA, 183 bp, Acinetobacter baumannii
acgatactgctttttaaacactctataattttaaagtatcatgacttaacgatacatgcctatgactctcaggtacagcctttaagtgcagaaaaattagtgaattacaatttttgcgttaaatatttttattatttagattcatcaataggaccatttaaaataatgcacatgtgtgcttaa

SEQ ID NO: 2573 - DNA, 795 bp, Acinetobacter baumannii
aggataagtcgtaccgaaaatgatgctttcaaagcaataatttcattatggtggatgactaaaattatcatccttttgtttgtgtcatattttgaggttaagagaatattcgtgacgctaccatcttttaatgtatcaaatcttggtgcaatgccttcggtatctgaagttattgtcaaatatattagagaagcaattattgcagggcatattgctgaaggtgagcctatccgtcaggatgaaattgccaagctatttaatgtcagcaaaattccggtacgtgaagccttaaagcaacttgaagccgaaggcttagtagagtttataaaaaatcgcggtgcaattgtgacccgtatttctgaagaagaattagctcagatttttgaagtacgggttatgttagaaacgaagctgattcagctcgccgtaccgaatatgacagaagaaacttataaaaaggcagatgaaatttgtaatgcctttatcgacaacatggatattggaagctggaccacactaaattggcagttacatgcctgcctgtatgaaccagcacaacggccttatatgctcggattaattcgttctatttacgataaaattgagcgctatttaagattgcagatgaatgtttccgaaggcaaatcacgtgcaaatgatgagcacaaagaaattgtgaaagcctgtaaagccaaggatgttgatttggcggttaagttaattgaagagcatattaatggtgtttgccaatcactttatgagcacttacctcaccataaaaatgggaaaaactaa

SEQ ID NO: 2574 - DNA, 1854 bp, Acinetobacter baumannii
tcattcatgctgaagtggtttgaaaaacttgtagatccttatccaaccaaaggtttggatgagcccttaccaacacgctttttcccatttgtttggcaagctactgaaggtgtgcgtccatatttattgctacttattatatgtacagctggtgcagctagctttgaagccctgctcttttcaaaaattgggcaacttgtagattggcttagtaatagtcagcctgaaagtttcttaagccaacatgcttcaaacattcttattctcattagcgtgttatttgccaatattttatttgttaatattcaatctattataaaacatcaaattttatatagtacttttccaatgcgcttgcgttggcgcttccataaccttttattgaaacaaagcctagactttttccataatgattttgctggtcgactttctgcaaaggtcatgcaaacagctttagcagtccgtgaattctggattattttaggcgacatgttggcttacgtcagcatttactttattactgtaagtattgttcttggtgcaatctcacccacattacttattccacttatggtttggttagggttatttttattaagcgcatggttctttattccacgtttaagcaaagtatcacaacaacaagccgatgcacgtgctgtaatgactggccgtgtaactgatgcctatactaatattcaaactgtaaaactctttgcgcatgccgggcgtgaaagccaatatgcaaaagcgtcaatgaaagagtttatgaccacagtctatgcgcaaatgcgtctaggtactctttttgaagttagcattaatttactgtctgctgttttatttgttggggtaattggtaccgcagtttggttatggactcaaggtttagcagcgttaggtgtaattgcagccactactgccatgattttaaaacttaatagcatggctgagtttatgatgtggcatatgtcagcattatttgaaaatgttggtaccattcaagatggcatgcaaacacttggtaaaaaaatcaatattcaagacaagccagatgcaaaaccacttgcagtcacacaaggtgagattgtatttaaagatgtgacctttgcttataacaataaaaatgtcatcgatcactttaatctacacattaaagcaggtgaaaagattggtatcgttggccgttcaggtgcaggtaaatctaccctcatccaattacttttacacttttaccatcttaaagaaggtgcaattttaattgatgggcaaaatattgaagatgttacgcaagatagtttgagagcaaatattgctttagttactcaagacacttctctactacatcgttcagttgccgaaaatattaaatatggccgtccggatgcaactgatcaagatatgcaaagtgccgtgcataaggcaaaagcagctgaatttattcctcaacttgtcgacttaaaaggacgttcaggttatgaggcacaagtgggtgaacgtggtgtcaaactgtcaggtggtcaaagacaacgtatcgctattgcgcgtgttttcttaaaagatgcaccaattttaatcttagatgaagcaactagcgctttagactcagaagttgaagcagctattcagtcgagtttaaatgacctgatggtagataaaacagttattgcaattgctcaccgtttgtctaccattgctcaaatggaccgtttaattgttcttgatgaaggtaaaattgcagagcaaggtactcatgaagaattaattgctaaaaatggtatatatgcacaattatggaaacgtcaaacgggcggttttcttattgagcaaaaagtaatacagggtcaagattaa

SEQ ID NO: 2575 - DNA, 426 bp, Acinetobacter baumannii
gtgaatatccgtttagcacaatgggaagataccgagaccatatgttatttacttaaacaaatgggatattcacagcctttaaaagtagttcaagaacaatttcaaatattaagtaaagatcctaatgcgattacgttggtcgcagctgacgatttaaaagtgtatggagttttatcgctttattttattccacaaattgccttacaaggtgactttgccaaaatatgttatctatgtgttgacgagaagatgcgtagtaaaggagtggggcatttgcttgtacaagaagcagaacggttagcaaagcaacgtggttgtgaccgaatggaacttcattcggggatacaaagacctttggcacatcaattttacttaagagaaggctatgtcgaagcgccaaagtactttcgtaaagctttaaattag

SEQ ID NO: 2576 - DNA, 861 bp, Acinetobacter baumannii
agaaataaccgcttaaatttggagatagacatggctcaaacagcctctaaaaaatggctaggcataggcttagtcgttgtagtcctttttgttgctttgttcttatggaataaacatcgtcaaagtggctcaaatgaacttgtgattggcattagtccaccatttgcaaaacctttacaagctgctgccgatgaagcaaagaaacaaggtttaaatgtaaaactggtcgaattttctgactggaataccccaaatattactttaaatcatggggatattgatgcgaactttttccagcatcaacctttcttagataatgcaattaaagaaactggctttaagttaaaggcatttgcagtgggtgcagcgtcacatgtggggctgtattcaaagaaatataaaagtcttgatgaattgccacaaaacgcacgtgtggtcattccaaatgatccggtgaaccaaggtcgtgccctacttcttttacaacaagctaagttaattacgcttaaagattcaaataatcacttatctgcactcaaagatgttgtttcaaaccctaaaaatttgcaatttattgaggttgaaggaccacagactgctcgtgcaattgatgatgttgacttggcttttggctatccacattacttgcgcttagcaaaaacagcagaccctaatagtgcgcttttactggatgacaataccaataaacgttatgccattttgtttgtagtgcgtgatgactatgaggataagggcgataaattaaagaaatttgttgagatctatcaaaactcgccaaaagttaaagctgtgttagatgctgaaattgggccaaaactttggttccctggctggaagtaa

SEQ ID NO: 2577 - DNA, 717 bp, Acinetobacter baumannii
gaatcgttacgattaaaaaatcatatcaacaacaaaactcgagataggcgagcacaccacttgtgcggcttttgcatgcctgtatttagcactcattttaagagtgacggcatttctatctctgtacatacaacaagaatttataacggtaaaactatgccaaatttagaaacctcttctaaaaaattacacattattcgtaccgctattcgtttgtttaccacatatggattccatacaacaggcgtagacctgattgtcaaagaatcagaaataccgaaagccaccttgtataactattttcactcaaaagaacgacttattgaaatgtgtatagctttccaaaaaagtctacttaaagaagaagtgcttgcgattatctattcaagccgttattgcacgccaaccgataagctcaaggaaatagtagttttacatgttaactctaacagtctgtatcacttgctacttaaagctttttttgaaattaaggtgacttaccagcaggcttaccgtatggcaatagagtatagaaaatggctgactcgtgaaatttttgaactgatttttagcttagaaatacgcgctttaaaacccgatgccaatatggttttaaacttaatagatggcttgatgttcgagtttttgagtacaaagagtttggatgaaagtgatgtggtggtggagtatttttttaagccaacttgtttgaggtaa

SEQ ID NO: 2578 - DNA, 1023 bp, Acinetobacter baumannii
gtcatgcaacgtatcgccattaatgggtttggccggattggacgtaatgttttacgtgcctggtttgagagcccgaaacaatttcattttgaaatcgtggcgattaacgatatagcagatgtacatacactggtacatttattcaaatatgactcaacccatggtcgttttaatggcaaggttgatatcaccattgaaaatgaaaagatttatttaaatattcaatctaaccagagactcttaaaggttgaagttttgcagcaaaaacagccggaacttttaccgtgggcaagtttaaaaattgatgttgtacttgagtgtacaggtttattccgctcccatgctgatgctacccgccatttagaagcaggggctaaaagggtcattattggcgctgcgccttttgatcatgttgatgctgcaattgtttatggtgttaaccatgctgatgtgaaagcgactgatcagattatatcgagtgtgtcatgtacgacacaggctttagttccactggttaaaatcattgatgatgcatttggcatagaaacagcgcttatgacggaaattcatgcggtaacagcagatcagtctgtgcttgatcatgcgcatcgtgatttgcgtcgtgctcgagcttctgggcaaaacattatcccgactacttctagtgcgcttggtgctttaaagcgtgtgatgccaaaaatggaagaccgtattgatggttactcaattcgggtacctaccattaatgtagcggcaattgatttaacgtttatcgcgcaatctccaattacggttcatcatattaatgaattgctaattaaagcatctcaaacagattatgcagaaattatggctgtaacagatgaaccattagtttcaagtgattttaatcattcgccttattcacttattgttgattcaactcagaccatggttgttggacatcaagccaaagtatttgcttggtatgataatgaatggggctatgcaaatcgtttattagatttgtgtgattccttttaa

SEQ ID NO: 2579 - DNA, 861 bp, Acinetobacter baumannii
atgtttaaacgtaattcaataaaaatattaagcagtcttgctgttgctggggttttattaactgcatgtagtaaaacgccatcaactgaacaggcaagtaatgctcaagaagaccattctttagaacaagtcaaaaaaaatggggttctacgcgttgctgtttttgccgatgatccgccgtttggttatgtagacagtgcggggaataatcagggctttgatgtagctctagcaaaacgggtgaccaaagatttgctcggtgatgaaaagaaagttgagtttattgtgactgaagcttcaaatcgggtggagtttttaaaatcaaatcgtgccgatgtggtgttcgcgacatttacggtaactcctgaacgcaaagaggttgtcgattttgccgagccttatttaaaaggtgcttttgggattgtctcgcctaaagccaaaccgattactgacattgcccaattagaaggtaagaccttaattgtcaataaaggcacaagttcagatacctactttaccaagcattatccaaaagtaaatttactcaagtttgaaagaaactcggatgctttcaaagctttaaccgacggtcgtggtgacgcgatttcacaagatagtacgtatgctttggcatgggccgcgaagaacccaagttatgtggcaggtattcaatctattggtgatcaagagtttattgcaccagcagttaaaaagggcaatacccaattgttgaattggctcaatactgaaattaagcaactaagaacaagcggtgaaattaagaaaatttatgatgaaaccttgaagccaatttacggtgactcggtcaatccgaatgtttttttagatgtaggtcaataa

SEQ ID NO: 2580 - DNA, 354 bp, Acinetobacter baumannii
gagagaaagcgtacaaaattaaaagataaaaaattcattaatgtcgatttagataatattgatgaagtaatggaatctctgtctccaagagctgcttttcaagtagacaatacgttgacagaagaaggcggtaaaatggctgttgatttaacatttaaatcaatggaagattttcgcccggaaaatgttgtacagcaagttgatccattaaagaaattggttgaggcgcgtgagcgtttaaccgatttaagaaacaaaatttcaaacagtgagcgtttagaagatctgcttgatgaggttcttaaaaatactgatcaaatccgtaaattaagtgcggaggccgatcatgaataa

SEQ ID NO: 2581 - DNA, 231 bp, Acinetobacter baumannii
atgattcagctttttattaacggccaaccggtttctgtgattgagggtaccagtgttgctgctgctttagcacaagcgaagtcttacagccgtttgtcagtttgtggtgaaaaacgtactccattttgtggaatgggagtttgtcaggaatgccgtgtcaatattaatggactcagagtgcttgcttgtcagacgctgtgccagcaagacatgaaagtggaaacacaataa

SEQ ID NO: 2582 - DNA, 222 bp, Acinetobacter baumannii
cgagttcagctaatctactgttggaaatacgcccatctgtttgaagaatatccaaaatttttaaatcggtacgatcaaggcttaataatgggccattcatctgaattttcctctaaaaaatgggcaaaatatagtgagttattcggtgtttcttctgtaatgataaattatctaaacctctctactcaagatgagtttacgagagctggttggcggaaatag

SEQ ID NO: 2583 - DNA, 279 bp, Acinetobacter baumannii
attataaagctttacataacctataagaaaaaaaacaaacacatatctggaaatatttttcaattacagtctaacttcaagtttttattacaaaaccacatgctcattatttggaaaatattttgtattttattattaagtttaggggctttcggagttggtttaggtattagttatttagattttttcttattttttattggtttactttttttgctgtgtttttttctagccttgaagcaagcaagagaagatgcagggagttttcctgatgaataa

SEQ ID NO: 2584 - DNA, 864 bp, Acinetobacter baumannii
aaaagcattagcgagttaatgggttcaatgaacgctattcctcaaactttcgagttttggcaagatcggcgaatgccttatgtggaaacccgaaggtcatgttttggcagaacatgttataagtctcatagccatccaacattttcaattggtgctatagatgaggggaatagtgtttttcaaagttcttttggcactgcacaaaagatcacggcgggtacattagttattgtgcccgcacatgttgagcattcatgtaatcctatgccaaatcaggcatggagttaccagatgcttcatttagatctagcatggttaaatcaactgtattcagaatttcaagagcaaggtcttgatttacatatacctcagcataagccgctcattataaaagacgaatttttatatgaagcttttactgaaatgaatgagacattatttgatgcgcaaaaattaatttttgaaaaagagcagtctcttctccattgcctgattcatttgttattacctcattttattttagaagaaatacaaaagcctcaatatttatataaagactttttaaacctgatcgatgtgatttcatcctcagagggttttatttctttagaagaacttgctcaacgagtaggtttaagcagatatgcaatcatacgtttattcaaagcaaatgtaggtttaacaccacatgcatttcaaattaacttaaagattaatcaggctcgagagcagctcaaaaaaggcgtgccacttgccgaattggctgtaaatttaggttttagtgatcaaagtcatttccataaagcttttaaagcacatacaggggtaactcctcggcagttccagctcgcagccgcgcaataa

SEQ ID NO: 2585 - DNA, 207 bp, Acinetobacter baumannii
ggaataattagactaatgcgaaatcaaatacacccgattaataatgttgatccattagataccgataacgagcaaaagcaagaaaactcggtgcttaattctgtgaatcctgatccagttgaagtaacagatttatttgtagaaattggaaaagatatagctgattttgcatcatctattttagataacattgatatcaatttttga

SEQ ID NO: 2586 - DNA, 1362 bp, Acinetobacter baumannii
ttagggaagctacagcctaataaaaaatcaaatgccatgaggcatgggatgcctcatgttccttctgaggatatggacatgacaacaaagactgttacagagaatatgagtagcactgaagctattcaaacaccaaaaaagatttggattacagcttttatattcgcttttttcacacttttatgtgacggggccgacttaggttttttggcattaagtctcactagtcttaaagcagagtttcatttaactggtgtgcaagccggaacattaggaagcttgacactatttggttcggccgtgggtggccttattggtggttgggcttgcgaccgttttggtcgggtccgcattattgttttctttattgctttttcttcgatattaacctgtgcactcggctttacacattcttatatgcaatttgcagttttaagaacaataggcgccatgggcttaggtgcactttatattgcctgtaacattcttatgtctgaaatggtgccaacgaaacaccgttctaccgttttagctactctcatgacggggtacaccttaggttctttattagcgacattactagcaggtcatattattcctgaacatggctggcgtttcctatactggattgcaattacccctgtggttttgtcagttttaatgcacttttgtgtgcctgaacctgagtcatggaaaaaagcccgtcaactaaaagcgctagaagtcgctcaaagtaaccaacctaaaaaacgtcaaaatccatatcttgagattttaagagataaaaaacatggaaccatgtttattctttggattattagtactggggcattgcagtttggttattacggggtaagtaactggttacctgcttatttagagtctgaccttggcatcaagtttaaagaaatggccatgtatatggtcggtacattcctaattatgatgtttgccaaagtgatcgcagggatcgttgccgataaattaggacgccgcgctgtatttgctttcggaaccattggtacagccttatttattccagtcattgtctacttaaatacaccaaccaatattttatggatgatgctgtttttcggtttcctttacggtatgccttatgcaattaatgccacatatatgacagaaagcttcccgacttctattcgaggctcggcagtgggtggtgcttataacattggcaaagtactttctattttctctccattaacaattggttatctatcgcaaaacggttctattggtttagggctcttggtgatggctgcagcttattttatctgcggtgtaattccattgttatttattaaagaccgactatttaacccgcaaaaggcagagtga

SEQ ID NO: 2587 - DNA, 1605 bp, Acinetobacter baumannii
aagaacaatagttctgtcgttaaggaaaacgtaatgacaagtcagtttaaaaaacagttatctctaatggatcttacattcattggcttaggcgccattttcggttcaggatggttattttcagcaagtcatgtggcctctcaagccggccctgcgggtatattgtcatggattattgggggctttgccgttttaattctgggaattatttattgtgagttaggcgcagccttaccccgagcaggtggtattatccgttatcccgtattttcacatggcccattacaaggatatttattgggttctgtgaccgtcattgccttttcaagtttaattgcaattgaagtcgtcgctgctcgtgaatatgcagcagcatggttcccttctcttaccgccgtacatgatggtgttcggtctccaactaccattggatggttgtttcagtttgcacttttatgcgtattttttgcattgaactattacagcgtaaagacctttgcaattgccaacaacctgattagtgcattgaaatttgctgttccggttttagtcatggttgctcttctataccattttaaacctgcaaatttttcaatgaccgagtttgccccaatgggcgctcacggcgtacaaggtgccgtatctgctggcggtattatttttgcgtatttgggtttaacgccgattatttcggtagcaagtgaagtaaaacgtcctcaatttacgattccttttgcactcatcttatctgtcgttttggcaacgattatttatgtagtgcttcaagttgctttcttaggtgcagtacctaccgatatgttagcaaatggctggtcaggacttagtgacaagttcccattaccttaccgtgacattgccatgttattaggtttgggatggttagcactgttagttgtttcagatgccattatttctccgtctggttgcggcaatatctatatggctgcaactccacgtgtcatttatgcatggtcaaacagtaatacattcttccgtatttttacgcgtgtagatccgaaatcaggtattcctcgttatgcattatggttaacgtttgcactttcagtattttggaccatgccgtttccatcttgggataaattaatttccgtagtttcagcagcgttagttttaagttatgcccttgctcctgtcacagtgggtgccttacgccgtaatgctcctgagcttgaacgtccattctatgtaaaaggatttactgttctcgggccgctcgcttttgtcattgcgtcttttattgtgtattggtctggctggaatgtcatttcatggttgctaggcgcacaaatcgtcttgtttgcactctacgtcatttttaagcgctacgtgccaacccaagaagtcagccttgcccaacagttaaagtcatcaacatggctccttgtttactacattttaatgattcttgcctcttaccttggcagcttcggtgatggcgcatcccacctattggcagcgcctttcgacaccttattcgtcatggtgatttctcttggttgctactactggggtatacgctcaggtttaccaaaagcactgattaaaaatgacgatgaagcttag

SEQ ID NO: 2588 - DNA, 903 bp, Acinetobacter baumannii
aaattaaatagaggtagtctagacatggaaaatacaacgaatcagtatccatcagaagttcctgcacaagttcaacctcatcaaccaggtgatcaggagaaaatgcatcctgaaccagaaattattaaagcatcccataaaggcagtgaaaaactaaaaggcaaagttgccgtcattagcggtggtgatagcggtataggccgttcagttgccgtactatttgcccgtgaaggtgccgatattgctgtactgtaccttgaagaagaccaagatgccgaaattactaaacagcttattgaaaaggaaggacaacaatgtcttttattaaaaggcgatatttccgatccagaccttgcaaaacaaaatattgataaggtattacagcattttggtaaaattaatattttagtgaataatgcgggtgtgcaatatcaacaaaaagaaattgaaagtattagtaatgaacaattagaaaaaacatttaaaacaaatatttttgccatgttttatttaaccaaagaagccattccttatatggaggaaggcgatagcattattaacaccaccagtattaccagttaccaaggtcatgatgagttgattgactatgcaagtactaaaggtgcaattacctcttttactcgtagtctatcgaacaatttaatgaagcaaaaaaagggtattcgtgtaaatggtgttgcaccaggcccaatctggactccccttattccaagtagtttcgatgccgagactgtcgaaaagtttggtaaagataccccaatgggtagaatgggtcagcctagtgaagtcgcccctgcttatcttttccttgcctcagatgatgcaagttatattactggtcaggttattcatgtaaatggcggccaaattgttaatggctaa

SEQ ID NO: 2589 - DNA, 906 bp, Acinetobacter baumannii
aacgagaatagaatgcatacaattttaggctacttgtggcagtacatcacgaatcctaaagcaattatcgccttgtcattgttcgtggcattgatgtcttcctatacttcaattcctcgccatatattttgggctttagcatctgcatatgctttagggctcatcgcttatggaatttattggctaattcagcgtaaaaaacatgctgttcaaggtgaagagcttgcacaagcgattgaaaaggatacccaagcagagtacggcaaaaataaagataaagaagagctgcaacttattagccaacaaatgaaagaatctattcaattgattcgtaagtcaaagttaggcgataaaaaggggaacgcagcactatatgagttgccatggtatatggtcattggtaacccagctgctggtaaaagttccgcgatctataattctggtttaaagtttccttttgaagaaacccatcaaaaaatggtttcggctggtttaagcggtacgcgtaattgtgactggtttttttcgactgagggtattttactcgacaccgctggacgttattcggtctatagcgaagatcattctgaatggttaggctttttaaatattttaaagaagaaccgttctaaggctccagtaaatggtttaattcttattgttagtattgctgagcttgttagtcagagtcctgaacactcattaaaacttgcgaaaaatttacgcgctcgtattcaggatttaaccgaacgtttagaagtagttgtacccgtatatctagtcttttcaaaaatggatttgatcgcgggttttaccgaatttttcgaattctatgaagcgcaagaatataatcaggcgtggggcgcaacactaccatatgagcaaaatcttctcataatgccgtag

SEQ ID NO: 2590 - DNA, 1824 bp, Acinetobacter baumannii
atgaggagtagcgtgttgaaaaatttatggaccatccaagattggaaaacagcatatcaaaacgggcaaatccatcttgcagatttgattggctatgtggcagaaattaaaaatgatgatcatgcatggattgaaatttcatcgaacgagcagattcaggcacaaattgatgttttaaaagaccagaatattgctgacttacctctatatggtgtgccatttgcagttaaagacaacattgatgtcgctggctttcacactactgctgcatgtaaagagattcaatatttagcaaaccaagatgctaccgtcgttgccaaactaaaaaaagcaggggcaattgtggttggtaaaactaatctcgatcagtttgcaacgggactagttggcgttcgctcgccctatggtgcagtaaaaaatagttttaaccccgaatatattagtggtggttcaagctctggttcttcggtagtggtcgccaacggtattgtgccttttagtttggggacagacacggcgggttcaggtcgtgttcctgcaggccataacaatattgtgggtcttaagccgacaaagggctggttttctaccacaggtttaattcctgcatgtcggactattgatgtcatttctatttttgcgctgcatattgatgatgcgtggacagttgccagtttaatgcagggctacgatgaaacagatgaatattcacgaatacatccagccaatgtaccaactcaattttctaaacaaaaaatagctattccagctcagcttgagttttatggtgatattgaatctgaaaaagcctttttagttgcagtcgagtgtgtaaaaaaactgggctatgacgttgagagtattgatttcagcgcgtttaatgagcttgctgccgcactatataatgatgcttgggtagcggaaagaacagtcgccgttgaacgcatgacaacacgtgaaaaggctcatccagtcattgcccagattattgcgcaggcagataaattcaaggcaacagatgcacttcaagccgaatataaccgcgccgtactagctcgaaaaattaatttggctttacaaccttttgatgcattgatggttccgacagcgccaaccatttacaccattgccgaagttgaagccgacccgttgactaaaaatgcacacatggggggctataccaactttgttaattttgccgatctttctgctttagctttacctaatgtacttcgtgaagacggtctaccaagcggcgtaacctttattgcaccagcttggcacgatcaggcactcgccaattttgcgcagctttggcaaaccgagacatcgctgagtttaggtaaatcaactcaacattatcaaaaaagtctagagatccaatcgaatcattcagtacagcttgccgttgtgggagcacatttaacaggcatgccccttaattttcagctcactagtcgtaatgccactttgctcaagaaaactcagacggcagatgcttataaactctttgctttaaaaaataccacgccaccaaaaccagggctgcaatgcgatgcagcaggtacatctattgaagttgaagtgtgggatgttcctttagcaaattttggagccattgtggctgaagtacctgcaccacttggtattgggaacctgaaactaaaagatggaacatgggttaaaggctttatttgcgaagcgtatgccattcaagatgcaaccgatattagccattttggaggctggcgagcttatatacagtcactcaatcaaaccgctcaaagtgttgttagtaaaaatgttggggaagtttctatatga

SEQ ID NO: 2591 - DNA, 1398 bp, Acinetobacter baumannii
ccaagctggctggggtcctttaaagaaatatttacggttggtttatttatgataacttcgtcttactttaaaaaacacaagaaaaattaccgctccctaaaggaccagcagcttacaatcgcagccaaagcaaatatctttatttgtattattttttgcttgttttggactatatattttgcatttgcccaaatgtgggtgattgtttatatggatatctgtttcacactaatttccatatttagtttttttcttatttatataaaccgtatttcggcagggatacttttatcacaagcggttctactggtttttccagttgtcttttgcttatttttcgatgttgctacgcctgatcgtcctcgagtggcccatttgtttttacctgccggagcgatattgggatatttgaattaccgtagagagccaagcttcttacaaattgttttaatactactgtcgattggatgctttatattttttagtggcagctcttttactctcgatagtgccatacctttatcagaagatattcgtgatcatggtgggtggatagccacttgtgtcgctactcttatgatttgtatttcaatttataccatgcaattagaaatacaaatagaaagcagtatggagcataatctacgtttggcactgactaagcaacaatttgagcttttttatcagccccaagttaattcgtcagaaaaactgattggtgcggaagccttgttaagatggcatcatccggttttaggatatattccaacaaaagagtttattccggcagcggcaacttttgggttaatgccagagatcggcgagtgggtattggcccaagcctgcaaagttttacaggactggagtaaaaaagaagagactaaagatcttacgctttcaatcaatattagtgctgatcattttatgcaatctaactttgagcacactgtgattggtctggttcagcggtatgacttcaatccctctcggctcatattagaaattactgaaaatattgctttaaataattgtgcgagcatgatcgaaaaaatgcatttcttgtctaagcatggtattcagctttcacttgatgactttggtacagggtattcatccttaagctatttacaaaaaatgccaattaaacaaattaaaattgatcgcagctttgtacaggcagctttagatgataaacgcagcaataaattagtgacgggtataattaaaattggcctagatttaaaccttcgcgtgttggtagaaggaatagaaacggctgaacagtttagtgcttttaaaagtaatggttgtaccgagtttcagggctatttatggggctgcccaatgtctttaaatgagtttatcaagcaattgcccatcaagaccgataaagaataa

SEQ ID NO: 2592 - DNA, 588 bp, Acinetobacter baumannii
ataatggtcagtacgaattttttaatattcgaggaaagtatgcaccaaagtcttaatttaaaacgttcttcagctttcctaaaacaagctgcggtaattacattcgttgctttatcatctgcttcgacttttgctttgccgtctgaccgtaatcaacaaatttcgttagtggcagaccgagcaacttataatgaaaaaaccggtttgacgacttatacgggtaatgtcgtgattgagcagggcaccatgaagcttcaggctgactcaattgtggctacgctaaactctaaacgtgaaattcaaacgatcactgctaaaggtagaccgtctaagtttcagcaacaaataagtgctgataaaggtattgcacgcggtgaaggacaaacgattgtttataatgcagatacaggcattattaccttgtctggcggtgcatatttataccaagatggttcaagtattcgcggtaacaccctgaaatatagtatgaataagggtgatgttgaagctcaaggttcttcttcaaaccgtgtacaaatcattattccaccttcaagttcaaaaagtttcccaggagcgcgtgactaa

SEQ ID NO: 2593 - DNA, 1236 bp, Acinetobacter baumannii
tcaatctacagcccaacaaaaacaagtgagccaagggggcaattcatgagcgaacaacaacaagaacttacccgttcaatgaatgtatcttatagtgaaccacaattaccgcgtgccagtttagtcatctggatcgtgggcattggtttagtgattttctttatctgggcatggttttttaagcttgaagaagtttcaaccggtacaggtaaagttattccatcctctaaagaacaggtcatccagtctttagaaggtggtattttaactaagctaaatgtacaagaaggcgatattgtccaaaaagggcaaattcttgctcagctcgacccaacccgttttgcttcaaatgtgggtgagtcgagatctttattaattgcagctcaggccacagcagcacgtttacgtgcggaagtgaacggtacaccactggttttccctgaaatagttgcacaagatccgaagcttgttcatgaagagactgctttgtatgaatcacgcagagctgatcttgaacaaacgctttcaggattaagacaggctttacaactggttcagcaagaattggccatgacagagcctttggttgctaaaggtgctgctagtgaggttgaggttttacgcttacgccgtgaagcaaatgatttgcaaaacaagatgaacgatgcacgtaaccaatactacgttaaagcacgtgaagagttatctaaagcaaatactgacacgcaaactcaacaacaagtggtcatgggccgtaatgacagtttacagcgtgccgtatttaaagcccctgtgcgcggtgtggtaaaagaaattacagtgacaacgcatggcggtgtgattccacaaaacggtaagttaatgaccatcgttccaattgatgaacagttattaattgaagcccgtattttgccacgtgacattgcattcattcgtcctggtcaagaagctttggttaagatcactgcttatgactactcgatttatggtggtttaaaaggtaaggttacggttatttctccagataccattcgcgatgaagtgaaacaggatcaattctattatcgtgtttatatccgaactgactccgataagctttacaataaagaaggtaaagcattcggtattacaccgggtatggtggcaactgtagatattcgtacgggtgagaagactgtactggattatttacttaaaccatttaataaagccaaagaagcattaagagaaagataa

SEQ ID NO: 2594 - DNA, 243 bp, Acinetobacter baumannii
gcttttcacagaccgttgattcatattcttcagcatgcaatatactaccaactgacattaaaattactaagtattagtctcactcatctatctccccttatagaaagcaatattacaatatcagctatcgggatctataataattttaaaaaaaacttaaccgtcctaacccactttatcaaagaacggctactcgagatactgcgagtgagtgtgaacaatgggccgctaaaaaattattag

SEQ ID NO: 2595 - DNA, 1062 bp, Acinetobacter baumannii
ggatttcgcagtatgcaatttaaaccacttggtcacactggcattaaccttcctgaaatttgcttaggtaccatgacatttggtgagcaaaatactcaacaagaagctttcgaacaactcaattatgctttagaacacggtttatatttttgggatacggcagagatgtattccgtgcctcctaaaccagaaacatatggagcaaccgaaaccatcttaggcaattggtttgcacagcatggtcagcgcgataaagtattccttgcttcaaaaattgcaggtcctggttttggtggaacccatattcgagaaggccataccaagtttaatagtgaacatatttcacaagcaattgatggctctctcaaacgcttacaaactgattatattgatctttatcaattacattggcctgaacgccataccaacttctttggaacgctcgcttatggtaatcagcaagcccaaaatgattacgatactactcccttagaagaaacattactcgctctccaaaaagagattaatcgaggccgcattcgttatatcggcttatctaatgaaacaccgtggggcaccatgaagttccttcagcttgccgaaaatttaggtgtgagtaaatttgtgagtgtgcaaaatccgtatagtctgcttaatcgcacctatgaaatcggtatgtcagaaattgccaaatatgagggtgtaggtttacttgcatactctcctcttgcttttggttatttaactggcaaatttagaaatggggctcgaccagccaatgcccgcgttacactcttccctcgctttagcagatacagcaacccgcaaagtgaatgggcaactgaacaatatgcacagcttgctgaaaagcatggtttaagcctgactcaattggctctagcttttattaagcagcaattttttgtgacgagtacgattattggtgcaactaatttagatcagctcaaagaaaatatccaagcttttgaaatcgagctttcaccagagattttacaaggcattgaggctattcatatacaacagcctaatcctgctccttaa

SEQ ID NO: 2596 - DNA, 570 bp, Acinetobacter baumannii
aaaggtaggctattcctgctcatggataccagagttttatatattgttgctgtagtggttgctgctgtgagtggtggttactactactatagtggcaaggcaaaaaaactggacattggttcggcgaagaatatgacttattcggcgcagggcgtccatttgactcaaactgatgacaaaggcaatttgtatattcgtgctgaagttcgtcagcttgaacaggatatgcaacaaaaaacgtcaaagttggatcaactcaatgccactatgtataaattaggtaaagttgatgcaacattctttgctaaacaagcttatggatatgatgataatcaaaaggttgtgttatcgggtgacgtggtagccactaagttggcaccgcaaggaaccattgagtttcaaaccgatgaattaactggttatccaaaaactagagacattgaaactaatcatcaagtgacagttcagtctccacaaggcgagtttgtgagcaaaggactaaaagccaatttgaataatggtcagtacgaattttttaatattcgaggaaagtatgcaccaaagtcttaa

SEQ ID NO: 2597 - DNA, 483 bp, Acinetobacter baumannii
atggcaaggctaaataaacgggtaaaactctatatagtacggtcacttgctacctatgagacaccctcagaaacagcgaggggcgtccaagaagaatttggtatcgaagttactaaacagcagtgtgaagcatacgacccgacaaagaagactgggcaggacctaagcgaagagtttaaggctgagttttacagagtccgcaaggaaatgaacgacaaccttagtgctattccaatcgctaacattgcataccgtcttaaacgcttacaacgattcattgacctagaacaatttaaagaaaaccctgtcattgtaccgagcttaatggaacaggcggctaaagaggtcggtgggctttatacgaatcgaaaggaaataaccggtgctggtggtggaccactccaaagcgagaacataacccaagttgttgcaacgcctgaacagatacggcaggtgttagatgaactcaaaggtaaatactaa

SEQ ID NO: 2598 - DNA, 234 bp, Acinetobacter baumannii
tcatgtttaagtttaaattcagttcctttgatagcttgtcggatcaagctaatcaggcagtttaaattttcaatcatgtcttccgtaaataatttttcatttttaatctttttatataccgtatcggcgatagctaaatatctgggcatccttatctctccttataattatgcatcatttgagccacgttctgaaaaagcggctctttatggaattatgataaatttaatgtaa

SEQ ID NO: 2599 - DNA, 2013 bp, Acinetobacter baumannii
caacaattaaggacgatcatcatgtttgaaaagattttaattgcgaaccgtggcgaaattgcctgccgcgtaattcgtacagctaaaaaattaggtattagaacggttgccgtttactcagatgcagatgcaaatgcccaacacgttaaacttgcagatgaagcggtttatattggtcagtcccctgcaacacaaagttatttacaagttgaccgtattatacaagcagcgattgatacaggcagccaagcggttcatccgggttacggcttcctttctgaaaatgaccagtttgcgctcgcttgccaacagcacaatatttgctttattggcccaccagtggatgccattttagccatgggcttaaaagcgacctcaaaagctttaatggaaaaagcaggtgttcctttaacaccgggttatcacggaaccaaccaagatgccgactttttaaagcagcaggcagatcgaattggatatcctgttttaattaaagccagtgctggcggcggtggtaaaggcatgagtctggttgaacgcagtgaagactttttgcatgccttagcctcttgtaaacgtgaagctaaatcgagctttggtaatgatgatgtcttgattgagcgttatgtgattcaacctcgccatattgaagttcaagtgtttggtgatacacatggcaactatgtgcatttgtttgaacgggactgttcggtacagcgtcgccatcaaaaagtattagaagaagcccctgctccacaaatgccaagcgagaagctcgatgcaatgcgccaagcagcaattgatgctgcacgcgccgtaaattatgttggcgcaggtacggttgagtttattgtggaacaagacggtacagcgtatttcatggaaatgaatacgcgcttacaagtcgaacaccctgtcaccgaaatgattacaggtgaagacttggttgaatggcaacttcgtgtggcttatggcgaacctttacctaaactacaaaacgaattgcaaattcacggacatgcactcgaagcacgtatttacgctgaagaaccagaaaaaggctttttacccgcaattggtaaaattgactatctacactacccaactcaaaaccaatatgtacgtgtagacagcggtattgttgaaggcgatgaaatcacgacctattacgacccaatgattgccaaactcattgtatggggtaaaaaccgtgaagctgcgctgattcaaatgcaaaatgctttaagccaattccatgtggatggcttaggtaacaacattgcctttcttgaaaaaattgtacgcagtgagtcttttaaacaagccaagcttgataccaacctgattcaacgtgaacaaaacttcttgtttagtcctgaagaaattaaaccggaactggtggtagcagcggcatttattgagtttttaagcaaactgaataacaacagctcaagccaaaaacagctttggcaagctcagccactttggcgtttaaatattgcttatcagcacagcattaaactgaattatttaaaccaaaatattcaaatcaaatttgcctcaaatgaagatggcttcaccgcagaatataacggtcaaagctacccaatttcaggtcaattgattgatgctcatactgcctctgttcaaattggtgggactcagcaaaagctatcttttaatcaaagtcagcaaggcattaccttgttccaaaatggacaaagctataagtttgcctatatttgccaagattttaatcaggcagatagccaagccgatgaaggtcatttaaaagccccaatgccgggtgtggtcactcaagtgctagtcagtgcaaatcatagtgtgaagaaagacgatattttaatgacgcttgaagcaatgaaaatggaatataccatccgcgcccctaaagacggcgtgattgtagactcctatttccaagtgggcgatcaggtcaaagctggcgatgagcttgtggaatttcagcctgctcaggaggaagttgcatga

SEQ ID NO: 2600 - DNA, 1551 bp, Acinetobacter baumannii
agggcgctaagcatgacagatttagacttatctcgtgcccgaattgccgttattggttctggcactatgggcatcggcattgcccagttagccatcgttaatgggcactcgaccattttatatgatctggatgctcaaaaagcgcaacaagccgctcaaggcttagggcagacgtttaaaaagcttgttgaaaagagcaagctcacacaacagcaagctgatgaagccttagcgcgtttaactgtggtcaatcaaattgaagcgctgcgtgatgccgacttggtcattgaagcagtcgttgagaaaaaagaagttaaacagtctttatttaaacagctcgctgaaatttgtagtgcacaaaccatttttgcaagtaacacatcttcaatttcagtgactgcaatttcggcgggtattgctcacccagagcgcgtagtgggtttacacttttttaatcctgcgccagtcatgaaactggttgaaattgtacaaggcttaaaaacccccaacagcttatgtttagctttaaaagacttgatgttgaattggaaaaaaattccggtaattaccaagtcgactcctggatttattgttaaccgaattgcacggccgttttatgcagaaggctttagagcactgcaagaacaagtcaccagctatgaccagctagattatgccttaaagcaatgcggcggttttgcgatgggaccgtgtgaactcaccgacctcattgggcaagatgttaacttttcggtgacccaaagcgtttaccaagagtttttttacgaaccacgctaccgtccaagcctcattcaaaaagaattggtcgatgcaggagcttggggccgtaagtcaaaacagggattttatagttataacgaaaaaaatcagtacgagacatttcagcctcaagctgtggttgccaagccaattgatgcccatattcagctaaaagggacttggtctcagctacctgcgtttttaacccgtttaggtttaaaaagcggatctgcgagtgatgacaatatccttcaaattgatgatatcgacttacgtttaagccaaggtgagtcagccaatattcattacctaagccgtaaaatggttttaatggattggcaccatgattttgagcaggcggaggctttagtactgagtcataacgaactttgtgaagcaagtgatctggctaaagttgaagcttattttgcacagtttggtatcagcgtcatgtggattaaagaccatccggcactgttaaccttacgcaccatcgctttactcattaatgaagcctgcgaagcaagtttacatggtgttgcgagtctggaagatattgataatgccatgaaatatggagtgaattatcctaaaggcccttaccagtggttgacacaaatgggcggtgcttatgtcctccaaaccttaaataacttatatgcactgtatggagaggaaaaatatcgcgcgagtatctacctcaagcaatatgtagcaaaaactcaaaatattgctacccaatattcacgtgatatgaccgaatttgcataa

SEQ ID NO: 2601 - DNA, 249 bp, Acinetobacter baumannii
ctgtttataaggtcttatcgtatcttttgccctgtcccaagtttccctgtggatcgaggagatattacgattaccttaagtacatttatagcacattatttattcatggctagtgctgttcacgtttttttacaaatgaataaaatacttcaaaccttcatatttcaagggttttcgacgccatttgggtactggcgagccgtatcacaaattggataccacttcacttgtgaattgacaaatgcatga

SEQ ID NO: 2602 - DNA, 1494 bp, Acinetobacter baumannii
agtatgataagcaaaagtatggaaggaataataatggaacagtccaccttaaaagaatatagcggctctgccactgaacatatggaacttattttttccaaacaacgtgccaattttgaggcagatccttacccaagtcttgaagcacgccgcacaaaactgcatcaacttaaaaaacaaattatccgttatcaagatgctttagctgccgcgattaattccgattttagttctagatcacttgatgaatctaagctattagatttgcttggttctgtgttagaggctgatcatgcgattcatcatttacgccgctggatgcgtccaagtaaacgccgtaccgagcttttatttttatcaaaccgtttaagtgtgcaataccaacctaaaggtgtggtgggtgtcattgtaccttggaatttcccagtttatttagcacttggcccactcattgccgcattagctgcaggcaaccgagtcatgattaaactgcctgaaattacaccgaatactaatgcaatgcttcgacgcatgcttgctgaagtctttaatgaagatgaagtggccgtgtttggtgaagaaattacagacccagcaagatttacctctttaccatttaaccatattgtctttactggctcaccagcgattggcaaagtcgtcatgcgagcagcagctgaaaacttaacacctgttacacttgagttaggtggtaaatctcctgcaattgtaagccgcaactacccgcttgccgatgcggcaaaacgtattacgcatggtaaagcaacaaacagtggtcaaatctgtgtagcacctgactatgcgttggttcctaaaagaagtattgatgagtttgtggatgcagcaaaatccagctttataaaaatgtttggtcaaaacatcacaaacaatgagaattacacatccattgtgaacgaccgccatttaaaacgtattcaagatatcttgaccgatgcgcaagaaaaaggtgcccgtattattccttgcgacacttatagcttcgatcaacaaggccgtagaatgcctgtacagattgtgctgaattgcacaccagatatgcgcattatgaaagaagaactctttggccctattttacctgtggtggcttatgattctttagatgatgcgatcacttatgtgaaatcggacgaaagacctttagcgctttattgctttacacatagctcagtagaacgtgatcgtattttgcgtgaaactcattcgggtggtgtgaccatcaatgactggggttggcatgtagttaaccatgatgctccttttggtggtatcggcaactcgggcatggggtcatatcatggcgaagaaggtttccgcgaactttcacatgcaaaaacagtttttattcgtcatcggtttttcccgactcagcttttccaccctccttatggaacattcctacaaaaattatcgattcgctttttcttgaaaaaaggcgatccaagtattaaataa

SEQ ID NO: 2603 - DNA, 471 bp, Acinetobacter baumannii
ggagagataaggatgcccagatatttagctatcgccgatacggtatataaaaagattaaaaatgaaaaattatttacggaagacatgattgaaaatttaaactgcctgattagcttgatccgacaagctatcaaaggaactgaatttaaacttaaacatgattacatcaatttcgaagagtgtcttacaaagcctttagctgattgtacggtcaaactagatctgtcgcttatgcctaattttaaaaatgaggatgagtttgttttatggctagctggttttattgaaaaaattacaattggcggaaaacctaaatttccacctatatctcaaatgattccaaaagactttgtatttactaaggaaacctttccagtaacaccaacccctaaaaaagaagaaaatgctgaaatgataattaattattttaaatcagaagattaccttaaaaaaacaaaaatatcttcgtga

SEQ ID NO: 2604 - DNA, 2592 bp, Acinetobacter baumannii
ggaataacaagaatgcgatttgaaaaatttacgaaccgcttgcagcaagccctctcagatgctcaatccttagcgatgggtaaagaccatacagctatagcaggtattcatattttgagtactttattggaagagccgtccaatattagtttgttgcaacaagcaggtgcacggttacctgaacttaaacaaaagctagagcaggctttaaaagatgctccaactattgctaacccgacgggcgatgtcaatttaaacccagaagcagttaaagcactcaacttggcagatcgatacgcgcaaaaagctggcgatgagtttttgtcaactgactgggttttattgggcttggcagaaactggtgaaacaaaaaatattttaagtgccgtaggtgtaactcccgacagcttacgcaaagtaattgaaaatattcgaggtagtgacaaagtcatgagtaataatcacgaagaccaacgtgactcacttaataaatatacgattgatttaaccgagcgggctttatcggggaaacttgatccagtgattgggcgtgatgatgagatccgccgtaccattcaggtcttgtcacgccgtactaaaaataacccagtactcattggtgaacctggggtaggtaaaaccgctattgttgaaggtttggcacaacgtattgtcaatggtgaagtaccagaaggcttaaagaataaacgtgttttatcgttagatttaggttcattacttgcaggtgctaagtatcgtggtgagtttgaagagcgtttaaaagctgttttaaaagatttggcgaaacacgaaggcgaaatcatcttattcattgacgagttacatacactcgttggtgctggtaaaggtgacggcgcgatggatgcaggtaatatgttaaaacctgcgttggctcgtggtgagttgcgctgtgtgggtgcaacaaccttagatgaatatcgccaatacattgaaaaagatgcagccttggagcgtcgtttccaaaaagtgctggtcgatgaaccaagtgtagaagataccattgcgattttacgtggtttgaaagaaaagtatgcgactcaccatggcgtacagattttagactcagcgattattgctgcggcgaaaatgtctcatcgttatattacagaccgtcaattaccagacaaggcgattgacctgattgatgaggccgcttctcgtattaagatggaaatcgattctaagccagaagcacttgataaacttgatcgccgtttaatccagttgaaaatgcaattggaagcggtgaaaaaagatgaagacgcaggcagtaaggccgaagttactcatcttgaaaaacagatcgctgaagtcgagaaagaatacaacgatctggaagaagtgtggaaagctgagaaaacactggtagaaggcactaaacaagctcaggttgaacttgataaagcacgtattgcttttgaaaaagctcagcgcgaaggcgatttggcagaagcagcacgtttgcaatatggtgtaattccagagttgcaaaaacaacttgaacaagatgaagttgctgaagaaaacgaagagccaaaactcattcgtacaaaagtaactgaaaatgaaattgccgaagtcgttagtgctgcaacaggtattccggttgctaaaatgatgcaaggcgagcgtgaaaaactccttcatatggaagagttcttgcatgaccgtgttgtagggcaagatgaagcagtcgttgcggtatcgaatgctgttcgccgttcccgtgctggtttgtctgacccgaatcgtcctagcggatcattcttgtttttaggaccaacaggtgttggtaaaactgagttgactaaagctttagctaacttcttgtttgacagtgatgatgccatgattcgtatcgatatgagtgaattcatggagaaacattctgtcagccgtttagttggtgcgcctccgggttatgtaggttacgaagagggcggtgttttaaccgaagctgttcgccgtaaaccatatagcgtagtgttgtttgatgaggttgaaaaagcgcatccagatgtcttcaatatcttgctacaagtgttagacgatggacgcttaaccgactcacaaggtcgtgtagtggactttaaaaacacggttattgtgatgacatcgaacttgggttcacaagatgtacgtgaacttggtgaaggtgcaactgatgatgaagtgcgtactattgtaatgaatgcggtaagtcagcatttccgtccagaatttattaaccggattgatgagttggtgattttccattcactcaaaaaagcacagattcgtggcattgccgatattcagttggaccgcttacgctcacgacttgttgatcgtgatatgagtttaactgtagatgacagtgcatttgacttattgattgacgctggttttgatcctgtatacggagcgcgtccattgaaacgtgcaattcaacaacaggttgaaaatacactagctcaaaaaatcttgtcaggtgactttgttgcgggtgataccattttagttaaaggtgaaaatggtcacttagtgtttgataagctgaaactcagctaa

SEQ ID NO: 2605 - DNA, 303 bp, Acinetobacter baumannii
agagtaacaagaatgttttttctctatcgttttgttttggtgagccttctgacaataggtgttttaaatttgatggggtgcaggccaatgagtaaaaatgaatttaatacgcgttgtgtatgggccggacatgacctttcagcgtgtaattgtatttataattctttagagcagcattattcacctcaatttgtagaaagtttaccaaaattaagtttgcaaaatattgatgcaaaaatgaactttgtagaaaccatgaatcaaacaatgcagcagtgccaattgagtgcgagcaaacactaa

SEQ ID NO: 2606 - DNA, 486 bp, Acinetobacter baumannii
agcacaacaaggagaattaagatgaatttggattttacaactatcgaaaaacaggccaaattgctcaaagaagagcaagagaaactagaacagcaagatcatgattttcagttagctttagacaagcatagagaatctttaaaaaatttatttaaagaactatttcatgatcgagaaattaaaacagaaaatggaggacagttttgtgtagtatttggtgattttaaaatatctctactcattgaaacagccaaattcgagaatggtgttcctgttaaattaaattccgttaatccaattattgttaaatttaaaaaggataagcccgttgcaaaagcccaattttctgatgcaacccaatatcttgatagtggttttgaaacaccccactatcagtactattacaaacacgatgataaaacacagttagttcaattttcggagttacctgtattttttcaaacaatccttgatgcagaagtctga

SEQ ID NO: 2607 - DNA, 684 bp, Acinetobacter baumannii
aaagggacaagtgagatgataaataaaatcaccagtgacattgaaccgattttaaaagctattcctgatggggcaaccatcatgacaggcgggtttggtgtgacggggcaacctgctgaattaattgaagccttaatcgatttaggaaaaaaagaactcaccattgtaaataacaatgcagcttctggtgatcgtggtttaacaaatctgattattgctggctgtgttaaaaaaatgatttgttcatttccgaaatctgccggatcaaccgtttttcaagacttatatagagcgggaaaaattgagttagaactggttccacaaggtaatttggcttgtcgtattcaggccgcaggtgctggtctcggggctatttttactccgactggttatggcactaaagttgccgagggtaaagagacccgaaccattaacggtaaaaactatgtgcttgaatacccacttgaagctgattttgcactgatttatgccgataaagctgaccgctggggcaatttaacttaccgcaaagcggcccgcaattttgggccaattatggcaaaagccgccaagaccacgattgttcaagtgaatgacaccgtagagctaggaacgcttgaccctgagtgcattattacaccgggaatttttgttcagcacgttgtaaaagtaggagatatctaa

SEQ ID NO: 2608 - DNA, 183 bp, Acinetobacter baumannii
agaaaggcaaggtgtaatcatagatacagaattttttcaaaaaaatataacagatgggtaggtgttataacctcatctttaattaagtttttcttcaaatttatgactgaaaaaagactaaagtatggtgaatctagaagcatgagaggtacttataaaaattatttctacattgttttttaa

SEQ ID NO: 2609 - DNA, 1431 bp, Acinetobacter baumannii
attcctcaaagagagattaaggatatgagccaaaacgaaaatagcaataatgctttcgctatcgaaagtcattccattgattatgttgctccctctgaacgtaatggaaaagttcgcgatctattcacattatggttttgtaccaatattgcaccgcttgccgtcattacgggtgcaatgtcaattttaacgtttaacctcaatattgtaagtgcattgcttgcgatctgctgcggacatttttttggtgcagcgattttagctttaacctctgcacaaggcccacaggtcggcattcctcaaatgattcagagccgcgcgcagttcgggcgttatggagcattgctggttgtactgtttaccaccctcatttatttaggttttttcatctctaacattattttgtcaggcaaaaccctgcatacagttgttcctgctattcctgtgccgactgcgaccgtgattggcgcaattgcagcaaccacaataggcgtgattggttatcactttattcataagttcaataaaattggaacttggtttatgggtggttcgttgctcatcggcctcatgattatggtgccgcatattaatgcagatgtacttgctaaaggctctttcaatatgaaaggttggtttgccatgtttggtttgtgtgcggtatggcaaattagtttctcgccttatacctcagactattcacgatatttaccgaagtcgattggtatttataagccatttatctttacctatttaggtgcatcgttaggaaccatttttgcgatggcatttggtacgatcgcggttagtattggctcaaccacagatgccatggaagcggtaaagtcaggcactgggttgttcggctatgtccttatgattttgttcttatgcaatatcattggtcacaatgccatgaacctctacggtgcggttctttcttgtattacctctattcagacttttgcagggcagtggatgccaagccgaaatatccgagttgtgttatcaatcattgtattagttctagcgactttaacggcgctttgggcatcaagtaactttattagtttcttcttgaatgtgatttttgccttgttatttattttggtgccgtgggtgtctattaatttattagatttctatgtcgtgaataaaaagtcttatgacattcaatcgatctttgcacgtgatggtggtatttacggcaaatttaatgcaaaagcgcttacggcttattttattgggattgcggtacaaattccattcttaaaaaatgccttcttcacaggtgcattggccgatgtaattccggatgcagatatttcatgggttattggattggtggtgagtctggtggtgtattacgtctttaatctaggaaagattaaatgttctgcacctgcattaaacgcaaaattacctcaataa

SEQ ID NO: 2610 - DNA, 342 bp, Acinetobacter baumannii
agcgaacaaagtggcttaacaagatttatggaaaaatttgaggaaatcaaaatggaagataaaaacaactggtcgctctacgaagtatttgtacgtagtaaacaaggcttaagccaccgtcacgtaggcagcttaagagcacctgatgatgaaatcgcactacaacatgctcgtgatgtttatacgcgccgtaatgaaggaattagcatttgggtggttcgttcagaactgattaagtcatcacagccagatgaaaaagctgaatttttcgatccttctttagacaaggtttatcgtcatccgactttttaccatatcccagatggcattgagcacatgtaa

SEQ ID NO: 2611 - DNA, 483 bp, Acinetobacter baumannii
ttggagcaaagaatggagttagaccgttttgataaacaaattctggaaattttgtctcatgaagacctgaatttgaatgagctttcagaacggattaatctttcagttagttctgttcatcgccgaattaaacacttgattgaagctaatatcatggggcaactcaaaagagaaattaactttagcaaattgggttttactttgcatattttgctacaagtctctttaagcaagcatgatagtgagacatttgataaatttctttctgaaattgaagccattcctgaagtaacaaatgcttttttggtgactggtcaaagcgccgattttattcttgaattagttgcacgtaatatggacgactacagcgaaattttattaagacggattggtaaaattgataatgtcgttgctctgcattcgagctttgtcattaaagaatacaatgtatttaactgttataacttattaaataaagtataa

SEQ ID NO: 2612 - DNA, 630 bp, Acinetobacter baumannii
aaatataaaagcttaatatcaattgaggagataaagatgtctttgactacacctgttgagttgctaggtgaacacgttattttaaagccgttagatgtaactcaagctgaagcgctcaaagaggccgtttgcgatggggaactctataatctttggtatacccgtgtgccaagacctgaacagatgactgctgaaattgaaagacgtcttgatttgcaaaaagctggctctatgttgccattttatattgaagaccgaaaaacggggcgagcgctgggcatgacaactctcatgcatattgaagaagctcatcgccgtgtagaaattggttcgacgtggtatcgaaagtctgcacaacgtacgcctgtaaatactgaatgtaaaaagctattgttggctcatgcatttgagactttaaactgtattgcggttgagttacgcacatcttctttaaatgttcaaagtcaagccgcgattgtacgcttgggtgcaaagctagacggtgtgctaagaagccatcaaattgtgaaagatgatattttgcgggacacccatgtttacagcattttaaaacatgagtggcctgcggtccgtcaaaatctggaatggttattgaataaaccgcgttaa

SEQ ID NO: 2613 - DNA, 543 bp, Acinetobacter baumannii
aaacttgaaagattgagtattgtagccgaatttaatagcatagtgccgaaatgtttaattcggcagtttgatatgttcaaatcaaagactcgtttagtttatatcgccatcctgagtgcgagcgtatttatattgcaaggttgtgataatggcaatcagagctcagataaaaaagtagaaattaaaccagcgccgaaattaacgaatgatgcgacagtttatgcaaaaaaggcatggacattaatcaatactgttgatcatttagtctatgaaaaacagctcagtcaaattaatgataatgttcgtaaaccactacgtcagctcagtacagactggcgtattaatgtaaaaatgacagattcggtcactgaaggaaaatatgcgctttgccgtaaagctttaacgagtctagatgtatgggcgcgcgaaacgcttgaaaataatagttcggttactcaaaaacaggcagattatgagcgcgataaacaacagtgtaaggaagcgattgaaaatccgaatttaggaaacacatctcctaaataa

SEQ ID NO: 2614 - DNA, 669 bp, Acinetobacter baumannii
atcaggagaagcatcatgacagttttacaatcatttgaaaaagcagttttaaatgaagtttgtcctgctggcgaagcgtggatgtgcgaggttaaaaaaggccaatattttcgaattattgaccttgagggaaaccaagcagtcgatactttatttatgagtgcagaaaacccgactgagcgttatagcgcaatggataccttggctatcaaccaacaaatctatttagaaaagggcaccaaactctacagtaacttgggccgtccaattgcggttattcatgatgataactgtgggcgccatgacaccattggcggtgcttgttcttgtgaaagtaatacagttcgctatgcacatgaaacctacccaatgcatagttgccgtaacaactttatgtatgccttggcaaaacacccgattgcaaaaaagcatggcttaaatgtccgtcacatcggcccaaacattaacttttttatgaatgtgccagtaacgccagacggccagcttaaatttgatgatggaatttcaggaccgggaaaatatgtagaagttcgggcagaaatggatttgattgttttaatttcaaattgtccgcagctcaataacccatgtaatgcctataacccaaccaaaattcaactggttgtccgtgaagcggaaggggtgtaa

SEQ ID NO: 2615 - DNA, 195 bp, Acinetobacter baumannii
gtcctaatgagtaaatttaaagctggtgatgttgttgagttaaactctggcggcccggtaatgacaatcttggaagttaaaaataatggatgggttgtatgtgaatggtttgataaaaatcacacttataataaaaaagaatttttggaatcgaatatagatacctacgaaatgttagaggcatttaccatttga

SEQ ID NO: 2616 - DNA, 489 bp, Acinetobacter baumannii
tatgtaatgagagatttactcatgtcagagatttctttagataattttgattatgcgatcttaagaatattgcaaaaagacaataaaacttcccatcgagaaatttctgaaaaaatcggtctatccgctgcatctgtacaaaggcgtataactcggatggaagaaaaggaaattattttaaaaaattgcgctatcttaaatcccctcaaatttggtgaaaaaattacttccattattgaggtccgccttagcgaagatcgttcagtagttatggacagagcgaagctatactttgcttctgttgaagaaattcaacagtgctacttcgtgaatggaggagtctcatttataattatcatgctgagcaataacttatctcattttgaaagtttagttagaaaacatttcgctgataatgaggatgtaaaaacttatagaacactcattgttttagatcgcgtaaaagtaaactttgagttgaatatttaa

SEQ ID NO: 2617 - DNA, 225 bp, Acinetobacter baumannii
aaattcatttttaaaaatagctatattattttaaatgaaaattatatagactgcttggcccatttttattttgaagtatatttaaatttatcgtttactttaacttcattatattatttattgaattttcatatatttctttcattatttaatagtaaaaagcccaccttcatcaataaagtgggcttttataaattaattaacctgcgacttcttcaactttag

SEQ ID NO: 2618 - DNA, 1335 bp, Acinetobacter baumannii
tttaaagcgagtcatggagaaaggaataccatgaaagaaattgtattaagtgatttgatcaatcagcagaaagttggaccttatcaaaaatttattttggccacctgcttattactaatgattatggatgggtatgacattcagtccatggcttacgcagccccactgattatagaagaatggggtgttcaaaaatccatgttgggagtggtgtttagtgcaagcttgtttggtttgtttgttggatcatttttattaagttcactttctgatcgttttggtcgccgtccgatactactgatctcgacctttatattctccatattgatgctgttgacaccacatgtaggcaatattgagcaattgaccgtaatccgttttgttacaggaatttttttaggcggtatcatgccaaatgtgatggcttatagctccgaaattgttccatatcaatctcgtatttttaccatgatggtcatttcttgtggctatacggtaggggcaatgttggggggcggaatatcagccttactagttccttggggaggatggcaggcgattttttattttggcggtattatccctttaattattttctttatcacattctttaagttgccagaatctttatattttttaagtgaaaatagcaaaaatagctccaaaattttgttttggttgaagaagttttatccagcattaacattcaatgcagagataaaaatcatcaataatactgaggttgaggttaaaaagtcaccgcttgagttgtttaaaaatcagcgtgcgttttttacctattccatctggatcatcagtattttaaatatgatcagtttatattttctggcaaattggctaccgactttggccaaagagtcagggctttcattaaatcaggcattgttgatcggctccactctacaattaggcggtacgattggtagtgtggtgatgggccttaaaattgataagacaggattttataaagtattaattcctgtttttctggttgcagtgattagtgtcgctttaattggctattctgttagtcatatcgttttattgtttattatcatttttattgctggctttgccattgttggtgggcaacctgccattaatgccttatctgccagttattacccagtttcacttcgtactacaggggtgggctggagtattggaattgctcgtttgggttctgtcattgggccattatttggcggttatctctctcaatttctggtcattacccatttatttgtgattgctgccataccttcgctattcgtcattatcatgctgatgattcaggccaagtatcggtcataa

SEQ ID NO: 2619 - DNA, 1326 bp, Acinetobacter baumannii
tggactcagagtgcttgcttgtcagacgctgtgccagcaagacatgaaagtggaaacacaataatggaaaaacaatacgatgtggtggttgtcggtgctgggcctgcagggttgtcagctgctattgcagccgccgaaagtggcgggcgaattttaatattggataataacccacaggcgggcggtcaaatctggcgcgctggaccgattttccctgtacctgaaatggcgcagcagaaatatcaacaaattaaggctcattctaatattgaatttatgtttggtgcgaaaattgtcgccgcaccttttgcaggccaattgcttgttgagcgacctcacgacagcctcaacttgtcttatcgccagcttatactgtgtacgggagcaagagaactgtttttgccttttcccggttggactttacctggcgtaacaggggcaggtggtttgcaagccttaattaaagcaggcacacctgtcaaaaatgagcgcattgtgattgcaggttcaggaccattacttttagcaagtgcggatacggcgaaaaaagcagaggctcaagttctctatgttgccgaacaggcggcttcatcttccgttcgtaaatttgcactgcaactttggcgttggccttcgaaagtaatacaagcgttatctttacctcatcgtttatatcaacctgacagttatgtggttgaggcgattggtcaggagcgtcttgaacgagtaaggctacaaacgccgaagggaatcattgaaattgagtgtgatcgactcgcgtgcggatttggcttagtcccgaatactcaattagggcagttaatgggttgtcaaattaaggacaatgcgattacggtcgatgactatcaatgtacattacagccacaggtgtgggcagcaggtgagtgtacaggttttggcggaagtgagctggcgatggtcgaaggtagcatcgcaggttatgcagctataggccaaaatgaaaaagcgagacaattatttgctcaaagacaacggtatcgtttatttgcacatctccttgagaaaagctttaagttacgtgctgagttaaaaacgcttgcacgcccagaaactattttttgtcgatgtgaagatgtaacttttgataaagttgccgagcgtaatagttggattgatgcaaaattacatacacgctgtggaatgggagcatgtcagggaagtacatgtgcaacagcagcagcctgcctatttgattggcagttgcctaactctagaccaccattactgcctactcgtgtaaaaagcctcatggcgatgtctacttctcctttaaatcaaaaatga

SEQ ID NO: 2620 - DNA, 3783 bp, Acinetobacter baumannii
gtttacgagagctggttggcggaaatagatatgaacacaatggatacttttcatcaaatggataaatctcaccaaggctatatcaccgaattcaacgataaaagtgagtttgaacaacgcattaatacagcttggcgacgtgccgaacctgaagctgtagaagagctattacaagctgctgcggtatctgatgatttagatcataaaatttatgaccttgcatttaaccttgcccataatttacgtgaacgtaagacttcttcaggtaaagcaggtattgttcaagggttattacaagaattttctctttcttcacaagaaggcgtagcgctcatgtgtcttgctgaagctttgcttcgtattccagacacagcaacacgtgatttgctcattcgcgataaaatcaatcaaggtaactggaaagaacatgttggccaaagcagcttaatgtttgtgaatgctgctgcatggggtctcatgttaactggtaagcttatggaaacaccaaagcaaaccagtctttcaagtgtacttactggacttttagcacgtagtggccgtggcattattcgtaaagcagttgacgttgcaatgcgtatgatgggtgaacagtttgtgactggtgaaaccatcgaagaagctgtcgaccatgcaaaagtacttgaggataaaggtttccgctattcttatgacatgttaggtgaagctgccttaaccgaccatgatgctgaacgttactttaatgattacacacaagccattcatgcaattggtaaagcgtctaatggtaaaggcgtatatgatggccctggtatctcaattaagctttcagctttacatccacgttaccaacgtgcgcaaattgaacgtgttcacaaagaactctacggcaaagtatttgaactcgctcgtttagctaaacagtacaatattggtttaaatatcgatgcagaagaatcagagcgtttagaaatttctcttgagttacttgagcgtctttgttttgagccagaacttgctaactggaaaggcattggtttcgtaattcaagcttatcaaaaacgctgcttctttgtggttgattatattattgaccttgctaagcgtagccaaaagcgtctgatgatccgtcttgtaaaaggcgcatattgggatagcgaaattaagaaagcacaaatcgaaggtatggatgactaccctgtctttacacgtaaagttcatactgacttgtcttatatcgcttgtgctaaaaaattacttgcagcaccagaatttatttatccgcaatttgcgacgcataatgctcaaactttagcaacgatctatcatttagcagatccaagcaaatattacgctggtcaatatgagttccaatgcttacatggtatgggcgagccgctttatgaacaagttgttggtccacgtgagcaaaataaattaggcgtgccatgccgtatttatgctccggttggtaaccacgaaacattgttagcttatttagtccgtcgtttacttgaaaatggcgcgaatacttcatttgttaaccgtattgcagataaaacacttaaagttgaagatcttatccagtctccaatttatgatattcgtaatgcagctaagcttgaaggttcagttggtttaaaacatccatcaattccactacctttagatatgtacggaacgcttcgtaaaaactctaaaggttatgacttagcaaatgacaccccacttgcagctttagatagcacagctcaagaattacgtaatcgtatttggcaaagccatccgttgttggctaatactgattctttagaacaaggtcattctgttgcaattacaaacccagcacaaaatgatgaaattgttggttatgtacaagaagctgatcttaagcatgtcgaaatcgctcttactgcagctgaacaaacccagtcagaatggtcaaatacacctaaggatcaacgcgctcaatacttaaaacgcgcagctgacctcatggaaagccgtattcaagagttgatggtattactttgccgtgaaagtggtaaaacttatgccaatgcgattgcagaagttcgtgaggctgtagatttcctacgttactatgcaacccaagttgaaaatcttcctgcaaatacagttattcagcctttaggtactgtactttgtattagcccatggaacttccctcttgcaattttctcaggtcaaattgctgcggcattagtcagtggtaactgtgttattgctaaaccagctgaacaaactccattgatcgcagcccaagcagttcagattttatgggaagctggtattccacatggtgctgtacagctacttcctggccgcggtgaaacagtaggtgctcagctcagccaagatagccgtatcgatggcatcatgtttactggctcgactgaagttgcaaaaattttacagaagaccgttgcaaaacgtttatctgaaaatggtcaatctattccgctcattgcagagactggcggtcaaaatgcaatgattgttgactcatctgctttaactgaacaagttgtattagatgttgtaagttctgcttttgatagcgcaggtcaacgctgctctgctttacgtattttatgtgtacaagaagacagtgctgcaaccgttattaaaatgcttaaaggtgcaatgcaacagttgatcgtaggtaaccctgcaattttaaaaactgacattggtcctgttattgatgacgaagcaaaacagacgattgaccagcacatccagaaaatgaaatcgaagggttatccggtacatcaattgatgtttggtgcaacaagccaaacagaattagataaaggaacttttgttgtgccaacagcaattgaacttcctaaccttgatgacttacaacgtgaagtttttggtccggttttacacatcattacctataagtatggtgaacttgagcaactcatctcaagaattaatgcgaaaggttatggtttaaccatgggtctgcatacccgtattgatgaaaccatccaaaccgtaattcaacatgctgaagtgggtaatctttatatcaaccgtaatattgttggtgctgttgttggcgtacaaccattcggtggtgaaggtttatctggtacaggtcctaaagcgggtggccctctttatatgtatcgcttaatgcagcattgttctaacaaagtattagcaactccatttgcggtaaaaaatgagcaaaccgtttttgaaggctttacccgtgaggtttatcaaagcttacaaaactgggcgaaacaacatttaccacaagcaaaccgtgaaattgaaccttttggtgttggtaaattttatgagttacaaggtcctactggggaaagtaaccaatatattattttgccgcgtcatcgtgttctttcaattgctgatacagaacaagatcaattgcatcagttacttgcaatctttgcagttggcagccaagctgctgtaatgccaaatagtccattattggcaaaacataaacaaacgttgccaaaagatgtacttgatgcgattactaccattaaaaacatcactacagatgattttgatgcagttttacatcacggcaaccgtgaagagatcttctcattacagcaagaaattgctagccgttctggcgcaattgttggtattactcatgttgaaccaaatgagtcgattccacttgaacgtttggtaattgaacgtgcaattagcgtaaatacagctgcggctggcggtaatgcaagcttaatgacaatgtctgaataa

SEQ ID NO: 2621 - DNA, 1215 bp, Acinetobacter baumannii
tttgcatggaggcaatcagacatggcaaccctgttcaagacattaaaaaatgactggtccatatcagcaacagttgcgggctttcttgcagttttaatttcttactcaggcccactgattatttttttccaagctgctcagcgtgcccatgtgtccacagatatgatggtgtcatggatttggggaatttcaatcggcgctgccgtttcaggtatttatctttcaattaaatataaaactcctgtaattaccgcgtggtccgcaccgggtactgccctgttagttaccctatttccaaacatctcattgaatgaagcagtagccgcctatattacttctgccatcgttattttcttaattggcattacaggttacttcgacaaattactgaagtggattccgcaagacgttgctgcgggcatgatggcaggtattctttttcagtttggtattagcctatttaccgcatctgatagcatgcctttgattgtctttagtatgctcattgtctttttaattgccaaacgtttaatgccgcgctacaccatgatttgggtgttagctgctggagttttattaagcctctttttaggcaaaatgaatccggttgatgtgagttttagtttagctattccgaagtggattagcccagaatggacatggaactcaacactcaacctcgctgttcctctcattttagtcagcttaaccggccaatttttaccgggtatggcgattatgaaactcagcggttatgacacgccagccaaacccattattacggccaccagtattgcctcgttagccgttgcctgcgtcggcggtattaccattgtgcttgcctcaattaccgcagctttatgcatgggcaaagatgcacatgaactgaaagaaaaacgttacatcgcaggaatcgccaacggaattttttatattttaggaggcttatttgctggcagtattgtcatgctatttagcttacttcctaaagagttggttgcagcattggcaggtttagccttgcttggtgccattgccacaaatatttctgttgctatgaaaaatgacagtcaacgtgatgctgcacttattacctttttagctagcgcatcaggtatgcatttccttggattaagctcagttttctggggtatttgtattggtgtaatcgcccatttcattcttaccccacgctcaactccagccacaaattaa

SEQ ID NO: 2622 - DNA, 1986 bp, Acinetobacter baumannii
atgatgtggaggtggacaaatatcatgactacccagttaactacaagtaatctgcaaggtagttcaacggggcctgaagtgactggtgctaacccaccagccaacttccccgatgagtccaccattgctcgacttgctaatgagttttttttagcagtgccaagctcaagcaattcagcttctccatcgggcctaaacttggatttacctgtcggagcaccaccgcacccaccacaaccgggtgaaccattttctgcactcagtggtcgtgcgcccaatatcgcctttcagaaaagtcttaatccggaatatcctgaacatattccaaatttgccagactaccctgaacgccgaattgtagcgtctgcgcctgtggttggtggagctcatttgccacgcccaccatttgaaccacatttgccacaagctgctcatagtgaaccaaatgtgccacgcattgaaccaaacttacccactggtgcagatgaatcaccttattattttttaaatgatttttctgcccccaatgcaacagaaccatctgttaaaggtgttgaagataattattcggttgcgcagtcttttcagttgccacatggtgaccagctaaagtccttactgacagaagatcgttttgcaacgagtacacctccccaaagttcggcaagctctgtattttattttttagacttgcctcaaagtggacaaagttatagtcactatcaaccgtcgcaacctacttttgtagcaagtagtgctcaaccactcgatgtacatgccatacgtcgcgattttccaattttacaggaacgcgtcaacggtcgacctttggtctggtttgataatgcagccactacacaaaaaccgcagcgcgtgattgatcgaattgcttatttttatcagcatgaaaactcaaatattcaccgtgctgcccatgagttagcggctcgtgcaaccgatgcctatgagcatgcaagaaatgtagttgcccgatttattggtgcaccctcttctaaagaaattatctttgttcgaggaacaaccgaaggcattaacctgattgcaaaaacatggggtgagcaaaatattggtgaaggtgatgaaattattgtttctcacttagaacaccatgccaatattgtgccttggtatcaactcactaaaaaaactggagcgaaattaagagtcattcctgtggatgacacgggccagattattttagaagagttaccaaaactgattaatgaacgcactaaactgctgtcaattactcaagtttcgaatgctttgggtacagtcacacctgttgctgaagtcattaaaattgcccatgccaaaggtgtacgcgttttagttgacggtgctcaatctgtttcgcacatccctaccgatgtacaagcccttgatgcagacttttttgtgttttcaggacataaagtgtttgggccgacgggcattggcgcggtctatgcaaaaccaaagttgctagaaagcatgcctgtttgggaaggcggcggtaatatgattcaggatgttaccttcgaacaagtagtttaccaacctgcaccaaacaagtttgaagccggaactggaaacattgccgatgctgttggcttaggtgctgcacttgaatatgtagaaagtctaggcattcataacattgctcgctatgaacatgatctactcgaatatggtcaaaatgcactgagcagtgtgtctggtttacgcttgatcggaacagcgcatcacaaagccagtgttatgtcctttactttacaaggctattcaactgaacaagttggtaaagcattgaatcagcatggtattgccgtacgttcaggtcatcactgtgctcagccgattttacgtcgctttggcgtcgaacagactgttcgtccatctttggctttttataatacgacagaagaaattgatttattggtgtcggtgttacatcaactgacgcgtaataggcgtaccagttaa

SEQ ID NO: 2623 - DNA, 1431 bp, Acinetobacter baumannii
ccttataggagagcaaatatgattaaaaaaatattactctcattcatcgctatttttacagttgttagtggatttatcattttctactggcgtgatgttcaatataatccaaataaaagcgactttttcctttattttttattattgccagcaatcattactttggtgatcttgtcaccttggttaatttatagtgtttataaaagctacaaagaaaagaaagagcaggctgcaaatcaaagtcaagatgatgatagccaaaaaccatctgctgcaattgaacaacctctagaacagctggattttaatgtatattccgcttttgctatacatgccctaggcgagaatgaaactattattgaagaaatacaaaattttaaaagtccggagcttgatgagcaattgttgaattcgtatggattgcctcttttatcttatcgaattaaagatttagctgagacaaatgatgaggatattcaatacgctgcttcaccaagacaagttcgtatcatgtctttaatcaggcaacaactagaacaaaatatagagaatttgtatcgcttggctgaacatttaaagcgctcaattttattttatgagtctcatcagatccgtgaatatcatatgcatcctgcatgggtcgatccaaatagcgaatatgaagatgcggaaacaccagtagttgaagtacaccgtttaaatcgactgaatttgcatatttttcttccagaagatttattacatgtttggaatgatgagcaaagtaatgatctgattttagagttttttactgagattggcattatttcccaaaaagttcatatcgaatatcactttttgggtgagcgtgtagcttatcaagaatttattcatttattaaaacgcattcaaaagaaagagcatgaggtatttctcatgctggctgtcgattcagagattgatcaagatcttattgatgaaaaatcatggatggtcaaagattatattccggctgaatttgctgcaagctgcctccttgcggacccatcattaaaaatcgaagaactcgaaccagctaaaaacttaaaaattgtggtgggccaagaaaaagcagccaaagttcttcatacgctgaacttaaatgaattaccgcagtatgagggagatgagccatacgtacttattctttcagaccagacagatataaaagcagcgaaacaattacagcagcagtttgcacaaacttctgttgaaccacatcactatatttatgtgaaatcttcattggggcatacccagcatttagttgatatttatggctttatgctcagtatgcattttcctgaacatatcgttccttttgtctttggagaaaatacagtgtcagcacatacatttgtgcagagtgtcactgaaaattcagaagatgatgcgatggtgttgaatagctaa

SEQ ID NO: 2624 - DNA, 648 bp, Acinetobacter baumannii
aatatagggagtaagaaaatggtaaatacaaaacaatcaaattcagatggtaatcatacgactcataaagagccatcttctaatggttatgtatcatatagcaaaccattacaagacatttcatccacaattgataatgctcgtccagatttaaactctccaccgactaataacaattatgtacccgatatgaatgaagggggagagaatttggttgctacaggtgcaggaaccttgggaggagcggcggtaggtgctgcatttggtgttgttggcggccctcccggtgcagttgttggggggattattggtggtgtagtaggggcaatagcaggtaatgatatagctcaaacaaataatcaaaaagatgatagtaatgactggcaagaagaagataattattggcgagaaaactataaaaaaatgccatattatagtgaagacaagaatctagaatatgatcgtgattatcgggcggcttatcgtttaggttatgaaaatcgtgtacataataatgcagaaattaatttttccgaggttgaatctaaattgaaagctaaatgggaacaagttaaaggcagttcacgtttacagtgggaggaagctaaatttgctgtagaagatggattgaaaaaaattcatccttaa

SEQ ID NO: 2625 - DNA, 195 bp, Acinetobacter baumannii
gagatgactggcgtggatatttcttcattgatgagccctacccttaaacgcaccacatcaggtttatctaaacgttcactccagacaggtgaaccgcaggttttacagaacactctctttttatttggcgatgcaaaatacgcttgcaaaagattttcaccctgtaccatctctaaatcgcttttttgtacttga

SEQ ID NO: 2626 - DNA, 723 bp, Acinetobacter baumannii
aaaacgcatggctgtaccaggtttaggctcgggaggaaaataattatggatttttctctattgcataatcctgatgttattgcggctttaaaagaaggatttatttttacacttaccgtaaccgtgcttgcaatgatggggggcatcctcatcggaactcctttggcaatgatgcgtttatccaacaacgcccttgcaagtaactttgcgaagttctatgtcgatttattccgtggtattccattaattcaggttatttttattttttatttcttgttgccaaagatatttgagtttcaatcagatacgtattgggggccattattttccagcgttgtgacctttgccatttttgaagctgcgtttttctcggaaattgtacgttcgggtattcagtctatttcaaaagggcaagtcaatgcaggctatgctttaggttttacctacggacaatccatgcgttatgtggtgttaccgcaggcctttcgcaatatgcttccggtattacttactcaaaccatcattctatttcaggatgtgtcattagtttatgtcattagtgcaccagacttcttggggcgtgcagatactttggctaatacctatggtcctgaaacgaaagcaacattctatttaatcgtcgctgtggtgtatttctgtagctcgtttgtgctatcgcaattagtcaaacgtttgcagaaaaaaattgccatcattcgctaa

SEQ ID NO: 2627 - DNA, 1482 bp, Acinetobacter baumannii
ttctttaatggcaatgtaaggacacaacccatgcaaaatgtacagttacttattcacggtcaatctgttgatgcatcaaatcaggcaacttttgagcgtattagcccaattgatggaacggtagcaactaaagctgctgctgcaacattggaagatgttgaccgtgcaatcgaatcggcacaacaagcttttaaagtatggtcgaaactctcgcctaccgaacgccgtttacgcttattaaaagcagccgatttaatggaccaaaagaccgagcaattcattgaaactggaatgcaagaaacaggttcaactgcgacatggtatgggtttaacgttcaccttgctgccaacatgttacgtgaagctgcagctatgaccacacaaattgatggaagtctgattccatcagatgtgccgggcaatcttgcgatgggtgtgcgagttccttgtggtgtgattgtagggattgcaccttggaacgcccctgtcattttggcaacacgtgcgcttgctatgcctttggcttgtggtaacacggtagtgttaaaagcatctgaagcctgtccagcaacgcatcgtcttattggtgaagtgttacatgaagcaggtcttggcgaaggtgtggtgaatgtaattacgcatgccgctgaagatgcaccacaaatcgtggagcgtttagtctctcatccagccgtgaagcgtattaattttacgggttcaaccaaagtcggaaaaattattgccgagactgctgccaaatatttaaaacctgttttacttgaattgggtggtaaggcgcctgtcgtggttttaaatgaagctgatattaatgaagccgtaaatgcagtcgcttttggagcattctttaatcaggggcaaatttgtatgtcgaccgaacgtgttttggttcaagacaatattgccgaccaatttattgaaaaactgattgaaaaaacccgctctattcaggcaggtaatccaagctcaaaagacaatgtactcggtgttttagaaagtcgccgtgctgcaaaccgtattcagcatttgctagaagatgcccaaaacaaaggtgctgacttacctttaggcattcatattgaagacaccaccatgcaaccgacgctggtgctcaatattaaacctgacatgctgctttaccgtgaagaatcatttggacctgtatgcacagttcaacgcttttcaagcattgaagaaggcgtagcattggcaaatgacagcgagttcggcctttcttcggcagtgtttagtcaaaatatttcgcaagcactggaagtggctcaacaaattgattcgggtatttgtcacattaacggcgcaaccgtacatgacgaagctcaaatgccatttggcggaacaaaatcgagtggttatggacgttttggtagtaaagtctctgttgccgaatttaccgacctacgttggattaccattcaaacacaatcacgtcattacccgatttag

SEQ ID NO: 2628 - DNA, 348 bp, Acinetobacter baumannii
atagttgatggaggatgcatgatgaatgcttatgtacgccctcatcccgatggttttaaatcttatttaggaaaggatcagaaaaccggcctctatacagtacgggttggttggacagtatatgaaaccaatgccaatggttctgttttgtatattgttaaagaggaaagtaagattccactggatgtagaaaagtttaaaactgaccgacctaaaatctatgatgcgcttttaaatgaagtgcaatttcaacgcagaaaacaattggctattgatcttcaaaagtccaatattccctcttatgatcgtaaagcctacaaaaagcgccgcggctttacaggttcttaa

SEQ ID NO: 2629 - DNA, 339 bp, Acinetobacter baumannii
gatttatgtgggaaggttccaatgaataaaaagcatattattgtatcgatcattattggtttgattgtgggcggactaattggcgcatttggttattcaaaaactgtagcaaaatatgacgctatttcgactgcatgtgtaatggtgaatgaagcagtagaaaaccaactgctaactacagaacaagtgaaaactttaggtgagttgactggaacaaacttaaagaaagactatccaactgtagcttcaaaatttgctttctcacctgaaagtttaaagaaagcttcagaagcatcaaattgtagtcagtttattgtaggcttcaatcaatctaaataa

SEQ ID NO: 2630 - DNA, 201 bp, Acinetobacter baumannii
tcgatgagtggtttatacagactattaaaaacaagaaatggaataaaaaaagcccgattccgtggatcaggcttaatgttcgtcgataaagggtatcaagaacatgaagaatctaacaaagaatttaatgcgtcacaaaagtttccgatatacggcaacctgttatctcaactttttggtcaaaaaagagaggttatctag

SEQ ID NO: 2631 - DNA, 1503 bp, Acinetobacter baumannii
agttatgccggcatttgcatagaggcgaatatcatgacagcagattttcagctttatattaatggtcagtttgaatctggtgcagcaacgtttgaaagtattaatcctgcaacaggtgaagtctgggcacagatgccagaagctcgaaccgatgaagtcaatcgagcagttcaagccgcatctcaggcattaaaagcatcggcttgggcaggtttaacggcctcccagcgcggtaaattgctctataaactggctgatttaattgaaaaagctgcaccgcaactggctcaaattgaaaccagtgatacgggcaaaattattcgcgaaacatcgagccagattgcctatgtcgctgagtattatcgctactatgcaggtattgccgacaaattagagggtagttttctaccgattgataaggcagacatgcaagcatggattgttcgtgaacctgtgggtgtggttgctgcaattgttccttggaacagtcagttatttttatcggcagtgaaggtagggccagctttagcggcaggttgtacagttgtgctaaaagcctctgaagacggccctggaccattattagcctttgctaaattggtccatgaagcgggttttccggctggagtggtcaatgtgattactggtttcggccctgaatgtggcgccgtgctgagtagtcatccagatgttgcacatgttgcatttacaggtggtccagaaacagcgcggcacattgtgcgtaactcggctgaaaatcttgcaaaagtttcactcgaattaggtggcaaatcaccatttattgtatttgctgatgcagatattcaaagtgcggtaaatgctcaggtcgctgctatttttgctgctactgggcaaagttgtgtggcaggttcacgcttattggttgaagaaagcattaaagatgaatttgttcaacgtttggttgagcgcgtacaaaccataaaaattggtttaccccatgaaatggcaaccgagtttggaccgctttgtaccttacgccaacgccaaaaaatcgagcaagtcgttgcaagttcaatccagcaaggtgcaaaacttcttaccggtggtaaaagccttgagcgagcagggtattactatccaccgaccatcttagattgtaccgatgtacctcaagcagattgcattaccactgaactatttggtccggtgttatcggtagatagtttcaaagatgaagcggaagctgtgcaaaaagccaatagtacgccttacgggctggcagcaggcgtttttaccaccaatttaagccgtgctcaccgcatgacaaaagtgattggatcgggaattgtttggctaaatacttaccgtgctgtttctccacttgcaccttttggtggacatgggctttcgggacatggtcgggaaggtggcgcaaatgcggttctagattacaccaccaccaaaacagtttggttacgtacctcagatgagccaattaatgacccatttgtcatgagataa

SEQ ID NO: 2632 - DNA, 849 bp, Acinetobacter baumannii
gctgattgcggtcatgaacgcttagagataaaggagagaaaaatgtcacaatctacaggtgctccttctttatttgacgatgggcaaattgggacaggggggaataataatagccagtcccaagtaaaattacaggcaattaatctgattgatttattgcatgatggtttttacttaatctttttaattcgaaatcagtatgtgccagctgatccacagcgctttcgtgaaaaaattctagatttgcttaatcgatttgagcaacaagcgaaaaagttacaattttcagctgatgatattcatgatgctaaatatgcgttttgtgcactgattgatgaaacgatcgtaacccagcaagacccaagctattttaatttacaaaattcttggttaattagcccattacagttaagtctgtttggttctcagttagcgggttatcaattcttcgaaattttagagcaattacgtagtcgtggaaaagagcgattagctgctcttgaagtcttccattactgcttattattaggttttcagggtaaataccgaattgagtcaattgaaagccttaaccatttggtggcacgagtaggcgatgaaattgattatctgaaagggaaaaaagtggctttttcgccattctcggcaattcctgatcagatacgaaatattatccatcgtgagttaccttttttctggattttgattttcttattgatttttgcattacttacctttgcaggtttaagatttatgcttaacaatcaaaatgataaagcattatctaattatcaaaatgtgatttctgccccacaagagcaggcacatattacaatttacttaccttga

SEQ ID NO: 2633 - DNA, 969 bp, Acinetobacter baumannii
acttttagcggcgaaaaatattgccgacttggtgacatggtcagatggcttatatcaaccacctgcaaaattcaggagttggtaatgatggcacaagttcaatatcaaacgctcagcgatagtcagcttttagcagatatggcagtcgaagcgttaattgatgaagttaatctgacgcccaaaccagctttggttgatcgccgtggcagtggtgcacacaatgacctgaatttggatttaatgaagcgctctgcaaaaagtttacgcccgatgtttgaagaaatggcgcaagcagcaaagcatcatggaaaagtctgtttagccttgcgtgaagacattggtgaaatcggtcgccaaggtgaaaagaccatgatgttggcgacaaatggcgtcaatacacatcgcggtgcaatttgggcattagggttaatggttacggcagcaacattggcgcgcacgaatcaacaatatttatcggctgttgagctatgccagttagcaggccagattgctcagcttgaagatcgttttattccagagcaggccttgagtcatggtcagcaagtacaaaagaaattaggcatcttaggtgccaaagaacaggctcaacaaggttttccaactattgtgaattttggtttaaagcagctttaccaaagtcgtagtaaacctatgaaagaagagttcgctcgcttagatgcgttacttgccatgatgactgatctaaccgatacctgtgtgctttatcgatctggaacaaatggcttaaagcgtatgcaacaaggtgctcagcaagtactggatttgggcggcagctcaagcttggaaggtcgacgtgctttgcatcttttagagattgatttgcttcggatgaaagcttccgctggtggtgccgcagatttattggcagccacattgtttatagatcgtgttgagcagtcatctgcgaaaaataaaaaggaattctga

SEQ ID NO: 2634 - DNA, 849 bp, Acinetobacter baumannii
aattttttaggatttactatgattttatttggtaagaaagaccagccgagccgaaacgcatatgctgtcgtaactggggcaggcagtgggattgggcgaagctttgcagttgaactggcaaaacgtggtggcagcgtagtctgtgcagatattaatttaggagctgctgaagaaaccgtaaagttaattgaacagttgggacaaaaagcatttgctgtacagtgcgatgttgggcaagcagaacaagtacagactttggctgatcgggcagaacagttattaggacatccggtaaccctcatcattaataatgctggcgtaggtctaggtggcaaatttgatgaaatgagtttggaagactggaaatggtgtatgcatgtaaatctgtggggtgttattcatggttgtcatgcatttgtgccaaagttaaaaaaactaggttacggtgcaatcattaatgtggcttctgccgcgtcgtataccgcagcaccagaaatgagtgtctacaatgtaacgaaagcaggtgttttggcattatctgaaaccctttcagccgagcttcgtaaattcaatattaaagtcaatgtactttgcccgactttggtgccaaccaatatcattaaaaatggtcgtattccagggcgttattcaaaacttgcagaccatgcactcatgaactatgccatgacaaccagcgatgcagttgcgactttaacattgaatcgattagatcgtgggcagctctacaccacgccacagatcgacgccaaattattctggcttatgaaaaggacatctccaacgctatatgcaaagttccttgggctttcgtatcagttatttaaataa

SEQ ID NO: 2635 - DNA, 576 bp, Acinetobacter baumannii
caaaaaaaagggtcttttatgcctgcctcaacctctcaatactacacccgtactgcacagattctgcattgggtcatggccatcatttttatcactgcttgggtgattggtttctatagtggaaattttctaagttatgacgttgatggcagctttaaaggcgatgtcattacactacataagaatatcgccacaaccattatcttcctcgtggtcattcgtctgttttggcgttacacccatcctgctccacaattgcctgacacgatgtcaccaacaatgaaaactttagctcacatcggacatttattactgtatgtgattttagtcgctttaccggtcactggctgtttatttagctggagtgctggtcaccctgctccggttttatatttatttgaaattccacgcctggtgcaagataaccctgagttattagccattgttaagccattacatatttatatttcatggtttgcaggtttacttattgttggccatgttctggcagctttaaaacatcactttgtagataaagacaatgttttaaacagtatgaccaaacaacctaaataa

SEQ ID NO: 2636 - DNA, 927 bp, Acinetobacter baumannii
acaaatagagggaatgatcatcaaggagttcttatgaaacgttctgcaacctctctcattgtttcaacagttatgctttgtacggttggtgctacttctcaaattcaggcagcagatacattagctaaaattaaaagtactgggaaaatcgttattggccatcgagaatcgtctgacccgatttcatatgttgttgcaggtaaaccagtaggttatgcagtcgacatttgtaaccagtttgcaaatgatattaaaaaagaattgaaaatgcctggtttaaaagttgaatacaaggcagtaacctcatcaacacgtattcctgagcttttagcgggcaatattgatatggaatgtggtaccaccacaaattctaaacagcgtcagcaacaagtgggtttctcaactaactactatgcaacagaagtacgcatggctgttaaagcaaactctggtattaaaagtttggcagacttaaatggtaaagcagttgttactactcaaggtactacatctgacaagtacattaagatgaatgaaaaaggccaagcaattaatgtacaaaatatttatggtaaagaccatgctgactcttttgccatgatggcatctggacgcgctgctgcatttgtaatggatgataatattttagcaggcttaattgctaagtcttctacacctaaagcatttgcaattgttggtccagtactttcatcagaaccttatggcattatgattgcaaaagatgatccaaaatttaaagcaattgctgaccgtactgtaaataacttatggaaaactggtcaagtggatgctttatataaaaaatggttcttatccccaattccaccgaaaaatactaatttgaacatgcaacaaagttcatcttataaaaaactcaaagctcacccaacagatgcaggaatctaa

SEQ ID NO: 2637 - DNA, 705 bp, Acinetobacter baumannii
gaaaacagaggaatgaaagttgtgttgaaacgaagtattttgatactttttttgactggaaacattatcggtctatcatatgctcaagcagcagaactagagtctgtaaaacttaaaaaaagttgtattaagaagaatcctctagcagaaggccaaaatgaccctgagctattgaatatttttaaacaagtttgtgatagtgataatacaactcaaaaaaatgatttattagctaaagctgctatgcggttttatcaaaccaatcaaccagttaaagcattgaatttagcaagtcaattgcaaagtcaaaatatacgcggttcattaatcactgatgtcttatttttatctggtgtgagcattgcaaataattcattgcaacaaatgcgtaatcaggaaatgcgatatttaacgaatgacataacatatcctcctgcaaagcagttagttgaaaatattcatactgcaatgccggctcctgatccatcgagtttcaaaactaacaactcggaaagcagttctactgataatgaaaaaagaagttataaaaaacagtacgcaacgcgtaataaagtgagtgcttctagaacgtcaaataaacgagtagtaagtccagcaaaggccaccgcagtaaaacctaaaactgcacctgcagccactgtcaataaatcaaaaagttcgccttttgaccctttaattaaataa

SEQ ID NO: 2638 - DNA, 1044 bp, Acinetobacter baumannii
aaatgttggggaagtttctatatgattaaaaaagcgttgttatccgtatctattttatcggcagttgtattgggtggatgtgacaatacggctaaagtgcccgaggctaaacaagatgctcaggcagccgcaaatacaaaaccaattaccatcggctatagtgattggccgggctgggtggcttggcaagtggctattgaaaaaggttggttaaaagaagcagggttaaatgtagagtttaaatggtttgattattcggcttctctttcggccttttcggcaaatcagctcgacgctgtgttggtcaccaatggtgataacttggtaacagcttcgggtggtacgcaaggcatgatgattttggcaacagattattctgcgggcaatgatgtcattattgcaaaagagggcattaataccattcaagacttaaaaggaaaatcgatcggtgtcgaaaaaggcttggttgaccatcttttattggcaacagctttaaccgaccataacattaaatcaaatgaggtaaagctagtaaattcagcgacgaaccaattacctcaagtgtttaatagcccagatatttccgcgattgctgtttggcaacctgttgcaggtcaggcattaaaagcagtggcaggctctaaaattatctatacctctaaagacaagccgggtttaatttacgacaccttaacagtcaacatgagtcatttaacagctcatcaagaggaatggaaaaaaatcattcaagtgtgggataaaacagttaaatatattaatgaccctgcaactcatgctgacgcagttaaaattatggcaaatcgttcaggggttgacccaaaacaatatgagttgatggttagcggtacgcatctattagatatcaatgccaataaaaaagtatttactaaatctcaaggctttgactcgatttatggctctagctatcacgtcaataaatttaacgtcgaaaacggtatttataaaactgaacaaaatgtagatgggctgatttatccaacactcatcgaacaactcaaataa

SEQ ID NO: 2639 - DNA, 1179 bp, Acinetobacter baumannii
acaatgtggggaaataatataaaaaaagatcctgcttatcaattgaccaatatttttatttattataaattggatccaataagtgataaggagtcgtcacaaatgtttattaaaaatgcatggtatgtagcttgccgtccagaagaaatccaagataaaccattaggtcgcaccatttgtggtgaaaaaatcgttttttatcgtggtaaagaaaaccaagttgcagccgttgaagatttttgtccgcatcgtggtgccccactctcacttggctatgtcgaagatggcaatcttgtctgtggttatcatggcttagtcatgggttgtgacggaaagaccgtttcaatgccagcccaacgtgtaaatggtttcccttgcaacaaagcatatgcagttgttgaaaagttcggctttatttgggtatggccaggtgaaaaggctttagcagatgaagcaaaactcccaactttagaatgggcagatcatccggaatggagctatggcggaggcttgtttcacattcagtgcgactatcgtctaatgatcgacaacctaatggatttaacccatgagacctatgttcactcaagcagtattgggcaaaaagaaattgatgaagccctgccagtgactaaagttgacggtgaccatgtcattaccgaacgctatatggaaaatgtgatcgcacctccattttggcaaatggcccttcgcggcaatcatttagcagatgatgtacctgtcgaccgttggcaacgttgccacttctttgcgccaagtaatgtccacattgaagtaggtgtagcgcatgctggacatggtggttatcacgcaccgaaagacaaaaaagtgtcctcaattgtggtcgattttattacaccggaaactgaaacatcacattggtatttctggggaatggcgcgtaacttccagccagataatgctgaactcaccgatcaaattcgtgaaggccaaggcaaaatctttactgaagatttagaaatgctggagcaacagcagcaaaacattttaaacaatccacatcgcaagttactgatgctcaatatcgacgcaggtggtgtccagtcccgtaaggtcattgaccgactccttgccgaagaaaataaaacacctcctgaaacgtccacacagaagtttccaaacattcggattatttaa

SEQ ID NO: 2640 - DNA, 3624 bp, Acinetobacter baumannii
agcggaaggggtgtaagcatgtttaaaaaagttctgattgctaaccgcggtgcaattgcctgtcgcgtcattcgcacccttaaaaaactcgggatcgcttcggtggctgtttactccgaagccgaccgtgattcgttacatgtgactttggccgatgaggcttttctgattggccctgcacctgcacatcaaagttatttaaatattgaaaaaatccttgaagttgcaaaacagtcgggagcagaagccattcatcccggttatggttttttgtctgaaaatgccgagttttgtgatttgtgcgaaagccaaggcattgcttttattgggccaacttcaagccaaatgctcgactttggtttaaaacatactgcacgtgaactcgctattaaaagcaatgtgcctttacttccgggtagctcattactttccgatgaagccgaggctttgtttgaggcagcccgtattggctatccagtcatgctgaaaagtaccgcgggcggtggtggtattggtatgcgtttggtctggaatgaaactgaattaaaagatgccttccaaaccgtatcttatttagcgcaggtcaattttaaagatgcaggtttatatttagaaaaatttgtacaacatgcacgccatatcgaagtacaaatttttggtgatgggcaaggacaagttttagccttgggtgagcgtgattgctcggtgcaacgccgtaatcagaaagtcattgaagaaacacccgcgccacacttaaatgaacagcaacgcgactaccttcaaaaagttgcgattcaactcatgcagtcggtgaattaccgttcggcaggcacggttgagtttgtcatggacaccgaaacccaagaattttatttcttagaggtcaacacgcgtttgcaagtcgagcacggcgtgaccgagcaagtatttggtgtcgacttagttgaatggatggttactttggcaagcggtgattggttagcaccaacagaaaagttagagccaacaggacattccattcaagttcgtctttatgccgaagacccaattaaacagttccagccgagtgcaggcctgcttacacatgttaaatttgacccgcaagcccgagtagaaacatgggttgaaacaggttcaacggtgtcgtctttttatgacccaatgattgccaaaattattgtaactgctgcaacacgggaccaagccatacaggcaatgagcgctagtcttgccaacacgcaagtcgctggtatcgaaaccaatttagaatatttgcaaaacattattgcttgcaatgtgtttgctttaggtactcaaaccactcgatttttaaatacgtttgaatggaaaactcagaaagttgaggtattgcaggctggcattcaaactgccattcaagacgtaacaggccgattaggttattgggatgttggtgtgccgccatcaggtgcgattgatccactcagtttaactgtggcaaaccagcttttagccaatgagccaaatacggcagggcttgaatgtaccttgcaagggccaactttaaagtttcactgcgatagccaaattgtcattacaggcggtgatatgccttcaaaacttgatggcgaacttgtgccgatgtggcaaaccatcaatgtaaaaaaaggccaagttttaaaatgtgggattatccgttcaggttgccgtagctatataggcgtgaaaggtggtttcgatgttcctgagtatttagggtcacaggcgactttcactttagggcagtttggtgggcatgcaggccgtaatttattaattggcgatatgttgccaattactgaatattccgctcaatcgactacagctttagctcaagcgcaaattcctagctttacccaaaactgggaaattgcagttatgtatggcccacatggcgcaccagattttttcaccaaacaagatattgatacgttctttgccaatgagttcgaaattcactataactcaagccggacaggcattcgtttaattgggccaaaacctgagtgggcacgtgaagatggcggtgaggcaggcttacatccttccaatattcacgacaatgcttatgcgattggcgcaattgattttactggcgatatgccaattattttgggtccagatggtccgagcttaggcggctttgtttgccctgcggtagtcattcattccgaactttggaaaatcgggcatctaaaagcaggcgataaggtcaaatttgtacccgtgagttatgcgcaagcaaaagcactcgatcaaaaatatcatcaaagcttaaccgcgactgatacaactcgtattgatttcaatccaatcattcaagcagaacccgacactttaaaagatgcagttttggcaactttagaaggtgacgctaacttaccaagcgtgacctatcgaccagcgggaaatagctatttgttggtggaatatggagagttagtacttgacctaaatttacgcttccgtattcatgcactcatgcaatgggttatagatcaaaacattcagggtattatcgacttaacaccgggtattcgttcactgcaaattcattttgattcaatccagcttgatcaactggagcttctacagaaacttcaacaagcagaagccgaattacctgacattcaaaatatgcaggtgccttcacggactgtctatttacctttggcttgggaagattcgcaaactcaacttgccaccgaacgctatacacaaattgttcgtccagatgcgccatggtgcccagataacgtcgagtttattcgtcgtattaatggcttagcttctaagcaagcagttaaagatgtggtctatagtgcaaactatttagtaatgggtttaggcgatgtgtatttaggtgcacccgttgcgacgccgctcgatccacgccaacgtttagtcactactaaatataatccagcgcgaacttggacacctgaaaatgcagttggcattggcggggcgtatatgtgtgtctacggtatggaagggccgggtggctaccagtttgttggtcgcacgacccaaatgtggagccgttaccgtaaaaatgccaactttgaagaaggtaaaccgtggttactgcgcttttttgaccaagttaaattttatgaagtttctgagactgaacttctacaaatgcgtgaagactttaaggcgggccgactacaacttcgcattgaagatggtgtgcttaacttaaaagaatacaacgagtttttaaaaacacatcaagacagcattcaagcctttaaagacatgcaacaagctaactttgaggctgagcgccgccgttggcacgaagcgggcttacaagaatatatctctgaaagcctagatactgttgatgaaggtgaaaccgtggttattcctgaaggaggctgtgcagtcgaatcgcacatgccggggtcaatctggaaaatcgaatgtgcaccaggagatattgttgaagaaggtgcgacccttgcggtaattgaggcaatgaaaattgaaattccgattattgcgccggaacgcatgaaagtagaaaccattaccattgaaaaaggacaaaccgtaaaaacggggcaagtgctatttaccttagcgccagtcgcttaa

SEQ ID NO: 2641 - DNA, 1464 bp, Acinetobacter baumannii
ttcacagggggaaagtttatgagcctcggtctaaccgctttagaattagcacgaatacaatttgcttttacagtatccttccatattatttttccggccacctctattggacttgcctgttttttggcagttttggaatggaaatggttaagaacgcaaaaccctatttataaagatctatttaaatactggattaagatctttgccgttgcgtttggtatgggagtggtttctggtgtcgtgatgagctatcagtttggtaccaactggagtgagttttcacgagtagcaggaagcattactggtcctttacttacctatgaagtcttgagtgccttcttcttagaagcgggtttcttaggaatcatgctgtttggttggggccgtgttggtcctagagcccatttctttgcaacgcttatggttgccatcgggacatgtatttcgatgttctggattttatcgtccaatagctggatgcaaacgccgcaaggttttgccatcgaaaatggcattattgtgccaaaagactggctagctattgtcttcaacccgtctttcccttaccgctttgcacatatgggtgctgctgccttcttggtttcatctttattggtagtgggaacatctgcttggcacttggtgaaaggccgtcgtgatgaattggtgaaaaaatcattctcgatgggtttatggatggtgcttgtgacttcttgtttacaagtggtgattggtgataaccacggtttaaatactcgtgagcatcagcctgccaaacttgctgctatggaaggccactgggaaactaatcataacgagcctatgccattactgttatttgccattccggatatgaaagaagaacgaaatcactttgaagtgggcgttccatatttgggtagcttaattttgactcacagtttagatggacaagtgactggcttaaaagaattcgcacctgaagaccgtccaaactcgaccattattttctggagtttccgtgtcatggtgggtcttggcgtccttatggtcaccttatcactcattgctctttggttacgtaaaagaggaaaactctatgaaacatcatggtttcataaatttgctgtagtgatgggacctgcaggttatgtggcaatgctggctgggtggattactaccgaagtaggccgtcaaccttgggtggtctatggcattatgcggaccaaagatggtttatcgcatactgtttcagcagatcaggtgggtctaagtctctttatttttgtggtggtgtataccatcgtttttggtagcggtatctactacaccttaaaactcattaataaaggccctgtatttatcgacacgccaaatatggaagcaggcggcgtaggacactttaaaacaccgatgcgtccacttagtgcagttgatgaaaatattgacagcaaacaaaactctggggagaaccgtcatgattga

SEQ ID NO: 2642 - DNA, 891 bp, Acinetobacter baumannii
attataattttcgcagtgcgaaacaaaatatggattggtatgacaatgaatgatgcagttgatgcagaacagacagaaaaattattagcgcctttaaggcatgaattattacatccgattgaagacatgcaggatgaaaatgatcgtcaatttattactgcattagcacgtggtttagagctattacgttgttttacgcctaaacatcagcatttgggcaatcaagagcttgctcagatgacaggtttgccaaaaccaaccattactcgcctcacacataccttgtcgcgtttgggttatatcaaacaagtacctaactcaagcaaatttcagctttcagttggagttcttgcgtttggttattcgatgctgtctaacgtatcgattcgctctattgctcatccatatatgaaaaatttggcagactatgctggtgctgctgtagccatggcaacacgcgatcgtctgaatatgatttatcttgacgtggtgcaaggcaaaggcaatatgaccatgcgccgtcaagtcggaacgtatttaccgattcatttaagttcaatggggcgtgcatgtttagctgcaatgcctgaagatgaaagagagttcttacttaatgccattcgtaacaagcataaagaagactggattaaaattaaccgtgatctagacaaagcctttaaagactaccaagattttggatactgtttttcaattggcgaatggcataaagacgttaactcggttgcggttccactcattcatgaacaacatggtttgctggtatttaactgtggtggtccaagctttattatgaaccgtgaaaaactcgaagaagatattgcaccacgtcttttacatatggtgaataatattcgcactgagattagctaa

SEQ ID NO: 2643 - DNA, 495 bp, Acinetobacter baumannii
catccttttataagacctcaactaagcttgagattaataaaaatgagtgaaaggaatcaaagtcgtttattaacggttggtgaggttgcaaaacgtagcggtgttgcagtttcaacccttcatttttacgaatctaaaggtttaattaaaagtataagaaccaatggtaaccaacgccgttttactctagtggtgttacgctacattgcgatcattaaaattgctcaaaaagttggtattccattagatgaaataaaacaagccctaagtaaatatccgatgggttctaaattaactgcacaacaatggaaagagctatctctcgattggcggaagaatttggatgagcgtattcaaaaactcacaagactcagagacgaaatggattggtgtattggatgtggttgtttgtcattagaacaatgtccattaagaaatcccaatgatgtgttggggcaagaaggtgccgggccgcgtattttagaaagaccatag

SEQ ID NO: 2644 - DNA, 1197 bp, Acinetobacter baumannii
aggctctttatgcttcaaaatactatgcaccgccaagtattaattttggcgagttcccaatcccttttccaaaccgtttctgtcatggtcatgaccattggtggcttggctggggcaaatattgcaaataccccaacacttgcaacgctgcccatcgcatctatgtttttgggtacggctttaatgatgttccctgcctcaatattaatggcacatattggacggcgtaacggttttctattcggtgcttttttaggtgtgctcggcggcattatcgcatcaattggtattttttatagttcactcatgcttctggctctgggtacgctatgtgtcggggcctatcaatcctttgctcagttttaccgttttgctgccagtgaagtggcaaatgatgcgttccgctcacgcgctatttcttgggtgatggcaggtggaattgttgcagcactgattggtccgactttagcccgttttggtggacccttattccagcatttagaatatatcggttcatttttaattattagtatcatctcacttgtggcaatgggcattttatctaacctacatattgccgatacagttgagcagaaatccaactttactgctggtcgtccgtggcaacagattgtctttcaacccacctatttagttgctttatttggcgcaataacaggttatggcatcatgattttaggtatgactgccacaccaattgctatgcgacatgcacaccatgaacttgggtcaattacgacagtcattcagctacatgtacttggtatgtttctgccttcattctttactggaaacttaattgctcgatttggtgtgcttaaaatcatgtttgcaggccttttattatttgtctgctatatcggatttgctctctcaggtattcagttcacatcttttgctatttctttaattttattaggtgtgggatggaactttttatttattggcagtacttctttactcacaggaacttattctgtagctgaaaaagccaaggcccaagctattaacgatatgaccgtttttgttgtcggtttgatttgttcgtttagtgcaggtgctttactggatttatttggctggaaagcaatgaatatggctttaataccatggctgctgattgccgcagcttctctcttttggctaagccaaaaaagagaaaaacagcttgcttaa

SEQ ID NO: 2645 - DNA, 555 bp, Acinetobacter baumannii
ggaatctttatgaactattccctcgattctaatttccgtttaattgattgtaatgaagcagagcatgcggcagcgatattagaaattctaaatgatgcgattgttaactctaccgcattgtatgactatgttccccgttcacttgattcaatgaaaacatggttttcggtaaaaagagaaaatggtttccctgtcattggggtagtagatgagttaggtaagttattaggatttgctagttggggaacatttagagcgtttccagcttataaatatacggttgagcatagtatctatattcatcatgaacatcgtggctgtggtctaagtaaagttttaatgcaagcgttaattcaacgtgctcaacaggctcaacttcatgtgctcattggttgtattgatgcgacaaatcaagccagtataggccttcatgagaaaatgggctttacccacgctggtacttttaaacaagtgggctttaaatttgggcaatggcttgacgctgctttttaccaactagttttggatactccatttgaaccagtggatggatag

SEQ ID NO: 2646 - DNA, 249 bp, Acinetobacter baumannii
gttgactttataactggtataaaaatggatatttgtattggcggtattttaaacggtaaagtaagaaagaataatgaaaattatttctctataggaaatcctcattcagatgatgtaacggagtatcacaagcaatatttccatttggatggaaagcttttatcattttgggtgtgtaatgaaatcaattttcaagaagccttcagaatagccgaaagtttctttaaaaaagaacaaagtttttattaa

SEQ ID NO: 2647 - DNA, 222 bp, Acinetobacter baumannii
gagttatttatgagtaaagactttaaagccttaacttatattgcggatgataatatagcagatacagtgacttggctcttacaccatcaagatgtttttgaaacttttcactttgatgtattgagccaagaattatcggttacccatgcggcaggtagggatattattcgagttggaacctttctgaatgctacttatggcatattagtcacttctgtataa

SEQ ID NO: 2648 - DNA, 1209 bp, Acinetobacter baumannii
gcgcaatttatgaaagacatttaccgcttcaaggtaggtgactttgctccaagtgaatccacacgctcatttacaccggaaggttatttgaaatgcgtaaacgttcgcttgggtaaagcacctcaggtacgccagtactatgcatatgagtttccaaacttagaaggcttttcagcagatcagacgattaacgtctacacacctgcagaagagctttttaagcctaaccctatcaaaagttgggatggggcagacgctacagattatcacccacctaagaatgaaattaatgctgccaattggaaggaatatcacattggctattgtgagaatgtccgccaagaaggcgaatatctagtgggcgatttgctcattaaagataaagacagcattgatttaatccagaacaacgagcgattagaaatgtcgctgggttatggagccacattagttctagaacagggccttgcaccagacggcacagtgtatcaagcaaaatttattaactttattggcaatcatgtagcactcgttaaatatggccgttgtggtggtgattgccgcatcggtgacaaacagcaaactccaccaaaggggaataaaacaatggaagtaattgtaaacggtatccgttttaacatcggcgataacacgcctttggccgatgcattaaagcagcaacaagagcagctggaaaacatgaaggctgcaaaacttaaagttggtgataagcaattttctatcggtgatgagcttggagcaattcaagcggtcgtagatcaattgcataccgataaaacaactcttgagcagaaagttggtgatctggaaaagaaccagatgactcctgaaaagcttgaacaagctgctgctgaacgtacagctgtcattgccgatgctaaagcattggtgccaacagttaaaaccgaaggctgcacatgtgagcaaatcaagcgtgatgtaattgcggctaaagcgggtgatgcgttggtaactgccttattaggtagcgtatcggtaggtgatgccaagcctgatcagatcgatacaactttccgcgctttgtctgccgtgaagggaacacacccatctaatcctgtaggtgatgcacttcataagcaacaaaacattcaagcaggagatggtaaaccagaggatggggaacctaaacctaacaacaaaaaagaagcgtggaaacaaagcttctaa

SEQ ID NO: 2649 - DNA, 822 bp, Acinetobacter baumannii
aaaatgtttatcacttctcaactgaacattactcataaaattattaaaaatcagtctatttccaccttggtaatagatcagttggaacagacttatgtgaaccttgaagcaaccttacttagagcgaaagtacttagggatttttctaaaactcaaaccgtgtatttaattcagtctcatattgagccacaacaaagcagtttggcttatctattctcgccatttatttttgcaaacttaaacaaagcagccatttatacaacaccggcgactccacctgcgctaaatatccttaataaatactatcaagctgacaagaaggtcgtatttaaggtagacgaagttttagaaagcctaaaaatatatctagatttagaattaatagagatgggaggagctgaatttatttatttaaatttaatcaaagcattgtgtcgaagtgatatctctacagtttttttaattacccatttagagcttgatttagaggcgttaaagcaacttgaacagttcttaaaaataaaaattcattgggtaaaagtcgtaaaaaatgaaggtctaaaaggcttggatcagttggatatgcgtaaattattatttaaaaataaagatgaaacgcatgttcaattatgcgctctgtttgctcaaatgaatgcagcactggtcggcctatgcgatacctttactgtcaatcaaatgacacacttaattgatgacatgttttactcagagcatattttcgaaaaactttctgtctattcagaatatatgcaaaccttattgcaaagtcagcatagtcttaacaaaaaacaaattgcttag

SEQ ID NO: 2650 - DNA, 2691 bp, Acinetobacter baumannii
tttttacttattggtagacccattttcatgatcaatacatcgccattgctgaactatgtctcaagtcatcatgatattaaagccattaatcagtggcgaacggatgtagaaaagcaattgcaagattcatatgaaaatgggcaatctattcgagaaatcattaaagctcgttcagatttagtagatgaagcgctcgtctttttatggaaacatgcagaacttgaccagtcaaaactaggtctttttgcagtaggtggttacgggcgccgtgaaatgctgccctattctgatgtagatatcatgattttgtctgaagatgaaatcagtgaagaaaatgaaaaacgtatctctacatttatttcctctttatgggatgtaggaaatttcaaaccaggtattagtgttcgcaccattcaaagctgtgttgaacaagccgctaccgatttaactgttgccactacattaattgaagcgcgtttaatcacgggcaatacgcaacttgcgaaatggcctcgccgtattgtttcacagacatggacagacaaaacattttatgacgcaaaaatggctgaacaagccaagcgttatcaccaacacaataataccgaaagtaatttagaacctgacattaaaaatgcaccgggcggtattcgtgacattaatcaaattggttggattgccaaacgccacttccgtgtgaaccgtatctatgacttagtgcatttaggtttcatttcagagtttgaattggctgttttagaagaagctgaaagctttctttgggaaattcgacatcatttacaccgtttagccaaacgtgatgaaaaccgtttactctttgaccaccaaagagaaattgctgctaaatttggttacgttcgtcaagaaggccaacctgtaaattacggcgttgagcaattcatgaaacgctattaccgtacggcgcagcaggtttcaacactcaatgaaatgttgctggcgtattttagtgagtctgtcattactcctcgactccccaactatgaacgcaaaattgaagttgtgaacgatcactttaagattgtcgacaataaacttgcagtacagcatcataaaatttttgcagagcatccgagcgcgatcttagagttgttctatattttagcgaatcgaccagatattgaaggtattcgcgctcgaactttgcgcttactcattcttgctgcaaaacgaattaaccaaagttatcgtgataacccagagcatcaagcactatttatgtcgattattcgctcaccatatcgactatacgataccttggtcgcgatgaaacgttatggtgtgttaggaaactatattcctgcttttggccaaattatgggtcttatgcaatatgacctattccatatctatacggttgatgctcatacattattattgctgcgtaatttaaatcgttttagagaacctgaatttgccaaagaattccctgtggtaagttcggttttccaacgtcttgctcgtcaagatattgtctttattgctgctttattccacgacattgcaaaaggccgtggtggtgaccatagtgaacttggcgcagaagacgcgattgagtttggacgtgcacatggctttactgagcgtgaatgcaaattaattgcatggcttattcaaaaccatttgctcatgtcacttacagctcagaaaaaagatatttctgatccagatgtcgtgaaagattttgcagaaaaacttggtgacatggagcatcttgattatctctatactttaacagttgcagatattaacgccacaaatccaaaactttggaacacatggcgcgcatcgcttatgcgtcaactttatacgcatgcccgtgatgtaatccgtacaggtttaggtcgtcctgttgactaccaaatgttaattgaagacaccaaatttgcagcaagtgaattactggtaaataactttgcattggctgatgtcgaaaaagtatggcaagaacttggtgatgaatacttcattaaagagtcggcagatgaaattgcatggcatacacaagcaattttaaaacatggtgataatccagagccattagtcctcttgcgtgctcaccgtaaagcagctcaagatgcggtgcaaatctttatttatacacgtgaccaacctaacctgtttgctactactgttgctgttttagaccgcatgaacctagacgttcaggacgcaaaaattatcacagcaagtacagcatttagcttagacacttatgttgtactcgatcgtttcggtacattgcttaccgacccagagcgtgaagaaaccgttaaaaatgcattagtgaaggcgcttagccaaccagaccaatacccgggactcatgcaacgtcgtattccacgtcaattacgtcacttcgatattgaaaatacagtcgacgtaacattaaatgaagccttacagcaaaatatggtcgaaatttcaacactcgatcaccctggcctacttgcacgcgtgggtggtttatttatgatgcaaggtttagacatccattcagcccgaattgcaactttaggtgaacgtgccgaagatattttctttgtcaccaaaaaagatgggaaaccgctgaataacgaagaggtcaaactcttctcggaaaaactgaaagctgcattagatgaagcatctaatcaaatttgtcagcactga

SEQ ID NO: 2651 - DNA, 1329 bp, Acinetobacter baumannii
aggctacttatggcggcgcccaattcttcggcagggtggttagagcgtttatttaagttaagcgacaataaaaccacgtttcgaacagaagttcttgctggtgtaactacatttttaacaatgtgctacatcatcattgtcaatccactcattttatctgaaaccggcatggatcatggcgccgtattcgttgcgacctgtttggcagcagcaatcggttgcttagtgatgggtattattgctaattatccaatcgccttggcacccggtatggggcttaatgcttattttacctattcggtttgtatgggcatgggagtgccatggcagacagctttagcagctgtttttgtttcaggtgtggtattccttgcaattagtttctttaaaattcgtgaggcgattgtcaatgcaatcccgatgtcgcttaaatttgcgataggtggtggtattggtttattccttgcgctcattgcattaaaaaatgccggaattattgtcgcgaaccaagcaacattggtcggtttgggcgatattaaacaacctactgtattattagctttatttggctttttacttatcgtaattttgcatcagcttaaagtccgcggtgcgattattattagtattttggtcgttacagcaattgccacagctttaggtctaaatgaatttaagggtgtggttggtgaaattccttcaattgcgccaacattcatgcaaatggactttgaagggttgtttaccgcaagtatggttggtgtcatcttcgtattctttattgttgacttgtttgacagtacaggtactttggttggcgtttcacaccgtgccggccttttacaagatggtaaattgccacgtttgaaaaaagcgctatttgctgactctactgcaatcgttgctggtgctgcattaggtacctcatcaactacgccatatattgaatcggcttcaggtgtagcagcaggtggacgtacaggtttaaccgcggtagttgtcgctttcttatttatttgctgtttattcttggcacctcttgctcaatctgtgccaggttttgcaacagcacccgctttattgttcattggtgtattgatgatccaagggatcactcacatcgattgggatgatattacagaagctgtaccagcctttttaacgattgtatttatgccatttgcatactcaattgcagatggtattgcaatgggctttatcagctatgcattagttaaattatttacgggtaaggcaaaaacagttccatacatggtgtggattattgctgccctttgggtatttaaatttatcgcctttggcggttaa

SEQ ID NO: 2652 - DNA, 903 bp, Acinetobacter baumannii
gtccttattatgaagcaacttcttgcatggaccatccgtaccacactacgtccagctttatcccctaaaacaccactaaagctacaacgtttttgtagtgatgcagccagtgctattgtgcttgggcctcgtggttatcaaacaaagaagcaaataattgctcaagttcctacgcttcatattcggcctaagaccattaagtcaggtcgcggtattttgtatttacatgggggtggctatgtcgtgggcagtagcaaaagtcacgctaaacttgccgctcaggttggacatgtagctcaagcacaagtctggttacctgaatatcgtctggccccagaacatccaagccctgctgctattgaagatatcgttgctgtctataaagctttacttgcttacggacaagaccctaaaaaacttgtaattgcgggtgactccgctggcggtgggctgagcttaagcaccgtaattgctttacgagatgcgggtttccctttaccagcggctttagttttactttcgccttgggttgacttaagtctttcaggaaacacaataaaaactcatgctgctcaagatgcgatgttgtcagaggactggttaacctggtgtgcaaaaaactattgcggccaaaaatcggcaaccgatccaacgtgttccccactttatgctgacttaaccggattaccgccggttctgatccatgtcggtaccgaagaagttttattagacgatgcaaaacgacttgctgaacagactgaaaaatacggtattccgacgaacttaagggtttatgaccaagtcggacatgtttttcaatttcatgcaggtatactaaaggaatctaatgactccattgagcgcattgggcaattcattgataaacatatagagtcaatataa

SEQ ID NO: 2653 - DNA, 198 bp, Acinetobacter baumannii
tttttcattatgaacaaaactgatttaaatattactcaaagtgaaacatggctaaatgctaagtttaactttcaatcaataaggcataggagtgtcatcatgtttaaagcaatgtttttcttcagtgcaggcgcaatgtttggctattgttataaacattatgatgaaaaagttatagagtctaataaatctaaatag

SEQ ID NO: 2654 - DNA, 1026 bp, Acinetobacter baumannii
gaatccattatgcatattgcagcgttgcatcaaccgagccaggttcagctcaatcaagacggaaatttaaaacattttttaacgattgagggcctttcaaaagaaaacctcactaagattttagataccgcgcaaagctttttagatgataataataatttaattaaccgcccgcttttagaaggtcggacggttatgaatctcttctttgaaaactccacccgtactcgtactacttttgaagcagcagcaaaacgtttgtctgccaatgtattgaacattgatattgcacgttcaagcacgtcaaaaggtgagactttacgagatacgctttggaacctcgaagcaatggctgccgatatttttgttgtacgtcattcatcttcaggtgctgcacatttcattgctaaagatgtatgtccgaaagtcgcaattattaatgccggagatggacgtcatgcccatccaacgcaagcgatgctcgatatgctcacgattcgccgtgagacgaaaaaaccatttgaagacttgagtgttgccattattggtgacattaaacactctcgcgttgcgcgttcagatgtagctgcacttcaaacactcggatgtaaagatatccgtgtgattgcgccgaacaccttattaccggttggtttttcagaatatggcgaccatgttcgtttgttcaataacatggatgaaggcattaccggttgtgatgtgattattgctttacgtattcaaaatgaacgtatcgattcaccagcattatcttcacaatctgaattttacagaatgtacggtttaaacaaagagcgccttagcttggctaaaccggactgtattgttatgcatccgggaccaatgaaccgtggtgtagaaattgattcgagtattgctgatggcgaacagtcagtgattttaaaacaggtcactaacggtattgcagttcgtatggctgtgctggcgttgtctatgcaagggcaactccaagaacaaggtttaattgaagcgattgcgttgtaa

SEQ ID NO: 2655 - DNA, 945 bp, Acinetobacter baumannii
ggaataattatgagtaatatcttcacaggatgtatcccggcgctaatgactccatgtactcctaaccgtgagccagattttgatgcgcttgtgaaaaaaggccatgagcttattgaagcgggaatgagtgcggtagtgtattgtggttcaatgggcgattggcctttattgaccgaagctcaacgtcaagaaggtgtagcacgacttgtagctgctggtattccgacaattgtgggtactggggcagttaattcaaaagaagcagtttctcatgcagctcatgcagaaaaagtaggtgcacaagggcttatggtaattccacgtgtattatcacgtggtgcatcgccaactgcacaaaaggcacacttttctgcgattctaaaagctgctcctagcttacctgcggtaatttacaatagcccgtattatggatttgcgactcgtgcagatttgttttttgaattacgccgtgaatttccaaacttaattggttttaaagagtttggtggtgctgctgatatgcgttatgcagctgagttcatcacttcccaagatgactctgtgacattaatggctggtgtagatactcaagttttccatggtttcgttaactgcaatgcaacgggagcaattacgggtattggtaatgctttgcctaaagaagttttacagttggttgaccttagtaagaaagctgcagcaggggatgcgaaagctcgtcgtttggcacaagaattatcaagcgctttagaagttttatcatcttttgatgaaggtactgatttagtcctttattacaaatacttaatggtacttaatggcgataaagaatataccttacattttaacgaaacggatgcattgagtgaatcacaacgtaaatacgttgaaactcagtatgaattattccgtacttggtaccgtaactggtcagctgaaatctaa

SEQ ID NO: 2656 - DNA, 468 bp, Acinetobacter baumannii
agtgtaattatgattcaaaatgaaacgatcgaagtctcgccagttcaacaacaagactatactcaatggttagaatattgggttgcctatcaaaatttctatcaggtcaatttacccctccatatcacaaaaatgacttgggatcgttttttcgatgaaaaagaacctatttattgtgcagttgccaaaaataaagaaggtattttaggttttgtcacttatatgtttcatcggtctacttgggcagaaaataactactgttatttagaagatctgtatgtatcacctgaagttcgtgggcgacacattggtaaacaacttattgagtatgtacagaagcaagccaccgaacatagctgtgaacgtttatattggcatactcaagaaagcaatcaaacagcccaaaagctctatgattggattgcacaaaagcccggcgttattcaataccgtatgtctttgaactaa

SEQ ID NO: 2657 - DNA, 1500 bp, Acinetobacter baumannii
accagaattatggcaagaatggcaaaagttgtggaacttccgtctattgcaaagattgataaaagcaaaggaaagataagtgctcaactgactcaagctttacgtgaagctgtacaaagtggtgatttacaacctggcgatccattgccttcttctcgtgaactggctttaaccctaggtgtcgctcgcggaacgattatcgaagcttacgatcagcttttagctgaaggtgtgtttgactctcaagcacgaacgggcacctatgtgtctcatgctttagctaaaaaaactacaccgcaacattctcaaaaagagaccacacctagcgtaatccctttaacgaagtcggcactctcctatgctcaagtgcttaaagagtttaaaccgcttcctcatgccccttttgcagtatctgttcccattgcccgcacccaaccgagcgacatctggcgtaagtttggtaataaatttagatctcgaggtgcaggtgctccttcgggttatggcgaacctcaaggcgtgctatcactcagagttgctatagcagactatgtacgcagatcccgctctgtacactgcgaacctgaacaaattgtgattactcccggtattcagcaatcactttatatttgcagccaaattttatttgaagcaaaagatgaagtttggattgaagatccagcttatcggggtacaacagccatttttgagcatactgtgcaaaacattcggatggtgcgtgttcctgtcgatgaagaaggtattcaggttgaaaccggaattaagctttctaaaaatgcacgtgctgcttttgtgacaccctctcaccaatatccacttggcatgccaatgagtctagcaagacgcacggctttattggcttgggcaaaacagcaaaatgcatggatcattgaagatgactatgacagtgaacttcgctataacggacagcccttcccatcattacaaggcatggcacccgaccaagtgatttatcttgggactttcagcaaagtcttatttccatcgcttaggcttggctatgcagtgttgcctaaagaactggtagctcctttttgtgggcttagagtcttaattgatagacacccgcctgctgccgaccaacacgttttggctgcttttattcaagagggttatttagagcggcatatacgacgtactcgaaatgtctatgcagaagttcgagaatacattattggcttgattgaaaaatacatacctcaagaactggcttggttacagccaggcgatcaaggcatgcatatggtgttatggcttgctcaacatattaatgatattgacgttgcaagctcggcagtcgatgcaggtattgccatcaaagcaatttcaccgacattttcaaaagagcggcgacgttcgggtttaattgtcggcttaggcgattttgaacccgaactaatgcaacaagctatcaaaaaattatcaaagattattcaacagcaagccaagtcaatgtag

SEQ ID NO: 2658 - DNA, 339 bp, Acinetobacter baumannii
ggtgagattatgagatttatattcctctttataagcgcgatttcaattcaatgttatgcagcatcagaagctatggaacttcattactgtgaaactgtgaaaaaagcagcgagtggtgtgatggatgctagacaacatgaagtgcccgctaaagagttacacgacatcgccaatcatcttgaagagcaacaagccaaacaactttatcaagagcttatcaaatctgcatattcttcaaagctatttgaagatcctctcattaagtcaaaagctgtcgaaaattttcaaaccacttggcatgaacaatgtttggcaaaagaattagctaaaaatatgtga

SEQ ID NO: 2659 - DNA, 873 bp, Acinetobacter baumannii
gagtggattatgcctaaaaaatttgaggactttaataatcctaggaaaaaagcacttgcagggatgaaacaaagcatttcagctgaactttgggacaaaaatcttaattttttaaatcaattaagagccaagatcgcgaaacatccagtatctcatcatcctgcaatagaaactttaaataacggtgaaattaataaagaaaacttaaagcgtattcatttagagtatcgccatgcaatcgtacaaacatttacagacgctttattaatggctcaataccagacaaagcagttagaacctaggttgcatgcaggtgcaaagatgtttccgcgctgtcttttgagtcttaacatatttgatgagtttgggtttcggcctgggaccgacaaagacggttattatcaaggtaacccagaatatgcacattatcctttatttgaagatgtgcttgatgattttgaagtaacggaggaagagcgccagagttatcaaccaacagaaattgcacatcaggtgagagagtttctagaaaattcctataaagactataaagccgtttctgctttattagctgtagctgaaaaagaagttattttgtacagtccacctttacgaaaagcaaccagtgctgtaggtatagcggtcgagggtggtggctattaccatgtgcatggagtatctgaagatgaaactgctgaggcagcagatgacgatcatgaagaagatctatggtttattttaatgcaagcttgtacagaagaagattacacttatttagaaaacctatgcctcgaatattgtgatttatgggaaaagttttgggatgttcaaatagaaaactcgaaatcaatcctgaaacaaaatttagcttaa

SEQ ID NO: 2660 - DNA, 594 bp, Acinetobacter baumannii
agatacgttatgaaaaataagccgtggattgaagaaaatgaccctttaaaagaatattatggtttattggatgataacgagttaagtagttttttaagtttatttagtgagtggaataaaaatgattacgcattagaatctgatattggtcaagttaagactgggattcaattattagatttctttgactattctaaagaaagttgtcatctacccttatttgagaattcatgctcaataatggaaggagagagtgagaagttatactggattcctcttagtaataacgaagatattatctttcaagatttttctcctcttatgattgctaaaacttcgattacaaaagaaacacttgattatgtaagtcgttcatttgtgcagatgataaatggaggttacatatttattgatagtaaatgtagatttgtaggagtagttatagatggatattacatgcaggtctatatgaaaaaagttttcataaatgatgtaatgaagccctatgtaaagaattgggaaaagatagatgaatttttagatccattattaaaaaaagatttaattgatcgagtacataggatttcaagataa

SEQ ID NO: 2661 - DNA, 960 bp, Acinetobacter baumannii
gcaaacgttatacagctactcgagatactgcgagtgagtgtgaacaatgggccgctaaaaaaattattagaattacaatctgaacaggctaatcctgagtctgaaaaaatccatatctccttctatgccctttttgaacagtactatcaagaagaaggcagaaaaatgaagagtgcccgcttaattgttcaaatacttaaatgcctaaagaaaaattgggggaaactagcagatgaatcaattcacgatctgacaccagcattagttaaacaatggcgtgacaaacgtttaaagcaagttaaaggtgcaacagtcattcgcgaaatggctatgtatagctctgtttttgactttgctcggaaagagctatttttaacgaaagaaaatccattcaaagaaatatcaaaacctactgcccctcctccacgtaaccagaggatttatcagaactatatagataaagttttagctgggcttgattatgaatggggaaaagtgcctgttcagccaagacaccgagttgcttggtcctttctattcgcacttgaaactgcaatacgcaaaggtgagatacttagtgtagaaaaatctttaatctttccagatttcattcgactattagacacgaaaaatggtactacccgtgatgttcctttaactaccaaagcaaaagaattactttcttggctaccagatgatcctgacgataaccgtatggttcctcttacatcgaatgcatttagattaatatggcaacgtaacttacgccgagttggcttagatggtgttattacgttccatgatacacgccatgaagctattacccgttttgttcatgactaccgtttaccagtagagatcttagccaagattactggccataaaacgattagtgttttagtgaatacttattacaatccgacagcttccgaaattgccaagatgttgacagctgcttag

SEQ ID NO: 2662 - DNA, 3162 bp, Acinetobacter baumannii
tttagtcctataaagatgttgaacagtattcatcaagttttagatagtttgggtattagcccgcagaaacgtgctattcatgttcaatttacgtcttcgatattgaatgcccaagtatttctgcaaagaattgatggtgtacatgcactcaatgatggtttaaaagcagaacttttatgcctatcgacaaatgcaacgattcaacttaaatcttttattggtgttcaggctgctgtagatattgtgacggagcgaggtgagttaactcgcgttacaggcattattactcatgctcaacagggccaatcagatggaagtctaactttatataagctgaccttagaagatccaaccgcattatggaaatatcgccgtaattcacgtgtatttatgaataaaagcgtggttgagatatgggaaatattatttaaagaatggcaaactaaaaatccgctatttgctgcaagtttaagtttagatttaagcggtctaacacaaacttatgatgtgcgtccttttgtgatgcaacataacgaaagtgactggaatttccttacacgcttacttcgtagtgaaaatatcagttggctcattgatgaagctcagcatattgttccaagtaccgagacacctattcaagctcagaaactcaggttaattgatgccaatagtcaatatcagcctttagaccgtaaaacgattcgttaccaccgtagtagtgcggtcgaacaatatgacagtatgactcgcttaactgctgagcgttcccttcaacccaatgttatgcatatacaacgttggcaagcagaaatattagatcaagaagaagggattggaagtgttcaaagtaagcatcagcatagtgaacattatgacaatgctacacttggcttggagcaagcttggaactattcgcctgcatggattggtgacttaaagggtgaggatggggttactaaatctggaaatcaacaagttgaacgattaaaccagaacctcaacaattattatgaagcacaggctaagcggtttattgcacaaacaacagttcgtgatgcctatgtgggctactatttcgaattaaatgaacatccagaaatagatcagcatgaaagcacagatagaagctttttgattatctctaaaagttttttcaatcagaacaacttacctaaagacctgaatgatcgaatcaatggtttattggcgcaaagtaactgggcaatacaaaaccccgagaacagtgatgaacgtcaagcgaatcaactgattttacaacgtcgtcatattccaacaacaccagcttataacccgcaaattcatagtccagtcactcatccacaacgcgcaaaagtggtgggacctgaaggtgaagaaatctatgtagatgagtgggggcgtattaaagtccgcttcctatttacgcgtagtgatgaccatagccatgatggtggagcaggaaccaacaacaatgacaccgattcagcttggattgacgttctaacgccgtgggctggagaaggttatggtgtacggtttttaccgcgtatcggtgagattgttgttattgacttctttaatggcgatatagaccgaccatttgtaatgggtcgaattcatgaggcacagcgccaaccaaccaaatttgataacaaaggtaagcttcctgatactaaaaagctcagtggtatccgttctaaagaagtgtcaggtggtgggtttgggcaactcagatttgatgatacaccgggacaaattagtacccagctacaaagcagtcatggtgcaagccagttaaatatggggaaattgagccatcctaaagataaagcggaaagtgaagaccgcggagaaggttttgaactgcgtacggatcaatggggagcattacgcgcggggcaaggtttattggtatccacccataaacaggataatgccaaaggcgaacacctcgatgccgaagtggcgaaaaagcaacttgaaggtagtcaaactaacagtaaggcactgagtgacattgctaaaaaccagaaaaccgatgaaatagaatcgattgaacagttaaaagattttgcctcacaaattcagcagcaaatcgctaaatttgaaaaagctttacttcttttgagttcaccggatggtatagctctaagtagttcagaagatattcacatctcggctgatgcacaaattaatcagattgctggagacagcattaatataagtactcaaaagaatgtgattgcccatgcccaaaataggctcagcctttttgctgctcagagcgggctaaaagcagtagctgcgcaaggtaaggtagaaatacaagcccagtctgatgctttagatgtgcttgctaataaaggtattacgatttcttcgacagaagactgcattgaaattagtagtcctaaagaaattgtaattactggtgcaagttcacaaattaccttaaatggttcaggaatctttccgaaaactggtgggaaattccaagtcaatgctggacagcatgtgttccaaggcggcgcatcggcaagtgttaaatctagtttgccaccaccaccaaaacgtgcacaaggtgtacttgagcttttgcacgactattcacatggagcttttgttaaaggagctggttataccgtaactgataatttgggcaaagtcgttaatggaaagctagacgataaaggatttgctcgtgtttcaggtttggcaacgggctcagtgaaggttctttttgatccagatccgcgtaatccttgggatgaggcaagtgattttaaacgcaaggtagagtggccaaatcaaaatgacgtagaaggtagcattggtattgaatctggcagtaaagggttaactgaaacattgaaaaatgactttaaaaagttgagtcaacttgcgagcaatgtgaaatctgtgcagcagaagattgaatcggttaaaaaaatcaaagatcaaggtgctaaagcattattgccaatggcgatggaacaggttttaggggggagtcatggatctaagttaagtcaatcatttgttagtcaaaatagctttatgccttcaagtcagcagagtaacccactcagaagattggctcaagcaagctctgacaaaacagcaataacaaaaatccaatcaccttttgaaacgtttgtataa

SEQ ID NO: 2663 - DNA, 702 bp, Acinetobacter baumannii
aatacgcctatcaatatacaggtaaatttgactatgcagcagatgtggacagacattgacgaatatatcgattcacatttaattcccgaagatcctcgactcgactttgcattaaaaaataccgacgaacacggcttttcaaatcatcttgcagttgctccaaatcaaggaatgttcttgcaaatgctcattcagatgaataagtgcaagcgtgttttagaaattgggacctttgctgcctacagtacaatctggttaggacgtgcactgcctgaagatggttatttgcttaccattgaaggtcgtgatactcatgcagaaatggctcaaaagaatatcgatcatgccaacctgcctgtaaaagttgagcttaaattaggccgtgctgccgatgtactttctgcaattgaccctcagtcgattgagccttttgattttatctttatcgatgccgataaacagggctatccggaatatttagaactcagtctcaaattttcaaaatctggcactattattgtgctagataatgtcattcgtgccggtgatattttgaatcctgaaaacaaaaaaccaagtattgaaggcattcgtgaaacctttaaagccctagaaaatcatccgcaaattttgtcttgcacagctttacaaacggttggctcaaaaggtcatgatggttttgcaattgcaattgtgaaataa

SEQ ID NO: 2664 - DNA, 252 bp, Acinetobacter baumannii
ttcgagttcttaatatcatgcaaggccaacgttacattgaaatctgtgaacgaaatcctacccaagagcaattcttttatggttggatcgctaaccgcgtttcactatgaaggttctgatttcgctgtgtattctactttcaggttgcacagctcatacgatatctacaaaagtgcatgtcactgtttgtgtgcagtgtgtgaattaaagtttttaggagaacgcttttttatagatgtgcgaataagttaa

SEQ ID NO: 2665 - DNA, 1458 bp, Acinetobacter baumannii
tgtaacactatttttgttgagtgtttgaaaacccttatgcaaccgtttgttttatataactctgagcaacgaaaaaaagttgaatttgtacctcgcaaagaaggtcacatcgatatgtacgtctgcggtatgaccgtttacgactactgtcatatcgggcatgctcgagttatggttgcatttgactacattatccgttttttgcgtagtcaaggctggaaagtccgctacattcgcaacattaccgatatcgatgacaaaatcatcaaacgtgcgaatgagaatggtgaaacaatccaacagctcaccacgcgtttcatcgatgccatgaatgaagatgcagcgaacttaggctgtttagcaccagatgaagcacctaaagcgactgaatatattgaccagatgcaaaatatgattggtaatctggtgaataaaggcgctgcttaccctgcttcaaacggtgatgtttattttgaagtcaccaaatttgaaaaatatggtcgtctctctggccgtaagcttgatgacatgcaagcaggcgcaagtgagcgtgtcgatgtagaagttgaaaagaaacatccttttgactttgtgctttggaaacatgcaaaagaaaatgaaccatcttggccatccccttggggtaatggccgtccgggttggcacattgaatgttctgcaatgtcgacttgctgcctaggcaatcactttgacattcatggtggcggttcagatttaatgttcccgcaccatgaaaatgaaattgcgcaaagtgaagcttcgactggtgagcaatatgtaaactactggatgcatgttggctttattaacgttgatggtgaaaagatgtctaagtctttaggcaacttctttacgattcgtgacgtaatggagaaattccacccagaagtgattcgatacttcattgtgtcttcacactatcgtagccctgtgaacttctctgatgtagcacttaaagaggcaaaaacttctttaactcgtttctatcattcatttaaagcttaccaacaagtgtacggtcaaacgacaactgaagcgcttgatcaaagctttattgaacgctttaacaatgcaatgtgtgacgatttcaatactgccgaagcaatggctgtattgtttgaactgaacaaagagttaaaccgtgctgtaaaagaagagcaagctgaccaagcgactgtgctttattcgacattacgtcacctcaccaacattttaggtttggtacaacacaatgtagacgatttcttaaaatcagatattggacaagatgcacttgctttgtctgatgctgaaattgaagatttcattcaacaacgtgttgatgcgaaaaaagcaaaagactttgctaaagcagatagcattcgtcagtctttacttgagcaaggcgtagttcttgaagacactcgtcaaggtacagtttggcgtcgtgctgattaa

SEQ ID NO: 2666 - DNA, 189 bp, Acinetobacter baumannii
ccgaacactatgtacactgcgttcaaatgcccatgcatacttcactgtatcgctcagaatgtcctcgaatcacaatattttgtcctcatccatcctctaaatcaagttaataaacgtctattctgcatacaggaaattgcgattttttcgctcactgtttttaaggattttagagcagcctatgtttaa

SEQ ID NO: 2667 - DNA, 453 bp, Acinetobacter baumannii
gagcgaactataaaaggtaaggatatgccccaatatttaaaaatagctgagaaaatatatcaaaatgttaaagaaaaaaaaggctttacggatgatccgatggaagatcttaataatttgatgattgaactcagacaagaaataaaggggacaaaattaaagcttttatataattatattgattttgccgaaatactcattaaacctttgcaagagtcaaaaattaaattggatttaagtcttattcctaaaagtaaaaatactcaggagtttgtcctttggcttgctggttttattgagcgaattaccacaggtggacaagaaaaattacctccaattcgagctaaaattactttacccgcctatgcctatgaagaaacttacccttcgcagaaaaagcctgtaaataatggggaagaaataattgaatattttaagaaaaatcaaagttaa

SEQ ID NO: 2668 - DNA, 918 bp, Acinetobacter baumannii
aagaaatatattgattatagagaattaaaatttcaatcattccccccaatagtaaagatgatgattgagacaaactccaaacaaggtatggcatttgcagccgcatttttatctttagtttctgtacagatcggcgcagcaatagcaaaagtcctttttccaattcttactgctgaaggagttaccttaactcgacttgccttatcggcctgtttcttatggatagtctttaaaccatggcgacagtggaataaacagaccaattggaaaaatctaattatttatggatcaatcctcactttaatgaatactttggtttataaagcattttcttacatgtctgttgggattgcgatttctatcgaagtgttaggaccacttacggttgctattttaatgtctaaaaataaattagattatttttggggaggattatcaattattggtttgcttcttctacctatgggcaatgcaaataataactttagttttattggcatgacgtatgctttattagctgcagtgggttggggactgtatgtgatttatggctcaaaagttgcacaaggtggtggcagctctgttgcgaccggaatgtttatagcggctttatttgcaacacctttaggtgcatctcacattatccatatttttgatagttataagattctttttacatgtttacttatggcgatgctcgcgagtgctattccatttatattagatatgattgccatgaaaaaactgcatcctcgagtttttgggattttactaagtgcatcacccgcagtgagcgctttggctggatggctgattttagatgaacgattaaatagttttcaggttctaggcataacaattattatggcatcgtgtgcaggttgctcttatttctcttataaacgcaataaggtataa

SEQ ID NO: 2669 - DNA, 813 bp, Acinetobacter baumannii
gaggtgtatatgagctatcaatttttacaactcgaacaacaaggtcaggttgcctatgtatggctgaaccgccctgaattgcacaatgcttttaatacgacagtcattgaagaattgcatacttgctttaagcaaattaatactcgtgatgacattcgtgttgtggtcttagctggtcgcggtaaaagcttttcggcaggcgccgacctcaactggatgaaacaggcaggtcaagcatcttcggctgaaaatgaagcagatgcattaaaacttgcgcaaatgcttgatgcacttgcaacacttaaacaaccgactattgcccgcgtgcatggcattgcctttggcggcggtatgggcttagcgtcggcatgtgatatttgtattgccagtactgatgccaagtttgcaacctctgaagttcgtttaggccttgctccatctaccattagtccttatgtgattcgtgcgattggtgcaagacaagcttcccgttacttcttaactgccgagcggatttcagcacgtgaagccaaacaaattggtttagcacacgaagtagcagatgctgaagacttagataaaaaagttcaagaaattattgatgctctattactcggtggcccgcacgctcaagcggcttcaaaacaactcattcaaatggtgagtaaccagaccatgagcaatgacttgctgcaacagacagcacatcatattgctcaagttcgtcaaggcagcgaagcaaaagaaggtctaagtgcctttttaaataagcaacagcctgcttggatttctaactcgaataacaacaattaa

SEQ ID NO: 2670 - DNA, 1101 bp, Acinetobacter baumannii
gcaactcatatttttttatttttcattataaggccagctgcataccatgagcttatattattgaaagatcatgaaattatgagcacgaagaccaaaccgttgatcatcacggcaattgtagtagtcgcaattgttgcatttatcgtatggcaaaataaaaaagacaataatacaagtgcttcagttcgtgacaacaaacctgttgtgattgcttatcaaactggggttgacccaagcaaagtggtgcaggccaatggagactatgaaaaacatagtcaacgtactattcaatggaaaaaatttgatgcgggttcagatgttgtcaatgcacttgcttcaggtgatgtggtacttggtaatattggttcaagcccacttgctgccgcggcaagccgtaatttaccgattgaagtattcttaattacttcaaaacttggtgcatctgaagcactcgtggtgagtaataaatcaggcattaaaactcctcaagatttaattggcaaaaccattgctgtaccgtttgtttcgacaacccattacagccttttgtctgcacttaaacattggaacattccagaagacaaagtaaaaattattaacttgcgtccacctgaaatttcagctgcttgggaacgtggtgatattgatgctgcctatgtttgggaacctgctttaagtaaagccaaatcatctggtacggttttaaccgactcaaaacaagtcggtgaatggggtgctccaacttatgacttatgggttgtacgtaaagactttgcagagaaaaatcctgactttttgaaagcttttgtccaaaccacacttgagcaactcgaaaaatataatcaagacccagccgcttacgttaaagatgccgataacgtgcaaaaaattgcgcagctcacaggttctgatgcaaaagatatcccgcttttattaagtggaaatatttaccttgaccacgctcagcaaaaacaaacgttagatggtgaatttgcgcaaaatatttttgatacagcgaagttcttaaaaggtcagggcaaagtcgatcaactgaaagccgattataaaggcaatgtgaattcttcatttttgcagccttaa

SEQ ID NO: 2671 - DNA, 837 bp, Acinetobacter baumannii
atcatgattttatttggcaaaaagaaagttaaaccaagccaaaaagcttatgccgtcgtgacgggtgcaggcagtggaattggacgaagttttgcaattgaactggcaaaacgtggtggcagcgtagtctgcgcagatattaatttagaagctgcagaagaaactgtaacgctgcttgaacaacatggtgcaaaagcatttgcaatgcactgtgacgtaggtaaccctgaacatgtcacaaatttagctgaaactgctgaaattttacttagtcatcctgtcacccttgtcattaataatgcgggtgtaggtttaggcggtaagtttgacgaactcagcctagaagactggaactgggtcatgaatattaacctgtggggtgttattcatggttgtcatgcatttgtgccaaagttcaaaaaactaggttacggtgcaattattaatgtagcttctgcggcgtcttataccgcagcaccagaaatgactgcctataacgtaacgaaagctggtgttcgtgcgttgtctgaaacactttcggctgagcttcgtaaattcaacattaaagtcaatgtgctctgcccgactttggtgcctaccaatatcattaaaaatggtcgtattccgggccgttattcaaaacttgcagaccatgcgctcatgaactacgcactcaccacaagtgatgatgtagccaaactcacacttaaccgccttgatcaggatgagctttataccatccctcaaatcgatgcgaagttgttctggctgatgaaacgtgcatcaccaagtttgtataccaagtttcttggtacctcttacaaattatttaaataa

SEQ ID NO: 2672 - DNA, 1299 bp, Acinetobacter baumannii
aaaatgatttttattgggcggccgagcagcgtgaacgtattttggctgaatggtcaaagcgttttgaaaagtgatcttttggataagggcctcattatgcaaataccttcgttattgcagtcatcgctgctaggtcaaaatcaaaaggtcgagttagcagggcatttattgtcgacattaacgacttataaatatcctgaacatggtccgtcggttttagaagtggtggatatccaaaaaaagttccaacactttcaggccctaacgcatattaatttagacctgaaagctggcgagttcgtgagctttttagggccttcagggtgcggtaaaaccacattgctgcgcataattgcgggtttagaaaaacctgattatggaaaggttataaaaaagggcgcagacattacgttgctcagtgctgaaaagcgtcactgtggcattgtgtttcagaactatgcgttatttccaaacttaaacgttgaagaaaatattacttttggcttagataaaaagaaatgggataaggcacagcgtagccaaagggttcaacagttattggaactgattgaattacccgatattgctaaaaaatatccaaaccaattgtcgggcgggcagcaacaacgtgttgcgcttgctcgggcaattacgccgaatccagatattttactgttggatgaaccattgtctgcactcgatgctcaggtacgtctaaagctaagacaaaagatccgttcgattcaaacgcagcttaatttgccaacgattatggtcacacatgaccaagaagaagcattaagcatttctgaccgtgttgtagtcatgaatcatggtgtcattgagcaaattgatacgccgcacaatatttactacaagccacaaacccaattcgttgccaagtttattggcaccatgaattttttaaaagccacttgcgctgtaccgaatcagctcgaggttttaggttttattcctctaaatttggagcaacaaaaacttaaagcaggggaaaattacagtattggttttagacccgaagctgtcgagttggttgatgatttcggtagtgataaagagtcgttgtatttgccggttaaagtattaagtactgaatttttaggtgccaagcgtcgtttattttgcgctattcatatcgatggaattgagcaggcaaaacaccttttgcaaattgaaattgaaaataccaagttcaaatctttacaagaactcatgtttataaaagtgcctaatcaactcattcatgtctttgacgaacaagggcacgcactatgttaa

SEQ ID NO: 2673 - DNA, 600 bp, Acinetobacter baumannii
gatattaatatgataaaaacatttttatttataagtgttttaggtttttcgctaacaggttgtgtagctgtcccgatattagcaatgcaacatgggcagccaactcaaacattaaataatgcagcttatgataagcaaactcaatcaagactgcgtgtttactctcaatatgcaaatgtgaatacttatacgaatacaagttgtaatgaatggagtagtaagaaaattaaaaattattttaatagcgttatgaccagtttacctaataccgaaaccatttctgtaggtatgccagcaacaaaagatagtcaatcaattcttaagacacctcaaaaaggatggggacctaaactaacctttaaagaggttattttagaagcaaataaaccagtagttcttgatgctcgtcgtgtcgaaacaactgcaagatatacttgtcaagttgctgtaagttttacccctgaagctggaaatgactatgaagcttggtatagtgaaaataatgatacttgtagtataaaattcaataagattacggaaaataaaactgataatctctattctacgcaagactttgataatattagtatgtgtaaataa

SEQ ID NO: 2674 - DNA, 1368 bp, Acinetobacter baumannii
aaaaataatatcagtatgccaaggagtattttaatggcgacctctacacctcttgttaaatccattcgagcgatccctgttgctgggcatgacagtatgctgctcaatttgagtggtgcccatggaccttatttcactcgtaatatactcatcattgaagataactctggcaatattggtgtaggtgaaattccaggcggagagaaaattttagcgacattaaatgatgctaaagccttggtagaagggcagccgattggtgaatataaaaacttgctcaaaaaaattcagcaaacttttgccgatcgtgacagtggtggtcgaggcaatcaaacctttgatttacgtaccacaattcatgttataacggcctatgaatcggcattacttgatttgcttggtaagcatttaaatgtaaatgttgcaagtttacttggtgaagggcaacaacgtagtgaagttgaagtattagggtatttattctttattggtgaccgcaaacagacttcattagactatgcgactacacctcaacataaccatgattggtataaagtccgtcatgaaaaagcgttaacacctgaggctgtgcagcgtttagcagaagcatcttatgaccgttatggttttaaagactttaaattaaaaggtggtgtattacagagcgaacaagaagctgaggcagtaactgcaattgcgcgccgtttcccggatgcacgtgtaacgcttgatccaaacggagcatggtttttagatgaagcaattgctttaggtaaacatttaaaaggtgtgctggcctatgcggaagacccgtgtggtgcagaacaaggttattcaagccgtgaaattatggctgagtttaagcgagcaacggggttaccgaccgccacgaatatggttgcgactgactggcgggaaatgtcgcatagtattcaattgcaagctgttgatattccattagctgacccgcatttctggacattggaaggttcggtgcgtgtttctcagttatgtaaaatgtataacttaacgtggggatcgcattcaaataatcactttgatatttcccttgccatgtttacccatgttgcagcggctgccgtgggtaatgtgactgcaattgatacgcactggatttggcaagaaggtacagatcaactgactaaagcaccgcttgaaattaaagacggtaaaattcaggtaccaacagcaccgggacttggtgtcgaacttgattgggaccgaattaatcaagcccatgaactttataaattaaaaggtttaggagctcgtaatgatgccgatgcgatgcaatttctaattcctaattggacttttaataataaaaagccatgtttagttcgttaa

SEQ ID NO: 2675 - DNA, 1185 bp, Acinetobacter baumannii
gatgaaaatatcatgaacctacgcagcttgaatttcggtctagatgaaactttaattgcgcttcaagattcggtagccgcattttgtgcaaaggaaattgcaccaattgcccaacaagttgatcaagacaacaaattccctgcacatctctggaaaaaattcggagatatgggccttttaggtatgacggtttctgaagaatatggcggtgccaatatgggttatttagctcatattattgccatgcaagaaatttcccgtgcttcggcagccattggtctttcttatggtgctcattctaatttatgtgtaaaccagattaaccgtaacggtaatgagcagcaaaaacaaaagtatttaccaaaattaatttccggtgaatatgtgggtgcccttgccatgtctgagccaaatgccggttccgatgtcgtcagcatgaaattacgcgccgagcaaaaaggtgatcactttgttttaaacggttcaaaaatgtggattaccaacggcggtgatgcagatgtactggtcgtttacgctaaaactgatccacaagctggccctaaaggcatgaccgcattcttgattgaaaaaggcatgaaaggctttagtcacggcaaccacttagacaaactcggtatgcgcggctctaacacttaccccctattctttgacaatgtagaagtccctgctgaaaacgtacttggtggtgtgggtaacggggttaaagtactcatgagtggtttggactatgagcgagcagttttaagtgccggacctttaggcattatggatgcttgcttagatgtggtgattccttacttacatcagcgtgaacagtttggtcaggctttaggtgaattccagcttatgcaaggtaaacttgccgatatgtattcaacatggttggcatgtaaagctctcgtttatgcggttggtgctgcctgcgacaaagcggatcatgaccgcagcctacgtaaagatgctgcaagtgcgattttatatgctgctgaaaaagcaacatggatggcgggtgaagcaattcaaactttaggtggcaacggttatatcaatgaattccctgctgggcgtttatggcgcgatgccaaactttatgaaattggcgcgggaacttctgaaattcgccgcatgctgattggtcgcgaacttttcaatgaaaccaaataa

SEQ ID NO: 2676 - DNA, 816 bp, Acinetobacter baumannii
atgttgaatatagtacagcctaatatttgcttcattggtagcagtaatttgtctttagctttaattggaggtttagttttaaaaggctttcaaagagaaaaaattaatctaatagaggaagtcaaatttgagaatcaaatcattctaaagcaaaagcaacatgaggtgaaaaaggcagatatagttgttctattactagacccaaaagacttaaaggctatactggcgcccttaaaaaaatggttagctgataaaactattgtgtcgatgatggccggagttaatattcaacaattaatgagtattacgggttcaaaaaaaattatcagagtcatttctaatccccctgtattaacttatacaggtactcatgtgttaattggttcagactatttagagcctttagataaagaagtgatagaaacaatttactcagcaacagggcgaacctattgggcaaattcagaatctcaaagtgatgcgattattgctttatcgggttcaggaccagcttacttcttctatattctcgacagtatggtgaaaacaggggtgtctatggggctagataagcaatttgctttagatctaatacttcaagctgcatcaggcgctgtagaaatggttcgtaaaagtaatgttcagcctagtgagttatgtggcaaggtcacattagcgaatggtattacagagtctgcattacgaatgtttgaattaggcaacctctctgatgatattcggctggctttaaaagcagcttaccatcgtagtaaagaaataaacttagaaattaatgcagaaattacgagacactag

SEQ ID NO: 2677 - DNA, 219 bp, Acinetobacter baumannii
aataggaatatattttattttctaggcgaatttatgacacagctcattaataaaggtggctttcgtgaaagagccaatagaagccgaaaatatcaacaatctgaaaacaagcaagtagctctgccttcaaacaagtatcaacctcaaactaagctccaagataatcaaaatgagatgattcaagcaaaagcaggtacttctgaaacttcagatgattaa

SEQ ID NO: 2678 - DNA, 1158 bp, Acinetobacter baumannii
aacagcgatataaaaagaaaaataaagtgcacctttgtagaggtaacttacatgaagaatattactgaaaaatcactttttgatgtttttactcagcatcaagcttatctctaccgagcatcatcgcgatcggtaaatgaactttataagttttttaatagtgaaacgatggttatgcttgatcggttaggcgatttaatgaaagagctgaatgaaactgagaggtttgctcttgctggtggtgagtatacaactcagcatctaaaaaacatccaacttgttatttcgaactggtttaattcaattaatactgttttaccggaaatgtttactcactcggcaattgctttggctatatatgagtcaaactatattgccaaattatttggtaaggttattaaagatttaaagggagagcggctttatcagtcaataaaacgagtgcctttggctggaggtgccttggttgatgaatccttagctcaaattggtgaaaatgcccttcaacgcattgaatatgctattcgggatggtatgaataccggaatgacgcctcagcaaatcatcaaacgtattactggtacaaaacgccttaagtacgaagatggattgctcaacagtaccaaaatcgatattgaaagaattattagaacgctacgtagccatatatcaaatcaggtctatttatataacttcaaaaattttaattttgaatatgtaaggttcgtgagtgttttagatggcaggacttctaaaatctgtgcagccgttgatggttctatttggaaactgaatgacccagcgaaaagagtgccacctttgcatccgaattgccgaagtattctggtccccgtaagtaaggatggaaggcttattgggaaccgatctttcgttatggatgagaggaaagtacgagatattcctaaagatgagcggactcagttaatgggtcaaatagatgcaaatatttccttcaaagaattttttaacctgaccgataattttttccaaaaagaatggttaggccctaaacgttataagttatataaagtagggcaatttgattttgataaattttttgatccaaaggggcggctctatactttggatgaattgagagaattagatgaacgaacttttaaaatacttggtttatag

SEQ ID NO: 2679 - DNA, 951 bp, Acinetobacter baumannii
ggaatagatatcatggcttcaatttgggtatatccgggacaaggtgtgcaaagaagcaatatgttgcacgatttacctcaaaccgcactggttaaagaataccttgagcgtgcatcggatgcactcaaagaagatgtcttgatgttagatcgtccggcagcattaaagtcaacgcgtgcagtacagctgtgtttgcttatttcaggtgtggtgagttcagctctattaagggctgaaaacttaaaacctgattatgtagcaggtctatcaattggtgcatggtcggctgcagttgtagcagaagttttagcctatgaagatgctgttcgtttggttgcctatcgaggtgaactcatgcaaaacgcctatccaactggctatggtatgacggccctgattggtacagaccgtgcagctgttgaaacatgggtcaaacaaatttatgaaataacgccagaggtgtttgtcgcaaatattaatgcacataaccagattgttatttcaggaagctttgaagccatgactcaagttgctgttttggcaaagcaacaaggcgtggtggcaaaaaaattagatgtatcggtgccatcgcactgtgaattattaagtcagcaagcaaagcaacttgcagcgtctatggagggagtgactttaaagcagcctaaaatacgttatttaagtggtacaacggctcgtacgcttagcaggccagaacagattggtgatgacttggcttttaatatgagtcgaactgtagattgggaaagtaccatccaagctgcatgggagcgaggtgtgaggttacagatcgaagctttgccgggaacggtgcttactacacttgcacgtcgaacatttaaagaaggaactgtattgtcatttcagggaacacgtttagacagcattcagatggcaatgcaaaaagaacaggcaaatagtttttctttttga

SEQ ID NO: 2680 - DNA, 594 bp, Acinetobacter baumannii
atcggcctctttttcattggagtatacatgtttgttgcaggcgtagatgaggcaggacgaggcccattagtgggttctgttgttgctgcagctgttattttagatccgaataatccaattttaggtttaaacgactctaaaaaattaactgaaaagaaacgtgaaaagttgtttattgaaattcaagaaaaagctttagcatggtcaatagcagaagctacacatgcagaaattgatgagctgaatatcttgcaggcaacttttttggctatgcaacgtgcagtggatggtctgaaaacacaacctcaaaaggtaattgtagatggtaatcaaattcccaaaggaattgttattccttgcgaggcgattgtagggggagatgcaagccatgccgagattagtgcggcgagtatcttggctaaagtcacgcgtgatcgtcaaatggcagaattagatcaacaatatccattatttggttttgccaaacataaaggttatccaaccaaagcacactttgaagccattgcagctcatggcgtgattgatcaacaccgtcgtagttatgcacctgtaaaacgcgcattaggtctataa

SEQ ID NO: 2681 - DNA, 504 bp, Acinetobacter baumannii
atgaaagatatatacgttgagtttcgcggtaaatataaagttgatggagaatctcgtgattctgagcacaaaggttggttagaagttaactcttggtctcataacatccgtcaacctaaatctgctacttcaagtagtgtaggcggccacactgctgaacgtgttgaacattctgacatggttttcgtgaaagacttagacgcaactagccctaaattatgggaagcttgttcagctggttatacatttgatgaagtacaaatcgacttctatcgtgcaaatggcgataaacgtatcaagtacttacaaatcaaattgaagcacgttctagtttctagtgtaactccaactgttaacgaagaaggcgttcctacagaagcattcggtttgaaatatgctgctgttgagtggacttataaccaacaagatattaacggtactgctaaaggtgctgttactaagaaatggtcactttctaataatacagcttcttacgcagcgtaa

SEQ ID NO: 2682 - DNA, 633 bp, Acinetobacter baumannii
acaggaagtatcaacgtgagcggtcttttagtttttataaccattgcttttcttactttatcaagcccaggcccaggcgttttatttacagtaaccaattcaataaattatggtgtgagaacagctttatttggcattagtggtttaattattggtatgtttattatcgctgtgatttctgcaagcggtgtcggacttattattactagcaaccctactatcttcactgctttaaaatttattggggccttttacttaatgtacttaggttataaaaattttattaaaaaatccccgactcaagacttattagaaactgaacataatgaaaaagggataaagaaatcaaagcttttctatcaagggttgtttgcctcactacttaatccaaaaacaattgtcttttttattgccctttttccacagtttattgatattaaaaaagaaatattaaatcagtttttggttttatctttaacattctgcttgatcggatttttaattcatttagtttatgccaacttttcctcaatattcaaagagaagatgcttgccggaaataatttttctaagctcaataaagtcagtgggtgtatattttttcttttagcagttttacttattactcaataa

SEQ ID NO: 2683 - DNA, 963 bp, Acinetobacter baumannii
gcaatgagtatgcaacatgtttcttttcagcaagcttcgccaaacgagcaggctgttattctgattgtggatgatgtgccggaaaatttaggcttgctacatgaaagtctggatcaggcaggttatcgcgtgcttgtcacaaccgatgggttaagtgcaattgaaattgcacaccgatgcttaccggatatgattttgcttgatggcaatatgccgcatatggacggttttgaaagctgcatacagcttaaagcgagtccaattacgcagtttattcccgttatttttatgacaggtttgtctgagacagagcatattgtgcgtggttttcaggtcggcggggtggactacgtaactaagccactgaatattgaagaagtattagcaagagtaaaaacacatttggcacatgccaaactattgcaacaacagaaacaggtgattgatgcaacggaaacagccattcttgcgctagatgttcacggtaaaattgtttggaaaactcaaaaagccagtgatttactgaatcaatatttacctgaattagaaggttttgaagcaggcttaaaagcttggttttcagatttggaacatgaaaaagactccaaaaaattaaccagctgtttttattcaacaccatctcagcaattacagcttttattgcttacgccgtgggaaactgaaccaagtgtggcaaaaaattatcttatccagataaaaacttctacgccagctttggaaatggctgatattttgaaatattgcccacagttgactcaacgtgaggcagaagtcatgcactggttgttgttagggaaaaccaataaggatattgcagaaattgtggagctgagtccacggacagtgaataaacatttagagcatgtttttgaaaaactttgcgttgaaaaccgaactgctgcggtggcgcatattaatagcttggtgcaagagtttcactaa

SEQ ID NO: 2684 - DNA, 276 bp, Acinetobacter baumannii
gtagttttcatgaaacgatctattgcatatcgccagatatttcatcaatgtttcaatgcaacatgtatttttacaaatgcaacatcaagcctaaactttgttaacagattgagaacaatcaatcgttctattctcttgaaatatcaagcaattatgttgctttaccctgttggcactttacttgctaagaacatttatcacagaagtaagcctaattgccaaagtacttttttgcctgaaattaagtatttaaatcatttaatcatcatcagctag

SEQ ID NO: 2685 - DNA, 1101 bp, Acinetobacter baumannii
gtggttttcatgggttttaattgcggtattgttggtctgccaaatgtagggaaatctacccttttcaatgcattaactaaagcagcgattgcagcggaaaacttcccgttctgtaccattgagccaaacacaggtattgttcctgttccagatccacgtttagataaacttgctgcgattgttaaccctcagcgtgttttgccgaccactatggaatttgtggacattgcaggtcttgttgctggtgcatcaaaaggcgaaggtttgggtaaccagttccttgctaatattcgtgaaactgatgcaattgcacacgttgtacgttgtttcgaagacgaaaacgtcatccacgtaaatggtaaaattgatccattagatgacattgcaactatcaatactgaacttgcacttgcagatcttgaaactgttgctaaagcaattttacgtttaactaaagttgctaaaggcggtgacaaagaagctgtagcaactaaagcagttttagaaaaaatccaaccgttacttgacgaaggtaaaccagctcgcgcggctgatttgtctgatgacgaacgcaaattaattcgtggttttggtttaatgactttgaaaccaaccatgtacattgcaaacgttgcagaagacggttttgaaaacaatccacatttagaagctgttaaaaaacttgctgctgaagaaaatgcgattgttgtgccgctttgcaaccaaatcgaagctgaaatttcattattagaagatgaagatcgtgctgaattcctagaagcaatgggcatggaagaaccgggcttaaacgtagttattcgtgcaggctataaacttttaggtttacaaacttatttcactgctggtgtacaagaagttcgtgcatggacagtaaaagttggtgcaacggctcctcaagcagctggtgttatccatactgatttcgaaaaaggctttatccgtgctgaagttgttgcatatgatgacttcgtacaatacaacggtgaaaacggcgctaaagaagcaggtaaatggcgtttagaaggtaaaacttacgttgttcaagacggcgatgtaatgcacttccgttttaacgtttaa

SEQ ID NO: 2686 - DNA, 231 bp, Acinetobacter baumannii
aaaaccttcatagagagcaacttacaaaataattctctattgcaaatgttaaattatgatgcgttatatctaacaataaaatttatcttctatggtctttctaaaatacgcggcccggcaccttcttgccccaacacatcattgggatttcttaatggacattgttctaatgacaaacaaccacatccaatacaccaatccatttcgtctctgagtcttgtgagtttttga

SEQ ID NO: 2687 - DNA, 627 bp, Acinetobacter baumannii
tatggcttcattaaaaacgtggagatggtcatggctaaaatattggtattaaaatccagcattatgggtgagggttcacaaaccaatcgcctaatcgatgtaatgcttgaacaccgtaaaggccaaggtgtgcaagatgacattaccatacgcaatttagctgaaatgaacctgcctgtattagacctagaaatttttcaggcgcttcgtggggctgaaaatgtaactcaagacattcaacgaatcgttgctttgtcggacgaattaattgctgaattaaaaagtgctgatttattggtcattggcgcaccgatgtacaacttaaatgtcccgactcaactcaaaaactggtttgatttggtggcacgagcaagacaaacattctgctacaccgaaacttatcctcaaggtttggttgaaggggtaaaagctgtggtggtaagtaatcgtggcggtattcatgttggtcaagaaactgaggcagtcacgccttatctcaaagcggtgttagggctaatgggcattcatgacgtcgattttatctatgcagaaggcttacacatgcaggcttatcgtagcaatgcattagatctggcaagccaacaagtcaaagaattcactatttaa

SEQ ID NO: 2688 - DNA, 1029 bp, Acinetobacter baumannii
ggattattcatctcagcaggagttataccaatgcagtcagaacgttggtggcaagactcttctgtaacggctgagttgtttcaacgccctaaatcttttgagtttattcaagcaacacgtttattgcgtcatatgcctgccaatgacgcagctttgtcatggtctgaccattttaaatttgagacctcatttaacttaaattttccggccactgaaattgaaagtttagagttagtagatgagcgtgttcatttaacaaacctgatcgttggtcttaccggtatacaaggtgcattaccttatacatatacaaataaaattaagcaggctccaaggcaacaacgtgctgaaacgaaagagtttttaagcttgtttaatcataagttgaccagtcagtatgtagagtcaagtattacttatcacttgcctgtgcgctatgaaattgaaaataaaaatgattatttggatattctccatgcattgaatggctatgttcgctcacaacatcagcaacaagacttggatgaatatttcgctgaattttcaggcctaatgcaggggcaaaataatacggttcatgctttaaagacgatgttgagttgtatttttaagcatgaaattacaattaaagagtttgtacaggaatcgtttaagttagcgggtgatcagctaaccactttaggtggaagtcaaccgagcttacttggtattaacacattttgtggggaaacgattcaacaaattgatggaaaaattgagattcaaataggtccgcttaagcgtcagcaatatttaaaatttttacctcaccaagagcttagcttaaagctcaaaaaaatcgtagaaacctggtgcagtccaactttatcgatagatttaagattgatattggatgagtctgaaatacaacctgttcgcttaactcaaggccaagaaagtggcctagggcaaggcgcttttttaatgtctcgtaagcctaatacacataacgatgaaacatgttatagccttataggagagcaaatatga

SEQ ID NO: 2689 - DNA, 189 bp, Acinetobacter baumannii
agcgagttcattaagctgcatgatcattatcctgttgagatcttctgcattgatagtggagcaatacataaattaaatagctcaccatcaactttgtattatggcataccaaaaattaatttaaaaaaaattttcggtatgcccgaatgtttaaatgtctttagaaataataaaacagcgttaagttaa

SEQ ID NO: 2690 - DNA, 585 bp, Acinetobacter baumannii
acctcaatcatggagacaatgatgagcttgattaatactgaagttaaacctttccaagcaactgcttaccacaacggccaattcatcgaagtgaacgaaactaaccttaaaggtaagtggtctgttgtattcttctatcctgctgacttcactttcgtatgtcctactgagcttgaagacttagctgataactacgctgaattccaaaaattaggcgtggaaatctacggtgtttctactgacactcacttcactcacaaagcttggcacgacacttcagacgcgatcaagaaaatccaatacccattaatcggcgatccaacttggactctttctaaaaactttgacgttttaatcgagtctgaaggtttagctgaccgtggtactttcgttatcgatccagaaggtaaaatccaaatcgttgaaatcaacgctggcggtatcggtcgtgacgcatctgaacttcttcgtaaagtaaaagctgctcaatacgtacattctcacccaggtgaagtttgcccagctaaatggaaagaaggcgaagcaactcttgctccatctatcgacctagttggtaaaatctaa

SEQ ID NO: 2691 - DNA, 921 bp, Acinetobacter baumannii
gcaacaatcatgcaacatgagttaagtgcaatttctatatttgtgactgtggttgaagctggaagttttgtaaaagctgccgagcaattgcatttaactcgctcagccataagtaaaaatattgctcggcttgaagaacagcttggtgtagttctatttaaaagaacaacacgttcactcagtatgactgacgaaggcgctttattttatgagcatagccgccgagcgttaagtgaaatacaaaatgcggcggctttattagaccaaggcaaaattaacgcaacaggccgattaaaaatgtctgtgccagtgctgttcgggcaactttttgctgccccgctcatggtaaaatttgctcagcaacatgcggacttacagttagaaatttcatttaatgaccgaaatgtagacttgatcgaagaaggttttgatttatgtataagaatcggggcattgcctgacaccactcagctcgttgccaaaccaattggtgagcatcgaatgctactttgtgcctcacctgactatttaaataaagcaggtcccgtagaacatattgaagacttagagcatcacgcgacgattgccgatccgcattttggtcaaatgcaaaaatggcaacttaaaaaggaaaatgacgagcctttatttattaaaccgaaagcaaaacttcttttaaatgacttacaagccattaaaaatgcagcacttgctggagctggtatcgcttggctacccgactggctcattcaaaatgaattacaggacggtaagctggtacaagtgttagacaccatgtcgagcactgcttttccaattcatttggtatggcctacactgccttttatgccactcaaaacccgtcttgcaattgattatttggcgcagcatttaccccctgaactgaacaaacaagcttaa

SEQ ID NO: 2692 - DNA, 426 bp, Acinetobacter baumannii
gggattgtcatgattatatatggagttggtttactcgcactttgcaccttggttggtgtaattgctggtgatctattaggcgttttattgggtgtaaagtccaatgttggtggcgtgggtattgccatgattttactcatttgtatacggttatggatggaaaaacgtggaatgatgacagttgaaactgaaaaaggagtttcattctggggcaccatgtatatcccggttgttgttgctatggcagcccaacaaaatgtagtggcagcattatcgagtggccatatggcactctttgcggctgtagtctcagttgcagtttgtacgctcactattgctggtctaagtcgatttaacaaagccagccctttacctaaagaagaggacacagccttaaaccgaatcggaggtaaagttcatggttga

SEQ ID NO: 2693 - DNA, 384 bp, Acinetobacter baumannii
ggagttgtcatgaaccatccttcagaattgaagtatgcacgtacacatgagtgggtaaaaattgaaggagaccttgttattacagggattaccgaccatgcacaagatgagcttggagatttggtctatgttgaaactcctgaagtgggtagccaagtaacagctggcgaacaagccggagttgttgaatcagttaaaactgcttctgatattcatgcccctgtctctggtacagtagtagaagttaatactgatcttgaagatgatccggattttgtaaatgaagatccatatggcaaaggctggatctataaaatcaaaccagacaatattgcagatgttgaaaaacttttaacaaatgcagagtatgaagctggtctataa

SEQ ID NO: 2694 - DNA, 804 bp, Acinetobacter baumannii
ggagttgtcatgagtgtactagaagccaaacatattcatctgacttttcctaaacagcaaaagccagttttacaagacattaacctaaccattgaagaaggttctttaaccgtgattttaggtgagtcgggttgtggcaaaacaactttgcttaatatcttggcagggtttcaaaagccgagttctggtgatgtgcttgtaaatcatgaagtcgtaactggaccagatgtaactcgtgctgttgtatttcaagatcacgccttacttccttggttgaatgttgcagataatgttggcttcgctttgcagttaaaaggtttaaagcgtgcagagatcgaagcacaagtaaacgcaattttaaaaattgtgggtttaagtcacgttgaaaaagcgaatatctgggaactttccggtggtatgaaacaacgtgttggtattgccagagctttgatcagtcacgcgccgtttattttattagatgaaccttttgccgcattagatgcttttacgcgtgaaaacatgcagcagttagtgctcgatttatggattcaacaaaataaaagcttctttttgattactcatgacattgaagaagcattattactcagcaatcagctggtactaatgacagcgcatccaggcaagattgtagaaactctacacctcgattttgcccaacggtaccgtcagggtgagtctattcgctcaattaaatcggattctcaatttattcagctcagagaacagctatttgaaagtttaagggcacaaaaacaaagcggtaaggaggcgttacctacatga

SEQ ID NO: 2695 - DNA, 612 bp, Acinetobacter baumannii
gcaatggtcatgaaacttaagctcgaagcccatgatttgttgtggggtatgacggtcgattgcttggccgatgatgctccacattgggtgaaagaggtattactacgtggtgatcctgttgtagttcgacgggaaattactcctgaagatcaggtggccgtgggtataagaggacaatttcgctatcaacgatatgcggcgcaaatgccaagatctgtaattagcagacagcttaaacccgaagcactagctgaagtaaatccaagtcactttaaacacttggcagaacgtttacagagcatttctagcattatgaaaaacttttcaggatgttggggatatacgggaagtttcggctttgaactagcaacgggcattaaaacagtaaatcagcaaagtgacatagatttgttgattcgagctgaacaaccttttgccaaaaagcaggcagttgagctactcgaaaattttcagcaagcagggctgaatgtggatatacagctacaacttccacaaggtggtttggcgttaaaagaatgggctgggaatagcggaaaagttctattgaaacgtcttgatggtgctgttttagtagaaaacccatggaattag

SEQ ID NO: 2696 - DNA, 513 bp, Acinetobacter baumannii
ataaacaccatacgaggtggaataatgcttcagcaatgctgtcagttattagaagaccgtttacttaaagtcgcatttattgaaagtgccagttcaggttacttaaccagtcagttttcgattcataaaaatagtggtgctgatattttactgggtggattagtcagttatgaccccagtattaaaatcagtgttttaaaagttgatccaaagttaattgaaacctacacagcagaatcgccacaagtaactgaagaaatgtgcaggcttggtcaaaccctatttcaacaagctgacattgttgtgagctgcacaggtttattaaaacctggcggaagtgaaaccacggaaaaacctgtaggtactttctttatctgtatttcttatctaggacgtatttatcattaccattattttttatcaggtcatgccgaacaaaaacttaaaactctcacacagaaagtagcagactcaattattgcgcttgtatcttcaaatcagcataaaagttaa

SEQ ID NO: 2697 - DNA, 1170 bp, Acinetobacter baumannii
aatatgaccatttcagagacatggttgctgcctgacggggtagcagatgtattgccggaacaggcgcaagtcattgaaaaacttcgccgtgaagctatagatttcctcgcagtacgaggttatcaactggtatatacaccatttatcgaatacatcgaatcgttgtcttcattatcagaatcaaatcaagacctggatttagtaacttttaaggtgattgaccagctttcaggccgtttactcggtatccgtgctgatatgacaccgcaagttgcacgtattgatgcacatgtaagacctgttgaaggtgttgcacgttactgttacgcagggactgtattacatacaaaaccacaaaatttcaatgcgactcgcgcacctttacaattaggcgcagagttatatgggcacgatagtattgaagctgatgtcgaaatggtcgacgtgatgctgggtttgattgaaaatgcctatactttgcaaggcgcacatttagacttagggcatgtaggcctatttcgtagcttagtaaaatatgctggtctttctaaaaatgaagagcatgagttatctgatctttatcaaagaaaagcattacctgagttagctgaatttacccaaaatttaaatatgggttcagatttctatgtacttggccgttatgcaagtgatttagatgccttacaagcgcatttaagtgcagatattttaaaagatgctgaatttgatgctgcattaaatgcacttaaaaccactcttgaacagattaaaaaccgttggccagcacttaatgttggaattgacgtggttgaacttcgcagttaccactaccacactggtttgatgtatgcagtttatgcaccaaatcgtgccgcacctttagcgcaaggcggccgttatgatggtattggggaacacttcggtcgtgcacgtccggctaccggttttagttgtgatttatatgctttaggtgcgaaccagtttgccgaaatcgaaactgtagtggcacctaaaggtacagaagctgatttacttaaagcaattgcgaatgcgcgttcagagggtttacgtgtagttcaattgttaggtaatgatgatttaagttctattccttatgcaacacatcaagtggtattgcaaaacggacaatggaatattgaaaagatttaa

SEQ ID NO: 2698 - DNA, 1017 bp, Acinetobacter baumannii
attaatgccatcatcatggatatgacaatgactctacgtaatgattggactcgtgaagaaatccaagctctatatgaacaaccttttttggatttagtttttaaggctcaacaagtacaccgtgagcacttcactgccaatacaattcaggtcagcacccttttatctattaaaacgggtaaatgtcctgaagattgcaaatattgctctcaatctgcacattacgattcaaaattagaagcagaaaaacgtattgctgttgaaaaagtaattagcgaagcaaaagctgcaaaagattcaggttcatctcgtttttgtatgggtgctgcttggcgcaaccctcatgagcgcgatatgccttatgttttagaaatggtacgtgaagttaaagcattaggtatggaaacctgtatgactttaggtatgcttaatcaatcacaagcagaacgcctaaaagatgccggtttagactattacaaccataaccttgatacttctcgcgagtattattcccacatcatcagcacacgtacttttgatgaccgtttgaatactttagattatgtacgtcaagctggtatgaaagtatgtagtggcggtattgttggtttaggtgagagccgtgaagatcgcattggcttgttacatgagttagcaaccttacctattcatccagaatctgtgccaatcaacatgcttgttccaattgaaggtacaccattagctgatgttgaaaaactagatgttattgaatggattcgtactattgcggtagcacgtatcattatgccgcatagttatattcgtttatctgctggtcgtgaatctttaagtgactcagatcaagctttagcatttatggcgggtgcaaattctctgttctctggtgataaattacttacgacgccaaatgcaggtgaaggtaaagaccaagcgttatttaataaattagggttaacagctgaaaagccaaaaccaactatttctgaattatcagtagatgcgatgagtgcttaa

SEQ ID NO: 2699 - DNA, 1116 bp, Acinetobacter baumannii
gagttttacatgggcattcgtatcacaggtactgggctatttcacccaacagaaatcatttctaatgaagaactggccgacagtttaaatgcttatgtggaacaatataaccaagagaatgcagagaaaattgcagcaggcgagctagaagaattacgtggttcaagtgctgaatttattgaaaaagcttctggtattaagcgccgttacgtgattgaaaaatcgggtattcttgatccaacacgtttacgtccgcgtttgtctgaacgttcaaatgatgaactttcaattcaagcagaatggggcgttattgctgcaaaacaggcaatggaaaatgcaggtgtaactgctgaagatatcgatgttgtgattttggcatgttcaaatatgcagcgtgcttatccggctgtggcaattgaaatccagtcagcacttggtattcaaggttatgcttacgacatgaacgttgcgtgttcagctgctacttttggtttgaaacaagcggcagatgcaattcgttcaggcgctcgccgtgttttattagtgaatgttgagattacatctggtcacctagactaccgtaaccgtgattgtcacttcatttttggagatgtggcgaccgcttctattattgaggaaaccactactaaaactggttttgaaattttagatattcatttattcactcaattttcaaacaacattcgcaataacttcggtttcttaaatcgtagcgaagatgcagtggttgatgacaagttattccgtcaagatggccgcaaagtatttaaagatgtttgtccgttggtggcaaaaatcattaatgcacagttggaaaaaatgcagttaactgcaaacgatattaagcgtttctggttacaccaagccaatgccaacatgaatgaattaatcttgaaatatgtggctggtaaagatgcagatctaagccgtgcacccattattctagatgagtttgccaatacttcttcagcaggtgtaattattgctttacaccgtacaggccacgaagtagatgatggtgaatatggcgtgatttcatctttcggtgctggttattcagtaggttcgattgttgtacaaaagcatgttgcttaa

SEQ ID NO: 2700 - DNA, 3483 bp, Acinetobacter baumannii
tgcagccacatgccaaacatgagtgttatgccagattcttcacgcccccaacaagcgccacaacgtgtgatcaaaacacgccgtgaatataatatttgggtggcagatgaaagtatcgaagattatgcgcttcgctacgcacccacctcagtaagaaaatggtcgccttggacggtaaccaatactgcaatttcgacagttagctttttagcgatggaagccattggggcaaccatgctttggcaatatggttttagcaatgcgttatgggcagcaattgtcgtatgtaccatcatatttttaaccagttggccgattagttactacgccgcaaaatataatgtagacgtcgatttgcttactcgtggtgcaggttttggctacattggctcgaccattacatctctaatttatgccagctttacctttattttgcttgcctttgaagccgcaattatggcgatggcacttgagcttgccttaggaattccgcaagttattggttacttaatttctgccttagtgattttgcctttagtggtcaaaggcattggttttattaataaagttcaggcgatcacacaaccaatctggctcttattgctgttattaccgtggttttttgtactttggaagcagccacaaattttaagtagtagcttgcattttgttggggcggtttcaaactcaaccgattttaatctgtattactttggtgcggcgtgcactcttattttttcatttgtgatccaaattggtgagcaagccgactatttacgtttcttaccgcaaaaagaaaagaacagaactgcatggcgttttgccgtttttctaggtggcccatcttggattatttttggatttctaaaagttttgatgggtatgctgctgatggtgttggcttttcagctgtttattcctatctctgaactagacaatccgacttatttatattgggttgcttatcaacagtttattccaaaccctcagcttgctttaatcttgactctagcactggtttgcttggcgcaaattaaaattaatatgaccaatgcctacgctggttcactggcatggtcaaacttttttgcccgcttaactcatagccatccgggacgaattgtctggcttctttttaacgtttttattgctattgttttgatggaaatgggcattagccatgcagttgagcgcattttggggctatatagcaatattgctttggcatggattggtgccgttgttgccgatttaattatctgtaaacctttaggtttaagcccaaagggaattgaatttcgccgtgcttacttatatgacattaaccccgtaggtgtgggtgccttactcatcgcttcagtgttatctatgcttagctatttgggccttttcggactcatggcaaaaggattggcgagttttattgctttggggagtgcggtgttatgcgttcctattattgcttacctaaccaaaggcaaatattacattgcacgccagcctgaaaaaattcaggcgacgtcggttgctaactgtgtggtatgtgaacgggattatgagcttgctgatatggcgggctgcccagcctataacggtacgatttgctctctatgctgttcacttgaagcccgctgtcacgatttatgtaaacccgatgcacgttggtcagttcagctcaaaaaagccatctggcactatttaccagaacgttgggctagtcgtttaaatagcagggtcagtttatatttattactgactctggggctgtctattgttttggcagtgagtttaagtctggtttatatccaagaaaagacctacttagaaaccattgatgcggcagccgttcctcagttatttacactgtttgtcaaaatttacaccattttatttttattaatgagcgttgctgcatggtggttagtgttaaacgatgaaagccgtcgtaatgccgaaattgagacacaccaacaaacagcattattgattgatgaaattgctgcccatgaagtcacttcaaaagacttacaagacgccagaatttcagcagagcgagcaaatgatgcaaaaagccgttatgtcattggcattagtcacgaactaagaacacccctaaatagtattttaggctatagccaattacttcaaaaacaagagcagctttcagaacaaggcaaaatggcgcttggggtgattagccgtagtgggcagcatttaacttcactgattgatggtttactagatttagcacgaattgaaacgggcaaaatttctttaaatgtagtggacgttcatttccccaattttatagaacagattattcaaatgtttcagcctcagtttgaacagaagaatttacagtttgtttatgaaattggagagaacctaccgcactatgtgcgtaccgacaaaaaacgtttagaacaagtgctcatcaatttactgggcaatgctttaaagtttacaacgagcggtacaattactttgaaagttgagtaccgtttccaaacggcttattttgaaattagagatacgggctgtggtattgccgaggcagatttagagcgaatctttaatccgtttgaacggggcagtaatgtggtgcaaggcggatttaccggaacaggactcggactacccattgtaaaattattagtcgatttactcggcggacagctatctgtgactagtcagctcaatcagggttcacagtttaagattaagttttacttaccttcaaaagaagtagttcatccaatttctaatgtttactccaaccaaattacgggttatcagggcgagcgtaaacgaattttggttgtcgataatgaagcggtggaccgaggcctagtcgctaattttctaaaacctttgggatttatgattgaagaagccgagtcgggtattgactgtttaagacgtgtacctatttttcagccgaacctgattttgatggatttaaatatgcctttgatgggcgggtgggaaacagcacgattattgcgtcagaataatattaccaatgtgccgatcttaattatttcagccaatgcaggcgagcgcgaagtcaatccacaagatgcggtcttaagtgaagactttatgctaaaaccaatcgacctgaatttgttgctgagtaaaattggagataagttgggcttggtgtggattgattccaaatcagagacactccttgaaaataatgaagttcaaacactcgatttaaatatatataagcaagagcaagctgctgttcatacaccagtcaaacaactggaaaataatgatctgcttgatttaccgcaaagcttgcaacagttaaatgatttaattgggcagggttatattcgaggaattcaacagactttaatgcaatgccggcaaaattttccggagcatgatgagttatgggaacagctggaacaggctattcgaaagtttgatttaaaacacgcgcaacgattgattcaggataagcaatga

SEQ ID NO: 2701 - DNA, 519 bp, Acinetobacter baumannii
ttttataacattttaaaaacaattgtagggagaattaaaatgttcaataaatgttgcgaattattagcaaaggaaaaaattaaaattgcattttttgaaagcgcctctgcgggttaccttgcttatcgtttctctttaagtccttattctggcgatattctgattggaagccttgtgagttacgaccttcgcgtaaaggaaaataccttacatatttcagaagagcttgttgaaaaatatactgcagaatcaatgcaagtgactgttgaaatgattaataaaggtaaagaacttttacatgccgacctgtatgttgcctgcacaggtcttttgaaaaaaggtggctctgaaacaccagaaaaacctgtaggtactttcttctactcaatatattataaaaataatttttataattttagacgtgttttaagggggcctgcctttttaaaactaagaaagttaatttactatgttactcaagatataaaacttattatattagaagacaaaaggcgttaa

SEQ ID NO: 2702 - DNA, 852 bp, Acinetobacter baumannii
ggggcaaacatgtcagtcggctcactaaactggactatattctgtgcggagtctaatgaatatggtgtcgataaagccgcatgggcagaatcagtttgtaaggttattggtagttctagctacaatgcctatgctgaggcgcccacatggttacaaatgttaggttctggtgtctttactatggtttggactgccattgtagcctttcttatcgcatttttattaggttctctcctcggggtaattcgtactttacccaataaaccacttgcttttatcggcaactgctatgtcgaaatattccgtaatattccattaattgtacagttattcttctgggcttttgtttttccggagttcttaccggacagtttaagtgcaggaagtggagatgttgtagcagggggatggtggaaaaacattttaaatcaacaacctgctattatcggtgtttttgctttaggtctttatactgcggcgcgtgtttcggagcatgtcagagccggaattaacacggtttctcgtggtcaaaagtttgcggcatcggctatgggatttaccaccgctcaaagttatcgttatgtgattttgccagtggcataccgtacggtatggccaacgattacgtcagaagcaatgaacgtctttaaaaactcggcagttttatatgccttaagtgttttaaatttctttgcttataccaaaaccatgcgtgaagagacttcacaggacattatcattcttattctgtctacacctgtctatttaatcattacatacaccattaaatttataatggcatggattgaaaaacgcatggctgtaccaggtttaggctcgggaggaaaataa

SEQ ID NO: 2703 - DNA, 996 bp, Acinetobacter baumannii
atcgctgacatgaatcctaagtatctaattcttattacatctgtattttgctcaatgtcctcctatgcacaaagttttgagttaaattcagacattacagatgaacttaatacagcactgaaaaataataagaatgtaacaattcctcctggtgactacaaagttgatgctcttaaatcaattaagccccaaaatggttctgttataactatgtcagaaaatacgagattgaatgtcattccaaataaaagcggagcctataaagtatttgatatttctaatgtaaaaaacgtaacaatcacgggaggcgaacttatcggtgacaaatattcgcatttgaataaatatggcgaatggggaatgggcattgatattcgtgattctcaaaatattaggatttcaaatatgaaaatttcaaaaatgtggggggatgcaatctacttagggaacaacaacaacttttcaaactctgatattgtcttatcaaatatcatcatgaatgataatagaagacaaggcgtctccgtaattacagctaaaaatttgaatgcaaacaatctaacaattaagaatacctccggtactggacctgcgagcggtattgctattgagccaaataacaataaatcgcatttagaaaacttaacttttaaaaatattactacagaaaataataagggagctggaatacaaataacactgaagttttataagaaccctaaaaacccagttagtatttctgttattaatcataaagataaccgatctacttttggatcgattgtaaatggtattgatagtacacaagcaggtcaaatcaacttcaacaaattagcttataaaaataactccaactcaaatacgtgttttagtaattggtcaaataccaaatttaatattaaatttactgaagcaactttagatggctctaaaggtgtaagtgagtggtgtcacgatgttagtaaaaataaaagaattttagtgcaaaaaaattaa

SEQ ID NO: 2704 - DNA, 2148 bp, Acinetobacter baumannii
gtaatggacatgaacgacaatactaaatcaaccaataaaacaagtgaaatggctggtgccgatgcagcaaataaagccaatactacccagaaaactgaacagttagacacagttagagatgatgcaactaatgaagctttaaccacaaatcagggggttaaaatagcggataaccaaaatagcttaagagcgggtattcgtggctcgactttattggaagatttcattttaagagaaaaaatcacccactttgaccatgagcgtatacctgagcgtattgtgcatgcgcgtggtgtaggggcacatggttattttcaggcatatgaaggaaacgaacgtttaaccaaagctggattcttgacagacccaactattcagacgcctatttttgtacgtttttcaacagtccaagggcctcgtggttcagccgatactgtccgtgatattcgcggttttgccattaagttttatacccaagaaggtaacttcgacttggtaggaaataacgcacctgtcttttttgtgcaagacgggattaaatttccagactttgtacatgcggtaaaacctgaaccggacacagagatcccaacaggtgcaactgcgcatgatactttctgggatttcgtgtctttagtgcccgagtcagcacatgctgtaatttgggcgatgtcagaccgtgcgattcctcgtaacttacgttcgatccaaggttttggtgtgcatacgttccgtttaattaatgctgaaggtaaatcacattttgtgaaatttcactggacaccaaaacaaggtttgagtgcgctggtatgggatgaagctcaaaaacttgcgggtaaagatccggatttccaccgtcgtgatctttatgaagcaattgagcaaggtttttatccagaatgggaactcggcgtgcagattgtcgaagaagaagatgaaatgaactttgacttcgatttgctggacccaacaaaaattattcctgaagaattagttcctgttacgccaattggccgattcgttttaaatagaaatgtagataacttctttgctgaaacagagcaggtagctttctgtccgggtcatgtagtacctggtattgattttacagatgacccacttttacaagcacgtctattttcatacacagatacccagttaagccgtttaggcggaccaaacttccaccaaattccgattaacaaacctgtgtgtccattccataacaatcaacgtgatggtattcatcagcataccattcataaaggacaggctgcatatcaaccaaactcaattgatggaaattggccagtagaaacaccgccagcggcatcaaatggtggttttgaaagttatcctgaaaaaattagtggacataaacttcgtcaaagaagtgagacgttctctgattatttctctcaaccgcgactatattacaaaagccttgcaccgcatgaacaaaaacatgtagtcgatgcctatacttttgaattaagtaaagttcaaagaaagcatattcgtgagcgtcaagttcaacaaattttggctaatatcgacttagatttggcacgccaagtaggggcaaatttaggtattgaagtgcctgacttaacactaaactataagaaaacagcagttgaaaaatctgccaagttatcttttttagctttcccgcctgaagatattcaaggtagaaaagttgctgtacttatccataacatggtgaagtctgatgcattggaggctattaaaaactgggcaattaaagaaggcgtaatccttcatttactagcgccgagcttggctccagtaaaagatcataaagataacgttattgtggctgatggcatgcaaatgtctgagccttcaattgcctatgatgcggtaattattccggatggcgataacctaaatacggttatgcaagacggggtagctcgccattacttactcgaagcttataagcacttaaagccaatcgtatttttaggtaataaatctgatttgcttgaaccattaggtttagtggcggatgaaggaactttaattgaagatgagttccagcatgttgcggaaaaatttaagaacctgattaaagcacaccgggtttggtcacgagaacaaatagccgcacatgtaccggcttaa

SEQ ID NO: 2705 - DNA, 1038 bp, Acinetobacter baumannii
ttcgaggacattctgagcgatacagtgaagtatgcatgggcatttgaacgcagtgtacatagtgttcggttaatggctgatttcgcgctggaatcaggcatctcttatcagacaattttgcaaggaactgggcttagccaacaacaattacttgaccctaatatggtggtgacaggccatcaggaattacagttgattcataacttggttgagcaactaggagacagaccgacattaggcttagaagtgggcacacgctatcatttcaccacatttgggccattaggcatggctctgatgagtagtgcgagcattcgtgaagcactggatttggctttaacctattttactttaacctttgcttttacccgctttgatgcgtcggatacaccgcaaggaatccgtattgaaattgatgagcaagatattccatcttcagtacgtcaattcattattgaacgcgatgccgctgcactcattacggtacagcgagatttggtgcaggacaatttttgccaatatttggctttttctttccaacccaaaggtgatgccgagccttatcggaatttatttggggtcatgccggaatttggcgcagctaaaagttttgtaattcttgatccgcaaaaagtggatcaaaaattactcatggcgaatgagttggttctgcacactgcagaagaacaatgtcgtcaaatattagaaaagcgccaatcacaaaataaatttacaaccttagtgcaacagcagctgatgagtatgcgtggggaaatgccatctatggatatagtggctgatcgactgcatttaaatataagaaccctgcgccgtcacttggcatcggaaggaatgacttttatccagattcgtgaagaggttagacaggtcttagcagagcaatatttggcattaccaaaagcttctgttgagcaaattgccgagtggttaggttatgccgaacctgccagttttattcatgcttataaaagatggcatgggaaaacacctcatgccatgcggttaaatagccaatag

SEQ ID NO: 2706 - DNA, 231 bp, Acinetobacter baumannii
gtggtttttttattgtttataggtcaattcaaaattcgcattaagaaacgctttatatttccattgcagtaccatgaaatttggagtgttattatgcaaaagccagttaagcgcggagacgcgtggcgtatcattgtccgttatttaggcaaacgttatacagctactcgagatactgcgagtgagtgtgaacaatgggccgctaaaaaaattattagaattacaatctga

SEQ ID NO: 2707 - DNA, 456 bp, Acinetobacter baumannii
atggatcgcatagataaaaagattcttgctgaattgcaattaaatggccgattatctatcactgagttggcagaaaaagttggtttgagcatttcaccttgtcatagacgagtgaaggctttagaagagtcgggagctatcaaaggctatcgggcagagctcgacccaaacttagtcggttttgagttttcagcaattgtttttattacgcttaaagaaggcgataaacaggcggttgagaagtttgaaaatgccgtgattgagattccgcaaattattcaagcgcagcgtttgtttggtgaacctgactatttactccatgttgtcgctaaagatttaccggcttttcagcgtttgtacgatgaaaaactatctgctattccaagtgtgcagcggctcatctcaaccattgtgatgaaagatgtggtacctgagcgcttatttccgattggctaa

SEQ ID NO: 2708 - DNA, 636 bp, Acinetobacter baumannii
ggaaaacgcatgttaaaaatcttagggcgtgataattctattaatgttcgcaaagtcttatggctatgtgacgaattaaatcttacatatgagagagaagattggggtataggcttccgctccgctcaatctcctgaatttttgcaattaaatcctaatggtcaaattccagtgattttagatggcgacttagtcctttggcagtcgaatagcattatacgttatctagcaaatgcttatgataaagaccatatactctacccaactcaagctaagcaaagagctattattgaccagtggattgattggcaagctatagaactgaataacagttggacttatgcatttatgtcgctcattcgacattcagcccttcatcaagatccgaatttgttacaacaaggtattgatcagtggaataaacaaatgcagattctcgatcaacaacttgcaaaaactcaagcctatgttgcaggtactgagtttaccctagccgatataccaattgggctgtctgtgcaacgctggaaagcaactccttttgaccatccagcgcttaaacatgtcgaccaatattttgaacgtttaaatcagcgtaaaggctttttaaaatggggtaataacggtcaaccttaa

SEQ ID NO: 2709 - DNA, 1104 bp, Acinetobacter baumannii
acaagcagcatgatgattattcgctacattgaacctagggatgttaatgacctttacctgttggcgcaaaaagcaggttttggtttgacatctttgcagccaaatatggaaaagttggctgcacgtattgaacgggcctgtaaaaccgtagcaggtgaacttccaaaagcagatcaggtttacttatttgttttagaagatactgaactcaacaaagttatcggggtttgcggaattgaagtcgcacttggtttaaaagagccttggtacaatttccatgtaggaacccaagttcatgcttcagaaccgttaagtgtttataacgctttacctactttgtatttgagtaatgaccatactaactgtagcgagctttgtactttatttttagatcctgactatcgcttaaataaaaatggcaaatttttatctaaagtccgttttttgtttctctctgcctttcgccaatattttgaagaaacgattgttgccgaaatgcgtggatattctgatgcaaatggacagtcaccattttggaatgcggtaggccataagttttttaatattgaatttactaaagctgattatttgagtggagtcgggcaaaaggcttttattgctgagctgatgccaagacatccactctatgtcgatatgttgccggacgatgctaaagctgcgattggcattgttcacccgaatactcgaccagcctacaatctcttgcttgaagaaggactgcgctacaaaggctatgtcgatatttttgatggtggtgcaacgctgcaagcagatattgaaaatttacgagcaattaaagaaagccagattttaactgtacaagttgtagagtctattcctcttagttcaggtgatgaaccctatattgtggccaacgataactatgaaaattatcgcgccattcttgtgtatagccagcctcatcagaacatgttgcagttaacaaaagaacaggcaaaccaattgaatgttgaaaatggctctttagttcgggtgctaagtgttcaagttaaacaaatttcgagtccagaagtggtcaataaactcaaagccactgaatatttgcgaatggctgttaattaa

SEQ ID NO: 2710 - DNA, 603 bp, Acinetobacter baumannii
gcttctttaatggatgatatcaatataaggattgcacatcgaatacgagagctgcgtttagcacgtggatatactttagatgtgttagctgcccgttgccaagttagccgttcagctatctctttaattgaaagaggtgaaacgagccctacggcagttgttcttgaaaaactagcaaatggtcttgaagtacctttaactcaaatttttacgaatgaagtggggaattcatcatctcaaccgcttattcgtcggaatgaacaagctgagtggcgagatccggaaactggctatatacgccgtacagtttcacctccgaacttaaaattaccctttcagatggttgaaattgaatttccgcctcattctcgaattacttatgaaactaatgaaagctctagagtggtacagcagcagctttgggtcgttgaagggaaaattgaaattcaattaggtgaaacttcttatgcattaggtcaaggggattgcttggcaatgcaattagatcaacctgtcatatacagtaatcattcagctcaagttgctcgttatattttagtcgtttctaatcaactggtgcccgctcttaaggaatctttatga

SEQ ID NO: 2711 - DNA, 213 bp, Acinetobacter baumannii
tgttctttaatatattttaaaatgagtttttgtatgactcggtcttttatagagggaatacagattaatcttaatgacccatctgacttttctagaaagctaggatgtagggatgtaggtgaatatgttttagtagccaagtcatttaaaacctcagctaaaattttttctttttttaaattgaattcattaaaagatagatcttctggatag

SEQ ID NO: 2712 - DNA, 549 bp, Acinetobacter baumannii
ggagtcttaatagtgcaagtttgttttaaaaaattattagaggaagttggtgaatgtaatgaaataatttatggtgaaggattccttattaatcaggttaattctgttaatgatgatctgtttaaaagctatttaagttgtattcctgaaaatgattttaatattgatctaggagggaatataaatgattttttaggaaaagattcgttagacaatattcaatatatgtttgaagatatattcgatggggaaagtgctacagtattcttaacacagcatgatgtaaatattgtatacataaatcataatagtggcgagataggagcatgtatttcaggcgatgaattacatatcattgctaaaaatttattttattttttttcgcaaattaatgttatacaaaatttaattattgacttatatgactctaaccctagaggtgaaaatggaggatataagacaggtttcttagaagaactaaagaaaacccttataaaagaaaatgtagtattggatgcagactattttatggaatttttttatggttaa

SEQ ID NO: 2713 - DNA, 789 bp, Acinetobacter baumannii
cccatgttaatgaataaaaagttcgttctaagcttgtgtgcagcaggtgcagtaacaatttctggttgtgccacaatggctgatatggcaggtgcagataccgcaaccttaaatgctcaatctgcgcaaagtttcaataaaatggtgcaggaagcgcgtggtaaaggtgctttagatacaagttcaagtacctataaccgtattaatgcggtttttaaccgtttaaaaccttatgcgaatcaaatgaatcagacaggccagccatttagttggcaattggctgtattgaagtcagatacgattaatgcttacgttgcacctggtggcaaggtagtgttttatacaggtattgtaaataaactgaacttgactgatgctgaaattgcagcagttatgggccatgaaatgactcacgccttggaagagcatgcaaaaagtaaaattggcgctcaagctttaactgatttagcgttaaatattggtttaagtcagattaatggtggtaatgtgagtcaactaggcgcggctgcggctcagttaggcacacaagtaggtgtgggtctgccatattctcgtagtttggaaagccgtgctgaccaaggtggtttaatgctaatggcgcgtgcaggttataatccaaatgcagcgattacgctttgggaaaaaatgaacaagcttgaaggcagtggatcatctttcttgtctactcacccatcaaacgctcaacgtattaatgacatgcgtaagaacttacctgcggcattagctatctataatggtcgtaagtaa

SEQ ID NO: 2714 - DNA, 1569 bp, Acinetobacter baumannii
atcaagttaataaacgtctattctgcatacaggaaattgcgattttttcgctcactgtttttaaggattttagagcagcctatgtttaattcgtcgtctaattcaaataaaaatgtacgcatcgccattattggtactggctttggtggtctaggacttgccattcgtctcaaacaagcaggttttgaacaatttaccctatttgaaaaagctgccgatgtaggtggtgtctggcgtgacaacacttatccgggcgctgcatgtgatgtaccgtcacatctttattctttttcttttgaacaggaacttggttggaaaaatcgctacgggacatctcaagagatttatcaatatttacgtcactgtgccgataaatatgatcttcgcccgcacatcaaatttaacactgaaatagccagcgccgaatttgatgctttgcaaggcgtatggcacatccaaagtacaactggtgaacagtttgaagctgaatttttagtgggtgctgtaggccaacttaaccgcccagcctatccaaaacttaaaggcattgaaaactttaagggtaaggcatttcactcagcgcgttgggaccatgactatgacttaactggtaaacgtgttgcagtcattggcacaggcgcaagcgcgattcagtttgtacctgaaattgcaaaacaagtggctcacctagacgtttatcaacgctcagcgccttatgttattccaaaaccggatcgggtttaccaacctttagagaaaaaagctttccgtaaactgccgatcttgcaaagtctagaccgtgccttgcaatatggtcatcatgaaattcgcctacttgcttttacaacttcacttaatgaaatgcctttggtggaatacatattccagcgccacattcgaaaagttgttaaagatgggaagttacgccatcgtttaatgccggactatccaattggttgtaaacgtattttaatctctaaccactggtatgaaacgctgacccaacctcatgttgatgtgattgatacaggtattcaggaaattactgaacatggcattttagacacggaaggaaagctgcgtgaagttgatgccattatttacggtacaggttttacagcgactgaatttatggcgccaatgcaaattactggacttgatgggcgtacattaaaagacacatggaaagatggtgctgaggcttatttaggcctaacagtaaacggatttcctaacttctttatgttatatggaccaaataccaacctcgggcataactcaatcgtctatatgattgaaagtcaggtgaattatattttagatgcactgcgcactactttgaaaaataacctgctgttcaccaacattcgtgccgaaattcaacacgagtttaatcaaaatattcaggaaaaaatgaaaaaaacggtgtgggcgcaaggctgtaccagttggtaccaaactgctgatggcaaaaataccaataactggccaggttttacccttgaatatcgccaacgcactcgtcgctttgacattgaaaactacactcaggtgtcggctatttcttaa

SEQ ID NO: 2715 - DNA, 1314 bp, Acinetobacter baumannii
aattacataatgaggagagaggcgatggacagccttacaatggataatgttgagcaattaacacttgcagagcttagagagctgcaaactaaacggttaaagcaaaccctgacttttgtatatgaaaatagtccggtctataagaaaaagttcgacgatgcaggtgtgcatcctgatgacttcgtgactttagacgatctggcgaagtttccatttaccaccaaacaggatttaagagacaactatccgtttgggatgtttgccgtaccgcaagagcaaattgtgcgtttacatgcatcatcgggtacaacgggtaaaccgacggtggtgggttatacccaaaaagatattaatacgtggtcggacattgttgcgcgttgcttacgcatggcaggtttaaccgcgaaagatatggttcaggtggcttatggctatggactgtttactggtggtctaggcgcacattatggtgccgagcgcttaggtgcaacggttattccaatgtctggcgggcaaactgaaaagcaagttcagcttattcaagactttaaaccgactgcaattatggttacgccatcgtattgcgtgagcattattgaaaagctcgagcaacaatttggtactgcacgtaatacgtctttaaaagtcggtatttttggtgccgagccgtggaccaacgaactgcgccgtgaaattgaagaacgtcttaatattaaagcgctcgatatttatggtttgtctgaggtaatggggccgggcgttgccatgcagtgtttaggtgagggcgagggattaactatttgggaagatcatttctacccagaaattattaaccctgaaacaggtgaagtctgtaaagatggcgaacttggcgagctagtctttacgaccattactaaagaaggcttaccgattattcgttaccgtacccgtgatttgacccgcttactaccgggtgaaaatctagcaatgcgcaaaatggataaaattgtgggccgcagtgacgacatgctaattattcgcggcgtgaacgttttcccgactcaaattgaagagcaaattttgcaagttccgcatttagttccaaattatgaaattttggtgactaaaaaaggccatatggatactttgcatattcgtacagagatgtgtcataactgtactatacaggccaatcaacttgctcaggagttgatgaaacgtattaaaaccatgattgggattagcgttactgtagaggttgtgacagaagcgaccttacctcgttcggaaggtaaggcaaagcgggtaatcgatatgcgtcagattgcttaa

SEQ ID NO: 2716 - DNA, 369 bp, Acinetobacter baumannii
tacttagtaattttaatgtcagttggtagtatattgcatgctgaagaatatgaatcaacggtctgtgaaaagcttaatattgcagcatatcaaatcatgttagaaagacagtctggtattaagtctcttgatttgcttgaaaagctacttattccattagctcaagataaggagaatgtaataacgaattcccgtatcaataatttttttggtcatgtaagtggtttggcttatgagactcctctatatacaaaagaagatgaaaaacaaaaagcagctacagattttggtttgagaattgaaagaatttgtacaaaggataagacggcattatttgctcctccgctatttcagacttttgaggaataa

SEQ ID NO: 2717 - DNA, 1047 bp, Acinetobacter baumannii
aagtttcaaatattttgtaggatacatgccatgtcaaaccacaatgttgcacttcaatttgaagatggtgttacacgttttattaacgtagctcaaggcgaaaccctatctgacgcagcctatcgccaaaaaattaatattcctttggattgccgtgatggtgcatgtggaacttgccgcgcattttgcgagtccggtagttatgacatgcctgaagaaagctatattgaagatgcgttaacaccagaagaagctgagcaaggttatattcttgcttgccaatgtcgcccaacttccgatgccgtattccagattcaagcctcatcagatgtctgcaaaacagaaattcatagcttccaaggtactttagcccgtgttgaaaacttatcagactcaaccatcacatttgatatccaacttgatgaaggacaaccagatattcatttccttgcaggtcagtatgtgaatgtgtcaattccagaaaccggcgaaacccgttcatattcatttagctcaaaaccgggcaaccgcttaacgggctttgtggtccgtaacgtaccaaatggcaaaatgagtgaattcttaagcaagaatgccaaaactggcgacaaaatgacttttaccggtccattcggtagcttctatttacgtaatgtagtacgtccagtgcttatgctggcaggcggtactggtattgccccatttatgtcgatgttacaagtgcttgaagaaaaaggttcagaacagcctattcgcttggtttttggtgtcaccaatgactttgatttggttgctctagaaaaactcaatgagttgcaggcgaaatttccatggttcgaatatcgaactgtagttgcaagccctgagagtaaccatgaacgcaaaggctatgtgactggtcatattgaaagtgaatggttaaacggtggcgacgtcgatgtttatctatgtggcccagtgccaatggtagaggcggtacgtagttggttagaaactgaaaatatcaaaccagctaatttcttgtttgaaaaattctctgcgaattaa

SEQ ID NO: 2718 - DNA, 504 bp, Acinetobacter baumannii
gccatgcaaatgattcgtcattgcatcgaccaatgttgggatgttctacaaacggtcagtgaccctgaaattccggttttatcggttgtcgatttaggcatgattcgcggtgtagagattaacgatcaacaagaaattattgttcggctaactccaacatatagcggttgcccggcaacagatatgctcaaagcacaaattgttgaggcatttaccgcagaagctttgacaccggtcaaagtcatggtcgatttatcagaagcatggaccacggactggatgtctgatgcgggtaaaaagaaactacaagtttatggcattgcaccacctgaagggttggcgcatcagtgtggaactcacgttcatttaaatgatggtgtcgagtgcccacgttgcaaaagccgacatacccgactgttaacagagtttagttccaccgcctgtaaagcactttataaatgtcaggactgtcttgagccttttgattacttcaaatgtatttaa

SEQ ID NO: 2719 - DNA, 1176 bp, Acinetobacter baumannii
atttcgcaaattggaagtcttatgaatcacgtacagtttgatttaattgttgtcggagccggtattttaggtttgtccgctgccatacaggcacaagaacaaggcttgaaagtttgtatcttcgagaaaaatgccaagcctgtgggcgcaactcaccgtaattttggcatggttggaacatcgactttaacccatccagagcaacagtggcgaaagtacgcgcttgaaacgcgttctttttatcaacgcattcaggctgaaaccgatatttcatttgagcaaagacaaggtgtatatctggcaaatacggcacttgaatggcaggttttaaatgagtttgccgagcgtgcaaataaatatcaaatacctgtgcatttacgaagtcatgatgagctggttacccaattttcttatttaaaccccgcgcagcagtttcaaggcggcttggtttttgaagaagattattcggttgaaccccatgtggttgggcagcgactattggcatatgcacaaagtcaaggtgtagagatttataccaatgcctgtgtcgttcaaacccaatatcagcaggaaagttgtcaagttcgtttggcaagtggcgaggcatatcgggcaaataaagttttgatctgtcacggtgaaatcatcgatgttttatatccagatctcttacaaagcttgaatctgaaacgttgtggtttgcaaatggccctgactcaacagtttcaccaaaaattaaatgcttctttttattcaggcttatccatttcacgttatccagcttttgaaatttgcccaagtcatgcagagctggttaaagcatcacaacagggtttcattaaagaattcggtattcatattctgattaaacaaaatgaatttggcgaactgatcgtaggagatagtcacgaatatcattctattaatgaagcgcctcagttcgagcaacgcgaagagattaatgagtttattcaaacgtactgccacgaaaaactagggctgactttacctccaattcaaaaacgttggaatggttattacctgacccatgaacatgagttggcctgtatcactgaagctgaaaaaaacatctttctggtaagtgcaattgctggtaaaggcatgactacaggggctggctttatgaaagaagtattggaacaaaatatttactag

SEQ ID NO: 2720 - DNA, 327 bp, Acinetobacter baumannii
gtatttaaaatgaataaaatgcatgtaactttggctgtagtggttggtttaattattggtggtgtagtcggtgcgataggttactctaaaacggccgcacgttatgatgcgatgaccaccgcatgtgtaatggtgaatcaggcagttgaacatgaaatcttgaagcctgaacaagtgaaagagttaggtgagctcacaggtcaaacccttaaaaaagattatgcttctgtggcatcaaagtttaagttttctgaaaatcaattaggtaatgcctctgaaggttctaattgtagccagtttattgttggtgtgaatgcagcacagtaa

SEQ ID NO: 2721 - DNA, 759 bp, Acinetobacter baumannii
agacttaaaataccgcatttgaatttcaatattgccaaggttatgtcgatcgatcagttagaaacgcaaattgcagaattggacaatttgcctgaacaccgtgaaattgtgacgtttatgcgtcgttcagccccactcaatacgtctcaacgcacggctttagaacaacatcgcgatttaattttggaatatcccgtgggtgacttacgtcagcactttgagcatccggagcgccctttaacagttgaaatcggtttcggtatgggccgttctttagtgcttatggctaaagcgaaccctgaacgcaactatgtgggtattgaagtccatgtaccaggcattgctcaatgtgtctatgaagcaggtatggcagagcttaaaaatttacgtgtactcgatgctgacgcaattcaagtactacgtgaaatgcctgacaacagtatcaactgcgtacaactttacttcccggacccttggcaaaagaaacgtcatttcaaacgccgcttcgttattcatgaacgtatgcaattggttgaacaaaaacttgagcttggtggcacattccacgctgcaacagactgggaaccgtatgctgagtggatgttagatgttttagacaaccgtccaaaccttgaaaacttggcgggtaaaggcaacagctatcctagaccagaatggcgcccagtaactaagtttgaacgccgtggcattgagtcaggtcataagattaatgactttatctttaagaagattaagtaa

SEQ ID NO: 2722 - DNA, 363 bp, Acinetobacter baumannii
cgtttaaaaatggcaaaaactcaaaataaatgtgaagttacggtaaatggaaaaacgtatccatgtcatatcagtatggctatggatttggtaggtggaaaatggaaatgcgtgattttgtattatctaaaagatggaccaaaacgttttaatgaaatcaatcaattaatgccaactatcacagaaatgaccttaagccttcaactcaaacaattagagcaaagtggcttaatatctcgaaccgtttatggtgaaaaagcaccgattaaggtggtgtatgaaatgaccgaattaggtcagtcttttaagcctgtattagagtctttatcggtatgggcacatacgatgattaatcagtcataa

SEQ ID NO: 2723 - DNA, 474 bp, Acinetobacter baumannii
ggatcaaaaatggcgcttaacttatcaaaaattaaagcagaagcaagtgaagataaaaaattggaggaaataactgctgaaaatcacaagaaaattactgacggagtagctaaacatagaaaggatttaaaagagtggtttatttctcttttcccaggggaaaatattgaatctgattatgtcgaaacatcagttttatttgatggcgattggaaagttactttagctctacaattaatgactaaagcacccgaaggcaatctagttcaagttaataccaaagcaaattttatgtttaaaaagactaaaaatgagcgaataatagcttcagccgcttttattgatgaaactgattatttaaatttagagccagaaagtaaggattacaaatatagctataccgttcaagatcaaacaaagtatttcacttttgctgaattagagcagttcgtccaatatgtaattgataaataa

SEQ ID NO: 2724 - DNA, 441 bp, Acinetobacter baumannii
tttcgaaaaatgagtactgaatctgcttctggaacaccctcacaaccatcactgttcgtgttagttaaacaaattctcattttggctggattttggtggattggatatctcttacaccaaaaactcggtgtacctgtctcggcaggtattttaggtatgtttttattgcttttatgcctgttctttaaaattatcaaaatggatcaggtagcaatgggagcaactgtggttttaggtgagctattactattttttgtgcctgtagtcgttgccgttgtccagtataaaaccctgtttatgaccgaaggatggcaaatcgtcttaagcattggggttggaaccattttagtcatgttaagcacttcactgactattcattattacaatcgtttgaaggcttacttacaggctagaaaacgtcttcaacataagcatatctaa

SEQ ID NO: 2725 - DNA, 420 bp, Acinetobacter baumannii
aaaggaaaaatcatggcttattcagcttcttgtctttgtaatgggattcaactccgtattaatgccgaattagaatccatcatggtttgtcactgtaagcaatgccaaaaagcacaaggggctgcttttgcggccatcactcaagtacaaaaaagcgatttagagatggtacagggtgaaaatcttttgcaagcgtattttgcatcgccaaataaaaagagagtgttctgtaaaacctgcggttcacctgtctggagtgaacgtttagataaacctgatgtggtgcgtttaagggtagggctcatcaatgaagaaatatccacgccagtcatctctcatgcatttgtcaattcacaagtgaagtggtatccaatttgtgatacggctcgccagtacccaaatggcgtcgaaaacccttga

SEQ ID NO: 2726 - DNA, 777 bp, Acinetobacter baumannii
aggtgtgtttttcaggtatctccttctgtgcaacgcactccaaccctatttcaagcaggtgcttcacctaaaggtatgcagtttgcaacacgtcatgctgaatgtgtatttattggcggtgacaaacccgaaaaaattcgcgaacaagtgaaaaagattcgtactcttgccgaacagcaaggacgctcagcgaacgatattaaagtgtttgtcggcataactgttgttgtggccgaaacacatgatctggctgtacaaaaacttaatgaatatcgtcagtatgcgagccctgaagcaggcttagcgcattatgcgagttcaacaggcattgacttaagtaagtttgctgacgatgaagcgattccttaccaaaaaagtaacagcattgtttcgattaccgaaaagtttaaagaacagcaaatcacaaaaaatgacttaaaagctcagcatgttttaggtggtcgttatccccttattgtgggtagtggcgaagaggttgctgaatacttaattcatcttttagatgagactgatattgatggctttaatttgacacgtaccgttgcccctgagtctcaccatgactttatacgcttggtcattccagagctacaacaacgtggtcgctataaaactgcatataaaacgggttcactacggaacaaaatttttaatcggggtgatcacttaccagaacagcaccctgttcaagcgttccgatgtagtccctataacaacagcaaaaacttaacaaaaattgaagaaataaccgcttaa

SEQ ID NO: 2727 - DNA, 816 bp, Acinetobacter baumannii
ggaaagaaaatcatgaatgcttattatcaattactgaatagaacaattggtcctcaaggtgaagtgattgctcattattgctcaactgttcatgcgcaaggtgcttggaaccctcatgaacagcatatggcgcctgcaagtggcgtgatcgcagtagagttagaacaattttcaccgcgacaagatatgcgaattggccgaattagttttgatatttttggattaattgcatttggtgaatttacgattaagacccatgtgattcgtgctggtaaaaccattgaattgattgaagcagaactacaagcgcaaggtaaaacttgtattgtggctagagcatggcgcatgtgtactcaagacagttccgagattgcggggcttgaagatcaaccaattcatcatcccgatacctttactgaatggtcgggcatgaaaagatggccgggtggttttatccagaccctcgtcactaaaactaatgatcagcatcgcgcgggcaaaggcattgtttggctaaacaatgacaaagaaatggttgaagggcagccgaccacagattttgcacatttaattggcatggtagatgcggcaaacggcattgtcccaagacaagaaggagaatttacttggggcttcccaaatcttgatttacaaatccacatgcaccgttatccgcaagggaaatggctaggtttggaaaccgttcagcaatatggttcggatggcattggtttaaccagtgcagttttacatgatgtgtatggtccatttggacgaagcgagcagattttgactttacgtaaaatgactaaataa

SEQ ID NO: 2728 - DNA, 1215 bp, Acinetobacter baumannii
gcaattgaaataaaaaaggaagctcaaacttcggtttgggccttagcctcacttttgcctaaaaaaaggttcaacatgccacacgatacagaatttgaactatttcgggacagctatcgcaggttcttaaaagaacaggttgctccatattacgaacagtgggagcacgatggtcttatcccacgtgaactatggcttcgtcttggggaaaatggctttttgtgcgtcgatgtgcccgaagaatatggcggctatggtgctcctgtgcactactcactcatgctggttcaagaaactgctcaagctggctttgcatctttagctgttgccattggtgggcaaaatgagctggtttccccttatctgcaaaatattggaaccgaagagcaaaaacgttattggttacccaaaatggtcacaggtgaagtcgtgactgcaattgccatgacagaggccaatgcgggttcagacttacaggctatacgcactcaagccattttagaaaatgatcattatcgtattaatggttcaaaaacgtttatttcaaatggtttgcatgccgacctgatcgttctggtggcaaaaactgaccctcaagctaaagcaaaaggcatttcgatttttttagttgatgctgctttagacggcgttaaaaaaggccgttcattacaaaaaatcgggctacatgctcaagatacagccgaactattttttgatgatgtctgtgtgcctgcaactcagcgtttgggggaagaaggacaaggttttgcttatttaatgcaagagttacctcgcgaacgtttgagtatttccatgatggctttggggtcaattttaggcgctatcgaactgaccaaagactatgtattagagcgtaaagctttcggacaacctttaagccaaatgcaaaacacgcgctttgttctcgcaaacgcgcaaatcaaagccaaagccacccaagcttttgtagaccgatgtgcggcgctttatcaacaacaccagttaagcgtgactcaagttgccgcactgaaatgctttattaccgatgtccaatgtgaagtgattgaccaattacttcagctttttggtggctacggttacatgcaggaatacccgatttcacgcttttttgtggatgcgcgggtacaaaaaatttatgggggaaccaatgaaattatgaaagaaatcgtcgcccgagaactgctcggaaaataa

SEQ ID NO: 2729 - DNA, 594 bp, Acinetobacter baumannii
tggaaagaaatggctcaggaaaaaccaacttctattcgagttttgcaatcgaataaaaaaaagtcgagatcacccgtaatctatatcatcattggtattattgcaggtgtttttgtaagtatctcgctgttcctgttcttgtctcaaccgtattcatccgaccctacaagtgttgagagcaaatcgaatcaagatcaggagcttgaccaagtcttgatgactaattcttctgcagatgaccaagcagtaagtgatcagcaagagcaaactgatccgatgagccatgatggttttgagcaacctaaagagaatgagttaagtaacatttttaagcctgctcctcataaagaggccgcacctaacccacaacgtgtttcaccttttgatgcacagttaacaggtgaacaggttgtacctaaacctgtacagccaaaactacaggtagttcagcaaaaaccggctacccagacgaaagtggttcaagccaaacccgctgaggtaaataaagctccggttgaacaagaggctgatgtggaaccacctaaagcttcggttgatattaagattacacgaagtccatttgctgtgaattag

SEQ ID NO: 2730 - DNA, 1347 bp, Acinetobacter baumannii
ttagaggaaattatggctgaaactaaaaagcccgatgcaattggcgatgcaggggcatacacaaactttgtctcaaatattggtaccagccgtgataaggcttcacatggtcattttgttcaaaaggaaattcctgatgatcaactggaagctgtatatcaacactggttggccaaacgtattgtgaaccgtccagcaagtgacatgttgcgggctggttggttttatgagggaattcaagatagagacctaatcaaactagaagaggcgtgtaaggcttttcaactgaaccagatacttttatcaagcttgatcttatcgcgtctatatggcgtggtttatgtgctgttagggaccgtagatggcggtaatttggagcagccatttgatttaaagaaattaggagtaggtcgtttagagttctttacggtactcaagaaaaagtacattaagccagataccacgacgtatttatcacctaaggtctgtggcggtttattaaagcaacctgagttctataaactacaaatggatggcaaggcaccccaacgtattcaccatagccgtttaatcaaattctgccatgccgatgtagtgaatgaagagccgcaaagtattcttcaggaagtatatgaagatctgctagaccatgccgccgttaaaaagggttcagccagtcttgtccatgaatcaaaaattgatgtgattaaaacacctggtctagtggacaaaatcaaagaggatatgaaagccgtagcagaacgttttcttagtgtcggattgcttaaaggtttaaacggcatgatcgtgctggatgctgaagaagattacgactccaagacttataactttgctggcttaccggacatgatgcgggaattctcaattcaaactgcgggtgctgctgatattccatacaccatcctattcggtcaatcacctgcaggtatgaatgctacaggtgagcacgacacacggaactattacgacagcatagcgactaagcaaacatggatgcttaaacctttcatgatgcagattttagatgtcatttgccagactacattcggccgcgtgttcccaaatctggatattgtctttaatccattatggcagttggatgcgaaggtccgttcagaggttgagaaagctaattcagaacgagatgccaagtatttagagatgggcattattacagaaccacagatagcacggcagttactcattgacggcgtttattcagtgattgatgaagctcatatcaaagagctagaaataatggtgaagttaaatgtcggcgatcattcagatgctgaaacctcacctccagcaggcgaagaagagtaa

SEQ ID NO: 2731 - DNA, 864 bp, Acinetobacter baumannii
tttgtccgaatagcggacagaaacaaccaaaataacaggaatgaaaggatgccttctcacgatgcttttctagagcacccgaactcgcatgagaaaattcgtcaagatgactacattgcaggattagcaaaaggcttggctttattggaagcttttggaacagatcggcaacggcttaatgtcactcaagtggctgagcgaaccggtattagtcgtacagcggcaaggcgttacctaaaaactttaaaatacttaggctatttagaaaccgatgaacattacttttggctcactcatcgcgtgctgcgcttttcgagttcttatctaagctctgcccacctgcctaaagttgctcaatcatttttaaatcttttgtgcgcgcagacgtcgctgactttttcgattgtggtgttagacgataacgaagtggtgccgattgcccgtagttatttaccacaacaagataatttacgcgttagcccttatggcatgcatttaggaaaccgactccctgcccatgcaacttccacgggtaaagttttacttgctgcactacctgaagaagcccaacatacgtgggtaaaaaattacggtttaaaacgcttaaccccatttactatagtagatgagtcaaagttttttgaagtgcttaagggtatttcgttatcggattattgtctttctaaagaagaacatgagcttggcgtaattgcgattgcagtgcccgtatttaacgcccaaggtcaagcggtggcagcacttaactgcatgtctcaaaccaaccgagtacaagaagattatttggttcagcaaattttgccattgctacgcaacacagcaaatgaactcaggaatgtaatttaa

SEQ ID NO: 2732 - DNA, 1230 bp, Acinetobacter baumannii
agaaagcgaatgaaaattctaccttcatctgaatatgatcaaattctaaaatacagtgtctactggcttgtcatttcgattgtgattggagtcgttgcagggttggcatcgaccttaatttttgtggcttttgatatttcaaataaagtgagaagcctgcatcactggcttatttatttcttgccttttgtgggttttggtatcggttatctcattaaaaaatatggttcgcccattgaacgcggaactcatttactcatagatgaaattcaccaacccaagtcgtttattccaaaacgaatgagccccatcatttttatcacctcaattttaacgcagttatttggtggttcggcagggcgtgaggcgccagcagttcagctttcaggtgctttaattgaccacctgagccatatattaaaaatctcggaagataaccgaaaaatctgtttaatcgccagtattggtgcaggctttgcgggggtgtttggcttgcctctagcgggtgcaatctatggtttagaaaatgctgctttaggtaatttaagatactcagccatttttccatgttttgtgtcggcgctgattgcttcggccatacctgagctattcgaaattgttcatcctcatgttttttatgtaattagcgagtttccagccattcattttggaacgctcatgagcctgattgcggcagggttgatctttggtttagttgcgcgtttctttattgcagccatccattttgcgagtgacgttttttataaatacgttcggtatttgcctttaagaacgatggcgggcggtattgtcattatgctacttactttgttcactgcgcatcagcaatacaatggtttgggtacagataaaatcatttcatctttttatgtgccgattgagttttacgacttttttaacaagaccatttttactgccattactttaggttcgggttttaaaggtggtgaaattacaccactcttttatgtgggtgcgacattaggtaatgctttaggggcggttttaaacctgcctatttcattgcttgcaggcttagggttggtcagtcttttttcaggcgcgagtaaggcaccgttaacatctattattttagctgttgagctatttggaatgaatgttgccacttacgccattattacctgtttgttggcagcgctattttctgggaattgtgggttgtatcgccgtaaaaagttgatggattag

SEQ ID NO: 2733 - DNA, 708 bp, Acinetobacter baumannii
ataaacagaattgcctttaggaggagagtattcatgttgatccatgccgatttttcacaggctgtgattgtcaaacctgaagactatcactgggtgaaatctccccgtggggaagttgatcgtgtcatgctcgatcgtattggcgatgaaatagctcgtgcaaccagtttggtgaaatatgcgccccatacaaccttccctgaacatcggcatcatcatggtgaagaaatcctcgtactttcaggcgtatttactgaaaatcaaaatctgcactactccgctggatggtatttacggagtccccatcagtcagtacaccaaccatcgagtgaagaaggtacattgatttttgtcaaacttatgcaaattcctatgtcagaaactcaagctttacgaatcaataccaacgacccagcacaatggcaaaaaatagatacgcgtttaatttgcacattaattgatgcaagttatgaacacacttatttagaaaaactcaagccgcagcaactttttattgaagaagctgagggtggaatcgaaattttgattacccaaggtcagttggttgataaagaaatggtttttgacgctggaacatggatacgcctacctccaaaaacacttgcctattttcaagctggtttgtctggcgcttctctttatgtaaaaactggacacctagcctcagccattgcggaatataattaa

SEQ ID NO: 2734 - DNA, 1896 bp, Acinetobacter baumannii
ttcacaagaatggagttcagaatgaccgaaataaacctcatactcataaacggtaaaatcacaacactagatcctcagaaccctgaagtacaagcaattgcgattgcagacggtaaagtcgtacgcacgggtacaaatgatgaggttatgaaactcgcaacaccaacaagcaaagttgtagacttaaatggccgtcgcgttataccaggactaaatgacagtcatctgcatattattcgtggtggcctaaattacaatatggaattgcgctgggaaggtgtgccatccgttgcagatgcactacgcttactcaaagaacaagcagataatacgcctgctccacaatgggtccgtgtagtaggcggttggactgagttccagtttgccgaaaagcgtttaccgactttagaagaaattaataaagctgcgccagatactccggtattcgttttacatttatatgccagtgccatgctcaaccgagctgcccttgatgtattaggctttaataaagacacgccagaccaaccgggtggcaagattgtaagagatgaaaagggtgagccaacaggtctgttgctcgcaactccatccgctatgattttatattcgaccttaggtaaagcgccgaaattgccagttgaagatcaagtcaattcgactcgtcatttcatgcgtgaattaaaccgattaggtattacttcagcaattgatgcaggtggtggaggtcaaaactaccctgaagattatgatgtgattaagcaattacatgatcaaaatcaaatgactgtgcgaattgcttataacctatttgctcaaaaggcaggccaagagcttgatgattatcgtcgctggacagaaatgacatttccgggtgatggggatgaattatttagaatgaatggagcaggtgagaacctgacttggtcagcgggtgactttgaagatttctatgagccacgtccggatttaccagaaaaaatggaaggtgaactcgaagctattgtagagcacttggctgaaaagaaatggccattccgtatccatgcaacttatgatgaaagtattagtcggttactcaatgtatttgagcgcgtcaattcaaaacagccatttgcgacacgatttattattgaccatgccgaaactgtatctgagcgtaatatcgaacgtattggtgcgttgggtggtggtatcgcgattcagcatcgtatggcatatcaaggtgagattttcgtaaaacgctatggtgccgaggctgctcaagcaacgccaccagttaagaaaatgttagaacttggtgttcctgtgggtgcgggaacagatgcgactcgtgttgcatcctataacccttgggtgtgtttgtattggctaagtactggtaaaacagtcggtggtttgccactctatgatgaaaaaaatctgttagatcgccaaacagcactcaaactctggactaaaggttcggcttggttctcaggtgaaaaagatattaaaggatcactcacagcaggggaacttgctgacttggttgtgctgtcagatgactacttcaaagttgaagcagaagatatccagtggattgagtctgtactcactgttttaggcggaaaagtggtatatgcaggtgcagagtttaagcaagatgatccgccgctaccaccagcatctccaacatggtcgccagtaaaacgcttcggtggtcagtggcgcttatctgaaaaccgtaatgcaccatcgaatcaatcattacagtcacaaagtgcattgtgtgcatgtgctagtagctgtggaatgcatggacacagccacgcttggatgcttgatgttcctgtaaatgataaggacaaaaaatctttctggggcgcacttgggtgctcgtgttttgcattttaa

SEQ ID NO: 2735 - DNA, 735 bp, Acinetobacter baumannii
gaatatggaattttaggagttataggaatgacccaacatttagatgtagaagagcttcaaaatttgttaaagacggtggttgacgaaacaacctctattacggaaacactcgcaagtaaagcaagtaaaattctgtcaaaacatgctgctgaaaaaaatgcagatattaagctttcaacttcagaacgcgctgctttgcagaaagaaattaaaaaagcactctctcagagccattatagtcaaggtacgggttttgcaagttatagtccggcaactcaagatgaacaagactattggacgctagaatggtggtataaaaaagaagatcaattacaacaagcgaaacttgaaaactaccaaaatgcgcagcgctttttagatttccgctcatttgagtggttccataaacctgcacaaaataaaagtccatgcatacatggtccttatgtggattatatttgcaatggtgcctataccattaccattgctcaccctgtcatgattcatgaccattttatcggtgtcattgcgaccgatattttagtttcggcccttgaaaaactacttatgccaaaactcaaaaacattaagcaaaaggcggtcattatgaatgattcatctcgagtcattacttcaaatgacattagcatcagaaccgggacattatttaaagataaaactgatcaacagtttttctcgcaaccctgtcagtctttccagttggttgtcatctaa

SEQ ID NO: 2736 - DNA, 348 bp, Acinetobacter baumannii
gcttgtggaatttcagcctgctcaggaggaagttgcatgaatgagtttgtcaaaatcgtggaggtcggtcccagagacggcctccaaaatgaaaagcaggctttaactgtcgaacaacgcttaaactttattaatgacctaatcagtgcaggcctaaaatccattgaagtcggctcatgcgtttcggcaaaatgggtaccacaaatggctcaaagtgacgagctatttatgcttttaccccaaacaaccgatgtgcaatttagcctgcttactccaaatattaaaggttttgaaactgctcaagccggtaggatgcaaagaggttgcggtttttaccgcagtttctga

SEQ ID NO: 2737 - DNA, 609 bp, Acinetobacter baumannii
ttttctacctttttagacaaactcatattagaattctgcaaccttattgtctcccacatctctatgaaaaagtttttaggcaattctatcttcaaagcagttggttggacctatgatgcagatcctacaattcttgagaaaaaacaagttattatcggttttgaacatacttctaaccttgatgcgatcttatcaatcgctttgtttcaaatattagatttaaaaattcatacactaataaaaaaagaacttttcaaaggtccaatgaagcctatccttgaaaagctaggtggcattcccgttgaccgaaaagcaagcaaagatatcgtctctcaaatggttgaaaaattccaaagtagcgatacattcaatctagtgattgcacctgaagcaacgcgtgccaaagatggatcggaacgcaaacctattcgtaccggtttttggcatattgctaaagcagcaaatgttccaattgtactgatgtatgcaaatgcaagaaccaaaaaaggcggtattttaggtaagatttatcctaccgatttgcagaaagatcttgaaacgattaaagaactttatgcgcaatatgatattgatgtgaaaattaactag

SEQ ID NO: 2738 - DNA, 369 bp, Acinetobacter baumannii
aacaatttgatgaggtcgaagcttaatatgaacctagaaattattttggtcggcattattgtgggtattgctaattttgcttcacgcttcggaccatttttcgtaatacaaaaactacagggcaaccaacaaagacgtggctcaatctggttaaaaatcgctttaggaagtattggtatatctgcaattagcgccatgcttgtggttgcaacacttccacctttacttgaaaccccaaataagagtttagcaatgcttatcggttttttagttttagcaggtctttattttaaatttaagaaaatcgtaccagcaactttaactgccgcaatcgtttatggccttatctatacttatttacctttataa

SEQ ID NO: 2739 - DNA, 1197 bp, Acinetobacter baumannii
accagattgatgtatattgaaatgaacgcgaaagaaatgagtaccattatgaacatgcaaccccaactcgatatggatttagagaacaagtatttgcttcttactccaggaccattatcaacatcggcaacagtacgccgtgccatgcaaaaagactggtgtacttgggaccaagaatacaactcgctggtacaagatattcgtaatcgactggtaaagttggcaaccagcgaacctgaaaaatatacggctgtgttaatgcaaggcagtggaagttttgctgtggagtctgtgcttgggtcagctattccacgtgatggcaaaatcttgatcattaataacggcgcatatggtgcacgtatggtgcaaatggcgtgttgcttaaatattgaagttgtagaactgaactatttagaaacccaaacaccagatttacaagagattgagcgcgttttagaagataaaaccattagccatgttgcttgtgtgcactgtgaaaccaccacaggtattttaaatccgattcaagagataggccgttcagttaaagcagcaggaaaaatctggattgtggatgccatgagttcatttggtggtgtgcctatggatattgccgagcttgaaattgattttctgatttcaagtgcaaataaatgcattcaaggtgttccgggctttggttttattttggcaaagcgtgattgtctagaagcatgtaaaggtttggcacgttcggttagcctcgatttgtatgatcagtggaataccatggagcagcataacggcaaatggcgttttacctcgccaacccatgtggtacgtgcattttatcaagcattgcttgagcttgaagccgaaggtggagttgctgcacgttatcaacgttatttacaaaaccaacaaaccttatctaaaggtatgcaacaacttggctttgaattggtactcggtaaagagtgcccacaatcacccatcattaccacttttctttacccaacagccgaaacatttagcttccagtcattttatgaaaccctgaaaaaatcaggctatgtgatttatccgggcaaagtcactgaccttaactgcttccgtattggcaatattggagaagtttatattcatgacattgaagggcttcttgctgcaattgcgagctactgcgaaagccatctaaatcaagctgtaacagtataa

SEQ ID NO: 2740 - DNA, 522 bp, Acinetobacter baumannii
ctgatgaccttattattcaaaatcaaattgattcacaaaatttgtaattcagtaaaaaatgaattattttttaccaatctgataattgacaattacattatggacaatattgatcaaattattttaggtttacttaaagataacgcacggatgtctgtaaccgagttagccgaaaaagttcacgtctcaagagcaacgattaaaaagagaatggaatatcttgaatcttcgggcattattaccggatatacggttcgttttaaaccaaatgcggaacggaatgtcatccgtgcatggatgagcattatggtcgaaggcaccaaagcacagtctgtgattaaagaactacgcctagaaagtgcggttgaatgtctgcataaaaccaacggtaaatgggatattctggttgagctacgttccgacactttagaaaacttcgataaagtattagaaagaattagaaatatttcaggtatttataacagtgagaccagtattttacttgctagccataagacctaa

SEQ ID NO: 2741 - DNA, 669 bp, Acinetobacter baumannii
atagtcctgatatttacagcgaggtttttagccatgtatatccctgatgattttgcagaaaaccgtttggatgtattgcattctcttattgcagaacatccatttggggtgctttttacgcatggaagtaatggcttagatgcaaatcatcttccattcgagttacaagcaaatgaagggaaatttggcatactacatgcccatgtgtcacgaaataattctgtttggcaggacattaaaaatggagatgaggtattggtcgtttttcaagcaggcgatgcgtatatttcaccaaactggtacccatccaaacatgaacagcacagacaagtacccacatggaactatagggttgtgcatgcttatggcaaagtgaccattcgagatgatgaacgttatgttcgtggtgtagtggctcgtttaacccgtactcatgaagcatctcaacctgaaccatggaaaatgtccgatgcaccaaaggattatcttgaaccgatgttaaaagccattgtaggtattgagattgaaattaccaagctgcaaggaaaatcaaaacttgggcaaaacaaagaacgccgagacattttaggcgcggcagatggcctatcgaaatctggtcatcaaactatagcgaatgccatgtacagtgtggctgagttaaataaataa

SEQ ID NO: 2742 - DNA, 744 bp, Acinetobacter baumannii
atgccaatgatagacatccaacatatctctaaatggtatggtgattttcaggttttaacagattgcacgacgagtattgaaaaaggtgatgtcgttgttgtttgtgggccatccggttcaggcaaatcaacgctcatcaaaactgtaaatgctttagagccgtttcagcaaggcgacattattgttgatggggtttcactaaaagatccgaaaactgatcttgcaaagttccgttctcgggtaggaatggtattccagcattttgaactttttcctcacatgactgttttggaaaatttaaccattgcccaagtaaaagttttaaaacgttcagttgctgaagcgcgtgaaaaaggtcttaaatatttagaacgtgtaggtctgcttgcccataaggataaatttccagggcaactttctggtggtcagcaacagcgtgttgctattgcccgtggcttatcaatggacccaatctgtatgttgtttgatgaacctacttcggcactcgacccagaaatggtaggcgaggttcttgaagtgatggtgcaacttgctcatgaaggtatgaccatgatgtgtgtgacacatgaaatgggctttgcaaaacgcgtatctaaccgtttaatttttatggatgaaggtaaaattcttgaagattgcccaacccatgaattctttgataatttagaggcacgtcatgagcgcgctaaaattttcttggaaaaaattcaggcaatgcactaa

SEQ ID NO: 2743 - DNA, 957 bp, Acinetobacter baumannii
gtcatgatgatttttctaattttcttttgttttgcttgtcttgctatagggctagcatttttgatgtcttatgagttaagaaataagggtagaacatttgttctatctttattacctcaggggcgtcggcagctaaaccaagttagacaatttgctcaaacaatgaatcaggctgcggctcctgaaaaactacaatcacattggcatttacagcaatggtggattgtaattgcaggattttttttatttgccagtattttaatttttgcttttactcgcccaatcagttcaacacgaattgaagccgagtatcttaaaaaaactgatccgcaaatttatgcattattaaatggagaaatattatcgcccccacctgaagtagatgaaagcctgattgaagctgcaattgttgaagcaactcagttagagcagcaatatgcttctcaagaaagtggtgttataaattcttcaccaattgataatactagttttgatggccgtgcgattttagatacgagtttagtcaaccgtaagtgggataaaatgaacccacgctataagcagcgtttgcttatggtctttaaaattatgaaagaacaatatggttatgaacttgttttgcttgaaggttatcgtagtccagcacgtcaaaatatgttggcgggcaatccgaatacaaccagagcaaaagggtatcaaagttatcatcaatttggtttagcggcagatgtggcctttaagcgaaacggtaaagttgttatttctgaacgtgacccatgggctatgcagggttaccgcctatatgggcaagttgctgagtccgtcgggcttacttggggtggtcgctggaaatctatacaagattatggccatacagaatatagaatgccaggcttgaagaaaactcaagaaatggcggaaaagctgattgccgaaagcttaaatgacatcagttaa

SEQ ID NO: 2744 - DNA, 1419 bp, Acinetobacter baumannii
ccaatgtcgataaaccctatagaactgcttaaagaaaaagtatcttcaacaatattaaataatcaggatggatacctcggcgaaaaaacaaacgctttatctaagttttatccaattctactttcattattagctgctaaacctgatcttgtaggacaattgaaaaacagtttggctccgtcattatccgatcttttttctcataatgagcaaattaagaatactgtgcttacccatttaagcggtacagcaccaaataatgaaatcgaaaatactctcaatagcgcattaaaaccgagccttaatgcaatttctgacgttgccggaaatgatcaacaaagtattgtgaactatttacgtcagcatgctgaaacgatccgttcatatttaccaggatgggccgtgggcttattagctccattaggtattggggctggtttatcttctgtaacatcatcgacagcaccgccacttgcagcagcaacagagactacgggcaaatctcgtggttttttacccattattgcgctcattattctcgggttattaattgcttggttgtggcgctcttgccagcataaagaagctacacctgcaccagaaactaaagctgcaagcggtgtagaggccgcggctactccagctactttaactttaagcaccgatgataaaggtgccgtgagccagtgtcaggctggaattggcgatcaaggtttcttggcgactttacaaactcaaattaaacaagtcttttcagctactaaagattgtgatgttgatacaagtcaaacttatgcggctgcttttaccgataaggatgctttggcaggtgtgttgggtgcattaaaaggtattccaaacgcttctttagaatgggtgggtgacaagattacattgaaagcaggtgatgctgcagcgttagaagcgttaactgctaaagtaaaagcacttgttccacatactgaagttgttgccgcagcgccagaaacagctgaacaatctgtaagcaacagtttaagtgcttcacaaacagccttaactgcaattgacccgaacaatgtagatgtaaacgcactagttaaagcacttaatttacaaattattaactttgcgagtggctcaagtgacattcctgcagataacaaagctattcttgatcaagcagcaactcttttaaataaagtgtctggtgttaagttaaatgtaggcggtcacaccgactcaacagggaatgccgctgctaataaagcgctttctcaacgacgtgctcaagcagtagtagattatttagtttctaaaggagtagatgcttctaaactggttgctaaaggccatggttcagaacagccagttgcagacaatacgaccgaagaaggacgctttaaaaaccgtcgtattgagttttcagtagctcaataa

SEQ ID NO: 2745 - DNA, 813 bp, Acinetobacter baumannii
atgtcggcgatcattcagatgctgaaacctcacctccagcaggcgaagaagagtaagaaaggccgtaaggcttccaaacctagacccgtaaaagtaaatcgccgtgtagagctttattacacacggcaattactggctatttcaaaatattgtcaggaaaaaacaaaggaattagttattcctacggttggccagaatattggtgatgcttggttttccgacatgatgacttcgtttcgagagaagctgacaaagtatgttgttgagatttctaggcctctagctacaaaggttgtgactgacacacaaaaggaagtggacaaacaaattgcagagcacaccaaaacgattattggtgtggatctcacgccgttctatcgtgctgcagatattcaggacgaagtagatctcaacataacttcaaacgttagtttgattaagtctattcctcagcaatatgcagacaagttagagaacttggtaacgaatgctttgcagactggacaaactaatgaagatctcgctaaagagattaaggcattagggcagtctacagattttcgtgcacggcttattgctagtgaccagatgggcaagatcaatggacagatcaacaaagccagacagctttcaatgggtgttgagacatatacatggcaaacggctaaagatgagcgtgtacgtccagatcatcaacataagcaaggtcaaacctttagatgggattcaccaccagctggcgggcatcctggtcagcctattcgttgtcgttgcactgccttacctaattatgaggatattttgatcacttaa

SEQ ID NO: 2746 - DNA, 1686 bp, Acinetobacter baumannii
acaggagccttcatcatgacaataaacaattatgactatgattacctgattattggttcaggctttggtggtagtgtttctgcttgccgtttaaccgaaaaaggctactcggttgccgtaatggaaatggggcgacgctggaaagctgaagattttgctaaaaacaactggaatacccgccgttggatttggcgtccgggcatgaaacttttcggttatttcaacatgcgtttttttcgccatgtcaccattatttgcggtaatgccgtaggtggcggttcaattacctatgccaataccctactggttccacctgaacatatttgggatgaaggcacgtgggcagatgcggcggactggaaaaatgaaatgcctcagcactatgctgaagcagaacgtatgcttggcgtgactgataataaaattttcggccctgccgaccacatgctaaagaaaatgggtgaagcagtcggtgtcggccatacatttaaacctactcgtgttgccactttctttccaccggaaggtgaagaaggtgggaagacctaccccgacccttattttaacggcgaaggtccagaccgtggcacctgtaccgcatgtggcggttgtatgacgggttgtaaacacaacgcaaaaaatactttagataaaaactatttgtactttgccgaaaaaaatggtgccaaggtttatgaagaaaccaaagtagttgatgttaaaccgctcaatggtaaagccgatggcagtgatggttatgaagtcacgactgaatgttcaagctcatggtttaacaaacaacgtcgtacttggcgagttcgtaatgtaattttctctgcatcttctttaggcacacaagagatgttgttccgtttaaaacagtctggttctttgccaaatatttctgatgatttgggtaatcgagttcgtaccaatgccgagtcgattttaggtgttcgcttttttggtaaagacgtcgacatgagtaaaggtgttgctattggttcaagtatttacattgaccatgacactcatattgaagcgactcgctaccaaagtggttcagatgccatgggccttatgtgtacttacatggctaaaggcaaaccgggttggacacgtattttcttttggttatgggcactcatttgccatccatttattttccttcgcatgagtaatcctgtcagttttgcacgtcaaaccttaattttcttagtgatgcaaactgcagatgcctcaatcaacatgcgcttgaaacgtaactggttctggccttttggcaaggtgttatcgagcgaaggtaaaaagctacctgtttatattccgcaggccaatgcatttaccgaaaaagttgccaaaatgtttaatggccaccccatgacgaccattaccgaaattttgtttaatgtaccttttacagctcactgtatgggtggttgtgcaattgcttcaagtccagagcgtggggtggtagatggacaaaatcgggtgtttaactataaaaacttatacgttgtagatggttcaatgttaggtgcaaatttgggcgttaacccaagtctcaccattacagctctggcagaacgtgcaatgtcttatattccggctaaacatactttagaagaacaagcttatactcaaactcataatgaagttttagaagcaacaaaagtatctgcttaa

SEQ ID NO: 2747 - DNA, 726 bp, Acinetobacter baumannii
gttcttcagattatgtctagcgcaattaaacctagatcaacaaaaaaactaagccagattattgtagaacaactgatcgaaaaaattcagtctggagaatttaaagttggagaaaaaatcccgaccgaacttgaattaattgaaacttttgaagtaagccgttctgttattcgtgaagcaattactgagttgcgttcattaggatttgtcgagactcgtcacggaattggtacttttgtcaaagagcagacagttgagcaaaattttctgttgtctaatgccagtttagaaaccattaatgacattatttccttgcttgagcttcggattagccttgagtctgaagctgtctttttagcatctgagcgccgtaagcaaatccacatcgataaaatgaaagctgcgcttgaagactttgaacgacatatttcttcagatgcaaacgatggtacggtaaaagctgactacgatttccatattgccattgctgaagcttctgaaaaccaatatttcgttgattttttgaagtatctgggtgaaaaaattattccacgtgcacgtgttaaatctattgagcaaagtcctgaaaatcgcgaagaatatttaaaagcggttcaccatgatcatgtcaatatttataacgcaattgtcgatcaggatggtttgttggctagacaaatgatgcgagctcatttgtctaaaagtattaaaaagtttaagcagtaa

SEQ ID NO: 2748 - DNA, 195 bp, Acinetobacter baumannii
tatgaccagattcagattttacagatggaaaaacccactctcctttattttgtattcttcgttttttcatcagatgccaaagaaagtttcccatataaattttatagtacacattattgtatggatttaaaaaagacagagttccttcctctaaatctatatttttccaatgtaaagattcacactcattcctaa

SEQ ID NO: 2749 - DNA, 1479 bp, Acinetobacter baumannii
gtgttcaagatgaataatagtgaagcaataattaaaccttcttatgatgcaaaactaacaaatcaagacttagctcctttaaaaaagcaaacttgggatgcttataatatttttgctttttggatgtcggatgttcatagcgtcggtggttatgtcatggctggaagcctttttgcactcgggctcaatagctggcaggtacttctatctttactgatcggcattgcaattgttcagttttttacaaatctcattgccaagtctagccaacaaacaggcacgccctatcctgtgatttgtcgtgccactttcggtgtgcttggtgcaaatatccctgccgttatccgtggtcttattgctgtcgcatggtatggcattcaaacttatttggcctccagtgcctttttattggtcattttaaagttctttccagaatggtcagtctatgctgatgtttcaacttacggctttcttgggctttcctatttaggatgggttggcttcatgctgctttggttactacaagcgattgttttctggtctggcatggacagcattcgtaagtttattgactgggcaggtccggctgtctacgttgtgatgtttgcaatggcagtctggctgatctggaaagctggctggcaaaatattgatttaaacttgagtggggttcaatacgacggttttgcagttgtaccggtcatgattggtgctattgcgctcgttgtctcatatttctcagggccgatgctgaattttggagacttctctcgttatggtaaaagctttaacgcgattaaaatggggaactttcttggcttaccaattaacttcttaggcttttctttacttactgtggtgtgtattgcagcaacacttccagtgtacggcaagctcattaccgaccctgtcgagatggtcggtaaacttgataacacatttgtagtcattttaggtagtttgaccttaatgattgccaccatcgggattaatattgtcgctaactttgtttcacctgcctttgatttttccaacgtttcaccgagcaaaattagctggcgtatgggtggaatgattgcagcagtaggttcaattttcattaccccatggaatttgtttaataaccctcaagtgatccattacaccattgatattttaggtgcatttatcggtccactttttggtgtattgctcgccgatttttacctcgttaaaaaacagaaaatcgtggtagatgatttatatactttagataccaagggtttgtattggtacaaaaatggttataaccactctgctttttatgcgttaattccggcttcattaattcctattctctgcgtacttttaccacaactgtctgggctggctaatttcacatggtttattgggatgggatttggttttgtcatttaccgatttcttaaccaaccgcttgcccatgctaaatcggcaatgactaaggtaaaagtacaatga

SEQ ID NO: 2750 - DNA, 405 bp, Acinetobacter baumannii
cgattagagataaaaatgtcacaagttaaaatttatgcaaatgaacgaaccattattcagtatcgcgaactgctctctcatgcgatccatcaagcacttattgaagaattgaagtatcccgtcgagaaaagatttcaacgcttcattagccttaaacctgagaattttatttatccatctgacagaagccagcattacattatcatcgaactttcaatgtttgcaggccgcagtccagccactaaaaagcaacttattcaaaccttatttcgcaatattgaagagcaatgcaaaattgcatctcaggacattgaaattaccatttttgaaacacctaaagaaaattggggcatccgtggtaaaaatgcagatgaattgcttttaaactatcaggttaatatctaa

SEQ ID NO: 2751 - DNA, 1329 bp, Acinetobacter baumannii
acccaaaggatagaggttcctatgaagcaaaagaaattgctcaagtatattgtggttgctattttactaggagtattgacgggttggatctgtcatcacttctttaatgaaggcgagcaactgaagcaaatcgcttcttatttcaacatcgtcacagatatctttttacgtctcatcaaaatgattattgccccattggtatttgctacaattgtgtgtggcattgtgtcaatgggcaaatcaacttcaattggtagcattacactcaagtcaatgacttggtttattaccgcttcgtttgtctcacttgccatcggtatgggtttagcaaactttttccaacctggcgcggcgctagacctagcattaccaacagctcaacaacttagtagttcttctctcccaacaactactggttttaccttgcaatcattcttgagtcacgtgttcccacgcagcattgcagaagcaatggcgaacaatgatattttacaagtccttgttttctctattttctttggttcagctcttgcttttgtaaatcagggcaaagaaaaagactcagttatcattcgcttaactgatgaactcagtaaaatcatgtttcgcattactgactacgtaatgatgttcgcaccttttgcagtatttgctgcaatcgcttcagcaattacagtacaaggcttaggcttaattgttgattatggcattttaatcgcagaattctacttcggtctgctattactttgggtcattttgttctctgttggcgcaatcgtacttaaaaaagatatcttccgtttaggtaaattgatccgtgaacctgtaacacttgcttttgctacagcttcaagtgaatcagcctatcctaaagttatggatgctttaaataagttcggcgtgcctaaaaaagtgactagcttcgttttaccattaggttattcatttaaccttgatggttcgatgatgtacaccacctttgcagtactctttatcgctcaagcttacaatattgatctgagcttcacccaacaaatcttgattttgttaacgcttatggtgacaagtaaaggtattgcgggtgtttcaagagcttctattgtagttatctcggcaacactcacaatgttccatttgcctgaagccggcattctattattgcttggtattgatcagttccttgatatgggccgtactgcaacaaacgtagtaggtaatagtattgcgactgcagttgttgccaaacttgaaggcgataaattagctgatactgaagaattaccagagcctgtattaattaaatcaactcaagaacaaacaatcgcttaa

SEQ ID NO: 2752 - DNA, 411 bp, Acinetobacter baumannii
atacaccttgtttggaggattgaatatatgagtaatgaaaaatttgaaaagggtttagcaatccgtaaacaagttcttggtgaagaatatgtaaataattcaatcaacaatgctgatgagtttaatcttcctcttcaagaattagtcactgaatattgctggggagctgtttggggacgtgaagaattaagtaagcctgagcgcagtttaattaatttggcaatgatctcagctttaaatcgtccgcatgaattaaaactacatgttaaaggtgcacttcgaaatggtgtacctaaagagaaaattcgtgaagtgcttttgcaggttgcaatttactgtggcgtgcctgctgctgtagatagctttcgaattgctaaagaggcaattaaagagtttgaatctgagcaataa

SEQ ID NO: 2753 - DNA, 1236 bp, Acinetobacter baumannii
ggagcaattgtcatgacttcatatcaatcggttcaaaccaaacaaacatcggcatcaggccaagcacatattattcaaaatgatgctgaagcattagaaattgccgaacaatttgccgaacaatttaaaaaaaccgcagttgagcgagacgctaaacgaattttaccttataccgaaattgatgctttgagccagtctggactttgggcaattacagtgccaaagcaatatggcggtgccgaagtttcaagtcatactgttgctaaagtgattgcacttttaagcggtgcagatggttcaatcgggcaaattccacaaaaccacttctatgcattagaagtgttacgcaatacaggtacagaaactcagaaacaacgtttatacggcgaagtgttaaatggcacccgctttggtaatgcacttgctgagtttaaaactaaaacttcaacccataaacaaactaacattcgtccgcatgaaaatggatatctcattcagggtgaaaagttttactgcacaggaagtttatttgctcaccgtattccaaccttagttttagatgatgcaggtcgagagtatttagcctttgtaaaaagtggttcacaaggattaaaacttgttgatgactggtctggatttggacaaaaaactacaggcagcggcacagttaagtttgatcaggtttttgtcgatgcagatgatgttattccttttgatacagcatttttacaaccaaccttagtcggtccttttgctcaaatcatgcatgcatcgattgaggtaggcattgcacgtgcagcctttgaagaaagcttgcaaagagtacatcaagctcgcccatggattgattcaaatgtagaaactgcaaaccaagatcctttaacgatttatgaattaggacgcattgcggtagatgtacgagctagtgaagtcctattaaaacaggcagctcaatcaattgatgccgcaaaaattgaaaccacacctgagaacattgctaaagcatccatcgatgttgccaaagtacgtgctcatagtaccgatatcgcactcaaagcatcgtctaagctgattgaacttgctggtagccgtggtagtcagtctcaagatggcctagaccgtttctggcgtaatgcgcgagtacataccttacatgatgctgcacgatggaaatattactttattgggaactacgttcttaacggtgttctaccacctcgtcgggggacattgtaa

SEQ ID NO: 2754 - DNA, 993 bp, Acinetobacter baumannii
tatggaattgtacacctttatgtgattactcagaataaagacattctttttcggagcccaatcatgaataaatcaatggtgtatgcctatactggtgttgtaatcacaatgctgttttggggctcggcatttaatgcgatgtcttatgtgattcaatatatgccacctctttcagcagcagctgaacgttttacaattgcaagccttggcctatttattctttttgcagctataggaaagctacgttgggccgcattacggcaaaatttagctatctatcttattattggaattataggtattgccggttttaacctaggctgtttctatggtttacaaaccacctcagcagtcaatggcgctttaatcatggccacaacacctttaattactttactgttaacaattttacttgatggagaaaaactcacacttaataagtctattggtgttgtatttggcttaagtggtgtactttttgttattagtcatggccatatttcaacgctactacacttaaaaatagcaatcggtgacttattcatcttactaggtggtgtcagtttttgtttagcgaatgtgctatcacgccgttatgtaaaaaatgctacacctttagagaccacaacattttccatgatgttcggtgctttgactttaatcatattaagtgtaatttttgagcacccttctcaagcaattgctatggcgcctatcactgcacacttagctatgggatacgtcattatttgttctaccatgattgcttatttattttggtttaatggtattcaaaaactaggtgcaggccgagcatcaatcttttttaactttgttccggtttttagtatgttagttgccttgttagctggtcaatcacttaatatctggcaacttataggcacagctttagtcatgcttggcgtgatgagtagtggaggatttattcagattaaacgtcctgcacttatagctaagccttgcacaaagtaa

SEQ ID NO: 2755 - DNA, 858 bp, Acinetobacter baumannii
aaactcgctgttgaccgtgccgagcgcttctctttggatttatggctttatttttattttgtattttctgatttgctatcccttatctcgtttggcggcacatttagaaaaggtctgggagtaattatgcctttgctatcgatacaacaattacagaaatcatttgcacaaagtcatattttacagggcattgatctagatgtagaacaaggagaggtggttgttattttaggcccatcgggctgcggtaaaagtaccttattgcgctgtattaatggcttagaaccgattcagggtggcgaaattcgtttaactggctcaggtgtgcttggtaaagacgtggactggactaatgctcgtcaaaaaattggcatggtttttcagaactatgagctatttgggcatatgaacgtcattgacaatattttgctcgggccacttaaagtacaaaaacgtcaccgcgatgaagcagaacaagtagcagatgagttgttaaagcgagtcgggctatatgagcgaaaacttgattatccacgacaactttctggtggacaaaaacagcgtattgccattgtccgttcattggtcatgcaacctcaggtgattttacttgatgaaattaccgctgcgcttgatccagaaatggttagggaagtactcgatgtggtactgaaattggcgaatgaaggaatgaccatgttgattgtgacacatgagatgtcctttgcgcgtaaggttgccgaccgcattatttttatggataagggcaagattattgaacaggcttcaccagaagaattttttgaacagccaaaaacagaacgagcgaaagctttcttaaatattttgtcgtactaa

SEQ ID NO: 2756 - DNA, 786 bp, Acinetobacter baumannii
atagaggctgtcatgcaagagttgatcaaagccagcacagcaactgacggtgttttgttattaaccctaaaccgtccggaaaaaagaaatgcattaaacaaggcaaccttgcagtgtttgtgcgagttgctcgaagaagctgaacataatgctcaagtcaaagcagtggttttaacgggtaacgctcagtgttttgcggctggagcagatctgagtgagttggctgcaatggatgccgtgtctttgcaactcgatattcgcccgaagctttggcaaaaaattgatgcgtttagtaagccactgattacagcagtgaatggctatgccttaggcgctgggtttgagttggttttgcattcagatatggtgatttgcggtgaaaatgcccgattcgctttacctgaaattggccttgggatgttgccgggtgcaggcggaacacagcgtttagcacgcttggttggacaacaactcaccatgcgctgggctatgacaggtgaaatgatttcggcaaaacaagccgagcaacatggcatttgcagtcaagtggttccgaccgaattaaccgttgaatatgcggttcaacttgcagccaaaattgccaaacaagcgcctttagcgattcgcgtgattaaacaatcaattaaaagtattcatgaaacaacattaagtcagggactcaagtttgaacgtcaaaactttgtctggctggcggctacaaaagatcgaaacgaagggattaacgctttctttgagaaaagaaagccagtgtttagaggtgagtga

SEQ ID NO: 2757 - DNA, 252 bp, Acinetobacter baumannii
agattttatgtcataacattaaaaggtactttcatgtcattgcaacgcggcatttatcagcattataaaggtaatctctatcaagttttttctgtagcaaaacacagtgaaactgaagaggaattggtcgtttatcaatgtttatatggtgattattcaacttgggttcgaccacttgatatgtttactgaaaccgtgcaaatgagtgatggtagcatcgtaccgcgttttaaattaatacaaagtacttaa

SEQ ID NO: 2758 - DNA, 504 bp, Acinetobacter baumannii
gtggtttatgtcgcacttcaagttttactctgccgtggatcattttacagtggttttattttaggcaatagccatttcaaattaggccgccggtatggccttcctttaagtctagtttcactatttatttttctctgttggttactgctgccttattttccaaaatatggactattatgggcttgtgtcgccatggggctacaaaatgcaatggtaagtcactataaaggaaccattattaggactactcacttatcgggtgtcttaacagatcttgggcttgcacttggttatatagcacgaggtttaaaagtagagaatcgccgcattattttgcatctacttatttttataggttttctatctggcggtataattgctgctttagttcacccttatttaaaattgcaatcatttttgcttccagcaattttaagcttaactctcagtatttcgtattgggcagtttactttcatagttcttcctcttcaaattcggattaa

SEQ ID NO: 2759 - DNA, 954 bp, Acinetobacter baumannii
attattcatgttaatattattccaaaatggaataatctattctttattatgctttctctaaaatcattacagtgctttgttactctggttaaaactaaaagttttacccgtactgctgaagagttatatctgactcagcccaccattagtaaaatattacaacaactcgaagagcagcttcaggtacagcttttggttaaacccgatcatggacgaaaaagacaaattgaattaaccgaaattggagagcgtatttatcaacatgcggtcgaacttcttcaagcagagcaaaacatctttcttgagatagaaaactaccaacaattaaaaacaggtactttaaaacttggcgttccacctttaggttcacagctcctaacgactgccctatttgactttcatcgccaatggccagatattgaattagcttttatggaagtaggttcacgcggtattgaacaggctttactcaataatgagctagacgttggggttttattgcagccttttgatgaacaaacttttaatagcatcgagttatgtaactaccctttaatggtacttttacgtcgtgatgcaacttgggcaacccgcaaaaaaataaatttagaagagctacaacaccaatcatttttaatgtttcctgaaaatttctctttaaacagtattattctcgatgcttgtaagcagcatggtttttacccaaccattgcttgccgtaccagccaatggcacctcttggcagacatggttttacaacgtatgggaatcgcgcttcttcctcaatattatacagacatgcttgacccgactttatttgcagcagtgccactcgaaaaaccaaatattcagtggcacttagtcatggcttggaaaaagaatcttcctgtttcaccagcagtacaagcttggcttagcattgttcgtcaacattttcagcacattaaaccctaa

SEQ ID NO: 2760 - DNA, 657 bp, Acinetobacter baumannii
aaatataatgttattcttgttttttacttgaaaggtgctatatttccaccgcattacttgatcagaataaaagcactgaagagtaataaagcgatatttattgaatattctggggattttatgaaaaaatttatttttattgcggctagttctctttttaatattgcagcagcacaagcagctgatggtacgatcactattaatggtttagtaactgataatacgtgtacgattgatactggtgataaaaatcttactgtaaatttaccaacagtatcatctcaatctttgaaaaatgcgggcgatgttgctggtcgtacaccttttcaaatcaatttaacgaattgtgcttcagttggtaaagtcgcgacttattttgaaccaggcgcaacagttgattttaatactggtcgactattgaaccaagctacctctggtgcagctgccaatgtcaacatccaattattgggtagcaacaatgcagtaattcctgtaattgcgaaaggtgcttctggtgcacaagataactcacaatgggtaaatgtttctgctggggggaatgccgatcttaattattatgctgaatattatgcaactggagcatctacagcaggtactgtaacatcacaagtgaaatacacaattatttatcaataa

SEQ ID NO: 2761 - DNA, 345 bp, Acinetobacter baumannii
atgaaagatgtgatggggaatggttttatagcgaatgcagaagctttcacactagctactcaaatttatgtgcgtatgcgcagagtaacgggacgggtgatagatgcaatgtatgttgttcaaaataaagactatgcgaaatatgtaattgcactggcactagaagcagaagatgatgaattaaaacgctgtgttgaacgattaatggtattgacggattcaataccagagcagtctcaaaaagaaatgacagtaagtattcaaactagtgaagaatcagaaatcacagccgaagacatttatcgggcacaagttccacatcattatattggtgctttaaggtaa

SEQ ID NO: 2762 - DNA, 1389 bp, Acinetobacter baumannii
caatgtcgtgtgtatctcttatccacattgggagatgcacaaatggaaagagatgttctaagtgagatcaatcacaataatatgagccgttatcaatggttcatcattttgatctgtatttgtctcaatattattgatggctttgacgtgatggtaatggcttttaccgcgccatccgtgtcagcagaatggtcactttcaggcgcacaaattggcttattgctgagttcaggtctttttgggatggctgctggttcaatttttctcgcacctttagccgataaaattggtcgccgtttacttatcttggtttgtcttgtaattgcaggtcttagcatgttgggctgtgctttagtgcaaagtcacggcatgttggccgcacttcggtttattaccggaattggggtaggtgggattcttgcgagtagtaatgtcttggcaagtgagtatgccaatgcacgttggcgcagtctcgcagtgagcttaatgtctacaggttatggcattggtgcgacactgggcggagtactttcactggccttgattgagcatttaggttggcgttcaatctttttggcagggggcatcacaaccatagtgatgttattgattagtgcgtggttattacctgaatctttagattatttgttggcgaaaagaccaaaacaggcactagaacgtattaacgcaacagtaaaccgtatggggttacctgctttaaaagctttaccttattacggtcagaataatcaaaaaaatacaggtgatattggtaaattattttcagggcagcaggggttacaaacactttgtctttggtttgcattctttttagtgatgtttggcttttactttgtcatgagctggacaccaaaaattctgatttcaatgggaatgtcgcctgaacaaggcgtaagtaccggtattttaattagtattggtggtattttcggagcagccattattggtttacttgcttcacgcatgaaaatattctatgccctcagcttatttctgggattaaccgctgtctgtgttttcctatttatcgccgtttcatctcaagtgagcattgcgctcatagtcggtttattacttggcacactcattaatggctgtgtggcaggtttatattctatttctccaacgatttacgatgctgaaatccgtagtcgcggcgtgggttatgcaattggttttggtcggattggggcaatcttatcgccaacggttgcaggcattttcttagataaaggtattgcacctgcaacgctgtatgcctattacggtgtggtgtttattttggctattttcctgattttgagtttaggtagcgctttttaccgaagtaagaaagagcaaaacttctcacttaaaacagcaccttaa

SEQ ID NO: 2763 - DNA, 3609 bp, Acinetobacter baumannii
actttgcgtgttaaactatgctgcggtcgcattaaggattggtttatgcagtttgttcatctcggtatttacacagaattttcgattacagagtcgattgttcgcatacccgacttggtcaagactgcggtaaaggatgaaatgcctgcgctggcacttaccgacttatctaaccttcatgctgctgtaaagttttataattcttgccttaagaaaggcattaagccaattttgggtagtacaatccgtcttaatgatgcccaacatcgtgcaactttgcttgcaatgagtgatattggatggaaaggactgaccgaaattgtttcgcgtggctttattgaaggtcaacaactcagtatcccttgtgtacaaaaagaatgggtcctagagcagcatcaagatattattgttttacttggccaacatagtgatgttgggcaaatgctttgctcatctaacccgcaaaaagcagaacctttacttgaagagtggatcgaaaagtttggtaatcgtgtttatctagccttaacacgtactgatcgtcctggcgaagaagactttattcaagaagcagccaaacttgcagccaaatataatattggtgttgttgcacacaacgatgtgcactttattgaaaaagaagatttcgaagcgcacgaagctcgtgtatgtattgcagatggttacgttttagcagatgatcgacgtccgcgcttatatagtccagagcagtatttcaaaacttctgatgaaatgattgagctgttctcagatattcctagtgctattgaaaacacctatcaaatcgctaaacgctgtaatgtcactttaaagctcggtacttactttttacctgagtatccaattcctgatggttttaccatcgatacctattttgagcacttatcaaaagaaggtttggaagagcgcttaaattacctttaccctgtcgaaaagcgtggtgaggactggcccgaaattcgtaaaccatatgatgaacgaatagattatgaagtcggaatcatcctgaaaatgggattccctggttacttcctgattgtcatggacttcattcaatgggcgaaaaacaatggtgtccctgttggaccgggccgtggttcaggtgcaggttcattagtagcttatagcttaaaaattacagatcttgatccacttcgttatgacctactcttcgaacgtttcttaaacccggaacgtgtatcgatgcccgactttgacgtcgatttctgtatcgcaggtcgtgaccgtgtgatcgattatgtatcacgtacttatggccgtgaagcggtgtctcagattgcaacgttcggtacgatggctgcgaaaggtgcgattcgtgacgttgcccgcgttttagggaagtcttatggtctagctgaccgtatttcaaaaatggttccaactaagccacttggtgtggatttggcaactgcgattgaaatggaacctcagcttaaagatattgttaccaacccttccaacccagacaatgatgatgccagcgaaatttgggaaatggcattaaagttagaaggtattaccagaaatacaggtaaacatgccggtggtgttgttattgcacccggtaaaattaccgacttctctgctgtgctttgtgacgcagacggtactaaccgtgtagcacagtacgataaagatgatgtagaagctgcaggtctcgtaaagttcgacttcttgggtttacgtaacttaaccgttattgaagatgctattcaaaatattaataaaaaccgtgatagcaatgaccctttaaacatttcgcacgtccctcttgacgaccctaaagcttattctgtctttgctgatgcaaatacaaccgcggtattccagtttgaatccgtcggtatgaaacgaatgcttaaagaagcgcgtccaagtaaattcgaagaaattattgcgttcgtatctttatatcgtccgggtccgatggatctgatcccagactttattcaccgtatgcatggtggagaatttgagtatcttcatccattgcttgaaggtgtattagaaccaacctacgggattatggtttaccaagaacaggtaatgcaaactgcacagatttgtgcaggttacacactcggtggcgctgacttgctccgccgtgcaatgggtaaaaagaaacctgaagaaatggtgaaacagcgccaaatcttccttgagggtgctggacaaaaaggcattgatgaaagcacggctaaccatatcttcgactatatggaaaagttcgcaggctatggttttaacaaatcacatgccgcagcctatgcgcttgttgcataccatacagcatggttaaaagcccactatcctgccgaatttatggcagcagtaatgtcatcggaaatgcagaacactgacagtgtcgtatttttgattgatgactgccgaaataacggactcgaggtcttaccgccatcagtcaatatgtcgacttatcatttccatgcgagcgatgataaaaccattgtttatggtttaggggcaattaaaggtgttggtgaacaggcaatgcagtctgttattgactcacgtcgccaacaagggccttatactgacctatttgatttctgccatcgtattgatttgaaaaaaatcaataaacgaaccttagaagcacttatccgtgctggtgcgcttgattgtttaggtattgaacgttcaagtttaatggctcaattgccagaagctgtacaagctgccgaacaggcacgtagtaaccgtgaaagcggtattatggacttatttggtgaagttgaagaagttcaacgtaaaccagctaaacctgttaagccatggagtgatgaagttcgtctcaaaggcgaaaaagatacacttggactatatttaacaggtcacccaattgatgtttatcgtcaagaactcaaagcgtttattcctgcaaaacttaatgaaattaccgcaactcgtcgcggtgtaacgactgtttatgcaggacttgtccttgatgtagcgaatttcccaaaccgtgttgttattgtacttgacgacggaacagcacgtattgaagtcagctgtaaccacgaacgtttccaacgctttaaagatattattcaagttgagcgcgtagtcgtctttgaaggcgaaatctatgagcgtgaaggttttgatcgtccaatgggacgcttgaacaaagcgtttagcttaaatgaaatcagacaaaaacgcgccaatagcattcaaatcaaattaacccatgatctattgcaaccaagtttggcaaaagatctacaaaatatattattgccttattgtaatgtcgatatgcatcagcatattgcaatacagttacagattgaccaaccatatgctcaggctgagcttcagcttggcccacaatggaaagtcgctcctttagatgaacttcttgccaaactaagagattattttggtaaggataatattcatattgaatatcaggtaaaatctaaggcagctaaagcagcagaacctgttcgtccacaacctgttgcctcacctcctgtggacatgactattgatgatgcattggattcataccaaagcgaagtttctcaatattcgtaa

SEQ ID NO: 2764 - DNA, 975 bp, Acinetobacter baumannii
tctgaaggtgtcaccatgatctcgaccacagttaaaaaatcactaaacaaaattaaattttaccgtgaaatcgagttaccggattttgccagtaaaaaatccatcccaatccgtcatttaaatatcggatttgaaggtaaagagattgatgttgaattctatatgaacaatcaatttgccacgatgttttttgctacgctttcagtatttctgacttatggtgaagatctggtgattgaaacagctcgtcatcaccgtgaatttattcaagacccagttttaaaacagcgtgttacttcattgattggacaagaggcgattcactctaaactgcacaatgaatataacgatgcacttaaagatgttgaataccctgtcgatttataccgtttcttgggcgaaaacttctttaaatatgtgtttttgaaatttccgcaaccgcttaaattatcgatgatggctggtattgagcattttactgcggtacttgccgaatacatgatgaagcacgaaaagaatttctactattcagatgatgcaaaaagccgtgctttatggatgtggcatatgcttgaagaatctgagcataaagatattgcctacgatgtctatcaacttttaaatggtagttatgcactacgagcttctggtttcttcatcgcgctatttaccattttaggtttaatcccagcaactaccttgtttattccggttttaagaaaaccgcaggaaatgttgactagaaaattctggaaagacgcgcgccgtggtgtaggacttctttttggtccaaaagatggagtattcggtagcaccattggccagattttcgattacttacgtcctgacttccatccaaatgaccatgacacgaccgaatatctagagtactacaaagacaaattactcaaagaaggcggcgcgattgcaccttactttgtgaaggaatttaccccacctgtacgcttgtcttaa

SEQ ID NO: 2765 - DNA, 1128 bp, Acinetobacter baumannii
cccatttgcttggggtattcagctatgagaaccgatgccatcgtcattggtgcaggtattgtgggggcggcatgtgcttatgaattggctcggcaagggttaaatgtgcaagttttggatgctcggatcggtggtgccacagccgcgggcatggggcatttggtcattatggatgacttggaagccgaattaaaacttagtcattggtcagttcagctatggcatgaattaggacacgagctttcggaagaatgtgcctatcgccaaacgccaactttatggctggcaagtagcgcagaagaaatgcagattgctgaggaaaaatatcaacgtctcactgcacaaggcgtccgttgccaacttcgaaacgcagatgaagttcatcagctcgaacctcacttaaagcagggtctttatggtggtttagaagtttttgatgatggaattttatatgcaccttgtgctgctgaatggttattaaaaaaaattccccacaaggttcaggttcaacaagctaaagttattcatattaaagaaaatcgggttcagttaagtgatggcacatggctagaagctgcacatatcgttttggctaacggtattcatgcgacagatttttttccagagctaccgattgaacctaaaaaaggtcatttggcgattaccgatcgttatcccgaattaaatgtaaaacatacattagtggctttggcttatgcggccagtactcaagcgacaagtggaatttcggtggcttgtaatattcagcctagaccgacgggccagctttttattgggtcatctcgtcagttcaatacggttgatccgactgtagagccagaagtctttactcgggtacttaaagaggctgtcgattattttccagctttggctgatcttaatgttattcgggcatggactggctttcgcgcagccacacccgatggtattccggtaattggacgacatcctgcatttcaatcggtttatttagcggtagggcatgaaggtttaggtgtaaccacagcaacaggtacagcaagacttattgcctcacacatatgtggattaacttttgatatagatccagaaccttttttacctcatcgctttataggagctgcatag

SEQ ID NO: 2766 - DNA, 510 bp, Acinetobacter baumannii
tcgaattgcttagcgtacgcgcaggcgtatatatcaagcaaaacaatcagccgcctaaaacaaaaggataagactgtgccgaaacaaaagttggctcgaatcagtattactgtacctgaaacgaccctcaatgcactcgaccaaaaaattgtcgagcagaactatgaaagtcgctcgcaagctattgtcgacatgattaataaacacttaattgcggagcaggcacaggccaatgaagtcatggtgggcacattaacgctgctttatgacgctagccaaatgaccttgcgcaaccaattggtagatttacaacaacagtttttagcacaggtaattagttcacttcatattcagctcgaccaacaaaagatattgcaagtcatgttaatgcagggcgcgagttctgagcttagacaaattagccagcaatttattgtgctgaaaggggtaatcaaaggacatctagaattgatggatgccgtcatgccgcctatacagcaaaatgactaa

SEQ ID NO: 2767 - DNA, 465 bp, Acinetobacter baumannii
ttagactgcttaatcatgcaaggacgatttatggaaagcccgaaatacacaggtcttgagtttttaaccgctttaaaaaatggtgaagtttctccatcacctatggctcacaccataccgatggaactcgttgaagtttccgaaggtaaagcaacttataaagttactcctcgcaaagaacatagaaatatacaaggcggtgtacacggcggcttttgtgccacagctttagatacggcgacaggcagtgcggcccataccctacttgaacatggtgttggctatggaaccattgatttaaatgtaaaaatgatccgccccatgcaggttgatacgtcttactatgcgacggccgagttgatcaatgcgggccgcaatattattagtacccaaggtaaaatcgtagatgaaaacggcaaagtgtatgcttttgcttcggcaaccttaatgattattcgcaaataa

SEQ ID NO: 2768 - DNA, 783 bp, Acinetobacter baumannii
gataatgccgtgaaaaatataattttagcaacaataatgggcttcagtggaatcagtagtgtatttgctgagtgtacatatagctttgatgcaacattaacccagttgcaatcattaggtaatacttctgttcagaagttcccaactattacaggaaataagttttcttataagacttctcagcaaagtcccatttactcggcttacagtcaagattatctaacaagggcattagccacgaatgaccctcaagcttcactctatacgcgtggtgataaaatactacctacaaccggaattatagcttttgaatataaaattaaagttcctacactaggcaatacgggttatgtaaatattttcccagccttatctggtggaattatgcagaacggtaaggctgtacatttcatagttgcttaccaacatgggccgacaactaataatttttattttcaaactacatcaaatgatagtgcgttagttactaatggatttagtttagctccagaagttacttctgatggctatcagaaaattggtatctatattaatcagaactccaatcaagttggtttagtttttaatggggttaacaaaggctattttgcgacattcccttctaaactagataacctatatttttcattaacttcaaattattttgatttggcagcaactgatgcgaacaaagatgtctcggtcgagtttctgctggatcaatctaaaattacacaaacttatccaactggtactaaggatatttgcggagtcgctttgtaa

SEQ ID NO: 2769 - DNA, 1503 bp, Acinetobacter baumannii
acaaatgccgtttgtagattctgcaagcggcatttattattggttcagtgcatcttttattttgttatttcgtgcagcccatacatgtataaatcagaacaactcgcccatagcattcgtcaacttattgaaagcggcactttaaatgcacatgagaaattaccttcattaagagatcaggtccaacgttctggttttagtttaatgactgtgatgaatgcttatcaggagcttgaatcacaaggtctgatctattcaaaggaaaagtctggctattttgttgccgagcaaattgcacttaaaccactggaacaatattcgatcgtttcactcaattctaaaattgaaattaattctttagtttttaaataccttaaatcgattcaacatgagtctgttgtaccttttggttcagctttccctgatagtcaacttttagctgcccccaaacttattcaaattatggggcaacttgcacggcaaaggcaaagctatgaccaaaccacaagtctaccgccaggtaatttagcgttaagaaaactgattgctcagcgctactgtatgcaaggcatacagaccgatccagatgacattgtcattacatccggaggattagatgcactcaatctttctttacaagcagtagccaaaccgggtgactatattctattgcaacaaaccgtgttttacggtgcttggcaggctgctgaacgtttaggacttaaggtcattaccattcccgaacatccacaacatggttttgacctagaggcttttgaacaggttattcatacatatccaattaaagtatgttggctcatgttaaatagccacaacccgatcgggtttacggtcagtgatgagattaaatataaaattgccaaactgcttcatgaacaccaaatttacttaattgaagatgatgtctatgaagagctttattatggcgggcaaaagccactttcgatgaaatactttgaccaacaaaatctggtactgcactgctcttcattttctaaaactttaggggcaggttttcgggtaggttgggtctatgcgggtaaattttcggaccatatccaacacttgcagcttatgagtactatttcagtgaatgcactcatccaaaatgccttggttgagttcttgtctcatcatcattatgaaaagcatttgcgcacacttagactttcacttgaacgttataaaaagcagttttaccactatttgaaacaacatctgcccgcgacctgcgagatttattattacccaagcggttattttctatgggttaaattgcctcataaactcgatagtatgcaaatttatgaagaactcatccaacaagacattggtgttgcgccaagcccactctttagtgttttacccgcacagcagcattatttaagaatcaattgttcttttgagtggaacgaaaaaattcaagctgctttagatcaagtcatcaaaactattcaacaaagggtcgaagcaagcctgtaa

SEQ ID NO: 2770 - DNA, 1635 bp, Acinetobacter baumannii
ctctccaacgtcagaagaagcacttttgacgttcactctcaagtgaggttgataatgttaaatattactggtcaaaattttattgcaggtcaacgttcaagtgcaggcagtaagtttgtattaagctacgatgctgcaacagatgaagcattaccctatcagtttgctcaagcaactcctgaagaaattgatcaggcagctcaagcagctgcattggcttatccggcttttagacaaactacgccagaacaacgcgccgtttttctagaaacgattgccagtgaaattgatgcgcttgatgaccagtttattgcaacagtctgtcaagaaactgctttgccggaagcgcgtattcgcggtgaacgtgggcggactacaggtcaattacgcctatttgctcaagtattacgccgtggtgactatttaggtgcccgtattgatttggctttacctgagcgccagccacttccacgtccagatttacgtcaatataaaatcggtgttggaccagttgccgtatttggtgcaagtaacttccctcttgccttttctactgcgggtggcgataccgcttcagcacttgcggctggatgtccagttattgtgaaggctcatagcggtcacatggcaacagcagaatccattgcaaatgccatttgtagtgcgattgagaaatgcgctatgccaaaaggcatctttagcatgatttatggtcaaggtgtcggtgagccactggtaaaacatccagcaatcaaagccgttggatttacaggttcactcaaaggtggtcgtgctctatgcgatttagctgccgcacgtcctgaacccattcctgtttttgccgaaatgtcgagcattaacccaatgattttattacccgaagctctaaaagtgcgtggtgataaaattgcgaccgaacttagtggttcagtggttttaggctgcggtcagttctgtaccaacccgggtttaattattggaattaaatcaccggaatttagccaattccttgaccatttcaaggctgcaatggctcagcaaccgccacaaaccatgcttaacaaaggcactttaagaagctacgagcatggtcttaaagaattactcgcacatgacaaaattgagcatttagcgggtcaaccccaacaaggtccgcaagcctatcctcagctctttaaagccgatgtatctcttttactcgagcatgatgaattacttcaagaagaagtgttcggcccaacgacgattgtgattgaagttgaatcggcagagcagctcgctcaagctttaaatggcctacgtggtcaacttacagcatctttaattgccgaaccgcaagattttgaaaacttcgcgacccttattccgttacttgaagaaaaagcaggacgtttacttctaaatggttacccaacaggcgttgaagtctgtgatgccatggtacacggcggaccttatcctgcaacttcagatgcacgcggtacatcggtaggaaccttagcaatcgagcgttatttacgtccagtatgctaccaaaactatccagatcacttattgccactcgcccttcaaaatgccaatccgcttggtattgcgcgtttagtcaatggtgaaatgagtaaagctgctctttaa

SEQ ID NO: 2771 - DNA, 537 bp, Acinetobacter baumannii
acagaacgcttcaatttaaaaaacacggttaagttgagctggagaataagggacttaatttgcacaaaagcatcaatttatttgtttcttctaagcacaagtttaggcaaaatacgcgctgcttacgttcgatcaaaggaaaaaatgatgaaaaaattgatgctcgctgtagcaccagttgttttagctttaactgcatgtgcaaccactacaggtaccggtactggcggtgcttctgcacaaacgacaactcaacagttaggcgtagctgcattaaaagttgctgttaatgcgaaatgtattacagaaattaataatgttgctgcatggaagacagcaacaaaatatatgactgctgaacagcgtgatagcatccaaacgaatgtttgcggctgtgtaagtgaaaaagcaccaaatagtgtgactgcagtagaattagctgctgctgcgcttgacgtgaatgctcgtgctacaatcgtaaaccaagtggtttcgaaaactgtaaatgcttgtgtggcagaagctttacaaaaataa

SEQ ID NO: 2772 - DNA, 615 bp, Acinetobacter baumannii
aagcagcgcttaattcataatcactcattgagcaaacatgtgtataggcatgtttgctcttactttaaggagaataaaatttctattttcttaaggccactacaatacacagagatcgatttaatttggcaacagattaatcgtcgtgaactgattacccaactctacttacaaaagcaagaacacttagaattaacagattgtttttatgatgttaaacattgggatgcttatcatttagaaaatgatccgcccaaattaaaagaactctatgaacaaggggctttatttatcggtgcttttgatgcgtctgaacagttggctggcattagtgtagtctcgaatcagactattactgattatcccgatgcaaaattactgcaatatttttacgtcgatgccgatcaacaaggtaaaggtattggtgcaaagctgatgcaagcggcaaaagaatcggccaagcaattggaagcccatcaactttatatttcagccactccaagtaagcgtacagtagatttctatataaagcatggcgcggtcgtattaaagcacccagatcgtcaattatgggaacttgaaccagaagacatccatttactttgtacactttaa

SEQ ID NO: 2773 - DNA, 201 bp, Acinetobacter baumannii
aaacaaatagttaagataaaaataagactccttttgtcgaaaattcatattagaattaaaattctactaaatcaaatagaatatttaaaaaatttaaaaataatcttgagtagcttttataatattcgcttgaataaaattatgtttttgattatgattaatttgattaaaattttaaaatctatatcaagtaataattag

SEQ ID NO: 2774 - DNA, 390 bp, Acinetobacter baumannii
atggaaccagtttccactagcggttttacagcacttttaaaattatatgggattgcaatcatggtgactttagcagtcggtttggttgcagcagttgtattgatgacacgtatgccacgctcaccacaagagtgggcagtgggcttgatctgtacggttgtatcaagtttagctggcggttcattcattattgtgaagtgggggcttcatgaatgggttactgatgtatggggaatgattgcacttggtgggttcttctttgtttgtggtttacccggttgggctttagtccggtggatctttaacttcattgataagcaggaaggtaaaacgattgttgaagtgatcaaagaatttaagaaagccaaagatgatatacggaatagttaa

SEQ ID NO: 2775 - DNA, 1770 bp, Acinetobacter baumannii
tttggaaaagtagttgcagtaacaacaattagatcaggtaagaagagaattagaagaatcaaggagaatgattcaatgcaacaagaacggttaagctacgcctcgggaccaagtacacaacccttattgggtatgaccattggtgaacaatttgatcaggcctgtcagcaatatgctgaaaaggaagcgattgtcagttttcatcaaaacagacgattaacctataaagctttacaggatgaagtaaacgcttttgcttgtagcctattaaaattgggattaaaaaaaggagaccgattagcgatttggtcacctaactgtgtggaatggaccattacgcagtttgcagcttttaaagcagggattattctagtcaatctaaatacagcttataaaagtcatgagcttgaatatgtgttgaataaggtctcatgcaaaggattgattattgcttctcaatttaaaacgacggattatcaagagttactcacaaaaattgcccctgagttaaccacctgtacagataaagtgctcagttcagagcgactaccacatttaaaatttgttattaaaattgatgaccaacaacatacaggtatttatcgttttagtgatttactaactacaccaacttctgaacagctagaacaattaaaacaattagccagacagctccagtttgatgaaactattaatatccaatttacctcagggacaacaggtaacccgaaagggaccatgttaacccatcataatattttaaataatggttattttgtcggtgaaggcattcgtttaactcctcaagataaagtctgtatttctgtgccattgttccattgttttggcatggtgatggggaatctggcgtgtgtgacgcatggggcaaccatggtctatccatctgctgtatttaatcctttggaaactttaaaagcgattcatcaagaacgttgtacggcagcttacggcgtaccaaccatgtttattgcaaccttagagcatgaacagtttaatgagtttgatctgtcgagcttaagaacaggcattatggcaggtagtccttgtccgcgtgaaattatgcaacgtgttatagaccgaatgcatatgtctgaaatcaccatttgttatggcatgaccgaaacctcgccagtgagtgtacaaagctcggtaaatgattcgattgataaacgggtaagcacagttggacatgttcatccgcatgttgaaattaaaattgttgatctagaagggcaaattgttccgcaagggactttgggtgagctatgcgtccgtggttattcagtgatggctggttattggggtgaagaggaaaagacccgtgaagtgattgatgcggctggctggatgcatacgggtgacattgccgagatggatcaagaaggttttattaaaattaaaggccgtattaaagatgtcgtgattcgtggtggggaaaacctctttccaaaagagattgaagactttttatatactcatccagatgtaagcgatgtacaggtgattggcttgccagatgcgaaatatggcgaagaactttgtgcatgtattatcctgcatgagcatcaccaagtcgatgaagacagcatccgccaattttgcaaagaacacatttcacataacaaagtgccgcgttatgtccgattctttaatgagtttccaatgactgcttctggcaaagcccaaaagtttaaattacaggaaattatgcgagctgaacttaatttaacaggaaatgtctttgactaa

SEQ ID NO: 2776 - DNA, 645 bp, Acinetobacter baumannii
gggttcagagtggcttttgtatctgtaaaagaagtagctgataaagcgcagcattttagtgtccacgaacaaatgattatagggattaattattgtttaggattaaatggacatgaacaagacattaatgaggggcgagcatggttgtggatagcagctacatattatcggtcttttattgctcagtataattgggctttaacatggacaagtatgccttgttataaagttgaaaaagatatttctttagaagaattacaaatattggcaaatgaaaataatttggcagcgatctacatgctaggtgttcattttagagaacctgatcctattttagctattgaatactatcaaaaggcggcaaaagaaaatttttatccagcaataaataatttagctgatatatatgaaaacggctctggtgttgaacagaacattaataaagctgttgaactttataacattgctgctgaacaaggtattgctgctgctgagtggagtttaggattgctttatttcaatggagatcttgtggatcaaaacattccattagctcaatattggttacaaaaagcagaagcaaatggatggtttccagcgcaggatcttttgatttctatcgatgaaaattatcaaaaaatttaa

SEQ ID NO: 2777 - DNA, 621 bp, Acinetobacter baumannii
ttaattatggtttataatttttttgttgaatctgaagcgatgccaaaacacggcaaaaacttcaatgatgcgacccgagtacagcacatcacaccgatttcagcagggtccttgacaggatcatatacgttcatcgagttattagtgaacagcagtgatggtgtgatgcgtagaatactcattcctcttgctaccattcttaaagaggaatccaacataaattcggaggtcgtggctatgaaggctcagcagattcagcatagtggagatgtttctcagaacatatttctggcagtaatgattttaatcatgataattgtgctattaattagcccttttagcatcgagacactactgtcatgttttgttacaattttctgcttggcaaatgacttagtaaaatgctataataaaacggctataagttatttgcaaaactgcactcaggttgaatctgaagcgatgccaaaacacggcaaaaacttcaatgatgcgacccgagtacagcacatcacaccgatttcagcagggtccttgacaggatcatatacgttcatcgaaaaattagtgaacagcagtgatggtgtgatgcgtagaatcacttcgtacctgtatgggtag

SEQ ID NO: 2778 - DNA, 465 bp, Acinetobacter baumannii
aaggttatggtacgttcgaatttagttcaaaaaaaagtagaagatgagcctaagttaagttacatgattgctcgtgttgaccgaattattagtaaacatttaacagaacatttaaaagagcttgaaattaccttaccgcaatttaccgcactttctgttttagcttcaaaaagtaatttatccaatgccaagcttgctgagcgttctttcataaagccgcaatctgccaacaaaattttgcaagatttactggtcaatggttggattgagaaaaaaccggacccgacacatggccgccgtattttaattaccctgaccgaaagcgggattgaaaaattaaacaaatgcaatgaagtggttttaaaagtcgaagaaaaaatgcttgaaggcattgatattaacttggcttatttaattcgtaataatctcgatattatggtgaataatcttaaaaattttaaataa

SEQ ID NO: 2779 - DNA, 1110 bp, Acinetobacter baumannii
aggtatgtggtttcaaggctggaaataaggagaatgacgatggtgagttttggatcacaagttgatttttctctaccccacatcaaaattcgtggtttaaataagttttaccaatctcaaggtcaaaaactgcatgcgttaaaggaaattaaccttgatatcccacaaggtaagattttaggcattattggtaaaagtggtgcaggaaaatcttccttacttcgtacattaaatggtttagaacaagtaaatactggcagcattcatattcatcaacaaaacattgctgaattgagccattctgagcttattcaaacccgtcaacgaattggaatgatttttcaacatttcaatttaatgtctgcaaaaacagtttgggaaaatgtggcattgcccttaaaagtttccaattacaacaaagcagatatcgaccaacgcgtaaatgaggttctagctctcgtaggtcttgcagataaatctaactattatccatcacaactttctggcggacaaaagcaacgtgtcggtattgcacgtgcacttgttcaccacccagaaattttactgtgtgacgaagccacctcggcacttgatcctgaaagtactgccactattttggctttgcttaaaaagattaatcaggaacttggtctcaccattgtattaatcactcatgaaatgcaagtgattcgagaaatttgtgatcaagtcgtggtgattgaccaaggtgagattgtagaggctgggcaagtttggtcggtattttcacgaccagagcaacaaattactcaagaactattaaaccttgagcaaattaccctgccttttaaaatcagccgtctacccgatgaagattcgactcatattattgtaaaactgaaatatgaggctgaagcacatcaggttccagatatccaagaactacttgccaaattcaaagcacccgtcaatttataccaaagtcaggtcgataccattcaagggcacattattggctcacttttagtcggtattcctaacgtagaaattgatctttcatctatacaacaagatgcattaacagcaattgcacaatttgaggtacttggctatgcaagaccagctcattga

SEQ ID NO: 2780 - DNA, 432 bp, Acinetobacter baumannii
aaggtgcaggtcatgggaaaagttaataaaacagaccgagaatggcaaagagagttatcacctgaagaatatcggataacgcgacaaaagggcactgaaccagcatttacggggcaatactggaatactaagcaacatggcacatatgtttgtcgttgttgtggcgcggaattgttttcgtcagatgcaaaatacgatagcggttgtggttggccaagtttctttcgccctctgaatggaagcgttattgatgaacatgaagatttaacgcatggtatggtcagaacggaaattgtttgtcatgattgcgaagctcatcttgggcatgtttttgaagatggaccacagccgacaggtttgcgctactgtgtgaactcggcatcattacaactgaaaacacaagaaaaaaatgatgaggaaacctatccatga

SEQ ID NO: 2781 - DNA, 747 bp, Acinetobacter baumannii
gcactaagggtgtatgattggcaagattttgagccatttaactttaatatgacaaatacattttctgaccacaagcaagttgaagtggtatctacttttgctgaacttgtgaatacacattttcagggaaataagaatgctatttgttggcacagaaatttggtgggcgactttaaagaaattgtggctaaacttgagttaaaagaaaatattaccgaaatttctactgaagacctgttagcacttgagctttcagaacaaggtgatttggctcgagatattattttaaaagacatgcagctcttaactgatatgggtgcatcacctgtacttaatttacttaagcattatgaacgtgatgaagagctcgattttatttcaacagatgtctattcatttcatgttgatcgttcccctattgaaaccgacacattcttatgtacttatcacggtacgactagcgacattgtgccgaatgatcaggttgaacaaaaagttttaattccagaaattagagaaaagctcaaagctttacatgacggcccagaagccgaatttgaaagctttttagcagagtatttttttgatttacattatcagcctaaacccgatgcacaacctataaatttaggtattggacatatttggcgtttagcggtagatcatccaactcaaaaggttttaccgtgtgtgcatcgggcaccagttgaaaatgacggtgaatatcggttgctactgatttgttag

SEQ ID NO: 2782 - DNA, 1140 bp, Acinetobacter baumannii
gctcaattttttggtaccattcaccatttgattctgtctaaattttctttgtctatgacttcttcttatcgtcaacaacttcaagctaaaattgatcgcattactactcaattttctgaatttacaccgcctacattagaagtgtttgaatcgcctgaacaacatttccgtatgcgtgctgaatttcgtatctggcatacagaaaatgatatgttttatgccatgtttgaacgtaatgacgatggcaagcaaaaaaccgttgtacgcatagatgagtttcctattgcagataaaagcattaatgacttaatgccacttcttttagcagaacttaaggccaactctttactttctcagcgtttatttgaaattgactttctcgcaactttaagcggagaaatgttagttaccttgatttatcaccgtaagcttaatcaggaatgggaacaagcagctaaagcacttgctgaaaaattaaatattaaaattatgggccgtagccgcggccagaaaattgttattggcgatgactttgttgtagaagaatttgaacttttaaaccgttcatttaaatacaaacaaatcgaaagtagctttacgcagcctaatgcacaagtttgcaaaaaaatgctgcaatgggcatgtgatgcagctgaaggatcaaaaaaacacctattagaactttattgtggtaatggtaatttcacacttccactctctttaaaatttgaaagagtgcttgcaactgaacttgcaaaatcatcagtttatgcggcgcagtggaatatcgaacagaaccaaattgataatattcaagtagctcgcctctcggctgaagagttcactcaagcctatcaaggtgaacgtgaattccgccgtctacaagaagcagatattgatattcaaagctacgacttcgatacagtattcgttgatcctccacgcgcaggaattgacgatgaaactttaaaactattgcagggctttgaacgtattatctacatttcatgcaaccccgacactttatatgaaaatttaaaaacgctcactcaaactcatcgcattactaagtttgctttatttgatcagttcccttatacgcatcatgtagagtctggcatcttacttgagaagatttaa

SEQ ID NO: 2783 - DNA, 252 bp, Acinetobacter baumannii
acaaaatttttcaatgtaaccctattttataaggagattaaatatctccttatttttcaagatgttttaattaagtatttaaatttaaaaaaaatatcaagtcatctattcgtcataatttcgtttaactcgaccattactatcgaaaattctctagttcaactggtggatttatcacatatagagtcttgtattttaatttatattggctatatttcgagctatgttaggttgtatatgaaggctctatga

SEQ ID NO: 2784 - DNA, 372 bp, Acinetobacter baumannii
atttttttattttcaattatttataataatattgaggaggaagaaatgccaaagtatttagctatagcggagaaagtatacaaggaaattaaaaaagataatttatttactgaagataccattcaaaatttaaattgtttaattagcttgattcgcaaagcaattaaaggtactgagttcaaacttaagtacaattttataaattttgaagaatgcttaaatcaatttaataaagaaaaatcagtgcatattgacttaagtctacttcctcgttttgagtatagagatgaatttattttgtggctcactaattttattagaaatattagtgtgcaaaaaaagttcgtaaaacaaaagtactattttaattag

SEQ ID NO: 2785 - DNA, 909 bp, Acinetobacter baumannii
atggatttattttgcagagcgaaatataatggcaaaactattgctttaattatatttgaggatcgaatgtctcaaaacacggaaactgaaaaaccaataaattttgatgagatacgtttagatcctatttcgcatatacatcgggaaaataacccgcaatttattgcttctttagcgcgcggtttagaacttttaagatgcttttctgcaaataatcaggtgcttggtaaccaagaattagcaaaaatgacaggtttacctaaaccgaccattgcacgtattaccaatacccttgtgtcattaggttatttaaaacaattgcctaactcgaccaaatacacactagatattggtgtcttatctttaggatatgcagcattatctaacatctcgattcgtaatattgctcatcaatatatggaagagatgagccagtatgttcaagcgcctgtggcgatggcaacgcgtgaccgcttaaatatggtgtatatcgatgttgtgcaaattgaaactgcattgaatatgcgccgtccaattggttctactttgccaatccatagtagttcaatgggacgagcatgcttggctgcgactcctgaacgtgagcgcaattttctacttgatgcgttgaaacaaaagaatccagaaaactggccagccataaaacgctcattagaacgagctttccgtgattatcaagattatggatattgtttgtctttaggtgagtggcataaagaagtgaactcagtggctgtacctttggttagttctaaacatggtctttatgtttttaactgtggtgcgccaagttttcatttaaatccggaaaaacttgaaggtgaaattggaccacgtttaattcatatggtgcacaatattcaagatgctttgaatgaaacgcactaa

SEQ ID NO: 2786 - DNA, 1413 bp, Acinetobacter baumannii
cgtcacctatttcacggatatgcaaataggtcgattattaaaaagagtttgtatatggataatctgcaaacaaatattgctgtagtgactcagcaaagagccaagcatacaaaaactcgctattacattcttgcgatgatttttttggtcacggcttttaattacggtgatcgtgcaactctctcaatggcagcaacgccaatgtctcatgaactgggaattgactcagtcactatgggatatattttctcggcctttgcatgggcctatgtgattggtcaaattccaggtggctggctactcgataagtttggtgctcgccgtgtatatttctggagcctgtttttatggtctttgttcactgttttaatcggttttaccgacattttaggtgatactgcgaccatcattacttcactctttgtactcagatttttagtcggtttgtctgagtcgcctgcttttccgggtaacagtaaaattgctgctgcatggtttccaaccaaagaacgtggaactgccgctgccatttttaactcatcctcttatttctcgaccgtacttttcgctcccctcatgggctggcttgttgcaaccgtccactggcagtctattttctgggtcatgggtggtcttggaatcattctttcctttatctggctcaaggtcatttatagcccgaccaatcatccaacagtaaatcctgaagaagtaaaatacattgcttcagaaggtgctttactcgatatgggcgaaaacagccaaaacgctaaaaaagagaaaattacttggagtaaagttaaacaacttcttgcttcacgtatgatgctcggtatttttattggtcaatattgtgtaaatacactgacctattttttcttgacttggttccctgtttaccttgtcaaagaaagacatctcagcattttagaagcgggttttgcagcggttgcaccagcactctgtggctttataggcggaattttaggtggcttaatttcagataagttaattcgaatgaattacagcttaagcttttcgagaaagctccctatcgtagtcggcttcttggtctcaacctcaattatcttatgtaattacgtagattctcaagcagcaatcgtattctttatgtctttatcattcttcggtaaaggaattggctctttaggttgggctgtgatgtctgacgttgcaccaaaagaaatggttggtttatcaggtggaatgatgaatgcatttggtaatacggcaggaatcgtgaccccaattgtgatcggctatatcttggcaagtacaggctctttcaaccttgcattaacttatgtcggtatacatgccatcgcagctgtcatttgctataccgttattgtcggtaaaattcagcgcttcgaattaaaacctacttcttaa

SEQ ID NO: 2787 - DNA, 192 bp, Acinetobacter baumannii
accgttgtatttaaaattttcatcatgaaattttcctttagacctttaagtagtcttaaaagtctcgacatcctttttgttatgtacctatctaaaatagatcctttaaaatttgcctttctttcacaagaaagacgttccctcatattttttagatccaccctccctagtgcagcaaaagcaactttttaa

SEQ ID NO: 2788 - DNA, 288 bp, Acinetobacter baumannii
caggccgtatttacccaaagcacacgaaaaagtctctcttttttgtgggcatccctacgtgccccctctgcggcggaacgggagggggacatcttcggatgtgctgatttttgggtaaatcagtctgctaaccccttttcgtttcgccaccataatcatttagcagtgatgtggcgaaacttctttcttacccaaaggagttcgcacatgcgtactatttcttatttattggcttttgccaaatcttctctatttataccgccgaaacagtctttaaaacggctctag

SEQ ID NO: 2789 - DNA, 237 bp, Acinetobacter baumannii
tatgaggtattaaaaatgagcactactaataatcaagcaaatcaacgcaataatcagcagcaacaacaacagcaaaatgacaaccgtaatcaacagcaacacggtaaccaacagcaaaacgatcaacagcaacaaaataaccagcaacaacagcaaaatgataaccgcggccaacaacaaggatctaatcaaaaagattctggccaacaaaactcaaataacaaccaacaacgttaa

SEQ ID NO: 2790 - DNA, 864 bp, Acinetobacter baumannii
tggtattcatttatgtttgaccctcgtcttcttcgtgcatttgtaaccattttcgaaagtggtagttttacagccgccgctgataagttgcatctgacacaatcaactattagtcagcagttagcacgcctcgaagaatcggttggtcactcccttattgatcgcacagcaagaccattacaattaacagcttcaggtgaatatttaattggttatgctcaaagaattttgacgcttcaacaagaggctgaggcggtcttaaaagatccagctggcagcaaccctattcgaattggattgccagaagatatgatgagtactgctatggcagaagttttcggtctattcgctcaagaacatcgtactattcggttagatgtcacttcaggcttaagccgcaacctgacagagcgctatcgtaatggtgaactagatattgttattgtgaaagaatcagcagccagcgccgattgttatgcctcttttcctgaagaaatggcatggtttgaaagtgaaaatgcgattacgcctttgtctgaaccaattcgtttagtgacctttcctcaaggtggactttaccgagatgaaatgtttgagacattagagcgtgaacgacgacgttggtatattgcttttacaggaagtagtttagaaagtgttctagtaagtgtcgaaacaggtttgggaatatctttactaccagttagtaccacaaaaggccgtcgtgtacgtagatataaatctttaggtgaagcttcacctatggttgtttcaatttatacatgggaaaaagctgggttgatttcccagcttgtcgatcacatgactaccgttttacatgatcgcttccaatcaggctcctag

SEQ ID NO: 2791 - DNA, 756 bp, Acinetobacter baumannii
gctaagtcttttgacttagcttttagagaattcgccatgtcagcatatacgataatttttgcacctattgctcaagcaactcgttcggaacaagttgtagaacgcttggaaaatgcaattatctctggtttgctcaaaagcaatgaacaacttcctaatgaagcagacctagcacgcttaatgggagtttcgccaattaccgttcgcgaagcattaaatactttacgcgtaaagggtttaattgatacacgtcgcggaagaaatggtggaagttttgtttgtgagctaccttcggatttacttttaaatcaacatcctttgcgccaagcttcaaatgagtatcttgccgatttaggtgagtttcatagtgcaattttaagtcatagtgcctatctggccgctcaaagaacaactgaatacgaacttaacaaaatcaaagagttaattgatcaatttaaacaagctgttgaagcagatacacgtgcacagcttgatttacgttgtttactcacactcacctcatttgcccaatcttcaagactggcaaatcaggaactcacgattcaggctgaatgggctccactcattgccgtgctttatcaagatgatgattttcaccgtgaagttgtaaaacaatatcaccatcttttgtcgtcttttattgacaacaatgaaaatgaagctgttattcaagccagaaaaatagtttcaatgctcactgaccaaatgcttcgatataagttatcgagtgaataa

SEQ ID NO: 2792 - DNA, 228 bp, Acinetobacter baumannii
aggggtgcatttatggcgaatacagcggtcgtcacttcatggaaatacaatgcgacatcgcgtcatttaaaaatcttttatagcgatggctcaggagatctttatcatcctgttcctgagtttgtttatgacaacttattacgttcaaccgataaagccgcttttgtacacaaatacttagaatttaatttgcactttacccgactctctttggtgattgcctcataa

SEQ ID NO: 2793 - DNA, 759 bp, Acinetobacter baumannii
ggtttggcattaatgaaaatactagtactgtgtatcgtgaacttcataatctttacacaatccgctttagcactagagtatcggcagattagaaatactactgatgatcagtttgaagtaattgaaatttctaatttagaacaattacgcttatttctgaaaaatccgcaaactgatcaatattataaaagtttcgacaatattcaatatcaacttaaagcatgtgaacagcttacttttgcgatgaatggaggcatgttccattccggtttttctccagtaggactatatattgaaaacggacgagagagccaacctttaaatgaagataaaggctggggaaacttctttttgcagcctaatggagttctagcatggaatgacaaacaagctgttatattgacaactgaacaatacaaagcaaaagtttttcaacccgattatgctacgcagtccggccctatgttagtgattaatggcaaaataagtcccttattcttggcaaatagcgattcaaagaaaatacgtaatggggtaggtataaaaaataataaattgtattttgtgatatctaaaaatagagtgaatttctatagttttgctcagttcttccaaaaaaatcttgaagtcgagcaagctctataccttgacggttctatctctagtttatatttgcataagaataatcgaaatgacaaaaaatttaatatggggcctattattggatgggtggatcaggcagattgtagacccaagtaa

SEQ ID NO: 2794 - DNA, 309 bp, Acinetobacter baumannii
gattctaaatttagttttcctgatttccttataattgaaaatcatatttttttagcgagtgagtttgatcaagacaaatttaataatttgcgaaagatggaagagataaatagaacacagttttggatgaatctcatagaatttacaagcctacatgatgagatgacagtggagcaggctttattaatcgcgcaaaaaatcgttgattcttggaatgcaaaaattaaatatgaaggattaaatgcgcatggtagagctagagtttttgaagaggttgaatatggggagatatttataacaattgattag

SEQ ID NO: 2795 - DNA, 507 bp, Acinetobacter baumannii
atatataaattttatcaatttgagtttttaataatgattttttttgaaccagaacaataccaacaaagatgcactcagctttttaacttataccgaaaacaaatttccgctctgctaccatctgcccaaattgagcatataggttcatctgcaatacctaatgcattctcaaaaggtgatttagacatttatattgaggttctacccgatcaatttgagtttgcaatagaacagttaaaaacgcttaattttatagaaaagcaaaatacattaagaacaaatgagctttgcatgctcgagtcactcaacaacgatgatgttgcctttcaagttgtagtaaccggttcaatattcacatttttcttaacctttagagataagcttatagcttctccaacattagttaatgaatataatcaattaaagttacagtccacccacttagatcatgaccaatatagagcagtaaaatctaattttattgaacgcgttttaagtcactcctag

SEQ ID NO: 2796 - DNA, 186 bp, Acinetobacter baumannii
ttgggcaaatttaaaagtcattcaacgaaaagttactggcctcgatttcaggtcagtaacttaaataataaatataagaaaaaattatctcattcgtttgaggttatacgtcacgactccccaaataaccagttcttgcccctcttcaatataaatattttgataatcaggattttctgcttttag

SEQ ID NO: 2797 - DNA, 447 bp, Acinetobacter baumannii
gaagcaaaatttatgaaaaaaattatctttcttggtttagcgcttgtttcgttaacggcttgctcatcagtacaacataaagattcaactcctccaaaaattggttcaccaaatcctgctagtcaatattgcgttgaacaaggcgggaaattagaaattagaaatgaagcaaatggtcaggtaggttattgccatttgccaaatggacaagtcgtcgaagagtggaaattattccgtgataatcaggcgaactgtgtttcagaagaagctcaaaaattagttgggcaatctggtttaaccgatgatcaaattaagcaaaaaacgaagtcagaaattattcgtaaagttgctccaggtcaaccgatgacaatggattatcgttcaaatcgagtaactgtcacaattgatccaacttctaaaaaaattactcaagcaacatgtggttaa

SEQ ID NO: 2798 - DNA, 891 bp, Acinetobacter baumannii
atgctgaaattgggccaaaactttggttccctggctggaagtaataacggaaagattatggcgattcagttcaaacagcataagccttggttactcggaattacgattttaatcgtagttctgggccttgtcggttaccgttatattaaaaataaacaagccgatgatgttttaacgattggcattagcccgccttatgctgagctattacaaagcgttgccaatgaagtagaaaagcaaggcgttcatgtcaaactcgttgaattttctgattggcgagcacccaatattgccgtacaaaacggcgatattgatgcaaactttttccagcaaagcgtatttctacgtaatgctgttaaagaaacgggttatgacttacatgcatttggtgtgggttcaggaagtcatgtgggtttatattcaaaaaaatataaatcacttgaagatttacctttaaatgcacgtgttgccattccaaatgatccggttaatttagcccgtgctttaattttattgcaccgtgcaggtttaattcagcttaaagatataaataatgaactttcaacaacccaagacattatagctaatcctaaacagctgagctttgttgaggttgaaggcccacagacagcacatgcatataacgatgtcgatttaattttcggcttccctcactacttaaaaatggcaaaggtaaccgacccacatagcgcattatttttagatccaatcgataaaaaatatgcaattttgtttgtgacccggcgcgattaccaagacaaaaaccaaaaactcgcaacctttgttaaagcattccagaactcaaaacaagcacaagacattctggataaagactttggtaaaggtatgtggtttcaaggctggaaataa

SEQ ID NO: 2799 - DNA, 201 bp, Acinetobacter baumannii
tttattgaattggttactgtaaataaaacgcctgggcctgggcttgataaagtaagaaaagcaatggttataaaaactaaaagaccgctcacgttgatacttcctgtttatcatcaatatgttaattgcatgcctactttaaagcagaataggaattatgtatacagacaagtatgtataatttataaaaaagtaaattaa

SEQ ID NO: 2800 - DNA, 2955 bp, Acinetobacter baumannii
gcaaaatcttctcataatgccgtagatctttttgagaaacactacaatattctttatgacggtttaaaagggggcagttcaactcatcttagccgtcgacattctcaaaatatctcacctagtgtgatgactttcccattagaatttaagaccttaaaacctgcattaaaaagttttattgcgacactgtttgaagataacccttaccagttccaaccagttttccgtgggttttatttcacaagtgctttgcaagaaggcgtaatagaaagtccaatgactgagcaaattgcacaggaattccagctttcccaaattgctcaaagtgaagtaaaagatcagctaaaaacaacgcctaaccatggttatttcttaaaaggcttgttttcagatgtcattttaaaagataaagatctggttaaacagcatgtcaatacaagcaaaaagcgtcagcgttatattgcatttattggtgctttagctggcgtatccattattctaggtgtgtgggtttggtcatatcgtaacaatcaacaacttattgccgaagttcaagctgatttaaataaagttgttcaattggaaaagagttcaggtcaacaattgtcgactcaattagaggccttacttatcttgcaaagacgtctacaacagttagacgaatttgatgaaaatagaccactaaaatttagttttggtttatatcaaggtaatgagctacgtgaaaaattaaaagctgaatatttaaaaggtgttaagcaaattgttttgatacctacacagcaaaatattgctcagtatttgcaacgtgtaaaaaataacgaagcaactttaaaagcaaatcataccaatgttgagatcaagcaaactgctcaaactcagcaatatttagagccttcggataccaaccctcaagatgcttataatgctttaaaagcatatttaatgatgagcaatccacagtatatggatgcaagtcacttaagtgatcaggtaacgcgtttctggcgttcttggcttgatgccaataaagggcagatgccacgtgcagatatgatccaagaagctgagcagatcttatcttatgcaatgacattggcaaatgataaacaattcccgatcttggatgctgactctcaactcgtggatcagacacgtcaagtattgctctctgttattagaggtatgccagcacgtgaccgtgtttataatgaaattaaaatgcgtgctgctgtgcgctttccagctttaactgtaagccagattgtaggtgatgcaaataaaaatattgtattgggtagttatgcattaccaggggtatttactcaaaaagcttggaacgagtatgtagaaaaagcaattgaggaagcagcagacaaacctacggatactaaagactgggtgcttaatagccgtcaatctgatgatttaactttttctggtagtccagagcaaatcagaaagcagcttactgcattgtataaacaagaatatattgcagagtggagaaaattcttaagtggtattcactatgcaaaagcaactcagtttgctcagcaagttaaaaatattgatgtattgggcgaaccacaaaattcaccaattcgcacacttattgaacgcgtagccattgaaacaaattgggataatccggtcgttcaagccgagttagcagcacctcaaaaaggatttattgcatggtttaaacgtaaggttttaaaccatgatgataaacaattagcaaatcagactgtaacgaatgctcaagggcctatttctcaagaatatcaaatgttctatcaattggttcgtaaacgtgatgatcagcaaggtaaatctttgcttgatgaatatatgacgaatcttgccttagtacgtagtaagtttaatgaacttaagaatgcgggtgagatcggaccgaatgcgatgacattggttaagcaaactttaaatgagcagacatcggtatttaaccagactcaaaaaattgtagatgaaaagatggcggttggtttcagtgaaattgatcagcaacttctacaaaaattagtggtgagtccacttacccaagcctttgaaagcttaattacacctactcaagatgaaattaataagctatgggtaatgcaagcttatcaaccatttactgcaaatcttgctaagaaatatccatttaactcatcagcttctttacaagcaacaagtagtgaaattggacaaattcttggtgaaaacggcagtatttcccgttttgttaaagagagtttagatccgtttgttatccgccgtggttatactttaacttcaaaaacatggaaagatttggggattagtttaaacccacaatttgtcatgaacttccaacgttatgtcgcacctacaaatggaatggcaacaggtgagttaaatagccaagcaccagctgctccggcaaccaatcagtctaacttccagttctacccaattcaaaacccgcagttactttcatataccgttgatattgatggtcagcgtatgacttatgaaaatggggtgcagcaatgggttaactttatttggccaaatcaaggcagtattccaggtgctcgtattacggctgtagatttacaaggtcaaacacatactatttttgatgaaccaggcgaatacgggattaaccgtttaatcgatagtgcacagcgtaaagagcaaaacggtggttttgaaatgctttggcgcagtaagacagatccatcactctttgtgaaaatgaacttccgtcttattagtagtaattcaggaagtatcggttcaagccgtggctactctggtatgcaactggttgacaaagtaactgcggataaagctgctcgcgttgtatccgcacagcaagcaccagctcaggctgctgctcctgccaaaactgaaaatccagtttctgcactagcacaacctgctgcgggagttaagccatga

SEQ ID NO: 2801 - DNA, 300 bp, Acinetobacter baumannii
tatgaggaattcattgtgaatattcaacaaaaagatgatacaaaacacggcagctttagcttacttgatggtgaaaccgttgcaggtgaaatgacttatacatgggcaggcgaaagcatgctaattattgatgccacagatgtaaacgaaaattatcgtggacaaggtgtaggtcgccaattacttgatgctttggtagcttttgttcgtgaaaaagacgtaaaagtaattccgctttgcccatatgctaaatcggtttttgataaagacccaagtattggtgatgtacttagaaaataa

SEQ ID NO: 2802 - DNA, 2172 bp, Acinetobacter baumannii
tatttcaattcaggggttcgaagtacaaccatgatgacaaaaataaattaccagccttggctacaggcggtcttaactattgctaaacattatcgaatagagccttcagaagaaagaattcgtttacaacttgattggaaccaaaatcagaatttagataacgtcttgcagttaatgacacgtcaagtcggtctgaatcttcgtaaggcaccattttccttagacttactcaacccatggcgtttacctgtcatggtggagtttaatgatggccaagtcggtgtaatcgataaggccgatacacaaggaaatgtgagtatccagttcagtggagatcagggcctttcgcaaagtttatctttagacgctttaaaaactacacttaaaaatgtctatatcttgcgtcctgaaacgtctataccagatgcacgtattgacgaatatatcaaaccttatgaagccaactggttctggtcaatcgttttaagagactggaaacgctacgttgatattatgtttgcctcgctgattgccaatgtgctggcactggcaaccattattttctcgatgcaagtgtatgaccgcgtggttccatcccagtcaattcccactttatgggttttggcgggtggtgtactgattgccgctctttttgagtttaccttacgcgtttcacgagtatatttatccgatattattggtaaacgtgctgatttacgtgtgtcggatcgtgtatttggccatgccttaagaattaaaaataaagatcgttcaaaatctacaggtagttttatttcccaaattcgtgaactcgaaagtgttcgtgaactggtcacctcaactacaattagtgcgattgccgattttccgttctttttcctgttcttagtaatttttgccattattggtggaaaactgttctgggtaatgctacttgttgtgccgcttatgatcttgccaggtattttggtacagaagaagctggctcaactggcacaagaaggcatgagagaatcttcaattcgtaacgcaattttggtagaagcggtacaaggtattgaagacattaagctcttacgtgctgaatcacgtttccaaaaccaatggaaccatatgaatgaagtctcagccgacattggtatgagacagcgtaaaattgtgggtaccttaatggcttggacccaaatggttcagggtttaacttatgccattgtggtgttagtgggctgttttgctgtaatggacggtgaaatgaccacaggtgcgttagtcgcatgttcaattttatcttcgcgtatgttagggccaattgcccagattacgggcgtattaggtcgtctacaacaggcaaaagttgctaagcaaagtttagatgaacttatgcaacgtccgattgatcaggctgaccgttcacatctggtacacaaagctgttttaaatggcgactatgaattaaaaaatatcttgttccaatatggagaagaagatccgagaccaagtcttgcgatccgccatttaaaaattcgtgccggagaaaaaattgcgattttgggtcgtaatggtgctggtaagtcgacattgcttcagcttttatctggtatgcaagttccaactcagggagctgtgcatttagatggactcgatctttctttaatcgacccatcagatgtgcgccgagatatggggctactcaaccagaatgcacatttattctacggaacaatccgtgaaaacctgactttaggtgcaccgcttgcaacagatgaagatattcttcgtgcattggtggtaacaggtgctttatcttttgttcaagagaaaaaagaaggcttggattacttggttttagaaggaggcgttggtttctctggtggtcaaaagcaagctttattgctggcgcgtttattgattcgtcaaccgaatattttattgcttgatgagccgacagcagccattgatgatgttgcagagaaacaattaattgatcatctcaaaggatggttagcacaccgaacgttggttgtagcgacccaccgccgagctgttcttgaactggtggaccgtattattgttgtcaatgaaggcaaaatcgtgatggatggaccacgagatcaggtacttaatcaatctacagcccaacaaaaacaagtgagccaagggggcaattcatga

SEQ ID NO: 2803 - DNA, 483 bp, Acinetobacter baumannii
tatccaaattctgacaattactcatgtcaaatttactttagagggaacaagatgttaaaaactcaaaaaatcaacatcgtacaagaatttgatgcacccgtagacaaggtctttgccgccttaagtgaacacgaaaacctaagtaaactttttgcccctgctaaagtcactcgcattagtaatggtaaggatgcacgtaacggcgttggctctgcacgcaagatgtctattccgtttacaccttcatttgttgaaacaaatttagtctacaaagaaaatgaactgattgagtatgcgattacaagcggcattagcccaattaaggcacaccgtggtgtgatgcaatttacagacttgggaaataaccgaactcgtttaaattacaccattagctttaaaggtcgcgttccttttattggcccgattattaaagcggccttagaaaatggcgtgagtcgtggccttaaaaagcttaagttttaa

SEQ ID NO: 2804 - DNA, 594 bp, Acinetobacter baumannii
caggtttgctcaaatatgagtagacctgttttaaatggagggaagatgatattcaatcgtggttcggcatttataatttcttattttttaatttctttagtaaatgcgggtgaaattggagctaaattaactagtcaaattgaattattgccttcttgttctgttaataataatgttgtagaaaataatgcagcaaatttaagttttggaactatagattttggtgaagctaccacagcttttaaaggggttttagaagctaatttagttaataatggtaattcaggttttcagattgagtgtgcaggtatttcgaccgtaaaaataatatttggagcaggaaataatgatagtaatattccagcttcattttcacaaaattattatcatgctttaagtaatggtagagattttattgcttataacttgctctatggtttaaataaacaagttattaaagcaaatgaagcttttattcttaatgatatgaataataaaaagaatatcgatatttttggtcaagcagcccatgatggtagtcgtatatctaagggtgaatataaagatatagtaccaattacgattgagttttaa

SEQ ID NO: 2805 - DNA, 510 bp, Acinetobacter baumannii
cattttggctctcaattattatacaattcaaattatttgcttttcttgccgcttctcatgcttgcccaatttgatgttaatttagttgttttattagttttacttatctgcggtttactaagtcaaaatgcagctgtaaccatcgcagcaggtattttaatcgtcataaaaatcacgccattaaatcaattttttccttatattcaggcacatggactaaacttaggcatacttattctaacaattggcgtactcacccctattgcaagtggcaagcttagtggagagagtattttaaaatcctttattagttttaaatctttggtcgctattgcaattggtctgctcgtcgcgtggctaggtggtcgtggtgtaaaacttatgtcgagccaacctgatgtggtggcaggcttacttattggtacggttgcaggtgtggcgttactccgtggtgtacctgttggcccactgattgcagcaggtctattatctttatttataggtaaataa

SEQ ID NO: 2806 - DNA, 1842 bp, Acinetobacter baumannii
agggcgtttttaatgaataatttattgtcgaaaatgttgggctgtgccttggtctcaacattgttgcctctgcaatttgcatatgcccagatagaaaaagatttaccaaaaaatcatacggtttctttaacctttcatgatgtcagggatgatgtcttaaaagaaggggatcgggatatttatgcaatccaaacgaaaaatttagcacagttctttgactggttaagtcaatctgattggaagcccattcgcttaaaagatattgaagaagcgcgtaaacaaggtaaggaattacctcataattctattttgttaactttcgatgatggtgctttaagtagttatagccgtgtatttccattacttaagcaatatcagattccggcagtatttgcacttccgaccagctggctaaatgggaatacacaagctggctatgaagcttatgggcaaggaaatctagtcaattggaagcaagtgcgagaaatgcaagcttcgggcttagccgagtttgcaagtcatagtgatgatttgcatcatggagtattggctaatcctcaagggaatgaacagcctgctgcgacttcttacgcgtatttaaaatcacaaaagcgttatgaaacggatgcagaatatcaacaacgtattttgcaggacttaaaaaaatcatacgccgttttaaagaaagaagtgggtgttgaacctaaggcaattatttggccttatggcgctgtgaatgagcaattagaaaaattgtctcaagaagcaggctttattttttctttcagtttagggcgtgatggaatgaatagagtgagtgactcgacttttaaacgtagtttagtcactaataatcctacagctgagcagttaacagagggtatgatcaatattctcaactttgaagaattagatttatttaagcaacctcgccactttgtgagtatggacttagaacaattaactgcttcaactaatactcagtcagatgagaaactagggttattgttatccaagctttatagcttaaaaaataacacattgatattgaaacctttagatgatcaagatggcgatgggcagtatgacattgcttatttcccaacaactcaactaagcgtccagcaagatattttgaaccgaactttatggcaggcacaaactcgtgccggacagtcggttattttagagttgcctgtatatcctcaaaaaaataaaccgttcttggtggcagatttagcgaaggatatcgcacgtttcaatagtaatttaagtggtattcaacttaatgctggaaccactttaaattgtgctatgcaaagcacaacaataaaagaaaatacctgtgctgaccaattaaaacagcttacatatgtgagccagcttactcaaaaggctgtgaagccttatttaaacatgagtaatcaggctcagtttagtttattgcttacacctgattttgaacatatcgaaaatttaccaacgcttttaaaaaacctgttatcccaacatgatttagtaaatcttaagttcaatatagtgggtaagcaaaaacagtttaatcacgtattagcacttttaaatacgcttgatacgaaatataaacagcgcattatgctgactttatcattacccgaaaataatcagcaaaatgtctggcaagaagtgaaacaaggtcttttcaatattcagcgcataggtattcagaaatttggtattgatggctataccaatgaaaactcaaaaaatgttcatgaatatttatataacccgattagcttgaattcgagttcggtcatgtatcagccctttgcaggtctcgcgactgaggggaaaaagtaa

SEQ ID NO: 2807 - DNA, 288 bp, Acinetobacter baumannii
gtatttcaatcagaacaagaggaactcactatggaattaaaagcttatttacatcgactagaaaacattaaagcgattcatgatctacatgcagcaggactcgaccatcatgtgattgccgtgttcttgtccgccgaaggtatttcaatgacagctcaggaggtaactactatcgttaatacttatgacgccttaggtaaagtgaaattaccaagtaaaaaagtgcaggcactgatcaatgccaaaaaacttggacaaaatgatgagaccttgccgtgccctgtttaa

SEQ ID NO: 2808 - DNA, 186 bp, Acinetobacter baumannii
aaaaataaatctggtttaaaaccatataaaagtgtgtgtccaccgcacttttataatcgctggaaaatttcagcaaccgccttctggggcggttttcttttgccatatacatacttaaacaattacatcataaaaaattccataacttatctgtatagcatgttaagtttttctacacatctataa

SEQ ID NO: 2809 - DNA, 951 bp, Acinetobacter baumannii
ttttacatgtcaaaccaattgcccgtcatcaatttaatgggaccgactgcaagcggaaaaaccgctttggcatgtgaactctatgaacgtggaaattttgaattaatttcagttgattctgcacttgtatataaagatatggatattggtacggctaagccaacacgtgaagagcaggagctatacccacatcatttaattgatattattactccacttgaggtctattcggctgctcagtttgttgaagatgcttgtgctttaattgatgagatgcattcacgtggcaaaactcctattttggtaggaggaaccatgctgtatttcaaagctctcttagaaggattatcaagtaacttgccaagtgcagatgcaaatgttcgcgcagcaattgaagaaaaagcagcaaatgaagggtggcaagctgtttatgatgagctggtggcagtagatccggcggctggagtaaagtttaaggtttctgataagcaaagaattattcgggcgttggaagtttaccgtattacaggtcaaccaattaccaaattgcaggcagaacaaccaaaaaatgtaccatatcgatacacatttcataactacgctttacttccagatcggttagaattacatcaacgcattgagcaaagattaagcaaaatgtgggatatcggttttttgagtgaagtcgagtctctaattgaaaaatacgatttagatgaaaatttaccctctatgcgttctgttggttatcgacaagctctagaatttctattaaaaagtgatatgagtctcaaaaaaaagcaggaaatggaggataaagccttatttgcaacacgacaacttgccaaacgtcaatatacgtggttacgttctttgcaagaaatacacgattttaaaacttacttgacgataaagcaggcgaaagaagacttgcgaaactcttatggataa

SEQ ID NO: 2810 - DNA, 489 bp, Acinetobacter baumannii
ccgaggcttccgtggagatcattcatgaaaaatgatgcaaatatcgacgtagaagttttagatatacctgaatatattgatcagcctgaatatgtgaaaaataaaactgcaaactatacgttacaaacaataggttggttttgtttaatgtggctgctttttccactcgtttcattatttttatggatttttgaagggcatctcatctatgactatgtgtgggtagatcatgtttcagaagtgaaaactttattgcatttacttctgttaataggtctgagcgcactcattttaattttatgggcaagttataactggcttagatttcatggagatgatcgtggcagcaaggccccgaatagctctgttgagttgctggcctcacaatttatggtcagtaccgaatcattatcagaattacaaaagtcccagcgcatcatcttacattatgatgagcaggggtatttaactcgatatgatttgaaatga

SEQ ID NO: 2811 - DNA, 1704 bp, Acinetobacter baumannii
ataatgattccattaatcccagtcaataaaagaacaatgagtatgtctgaaaacaaaacaaccagtgagacctcagatcatcatgaaacagatgttgaactggaaaacatgaatgatttaccagaaccccaagaaaagaaaaatcggtggaagcctctactaatctggattattccacttattgcgctgctgattgcgctttctttggcggtgaaagcattactttctaatggaccaaccattgaagtatcttttcgtaccgccgaaggtttagtcgcaggtaaaacgacagtacgctataagcaggtagacattggggtggtacggcaaatcgatcttgcagaagaccgatctcacattattgcgcgcattgatttacgtaaggatgcaagcaattttgctgctcaagattcacggttctgggtagtgcgtccacggattgggacaagtggggtttcaggcatcgacactttattgtcgggttcatatattgaagtggatggcgggaaatcacccgagaaaaaacttgaattcacaggtctggaaataccgccagtgattacctccgatgtgccgggcaaagagtttttcttgaaagccgatgatttgggatctttagatattggttcgccaatttattaccgaagaattaacgtaggacaaattacagcttataagctatctgatgacggtaaaagcgtagaacttcagacgtttattcgtgcgccgtacgataaatttgtaacgactgacacacgtttctggcaggcaagtggtattgatgtgacgttaaatgcttcaggctttaacttagatactcaatcgcttgcaagtattgtggctggtggtattgcgtttggtttccctgaaaactcaaatgcgactgtcgctgctaacaagagccgttttaatctttgggactcaaaagctgaagcattaaaagagccggatggtctaccgcgtggcgtgattatgtactttgatcactcattacgtggtttggctgtgggtgcgccaatcgacttcatgggaattgaaattggtagcattaaatcaattaatgcagagttttataacaactataagcagattcgcatgcgtgttgaggcagtgatttatccttcacgtgttgaaaacggccaagcacttaatccaaacagcgacattttcaaagattttgttgagcatggatggcgtgcccaaatgagaaccggcaacctcttaacgggtcaaaactatattgctttagataagttccctaaagcaaaacctgccactctacaaatcttgaatgatggccgtgtggtaattccaaccactgcaacagagttaagtggtttacaggcacaggtttcccaaattgctgataaattaacgaaattcccactagtcgaaattgggcaggatgttcgcaaaacgcttaagaatatgaatacagccattgagtctaccgacaagctggttaaacagttagatggtaaagttgctcctagtttacaagcaaccttagacgatgttcgtaaaactgtaagatcgtcagagtctattttgtcgagtgatgcgccgttacaacaagacgtacgtaaagcactacaacaaatgactcgtgcggctgcgtcattacagttaatggcagactatattgaacaacatcctgaatctattattcgtggtaagagaccagaggctaacgatgaaaaataa

SEQ ID NO: 2812 - DNA, 684 bp, Acinetobacter baumannii
tcgttaactcctcacaaggaggaggtattaaagatacatgggtcgttgaaacgctacattcttaatggttggttaaagaggaaatttatggttttactcaattcgagtgcgcaccacatttattggttgggtcgttatttaatgcgaattcaatttgctgtatcacatttgccatttacagatgatgctaaagcagctcaatttgcagcagcatttgggctagtcattgatcaagcagaattactgaattgctatatgttggatacgaaacaaacatattcgttactgaatcagttcgctattgctaaagataatattcaagagttaagaggaatattatcttcaaatgcctatgcagaattaaatcatgcgattaagggagtccaagctcatcctgattcattaaagcaggctttagcgaaatgtaatcaaatacttgatgctgaacatgaagatatagcattatttctgcatttaggacaaaagatagaattatttgatatacaactacgttttcagcaagaccttacacagctcttgcaggagttagaacaattacttcaacagctgaatgacttagggtggaataaattaactcaaccatggcaattattaaaagatcatccaaattgggaagcttattataattttacccagcagttggaatatatgttcgaggcataa

SEQ ID NO: 2813 - DNA, 231 bp, Acinetobacter baumannii
cacctaaaacccctccgattatcctttgcctgctggcctacattgccagttggttttagcagaccattagccaaagaacacgaaaaagtaatcactttttttgtgggaatccctgcgtgccccctctgcggcggaacgggagggggacaccttcgggtgtgctggattctttggctccagtctgctaaccctctttcgtttcgccaccattatttagcagtaatgtggtga

SEQ ID NO: 2814 - DNA, 1506 bp, Acinetobacter baumannii
ctacggatgccactggacggcaagagcattaccaaaaagccttactatttttcatccaagattctggcaaaaggtattaatgagttttcagtggatgttggggttccgcgctataactatggcctatactcgaacgattatgacgatgctacctttgcatcaggggcaattcgatatggttacagcaactcattaaccttaagcggtggggtggaggcttcaacagatggtttgtctaacattggaacaggctttgccaagaacctgttcggtattggggtgattaatgctgatattgcagcaagccagtataaagatgaaaacggttattctgccttgttgggtttagaaggtcggattagtaaaaatatttcttttaacaccagttaccgcaaaatattcgataactattttgatttggcacgagtatctcaggttcgatatttaaaagataatcagagcgatgctgagtcacaaaactacctcaactacagtgcgctggcagatgaaatttttagggcaggaattaactataacttttatgcaggttatggggcctatctggggtataaccagattaaatatagtgataatcaatataaactgctatcggccaatttaagtggaagtctgaacaagaactggggattttatacctctgcctataaagattatgaaaatcacaaggactacggtatttactttgcgctgcgatatacaccttcgaataaattcaatgccattactagtgtttctagcgacagcggtagattgagttatcgacaagaaattttcggtttgtcggacccgcaaattgggtcatttggatggggaggctatgttgagcgagatcaagataaccacgacaacaatgcatcaatctatgcctcttaccgtgcccgtgctgcttatttggcaggtcgctataaccgaattggagataacgatcaggttgctctttcggcaacgggatctttggtagctgcagcagggcggctctttgcggccaatgaaattggagatggatatgctgttgtcactaacgcaggcccgcaaagccaaatcttaaatggtggagtaaatttaggctttacggataaatcagggagatttttgattcctagtctcatgccatatcaagagaaccatatttatttagatccttcattcttgcctctaaattggagcgttaactccactgaacaaaaaactgttgtaggttatcgccaaggaacaatgattgattttggtgcacatcaggtcatctcaggattagtgaaacttgttgataaaaataactcaccgttattaccggggtatagcgttcaaattaatggacagcaagatggagtggttggctatgacggtgaagtgtttatttcaaacttattaaaacaaaacaaacttgtagtcgatcttcttgatcatggctcatgccaagttgactttacctataacagtaatcagtactcaactaaaaaattgggaccttatgtatgtcattaa

SEQ ID NO: 2815 - DNA, 237 bp, Acinetobacter baumannii
ctaactcagcctctgttggatcaactgcaacagcttcatgagtctcagtatcttctaaaatccagatatagttttgtagggcattttgcacatcaatataatgaattctataacgcatttttttatcctgaaactaaatccaaaagcagtatctacgggctaattttgataataacagaaattaccttgagtaacctgtctaataaaatgctctataaattagactctctaaaataa

SEQ ID NO: 2816 - DNA, 207 bp, Acinetobacter baumannii
gtcgtaaagttgcccaagatcgtaactatgatgaccgttatgaccgtcgttatgatcgtgatgaccgtagatattatgatggtgatcgccgctattacagaggtggtaactaccgtcatgacaacggtttacaccgtggttggtacaaacatcgttaatttatatatcaatctaaaaaagcaccctagtggtgcttttttattttag

SEQ ID NO: 2817 - DNA, 1332 bp, Acinetobacter baumannii
ctatactttaccatctcgatatgggactattcgattctcaaaatgctaaagaaatgtgttttttcattggtctatctcttgccaattcaattatacgctgctcaggttgatgtattgcgtgaacaagctattcaaaattatagagcaggacaaactcaacaagctgtatctcaactagatcaattgctaaataaatacccgcatgatcaaaagctgcttgctgattatctgtttattatgtcaagtgaaaaaagggatcttacaaatttttcacggtttttggtaaatattaattatgtagactttccagaatatgcaaagttacctttaattcaaaatttccgtgattttaagcattttaaaactgcaattgactggtcaaataagttcaatattcaaaagtcagttgatggccgtattttattatcggttttgtatgctgaagctcaagatgtggcgaatgctaaagatcagttgtcgaagatcgatattaaaggtttaactgctgatcagttggtacgggttgcatatgcttatcgtttaataaatttaccagtagatgctttagctacagttgagcatgcttatcaacaacaaccaaaatcttcatccgttttacaagaatatgtttacgatctaattgctattggctcatataaaaaggcacagcaattgctgcaagcgagcgaaaaaactgaacaaacagtgcaaatgttgcagactttacaagttagtgagttttctcaacatatcaacaatgcaattgctcgatataaatatttaaatcgtgaaggactagccgatgccgaaagctttgctgaattagataaagtgctggagcaaggacaaaaaatacatcagcaaatgaatccttccgatcctaattacttacggttttattacgattatttatatggattagattttagagggcgttcaaaagcagttatagagaatttcacccagttgaatattccactcgaaaaattaccggcatatgtacgtcatgcaattgctgatagttatttggcggggcaaaaaccgaaaaaggccgagtttgcttataaaacgcttttaaccgaaaagaattatccggatatgaccgtttatacgggactgtattattcttatattgaacaagaaaaatataaggaagctgaacaacttctcgctgaagttgatcggcttattccaacttataaatatagtcaggctaagggtgtagataaaatcagccatcctgatcgtgatgattatattgctttacaaggaatgcatttagcctacgctaatcatctggatcaagctgaaaagcattttcaaaaaaagtag

SEQ ID NO: 2818 - DNA, 651 bp, Acinetobacter baumannii
aaatactttacccagactccttgcttggttatttatattaaaacgataaaaatcatcataaatgaaaaccaaaaggacttttggaaaatgagtattgaccttaaaaataatgtcgctaaatcagctatttttcaaaatacagttgaggattttgaagccttcactggtcaaattctgccatcaaataaacttaaagaatttgatttttctcatttaaatgtagccattattggaacggatcaggagaccgtaacgcatttagaaaaaatctgccaacaggcaaaatttgtaacggtatttcaaattacgcctcactttattttacctcacagtcaaatcggtatacatcgattaattacccatccacttattgccaagaaccggaggttatttaacaatcgtgttaaaagcatcttagctttacgttttcttgaaacccaagtaaatgaaacatggcttaaacgacttttgacgcccaataccgcacgggcaaataaaatattttttaaatcggatagctactatactgcactgcaaagagcaaattgcaaactacaaacttggccgattgtaaaagttatcgatacagccatttatagtatggatggcactcaacgacccgttgatatcattatcagaactactccttaa

SEQ ID NO: 2819 - DNA, 444 bp, Acinetobacter baumannii
atagtacttacaggctggataatgatcaaaattgatacctttgatactatgcaaataaagaagtcctttaccacactaaaagggcaagaaagaataaagcagatcttaaaaaatgctgaaatagtttttcttactaaaggttattccggatttagtatgagaggagttgcaactcaatcaaatattagtttaagtactttgcaacattattttcaaaataaagatattttattaaaagctttacttaataaattaatttgtgactatatacagcgtattgaaattttaattaatttgaatgcaaatgaaccacctttaattcggtttatgaatattatcactaatataatttatgaaatagagggcgaattcaaacatgaggtgcgacagtttcaaaagccatatgataatcaacaagctgagcaaatttctctaatggtgtaa

SEQ ID NO: 2820 - DNA, 1371 bp, Acinetobacter baumannii
aagatgcttacacgttttttactgccgattttgggcactaccgttttagttacaggctgtgcttcgtcctctcaatatccgattaacgagagttatggtccagagccaaagttgcctgaaccgaaaacaagcttatttccgaccgtaaatatagcaccggcacaaggttggccaagtggtgttatgccgactccggcagaaggtttaaaagtaaaagcatttgctaaaggacttgagcacccacgttggctctatgtattaccaaatggtgatgtgctggtggctgaaacggatgctccacctaaacctgaagacagcaaagggattaaaggcaagattatgaccttcgtaatgagacgggcagggtcatctcatccaagtgcaaaccgaattagtttactccgtgatacgaatggcgatggtatagctgaccaaaaaacggtattccttaaaaacctaaaatcaccgtttggtatggcactggtaggaaatcatttatacgttgccaatacggattcactcatgcgttttccttaccaagaaggtgaaacccatattacttcaaccggtactaaagtattggacttaccgggtgggcctctaaaccaccattggaccaaaaatgttattgccaatcgtgaaggtacaaagctctacattaccgttggttccaatagtaatgtggccgaaaatggtctagatcaagaaaaaggccgtgcacaaattatggagtttgatattgcaagtggtcagtcacgtccatttgcaacaggactgcgtaatccaaatggtatggcttggcagcctcaaagtggcaaactttggacagttgtaaatgagcgcgatgaaattggtagtgatttagtgcccgactatatgacgtcggtacaagatggcgctttttatggctggccttatagttactatggtcaacacgtagatgtacgagtcaaaccacaaaatcctgacatggtagctcgtgcaattaaaccagactatgctctaggtaaccacactgcttcgttaggtcttgcattttatacagccgaactcatgccacaatttagaggcggagcatttattggacagcacggttcttggaaccgtaaaccacatagtggatataaagtcatttttgtgccatttagaagtggtcagccctctggtccaccgcaagatattttgacaggatttttaagtgaaaaaggcaaagcgtatgggcgtcctgtcggggtagcaattgatttttcgggtgcagtattagtcgcagatgatgttggtaatacgatttggcgtgtctcaccagttgctgaaacaacttatgagagtccaacccagcaatccattcgtagttcagtaactcaaccttaa

SEQ ID NO: 2821 - DNA, 444 bp, Acinetobacter baumannii
atgaaagagttaggtaaaaaagaatttttcttttcaatagaaaaatatgaaccgaagaatgatctctttttattagttgttaatattaatggtacttcttttagcaattatgagactcctataaatcttccaattttaattaatgacttaaacttactgctatatactaaccaacgagaaatagactatctccaagtagatactgttaacgaaaacattgagttaattaaaaagttaataaatttagagtatttagaattagagaataatatctatgattttcaaaatagtaccgtaaggaacggccatgaagtatttttcttttttaaaataccaaatcattcattctatgaatctccttcactcataaaagctggtgaaggttatgtggaaactattcccatacaaactgttaagtttgcattaaatgagttaattaaataa

SEQ ID NO: 2822 - DNA, 780 bp, Acinetobacter baumannii
tgtctgtggttcaagtgctggcttgttgaatgtaaagagaacgaaatgacctattgttgtgcgctgagattagaacagggtttggtgtttataagtgacactcgaactaatgccggggtcgatcatatttctgtgttccgtaaactgcatacttttggagtaacgggagagcggtttattgccttgcaaacagcaggcaatttagcaactacacaagcggttatcgggcatttgcaaaatgcacttattttgcaacaagagcctaatttatatagcattaatactatgtttgaagtggctgatctagtcggtaaaaccttgaaaagcgttttagaagatatcagttcagatacccaagaacaaatgaattatgcctgtagtattttagtggggggacaaatcaaaggcggagatatgcagctttataatgtttatccgcaaggcaattttatttgtgccaccacagatacgccttactttcaaattggcgaaagtaaatatggcaaacctattttagatcgagctttatattatgcgatgccattagatgatgctcttcgttgtagtttaatttcatttgattctacattgcgttctaatgtctctgttggtttgccgttagatgcattggtttatagtaaagatagttttgtgattcctatgggtaagcgaattactgaagacgatccatatttttcacaaattagtcggcaatggtcagatacgttacgccgtggtttacaggaaatgccaaaacctacagatgattattggcgctaa

SEQ ID NO: 2823 - DNA, 1443 bp, Acinetobacter baumannii
ccaccaaggttttttataatgagtacgcttatttacccaaatttaaacttaaaagatcctcactttaaggcatttaaaatatcagatgattttattccacagacacaaagtcatacgttcaactcagagctttttttaaaagaagttgatgaatatttaagtttatatcctcacactcagcatattgatatttgtctacatgacttaaacgggcatattcgtggtaaacgaattgatgttaaaagtctaaaaaatctatcgaatggatgctattttcctctttctgtttatgccatgagccttgatgggaaagtgattgaagaaacaggtctgggaaaatatattggtgaaccagatagactttgcctgcccattttaggcagcttgcaacccagtgccttatccccagaattaaatgctcagctttacttatccatgcaagaagaagatggttctggctgtcgctatgaaccacgtaatatattaaaaaaactattaaatcagttacatgctaataattatttccctgtcatggctgccgagctagagttttatcttttctcacctcagcatcaatccgagatatgttcagaaaaccaatgttttgatatagatgcgccaaataattatcagcaagttctggatgaagttgaaaaagcagccctactacaatcaattgaaattaccgctattgttgcagagtcatcccctggacaatatgaattaaaccttcaacacaaccatgacattttaaaactctgcgatcaaattaatgccttaaaaagaattgttaaacaagttgcaagaaagcatgacttaaccgcttgtttcatggcgaaaccaaacttggcaaaggctggtagtggtatgcattttcatatgagtctgcttaatcaataccatcaaaatatatttagctcagaagaagaaaaagatgagcttgcaaccaaattattgagcgcaattagtggactcattgagttaatgcctgcatctatggcgattttagcgcctaatattaattcttatagacgttttaaaattggtcatcatgtgccattagaagccaattgggatactaacaaccgaaatgttgcaatccgaattccatgctcagacgtacaaaatcaacgcttagaatatcgtgttgctggtgcggactgtaatccctatctagtaacagcgactattttagcgggcgcgtcttatggcttatctcataagttaccgctaccaaaacctgctcatcttttaaaatttccagacgagcacattttattagctaacaaccaaccagaagccttaaaaatatttaaaggaagtctgattttaaaaggatatttaggcgctgactttgtcgaacattggtacacagttaagcaagctgaatatcaaaatatttacagtcaaatgactgaagcagaacaacattgggatatataa

SEQ ID NO: 2824 - DNA, 300 bp, Acinetobacter baumannii
gcaactgtaaccatagatgttgttgcgattaatgcacttgctagccaaacattcattttcattgtggaactccatgctcttttcaataacgagcaatctttatgtcttgagctaaatgtaattaaaaatttcgagaaaattatgaagaaggcacatgctgatacgatagttttgtgtctgctttgtattgtttctattaatatgtggataaactatgagcaactatcttggaaaccaaaatttttggttataaaaaaacacccgaaggtgtttttaagccgatttcatcacggtaattag

SEQ ID NO: 2825 - DNA, 1398 bp, Acinetobacter baumannii
aaggatgtaactatgagttatcgcaatattgtcgccaatcaacagtatcactttgctgacctaaaaacgttaatggccaaagctacaccgttacgttcaggcgatgagttagcaggtgtagctgccagagatgcaaccgaacatgttgcggcacaaatgactttggctgatgtgccattaaaaacctttttaaatgaagttgtaatcgattatgaaactgatgaaattacacgactgattattgatgaacatgatctggcagcctttgcccctatttcacactttacagtaggcgattttagaaattggctacttggagaagatgccactccagaaagcttaaaagcattagcatcgggtttaaccccagaaatggtggctgctgtcagcaaaattatgcgcaatcaagatttgatttatgtcgccagcaaatgtgaagtggtcacccaatttcgcaacacaattggtttaaaaggacatctttctacccgtttacaaccgaaccaccctaccgatgatgtgctcggtatttcagccagtattttagatgggttgatgtatggcaatggtgatgccgtaattggcattaaccctgccacggataacctgcataatttgtcagagctactgaaattgcttgatcatgtcattcaggaatatcaaattccaacgcaatcttgtgtacttacgcatatcagctcaggcattcaacttgctgaaaaaaatgtgccaatagatttaatgtttcaatcgattgccggcactcaacttgctaacgaaggttttggtatctcgctcgatttattacaagaaggatatgaagccaccctctcactcaagcgcggaaccattggacaaaacgtcatgtactttgaaacgggtcaaggcagtgccctatccagcaatgcacatcacggagtggaccaacaaacattagaaacgcgtgcttatgcagtcgcccgtaaatataatccgcttttagtgaatacagtcgttggttttattggtcctgaatacctttttaacggtaaacaaattatacgtgcgggactagaagatcacttctgcggtaagttacttggcgtgccaatgggctgcgacatttgttataccaaccatgccgatgccgaccaaaatgatatggatgtacttcttactctatttggcgccgcaggcattaactttattatggggattccgggttcagacgatgtcatgctcaactatcaaaccacttccttccatgatgccctctatttaagacaactcttaggtttaaaacccgctcctgagttctccgcttggcttgaacaacaagggatttttaaacagcataactctcaaatttgttgggcagaccatatgcctgaccaattctctcgtctgcttatgaactag

SEQ ID NO: 2826 - DNA, 732 bp, Acinetobacter baumannii
ataatgaaaacaatcggtttactcggcggcatgagctgggagtctacagcactttactatcaacaaattaatagaatggttcagaacaagttagggaaactacattcagccaaaatcattctaaatagtgtcgattttgaagaaatagcagccttacaagcgaaaggtttatggcaagaagctggagcctacttagctgagcaagcacaaaatttagaaaaagcaggggcagattgtattttagtctgtactaataccatgcataaagtagcgcctcaaattgaagatgctattacggttccatttatacatattgctgatgccacagcaaaagaaattttaagtcaaaatatccgaaaagttgcactattgggaaccgctttcacgatggagcaagacttttataaagccagattacaagatcgtggaattgaggtgattattccaaacgatgcaaatcggaaaatagtacatagcattatctatgatgagctttgtttaggtgtgatcaaccccgattcgcaaatcaaatacacgaccattgttgaagagttgattggacagggtgccgagggcattattttggggtgtaccgaaatttgtatgttgattggtgatatcaaattttctgtgcctctatttgataccaccaccattcatgcgaaagaagctgtaaattttgcattagagcaaaaaacggcagcccgttctattgctgctagttcggtctaa

SEQ ID NO: 2827 - DNA, 474 bp, Acinetobacter baumannii
ttaaaaagaacatgggtattttatatatggaatttaaaaatgctaaagacaattgttgaatttaaatttgatgattatcagctatatgatcaaaatttatcagcagaagacgggaatactttagtacagaaaactgaagatattgcacaatatatttatagtatattaaaaaatagatatcacttaaatattgagttaaatgctgagcgttggggctgggaaatagaagtgccattacctgagattacgatgtatatcggtattagcgtttatgaagaatacagtaatggttttgcaatattcatttcaccaaatacaccaattttaagaagatttctttttagaaagttagatattactcaccatattatgttgctacaaaattatattaatgtcattttgaagtcccatgccggtatatatgatgtgcaatggtgggaggaaaatgagtttagatatgttgcagcgcattaa

SEQ ID NO: 2828 - DNA, 243 bp, Acinetobacter baumannii
ataaggagaacatcaatggcacgtttttaccgtcgtcgcaagttctgccgctttacagctgagaatgttgcgtacatcgactacaaagatatcgatactttaaaacagtacatcactgaaaacggcaagattgttcctagccgtatcactggtactaaagctcgttatcaacgtcaattagcgcttgctatcaaacaagctcgctacttgtctttgattccgtacactgacaaccataagtga

SEQ ID NO: 2829 - DNA, 1119 bp, Acinetobacter baumannii
gttttttggacttttgagatatttcctcttatgaaagcgtcactccgtttacgtcttgatcaactctgtgatcgtcatgaagaacttactgcattgcttgcagatgcagaagtgatttccgataacaaacgtttccgtaaactgtctcgtgaacatagtgatttaactgaaattaccgaagtttggggcaaataccgtcaagcagaagaagatattgaaactgctgaaatgatgaagtcggaccctgactttaaagatatggcagaagaagaaattcaagcaaataaagtattgcttgaagaattagaaagccagcttaatattttgatgattccaaaagatccaaatgactctaatgctgcatatttagaaattcgtgccgggacgggcggtgatgaagctgcaattttctcaggcgatttattccgtatgtatagcaaatatgccgaatcgcaaggttggcgtattgaagtcctttctgaaaatgaaggcgagcatggtggttttaaagaagtcatttgccgtgtagatggtgatggtgtgtatggccgcttaaagttcgaaagtggcgcgcatcgtgtacaacgtgttccagcaactgaatcacaaggtcgtgtgcatacgtcagcttgtacagtagcaatcttgcctgaaattgacgttgataccaatgttgaaattaatccggcagatttacgtatcgatacttaccgtgcatcaggtgcgggtggtcagcacattaacaaaaccgattcagcggtgcgtattactcatattccaaccggtacagtcgttgagtgccaagaagagcgttcacagcataaaaacaaagctaaggcgatggcattgttagtgtcacgtttagaaaatgcaaaacgcgcagcggctgatgcagcaacttctgaaatgcgccgtgatttggtcggttctggtgaccgctctgaacgtatccgtacttataactacccgcaaggacgtatgacggatcaccgtattaacctaactttatataagttagatgccattatggaaggtgatctaacggaattgctcgatagtttacatcgtgaatatcaggcagatcagcttgcgatgcttgcacaggaaaatggcggctaa

SEQ ID NO: 2830 - DNA, 1038 bp, Acinetobacter baumannii
aaaattgggaccttatgtatgtcattaaattttatgaataaggctcaaatagagagctataaaaaacttccacggtctttaaaatacttcataggcatttgcttgtgttatctcgtttatgcattttttagtcctgcacaagctgcttgcacggtaagcgggactacaaatagtacttttaattacactgcagcaaatattaatagtgatgcaaccgtaaacctttcaggaacaattacttgtacgaatttaggacttccccagatttctaattttatgtgtatgaaaaccgtatttacaggagcaaccactgcgaataatagtgtgactttaccctatacagttactgcaactgtaggcggggctggctcttctactaccaaccaaacctccaatgtgtggtatggtccagtagcaacagtcgcatcaaataatattgtgagttactcggtaaatataaaagtaccagctcgaacagggtctctcattgcatatcctaaaggaacctatacggcttcggtccggttgtattgggatatggatcttttgggtttgtcatgtggcgatttacttggtggctgggattctggtgatacattactaacagcaaactttgtggtcccaagtctgtgccaattaaactcaacttcaactgtagatttcggcaatattaatgatattggtacgactaagcgtgattacacagctcaaggagcagtgaatactacctgcaactatggaacaccttatagcatttatttaggggatggaaaccaccgcatagctggtggttttaggcgtatgattcatgacaataatgattatattccctatcagctatataaagattctaactatagtacggtatgggatgccacaggaggtgtaaccaatgttggtggttcaggtggagtctcaaaaactggtacaggtagcgctcaaagtacacccgtttatggaaaaattccgcaaggcacttccatttcaactaaaccgggaaactattctgatagtgttgttgtgacagtgacttattaa

SEQ ID NO: 2831 - DNA, 1563 bp, Acinetobacter baumannii
gacgaggttgctatgtcagaacaagagaaagacctacaagccgatattgattattttttacaggaacaggcgaccaacgcattacttaaccaaacttcgtttatagaaaatctttccgtacagtcgaacctatttgaacaactaaaatcgcagttttttaatgagatgttggatgatgcaacgtctaacggtgtggcctctaaaaaaattgaacaatggctgagcattcgtactttggatgagttgaaacaattaaatgcggaggctaagcaacattttctctatcacggcattacatttaacgtatacggtgataaggagggagtggagagaacgataccttttgatctcattccaagggttattgaaaaaaaacagtgggaaaaaatcgcagctggctgctcacagcgagttaaagcgcttaattattttttagatgacatctatcatgggcaacatattttaaaagagcaattaattccggaaagtcagattatttgtcatgaggcttttcagccccatatgcttaaatacacgctcaaaggcaaaatttattctcaaattagcggaatagatattattcgcgacagtgaaggtgagttttttgtacttgaagataatttaagaacaccatctggcgtatcttatatgattgaatgcaggaatattagtcagcaactcatgcctgagctctgcgctgctaacaatctgcaaggtattgaacactatccaagcttattaaaagaaatacttcaagaaaactctgagattgatcagccttttattgtggtcttaacgccaggacgttttaacagtgcttattatgaacacgcttttttagcacgtgaaatggatgtgccactggtcaccaatcgagatttatttgtagaaaatgatcaagtatttgtaaaaacgattcgcggccatcaaaaggttgatgtgatttatcgccgtttagatgatgattttttagacccacttgcatttagacctgatagtgctttaggtgtggcaggtttaatgtctgcttatttacagaaaaatgtagtgattgccaatgcacccggcactggagtagctgacgataaatcgatttatccatatgttgatcagatgatccaatattatttgggtgaaacaccaattttgaagaatgtacctacttaccagtgccgtgagaaagaacatctggactatgtactggctcatttagatcaattggtcattaaagaagctcaaggatcgggtggatatggcatgttaattggtcctaaagcaagctcatgtgaaattgatgaatttagacaaaaactgattgctacaccgcatgaatatattgcccagccaacattggctttatcggttgcaccgactttaactacagcaggggtggctgagcgccacatcgacctacgcccgtttgtactcagttctccttatcggaccgaaattgtgcccggaggtttaacacgagtagctatgcaggcaggttctttagtcgttaactcctcacaaggaggaggtattaaagatacatgggtcgttgaaacgctacattcttaa

SEQ ID NO: 2832 - DNA, 1722 bp, Acinetobacter baumannii
aggagaatagccatgttagaatttatacttgttttatttattgctatttttctagcatggtgcctcagtaaatatctatccaaagtgatggcaaatcagccgatgtggggtgatggattatttcgctggattgaaaatcctgtataccgcttattaggtgtatctccacaacaacaaatgaactggaaacaatattctctagcatttgttgtgagctgtatttttcttgcagtggctattcttgctatttttatgacgcaagcatggctaccattaaacccgaaccatgcaccaaatatgagttgggatttagcattacatacggttatttcatttttaactaataccaatcaacagcattattctggtcaagctcaattatcttatttgtctcaaatgacaggtattgtaggtttgcaagtcattacgcccatgatggggctggctttggttgttgcaacattaagagctttcttttatcagcgtccaagtcatattgcggccgatgttgccgagcagccagatcaaattttaattggtaattattgggcagatgtaattcgtcctacagttcgctttttgcttccactctgttttgtctggtcattattgcttaacagccaaggcgtgccagcaactttccaaggcgggccagaagtacagcttatggataaagccaatagcgttgaaactcaaaaaattcctttagggccagttgcgccaatggtggcgattaagcaattaggtagtaacggtggtggttggtacggtccaaatagttctgtgcctttagaaaatccaacaccactttctaatttactagaaatgattgcgatcttacttattccaatcacagtcatttttatggtagggcattttactcagcgtaaaaaatttgcctactttgtgtttggcagcatgcttttcatgtcgattatttcaggtgcagctgctgtctggtctgagagtatgtcatcgacagcatctcaacttgccgtaatggaaggtaaagaacaacgttttggaccagcagcatcagcagtttgggcagtgcttactacacaggtaaataacggctcggtcaatatgatgcatgattcttctgcgccgcttactggtttagtcgaactcatcaacatgttgattaatgcgatttggggtggtgtgggctgtggtctgcaacagtttatgatttatctattacttgccgtatttattgcaggtttaatgacaggccgtacccctgaattgttcgggcgcaagattgaagcagcagaaattaaattgctcgcgattattatcttgattcaacctttagtcattcttgcattcaccgcattaagcctcagcgttccgggcatatctggaattagtaatccgggaccacatggtattagccaagtgttctacgaatatgtttctgcatttgccaacaatggttcaggttttgaaggtcttggagacaacactatatggtggaatgtcacttgtagtatcgctctactgttaggacgtttccctacattaattttgccattaatgattgccacacgtttagcagcaaaaagaaaagcacccgaaacatcaggtagtcttcaggttgaaactccaacctttgctttaacgctgattacgatagttgtgttgcttaccttattacaatttatgccagttcttgtccttgggcctattgccgatcaacttttgttggttaaaggctaa

SEQ ID NO: 2833 - DNA, 819 bp, Acinetobacter baumannii
ttttacccagcagttggaatatatgttcgaggcataattatgaaattgatggttaatcatcaaacgcattataactatactgaaactgctaaaaacagtattcagtatatcaagatgatgcctcaaacatcgctgcatcaacatgttatgaattgggcaatcagcgtgcctggtgacaagacgctcaaaagagatatttttaataatatttggataacggctagccagcgttatgagtatcagcaccttacttttatggcacaaggtattgtagagcttctaaatacagaaataggaggagtagatgtatctataccaataaatctatttctccaaagtacagaggccactaaatatgatgctgaaatgttggattttgcccagagaattgtaactgtcaaagatcgacaacatattgctttgctcagtgaaaatattctgcaaaagatgccatatcaaccggatagtacatctgttcatacaacggctacgcaagcctttcaggcaggtcagggggtgtgtcaagatcatgcacatgttttaatcgctatgtgccgtgcgttacaattaccagcacgttatgtctctggttatctatttgatcaaaattctccacaccttgccagtcacgcttgggcggaggtatttttagataatcagtggtattgttttgatgtgagcaatcaattgtttacaccaaagcatcatatttatcttgctgttggtcgggactatctcgatgttgcgcccattaggggagtgcgagaaaaaggtggtactgaaaatatgatgtctgtggttcaagtgctggcttgttga

SEQ ID NO: 2834 - DNA, 252 bp, Acinetobacter baumannii
atggctacagcaattgagaacagagctagacaacttaaaaacgctaaacgtggaggatatgcgccaaccattgccaaagacgtaaacaaacataaagtacaaaaaataaggagagctctagacgaagcccggcgatatgtgagtgaactaaatgatgaaacggttatctttgacgatcaggacgcaaggcaaaaggcagaaggagccaaagcaattattgaaatgtttgaagcagctttaagcggtgcgtga

SEQ ID NO: 2835 - DNA, 1245 bp, Acinetobacter baumannii
tgtataaaagctaaatatttgcttttatgttattcatcttatatgaacaattcaagttcaaaacggtcaagagctgtttttcaattagatgcagcaagtgctttgacacttaataccatcacgctcatgacattcatggctgcatctagtgcgccgacaccactctaccgcctataccaacagctttggcaattctcaccggttacattgactttgatttttgccacctatgcttttacgctacttggctcattactcattattggttctttgtctgattatattggacgccgcccagtcattattgcagctatttctttgcaaattatttcaatgagctttttcttatttgcttcagatgtttcgatgttattcattgcacgaggcttacaaggaatcgcaacagggcttgctgtttcagctataggcgcagcaattttagattttagtaagcttcatggctcactgattaatagtattgcaccaatgataggtatggctgttggtatatttctgacttgttctattttgcaattctctgcccaccccttacagcttgtttttgagttcttatgttttcttcttatttgtgaactcattttaagttttcttactccagaaaccgcacaaagaagatccggtgcacttgcttcattaaaacccaatatggccattccgccacagacaaaaagcgcgttattgagtattagcccaattaacattgcactttggatggtcagtggtttcttcctatcgcttatgccctctttactggcaaaaattttccacacgtcatcggcatggctaaacgggattatgtttatggcgctcgccctttccggtgcggtaggtatattaacgcttaggaagtcgacaaatttccgtattttattaaccggtacgctctcgattgctattggtgccattgtcttattcatcgccattaacctaaccaatgcagtagttctatttttaggttctattattactggagttggttttggtacggcgtttatgggggctattcgtagtgtaatgccattggcacttcccgaagaacgtgcgggtcttatggctgctttttttgttgaaagttatttggcttttagtattcctgcaattttagctggctattttgtaggtaaaattgggctgatgagtacggcaaatagttatattagttttattatcttattgtcactggtcgcccttctaatgattattaaaaattttaaaaataaataa

SEQ ID NO: 2836 - DNA, 1206 bp, Acinetobacter baumannii
tttattatggcgtcaccccaatccccttcttcttcccctcgacattactcactcttcttggcaattttttctctcgcagtaggcggtttctgtattggcactacagaatttgtcgcaatgggtcttattcaggaaattgcacacaatttaaagattacagtacctgaagcagggcattttattagtgcttatgcattaggtgttgttattggtgcccctattattgccattttgggtgccaaagtacctagaaagaccctattgctttgcctcatgctgttttatggtattgccaatgcatgcacagctttagcacataccccagaaactgttttagtctctcgttttattgcaggtttacctcatggcgcatattttggtgtcggcgctttagtcgcggctgaactagcaggcccttcacgaagagcttcagcagttgcgcaaatgatgatgggactaaccgttgctaccgttattggcgtacccttagcaacatggttaggtcaacattttggctggagagcaggttttgaattttcagcaacgatcgcattctttactttaattgctgtagcttgctttgtaccgaatattccagttcaagctactgccagcataaaaacagaattagctgggcttaaaaatataaatatgtggttaacccttgcagtcggcgcaattggctttgggggcatgttctcggtatatagctatgtctcaccaattctcactgaatacactaaagttaatatccagattgttcctattgcattagcgctgtggggcattgggatggtgattggtggtttagctgcgggttggcttgcagataaaaacctcaataaaactattgtgggcgtactcattagctcagcgatcgcatttgtagtcgcaagctttctaatgagtaatatctatagcgcaattggctctttattcttaattggcctaaccgttatgggtttaggtggggctttacagacacgcctcatggatgttgcaggtgatgcacaaacgctagcagcttcacttaaccattccgcctttaatcttgctaatgcattaggcgcttttttaggtggttgggtactgagccatcagatgggttggattgcaccaatctgggtaggttttgtactgagccttggtggccttattatcttactcattgcatttgctgtagaaaaagcaactcaaaaagcctga

SEQ ID NO: 2837 - DNA, 372 bp, Acinetobacter baumannii
attgaggtggctatgccgcacgttgtagttgattattcagataacttaactggactaaatgcaaaacaattacttgaagaaattaataccacgctcattgaaacagagctatttagtccagaagacattaaaagtcgtgcacgtagagatgaggtttttctgattggcttaggggttgatcaagcctatatccatgtaaaagcctatattttgtcgggaagaactgctgaacaaaaacagcttgtgggtgagcaattattagcggcgctcagcaacaaaaaatatctaccacaagagtttaataaagaaattcaattgtgtgttgagcttatagacatgccaagagacgattattttaagcaagttgtataa

SEQ ID NO: 2838 - DNA, 534 bp, Acinetobacter baumannii
tttaaaaatttttttttggagttaaaaatgtctaaaggtcaaactttacaagatccgttcttaaattctctccgtaaagaacgcatcccagtttctattttccttgttaacggtattaaattacaaggtcatattgaatcttttgaccaatatgttgttttattaaaaaatactgtaagtcaaatggtttacaaacacgcaatttctacagttgttccagctcgtaacccacgtccagcaggtgcacaaggtgcaggtttcccagctcagggtggtagtcaaggtggcttcggtggtcaaggcgctggctttggtggtgctcaaggtgctggctttggtggtcaaggcggcttcggtggtcaaggcggcttcggcggtcaaggcggcttcggtggtcaaggcggcttcggtggtcagggcggcttcggtggtcaaggcggcttcggtggtcaaggcggcttcggcggacatcaaggcggttttgataacgattctaaatttgaagatggtcaagacgacgaaaacaatcgttaa

SEQ ID NO: 2839 - DNA, 225 bp, Acinetobacter baumannii
ataaagctttacgcaaatcgaaaacgaattaattttttaattcgaaataaaaaacctgtagcaactagcaaatcgggagaggtgctgtgctacaggttttattatttaatgatcaaaaaatataatttaaaaactatatactcattaatagttattaaggaaagccactataaaaatttcacaaattttcgtatagaactactttttaaaaagcagaacttttga

SEQ ID NO: 2840 - DNA, 246 bp, Acinetobacter baumannii
agctctccttattttttgtactttatgtttgtttacgtctttggcaatggttggcgcatatcctccacgtttagcgtttttaagttgtctagctctgttctcaattgctgtagccattcaaacactccaactcacctaacaaatcttagtaaagcaactttattgtttgttattcttaaacatttagtattttctttgttcaaagtgtcaaatttgttacttaagccttactcctgcaagttttag

SEQ ID NO: 2841 - DNA, 642 bp, Acinetobacter baumannii
ttgtgcaattatttggtttgtaatctggagtttgaaatgaaaacttatgtacaaaattcagaagcaaatttgggtcagaccttaagagcatctttgggattattaatttttaccttagttggctgtggcgctgcttatagtgcgatcgctacaggtgcgggacaggtgttatttaataatcaagtgaatggtagtttgattgaaatagaacataaagttttagggtcaaaattagtcgctcagccatttgttggagaggcttattttcatccgcgtccttcagcagtcgcttatgacccgatggcgatggcaggtacaaacttagctcgtactaatcctgaactacaacaacaaattgatgctcagattcttgctgtgaaaaaacaagaccacacaggtaataaccctattccaagtgatttagtgactaaatctggtagtggtattgatccgcatattagtcctgaatctgctcagttacaggttgctcgagtggctcaagctcgtcatttagaccctaagattgtggaagagcttttgcaaaagtatgttgaaccgaagcagtttggtgtattggggcaagcgcgtgttaatgtattacagctcaatattgctttagatcaattacaatctacacattaa

SEQ ID NO: 2842 - DNA, 1509 bp, Acinetobacter baumannii
gattcaattcttaggctagatatgcgcacatctgaaaaacaagtaaaacctattgagattgatgatatcaatatcatcgagaacgaaaaaaccaaaaaagcgattactgcagctgcattaggtaatgcaattgaatggtttgatttcggagtttatggttatgtggcatacgttctcggtaaagtatttttcccagatgcttcaccaagcgtgcaaatgattgccgcgcttgctacattttcagtaccttttattttccgtccattaggtggtcttttctttggacatttaggtgacaaatacggacgtcaaaaagttctggccattactgtcattattatgtccatcagtacctttggtattggccttattccatcttatgaaacaatcggtttatgggcacctattcttttactcatcgtaaaaattgtacaaggcttctccattggtggtgaatactcaggtgctgcgatttttgtagctgaatattctccggaccgaaaacgtggttttatgggaagctggcttgattttggatcgatagccggctttgtacttggggctgcaactgtcgccttgatcacacacgccgtgggtgaggcacgctttgccgagtggggttggcgtattcccttctttctcgctctaccactgggcataatcggtttatatttacgtaatcgccttgaagaaacccctgtatatcaacagcattcagagcaacaagcacaaaaaagcaaaccccaaaaatttagtttcaaagaaatttttgttaaacataagcgtagtttattagtgtgcattggtctcgtaatcagcactaacgttacttactacatgttgctaacttatttaccaagctatttttcgcataacttaggctattcagaagcgcatggtgctcttattatcattgcggttatggttggcatgttatttgtacaacctgtgattggttatttgagtgataagttcggacgccgcccatttatttttattggaagcttttctcttattttcttgtcctatcctgcctttgtattacttaactctggggtaaattatcaaatttttataggcttacttattcttgctttatctctcaatatgtctatcggagtgatggcatcaactttaccggctctatttccaactgaaatccgttatagcgctttaggtattgcctttaatttctcagtagttatcgctggtttaaccccaactcttaccgcaacgctagttgaaactacccataatctgatggttccagcctattacttgatgatttgcggggtggtaggtattgctactgcaatgtatttaaaggaaacagccaataagcctttaattgggggcgtgcctattgctcacaatatagaggaagcacaagagttacttgaagagtttcatgaaactattgaacagaaaattgaaaatattgatcagaaaattcaggagcttcaacaaaaacgtcaaaaacttgctgataaacaccctgatatagcatga

SEQ ID NO: 2843 - DNA, 609 bp, Acinetobacter baumannii
cggcatgtctatctcttttatatacaacaaaaaattattttaaacggtataactatgccaaatttagaagcttcatttagagcacttagagtgcttcacacagcaagagatttatttaaacaatacggatttcacaaggttggtgtcgaccgaattattgctgagtccaaaattaccaaagccaccttttacaactatttccactctaaagaaagactcattgaaatgtgcttaacctttcaaaaggacgggctaaaagaagaagtattttctattatttattcataccgtgaacttatggtatttgataagctcaagaaaatcttttttctgcatgccaacctcgaaggactgtaccgtttacctttacaggccatttttgaaattgaaaagttttatcccactgcctacaaggtggtggttgattatagaaactggttggtgaaccaaatacatcaattacttttaaccattaaagccacagctacactcgaagacgcctatatgtttttgtttgtgattgatggggcaatggtccagcttttgagtaaagatagaatagatgaacgagataaattattagattattttttagtaatgatgtcctag

SEQ ID NO: 2844 - DNA, 186 bp, Acinetobacter baumannii
tttgttttatatataaaacagattagccatattttatttgtcgagtttgattcattttgttctacaaatctaatcattatatatgtaggttatgaatatgaaaaacattcagaaatcacttcttgcagcattaatagttgctggttatgcggtaaatactcaagcagctgttactggacaggttga

SEQ ID NO: 2845 - DNA, 1731 bp, Acinetobacter baumannii
agatgtacatatgagattatgaaacaggaaactgcacttaaactgctaaaagcaggtgaaaatgtctttttaaccggttcggctggtgcagggaaaacctatacactcaatcagtacatccattatttaaaagcgcgtaaagtacctgtagcgattacagcgtctaccggtattgctgcaacgcatatgaacggtatgaccattcatacgtgggcgggcatcggcattaaagatcagttaactgacgacgatctaaaacgtatgaaagagcgtaaatatctcaaggaacaccttgaaaacgcgcaagttcttgtgattgatgaaatctcaatgctccatgcgaagcagcttaatctggtcaatcaggttttaaaatattttaaagaaagtgatgaagcattcggtggcattcaagtgattgtagctggagatttcttccagttgccacccgtaggccgtaatggtgaagccaaccgtgacaaattctgttttatgtctgatgcatgggtcgaagccaaatttcgggtatgttatttaacagaacaacaccgccaagatgatgaaattctgaatcagatattaaatgcgattcgtgcgcaaagtattcaaaccgagcatttgcaagctttgcatcaatcccgtactcatgacattggcgaaacctttactcgtctttatacgcataacatggatgtcgataatatcaattatcagcacttaaacgaaattgataatgaagggcatcaatttaatgccgttttagacggtaatgaaaagttattagagaccttaaaatcttcagtccgtgctccggaagaactcacacttaaaaaacatgccaaagtgatgtttgtaaaaaacaactttgatatgggttatatcaacggaagtttaggtgaggtgatcggttttgaagaagatgatgaaaatgggttattgccaaaggtaaaattaaccgatggtacaactttgctggtagcgcctgaaacatggtcaattgaaaatgaagcaggaaaagtcattgcaagtttccagcaaattccacttcgtttggcgtgggcgattaccattcataaaagccaaggtatgactttggaagctgccgaaattaacctgatgcatacctttgaaaaagggcaaggttatgttgcgctctcacgtttgaagtctttaacagggttaaaattattaggttttaatgaacaagctttggagttagatagtctggcggtaaaagctgatcgccgttttcaagaactttctaaagaagccgaagataattttgctaatgtcgatttaacggctcaacataaagcctttattcgtcattgtggtggaaccttaaatgaaactgaaatttcaagaaatgagaaaaaactagcgagaggcgagaagcaaaattacgcctcagcgactttggatgaaactcgtgcattgtttgaagaaggctacgaaattgaagatattgcacatgaacgtggtctaacacctgcaaccattattaatcacttggctcgactgcataaagaacaaaagctagatatttcggttgcccatcctggtgaagaagtggtcgaagaagtgcgtaaaatttataagaagttgaaaaaacgccaaaatccggatcatttttctgatgatggttcgatcaaactaagaccaattgttgaagcaaccagccctcgaatgggatatgatcaggttcgattagctttattatttattgaataa

SEQ ID NO: 2846 - DNA, 198 bp, Acinetobacter baumannii
aaaaacaaatactttttttctccatatttattatttgtgattaaagttgctagttatttgattattgtgatgtatgtcacatttttaactatactttaccatctcgatatgggactattcgattctcaaaatgctaaagaaatgtgttttttcattggtctatctcttgccaattcaattatacgctgctcaggttga

SEQ ID NO: 2847 - DNA, 1218 bp, Acinetobacter baumannii
aaatgtgaatatataaggaatttacaaatgttcacaaaaaaggatttattgcagcaacggatgttgattgatcaactgcgcacgcaaaatagtctctctcctcagaacgctgccaaactcggccaaagtattgcaagctcgtgggaacgatcagcttctgctgcgattcctaaagaacgatttgcagcacctctacttgaaagaaaatctgcttcacaaaatgctttagatctggcactaagccagtgtgctgatgacttacgtcatattgcagagcaatcttctatggtcattgctgtgggtgacatcggtagtaccattatctggacagcctcaagtgctcaaatgcagagtgctgctgaacgtgtacattttgtacaaggtggtcaatggcgtgaagaatttgtaggtacgaatgcattggcgttatctttaaaaactcaacaatcaagctgtgttttttccaatgaacattatatggagtcgattcacgattgggtttgttatgcagcacccattatcgatccatactcaaagcaaaccttgggtgtggtagatttatcaaccacatggaaaaaccataataccttgggtattttggccgctgagcgttgtgcctccattattcaatctgccttgttagaacaacagcgccagcacttacacatccgggcattttcgacgccgcaagttaaatttaacggcaaaagtttattattgacgccgcgtcaaattgaaattttaacgatattggcactatgtccgcatggtttaaccttagagcatctctatcaggcactttacggtgagcgtaaagtaagcatgggtacgcttaaagctgaaatgtctcaattgcgagatatattgggaggtttgcttggttcacgtccatatcggttacttgtgcatgttgaggccgattttttacaagctgaacaagcgcttgatgctggatatgtcgcctctgcattgcagctttatacgggcgtatttctggcaaaaaccgaaagtccgtttctgtgtgcatggcgtgactgccttgagtcgcgcttaagtgatgcgatttttaaaacacaagaaacagatttattacttaagcatttagctcatttccctgaagcaatcgatgcggtagaacgtcttatggagttattaccgagtgaacatcctgcgcatcaattgctggtgaaatatattgactcacctaagctaagttag

SEQ ID NO: 2848 - DNA, 216 bp, Acinetobacter baumannii
attaacaagtatggaataggtggaaagatattgatcacaagtcactgtttctctttgtacctatataaaaagagatttttattccttaagaatgctacatatgaacaagttttaagacttttaaaatgtattaaattaatcaaaactcttaactctcttagaagatcttttgttatttatgtttatttaagagccacaaatacttctattatatag

SEQ ID NO: 2849 - DNA, 861 bp, Acinetobacter baumannii
ctttcttatctctggcttaataaggattatcagatgacttcgacatccaacctcattgaacaggtgattgaagcttggcaaaacatgcaggcaaaaacgccgctggtacaatgtattaccaacagcgttgctgccaactacaccgccaatgtattacttgcctccggtgcttcacctgccatgattgataatccttatgaagcagaaagctttaccaaaatttcatcggctttaagcattaatttaggcacaccgacttcagagcaaatgcaagccatgcaaatctctgccaagaccgcacagcttaatgaaattccgtgggtacttgatccagtgggctatggaccaatattagcttggcgtagtcaaatgacagacgagcttttacagttcaagccaagcgttatacgtggtaatgcctcagaaatcagtacacttgcaggcaatcaggttcaatcaaaaggtgtagacagcactttaagcagtgacaaagcttatcagcaagctttttcgctcttaacacatgcaagctgtatcgctatttcaggtgaatcagattatattttgtctaatgaagttgatgctgtaattcaagtaaacggcggaagcccgttacaacccaaaattactgcaactggctgcgctttgggtgcattaattgctgcatatagcgccgtgacgacaccaaccattgcagctctttcagcccatattcattttgcaattgcaggtaaacttgctgcaaatcaagctcaaacgatgggtagttttagtagcatatttatggattatatccatatgttagatgctaatctgattgagcaatacgcagatatcaaacttttggacaaacaggcataa

SEQ ID NO: 2850 - DNA, 1239 bp, Acinetobacter baumannii
gttttggatttttttaatttttatcgtgatcttcaagctgagttaagcaactatccttggctagaaatgctagtttcgctcacacttttgatcctttttgctgcattagcaaatttcattgccaaaagaattattgttcggggaatacgtcatttagtgactaaaattaagtcactcaaccagtcggtttttgcccagcatagtgtcattaagcgatttgccaatattgtgccggccattgtcattatgaatggtattactaccgttccgcatttgtcggaaaaagcggttgctttggtacagatgggcgcacaagcattcattttccttacgattgcgctcaccattagtgaattattaaatatatttaatttaatctatcagcgtaatccaaaatctagaaacaagccgattaaaggttacttgcaactcgttaaactcattatttttgttgtttgcggattaatgattttgggtacattcctgaaaaaggatgtatttacgttgttggctggcttcggtgcaatggcagccgtattaatgttagttttccaaaatacgattttgtcattggtcgcgagtgtacaaattgcctcttatgacatggtacgtattggggactggattgaaatgccatcgctcaatgctgatggtgatgtcattgatatttcattgcacactgtgaccgttcaaaactttgataaaacatacaccacgattccaaccaataaactagtgacagacacttttaaaaactggcgtggtatgagtaatgcgggctgtcgccgtatgaagcgttctctttatatcgatcaaactagcgtgcacttcatgaccgaagaagagcaacaaaaactcaaagattttttattgctagatcaatacctcaatgccaagcaatctgagattgacgaatttaataagcatttaggtagtcagtcacgttataacaaaagacgcttaaccaatattggaacatttagagcatatgttgaattctatttgcgccagcataaggggattgctcaaaatcaaacgcttattgttcgccaactacaaccaacgagtgaaggtctaccattagaaatttatgcatttaccaataccactgcatgggtttcttatgaagcaattcagtccgatatttttgatcatttgattgcgattttgcctgagtttggcttaagagtgtatcaggcaccttcaggccatgattttcagaaattaacagtagaataa

SEQ ID NO: 2851 - DNA, 657 bp, Acinetobacter baumannii
agtatggatttattaaatacggttaaaagtcgctacactaccaaagcgtacgatcccgagaaaaaaattcctcaagaaaaattcaataagttattagaaattttacgctttaccccttcttcagtgaatattcaaccttggcatttcttggttgcagacaatcctactgctaaagaacgcattgccaaagccttaacaggacgatatgcctacaatgcacccaaggttcttgagtcatcacatacccttgtattttgtacaagaacagatatttcacccgaatatttaaaccagttacttgaacaagatgatttaagtggtcgttttaaagatgagaaagccaaacttggtcaaaaggatactcgtcatggctatgttgagttttaccgtaatgagcaaaagaacttattcggctggatggaaaatcaaacttttatcgctttaggacaactactgtttgcagctggtcttgaaggcatagatgcaaccccaatgggtggctttgacgaaaatgttttaaatgaagaatttggcttaaaagaaaaaggcctgcgtagctctgtaattgtttcactgggttatagaagcgaaaatgacttcaatgcgaaattgccaaaatctcgtctgccggatgaagttatttttacacatttataa

SEQ ID NO: 2852 - DNA, 1302 bp, Acinetobacter baumannii
ataatggatttcaatacccttgaccaagaaacggtacagaaaaaacaaaagtttcatcaaattttgtatgtacaggtcatctttgcaattattttgggcattttaattggtcatttttacccagaacttggcgagagcttaaaaccgcttggtgatgcattcatcaaaatcgtcaaaatgattattgctcccgtaatctttttgacagtggttactggtattgccagcatgacaaacatgagtcgagttgggcgggtgacaggtaaggcaatgctatatttccttactttctctagccttgcgcttgtggttggtatgattgtggctaatatcattcaacctggtaaaggcctaaatattgacccggcaaccttagtcaacgataaagtaaatagttacgttgaaaaggctcatgctacaaatatcactgactttttcatgaatattatcccgcaaacattagtgagtccgcttgctggtggtgaaattttgcaggttctatttgtggcagtcctatttggtatttctttagctgcattgggtgaccgtgcacgtccaattactgattttttaaataacctcacggctccggttttctatttggttggcatgttaatgaaacttgcaccaattggagcttttggtgctatggcatttactatcggtgcgtatggaattgaatcaatcggtaatttattactattgattatgaccttctatatcacggcagtgctgttcgtattaatcattttaggggctgtagcacgctacaatggcttttcaattatcgatttaattcgttacatcaaagacgaactctggttagttttaggtacaagctcttctgaagctgctttaccatctttaatggataaaatgcaaaaagcaggttgtgaaaaatctgtagtaggtctagtcattccgacaggttactcatttaaccttgatggaactaatatctatatgactatggcggctttatttattgcacaagcatgtaatgttgatttatcaattggtgagcaggttgcattgcttttagtggcaatggtgagttctaaaggtgcggcaggggtaacgggcgcaggctttattacactcgcagctactttgtcggtagtacctgctgtaccagtggcaggtatggcgcttattttaggtattgaccgttttatgtcggagtgtcgtgcattaaccaatttaattggtaatgcatgtgcaaccattgtggttgcccgttgggacaaagctctggacaaggacgttctagataaagctttacgcaaatcgaaaacgaattaa

SEQ ID NO: 2853 - DNA, 669 bp, Acinetobacter baumannii
cgatttattcaaagatacgagcattaccccaagggtgagttgaaaaaagaattattatcccgtctagttcatgaaaataaaaagcgaaaagcttacgtggaacctaaaaaagattttatattacaggatattaaaactattcatgagcgcccagccgaagttcaagagagaaaaataccgggtcattgggaagctgatttaattaaaggtaaagacaataaaagttcgatagcaacacttattgaacgaaatacacggctctgtatcttggcaacattacctgatgcaaaggcagaatcagtgcgcaaggctttaactgaagctctgaaatatttacctgcagaactgcgtaaaacgttgacctatgaccgtggacgtgagatgtcagaacataaaatactcgaagaagatttaggcatagatgtatatttctgtgacccacattcaccctggcaaaaaggcacatgcgaaaatatgaatggtttaattaggcaatatttacctaaagggattgatttaaatcaggcagatcagcattatttaaatcaagttgccatgtcactgaatactcgtcctagaaaggcgttagattggcttacaccattagagaaatttgctcagcttgttgattatcatatggcttttgaaactgtcgcacctcatgtttga

SEQ ID NO: 2854 - DNA, 1014 bp, Acinetobacter baumannii
aaggatgatctattatttcatttcggttttatttttatcatgtctttaaaatcaaaattttctctacccaagactttgttggcatcaacattggggtttgtatttgcttcatctacttttgccgcaattccgactacacttaaacttgattacgcctactacgcaccaaccagtctggtggtaaaagatcaaaaacttctcgaaaaagtactaccaaatacccaaattaaatgggttttcagccaaggcagtaaccgctcattagaatatctcaacagtaatagtatcgattttgcttctaccgctggattggctgcagtattaagtcgagcgaatggaagtccaattaaaactgtttatgtacaaagccaaccggaatggaccgccctcgttgtcgcaaaaaactcacccattaaaagtctaaaagatttaaaaggtaagaaaattgcagctacaaaaggaaccgatcctttcttatttacactacaagcactagaaacagtaggcttaagtaaacgcgatgtacaactggtccatttacaacatccagatggcaaaaccgcattagaacgtggccaagtagatgcttgggcggggcttgatccattaatggcttcagctcaaattcaatcgggcgcgaaattactttatcgtaatgtagcatttaatagttatagcgtgcttagcgtgaaagaagactttgcaaagcaaagccctgaagcggttgaagcagttattaaagcctacgaacaagccagaaaatgggcaaaagccaatccagataaagtggcagcacttttagctcaagaatcaaaactccctctacctgtggctaaactacaattgagccgaacaaactttgatcaaagtattccatcagcaactcaagcacaagcgctaaaacgttctgggaaaattttgactgaagaagacttggttagaaaaggcaccaatgtcaatcaagtggtcgatcagttattagatccacgttttgctcaaaaagtcgtgaaatag

SEQ ID NO: 2855 - DNA, 1254 bp, Acinetobacter baumannii
tctacacatcacaatactaaggccatggtgaggctcacctgtaataacaaacaatggatttatggaaaaaggaatcactccatgacttttaaaaatattgcagatcaaacaaacggtttttatattccttgcgtatcactctttggaccaggatgtgccaaagaaattggaacaaaggcgcagaacctcggcgcaaaaaaagcattaattgtgaccgatgaagggctatttaaatttggcgttgcagatcttatcgcaagctatttaaccgaagcaggcgtagcgagccatattttcccgggcgcggaacctaacccaaccgatattaatgttcacaacggtgtgaatgcctataacgaaaatggctgtgactttattgtgtcgttaggcggcggctcatctcatgactgtgcaaaagggattggcttagtgactgcaggtggtggtcatattcgtgactacgaaggtatcgataaaagtaaagtaccgatgacgccattgattgcagtgaatacaacggctggtactgcatctgaaatgactcgtttctgtattattaccaatacagatactcacgtaaaaatggctatcgtggactggcgttgtaccccactcattgcgatcgatgacccgaaactcatgattgcaaaaccggcgggtttaacggctgcaacaggtatggatgcattaacccatgcagttgaagcatatgtatctacagcagcaaacccaattaccgatgcgtgtgctgaaaaagcaatcaccatgattagccagtggctccaacccgctgtcgcaaatggcgaaaacatcgaggcacgtgatgcgatgagctatgcgcagtacttggctggtatggcatttaacaatgcatctttaggttatgttcacgcaatggctcaccagttgggcgggttctacaacctacctcatggtgtatgtaacgcaatcttgctaccacatgtttgtgaatttaacttaattgcttgtccagatcgttatgcaaaaatcgcagaattaatgggtgtaaatacccacggtctcaccgtaacagaagctgcgtatgctgcaattgatgccattcgcaaactgtcttcttcaattggtatcccatctggcttaacagaacttggcgtaaaaactgaggacctcgcggtgatggccgaaaacgctcaaaaagacgcatgtatgctcaccaacccacgtaaagcaaaccatgcacaagttgtggagattttcaaagcagcactttaa

SEQ ID NO: 2856 - DNA, 639 bp, Acinetobacter baumannii
tttatgcgccactatactggaattgatcaacttattaactcttttgatcaagcattacgtagtcttgttccgggtgcaacagcagcgcagcgccaaaatccagctgaaacagtagaagcaaaacttggtgtagaagatgctcgccatgttgcaggtttaatgcgtgttaaccacagtggtgaagtgtgtgctcaagcactttatcatgggcaagcattgacagcgaaattgccaaatgtacgccgcgaaatgcaacaggcagcgattgaagaacaagaccatttagcttggtgtgaagaccgtttaaaagagctaaatagtcatacaagcttattgaacccgatttggtatggcctttcatatggtatgggtgctcttgccggtattgcaggtgataaatatagcttaggttttgttgctgaaactgaacgtcaagttagtctacatttacaagatcacttaaatcagttaccagcacaagatgaacgctcgcgcaaaattctagagcaaatgaatgaagatgaattgcatcaccgtcatactgcacttgaagcaggtggtgttgaattaccatatgcagtaaaaatcacgatgactgctatttcaaagttaatgacaaaaacgagttattatctttaa

SEQ ID NO: 2857 - DNA, 1998 bp, Acinetobacter baumannii
ctttaccaacagagcatttgtaccagactttgcaggaacagcttcatgactgatgaaaagctaacacaacgtcgtattcatacattagacgccgcgttagccaaccagattgctgccggtgaggtgattgaacgtccctcatcggtcgtaaaagaattattagaaaactcaattgatgcaggtgcaaccgaattaattgtgcggattgcacaaggcggctcaacattaatcgagattattgacaatggacatgggattcatcctgatgatttaccattggcagtgatgcgccatgcaaccagtaaaattaaaacagcagaagatttacatgccattgttagcttaggtttccgtggtgaagcacttgcttctattgcagcagtttcacgattgactttaaccagtagccaagatgaaagcggaattggtcatcaggttgaggtgaatggtacagcctttgatcatcaacaagtccaagctgttgctgcacaaaagggtactcatattcgagttcaggatttatttttcaatgttcctgctcgccgtaaatttttaaaaaagccaaccactgaatttggtcatattgaagaaattgtacgccgtttggctttaacgcattttgatatacgttttgtacttgagcataacgataatattcgaattaatttaccaatagcagatagcggtgaattaagatttcagcgtgtacagcaattattggggcaacagtttgttcaaaatgcttactggatcgatgccgaaagtattaacatgcgtttgtcgggttggctagggcatccttcagatgcacgtgcccaagcagacttacaatatgtgtatgtaaatggccgaattgttaaagataaaacgatttcgcatgctttaagaatggcttatgacggaattttacatggtcaccagcattcatcttatttacttttcttagaagtcgatcctgaaaatattgatgttaacgttcacccaacgaaacatgaaattcgttttctaaatcaacgcgaagtacatgagtttgtaagacattacgcgaaagaaacactagcacaatttcagacagcgagtgctgatttagcacaagctatgaaagcggacgatactcaggcttcatttgtacagtctcagcctaaatatcaagaacaattcacattgcatcgcacagaccaagctgttgatacaacactagataagtctagtagttatcagccctctactgaacttttaactgattttaataatagtcgtccccaagctgttcattatgcggaacaaactccaaaatataatggttctgcgcagttaaataatgcattaaagacttacttggctccattacgtgatcaacctacaaatttttcagttgatgaaaatattgagtctgtcgctaaggtagatgaatttccattaggtatcgcaattgcccagcttcatggaatttatattttggcgcaaaatactgaaggcctgattattgttgatatgcatgcagcacatgagcgtattttgctgcaacaaatgaaaaatgcttgggataaacctgagttttggacatctcaacagttgcttatccctaaagtgatctcaattagccgtatgcaagctattcgtgttgaggatttaaaacctcagcttgaacgcttagggttagagattgatttatatggcgatgagcaagtcattgtgcgtggtgtgccggctattttgcaaaaagcggattttgaaaatcttattcccgaacttctcaatgatttagatccaaatgatgaagcacaaggtttattgcaaaagcgtgatgaactgttagcaggtatggcctgtcatggtgcagtacgtgctcatcgacaacttagtctctcagaaatgaatgctttacttcgccaaatggaacaaaccgaatttgcaagccaatgtaaccatggtcgcccaacttggcgtgcatttccattatctcaactagataaattatttgctcgaggagagtag

SEQ ID NO: 2858 - DNA, 474 bp, Acinetobacter baumannii
aaatataaacataaatacaaggagcgcctaatgattgtaagacgagcgacctatgaagacctaagccaactcgctgtcctatttgatgaataccgtcaattttatggtgcatcttctaatctagaagaatctcatcattttttaaaacaacgttttgagaataaagagagcgtattttttatccatattaaggacgaaaaaattactgggttcgtattgctttatttaggtttttcttcagttgcttgttcaacttactacatcttagatgatgtatatgttacccccctattccgtcgtcaaggctcggcaaaacaactcattgatacagcgattttatttgcaaaacaagaaaatgctttacgtattagcctagaaacccaatcgaataatcatgaatctcaccgcctctatgaaaaaatggggttcatccgagacagtgagtttcagacatttcattgttttcttaaataa

SEQ ID NO: 2859 - DNA, 2661 bp, Acinetobacter baumannii
tatcaagtgcaaagcaatcgcgaaaatcaggctgaggccttattaaatcatgtcaacagatatcaagccggtcgactaacggtctttcttggtgcggcacctggtgtaggaaaaacttatgccatgctcgcccgcgccaaagaattatttcaacagggcacagatgtggttgttggtattgttgaaacccacggaagaatcgaaactctaaaaattttggaagggttgcctcaaatttctagaaaagaaatgcaatatcaggggcatactttagaagaaatggacttggatgctattttacttcggcatccagaaattgttttggtcgatgagttggctcatcgtaacgttccaaatagtcgtcatgaacggcggtggcaagatgttaatgaattgctagacgcaggtattgatgtatttacgaccattaatattcagcatttagaaagcctaaatgatgtggtctaccaaattacgggcattcgagtaaatgaaacggtaccagatcgggtatttgatcgtattcgagacattcgtttaattgatttaccagtcagtgagcttattgaaaggctccatcaaggaaaagtctatgtaccagagcaagcaaatctggcattacaaggcttttttagcatttcaaatttaacagcattacgtgaactcgcaatgcaatgcgttgctgagcatgtcgattcagacttaaaagagagttatgcctcaaagggattgaaatctatctcgttgcaaaatgaattgatgattgcgatagatgggcaaggctcttctgaatatttagtgcgagcaggctgtcgtttagcagaacgtaatggtgctacatggactgtagtgaatgttgctaaaagttcggactttggacagagttcagcgaattcttataaaaaagaatacatcgagattgaccgtgcatttgagctggctcggcaactcggtggtcgaacggaggttttatatgggccgcgagttgcttcagtgttaatggatgccgcgattgaccgaggtatttccaatctagtcattggtaaaagtatttcaccgtggtggttaaagttatttaagaaaaatttagctcagcaattattaaatcaagaaaactcgattgctttaaccattttgcacccagaacagggcactaaaaagattaatcagctcgaaaaaccttcatttttatcattaaaagaaagtgtttttgttttagctgttacatgcgcaagtatttttatagctcacttcgcagaagttctatttggtattgaagacttctctgtcatttttattatttctgttttaattgttgcaactaagacccgtatgctcgctgcagtagtggctgctcttatttgtttcttagcctataattttttctttattgccccgcgttatacctttcagatttcagcacaccaaggggtagtcaccgttgttgctttttttgcagcagctttaattgctggccgtttagcttctcagttacgccagcaagttttgtctttaaaagctgcgaatgcctacactacggtaatgcaagacttggcgcgtaagctttctagcgcagtaaaccttgaagaagtcatgcaaacaggacgtatgactttagaaacacaacttcaaactaaagtgtggatttctattcgagataaaataatttcatctgatattgagctaaatgataaagaagaagtagctgcagaatggtgtttgaaacatcagcagccatgcgggcgctttaccgatactctgagtcagtcaaactggtggtttttaccacttttagaacaaaaaaatagcctaggtattgtgggaatttactttaaggatgaagtggtttccttaaattttgagcaaaagaaactgacggaaagtgtaatcgaatatattgcgcaggcggtacttcgaacccaattggtgaatgagcttgaacaagcaaaagtcaccagtgaaacagagcgcttacgttctgctttattatcttcggtatcgcatgatttacgctcgccacttgcttctatcattggggcagcagacacacttgccaattttaaagctgaaatgtcagaacaagaccaacaagatctgcttgaaacaattcatttagaaggtgagcgcttagaccgttatattcagaacttgcttgatatgacccgtttgggacacgaaggtctaactttaaaaagagactggattggtgtagatgaattaattggttcggcaacccggcgtttaaagcgttataaaccagatacacaagtgtcagttgaattacctgagcaaccgattagtttgtatgtccacccagcactggtagagcaagccatttttaatgttttagaaaatgccgcaaacttttcacctccagatgaaccagtcatgattcgtgctcatctttcatcagaagatgaggtgaaaatagaaattgaagataggggggcaggaattcctgaagatgaaagaaaccgcatttttgatatgttttatactatggagcgtggagatcgtggaaagtttggtactggtttagggcttacaatcgtgaaagcgattattggtgctcatatgggtacaatagaagcattttcagggcgccaaaataaaggtactttaattcaaatcaaattaccccttcatccagtaaaagaataa

SEQ ID NO: 2860 - DNA, 390 bp, Acinetobacter baumannii
tgtgggcagcatagtctgtgtagagtaatgatgaaaaaagttttatttgttttaatgggcatgttaatagtcggctgtacagaaaaaaagcctttaacacctgaagagcaatggcatggctattgtacaagtgtggggaatgcagcaagaagtattctgtttgatcgtcagcaagcaattgaaaagtctcaagccattgagcatgctaataaaattgaagacgaaattacgaaaaaattcatctttaatattattgaaaaagtttacgccattccacaagacgaattaaaaacgaatccagaagccttgcaagaaaagattagaaaacaaatgacagatgagtgtttggttaccccacatgacaaaatgccaaactacaaaaaattctaa

SEQ ID NO: 2861 - DNA, 531 bp, Acinetobacter baumannii
gctttaaagcagggcaatggtatcatatcgattattttgaatcatgttatgtgtgttatgtcgtattcattgaaaatggtcttaaatcatgaagaagatacccagcgtttagctcaggcattggcgcagcatgttcaggctggcgtgatttatctgattggagatttgggcgccggtaaaacgacattgacccgttattttttgcaagctctagggcataaaggctcggttaaaagtccgacgtatacgttggttgaaccatataaaatcaataataaagaaatttttcattttgacttatatcgtctcaatgatccgtacgaacttgaattaatgggaatccgtgattatctagatattcaggatgcactatttttatttgagtggccatcgaaaggtggagatgaaatccctgaagcagatatcgtcattgatattcaaaaatcagatgatgaactcaatcgtttcgtcaccttaactttaccaacagagcatttgtaccagactttgcaggaacagcttcatgactga

SEQ ID NO: 2862 - DNA, 237 bp, Acinetobacter baumannii
aatgtttttaaattgaatcatgtcgtcaaaaactatgctaaaaagaaaaaacaggcaaagagtctttgcctgtttcgcgttgcagctattatattactatttagcttgcgtgaggtagctgattggctgattcacgtcaacttttgtaccaccaaagtgttgttcaacgtattttttaacagcttcagtgtggtaaagctgaccaactttctgaagaacagggtcatctttacgtga

SEQ ID NO: 2863 - DNA, 777 bp, Acinetobacter baumannii
aggtactttaattcaaatcaaattaccccttcatccagtaaaagaataagttgtaaattcatgataagttcagaaacatcacctgtagaaacacgtattgtgattattgatgatgagcctcaaatccgtaaatttctagacattgctttaagaactcaaaaatacaaaatcacgctctgcgaaacgggttacaaaggcctagagactttggcaacccaaggggctgatttggtgattctagacttaggcttacccgatttagatggaagagaagtgcttcaagaattacgtagctggtcgaatgttcccgttattgtgttatctgtacgtgctgatgaatatgaaaaagttgctttgctcgatgctggcgcaaatgattacatgaccaagccgtttagtgtgcaagagcttttggcacgcatacgtgtcattctaagaaatcaaccgattcagcaagaagctcatgtgtatgacgatggttatctcaaagtcgatgtcatgcaacgtttagtttggatcgagcaacaaccaattactttaactcgaaaagagtttcaacttttgaccttattaatgcgctatcaagggcagcttttaacacagcctcagctcttaaaagagctatggggacccacccatcaggaagatacgcactatttacgtattttagtgggcaagttacgcagtaaactgggagataacgcgattcagccacgttatattgctactgaacctggtgtgggattacgttttttagctaaacagaaaaatcattaa

SEQ ID NO: 2864 - DNA, 636 bp, Acinetobacter baumannii
agaaggactaaggaaatggctgaagtacttcatcacgacaaccacggccatgatggtcatcatgaacatgatgatactgacttaacggtctttggtttctggacatacttgatgagtgacttgattcttttcggatcactcttcattgcgttcgctgtattaagcagtcatgttccaccaggaactccaagtgcatatgacctgttccatgaatcattaggctacgtgttaactgaaacatttgccttattgatttcatcggtgactttcggttttgcggtacttgcatcttataaaaagaatgtaaatcaagtgatcacttggttatttattacattcctttttggtgcaaccttcatcgggatggaactctatgaattccatcaccttgtagaagaaggtcatggtccaactcacagtgctttcttatcatcgttctttactttggtaggtacgcacggtatccacgtaacttctggtttagtgtggatgttggtactgatgtatcaaatcaaaactaaaggtttgactttaccgaatacacgtcgtcttgcttgcttaagcttgttctggcacttccttgacatcgtttggatctgtgtattcagcgtcgtttacttactgggagttctctaa

SEQ ID NO: 2865 - DNA, 1926 bp, Acinetobacter baumannii
ttttgctataatgttccgtcttttttttctggtgtttttgtactcatgcactatcctaaagtttatgatgttatcgttatcggtggcggtcacgcaggtacggaagcggcgcttgctgctgcgcgtatgggacgacagactttgcttttgacccataacattgagactttgggtcagatgagctgtaacccagcaattggtggcattggtaagtcgcacttagttcgtgaaattgatgcgcttggcggtgcaatggctttagctgccgataaaggcggtattcaattccgtattttaaactcgcgtaaaggtgctgcagtacgtgcaacgcgtgctcaggctgaccgtgttcgctataaagctgcgattcgtgagaccttagaaaaccaagcaaatcttgatattttccaacaggcggctgatgacctgattgttgaaggcgatacagttaagggtgttgtgacccaaatgggtatccgctttgatgcaaaaactgttgtgttaactactggtacattcttgggcggtgttattcacgttggtttagagaaatcaagcggcggtcgtgctggtgatcctccttctattgctcttgctcagcgtcttcgtgagttgaaattaccggtaggccgtttaaaaacaggtacacctccacgtattgatgcacgttcagttgatttttctgttatgacaccacaaccaggcgacttcccgtctccggtaatgtcgttcatgggtgatgtgtctatgcacccagaacaagtgaactgctatatcacgcatactaacgaaaaaactcatgacattattcgtggtggcttagaccgttcaccaatgtataccggtgtcattgaaggggtaggtccacgttactgtccttcaattgaagataagattcatcgtttctctgataaagactcgcatcaggtattcttagagccagaaggccttgatacacatgagctttatccaaatggtatttcgacttcattaccatttgatgttcagtttgaacttgtgcgctcgattcgcggtatggaaaatgcccatatcttacgtccgggttatgcaatcgaatatgactatttcaacccgcaagctttgaaatttaccctagaaaccaaagcaattaacggcttgtattttgcagggcaaattaatggtactaccggttatgaagaagcgggtgcccaaggtttacttgcaggcttgaatgctgcacgccgtgcatgggaacaagaagaatggacacctaaacgtgaccaagcttatatgggtgtattggttgacgacttgattactttaggtacgaaagagccataccgtatgttcacttcacgtgcggaatatcgtttgatgttacgtgaagataatgccgatcaacgtttaacaactattggtcgtgagcttggtttggttgatgatgttcgttgggcagcttattgcgaaaaaatggaagctgttgagcgcgaaacatctcgtctacaacacttatgggcggcacctaacaacccaatgggtaaaaagtttgttgaaatgacaggtgctgacttaagtaaagaatgtagtgcgattgacttgcttaaacgtcctaatattaattttggccaaattgcagaacttacaggttctgaagtatcacagcaagtcggcgagcaaattgaaattgctgttaaatatgaaggttatatcaaccgtcagcatgaagatgtagctcaattaaaacgtcttgaagaaactaaaattcctgctgattttgattatgacgtcgtttcaggtttatctcgcgaaattactcagaagttgaaaacagttcgcccggaaacattagctcaagcgagccgtattcctggtgttaccccagctgctgttcagcttgtaatgatcacgattcgtaaaaataatatgacgaaaaaaacggcttaa

SEQ ID NO: 2866 - DNA, 546 bp, Acinetobacter baumannii
tatcagcataaaaatcacgtatatttaaaattaacagaagaatcttctttggtttatattttgaacagcacagaatacacactagatcgcatagatcggaaaatattatctgccctacgtagaaatggccgtttaacggttgcacagctcgccgaagaagtcgggctttcatcttcgccttgctggactcgactcaaacgtttagaaagtctaaaaattattgaaggctataccgtaaacgtaaaccccaaagcgattggcattcatgagttgttttttatcgaaattaccctagaacgccacgatgatgaaatgttagaaaactttagcgaggctttggcagacattccagaagtggtcgaagcgcatttagttacgggcgactatgattatttggtgaaagtggccgtaaaagatgccgagcattacgaacgttttttacgtaaaaagctctactcgattaaaggaatccgccacacgcgctcaacctttgctttacgaccacttaaatctgccaatactgccgatttaatgttgattgaataa

SEQ ID NO: 2867 - DNA, 246 bp, Acinetobacter baumannii
aataaaaataattcaaatatttctatattctattttttactcaaaaaaaccaaaaaataccggtcaaataatattattgatgagcttaatttttttagaaaattattactaactataaaaatttttcggattgaaaatgtgatggattttacatttttattcattgctgtggttcgttatggaagtcagtttcaaaacactcttatagattacattgggtatttcaacacttacatattgcaataa

SEQ ID NO: 2868 - DNA, 747 bp, Acinetobacter baumannii
tttcaggataaaaaaatgcgttatagaattcattatattgatgtgcaaaatgccctacaaaactatatctggattttagaagatactgagactcatgaagctgttgcagttgatccaacagaggctgagttagtcacccacttttgccaagaacatcaattaactttaaaacagatttggcttacccattggcataaagaccatatcggcggtgttgctgatttaacggctaacacgcctatggcggtatatggcccaagagatgaactaagtaaaatccctggcattactcatcccttacaacacgatgatcatctaaaatttaatgatttaaaagtagagattattgcaacaccaggccataccttaggtcatattgtatattttattgaagagcttaatgccctcttttgtggagataccttatttgcaatgggatgcgggcgactatttgaaggtacagcagaacagatgtaccactcactaaatcgtcttgctgcactacccactgcaacaaaagtgtattgcacacatgaatatacactttctaatgcggaatttgccttaagtgtagaacctgaaaaccacgcactgcaagaacgtgctgaacaagtccgcatgcttcgtcaagaaggtaaaattaccttgccaagtagtattgaacttgaactagcaacaaatccctttttacgtgctgaaagtgtagatgagttcgctcacttacgtagcttaaaagacaatttttaa

SEQ ID NO: 2869 - DNA, 240 bp, Acinetobacter baumannii
gaagccggtaatttagattgctggcttttttatttagtacagtcagctctcaaatttttactatccggaataaaaaagcgtcatctaatatttaaagcacgtcatttaggcattgcttttgcattcattcatacaaaccaactcgcaggagtattgtatgaatcaaccagaaacagcttccgttatttcttcaagtgcagaagtctcatcagcagaatattttgctcagcgccaacttaa

SEQ ID NO: 2870 - DNA, 858 bp, Acinetobacter baumannii
agatactgtttcaataatgattacatggtgatttgtatgaacaattctgcatttattaaaaatggcattttaaaatcttttttatttgcaagtacattatcacttgttacacctgtgatggcacaagcaacttttctaatttggccgatttatccaaaaattgaagccaatgaaaaggcaactgcggtttggcttcaaaatacgggtaagaccgatgcgatggtgcaaattcgggtatttaaatggaatcaagatggcttaaaagataactatagtgagcaatcagaaattataccaagcccgcctgtagccaaaattaaagcaggcgagaagcatatgcttcgcttaaccaaaagcgccaatttgccggatggcaaagagcagtcatatcgtctgattgtagatgagttaccgattcgactttctgatggcaacgagcaagatgcctctaaagtaagtttccaaatgcgttactcaattccattgtttgcttatggaaaaggaattggcagtggattaaccgaagaaagtcaaaaacttaatgcaaaaaatgctttagcaaaaccggttttacagtggtcaatccgcaataatcaacaaggccagtctgagctatatcttaaaaataatggtcagaagtttgcgcgtctttcggcactgaaaacgtcaaaaacaggtaatgatatctctttaggaaaagctgcttttggctatgttttatcaaatagcactgtaaagtttgctattgatcagtcgacggcacatgagttgtcaaaaacatctaaaatttatggtgtggacagttctggtattaaacaagaattgatcgaaatcaccaaaatggaggatccatcatga

SEQ ID NO: 2871 - DNA, 1545 bp, Acinetobacter baumannii
tctttagtcctaaaaaagcaaaggaatatttatatgcgctatatcgatccaaatcaaccaggctcaaaagttcaatttaaatcacaatatgaaaattttattggcggtgaatgggttgcacctctaaagggtgaatattttgataatgtgtcaccagtggatggaaaagctttcacacgcattccacgctctagtgctgaagatattgagcttgctttagatgcagcacacaaagcgaaagcttcatggaataaatcttcaccgactacacgttctaatatacttttaaaaattgctgatcgtttagaagcaaatcttgaaatgcttgcggttgcagaaacttgggacaacggtaaagcagttcgtgaaactttggcagctgaccttccacttgcaatcgaccatttccgttatttcgcaggatgtattcgtgctcaagaaggcggcatctctgaaattgatgaagataccattgcctaccatttccatgaaccactaggtgtggttggtcaaatcattccatggaacttcccgattttaatggctgcatggaaactcgctcccgctttggcggctggtaactgtgtggtgattaaaccagctgagcaaactccggtaggtattttgttagttgccgaactcatccaagatatcttaccgccaggcgtacttaatattgtgaatggtttcggtgcagaagttggccgtccgttagcgacaagcccacgtattgccaagatcgcgtttaccggttcaactcaaactgggcaaatggtgatgcaatatgcgaccgaaaatattattccagtcacgctagagcttggtggcaagtcaccgaaccttttctttgaagacatcatggataaagaagatgacttcttagaaaaaacgctggaaggttttgccatgtttgccttaaaccaaggtgaagtatgtacttgcccttctcgtgctttagtacaaggaagtattgctgatcaattcttagagttggccgtcgaacgcgtaaaacgtattaaaactggtcatcctcttgatactgaaaccatgattggtgctcaagcatctttgcaacaacaagagaaaatcttacgttgtattaatacgggccgagaagaaggtgcagaactcttacttggtggtagtggccgtaaagaagtaggtgatggtttctatgttgatccgactatttttaaaggccacaacagcatgcaagttttccaagaagaaatttttggtcctgtactggctgtgacaacatttaaagactttgacgatgcaatcaaaattgccaacgacactatgtatggtttaggtgcaggtgtatggtcacgttcagcccatatttcttaccgtgctggtcgtgctattgaggcgggtcgtgtctggacaaactgctataacatctaccctgcgcatgctgcatttggtggctacaagaagtctggtattggtcgtgaaaaccataagatgatgctagatcactaccaacaaactaaaaacttgttggtgagttattcaaccaaaccaatgggcttcttctaa

SEQ ID NO: 2872 - DNA, 243 bp, Acinetobacter baumannii
aaggaacacaaaatgaaaacgaccatgttgaaaatcttaacagcatctctaatttgtttttcaggcgtaacttttacacacgctgctgatacgagcaaagctgaaactcaaaaacaaattcgagtgtgtgcaaaaaaacagcaaggtgaatgggtttcttacaatcacaacggtgtaacctttaatggtacttgccagccgaacgaaaatggcaaattacaattcaaggcccctgctccttaa

SEQ ID NO: 2873 - DNA, 993 bp, Acinetobacter baumannii
cttaatgacaatagctcgataaaaatgaatacatctacagctaaacacaattacgccccagatattttaggtgccggctatgaacagctaacactcaactttccagatgattatgaaggtaaagttgtagccaccttagttcgtaaaaaggccactcaaccgactcaaaaagccgtactttatattcatggttttttagattatttctttcaaaccgaaatggccgagcaatttaatacccatggttatgacttctatgcactcgatttaagaaaatatggccgctcaaaactgcctcatcaaattttctataatgtgctcgatttaaatgaatatgatgccgaaattactcaagcattagagattattggccaagaaaaacatacacaagttttacttgcaggtcactcaacaggcggcttaacggcaacgctttatgctgcgcatcatcctgatcatcccttcattaaagcactctgggcgaatagtccgttttacgattttaatttaagcttagtcgaaaagaagtttggtattccaatgctcagtcgagtaggaaaatatctgccaaaagttaaatttccaagccaactgaacaaatggtacaccaccagccttcataagcagcttaaaggtgaatgggatttcaacctcgattggaaaccaacctctgcccctacagttcaactcagctttgtacatgcaattcatactgcgcaaaaagaaattcaccgcggggttaaattgaatattccagccctgattatgcattcgcaccaaactaaaaacccacgcaaatggggacccgatgcaactcaaagcgatgtcattttagatgttaaagacattgcgaaattcggtaaaaaaataaagggcgatgtctcagttgtctctatttacaatggtttacacgatttagtcctttcggcccagccagtacgggaacaagtctatcagcaactattccaatggctggatcaaaaagtcacctaa

SEQ ID NO: 2874 - DNA, 390 bp, Acinetobacter baumannii
tacgcccgcaatattatgactaatacttttaataactttgtcggggaaataatgcgtaattttttagtaacgattttcactttattagtaggaacatcaatttatgcgagtcaagaatctagaaatcttctagagcaaacacaatgcgaaaaagcagtagagctccatggttttttaagccgagctcaacttgactgtaactatcactattattcagaagagttaaaagaggctgccgcaaaatgtactaaacatgatctcggcgaaaaatatggtagagaggttatgaaatttgggatgaaggaatttgaagagcggaagaaagaggatacacaaggccacttttgtcataaggttttaaaagaatttccaaaatatattaaacaataa

SEQ ID NO: 2875 - DNA, 861 bp, Acinetobacter baumannii
gacaaatgtttaaggagaattttaatgtcagaaagtaaacaatttaagcggagtgttttttttatttctgatggaactgcgattactgccgagacccttggacattcgttattagcccaatttcctaacgtagattttgatattcacatcatgccttatatcaccactgaagaggccgcaatggcagtggtggtcgagattaacaagtgtcagaccagagatggttgcctgccattagtatttgatactttggtcgatccgcatgtgcgagaaattattaatacggctaaagcggttaatctggatgtgtttgaagggttaattagtaagctggaacaggagcttggaaccccgcctacaactttagtcggacagactcatgccgtgaccgattcggagtattacaaggcccggattgatgctgttcattttgcgcttgataatgatgatggagcacgtacccgccattatgacaaagctgatttaattttaattggcgtgtctcgttccggtaaaacaccgacttctatttatctatctttgcaatttggtatccgtgttgctaactatcctttaaccgaagaagatttagatgataatcgtttaccggcagtcttaagagagcaccgcagtaaattattcggtttgatgattgatgccgagcgcttggttgccattcgaagtgaacgtaaagcgaatagccgatatgcaagttttagccagtgtcagatggagttgcgggctattgaaggtatttatatttctgagggaattaaatacttaaatgttaccgaaatgtcgattgaagaaatttctactcgtattttacaaatgacaggtttaaaacgtcgtattggttaa

SEQ ID NO: 2876 - DNA, 252 bp, Acinetobacter baumannii
tctaatttaaaacaaatgtcattttgtgtgcttgactgtaatagggcagagcactatcctttgcctgctggtcacattaccagtcagcttttgacagagctggtacaaaaggcgcacaacaacgtattatttcgttttgtgcgtactcctaagtcacgcctttatggtgaggctaggaggggcacgcttgcgtgcgctggtttccttttgtaccagtctgtcaacccttctagtcttgccaccattatttga

SEQ ID NO: 2877 - DNA, 264 bp, Acinetobacter baumannii
tgtgatataaaaataatcactactcatgagtacaggattaatcttatggatattatagatatcaagatcaaagaccaatttgatcaaattcatgatgcgaaagctcaattaaagaagaatttagttgaacatgaaaatgagcctttaaagctaagtcagcgtatcgaacatattattgtagataatgaggtgatcttacccactacagaattgctatttgaaagtgaacaaaacgaaaaaatttatcgtgtcattgaagaataa

SEQ ID NO: 2878 - DNA, 351 bp, Acinetobacter baumannii
aataaatccctaaaaattaaaaatcatttggttttgttattcatgcgaaaaacagaagtttatcaggttcgacttgactcccaagagaaaaaacaggcttttgctgtttttaaacaattggggattacccctgcccaagcagtgcgactgttctttaaacaagtcgtcttaaccaaatctattccttttgcgatcgaaaaccagaatattaatatggaacaattattaaaactgagaaaagcaaaagcatcttcattaaatcagaacgcttcaactttaaatgaagatgatgaccatgaagatttatttgaagagttaaatgcactattaggtgaaagtgacaaaacttaa

SEQ ID NO: 2879 - DNA, 1224 bp, Acinetobacter baumannii
ttttttaaaaaaagaggaatgaacaccgtgctagaagcttaccgccaacacgttgctgaacgtgccgcactcggagtcccaccgaagccacttgatgatgctcaaactgctcaacttgttgagttattaaaaaacccaccggcaggtgaagaagcattcttggttgatttgcttgaaaaccgtgttcctgcaggtgttgaccaagcagcttacgtaaaagcagctttcttggcagcgattgcaaaaggcgaagcgacatctccgctagtttctaaagaacgtgcagtttatttactaggtacgatgcttggtggctataacgtagcgcctttagttgagcttctggatgatgctgaattaggtagcttggctgctgaagctttgaaaaaaacattacttgtatttgatgcgttccatgacgtagctgataaagctaaagctggcaatgcaaatgcaaaagctgttttacaatcttgggctgatgctgaatggttcactagtcgtaaagatgtaccagaagaaatcaaaatcactgtgttcaaagtaacaggtgaaacaaacactgatgacttgtctccagctcaagacgcatggagccgtccagacatcccattgcatgcaaatgcaatgttgaaaaatgagcgtgatggtatcaaccctgaaaaaccaggtgaagttggtccattaagccaaattaaagaactcattgctaaaggcaaccaagttgcttatgtaggtgacgttgttggtacaggttcatctcgtaaatctgcaacaaactctgttctttggttctttggtgatgaaatcgctcacattccaaacaaaaaagacggtggtgtgtgcttaggcggtaaaattgctccgatcttctttaacacaatggaagatgctggtgcgttaccagtagaaatcgatgtttctaacatgaacatgggtgacgaagttactcttaaaatcgatcatgctgctgcaaaagtaactgcgttcaaaaatggcgaacaaatcgctgagtctgaacttaaaactccagtacttttagatgaagtacgtgctggtggtcgtattaacttgatcattggtcgtggcttaactgctaaagcgcgtgaagctttaggtttagctccatctacattattccgtactccagtacaaccagctgacactggcaaaggtttcactttagctcagaagatggttggtcgcgcatgtggtcttccataa

SEQ ID NO: 2880 - DNA, 708 bp, Acinetobacter baumannii
attatgaaaaaaaacatttttattattacgggattattcttatctttatcgagcactatttatgccgctacaattcgtctttcgcctgtaacggtggaaattttaagtaatcaaagtgcttcttcgattagtttatataaccagtcaaatgaaagtaccgatttacaggtgcgtgtatttgagtggagtcaaaacaatggacaggatcaattaacccctacggataaaattgcggttagtccaccttttttaaaattacaacctaatgactcttataatttacgtgtagtgagggttaatccaacgccagtttctggcgaaaaaacttatcgtattattattgatgagctaccaaaacctatggatagccgcaaagttagtcaaggtataaatgtcttacttcgctcatcattacctgtattcgtagtgaataaagatgcgattactcaattaaattggaaaattgataatagtcaaaaaaccacttctttaaatatcagcaatattggaaacaggcatgcacttttaaatgacttaaaacttgtagatctaacagaaaataagagttactccattaaagtaaatacagtgaatggttatattcttgcagaacaatcacgaagctatccgattagtaatttttcatatcagcccgaccataaatacagtatttccttaacagttaatggtaagaaagtcacgctataa

SEQ ID NO: 2881 - DNA, 531 bp, Acinetobacter baumannii
gttttaagaaaaatgaaatacttatattttaaagcaatatttttgctatctgttagtcaatttatatatgcagcagatcctcagctcaattcaagttttaaagtacaagctaaaattgaaaatggttgttcaatagataatgttgagcaaaacatggattttggtaaatactctgctttatcaaaaaataaagtggtgactaatgttattaatagcaaaggttcttggaatatccgttgtacggaaagtttacctgtaagtatttctataggtggtggtgaaaaccttcaaaataatacaagacgtatgaagaatagttcatcccctaattatttatcttacaaactgtataactctagcagtttatccaatgaatatattgtacgtaataaatatttattgcctgctacaacacctacaaaccgtctggcaaattttgaaatatatggtgtcgttgatttagaaaataataatgaaccccatgtggccggaatttataaagatactgtttcaataatgattacatggtga

SEQ ID NO: 2882 - DNA, 432 bp, Acinetobacter baumannii
atcgtgagaaaattatgtattgcctgccttattggtatggctatgttatctatgtctggttgtgccgtatttatggctggcaatcaaccaagtaaaaaaaatttaaatgttttaaatccgggtagctctcgtaattatgttattgcagagtttggggcacctgtattgtctgagtaccgtgatgggacaagagttgaaatctatacattccagcaaggttattcaaagtgggtgaaagtaggtcgtgcatttgggcatggggttgcagatgttgcctcaataggtttatgggaagtatttggaactccagctgaagcatactttaatggtaaagaaacaacttatgaagtgacttatggtgaagatgatttagtaaaaagttataagcttattgactttaatcaagcttttccaaaagtaaaagaacaatga

SEQ ID NO: 2883 - DNA, 1122 bp, Acinetobacter baumannii
aaaagcaccctagtggtgcttttttattttaggaagaaagccatatcgaaaaaaaacgatatacattggcttctttatatcgtattatttcgatataacgttttccgagaatatcgcatgcgatcacttcaagatactaaattttcaattttggagcttgcccctatacgtgatgataaaactattgagttttcattacgtcatgcattagagcttgcccaacatgcagaaaagttaggttatgaccgtttttggcttgcagaacatcataatatggatggaattgcgagttcggcaacagctgttttacttggttttatcgcggctcatacccagcgcattcgcttaggttcaggcgggatcatgctgccaaaccatgctcccttagtggttgcagaacaattcggtacattagctaccttatatccagaccgtattgagttaggtttaggtcgcgctctaggtacagatcaggtcaccatgcgtgccctacgccgtgggcatcaggaaacagaagatcaattcccaagagatgttgtagaaatcttgcaatatttcaaagcacctcaagtgggccaaaagattattgcgacacctggacaaaatactcatgtacctgtctggttgttaggttcaagcttatttagtgctcagttggctgcaaaacttggcttaccctactcatttgcatcacattttgcaccacgtatgcttggtcaagccattgaactttatcgtgagaatttcgagccttctgaatatctagataaaccttacgtttcaatgggtgttccagttgtcgttgcaagcacagatgaagaagcacaattcttggcaacaagtgcttatcaacgtgtattaggattaattcgtggggaaagcctcaaacttaagccaccagttacatctatgcagggattatggaacacggcagaacaactgtctgttgaaaacttctatacgatggcacaaatcggttcagttgaaacagtacgttcaggtctgcaaaaacttctggacacttatgaagtcgatgagtttatttttacttgtgatgtatacgacacagctaaacgcttagatagtttcacccaattaatgcaagtaaaatcaggcaattaa

SEQ ID NO: 2884 - DNA, 942 bp, Acinetobacter baumannii
tacactatgaagcctaatgatgttgtctcgaacctgccaaacaacccgacaccgaatactcatgcctctgtcgattctgcgcagcaagaacaacaggctggattagattttgttcgccaagtcattaccgatgatttagctgccggacgtgccaaacaaatcgtaacgcgtttcccgccagaaccaaatggttatttacatattggtcacgtaaaagcaatttgcctcaactttggcgttgctgaagagtttaatggcctttgtaatttacgttttgacgatactaacccggatgcggaagaacaagagtatgttgatggtatcgccaatgatgtgaaatggcttggatttagctggaatggcgaaccacgttatgcttccggttattttgatcagctttatgcttgggcaattcagttgattgaacaaggcgatgcatatgttgatttgcagtctccagaagaaatcaaattaaatcgtggtagctttgttgagccaggtaaaaattcgccatatcgtgatgcttctgttgaagaaaaccttgctcgttttgaaaaaatgcgcaatggtgaacttaaagaaggtgaagctgttttacgtgccaaaattgatatggcaagcccgaatgtacatatgcgtgacccaattttgtatcgtgttttacattcagagcatcaccaaacaggtgataagtggaaaatctacccaatgtatgactatgctcatccattgtctgatgcgatcgaaggaatcacacattcactttgtacattagagttccaagaccaccgtccgttttatgactggattgttgaaaaagttaagtctaaagctgtgccgcaccagtatgaatcttctcgtttaaacgtagattacaccattacgtctaaacgtaaattacgtaaattggttgaagggcggttatgtgaatggatgggatga

SEQ ID NO: 2885 - DNA, 1305 bp, Acinetobacter baumannii
agaaatatgaaaaaaaatattttatttgatggattgcgctccgttgcccgcatcggtgaaaccgcagtagttgcggctaaagccggtattaagtatgcaactgataagccaagtaatgccaaactcatgcgtgagacttttgagtcgcttggttcaacatatattaaacttggtcagtttatcgcgagtaccccatcgctattcccacgtgagtatgtagaagaattccaaggctgtttagaccagaccccaactttaccttttagctatattcaaggtgtacttgcgtctgagtttgaagggcgtgatttaagccagatttttagttatatcgatgaaacaccactagcttctgcctcaattgctcaggttcatgcggctaaactaactactggtgaagatgtcgttattaaagtacaaaaaccgggcgttgaaaccattttgtacactgacctaaatgtggtgcattgggctgctaaattacttgaacgtgcggtacctaaaattaaatttgccgctctttctgaaattgttgatgaaattaaaacccgtatggtgcgtgaagtcgatttcattgaagaagcacaaaatttagatgactttgtggaatatttaaatatttcccaaaatcaagctgctactgcacctaaagtttatcatcagttttctacgcgtcgtgttttgaccatgcagcgtttatatggggtccctttgacagactttagcgtggttaaacaatatgctaaagatccatcgcaagtactcattactgccatgaacacatggtttggtagcttaatgttatgtaagagcttccatgctgacttacatgctgggaacctaatgttgcttgaagatggacgtattggttttatcgattttggtatcgtggggcagttaaagcctgaagtttggacagcatgtattgcgtttatggatgccttacaaaaaactgattatcaggcaatggctgaaaacatgctcaaaatgggtatgacccataataaaattgacgttcaggttttagcacaagatctagagcgtttatttaatggtgtgttaatggctgatccacagcagattttggcttctaatccagccgatttaaatgacatcatgatggatatggtggctgttggtgagcgtcatggtattaaattccctcgagattttgccttattatttaagcaaatgctttatttcgatcgttttatgcgcgtactcgcaccttatactgatatttatgcagaccaacgtttgaaaatggttcaaaatatggaacctgcttcgttgttaaagcactaa

SEQ ID NO: 2886 - DNA, 201 bp, Acinetobacter baumannii
agcagcaagaaattgcaaaaatgcagcaagcctacgcaagctaatttgaacaaagggaaatatttagaatttccctttattctttatattaaagatcggctttcacttcctcaccaattaaataaaatgtgccaccagcaatatagtgcagactacgaagttcttttggtgcatcctgaaaatgccaatgcccatctctaa

SEQ ID NO: 2887 - DNA, 831 bp, Acinetobacter baumannii
actagggagaacactatgaaacttaatcgcgatattcaatatccatcctctacccatcaggatcagtgggaaaagctcaaacagtttaccgatgcccgtattgctctgggtcgtgcaggttgtagtatcccaacacgcgccttacttgagtttcaattgtctcatgcgcaagcaaaagatgcagtttatcaagagatggatgtttcctacctctcgaagcaattagcacagcagcagctgcaaagttttcatatacaaagtaatgcatctaataaagaaatttatcttaaacgtccagatttggggcgccagctttcaaacccatcaaaagataccttaattaagaagtatgcagaaaacccgcaacagtatgatgtttgtattgtagtaggtgacggtctctctgcaagagcgattgaagcaaatgccatcgcatttattgcagcgctaagtgaacaaattcagcaagaaaattggagccttgccccgattgtacttgcaacaggaagcagagttgctttaggcgatgaagttgcagaaatttttaaagcatccatgctagtcatgctgattggagaacgccctggtttaagctctcctgacagtatgggaatatactacacatggaatgcatattcaggctgtctcgattccaaacgcaactgtatttcaaatgttcgctcagcaggtttaagtattccggttgctgtacaacgtttaatggcattaatgagaaaatcgaaacagcttggcttttcaggagtgaatttaaaagatgaacatcaactttcaaatatcgaccataatgaaaacgcaaagcttttattttaa

SEQ ID NO: 2888 - DNA, 303 bp, Acinetobacter baumannii
aaattacggaagggtttaaacatgaaatgttcatatcaagatctagatggaaatatagtcgaattaacttgtgaaagttatatacatataccgtcaggtgccagtggaaacaaattgggaatagataatagggcagaagacttaatacatatcactgaagattttagtttttttaagaaaacagaggcagattcaataccactctatcgatttgctgtagatgctaattacaatgtttttaatagtgatgagctaccagctttggcccaaattggaaccgattggaaagtgcttaatgaataa

SEQ ID NO: 2889 - DNA, 183 bp, Acinetobacter baumannii
tacgcaaggaatataaaaaccgtttgtttgatctgcaatatttttaaaagtcatggagtgattcctttttccataaatccattgtttgttattacaggtgagcctcaccatggccttagtattgtgatgtgtagattattttcctacctaccaaaaacctaccaaataccaacttggtattag

SEQ ID NO: 2890 - DNA, 1485 bp, Acinetobacter baumannii
gcattgcttttgcattcattcatacaaaccaactcgcaggagtattgtatgaatcaaccagaaacagcttccgttatttcttcaagtgcagaagtctcatcagcagaatattttgctcagcgccaacttaaacaaggtaccgtgggttggttactcctgattggtttaggcgtagcgtatgtgatatcaggtgattttgccggctggaactttggtattgctcaaggtggttggggtggtatgtttattgccactgctcttgctgccttgatgtacctgtgcctatgtctttctatgtcagaaatgtccaccatgatgccgacagcaggtggcggttatagttttgcacgtgctgcctttggaccttttggtggttatttaacaggtacggcgattttaattgaatacgcaattgcaccagcggcgattgccgtatttattggcggttattgcgaatctctatttggtattaatggctggatgatttacctcgcctgttatgccatttttatgggtatacatctcaaaggtgccggcgaagctttaaaaatcatgtttgcgattacacttgtcgccgttgttgcccttgtcgtgtttattggggcaatgattccacactttaatgcacaaaatttatttgatattccagttagtacaggtgttggcgcaagtctttttttacctcatggctacttgggcatctgggccgcggttccttttgctatctggttttttcttgcagtagaaggtattccgttagcagcagaagaagcaaaagatccagccaaatctctgccacgcggtttaatcggtgcaatgctcatcttaacagcatttgccatgcttattttgttcttgggtgcaggcgcagcaggtgcaagtactttacaaaactcaggtgcccctctggtagattctttggttaaagtttatggcaccaacacttggcttgcgacattcgtaaactttgtgggtttagctggtttaatcgcaagtttcttctcaattatctatgcctattcgcgtcaaatctttgcattgtcacgagctggttacttacctacttcactctcgttaactaacaaaaataaagctccttatctggcaattattattccgggcattatcgggttcttactttcactcacaaaagaaggcgattcactcattttaatcgcggtttttggtgcaactatttcttatgtgctgattcttttatcccacatcaaactgcgcttatctaaacccgatatgcctcgcccttataaaactccaggaggaatcatcacttcaagcattgcactagttttagcagtcgctgctgtggtcgcaggttttgttgttaatccgaaagtgtggtttattgctgccggtatctatgtcgtatttattgcttactttttgttctacagccgctatcatttagtgaaaggaacaccagaagaagagtttgcaaatattaaagccgcagaacaagaactataa

SEQ ID NO: 2891 - DNA, 2538 bp, Acinetobacter baumannii
acaagaattgatcgaaatcaccaaaatggaggatccatcatgatccttcggcataataatttatgcaaaagtattttgctgattttattgtcgggtggatgtttaaatattccaaatactgtgttcgcaggcgatttgcctccaccaccaagagacattaatgaaattaatcaactttttaaactgtatctcgatttggttgtgaaccaatattcggtccagcaagttgtgccagtgattgtgaaaaatgatgagtacttcatacaaaaaaagaagctgattgatgaattagaaattaagatccctcaagagttattaacaaacactgacacatctttatcgaatcaagatgttttgacattggggtttagtggtgacgcgagtgattggatatctttagataaattaaaagatgtaagttatgaatatcaatcttcgaaccaatactttaagctcaattttccgcccgcttggatgcccactcaagttttgggtaaagactcatggtataagccggaagtcgctcagtctggtatagggctgctcaataactatgatttttatacatatagaccctatcaaggcggttcaaccagtagtttatttactgagcagcgttttttctctccgttaggggtcattaaaaactctggtgtctatgtcaaaaaccattacaaaaatgaaggtaacgccgagtctgtagataatgatggctatcgtcgttatgacacatcttggcagtttgataaccaaaagaacgctacatcttttttactgggtgacattattaccggtagtaaaacgacgtggggaagttctgttcgactaggcggttttcaggtacagagaaattattcaacccgaccagatttaattacctatccattaccacaatttattgggcaagccgcgttgccaagtacagtcgacttaattattaatgggcaaaagaccagctcaacagaagtacagtctggaccgtttattttaaataatgttccttttattaacggtaaaggagaagccgttgtggttacgactgatgcagtcgggcgccaggtcacaacatcggtcccattttatatttctaatactttgctaaagcccggcttatttgattactcattgtctttaggaaaaatccgtgaagactacggacttaagaatttttcttatggaaaatttgcaagtgcagccgatgcccgttatggggtaaatgactggctgactgtagaaggacgcaccgaactttcttcagatttacagttattgggtgctgggtctgtactcaagcttgcaaatttaggtgtgctgagtgcctcttttacccaaagtaaagccgataagtctatgtctggagatcgaacgaaagacttggaaggtaatcaatatacagttggatacagctataaccgtaatcggtttggttttagcattaaccataaccaacgtgatgatgaatatactgacctttcacggctgcaatatagcaatttaatttcagtaaatagtaataaaagcttaacggccaatacttattttgcgaccaaaaactcaggaacttttggcgtcggttatatcaataccaaggcgaatgactttaaaaatcgctttttaaacttgtcttgggcgcctgttttaccgacttatatgaatggcgtgactgtttcattaagtgccaatcgtgatttcatcgaaaaagaatggagtgctgcatttcagctttcgataccgctgtttcagcgaaacgcgactgttaactcaggttatgcgtttaataagcagggcgatactggctacgttaacttcaaccgctctgttccatctgaaggtggttttggtgtcgatttaactcgacgctttaatgaaaatagtgaagatttaaatcaggcacgcgtcaattaccgcaacagttatattaatactgactttggtctgtctggaaaccatgactataactactggtttggcctatccggttccctgatttatatggcaggtgatttatttgcttcaaaccgattaggtgaatcttttgcattgatcgatacaaaccaagtgcctgatgttttggtcagatacgaaaacagtttaattggccgcagtaataaaaaaggccatatttttgtgccatcggtcacgccttactattcgggtaaatacagcgtcgacccaatcgacttaccttcaaactttacaatcacacaagttgaacaacggatagcggctaaacgcggttcgggcgttgtgattaagttccctgttcatcagtctatttctgcaaatgtctatttgactcagacagatggcaaacctgtgccggtagggtctgtagtacatagagctgatcaagagtcttcttatgtgggaatggatggcattgtctatttagaaaatttaaaaccgaataacaccgtaacggttcagcgttcggaccaaagtatttgtaaagcagatttttctgtagatgtagaacaagccaagcagcagattgtggtggttaaacctgttacttgtcacgaggtatctttgccatga

SEQ ID NO: 2892 - DNA, 1092 bp, Acinetobacter baumannii
accgaatctgacaaacttgctaaatctgtaaagtttttttattgtgttgacaccaaagcaattggatatagatgtattacgcttatgtctgtaacagaaaaagaaacttcaaatagtttatatcgccaatggcagattctatctcgccttcctaccggtaaatggatcggaactcgagaattgcaagaaatgcttgagcgtgaaggtattgaaatcagtttaaggacaattcagcgtgatttaaaccaaattgctcagcgttttccaattgaaagtaataaagctgtacctcaaggctggcgttggcaatcagatgcaccaattcaaagcttaccgcatatgacaagctctcaagctgtaacttttatgatggttgaggaacatctcaaacatttacttccacccagtctccttgacgagatggggccttggtttgatttggcaaaacgtagtctgtctacacaaaataatgtgagacagtggattaatcgtgtccgtattgtgccagcaagccaacctcttattccacctgtagtggaccgtgctgctcagcaggcaatttatgaaggtctactacaagacaaacagattgagtgtgtctatcgggcccgtgtaaatcaaggcgaagataaaacttatattttaaatcctcttgctttggtccaaaaaggtgctgtgatttacttaatttgtactcgccatgataaaactgaagtacaaacatttgccttgcaccgattcaaatccgctaaagttttagaaagtcgggctttacaccctgtcaatttcgatattgaccattatattgactcaggagctttaggtttcagagtagattacaaccaacccactgaatctattcagcttactttaaccatgaccgagcaaactgctaaaactttttatgaaagtcagttaagtaaagatcagaccattaccccaattgaagaaaatattgtcgaagttacggcgaccgttccatttacatctcaactcgtatggtggttacggagttttggtaaaaaactgcttcatattgagccagtccaagtacacaatgctgtgcgagaaattgagcctgatagcaaataa

SEQ ID NO: 2893 - DNA, 549 bp, Acinetobacter baumannii
gtaacttatgaagttacattaatgctttttattttaatttgcaacttttcatgttacattttatccatcctattaattgcgctgttttttttgcttatgcgtacagacaataaactttcccgaatacttcacgtacttttacatatggcaaggcaaaaccgcagttttacttctgaagaaattgcaaaaatgctatcaactaatcctgtagtcattcgtcgcactatgattggattaaaacaggctaacttcgtacaatcagaaaaagggcctggtggtggctggcatttaattggtgatatagaaaaaattacgctttttgatatttataatgctgttggtgaacctacaatttttgcaatcggcaatgaaagacaaaatccagaatgtgcagtagaacaagtcgtcaatgcagctctagatgcaagtattcaagctgcacaggcgattttgatccagcgcttaaaaggaactaccctagccgatcttgcaaaatcatttgatcaaatttgtatcgaaaaaggatgggattcaaaacactcacattga

SEQ ID NO: 2894 - DNA, 846 bp, Acinetobacter baumannii
ctcatgaatgaaaaacaaacccgctgccctaagtgtctaacagtttataaagtttctcttactcagttaactgttgctcagggtatggtttgttgccctaaatgtaatttaaattttaatgctctgactaatttagtaaatgttgagcagccggaaacggtaaactcatctgctttagctcatggctctatgcaaacacgatatatgacccattctcatgtgttagatatctttgatcaaaaagttgaaaactctaatattgatcttttgacttatttgaataatttaaattacttccataatgaacctattaatgctcttcctaatcttaatttggctgagcaagcaacctctcctgaacaagataacggtaaaaagcatagctggttgtactatacgctttggagttctgcaaatctgattctgattttggtttttacttttcagattctttggtttaaccctaaactcatgcaacaaagccctgcgattagccatgcatttaattatgtttgtcaaatattgcattgcaacaagtcagctgaacaatatcaacttctttatatagaaaaggtaaagctacgtaaaattggtacagagcatactcaactttcaggtgttctcataaatcagaataataaaagtattgagttgcccaacctaaaactcagctttggcaaaggaaccgatcaagaagaaatcatttttacccctcaacaatacttggtcgaaaatttacgtggtattcaacgtattccgaccaatacaccttttagattccaagttgagctaaataaaagcaaaaaaagcctagtaaattatcgattagaaattgtccacccctaa

SEQ ID NO: 2895 - DNA, 843 bp, Acinetobacter baumannii
tatatgagtgattcacttaacaaagctgagctaaatcacttcttagctcagcaggctttaaaatcacagaaaaagcatttaaaccacaaatttacacggtggtttaaagcgctactcattccacttatttttttagcggctcgcgagtttttagccagaaatggctatatcgatgcttatctactccccgcaccgtctagtttatggcaatcttttttagatttagctcatagcgacctatttgcccatatttatattagtacgtggcgtgttctattcggctttattatagggagtggcttaggtttaatttttgcgatttgggttggattaagtaaagaggcagaagcatatttagaaccaactttttcagcaattaagtcgatcccaagtcttgcttggattccactgttattgctttggttaggaattgacgaaggttcgaaaattacgcttattgcaattggagcattttttccaacctacaccaatacagttgcagcgattcataatgtagataaaaagctcattgaagttggaaaagtttatcggcttaatgcttttcagcgaattatatctattattttaccagcagcctctccgggcattttaacgggtttacgtaacagcttaagcttatcgtggatgtttatgattgcagctgaactgattgcggccacacaagggattggctatttactcagtgatggccgagaaacgtctcgaccagatattgttatcattgcaattattttattggcgctattgggtaaaataaccgataccttaatgaaacttatagaaaactggttgttacgttggcgtgatacgctacaaaaataa

SEQ ID NO: 2896 - DNA, 780 bp, Acinetobacter baumannii
cgtgtgaccgagcttcaagatatcgattttgtagagttaagtgatgaagaaatgcatctctatagccgtcagattttacttgatggatgggatattgaagctcaggaaaaacttaaactcgccaatgtgctgattgtcggtgctggcggaataggctgtagtagcgcggaactacttgcacgagcaggagttgggaaaattaccctcattgatgcagataccattgagataagtaatttacaacgtcaaatcgcatttggtcatgaagatattggacgttataaagctgaagttttagctaaacggttacagaaaattaacccttatatctgtgttgaatactttaacgaacgtttagacgaacataacattgataaactagttgaacatcaagacgtcgttttagatggttgtgataactttacaacgcgttatttagtgaatgcagcttgtaaaaagcatcaggtcgcattaattagtgcttctgcaattggctttcaggcgcaaatgtttatggtcgaaggtgattcagcttgttatgaatgtttgttcccaaaagaacaacatgccaatgaagggctgcgatgtgccgaatcaggtgtgcttgcgaccacacctgtaatgatcgcgtcattacaagcacatcacgctttattgtatttaggactaaacagaacgccgctaaaacaaaaactgttactttgggatgggttaaatatgacgcaacgcattgttagttttgataaagatataaattgtccactttgtcaggcaagctaa

SEQ ID NO: 2897 - DNA, 381 bp, Acinetobacter baumannii
catcgtttggatctgtgtattcagcgtcgtttacttactgggagttctctaatgagtagtcatgagcataatgctgctggtgcgtcacacggtaactttaagcaatacactgttggctttattctttctgtcatccttaccatcatcccattcgggatggtgatggcgggtggtttcagccgcggtcttttggttacagtgattgcaatcactgccgttgctcaggttcttgtacaacttgtgtacttcttacacatgaatacatcatctgaacaacgttggaatatgattgcatttatctacacaatcctatgtatcgctgtacttttaatcggttctgtgtggattatgaattaccttcactacaatatgatgatctaa

SEQ ID NO: 2898 - DNA, 2742 bp, Acinetobacter baumannii
aaaataagtttagagtttttcatgccttctaaaattaagtttaaacagtcaactctttctcactctatgcatttaatcttaaaaatgcagagtatacctaaacttatttgtagcagcttattattaagtttatgtgttactccttgttatgctcaaagttcggctgagaccgttacagcagaagcaaaccagtcggtaacagattctttggtacaacaaaccaatacaaataacccaagtgatgttccaattaccgatgtcgctactcttgtaactcaagcacagcaacaacaagatagcttggctatattgcaacaacaagaacaatttccgaatcagattgaagaatttaagccaattacgcttgataatcttgaagacttaccggttatgcctgttgaccagaatatggcaaatgaaatttatcgggtagcagaagaggcaaaaaacgaggctcaaaacttccaaaatggtacgcaaaaacaaccagaaatggtggtgaatgacgcatcacaagcagaattacatgaaattaatcaggcccctgtaaatattgaccagctcatgcatgagattcaatctgatagtaagattgtagttgaagccaatgaaacaggaaaaactttacctgagcttactgctgccgttgaagagccacccgaagaaaaaggtttctttagacgtatattcaataaaatccgtccacctcgggtaattccaatggagcagataccccgtattactgctgaggttacgggtgcgccagatgatttagctaaaaatatcaaaggtaaattatctacatttacccaagaatcatttgaagattttaatgcagcgctaccgcaacttaggagcttaagtaatcaagctgctcaagctgtaggttattacaatgctgagtttcgttttgaaaagttaagtgccagtcgcgtacgcgttaatgtaacgccaaatgaaccagtacggattaatgaacaaaacattgaatttactggtgctggtgcaaaacagccacaatttcaggtcattcgtttagttcctgaccaagatgtaggtgatatttttaatcatggcctttacgaaaccacaaaaagccgaattgtcgatgctgcatcggataatggttattttgatgcttattggcgtttacatgacgtaaaagtgagccaacctgaaaataaagcggatattaacctcaagtatgagactggtgagcgttataagcttggtaaggttgagtttcgcatgagcgatccatcaaaaccattacctttaaatatgaatattcttgaaagcatggcaccgtggaaagagggtgatgactatgctttttggcgtgtaaatgttttagcaaataacctgactaactcacgctattttaactataccttggttgattcaattaaacccgacccaattgaaaaaccacttgagttaccacccgatttacaagcgttggtcgatcagcagaatgttgatattgacgaatcgaagctgcttcctttagagcaacaacaacttgccaaagcacgccagttggcttcctcaagtaaagaagtaacacaaaatgtggtagatgaaaaacaatttgccggaactgaaagtgtacaagccgcacctgcatctttaaaagctgcaactgtacaacatgaagaacaagagtctgaacaagaccgtttacaggctcaagctcgggaagaaaaacgtataccagtgattgtgacgttaaatgccgataaactaaatagtctggaaacaggtattggttatggtaccgacactggcgcccgtttacgtagccaatatagacgttcgattgtaaataaatacggtcattcatttgatgcaaacttggagctttcccaaattcgtcaatctatagatgggcgctatagtattccttataaacatccgttaaatgattactttaatattgtgggtggttacgaacgtgagacgagagatgatattggtccggatgtaagcttacttacagaatcggcagttttagggggtgaacgagttattaaaaaaccactcggaaactggcaacatactattggggtacgttatcgtctcgaccgcctaactcaaaaggggaatgtagatatctctgagctaccagatgcatttaaaactgctgcatcagagcaagaagcattattatttagttatgagacctctaaaacctcaagtaatacacgcttaaacccaaccaaagcttttaagcaaacttataaattagaattaggtagcgaaagtttactttcagatgccaatatggcgattgcaacagcgggctggagatttatttattctttaggtgaaaatgatgaccatcagtttgttgggcggtccgattttagttatatttttaccgatgagtttgataaagttccatacaatttaagattctttactggtggtgaccagacaattcgtggttttgattataaaagtctttcaccagaagataatggatataagattggtggacaggctctagcagtaggctctttagaatataactatcaattcaaagagggttggcgagcagctgttttttctgattttggtaatgcttacgataagagttttagtaatccgacggcctatagtgttggtgtcggtattcgttggaagtccccaattggaccaattcgtttagacgtggcttctggtatttctgatgataaccatccgattcgtttgcatttctttattggtccacaactttaa

SEQ ID NO: 2899 - DNA, 1485 bp, Acinetobacter baumannii
aaccctttttgtgtacacattttatcatcaggtctaattatgtctcaggcgaatgccacttctttaaccctttcatctccaacagaaaataagacgagtgaatcaggccaacttaaagagtttcgcactcccccacacaatttagccattgagcaagctgtacttgctgcgctgatgaccgttgctgaatcttttgaacaagtcagtgacttactcaaagaaaatgatttttatgccactcgtcataaatatatttatcgtgcaattgaaaaattagcacaggaaaactcaccgtatgatgcggttttggtcaacgactggcttttaaaacaaaatttactcgatgcgattggcggtgaagaatatttgatgcagcttatggctgactcaccttcgagtttctataatcttgaaacttatgcgactaaaattaaagaattttctacactacgcagtatgattaaggtaagtactgaaattttacaaaatgcttacgacacaaaaggtcgaggtgtaagtgaaattttagatttagccgaaacgagtattttctctttagcagaacaacataacaacaataaaaaagattctggacctaaagcaattagttctgtaactgccgatgtaattagtaaacttgatgaactttcaaaattagacggaaatattactggtttaacgactggcttcttagagctcgataataaaacctctggtatgcaaccaggtgatttgattattgtcgcagcacgtccatctatgggtaaaactactttcgccatgaacttggttgaaagtgttttgcaatacaataaactcccagctctcgtcttctctatggagatgccagcagactctattgcgatgcgtctcatttcagctatgggtaaagtgcatcaagggcatttacgttcaggtaatttggatgctgatgaatggactaaagtaacgggtaccattctgcaacttcaacaaatgcatttgtatattgatgattcctctgccctaccacctactgaagttcgtgcgcgagctagacgtatcgcaaaaatgcatgacggtaaaatcggctgtatcatggtcgactatttacagttgatgaaagttccgggcatgggtgacaaccgtgttggtgagatctcggaaatttcacgtagcttaaaagctttagctaaagaaatgaactgtcctgtgattgcactatctcagcttaaccgaagtctggaaaaccgaccgaataaacgtccagtaatgtctgacttacgtgaatctggtgcgattgaacaggatgccgacttaatcatgtttatttaccgtgatgaagtctataacaaagaatcgaaagaagcaggcaccgcagaaattatcatcggtaaacagcgtaatggtccaatcggtactgttcgccttgcctttgaaggccaatatactcgttttagtaatctctctcctgagtattacagccaatatgatgatgaagaataa

SEQ ID NO: 2900 - DNA, 276 bp, Acinetobacter baumannii
aaaattacttgtaaattccagctttcacaaagcttcacaagtaatatggactacaaaattttactagagttcaagccaaaagttaatgagcgcggggtgtttctccgtgatgcccattattttgtaactaaatacccgtgtataaataatgatcttaataatggatttatcatgcggtattttaagttaaaagaacactccaccttagtggagtgtttgacgatgtcttatacacttagaattttttgtagtttggcattttgtcatgtggggtaa

SEQ ID NO: 2901 - DNA, 1098 bp, Acinetobacter baumannii
tataatagctgcaacgcgaaacaggcaaagactctttgcctgttttttctttttagcatagtttttgacgacatgattcaatttaaaaacatttcaaagcactatcagcttaaaggccaaactatacgtgcactggaccaaattaatttggaaattcctgaaggcagtattttcggcattattggctatagtggtgcaggtaaaagtactttaatccgcctgattaacttacttgaacgaccaaatgaaggtcaggttatcattaatcaaaaggacttcactgctttggatgcgcgttcattacgtcaggaacgtgcaaatattggtatgattttccagcacttcaatttgcttcaaaccaaaacagttgctgaaaatattgaaatgccaatgcgtctgctaaattacagcaaagcagaacgtgaaaagcgtttaaatgagttacttgaattcattgatcttaagcataaaaaagatgcttatccggatgaattatctggcggtcagaaacaacgtgttggtatcgctcgtgctttagccaaccaccctaaaattcttttgtgtgatgaggccacctctgccctcgacccacaaacgacaaagtcggttttagaattattaaagataattaaccaagagcaaaaaatcacaatcgtcatggtaactcatgaaatggatgtgattgagactgtatgtgaccatgttgctgtcatggaagctggtaaagtgattgagcaaggctcaaccattgatatctttagtaatccacaacatccgacaactaaaaactttatacaaactgttttacatcagcagttacctgtaaatattttaaatcaactggaaaaccagcatcatcacagcatttattgcttacagttcttagggcgttcagcacaagagcctgtgattcagtcgcttattaaacaatttgatattagtttaaatatcttatttgccaatatgactgaaattaacggcaccgtcattggtcagatgtttgtacagcttttaggtgatccacagttgattcgtcaggcgattgagtttttagagaaaaatgaagtgagtgtagttcaatcaggagatcaagtatga

SEQ ID NO: 2902 - DNA, 915 bp, Acinetobacter baumannii
gagccaacccgagtggttgagatctctcataatcaggactttttttacatgaaaaagctgatcagtctttttttaagcgtgtctgtagtattacttgcagcttgcggcaaacagcaaaatgaaccacaaaatggcaaagactctgctcagttacaaactgtagtcattgcttcaactggttctgacgctgatatttggcgctatattgcaactttaccggaaactaaagctgccggtcttaaacttgaggtgaaaaacttcactgattatgttgcaatgaatacagctactgcaaacaaagaagttgacctaaatgcattccaatcttatgcctaccttgttgcatttaatggttcaaataaagataagattgctcctgttgctacaacttatcttgaaccaatgggtatttactcgagtaaatacaaaaaagttgatgagttccctcaaggtgcaagcattgctattcctaatgatgcagcgaacgaagctcgtgcattgttattgttacaaagcgcaggtctaatcaagcttaaagctgactttgatccagcgaaaggcactccaagcgatattactgacaacagcaaaaaaattgacattaaaccaattcaaatggcaactgctgttcgtgtaaaagacgaagttgatgcaattgttttagggaatactttagcaatggaaggtggtttaaatgtgcttaaagattctatctattatgagccagttgaccaaagtacaaagctgaatgtaaatattcttgcaactgctgaatcacgtaaagatgaccctgttcttcagaaagttggtcagctttaccacactgaagctgttaaaaaatacgttgaacaacactttggtggtacaaaagttgacgtgaatcagccaatcagctacctcacgcaagctaaatag

SEQ ID NO: 2903 - DNA, 1077 bp, Acinetobacter baumannii
atgagggtgcgtcaagcaacagtttatattgatcgccaagcgcttcaatataatttaaaccgtgtcaaacaactcgcagcaaattcaaaaatcgtaagcatggtaaaggccaatgcatacggacatggagtcaaagactgtttagcagctttaaatgcctcagatgcctttggtgtagcctgcctacaagaaggattagaaatccgtgaacttggtttcgaacaaccagttactttaattgaaggggtattttctgaagatgaaatgcccgtcgcaattgaacaaaaatttgaatgcgtcattcaccatcaacaacagtttgaatggttaattaaacacaaacaagcatatattgcccaaggcttaaaagtatgggttaaattaaatagcggtatgaaccgtttaggttttaaaaacccagaaattattgaagtgattaagacattaaagtctgaaggttttacatgtgtacttgctatgcattttgcaaatgcagatgtagaccaccctttaaatgaacaacaaaaacagcaatttttgcatattaaagaaacttgcgatccaattttagcatcatgctgtaattcagctgccatctttaaatggccagaactaaattttgactatgtacgtcctggtattatgctctacggcgcttcaccttttgcagataaaacagtgcatgatcttgatttgaaacctgtcatgacttttactgcagaaataatagcgttaaaccatattaaagctggtgaacatgtaggttatggctctactttttgtgctcaacaggctatggatatcgccattgtttctattggctatggtgatggctatccaagagcttatgttaagcaaaattttgtcgctattgatagcaaactttgcccagttgtgggccgtgtaagtatggatatgattgcgattgatgtcacaaatactcaagtaaaacttggcacccaagttgaactttggggaaatcaccgtctagttgatgatgtggctgaagcaaatggtacaatcggttatgaattactttgccgtctaagttctcgcccagtccgtcagggtacttaa

SEQ ID NO: 2904 - DNA, 210 bp, Acinetobacter baumannii
ttattggcgctaaaatttattcaaaaaaatccaagcagtgcttggattttttatttagtgaactttaagtaccctgacggactgggcgagaacttagacggcaaagtaattcataaccgattgtaccatttgcttcagccacatcatcaactagacggtgatttccccaaagttcaacttgggtgccaagttttacttgagtatttgtga

SEQ ID NO: 2905 - DNA, 228 bp, Acinetobacter baumannii
gacacggatagaaggagttctcacgtgaaaaaggttgttaaagcgaaaaatttaattgcgttccgtatttggttagaaaaattagggtattcggttaaaaaccttgctgatggaaaaggttttactttcagttttaaaaaagaatatggcttagtgacctgtgatttggcaggtaatgctttagcaatgcaattaggtgaagagtttgaggatcacttaaaagcataa

SEQ ID NO: 2906 - DNA, 726 bp, Acinetobacter baumannii
agtgagtgtagttcaatcaggagatcaagtatgagagatttaatcgtacagtggttaactgaacttactcaacctttctggcacagttctctttcaattgaccagtttgtaactgcgttacaagaaaccttccatatggtgttctttgcgcttttatttggtggtatttggggctttatccaagggattattctacttgtaacccgcccagaaggcattttgccaaataaattcatttatcatttaatcaacccaattgtaaatgctttacgttctctgccatttattattttacttattgcagttattccactgaccaaattattggtaggaacttcaattggtacatgggcagcgatcgttcctttaacaatttacgttggaccatatatgggacgtcttattgagacttccctgcttgaagtaaatgaaggaattatcgaatctgctcaagctatgggtgcaacaccttggcagattatttcgcgctttatcttacctgaagctcgtagttcgcttattttgaacttaacgactgctacgattagccttattggtgcaaccgctatggctggtgcagttggtgctggtggtattggtgacttggcaatttcttatggctatcaacgttttgatacaagcgtcgttattttaacggttattgtattattacttttggtacaaatcgttcaaatgctaggaaattggctcgcaaaaatgcgctaa

SEQ ID NO: 2907 - DNA, 1716 bp, Acinetobacter baumannii
aacaataacagtcaggacagattttgtagccttacacaaaatcaatcatcaaacggaatgaaggtgagcatcatgaaaactttggcagaagcttatcagcaatttgatcttacaaggctcatcgaagagcaacttgttgggcatccccaagcaataaatgcttatgttgagtgctgtgagcgttatgtaggaaaaaataaaacagcgcttatctgggaaggaaaaaacgggcaggcagagcactatacgttcgaacaacttgctgaactttctggaaaacttgctaacttctttaaagcacaaggaattcaagctggagattgtattgcaggacttctaccaagaacgcctgagttattaattacaattttggcagcatggcgtataggcgctatttatcagcctttatttactgcctttgaagcaaaatcgattgatcaccgaattacgactgctcaaactaaattgattgtggccaatgatgaacagcgtcctaaactgaataccttgaatgttccggttattgtaactgttcatcaaacaggtcttttatctgagcatgacttcgatttttggcaatctttacaacgatattctgagcaatgtgagccagtaaatcgtagctttgatgatgactttttaatgatgtttacctctggcacaactggacttgcgaagtctgtacctgttccactaaaagcaattttggcatttaaaggttatatgacccatgccgtcgatttgcgtgaagaggatatgttctggaatctggcagatccgggctgggcatatggtttgtattatggcattaccgggcctttaagcttggggcatagcattattatggatgagcgttcatttaatgtagatcaggcaatagaattaattaaaaaatataaagtgagtaatttaacaggctctccgacggcatttcgaatgttctttggttttaaggaaaaatttgacccttcaattaaacaacatttacgcgtagtgagtagtgcaggtgagccattaactcctgaggttgtgaactggtttaagcagaatttagaggtcaatatttttgatcaatatggccaaactgagctagggatggtgattgcaaatcatcatgctcttgagcatccattaaaagtaggttcagctggtttcgcaattcctggacatcgttttgcggtgttagaccaaaattatcaagaattgccaactggtggtgttggtattttggcgatggactcggagcaatcgccattaatgtggtttaaaggttatggtggcaataatcgcaaagcctttgttggtaagtattatttaacaggtgacacggtcactttaaatgaacatgggggcattgattttgtggggcgtgctgacgatgtcattacaacttcgggttatcgagttggaccatttgatgttgaaagtactttattagagtgtgaggccgtattggagtcagcagtaattggtaagccagatccggaacgaaccgaaatagtcaaagcttttgtggtacttaagcctgcttatcaagcgtgtgaaacattaaaagataagttacagcaatatgttcgtaaccgtttatctcgtcatgcttatccaaaagagattgagtttgtggacagtctaccgaaaaccacgagcggaaaaattcaaagaggactgttgaagcagcaagaaattgcaaaaatgcagcaagcctacgcaagctaa

SEQ ID NO: 2908 - DNA, 462 bp, Acinetobacter baumannii
tatttatgcagaccaacgtttgaaaatggttcaaaatatggaacctgcttcgttgttaaagcactaaggtcagttaaatttatggatgccattattattgaaggcttgaaggttgagacagtgattggctgtttcaactgggaaagacaaatcattcaacctttaatgttggatttaaccatccataatgatttgagccgagctgcagcgtctgacaagcttgaggacacactcaactatgcccagatttgtgagttatcggctcaaaccattcagaaagccaagcctgaattaattgagcatgcagcacatctcgttctgcaatgtttgtttgaaacctttccaacaattgaaaaaattaccataaccatccgtaagccagccatcattgcagaagcaaatgctgtaggaattcgtcttgaacgcaccagaaacaatttttgcgctcgctctagcgagtaa

SEQ ID NO: 2909 - DNA, 864 bp, Acinetobacter baumannii
atatcaggcagatcagcttgcgatgcttgcacaggaaaatggcggctaatgaatattgctcaagcgcttgcaattcgtggtgagcctgacagttatgaacgacaggaaaatgcttggttacttgagtattttctaaaaatcaattcactcgaattaaagttcagacttgagcaagagttaacagcccaacaagagcaagactacctggctggtcttgagcgtatccaaaatggtgaacctttagcttacgtgacaggttcacaaccattttggacgctcgatttaaaagtaacgtcagatactttagtgccacgaccagatactgaagttttggtcgaaactgttttaaatctaaatttgccaaagaatgcaaatatcgtggatttgggaacggggacaggtgcaattgcgcttgcattggcaagtgaacgtccagactggttcgtcacagcaactgatatttacgcacctactttagacgttgcaaaagaaaatgcacaaacacatggcttgcatcatgtgaaatttgcttgtggcgcttggtttgaagcactagaaccccaacaatttgatttaattgtttctaatccgccttacattgaccctgaagatgaacacatgcaagctttggcaacagagccgcgccgtgcgttggttgcagaccatcatgggttagccgatattgaaattattattgcacaaggcaaaaactggttaaaaccgcaaggctggattgcactggaacatggttacgatcaggggcaagctgttcgaggcattttcgcagagcatggttttagtgagataaaaagtatacaagactatggccgaaatgatcgagtcactttggcatgttggatttaa

SEQ ID NO: 2910 - DNA, 2403 bp, Acinetobacter baumannii
tactgcaaaagtggagtgaaaactttggaagcgcgcgtaatcggtctagaaaaattagggaaacacgatgtcgaactcgtaggtgggaaaaactcatctttgggtgaaatgatcagccatttatcaaatgctggtgtatcggtacctggtggttttgcaacaactgctgatgcctatcgtgagttcttagaccaaagcggtcttaacgctcgaattcaagcagaacttgcagagcttaacgttgacgatgtaaatgccttagcagaaactggcgctaaaattcgtcaatggattgtagagactccacttacacctggcttagaacaagaaattcgtgaagcatttgctgcactttcaaatggtaacccagatattgctgttgctgttcgttcgtctgctactgcagaagacttaccggatgcatctttcgccggtcagcaagaaactttcttgaatattcgcggtattgataacgtattaattgctgtaaaagaagtatttgcatcattatttaatgaccgtgctattgcatatcgcgttcaccaaggttttgaacacagtctagttgcgctttctgctggtgttcaacgtatggttcgctctgaaactggcgctgcaggcgtaatgtttacccttgatactgagtctggcttccgtgatgttgtatttattactgcatcttacggtttaggtgaaatggttgtacaaggtgccgttaacccggatgaattctatctttctaaaccattattaaatgcaggtaaacacgcggtattacgccgtaaccttggttctaagcaccagaaaatgatttatggtgaagaaggttcagcgggtaaatctgttgtagttgtagacgttgaaaaacaagaacgtcaacaattcgcgttaaatgatcacgagttacaagagttagcgaaacaagcgcttattatcgaaaagcactatggcgctccaatggatatcgagtgggcaaaagatggtgacgatggtcaaatctatattgttcaagctcgtcctgaaactgtaaagagccgtcaaaatgtcggcacaatggaacgctacctactcaagcaaaaaggtactgtactttgtgaaggccgttcaatcggtcaacgtattggttctggtaaagtccgtattgttaactcaattaaagaaatggacaaagtacaagacggtgacgtacttgtatcagacatgactgacccagattgggaaccagtaatgaaacgtgctgctgccatcattactaaccgtggtggccgtacttgtcacgctgcaattattgcccgtgaacttggcgtaccagcaatcgtaggttgtggtaacgcaactgaagtattgactgatggtcaagaagttactgtttcttgtgctgaaggcgacactggtttcatctacgaaggcgcgttagattttgaagttcaacgtaactctatcgaatctatgcctaaactttcattcaaaatcatgatgaacgtaggtaaccctgaccgtgcctttgactttgctcaaattccaaacgaaggtattggacttgctcgtctagagttcattattaaccgtatgatcggtgttcaccctaaagctcttctgaacattgaaagtttgcctcgcgaaactcgtgcagcggtaatgacccgtacagctggttatgcatcacctgtagaattctatgttgaaaaactagttgaaggtattgctacacttgcagcagcatttgctgataaaccagttattgttcgtatgtctgactttaagtcaaatgaatatgcgaatcttattggcggtaagttatacgagccagaagaagaaaacccaatgcttggcttccgtggcgcaagccgttatgtttcggacaatttccgtgactgtttcgaacttgaatgccgcgcacttaaaaaagttcgtgatgaaatgggtttaactaacatccaaatcatgatcccattcgtacgtacagtgtctgaagcgaaacgcgttattgagttattagctcaaaatggcttgaagcgtggtgagaatggcttaaaagtcatcatgatgtgtgaattaccaactaatgcattgttagctgaacaattccttgaacacttcgatggcttctctatcggttctaacgacttaactcagttaacacttggtcttgaccgtgactctggtattgtttctcacttgttcgatgagcgtgatgctgctgtaaaagctctcctttctatggcaattcatgcttgtcgtaaagcgggtaaatatgtcggtatctgtggtcaaggaccatcagaccaccctgaccttgcaaaatggttaatggagcaaggcattgaatcagtatctcttaaccctgactcggttttagacacatggttcttccttgctgaagaaaaaatcaagcaaatctaa

SEQ ID NO: 2911 - DNA, 807 bp, Acinetobacter baumannii
gatcgagaaagaatgaatagattattagtaacatcacttatttttgtatgtagttacagccttgctcatgaaccttatgttgcgccattagcgtataaaactgagcagacacaagtaccggtagtagctggttatgctgaagaagcactaaatagtgaatacgctttaaaagatgccaagcttaccgtcattacccctaaacaagatcctaaagttattaatgctgaagccctacataaatctgtaactgttttcgatgttgctttaccggaagacggtacatatattctgcaaactcaggcgacttaccctttaaaatatgtatatgatcaaaaggagtggcatttattttttgatttaccagcagataaagctccgccaagaaaagagcgtgactatctaattcctgctgatcttaaaactaaaaaaattaaaacagaggaagtaacaagagaatgggtgttacaaagttatctttcaaaaggtaaagtttcagatattcaacttccaaatacaccagttaaagttaatttttctgttcatcctaaccagcttaaagttacccaagcagttcagctaaccataagtgaaaaaggccagaacctaccttatgctgaaattaatttaagagaaaaaggtgtaactgataaacaagtactacattttaaagctgatgataaaggacaagttgaacttaaatttccaaaagctggagaatatttaatggaagtcacagctccagtagatttaaagttaaagcctaaaaatcaaaattatacgattgttagcttacaagttaccgagtaa

SEQ ID NO: 2912 - DNA, 2055 bp, Acinetobacter baumannii
aggctaaggaggcgagtgaaaatgaatacacaaactcatgtaaatagccataaacaaaccatggcagtgccaaattttgaagtttggaaaaatgcatttgtgaaactgctaccacagcatgcaattaaaaaccctgtaatggcaattgtatggcttggaacagtggttacaggcattagtacaatcttaggttacaccacgctgttatttggtttagtggttacagcaattctgttcattaccattttatttgctaactatgctgaagcagttgcagaggccagaggtcgtggacaggcatcttcattacgtgcagcaagagaaaatttaacagctcgaagactcaactctttgacagaccgtcaagcgactcaagttgcagcgacccaacttcatttaaatgattttattgaagtacatgcaggtgagcttgttccagccgacggtgagattgtagaaggctttgcaactattaatgaatcggctgttacaggtgagtctgcacctgtgctacgtgaagctggaacagaccgttcaggtgttattggtggaaccaaagttcttacagatcgtattgttgtgcaagtgactgctgaatctgggcaaagtttcttagaccgtatgattgctttggtcgaaggctcaaatcgccagaaaactccgaatgagattgcgcttggcttcttgttaatggtgatgacaatcacatttttaattgtcgtgattagcctgccatttattgctcattacttgcatattgagctcgatccagttgtgctcgtggcgttattggtctgcttaattccaacaacgattggtggtttgttacctgcgattgggattgcgggcatgaaccgtgcactcaaagccaatgttttggcgaaatcaggtaaagcagtagaagtcgcgggtgatatcgatgtgcttttacttgataaaacaggaaccattacttatggtgatcgtcaagcgacttcattttatcccttaacttcggtaaccgagtcagagttgagagctgctgcttggataagttcacttgccgacccaacaccagaagggaaatcgattgttaagttagcaaaagaacaaggtttaaaacagcaagaacctgagcaagccgaatttatctcttttagtgcttcgactcgaatttctggtgtgaatttaccgaatggtgaccaaattcgtaaaggtgcattagatgcaatcttgaaatttgtagatgaggattattctcaagatttagaattaaaagcacgtgttgaacaagttgccaaaaaaggagcaacaccattggttgtcgcaaatcaacaccatgtattgggcgtaattgaactctcagatgtaattaaacacggcattaaagaacgttttgctcgtttaagagaaatgggcatcaaaaccgtcatggtcacaggtgataacccattaactgcggccgcgattgctgctgaagctggtgtagatgattatattgccgaagcaaaaccagaagacaaattggcttgtattcgcaccgaacaacaacaaggtcgtttagttgcaatggtcggtgacggaaccaacgatgcaccagcattagcacaagcagatattgggttagccatgaattcaggtacacaagctgcaaaagaagctggcaatatggttgatttagactcagacccaaccaaattacttgctgtggtcgagattgggaaacagcagctgattacccgtggcgctttaacaacattttcgttaccaaacgacgtctctaaatactttgccatcttgcctgcattgttcgctgctgcgattccacaaatgcaagtattgaatgtaatgcatttagcaagttcaaacagcgcgattttatctgcattaatttttaacgcgattattatcccgctattaattccaatcgcactccgaggcgtgaaatttaaaccttcaactgcaactcagttactacgtcgaaatatgttggtttatggggtgggcggtgtggttctgccattccttgccattaaagcgattgatgtagtaattgtgcaattatttggtttgtaa

SEQ ID NO: 2913 - DNA, 204 bp, Acinetobacter baumannii
ctctcttttgggccgtcagcaagataccatcatgagtggggtcatttacttttggcaaagtggagactatttagtatcggtggtcatttttatggcgagtatttttattccgatgctaaagcttcttattttgtatttcctgttgttggttgtatatatacagtcatccgcggcgtggaagtttgcaccggagcaatgcattaa

SEQ ID NO: 2914 - DNA, 1086 bp, Acinetobacter baumannii
ttagggaatgggactcttcaccgaggttgtaaaatgagacaaacgattttagctgtattgtctttatcaacgcttgccgcacttttgactgggtgcggtggtgatatggtacttctaaactctaaaggtccagttggtcaaggtcaaagtgaccttatgatgactgcgatctatttaatgttacttgtggtgattccttcaatcatcatggcattatggtttggttggaaatatcgtgcgtcaaataaagatgcagactataaacctacatgggcacactcaactgcaattgaagttgtagtatggggtattcctgtcattattattggtattttagcttggttaacttggtggggttcccacaagtatgacccataccgtcctttagaatcagataaagcacctttaactattcaggttattgctgaacagttcaagtggatttttatttatcctgaacaaaacattgcgactgttaacgaagtacgtttcccagagaaaactccgttaagtttcaaaatcacttctaacttcacgatgaactcattcttcattccacagttaggcggtcagatttatgcaatggcaggtatgcaaactcaccttcatttgttagcaaatgaaactggtgtatatcgtggtttctcttctaactactcaggctatggtttctctcaaatgcgtttcaaagcgcatagcgttacagagcaacaattcaacgaatgggtagcggctgttaaagcaggtaatggtacaactattaacccagaagcagttcaaaaaactacgcttgaccaagctgaattggcaaccttacgtgatggcgatcgttctaagcaccaaatcgagcatttagtaaatcgtgctaaagctgctggtgatcaagaagcgcttgctaaagcagaagcgatgaaaccgttcccgactaagccacaccctgtgacttattactcttcagttgaaccaaaattgtttgaaacaattatcaaccactatatgagtaactatcatggtgctgaccactctgctgcacatacagcagcagaaactcatgttgcagctgaacacgctgctcaaggggaataa

SEQ ID NO: 2915 - DNA, 648 bp, Acinetobacter baumannii
aaatgtgatggattttacatttttattcattgctgtggttcgttatggaagtcagtttcaaaacactcttatagattacattgggtatttcaacacttacatattgcaataatatattcatcatacttccctaaaagtctgatcaatcgcgatggtcaatataagagggaaggaaatatgccaaaatttctaataattgccgagaaggtttataaaaaactagaagaagataaattgttttcagataacctgatcgaacaactaaataacttggtcagtattattcgtaaagagataaagggaactccctgtaaactcaaatacaattttatcgattttgaagaatgtctaagtaaacccttaagtgaatgcacgattaaactcgacatgagtttaatgcctaaatataagaataagggtgaatatattatgtggctagcgagctttattgaaagaatcacggttggcgggcagccaaaattaccaccactttcaagtattgtgccagccgactttaacgtaaaaaaagaagctcagacgatagttgaaaataaaaaatcagtatcggaagaaaatgcaaagatgattgtgaattattttaattctgaagaatatcagaaaaataataaaaaaataaatctggtttaa

SEQ ID NO: 2916 - DNA, 843 bp, Acinetobacter baumannii
aattgtatcggaaaaaaacaacttttactctcactactaagcttaaagaacatttctataggacattacataatgaaaattcaaggaaaacatttcgtgattacaggtggtggctctggtttaggagctgcaacggctgaatatttagtaaagcagggtgcctcagtcacattagtagacatgaatgtagaagcaggtgagcagcaggcgaaacagttaggaccaaaagctgactttgtaaaacttgatgtaaccgatgaagcagctgctgagcagttctttaaagatgtgttggttaaacatggtcatttgcatggtttggttaattgtgccggtattggcccttctgcaaaagtagttggccgtgagggcgttcatgacttggggttatttgcaaagactttaaatattaatgtcacaggtacatttaacatgttgcgttttgcagcagatgcaatgagcaaaaacacggttgaagaaggtgaagaggaccgtggcatcattgtgaacactgcttctgttgcagcatttgacggtcaaattggacaggcagcttattctgcatcaaaaggcgctattgtggcgatgactttgccgatcgctcgtgagctagcgcgacatgccattcgtattatgaccattgcaccaggaattatggaaactccaatgcttaagggtatgccacaaaatgtacaagatgctttggggcaaatggttccgtacccatctcgtttaggaaaaccagaagagtttgctcgtttggttgcccatattgctgaaaactcttacttaaatggtgaagtcatccgtctagatggtgcaattcgcatggcagcaaaataa

SEQ ID NO: 2917 - DNA, 1335 bp, Acinetobacter baumannii
gaaatagagggggatgaaaaaggattaaagttaaggaacaaattaaaaatgaatattttagttttaggtagtggtggtcgtgagcatgctttagcatggaaaatcgcgcaagatgccaaagttactcaagttttcgttgcgcctggtaacgcaggaactgcaacagaaccaaaatgcgttaacgttcagctcgatattttagacaacccggcaattattgcttttgctaaagaaaataatgttgaactgattgttgttggcccagaagcgccattagtaaatggtgttgttgatgctgcgcgtgaagcaggcgtaaaaatttggggacctactcaatatgcagcacagcttgaaggttcaaaagcatttgctaagcactttttaaaacgccacaacattccaacagctttttatgaagtatttacggaagttgatgcagcaaaagcttatgttgaaaaaaatggtgcaccaattgtaattaaagctgacggtcttgcggctggtaaaggtgttatcgttgcaatgaccaatgaagaagcttttgcagccattgatgacatgcttgcaggcaacaaatttggtgatgcaggctcacgtgttgtaattgaacagttccttgctggtgaagaagcttctttcatttgtatgattgacggtaaaaacattttaccaatggcaacttcacaagatcacaaacgtatttttgaaggtgaccaaggtcctaacacaggtggtatgggtgcctactctcctgctccagttgtgactccagacgtttttgagcgtgtaatgaatgaaattatgcgcccaactgttgatggtatggctgctgatggacatgtttatactggcttcttatatgctggtttaatgattgatgaacaaggtcaaccacgcgtaattgagtttaactgccgtttcggtgatccggaaactcaacctatcatgatgcgtttgaagtcatctcttgttgatttggttgaagcaggtatcgcaggtaacttaccaagcgaagcagaatgggatgagcgtaagtcaatcggtattgtacttgcagcagaaggttacccagacagcgtgcgtaaaggtgacgttatctcaggtatcggtcaatcaccagaagatactaaaatcttccatgcaggcactgctactcgtgaagatgggcatatcgttacttctggcggacgtgtactttgcgtgactgctctaggtgatagcgttcttgaagcacaaatcaatgctttagaagtatgtgggcaagtaaccttcacaggtatgcaataccgcagtgacattggttaccgtgctattgctcgtgaaaaagctgaataa

SEQ ID NO: 2918 - DNA, 204 bp, Acinetobacter baumannii
tatccctttttctttaaatttttaagtagtacagaaaccagaacactgcacaatgctgcagcaaatattaataccatttgcaaagaacctattaatctaaattttaagaaacagagatggaccgcaggtagctttaatatgcttttttatagttttaaagccataaaaaaaccagtcatcactgactggtttttttcaagctaa

SEQ ID NO: 2919 - DNA, 918 bp, Acinetobacter baumannii
cacacttttatgtctagctcgattgaatttttcccacctatgattgatggcgtaagcgcaagccaagtctatcttcctccacaaacgatagcacaaaccatctatcaatttctttgcgaaaattttcctcatataaaagcaacagagtggcagcagcgttttcaagatgggcttatttacgcggcaaatggcgaaaaattaacattaaacagctcttatatagcaaacacacatattttttattaccgattccttgctaacgaagtacatgttccctttgagcatcagattttatttgaaaatgatgacttgcttgttgtagataaaccccattttttaacgattagcccaacaggacaatatgtacaagaaacattattagtccgattaaaaaagcaaactggtaatgagtttttaaccccgatccatcgattagaccgtgaaactgccggtgtcgttttattttgcaaacgaccacagtcacgtggaatttaccaacagttatttgcagatcgtcaagtcaataagatttaccatgcaatcgctgcatataaagctgaattaaaatttcctcagaatttaaaattgtatttagataaaggtacacccttttatacaatgcaggtaattgcacatacaaaaaccaataccgaaactaaaattgagctgattgaacataatcactcatgggctaaatattgtttaacgccatccaccggaaaacagcatcaactccgcgtccatttaaatcatttgggaattccgattaaaaatgatccgttttatccaatagttcaacataaagccgatgatgatttttctcagcccttacagcttctagctaagcaaatttcttttatagacccgctaacaaaacaggaaatggttttcaatacacagcttgaattgacactgtaa

SEQ ID NO: 2920 - DNA, 4515 bp, Acinetobacter baumannii
gtttattttatggcggaagtagaacagcagcccacttcggcacctagctctcctaagaagcgacgtattttgcgtagcttcttgctgacaatcttgatcatacttttattacttgttgcttccatcattattatgatgtcgactgaccgtggaagccgttttttattagatcgtgttttacaagctcagcaagtcattaaatatgagtatgaggggggtaatttactcaggggaattattcttaaaaatattattgttcagttaaaagaagttgacgttactttagatagagctgatgtccgtttagggtggcgttctttaatattagaaaaagaagtgcatttgagcaatgcagatgtccgtaacctagttattattaacaaagctccgccatcagataagccatttgagtttaaacccattaaattaccattcgtgcttcgtgtagatgttggagatgttgatcatttagaaattaaaaattcaggttctgtcgtaaatttccatgatgttcatttaaatgatgctttgtggtcagagacaaaactgaaatttgaaaattcaagtatggatatggggtatctttctgttcataacgcaacaggaaatatggactttagcggcaaatacccactgaatgcgactgcagatttaagaattccttctttaaaaagtttaaacatccaaaatattaaggtggcagcgcgaggtagtttagataccttgcaagccggtgtagcaacgacaacaccagatttattaacaggttgggttgttttacatcctgttcgtcatgaagtgcctatgcaaggtgcattgttactcaaaaattatcacttgcctttactggttgagcaaaaattatttgctaaaaacggtgtaattaaatttcagggtgatgttaagcaactcaacttagcacttgagacagatttaaaaggggaaaatttacctgaaggccagtacaacgccttaatgaatactgatctggttcatcagttgaatattactgattttaacgggcaggtcatgaagggtgcagttaatcttaaaggattagtgaactggaaagatcatgtcacttgggacatcaaaggtcgtctagatcatgttaatcctaaagacaaagctattcctcaggttgttcaggatttcttaccgccaagtttagatgcagccgtttcttcaactggttctttggaaaaaggtacggaagtatttgccaatgtagactttgaccgctatgaatcttggaaacttaaactaaaccaagcacctgaaaagaataagaagccacaacctatgtttatgaatgtggcttgggcaaatatagatcgtgctatgccatatataggttggttaagtagtgatagtggtcaagttgatttgactttgcgagatggtcagcaagatattaaagtttcgacaaaagtatatcagcatgaacaaaccttattaccggctggacaatatttagcaactttgaatgttaaagataatattcttaatgttcctagttttagttttgcggctcaaaagggtagcctcacaggtcaggccaaagtcttattaccaagtgaaaaacgtcagctggcatggaatgcattattaaatgcaaaagactttaatccacaaagtatacatacagcggcaccagttaacttgctcaacggatcaattaaagccagcggttttgcaaagccaaatcaacaaattattcagcttgaaaaaattgatttaaaaggtcgcttggctcaagcaggtcaagaaatggttgcgctagctggaaaaagtacagcagctttattatttaatgatgttaaagcaggtggcggttttaaaggctttgctgtcaattatgacggatctttaaaagcgcttaatcaagccaatggactattaaagttttctattgcaggtaccccagaatttatccgaattagtcagttacaacatgatggtgttgctgggaaaatctatgcgactggggcattaaatttaaaagaccgtattgcttgggatattaatagctcgttagtacgctttaaacctcaatattttgcctctagtgtaaaaggcgaaatttcaggaaatgtaaaaacacaaggcatctggtctgacaagttaaagcgtattgatattcaacaattgaaccttgcgggttatttgaataataagccagtcagaggtaaaggtaacttatccatacttatggattcgaaccaaaaaggctttttacctcagcaatttgaagcaaataatctatttttagtttatgcgcaaaaccagttgcaggcgactggtaatgcacagaatttaaaaattaagctgaatgcacctgcgctttatgatttgtatccgggtttaagtgggcgtgcatatggagacttgagtgtccaatctcaaccgcgtttgaaagctacggcgaatattgcggttgataattttgcatttaatacattagtcagtattaaaaaacttcgtatccagggtgaattgcctacttccgaaacaacaccaactcagttaacagcaaaattagacaatttacgtagtggtagccgtcaaattcagtctgctgaggtgaatttaacaggaacaagaaaagcacatttattaaaagtgcaaggaaataataatgtttctaaattctatgttcagttagcaggtggatttaatgcgaagaatgattggttagggcaaattcaaaaaggaagttttgattcacgccgaattcgtctagcacaaaatcaaaatgcaccagttgttttctcatcggcacgttctgaattatatgttgggcaacattgctggcaaagtacaaatagccagttgtgtcttgaccagcctgtgcgtgtgagtaaagcacaaggtaatatttcatttgttactcaaaatctagatttaggtgattttgctgcattcatgccggaaggtttggctatgacaggccaacttaatggttatgctaaagcttcttgggtaaatggtgggcatcctaagcttgatgcacgcttagtgaccagaaaaggtgaactgggcctagcagcggaagacccgcaagatccaccgactactttggcttatgatgaactgagtgtaattgcaaaaagtatttcagaaggcttattgttccgtgtcgatgtaaaaacacctgatattggtacaggatatgcgaatgttattattaatccataccaatcatctatgccaatgcatggtgaggtagcttttaacgatgtacagttaaaagtgttaaaaccattcattcaagatgtacggtcaatgagtggtaccttagccttagctggcaaagtgaatggtactttgacccagccacagtttacgggcgaaatgcgtttgaaaaacggggcgatcagtatgatttccctgccggttaatttaaccaatgtacaggtgtattcatctattcgtcaggacatggcaacaattgatggtgcattcaatagtggacaaggtgtagggttacttaaaggtagttttgactggaaaaatgcaccgcgtctacagttaaacttaaaaggcgataacttacttgtacgtcaagctccattaattacggccattgcaaatccgaatttgacacttgatatgtatccttttgataagcgtttaagcttgaaaggatcagtagatgttcctcgtgcacgtatttcaatgcctgaaacaactgcaccagtggttaacacatcttcagatgttcgtattgttcgccaaggtcaggacccacttgcaattttacgtgcggcaaaaccgtgggatatccgtgcagatatctcggtaaatattggcaatcaagtcatcttccaaggctttaacagtaatattcctttagtgggtcgtttgaatttaacccaacgcggttatgaaacggcaatgcgagcaatgggtgctattggtgtaagtcaaaaagtgaaaattgaggcctatggtcaaagcctggatttaaatcgtgcaattgcccgttttaatggtccattagcaaacccgacgttagatattgatgcgaataaaaatgttcagggtagtatggttggggttcgtgtcaccggtactgcttcatcaccaaacattcaagtttataatgatgcaggcctttctgaacaagaggcattaaatgcactcgtgacagggcgtattaatgaaggtgcaagtggtttaagtaatgcagaaggctttaaatctgatgtgaacaatacaattgctgctgccggtattagtatgggcttgggtggtactcgtgctttaacgaatcaaattggacgtacttttggtttgagtggtcttgcattagatgctcaaggtacaggggatgatactcaagtaagtttaactgggtacattacacctgatttatttattcgttatggtgtgggagtgtttactccagtcaataaactgacgttgcgttatcaaatgaaccgccgtttgtatttggaagcaagtcaatctttagaacgagcaatagatttattctataactggcgattctaa

SEQ ID NO: 2921 - DNA, 462 bp, Acinetobacter baumannii
gtttattttatgcaaatattacggttatctgattaccctcaatacaaagaaatggctgcacagtggttttctgaaaaatggcaaatccctgtggaagcctatcttgagagtattcagatttccattgatcaaaggcatgctattccacagtggtacattgttttaaatgaaaataagcatttaattgctggagcaggagtcattgataatgacttccatgagcgtaaagatttaacaccaaacttatgtgctttatttgtagaagagaactatcgaaaccaaaatattgcaaaacagattttagattttgtacgtgaagacttgagtaatcagggcatccaaacactttatttaataacagaccataccgagttttatgaaaaatgtggttggcggtttttaacgttggtaaaggatgaggaaggcgagatggtacgtatgtatgtagcagatactttttaa

SEQ ID NO: 2922 - DNA, 627 bp, Acinetobacter baumannii
agtataactatgaagcttaaagaattagcaggttgtgaggagtgcgataccgtctatcgtagagtcccgcttgcttacggaaaaagagcttattgtgtctgctgtggtgcagagctttatcggcataccaagccttttactacattgttagctctaattttaacggccctcattgtatttgttattgccaatagctttcccattgtcaaaattgaactgcaaggcaacatatccgaaaccactttactgggcgccgtgtgggtaatgtttcattacgatagggcatttgtcggtgttcttattttaattactacattcattgtgccacttacgtatttattattgatgggctatgtactcggtacggtcagtatattaaagaaacgcccccaatttttagtcggtgccttgcgaacactttattttatgagagtgtggggaatggttgaggtgttcctgattggaattctggtcacgcttgtaaaattaatgggcatggttcttgttattccggaaattgctctatgggcatttgcggtcttgagcctattaatggtttatattacttccgtaaaggtgagtgatatatggaatgaaattgataggtcacagccatggcaaaaataa

SEQ ID NO: 2923 - DNA, 774 bp, Acinetobacter baumannii
tggcagactatattgaacaacatcctgaatctattattcgtggtaagagaccagaggctaacgatgaaaaataaaaacaaccgatcattgcaacactctaaagtagccaaatggctgcttgggagtggagtgcttttgacagcgatagccatgacagcatgttctagttcaccaacaccgaactattatacgcttacacctaaagtgactccggtctcgaactcgactgtgcaggtgattgaggtcttgccggtcgggattccagatcgcttagaccgtgcgccactggtgctacaagacagtaatggtaagtcgacggtacttgataatgagcgctggacatcgactttgggtacacaattacgcgataccttatcggctggtttgcaacaaaaacttggagcaattgacagttatagcagtgggctttctggaaacaatcagcctctatatcgagtttctactgacttttctcattttgatattgtagataatagcaatatcaacgttgccgtatcttgggtagtgaagcgtcaaataccgcctactcaactagaatcaacgaatccgaaagtaatctcgaatagaggagcgcagctcaattgtagaattgcgtttaaacagtcgattgatcaaaaagctaaaaaaatggaagcaattgtaggtgcttcaaatgaagcgatgagccaaattattaataccatctcttcttcaattgtggcgctagattcaaataaaaaaatgaacatcaataacggtatatgttcatcttaa

SEQ ID NO: 2924 - DNA, 1044 bp, Acinetobacter baumannii
gaggcttatatgaaatatattataggtgtcttatgtgttacatatcttcctgcatatgcttttgctgaacagttacaggacaatacgaatgtgccggttccaagtattccggatacgattgacagcaaaagtaaaaacacgcagataaagatgaatgaacaggagcaagataataacgttgcacagctttttttaaatatttctattaattccaacccttctgaggatttagtagccgtaagacaagatcaagataaaaaattatatatccgtgcccgtgacttaaaaactttaagactaaaaatggatgattccatttctgatagccaatggatttgtcttaatgagcttaaagatatccggtttaaatacttggagaatgagcagtctttaaacttacaagtacctcctcacatgatgacaggctattcggttgacttaaaagggcagcagatcaccagtccgcagctacttaaaataaagcctttaaacgctgcaatcctgaactatagcctgtatcacaccataactaatgatgagaatgttttctccggttcggcagagggaattttcaacagtgcgatcggtaacttttcgtctggtgtgttatataacggaaatgataaaaatagttatagccacgaaaaatgggtacgtctggaaagtaaatggcaatatgtagaccctgaaaagatcaggatatataccctaggggactttatctccaatagttcggattggggcagcagcgtccgccttgcaggctttcaatggtcgagtgcctatactcaacgtggcgatattgtcacttcggcactgccacaattctccggttcagccgcactgccttcaacactggatttatacgttaaccagcaaaagatttattcaggacttgtcccgtcaggcccttttgatattaaacagctcccgtttatttccggaaatgaggtcacacttgtaactacggatgccactggacggcaagagcattaccaaaaagccttactatttttcatccaagattctggcaaaaggtattaa

SEQ ID NO: 2925 - DNA, 294 bp, Acinetobacter baumannii
tatttgattttcggattaactcgcatgaatagcaaatctcctatttttactgcacaatctgatgttgctcttcgcatccacgtggatcgcgcagttcgccattattttgcacaattgcaaggtgagcaaccatctcaggtatatgacatggtgctagcagaaatggagaaacctcttttatctgtagttctagaatatactcgtggtaaccaaacacgtgccgcagaaattcttggactcaaccgtggcactttacgtaaaaagttaaaagctcacggtttaatgagtgaataa

SEQ ID NO: 2926 - DNA, 693 bp, Acinetobacter baumannii
gagactcatatgctaaaaacaatatttcagaagtttcaaaaaaagcagggctgtgtggttattgcaggtcatgatatagaactacttgaccagaactttgtaattttagacaaaaatgagcaatctccattgcatgtctatcaagctgtgcatgattctagcgttcagaatatacaagtaaaccgtgtaaatgatggcataacgagtgtccgtttaaacttggtgaatactgagcatttaaaaagtttactaaaatatattgccagccatagtcatagcattgagttatgcgtgtttcagccaaatttttcatctgcgccaaatattgaagctttatctttagaagaaattgagcacagttggcaaacaacgggtttaagcgcggtgagcgtgtcacaagcagtgattaaaccgatgctaaagcagcagcggggcactgttatttttcttggagcgccatctaataattcggctcactacgatgtgttaagccaaagcatgtttgcgagtattcgagcgttatcacagtcattggcaagagagtttcagcccaaaggtatacatgtgacatattgcatggtggaaaaatgggatgggcaaaaccagcactttatttcatctgttaagcaagtctgtcagtacatctatcaacaacctaacactgcatggagccaagagcttagcgtgtcttga

SEQ ID NO: 2927 - DNA, 558 bp, Acinetobacter baumannii
atgttaaatattaagaatattcaacaaacggttaaagtagcgactacactggcagctttgatgtgcttttcttcactggcacaagcatatcaatatgagcaaaccgcgcgtttaattaacgaacgtttatcttatatgaaagatgtcgcaggttataaggcagagcagcatttaccgattgaagatttaacacaagaaaagaaagtactcgatcaatcgctttctgaagctgacgcttttgggcttaacagcgaaacagtaaagccatttatagtggcgcaaatggatgtggctaaagcaatccagtaccgttaccgcgccgactggttgtcgagtccggaaaccaactggaagcctcaagacttaagcgaagtacgcgtaaaaattagcgctttaaacacggagctgctaaaaaatatcgcctatgaacttaagaaaaataataacaaagcgcctcatggctgtagctatatgtggcctgttcagcatcctcaacttaaagaagctgacaagagagctttatgtgtaacattgaataaaatcaaattaaaacaatga

SEQ ID NO: 2928 - DNA, 537 bp, Acinetobacter baumannii
ctcataaatatgaatactatctcagctactcttttatatgaacacccgattgagggatgcaccaaagattcaaatggcaatttaaaacctttccctattctcgcaattgataatattccattaaatatatgggttcaccaaaatacccatattactgatctcgcagaaactttagttccagctcaaggttggttatatgattatgatagtgagttggcattaagtaatgcatggaaacttcttaaaccacaaacttatgaaaatgtatctatttcaacagtagttccaattttaatttgccctgatgatttagatctagtgtgcaatgtggttatggtggaacaagttgtttcagcagatcaagtcgtatgggctcgttttggttacgcatttaatcatattcatgatgttgtgacatccgtagtctgggaaaccccaccttctgctccgcagttaagttttccattaagcgaatttgaaaaagcatataatgatttaaaagaattagacaaaaaatggactgaaaattttatctag

SEQ ID NO: 2929 - DNA, 546 bp, Acinetobacter baumannii
gttatgaatatgaaaaacattcagaaatcacttcttgcagcattaatagttgctggttatgcggtaaatactcaagcagctgttactggacaggttgacgttaaattaaatatctcaacaggctgtactgtaggtggtagtcaaactgaaggaaatatgaacaagtttggtactttagattttggtaaaacttccggtacttggaacaacgtattaacagctgaagttgcttcagcagcaacaggtggcaatatttctgtgacttgtgacggaacagatcctgttgattttacagtcgcaattgatggtggtgaacgtacagaccgtactttaaaaaatactgcttctgctgatgtagttgcatataacgtttatcgtgatgctgcacgtacaaacctttatgttgtaaaccaaccacaacagttcactacagtaagtggccaagctactgccgtaccaattttcggtgcaattgctccaaatacaggtacaccaaaagcacaaggcgattataaagatactctattagtcactgtaaatttctaa

SEQ ID NO: 2930 - DNA, 1995 bp, Acinetobacter baumannii
gacatggatatgatttttggtaaattgggttgggactctatcccgacagagccaatcgtacttgtcaccatggtctttatggcacttggtgcaattgctgtgcttggcggtatcacctatttcaaaaaatggggatatttgtggaaagaatggtttacaactgtagaccataaaaaaattggtatcatgtatatcatcgtatctgtcgtcatgcttttgcgtggtttcgccgatgcgatcatgatgcgtttacaacttttcctcgctaaaggcggtggtgaaggttatttacatcctgaccattacgaccagatcttcaccgcacacggtgtaatcatgatcttcttcgtagcaatgggtctagttgtaggtatgatgaacatctctgtacctttacagatcggtgctcgtgacgttgctttcccattattaaactctttaagcttctggttattcgctggtgctgctggtttaatgatgctttcacttgtattaggtgaatttgctgcgactggttggatggcttaccctcctctgtctggtattcaatattctcctggtgtaggtgttgactactatatctgggcacttcaggtttctggtctaggtacgcttttatctggtgttaacttcttcgttaccatcatcaaaatgcgtgcgcctggcatgaaattgatggatatgcctattttcacgtggacttcactttgtacggctgtattaatcattgcatctttccctgtattaacaggtactcttgcgatgcttacattagaccgttacttcggtttccatttcttcacaaatgagcttggcggtagcccaatgctttatgtgaacttgatctggacatggggtcaccctgaagtatatatcttggtattaccagcatttggtttatactcagaaatcgttgcaaccttctctcgtaaagcgttgttcggttacaagtctatggtatatgcaacaattgcaattactgtattagcatttgttgtatggcttcaccacttcttcaccatgggtgctggtgcgaacgttaacgcgttcttcggtatcatgaccatggttattgcgattcctactggtgtgaaaatcttctcttggttattcaccatgtataaaggtcgcatcacctttactactccaatgttatggacgcttggcttccttgtaacattcggtatcggtggtttaactggtgtacttatggctgttccacctgcggacttccttgtacacaactcattattcttgatcgctcacttccataacgtaattatcggtggtgtggtgtttggtatgtttgccggcatcatttactactggccaaaaatgtttggttggaagctcaatgaagcatggggtaaagctgcattctggttctggttcttcggtttctattttgcattcatgccactttatatccttggtttcatgggtatgactcgtcgtttgaatacatatgacaaccctgaatgggacccataccttgcgattgcattattcggtgctgttcttgttgcgattggtattgcatgtttcttaatgcaaatcatcgttggtttcttacaacgtcaccaaaacatggactacacaggcgatccatgggatgctcgtacacttgaatgggctacttcttcccctgctccattctataactttgctcatgaaccagatgcaagcggtattgaccgtttctggactgacaaagagaacggtgtagcatacgcacgtaatactaaatatgaagacatccacatgccgactgatcgtgctgctggttttgtcattgcaatgttcattactcttcttggctttgcactcatctggcatatttggtggctcgttgttgtttcattcgttgcagctgttgttagcttgatcgtaagctcattcactaagaatgttgattactatgttccagctgcagaagttgagcgtattgaaaacgaacgctatgctttacttgaaaaacacttgaagaaggactaa

SEQ ID NO: 2931 - DNA, 687 bp, Acinetobacter baumannii
atgtcggatattattttgcatcaatgggaaatttctccattttgccaaaaagttgcaagagctttgaaatttaagggaatcccatacgaaacgattaattacaacggcattcttggagcgaaagttcctttgctcagtaaagtgggcaaagtacctgttattgaccataaagggcagcgcatacaagacagtacccgtatcgctcgctacctagacgaaacctttccgggtacacttcgcctttatcccgaagacccaaatcaaaaagcacttgtagaactttgggaagactgggcagatgaatcactctatttttatgaagtatatttaagagtaaatgattcggaagctttagaagaagcaattcgtattagcagtattggccgccctgcatatgaaaaacctatggtgaagggttttattttagctgaactaaaaacacagcttttctttcaaggcttgggcagaatgaaagctaaaaatgttgaagaagaatttatacgacacctcgaccgtattgagcaggttttatcacaaagtgaatggttagtgggtgagaatcaaacgattgcagacatagctgtagttgctcaacttggtgaagtcattcgtacaagtaagaagtttggtaaggaaatcttggatcgtccatttatggcagaatggtataaaaaacaaacaggttga

SEQ ID NO: 2932 - DNA, 732 bp, Acinetobacter baumannii
atcatttgtatgaacacaacaaacgccttccctaaaactatttatgccattcagcatcttgctttcgaagacctaggttcattagaagatgttttttatcaacttgggtttcgtgtccgctattttgaagcaggtgtggatgatttaacccctgcttttacacatgacggtttaactattattttaggcggcccaatcggagtttatgaaaccgaagattatccgtttttaaaagatgaaatcgctttacttaaacaacgcttggcagcagataaacctacacttggtatttgcctaggcgcacagcttattgctcatgcacttggggccaaagtatatgcaggccatcaaaaagaaattggctggggaaccttaagcttaagtttacgtcctaatcaggtattatcacctttgcttaataatgtgcatgttttacactggcatggcgacacttttgacctgcctgaaaacgcagtgttattagctagttcagagatttatactaatcaggcatttgaagttggaaataatattcttgccttgcagtttcatattgaaacaacagaagaaaattttgagaaatggttaattggccatacatgtgaacttcgtaatgccaaaatttcaattccgaaactacgagaagaaaacttacaatatgctcaagcacttgaacatgctgcatttgaagttattcaaaagtttctaaaacgaatcggatatagtggttaa

SEQ ID NO: 2933 - DNA, 576 bp, Acinetobacter baumannii
  unsure (11): Identity of nucleotide sequences at the above locations are unknown.
cgggtgaaccntaaaaaagattctatattacaggatattaaaactattcatgagcgcccagccgaagttcaagaaagaaaaataccgggtcattgggaagctgatttaattaaaggtaaagacaataaaagttcgatagcaacacttattgaacgaaatacacggctctgtatcttggcaacattacctgatgcaaaggcagaatcagtgcgcaaggctttaactgaagctctgaaatatttacctgcagaactgcgtaaaacgttgacctatgaccgtggacgtgagatgtcagaacataaaatactcgaagaagatttaggcatagatgtatatttctgtgacccacattcaccctggcaaaaaggcacatgcgaaaatatgaatggtttaattaggcaatatttacctaaagggattgatttaaatcaggcagatcagcattatttaaatcaagttgccatgtcactgaatactcgtcctagaaaggcgttagattggcttacaccattagagaaatttgctcagcttgttgattatcatatggcttttgaaactgtcgcacctcatgtttga

SEQ ID NO: 2934 - DNA, 1443 bp, Acinetobacter baumannii
ggtcaaggtatccgtccaggtacttactgtgagcctaaaatgactacagttggttctcaagatacaactggtcctatgactcgtgatgagttaaaagacttagcttgcttgggcttctctgctgacttagtaatgcagtctttctgtcacactgctgcttatccaaagccagttgacgtacaaatgcaacatacacttccagacttcatcatgaaccgtggtggtgtatctttacgtccaggtgacggtattatccactcttggttaaaccgtatgcttcttccagatacagtaggtactggtggtgactcgcatactcgtttcccaattggtatttcgttcccagcaggttctggccttgtagctttcgctgctgcaactggtgtaatgccacttgatatgcctgaatcagttcttgttaagttcaaaggtaaaatgcagcctggtatcactttacgtgaccttgtacatgcgattccttactatgcaatcaaagaaggcgatcttactgttgagaaaaaaggtaagaaaaacatcttctctggtcgtatcttagaaatcgacttaacagaaatggaaactgacttaacagttgagcaagcattcgaactttctgatgcttctgctgaacgttcagctgctggttgtgcaatcacactttcagaagagaaagttgctgagtacttacgttctaacatcacaatgcttaagtggatgatttcacaaggctatggtgatgcacgtacgatggctcgccgtgttgaaaacatggaaaaatggttagcaaacccaagcttacttaaagctgatgctgatgctgaatacactaaagtgtatgaaattgacttgtcagaaatcaaagaacctatcctttgctgcccgaacgatccagatgatgcaaaacttctttctgacgttcaaggcgacaaaattgatgaagtattcatcggttcttgtatgactaacattggtcacttccgtgctgctggtcagttacttgaaaaagtaccaagcggttcattaacaactcgtttatggttggctccaccaacacgtatggacgaacatcagttaatggaagaaggcttctataacacttatggccgtgctggtgcacgtacagaaatgcctggttgttcattatgtatgggtaaccaagcacgtgttgcgccgaacacaactgttgtatcgacttctacacgtaacttccctaaccgtttaggtcaaggttctaacgtttacttagcgtctgctgagcttgcatctgttgctgctgtacttggtaaattgccaactccagaagaataccaacaatatgcagctcaaattgacagtatgtctgctgacatctacaaatatttgaatttcgaccaaatgggcgaatatacaaatgctgctgataaagtagatactaagaaaattgctgctgctcagttgacttaa

SEQ ID NO: 2935 - DNA, 927 bp, Acinetobacter baumannii
tgtaacttcataagttacttattaagggtgcacaaaatgctttacgacgttacgattatcggcggcagttatgcgggtttatcagcagcaatgccgttagcccgcgcacgtagaaatattgcgattattgatgcagggcaaagaagaaatcgttttgctgaacattctcatgggttccttacccaagatggaactcgagctagtgaaattgttgaaattgcaaaaaatcaattagaagcatatagcactgttcactggaaaaatggatgggttaaacaaatcgcaaaaatagatgaaggcttttgtatttgtattgatggggtagtttccattcagacaaaaaaaattattattgcggcaggagttaacgatcagttgccggaaatatctggtttggctgagagatggggaaaaacgatttttcattgcccatattgccatggatatgaattacaacaagggaaaatcggtattttggccacttctgagcacagcctgcaattggcgatgatgttgcctgattgggggccaactacacttttacttaatggagatgatcaactcatccatacagaatggcatacttccttgcaaaaacgtggtgtagttgtagaaccaggttttattcaggaaattagagcgaatgctgaggtagtttttacagatggaaagattattgctctagatggactgtttgttcctacacgtacctatattactcaaccttgggtggctgagcttggatgtgaagtcgaagacacaccgtttggacaaataatcaaaacaagcgcgacaaaagacaccacagtaaatggagtttttgcttgtggggatattgcacgtttaggtggttcagtaccattcgcagttgcagatggaatgatggctggggtgagcgctcaccgttcacttgtttttaatgtgtaa

SEQ ID NO: 2936 - DNA, 198 bp, Acinetobacter baumannii
aacataatcataaaagaccttgctgaagacacggttaacgttctagcccctcgactaggcaacttggttattcagcaaggcagtaaaataaaaataattcaaatatttctatattctattttttactcaaaaaaaccaaaaaataccggtcaaataatattattgatgagcttaatttttttagaaaattattactaa

SEQ ID NO: 2937 - DNA, 1038 bp, Acinetobacter baumannii
gtctttgtcatggttgtccaatcttctttaagtaaaggaacaatttcgattgcattggtacatgaagcattaagtgcggcttatgctaaaggactaaatactcaaattattttgaataaagctggcattcctgctgaattacttatgacacctaaagcgcgtgttccggtagcaacgtatgcacaattatggatagaacttgccaatgccatggatgacgagttttttggcatggatagtcaccctatgcgccgtggtagttataaattacttacaaaactcgtcagtacggctgaaactttagaaaaagcactctacgatattttgaagttttttaattttgtgcttgacgatatacgaggagaactcattcgagaacaagaaaaagcttatttggtgattcatgatcaagaacaacccaaacgtatgtttacctacgcaacctttttaatgttggtacatgggcttatgtgttggttagtcgatcaaagaattggcttaaaccatattgctgtacgttgtccaaaaccgaacgatattcaagattatttggtacgcttttgtgaagatatagaatttaatgccgagacaaatcagattgaatttgatacacactatttagatataaaaattaaaaaagataaaaaagcgctttacgattttttagagcaaactccacaaaatcttttagttcgctttaaaaatgaaaatgcattgagtgttgttattcggcgtcatttattaaaacttcacccagccgaatggcctgaactcaaagatgtcgcacagcagcttaatatttcagaagctaccgttcaacgccgactcaaacatgaaggagtgagttatcaacaaattaaaaatgaaattcgttgtgatattgcgattgaacgcttaagcaaaagtaatgattcaatacaagacattagtgaagacttaaatttccatgatccaagtgcttttcaccgtgcttttaaaaaatggacgggtgtcagccccggcgcttatcgagataacttaactacattcaagcaataa

SEQ ID NO: 2938 - DNA, 894 bp, Acinetobacter baumannii
aatatatccatcccagttataaatccagcaaatgcttggaatgaaggtcgaataatgaagaagttaaatcaaataatgtttgcaatgattgcagcttcggcagcattaagtgcaaatgccgctcatgtattggttgtattgtctgatgaaggacagttagagctaaagaataagcaggtttttaaaacgggtttttatcttaatgagttgatgcagcctacaaaaatgcttttagatgcagggcataccgtaacgtttgccactccaaaggggaaagctccaacgttagatgagtcatcaaataatgcaatgtattttaatcaagatgaaaaagcattaaagcaatatgctggtttattacatgatttaaagttaacttctgctcaagattctcctgttgtaagtctggcgcgtattgagcaaattggtatagatcaatttgatgctatttatattccgggcggacacgcgcctatgcaagacctattaaaagataaacagcttggaaaagtacttacagctttccataaagctggaaaacctactgcattggtttgtcatggtcctatagccctgatgtcaactttacctcatgctgtggaagccgttaagcaacttgaacaaggtaaaaaagttaaaactggagaatggatttataaaaattatcagatgacagtaattagcaatcaagaagaagagcaagcgaagagcttgttaaaaggcggtgagatgaagttctatccacaaactgcattagagtcacttggagcaaaatatcaaagtaatacgaaagcttggtcgccaaatgtagtggtggatcgtgaacttattactggacaaaatccagcttcggctgttcttgtcggtaaatctttattagaaaaattaaaataa

SEQ ID NO: 2939 - DNA, 447 bp, Acinetobacter baumannii
gaattcgtcttgaacgcaccagaaacaatttttgcgctcgctctagcgagtaatttagacgcagcacaacactttacttttgcttatacgcaattagcaactttggggaaagtgcagttttcatctgtttatcaaattccatgccgagatggtattggagatgattactggaattcggcatgtctattaaaaagcaccttatcatctgaacaaattgaatcttttttaaagaaacttgagtcagattctgggcgtgttcgaccatcacatcatatttctttagatgtagatttgattgcatggggaagtgatctcgaccatatgcaatttaattctaaaaaattgccgttagcactcgatgtaaaaattcctttatatgaactttggcattgtgagaccttaaaggctgatagcacactttatccagtcgttaattttaaagtttaa

SEQ ID NO: 2940 - DNA, 816 bp, Acinetobacter baumannii
gtcacagccatggcaaaaataaaaaatgtgacttctgaaaaaatcacaaatacaaatatgattttaaaacaatatccaagagccaaagatctttcactgatattgtgtcattgctgtgggttattgaattcctcaaaagtaaataaaactgatgctcataaaaaacaaattctccgctgtgttagatgccatagcgttttgcacgagcgtaagccgggaagtttaaatcgtaccttcgctttagtggtggctgcgaccattctctatattcctgcaaatgtccttcctatgacggtaactgactctcttttgggccgtcagcaagataccatcatgagtggggtcatttacttttggcaaagtggagactatttagtatcggtggtcatttttatggcgagtatttttattccgatgctaaagcttcttattttgtatttcctgttgttggttgtatatatacagtcatccgcggcgtggaagtttgcaccggagcaatgcattaaactctaccgaattgttgagtttgtagggcgctggtccatgattgatgtgtttgtggtagccttacttactgctctcattcaaattcaatcacttgcaactattttagcgggaccgggttcaattgcttttggtgcggttgtggttttaaccatgtttgcatctttaagttttgacccacgtattatttgggataatttttatgcatctcaaaatacaaataaacctaaccgtgtttcttcggaaaaaaacacaattattcaggcagaacattcgcctttgaataatgattccattaatcccagtcaataa

SEQ ID NO: 2941 - DNA, 564 bp, Acinetobacter baumannii
gcggtatacatgaaaaatttaggcgcttcatttagagcattacacgtgctccacatagcatcggatttatttaaacaatacgggtttcataaggttggggtagaccgaattattagtgaaactaaaatttccaaagctactttttataactactttcattcaaaagaacgtctgattgaaatgtgccttctacttcaaaaagacacattaatggaaaaagtaagagtggagatagaaacgactcactattcaactttcgctcataaactcaggcaaatctatcacttacatgccaatttaaagagcgcttattatctgttgtttaaagcaatttttgaaattaaaacaagttatcctacagcttaccaaacggcgatacgttatagacgatggattaaaaacgaaattttctgcctgcttatggaaactaaaaaagccgtttcatatgccgaagcggaaatttttatatttatgatagatgggacaattttaggacttttgacttcagacagagccgaagaacaaaccaagttgttagactattttttagtgagggttaactaa

SEQ ID NO: 2942 - DNA, 654 bp, Acinetobacter baumannii
tttatccacatattaatagaaacaatacaaagcagacacaaaactatcgtatcagcatgtgccttcttcataattttctcgaaatttttaattacatttagctcaagacataaagattgctcgttattgaaaagagcatggagttccacaatgaaaatgaatgtttggctagcaagtgcattaatcgcaacaacatctatggttacagttgctcatgcagataatggtacccgtgtagcggcaacttctgctctaggtagtgtagtaggaacagcaatcggtaaaagtatcggtggtacatcaggtgcaacaattggtgcagctttaggtggtgctggtggtgcagcagcagcaagtgaccgtcgtaaccgtacagaagcggctattggtggtgctttaggcggtggcgcaggttacaccgttggtaaaaacatgggcggtacaaatggcggatatatcggtgcagcagttggtgccgctggtggttctgctctaggtcgtaaagttgcccaagatcgtaactatgatgaccgttatgaccgtcgttatgatcgtgatgaccgtagatattatgatggtgatcgccgctattacagaggtggtaactaccgtcatgacaacggtttacaccgtggttggtacaaacatcgttaa

SEQ ID NO: 2943 - DNA, 1332 bp, Acinetobacter baumannii
agcttgcacatgatgaaacaagatgaatccctgatgacatcacgtcggtttgtaccgatgttttttacccagttttttggcgcattaaatgacaatgtttataagcaagctttattgttagtcattacttatggttggattcagcaacaatctgcaccagtaagcacactcaataatttagcagcattgttgtttattttgccatatttctttttttcagcaactgccggacaaattgctgataagtatgaacgctcacaacttgtccgtggcataaaaattttagaaatcattattatgctcatcggttctgccggttttttattggggcatttatggttgcttcttttagccctatttttgatgggcacacattcaactttctttggtcccattaaatatgccattttgccagaaatcttaaaaccacatgaactcatgtctggcaatgccctgtttcagtctggtacatccatggctatcttattcggaatgatcttgggtggtgccgtaattgcatcatcagatggaaacttattgtggattagtattactgtagtagcgattgcttgcataggttatttattcagccgtttcatcttgccacaaaaagttgccgcacctgatttagatattgactggaactttatccgtacaagttttcaaactatcaaatatgccaaaagcttaccattagtgtttacaattttgttaggtaattcatggtactggttttatggagcgacttatttaactcaaattccgcagttgactcagcaaaaccttcatgcatcggaaaatgtggttagcctattactcactttcttttcagtcggtattggtgtgggttctcttctttgccgcaaaattggtggttcagaaattaatattaaaatggtgccaatcggtgcagttggccttactgtttttgcgctctaccttgcagccagtctggcttttgtacctgaaagaactggagcattactgactttaaaagatgtttttacccaaggctgggtttactaccatgtcatgattgctgtgactttattgggtattagtggcggtttttatattgttcctctatatgccatgatgcaggcttactcaccacgctcacatcgtgcccgagtggttgcagcaaataacatcttaaatgccgtttttatggtttcttctgcaattttctcaatcttaatcttaagtgttttaaaaattgatattaaaatactatttattattacagctgtacttagtgcaatctttagtatatggcttcttgcccgactaaaaccaatgcttgccacagcacatctttctttggaggactaa

SEQ ID NO: 2944 - DNA, 1617 bp, Acinetobacter baumannii
ttggttttaatccgtagacttgaaattgttgacttgaacatcatgactattaaacgtgctttgatttctgtatcagacaaaacaggaattgtcgaatttgctcaaaaccttgcagctttaggggtagaattattatctacaggcggcacatacaagttgcttaaagataataatattgctgttgttgaagtatctgaacataccggtttcccggaaatgatggatggccgtgttaaaacactacatccaaaaattcatggcggtattttggctcgtcgtggtctagacgaagctgttatgcaagaacacaacatcgatccaatcgatttagttgtagttaacctttacccatttgcggctacagtagctaaacctaactgttctcttgctgatgctatcgaaaatatcgacatcggtggtccaacaatggtacgtgctgctgctaagaaccatgcatctgtcggtattgtggtaaatgcttcagattacgatacagttattagcgaattaaaagcttctggttcactttcttacgaaacacgcttcgatttagcggttaaagcatttgaacatacagctcaatatgacggcatgattgcttcttacttaggcgctcgcgttggtaaggccgaaggtgaagcagatttattccctcgtacgttcaatacccaattaaacaaagcacaagatttacgttacggcgaaaatccacaccaatctgctgctttctatgttgaagcaaatgcaaaagaagcttctgtttctactgcaaaacaattacaaggcaaagaattgtcttataacaacattgctgatactgatgctgcccttgagtgcgtgaaatcatttgcaaaaccagcttgtgtcatcgtaaaacatgctaacccttgtggtgttgccgtttctttagacggtattaaagctgcttatgatttagcttacgcaacagatccagaatctgctttcggcggtattattgcatttaaccgtgagttagatgttgctactgcccaagcaattgtagaccgccaattcgttgaagtaattattgctccaagtattgctgatggtgtacttgaagttactggcgcgaagaaaaatgttcgtgttttagtatgtggtgaattacctgcaattgatgcacgtgctccacaacttgactataaacgcgttaacggcggtttacttgttcaagaccaagacttgggcatgattactaaagatgatcttaaagttgtgactaaacgtgcaccaactgaacaagaaattgatgatcttatttttgcatggaaagttgcgaaatacgtaaaatcaaacgctattgtttatgccaaaaaccgtcaaactattggtgtaggtgcaggccaaatgagccgtgttaactcagcacgtatcgcggcaattaaagctgagcatgctggtctggttgttgaaggcgcagttatggcatctgatgcattcttcccgttccgtgacggtattgataatgcagcgaaagctggcattaaatgcattattcaaccgggtggttctatgcgtgatgaagaagttattgcagctgctgatgaagctggcattgcaatggtcttcactggtatgcgccatttccgccactaa

SEQ ID NO: 2945 - DNA, 612 bp, Acinetobacter baumannii
agctatcccttttctgtattacttaggctaaatatgtcccaatcatatattgcaccagtagagttagaaaaagcttatcgtttgttaaatcatggtccaactgtactagtctctgctcagcatggtgatgaccgtaacgtgatggctgccgcatgggcatgtgccttagagtttaagcctgctaaagtgactgtcgttttagataaaagtactaaaacccgacagctggttgagcaaagtggttatttcacactacaagttccttgctatgcacagctcaatatgaccaagcaacttggtacaattagcaaattagatgacccacaaaaacttgaacactgcggggttgagctgttttatcaaaaagatctgaccagtccgcttgtatcaggttgtatcgcatggctggtatgtaaacttattcctgaaccacataatcagtcagctcatgatctatttattggttctgttgtaggtgcatgggcagatagtcgcgtttttagagatgggcattggcattttcaggatgcaccaaaagaacttcgtagtctgcactatattgctggtggcacattttatttaattggtgaggaagtgaaagccgatctttaa

SEQ ID NO: 2946 - DNA, 507 bp, Acinetobacter baumannii
atcatgaaaatttgtattgtaggaccttctggcgctggaaaaacaacactaagtcatcaattggcaaaaaagctaaatatctcagcttatgcatttgatgaaatttactggaatttaaatggaactgattttataaaaaattcagaggaattcatttctaatggagttaaaaaaatttctattcaagataggtggattgttgaaggagcttacgataaacgtttacttcccttacttcttgaatgctctttaattttaaagatggaagttcctttttatttaaggacaataagactcttacaacgttacttaagctctgtagttacagacaaggaacccaaggaaactctaaaaaatactttagagctgattcagttttcacatagttttgataaacgtttagaaaaatttctgtgtagtaatgctcaactctctaaaaagactattccttttaataacttttcaaaagctataaatattattcagacattttttaaaaataattaa

SEQ ID NO: 2947 - DNA, 240 bp, Acinetobacter baumannii
tttattgaaatgtttgaattaataccaattaatcgaaaaggtaagctgcgagaaattagaattattaaagcctttctaatttttgcatttgtattgtgtcttttaattttatatatcgaatatcaaaagtatgcacatataaactggaaatttgtatttattacctgtctatgtataatttgggattttgatttaaataaaaaaattaaagaattgaaagttcaaataaaaagtgattaa

SEQ ID NO: 2948 - DNA, 894 bp, Acinetobacter baumannii
tctaaactgattgtcatgttgaaaaagtatttattcctgactaaaccaggaattctcttcggtaatttcattaccaccttgggcggcttcttcttagccgcccaaggctctatagacatcttattattattgctcactctcattggaacaacattagttgttgcttcaggttgtgtggttaataatgttatagatcaagatattgatacaaagatgcagcgcactcaaaaccgtgcacttgttaaaaaaaccatctctcctactgttgcgcttgtatatgctttcgtactcggagtaatgggttttagcattttgtggtttggtgtaaatggttacgcatttttgtttgcaatgattggttttattgtctatgtcggtttttatagtttgtggactaaacgtacctcaatccaccaaaccgtcattggtagtatctccggagcgagccctcctgttattggttatacagcagtaactcatcaatttgatgtggcagccttgcttttgtttttagcatacgctttatggcaaatgcctcactcttgggcaattgcaatttatcgttttgatgattacaaaaatgcgggaattcctatcttgcctgtagcacgttccatttatcgcacgaaaattgaatgtgtaatctatatcctgttgtttgcagctgttttgaatgggttatattgttttggctacaccaatgtatttttcttgattacctttaatgctttgaccgcatactggttttatttatcaattattggatttaaagccgaaaacgaccaactttgggctaaacgctttttcctttactcagtaatcttaattactttgctaagtttaagttttagctttacctatcaatctcctgctccaaatcttcctctcttttaa

SEQ ID NO: 2949 - DNA, 243 bp, Acinetobacter baumannii
gtatgtatgatggaccagcaaactttattacaagaactgaactctctcattgaatactattcaaaaagaaccgattgcccccctactcgtatacgcatcggctatagagcttatgccaaactgatgcagtgcccgccttttgccgatgaagtaataaactcggcgctcgatccaaataagcggaaatataaaaagataaaaattaaaattaccaaagatgatgatcagttagaaattgaatag

SEQ ID NO: 2950 - DNA, 2616 bp, Acinetobacter baumannii
ggaataaagatgaatattgcggcgcagcctccagttcaggcagatcaaacagtttatttaaaagattatcaaaaacctacattcttggttgaatcaattaatcttgatattcaagtgtatgacgataaaacaattgttgattcaacattagtcatgaagcgtcaaactgctggagacttggtgctactgggccgtgatcttgagttgcaatctattcagctcaatggacaagatcttactcctgcacaatattcactcgatagtgaacaactggtgatcactgatgcaccagatgaagtcattttacaaactcaagtgattattcaccctgaaaccaacactcagcttgaaggtttatataaagctggtgacttgtttgtaacgcaaaatgagcctgaaggtttccgtaaaattacgttctatccagaccgtccagacgtactttcagtttttactacacgtgtagaagcagacaaaaaatatccggttttacttgcgaatggtaacttgcttgaaacaggtgaagttggtgaaaaccgtcactttgcgatctggcaagacccgactaaaaagccaagctatttgtttgcttgtgtgattggtgatttagctgtattgaaagaccgctatacgacttcggaaggacgtgatgtcgctttagaaatctatgccattgagaaagacattccaaaatgccatatcgcaatggaagctttaaagcattctatgcgctgggatgaagagcactatggccgtgcctatgatctcgacaactatatgattgttgcggtgagccagttcaacatgggtgccatggaaaataaaggtttaaatatctttaacacctcatgcgtacttgccgatgaagaatacaccactgacgcagcgattatgcgtgtacagtctgtgatcgcccatgaatatttccataactggacagggaaccgtattacttgtcgtgactggttccagttgtgcttaaaagaaggcttaacggtattccgtgatcaatctttctcggaagatttacaatctgctgcggttcaacgtattgacgatgtcgctgttcttaaatcgcatcaattcccagaagatgcaggtccattgtcgcaccctccacgcccagaccactttgtcgaaattaataacttctatacagcgactgtttatgaaaaaggtgcggaaattaaccgcatgatgtcgacattattgggtaaagaaaaattccgtcagggaacggatgaatatttccgccgtcatgatggacaagccgtaactgttgaagactgggttgctgcactctctgcaggttcaggtgttgatttatctgcattcttaacttggtataaccaaccaggtacaccaaagcttgaagcgaaaggtgaatatgatgcagcagcgcaaacttatcgcctaagctttaaacaaagcctaaaagcgcatccgaaatatccaaacttaaaagctgtcccaattcctgtagcgttggcattatttaatgcgaaaacaggtgaacaatatacgctccaaagcgaaagcctatttgtaaatggtgttaaagatggcgtgtatttatttgaccaagacgaggcaactattgagtttacaggggtaactgagcaacctgttgtttcactactacgtaatttctctgcacctgtaaatctggtatttgattacagtgatgaagaattagcattcttaattcaacatgaaacaaatggttttaaccaatggcaagcaacacaaaccttgcttgaacgtattttgttagaagatcactctgcggatacctatattcaagctattcaaagcacattgcctgaattagttggtcgtgatccacttttagcatcgcgtttgtttgatgtaccaactgaaggttatttgggtagccgtattgatcaaaactatgcaccagccgatatccatgtaaaacgtgaagccttactcaatcgtttggcacaagagttggggtcgttctggaaagatacgtaccttacactggaccctgacttgcaaaaagaattttctttagcgatgggtgtacgtgcattaaagaacattatgctcatgatgatggcgcgtcagggtgatcaaagtgcatttgaattagcttatgagcaatatcaaagcacggggaatatgtctgaacgtttaggtgccctgcgtgtactagtgtggcaaagtgcgcctcaagcacaagaagccctagctgatttctataaccgctttaaagatgaagcattgtctttggaccaatggtttatgattcaggcagcaaacccaaatgctacagttgagacaattgaatatctaactcagcatcctgattatgacttaaccacaccaaaccgtattcgcgccgtgagtggtggtttgtcaaataaccctgaaaatacgtggggctttggtgtagctcactttattaatcttgcagaatatctggacgagaaaaacccgattttaggttcacgcttattacaggtgttatctcgctggtacacgcttgccgaacctcagcgcactcaagtgcaacaggctttacaagcattgcagcctaaagtgaaatctaaaaacgtttctgaaactttaaatagtatgctgagcgtttaa

SEQ ID NO: 2951 - DNA, 927 bp, Acinetobacter baumannii
ctgggatggatatattctatttttaccccagaggtagaaaaacaactcatttcacaaatcttttttgcgtttgaggacaaaatgtctcgccaatttgaccatcttgccgatgttgaagtgtttttaattgtggccgaaaagctttctattagtgcagctgcaattgatttatctacaacgccttcggtcattagtagaacaattacaagactcgagaaaaaattaggtatccagttttttagaaggactactcgtcatttaagtctgaccgaagcaggtcagctttactatgaaaaaatgcaacatgcttttcagttaattgaccatgctgaacgcgtggttcaaggtgaacaactacacatttctggaaaaattaaattaagtgtacctacgacttatgggcactatcgtctaccccccttattagaaaaatttcttttgaaatatccggacattcaaattgaaattagtatttctaatcgaaacgttgacttaattgctgagggttttgatttagccatccgtcaaggacaacttcctaacagcacccttattgctagacctttagagcaagcacctttaaaacttgttgcctcacctgcttatttgaaacgcatgggtattccaaaaaatttggaagaattaaaacatcatcaatgtattgcctttgaattgcccagtagcggcaaaataaccccatggtttttaaaaaatgataatgaggaaattcaatggataccaacaaatcgaattttagtaaaagaagatattgtgggtgtggtaactcttgctgaaagcgggctaggtatatgtcaaagttacgactttattgttaatgaaaaaattcaacaagggaaaactacaacctatacttactacatatgcaggtcatacacgtcctttttctttgttatatgcgcagcataa

SEQ ID NO: 2952 - DNA, 1050 bp, Acinetobacter baumannii
acctgttacttgtcacgaggtatctttgccatgaatataaaaacaaaaaaattactcagacatttatgcatgttctctggactgatgttgacgggaaatatggctcatgctgcatgtagcgtgagcgcttcaggtacatcttctatttcggtcccgtctatttacttaatggaaaatggtgaaaactcatcacaatttaattcgggtttgtcgtgtacaggttttagcttggctttagcaaacatgacctacctaaaatatcgggttgagcaaatgtcaaattcatttaccaatgctcagaccggagaaaaacttaacgccattattctagacagtaacaatgaaatcattagtctaggccaagaaaaagacatgagtagctttacgctggtcaatctttttagcgggcctgatggcaatttacctttctacatacggcttccggctgggcaaagtgtatcgccgggtgtttatcgagccgactcaccgttaaaagtaaaatggttctattctgtgcccgcagttgcgattgtgggaatcggtgccttctttgagagccctgggtttaaacgtggggtattaggtattggttttaactggggaagtggggcagactcgcttggttcactctcaattactgtactgccagactgccgaattttagctcaagacgtaaactttggtacggcggcgtttgcttccaagcttgaacctgttcaatcgtctatgggaatacgttgctctgtaaatacaccatattatgtgagtttaaataatggactttccccgcaaaacggcaaccagcgagctatgaagtcacaaacgggaaatacatttttaaaatatgatattttcaagaattcatcgaatgaccgatggggaagcggtaacgagcgttggtcgagtttaaatgcaacgattaacccaggcgtacataatggagtaacgcagcagaattatgtgtttaccacaaaaattgtggaagaaaacgcagacacgataccagcgggaacttatcaagatacggtcacggtacaagtcgagttttaa

SEQ ID NO: 2953 - DNA, 870 bp, Acinetobacter baumannii
ttgctcaacttggtgaagtcattcgtacaagtaagaagtttggtaaggaaatcttggatcgtccatttatggcagaatggtataaaaaacaaacaggttgagacggctatggcatcagcaacaccagataaaatacgagattgtgcagttgttattggcgttggggcatcacagggcattggtgctgctgtctgtcatcgctttgcaaaagagggcttaaaagtttacgttgctggacgtactttccaaaaaattgaggcagtagctgccgaaatccatgccaatgcaggcgaagctgtggcatttcgtctagatgcagaagatatcaatcaagttcaagcattgtttgacaccatcataagtcagaatgaacgcattactgcagttattcataatgttgggggaaatattccctcaatttttttacgcagtccgttatcgttttttactcaaatgtggcaatccacttttttatcagcctatttagtttctcaaagctgtttaaaaatatttaaagaacaaaaccacggtacgcttatttttaccggagccagtgcttcattgcgtggaaagccttttttcgcagctttcactatggggaaatctgccttgcggacttatgcattaaacttagctcaaatttataaaactcaaggcattcatattgctcatgtcattattgatggaatggtggatggcgacagaattaataaagctttatttgggctaggacgtttcattcgtctcacacaggggacgggtggactcaatattaatgcactagccgacaactattggatgctctatcagcaaagccctgagctttggacaaacgagctagatttacgtccataccaagaaaaattttga

SEQ ID NO: 2954 - DNA, 522 bp, Acinetobacter baumannii
gagattaatgtaatgagttttcctcaagtcgaattaaacaccaacaaaggtcgtattgttcttgagcttaacactgaaaaagcaccgaaaacggctgctaattttctagaatacgtacgtgacggtttctatgatggcgtgattttccaccgcgttatcgacggtttcatgatccaaggtggtggctttgacgaaaacttcaaagaaaaagcaactcgtgatgcgattgaaaatgaagctgacaacggtttaagcaacgatgtaggtaccattgcaatggcacgtactcaagctccgcactctgcttctgcacaattcttcatcaacgtaaaaaacaactctttcctgaaccatacttcaaaaactgcacaaggttggggttatgctgtattcggtaaagttgttgaaggtatggacgttgtagaagcaatcaaaggcgtacgtacaggtaaccgtggttatcacgctgacgttcctttagaaaacgttgttatcgaatctgctaaaattatttctgaataa

SEQ ID NO: 2955 - DNA, 1152 bp, Acinetobacter baumannii
aataaggatgttgaaatgattctaaatgctgaacaaagtatggttcaggagatgatgcgtaactatgcgcaaaatcagttaaaaccaactgctgcacatcgcgataagacccatgaatttccggctcaggaactaaaagacttaggcgccctaggcgctatggggatgactgtgcccgatgaatggggcggtgccggaatggattatgtatctttggtactcgcaattgaggaaattgccgcaggtgatggtgctatttcaacaatcgtaagcgtacaaaactctttgatttgcggtattacattggcatacggttcagagcagcaaaaacaaacctatttgccaaaatttgcttctggcgaatggctaggatgcttttgtttaactgagccacatgtcggttccgatgcgagcgcgattttatgtaaagccgagcgagatggtgaccattgggtactcaatggcgtaaagcaatttattaccagtggtaaaaatgctcaagtggctttggtatttgcggttacagataaacaggctggcaaaaaaggaatttcgtgttttcttgtacccacgaatacacaaggctatttggtgactcgtattgaagacaaaatgggtcaacatgcttcggacaccgcaaccattacgttagaggactgccggattcctttagaaaatttggtagggcaagagggtgagggttataaaattgcgttatctaatttagcggctggacgtattggtattgctgctcagtctgttggtatggcaagagctgcttttgatgctgctgtccaatacgcaaatgaacgtaaggccttcggtgtagagctggttcagcatcaggcggttggttttcgcttagctgatatggcgactcagattgaagcggcacatcagctagttttgcatgctgcaactttaaaagatgcgggactaccttgtttaaaagaggcctcaatggcgaaactctttgcatcaactatggctgagcgagtatgttcggatgcaatccagattcatggcggttatggatacgtcagtgatttccctgttgagagaatttatcgtgatgttcgtgtaagccagatttatgaaggtgcttctgatattcagcgcttggtgattgctcgtgaagtggctcaagtttag

SEQ ID NO: 2956 - DNA, 915 bp, Acinetobacter baumannii
gtccttttcgtgaagtggttacaaatacacattaccgttgatcaagaacaagttgaattcacagaaacacttttaatgtctctaggtgcggtaagcgtaactttggatgatgccgaagatcaggctttactggaaccattaccaggtgaaacaccactctggaacaaagtcattgttactggtatttaccaacaagacgaacaagacccaattgatgttgatactttagaagctttcttaaaagcacaacttccagatgtgccaatgcgtcatgaagaacttgaagatcaagtttgggaacgcgcatggatggattattatgaaccaattcagattggggaaaaattctggattgttcctgaatggttagagccaccagaagcagatgctacaaatattaagcttgatccaggccttgcttttggtacaggtaatcatgcaagtactttcttatgcttacaatggttaggtaaaactgatgttaaagataagatcgtgattgattatggctgtggctcaggcattttaggtgttgcagctttattattaggcgctaagaaagtctatgcgacagacatcgatccacaagcagttttagcaactaaacaaaatgcagaactcaatggtgtattagaccgtttatatgtaggtcttcctgaagagtttgatcaagaattcaaacctcaacaagcagatgttttagtcgcaaatattttagcgggtcctttaatggcacttgcgccagagttcgcaaaattacttaaatctgatggtgatttcgcacttgctggtgtaatcgaagagcaagttgctgatgtttcaggtgtttattctgaattttttgatatattagatgtcgaaaagcgcgaagaaaactggtgccgcatttcaggaaaacgtaaaacaacaaattga

SEQ ID NO: 2957 - DNA, 573 bp, Acinetobacter baumannii
tttttatttttgagttctcttaatatgaaaaatatcggtttagccattttagcaatcagcctttcaggttgtgctgcaatgagcgtaaaagaatgtaagactgcgaattggtcattagtgggtgagaaagatggttcaaaggggtcttcgccacgtttagatcaatattataaagcgtgtggaaaagccaatattgttccagatcaaaagtcatatgaacgtgggtataaagaaggcttagggtattattgccagccatcaaatattttttataatgctttagagggtaacggcaatattaatgtatgtccaatcgagcagcgtaatcgtttaagaccttattatcgagctgcctcagattactacaatgcaaaagctgaatatgagcgttatgatgagaagtttaagcaatattctgacagtgcttataacgaaaaattaaagccagaagagcgcgaacgctatcataaacttttaagagaattacaaattgatcgtgaccgtattaacagaaactattggaactcaattcgagatatcgaacgttttaaatatgatcatggattaaaataa

SEQ ID NO: 2958 - DNA, 450 bp, Acinetobacter baumannii
tctgtggacgttatcttattacaacgcattaagaaccttggtaaattaggcgataaagtatcagttaaagctggttacggccgtaacttccttatccctcaaggtaaagcagttgcagctactgaagctaacactgctgctttcgaagctcgtcgtgctgaacttgagaagcaagaagctgaagtattagctgctgctcaagcacgtgctgaacaattgaacgaagttaacatcgttatcactgctaaagctggtgacgaaggtaaactcttcggttctatcggtactcgtgacatcgctgacgcgttaacgaatgctggtcttacagttgaccgtgcagaagttcgtttaccaaacggtgcgcttcgtcacactggtgaattcaacatcgcaattcaattgcaccatgatgttgttgcagaagttctcgttactatcgtatctgagtaa

SEQ ID NO: 2959 - DNA, 717 bp, Acinetobacter baumannii
agagaaagctttatgctgctggaaaaaattttacaatcacaagggtttggttcacgtaaatattgtcagcagttaataaaaaatggttcagtaagtattgatggggaggttgtgagtgatctcaaaaagcagttctccccagaaaattttgagttttccgtttttggtcaaaattatcaatatagagaaaaaatttatattgctctaagaaaacctcaaggttttgagtgttctcatcatcctcagcatcatcaaagtgtttttagcctactgcctgagaccatgattcatcgtggtgtgcaggcggttggacgcttggatcaagacacaacgggtctgcttttacttactgatgatggtaaatatctacaagctttaactcatcctcgtaaacatgtaccaaaggtttatcacgttacaacttacgaccccgtaacccctgagcaaattgaaatgcttactcaaggtgttaatttacaccaagaaaagggggtatttgctgccacagatgtagcactactaggaactcatcaattaacgatgactattcatcaaggtgtttatcatcaagtcaaaagaatgattgcagccgtaggcaataaagtcgagaagttacatcgacatcaaattggtcaattggttttacctgaaattgaggaagggggctggatatatttgtcggagcaggaaaaacaactcgctcaaaatattatttaa

SEQ ID NO: 2960 - DNA, 729 bp, Acinetobacter baumannii
gataaagcagtgacttatctgtttatttcagatttacacttgtcacctgaacaccctcgactcgttcgagggtttttagatttgttggtacattatcaaaataaacaaacacagctttatattttaggtgattggtttaatgcttggattggtgatgactattcagcgccttggctcgacgaaattgtcgaggctttgaaagtatttaaccaaaaagggaatcgcgtttatttccaagtgggtaaccgagactttgctttaaatcaggttttccttgataagtttaatggtgtattacttcctgatatttattatctcaacattgcaggtcaccaataccgtttggaacatggcgatgcgttatgtactgatgatatttcctatcaaagatttaaaaaaattatccgaaatcccttcctagttgcttttttacgccgtacccccttgagtttccgtacaaaactggtcaatggttttcgcaaaagaagtcattcagacaaacagcaaaaaagttatgaaattatggatgtaaatgaacaagctgttctctctgccctcacagatgtagatatacttattcatggacacactcaccgtccagcaattcatcaattacaacataaacagcggattgttcttggcgattggcgtgaagatcaggcttatattctggaaattgatccatcttcaaatacgcagcagctcgaattgattgtctggaattattag

SEQ ID NO: 2961 - DNA, 1290 bp, Acinetobacter baumannii
aaacctaaagtcaaaacaaagactttaggttttctatttttgcatcaaacaaaaagacaatctcatctatcggcaatgcagctgtgtataataggtcagtcagtcgtgattgatttaaacgctcggagcaaaatggccttacaaattctacaaaaacagctagatgaaagtagccattgccctctctgccaagcgtcgatgtactgggtagatgccgaacaatttgagcaagacgttcaatttcatgaatgtagccattgccaacaccgtgtatttaaagacacaaaaatgacgtgtcattgcgaccaatgcactaaacaaagaaaaaagcttttacagcagaccagattacaagaacaacgccagtttaagtcaaaagaccaaccacaacgtagtctggaacaacttagttttttaaataaactttttctgcttagtctgctcgatgactatgcacgagacgatgttgcacatgacgaatatattcactgggaccagataaaatatcagcctattacccccaactggatgttccagaaccatctcattaaacagcttcataaagatgggattttaaatgcacaagatcaaaccgatgaaccacagtgcttttatttaaatattcgtctagatggttatagcgacccgagtttatttagtgtggctcagcaattacgccactggttctatgaaaacctaagtcttggtattccatttcgtagtgccgatgaagtgaaagacgtgctgtttcaggtgctctatcaagaaattattcagttcactcagttctattgccgaacttggggtatccaaattgcaggaagctcaaattttcaagccttttgctaccgtttaatggactcattggcgattggtcaaatttattatcttattcagactgcacttgaatatctttataaacaaaaggcactacagccacgaaatgaaaagtttattaataccaatctattaaagaaaactttagagcaatatcgggaacgagctttggctgaaaagtgggaaacttcgatgttgccccgcccttacaatattccttacagtaaaatgagccatatattatttaaccgctttttaggttatgacgaacagatatttgtacaacctgtatggaaagcatggcgaaaaatcgaacctcgtttaaacttttactcggttaaacgttgtatgtactgtggttcaaatgatctaagcgtggactatgatgcagcagattatgtgtcgttgatttgccaaaattgcaaacatcaagatcactattttacccgttaa

SEQ ID NO: 2962 - DNA, 567 bp, Acinetobacter baumannii
atggcaaaagttgttactggattacgccctggtggacgcagcgaaagaatacaaactgcggtacatcaagctgtaaaagaactacaaaaagattttgagcagagccaaattactattcctatgattgcagtgcaggcaggggttacaccttcaaccatttaccgtcgatggggtgacatcaatcaattattttcagatgtagctttaaatgaactcaagcctgatatggaacccaaagatttaggttcgttccaacaagatattacagcatgggttgagcaatattttgaagaatatgcttcagaggttgggcaagacttattgcgagatgtactctatacatcaaactcggattctaatgcccgtaaatgtgagactttaattatccagcaactcgatattattcaaaacagggcaaaattacgtaatgagcttactatacctaatcaggaaatcatcgaggcagtaattgcacctatgttatttcgaattttatttaccaatcatgatcttagtcttgagtatgtatatgaccttttaaaccgtctttttataaaaaataagtag

SEQ ID NO: 2963 - DNA, 1260 bp, Acinetobacter baumannii
ggggaaaaagtaatgaaagtattactcgatatcttatttgcttttgcctttttatatccgttgttgatggcttggacatggatggtaggaggtctctggtttttctttaaaagggaatatcatgagcagcaactgcctgagccatcaagtgaagggtgcagtattattattccttgctttaatgaagaagctcaggtccgacaaacgattcgttatgccttacagacaaaatatccgaattttgaagtcattgctgtaaatgacggaagtagtgacagcactgcagaaattcttgatgaactggcagctcaagacgcccgattaagagttgtgcacctggcagaaaaccaaggtaaggcagtggctttaagatcgggagtgttagtaagtaaatatgaatatctagtgtgtattgacggagacgctttattacatcctcatgcagtactttggcttatgcagccttttttaaattttccaagaattggtgctgtaactgggaatcctagaattttaaatcgctcaagtattttaggtaaattacaagttggcgagttctcttcaattattggcttgattaagcgcgcacaaagaacatatggccgtatttttacagtatcaggtgtaattgcagcatttagaaagaccgctttggttcgcgtgggcttttggtctgatgacaaaattacggaagatattgatatctcttggaagctccaaatggaccattgggacattcaatatattcctcaagcactttgttatatctatatgccggaaacctttaaaggcctttggaaacagcgtttacgctgggcacaaggtggggtagaggtattattagaatatattccgaaaatgttcaaactccgcttgcgccgtatgtggccggtaatgctcgaagctttaatcagtattatttggtcatatgtgatgattatgatttttattctattttttgtgggattgtttgtggatttaccgcaacaatttcaaattaattcactcatgccgcagtggtatggcgtgatattaggtggaacatgtcttgttcaatttctagtaagtttatggatagaccatcgttatgatcgtggtcggctttttagaaattatttttgggtaatttggtatccattatttttctggttactgacgttatttaccagtgttgttgcagtacccaaaactatatttaacaccaaaaaacgtgctcgttgggtaagccctgaccgaggcttccgtggagatcattcatga

SEQ ID NO: 2964 - DNA, 186 bp, Acinetobacter baumannii
aatgttccggttttaaatgtgcaaacttcctctcgagattctagttttttattattttggtctcttttcccttatactttcttttttgagtttccttttattaatttattatggcgtcaccccaatccccttcttcttcccctcgacattactcactcttcttggcaattttttctctcgcagtag

SEQ ID NO: 2965 - DNA, 549 bp, Acinetobacter baumannii
tgtaaaaaggttttaaccatgaaaaagacttttttttatttatcagcatttgctgtaggattatcttctctcaatgcagccaatgccgctacagcaacaggcaccttgacggttagagctacagtaacaaatagctgtgtcctgaatacctcagctactggtacgacagctaatgcagttctagactttggcaccttaagttctctggctggtaatgtagacgcagatactacaactactggtggtactccaattagagtgttgtgtaacaacacagtgccatggactttgtcatttgatggtggacaaaatgttctatcaactcaacgtcgtatgattggtggcgcgtctactacagaatatattccttataacctttactctgacacaggacgtgctacggctattggagttgcaacaactgcttatagtggaacaggcacgggtaatgtccagacagttaacgtgtatggccgtatccctgctggtacaactttaccaagtgcaggtagctatgttgacactgtgacagtcacagtaacttattaa

SEQ ID NO: 2966 - DNA, 927 bp, Acinetobacter baumannii
gttcatttatttcttatgtcaaaaaatttagcaaccttgattggtttaagtgccatcctaatgtgggcctctatggtaggcttcgtaaaacatattacgactgcaatcggtccagatgttggcattacgctgatctattccttaagtgctttactcctgctcattatttttagggtgccaaattttaaattaatttctaaaaaatatttaattttaggggcaattttatttattgcttatgagctttgcttttcgtttgcacttgcctattcaaagacggcgcaacaagcgattgaagtaagtattgtgaactacctttggccaagcctgactgttttagcttttgttatttttagagagttaaaatttaatgtgtttattattttaggattactcatttcaatttccggtatcatttttattcagactgggaacggagattttagtttaggtcgtgttgtcgataattttcatagtaatcctttaagttatattttggcctttataggtgccattatttgggctttttactgtgtgttgaccaagaaaatgggtaaaggacaaaaccctatttctattttctttcttggtgttgccctaaccttgtggctaaaattactttttagcggccaagtgagtttgccttcactcgatttaaatacaattttatctttaatcgttgcttctgctgcaattggcctcggttatgcagcatggaatattggcattattcatggcaacattaccatgctggtggttgcttcttattttacccccatcatttcatctttacttgccatgttggttttacagacagagctatcaatcagcttttggcaaggtacagccatggtcacggcgggttcacttatctgctggctttcaacaaattgggctgtgattcgttcctatttcagaaaaaattaa

SEQ ID NO: 2967 - DNA, 927 bp, Acinetobacter baumannii
aaaagcatattaaagctacctgcggtccatctctgtttcttaaaatttagattaataggttctttgcaaatggtattaatatttgctgcagcattgtgcagtgttctggtttctgtactacttaaaaatttaaagaaaaagggatatcaacccatgcaaatgattgcatggaattacgcaagtgccagcttgctatgttatctgtggtttaagccagatattcagcatatttctatacaacatacaccttggtggctaattgtggcgttaggcgtcattctaccgagtatttttttatgccttgctaaatctttagagtacgcaggtattgtcaaaaccgaaattgctcagcggctgtccgtggtactttctttgttggcggcttatttctttttccaagagcagtttaattctcttaaattattagggataggtttgggaatttttgctgttctcttaattttattaggtcatttcaacgagtcttccggatctcagtcaaaaaaagcaatttttgctttgatgagtgtttggtttggatatgccgctgtagatatcttgttaaaatatacgagtagcttaggcctacagtttactttgactttaaatctaatttttataacggcctttgttttatcgattatttatttaatatttcaaaaaaattcagcatggcattttaaaaatacttttgctgggttaatgctaggcgtactaaatttttcaaacattgccctatacgttaaagcgcatattttactcaaagattctccggccattgtctttgcgagtatgaatattttggttgtgttacttggaatagtttgtggcgtagttttatataaagaaaaattaaaattaccaaccatcgtaggaattattttaggaataagcggactggtgagtttagccttagctatgaaatag

SEQ ID NO: 2968 - DNA, 945 bp, Acinetobacter baumannii
atttatgtattcaggcttgtgcccatgttagaaattcgacaccttaaaactttagttgctttacgtgaacatggttcactggtcgctgcagctaatgacctatgcttaacgccctcggctatttctcaccaattaaaagaattagatcattggtatggggtagaggtggttaatcgccgcagtcgacctgttagtttttctaatgtaggacaacgcctacttaagttggctgatgatgtattgccgcaaattcagattactcagagtgatattacacgtattgtgcacggacaaacgggcagaattattttttcatctgaatgtcatagctgttttgactggctaatgcctttactcaatcagtaccgtcagcaatatccagacgtcgatttagactttgcttcggggtttgaagcgaacccacatgaacttttacaaaatgctgagtttgatttacttattacagctgatccgatcgcactaaaaggaatcgaatacttcccgatctttgaatatgagtcgcgtttggttttatcaaatactcatcgattggttcgtgctgaaaatattactgttcaggatctcgcagaagaggttcttattacttacccggttgataagcaccgtttagatatcatgtcgaaactgtttatacctgcaaatattcaaccaaaacaaatccgaacaacagacttaacgcaaatgcttattcaactcgttgcgagtggccgaggtattgctgctttaccagattgggtagtcaatgaatacgaacaaaagggttgggtgactagccgccgtctagattgtgtttctccagcgggtttaagacgtacattgtatgcaggttatcgaactgaagaaaaagagaagagctactttgaaggtttcttaaagcagctagaaaagttttctttaaaacgcacttcttactattcaggctaa

SEQ ID NO: 2969 - DNA, 2328 bp, Acinetobacter baumannii
ttaaaatcattctcatttataattcgacgaatttacaatcactctcagggcgagaaaatgggaaataagataaaaagtaataaactttttactaggaagtctgaagcaaaaaatatcattccacttctatcacttggtggagccatctttctctcaaattcggcctttgcagcctcgccttctgagacaacagatgctgaaaaaaagcctgaagcactccctacaattacaatcaccgcttcacgtgcagatgaactttctacatctgccaaacaagtgacgaagctagatgaaaaacaaattgaacttttaagaaatggttcatctgggaatattgcaactgttttagctaaagccgtaccgggcctttccgactcaagccgaaccattaccgattatggtcaaactttacggggccgtaatgccctcatcttggtcgatggtgttccaatgaacctgacacgtgacacatcaagaggtctttcagctatcgaccctgaaagtattgctaacattgaagtcattcgcggtagtaacgcaatttatggcggtggcgcttctggcggtattatttcaattaccacaaaagcggctggtggaaaacctaccgccaaaacagtcgttgggctacaaacacctttaacaaatttccgttctaatgctttaagtggcgatattcatcaatatttcacaggcagctttaacgcttttgactatgcactcgactttggttaccaacgtattggtagcccatacgatgcaagtggcgaccgtgttgcacctgaaccaagtcaaggagatttatatgattctgacggctatagcatcggcggtaagcttggttaccatattgatgacaaccaatatctacaattcgctgcaaactactataatgccgagcaagattcagattatgcatctgacccaagtgtgaagaatgcccctgccggaacagtgccagcgaaagcaattaaaggcttaaagctaaaagaccaaaataaaaacgaaaaccagatctacaatttaacctataaccataaagacttttttggcaataaggttgatgcccaaatttattaccgcgacttctttactcgtttttcaccatttgatgcacgaaaaaatgcaaatcgtggtggacaagtcgatcagatctatcaagaaaataatgtactcggtagccgcttaactgtgactacaccacttgagtttttaggtgacacctcattggtttggggtggtgactttagccgcgaaaagagcgaaatgcctttagatatttttgatcaaaaaatttatgaccaatctggtggcttagagtttgtaaaaattggcaaacttatttatttacctgaacttaccacacaaagtgttggtggctttgtacagctaaaacatcgctttaatgaccaatggtcggctgaagcaggtacacgctatgaagatagctatgcccaaattgatagttttattccattatcacaatttgatcctaaaacacaatcatataagccaaacccttatgtatatcaaggtggaaaagtaaaagctgatgcatggttgtacaatgctaatgtaactttctctccaaatgaccagcactcgatttatgcatcgtttaaccaaggttttcaattacccgatgttggtgtaattattcgtaatgcagataatactgataaggaaaaaaattatgaattatcatcttcatttttagaacctgtaaaagttgataactatgagttgggctggaaagggaacttcaataacttttcatcaagcttagcagtcttccactctacttctgatctaggcgctgtgcagtctttcagcaatggtctggcacttactagaaccaaagagaaagtcactggtgttgaagcaacttttgactatctggacgatgccaatgtttggggaactggtggtagcgttacgtggatgaaaggccgtgaaaaaccgcaaaacggtgctgagcaagacatgacaggcttccgtattccgccattaaaactcacaggttatatttcttatagcccaacagaaacttggacaaaccgtttacaagccacttacttcggttcagaagattaccgcctaaacggtaagaatagttttggtcgctacgatgtaaaatcttatacaacagcagatttaatcagtagctttgcacttaataaaaaagacaccatgacgattggtttagagaatatgtttaaccgcaagtactatcctctatatagccaattattaagaacaagcgataataccagtcacttagttgcaaatagtgtgacgttaaaagtgacttatagccataagtggtaa

SEQ ID NO: 2970 - DNA, 864 bp, Acinetobacter baumannii
attacaccattacgtctaaacgtaaattacgtaaattggttgaagggcggttatgtgaatggatgggatgatcctcgtatgccaacggttgtcagtatgcgtcgccgtggtttcacaccagaaggcctacgtgatttctgtaaacgtgtaggtgtgtctaaaaccgacggtattgtggatgtcgcaatgcttgagttctgtattcgtcaatctttagagaatacggcagcgcgcggtatggcagtgttaaatccattaaaagtaacacttacgaacttaccagaagatttagaccttacccatgctcgtcatcctaatgtcgatatgggtgagcgcgtgattccattaactaaagaaatctatattgaccgtaaagatttcgaagaagtaccgccaaaaggctttaaacgtttaattcctgatggtgaagttcgtctacgccatgcatatgtgattaagtgtgatgaagtcattaaagatgcaaacggtgaagtcattgagctgaagtgttcaatcgatccggatactttaggtaaaaatcctgaaggccgcaaagtaaaaggcgtaattcactgggtatctgcaactaaaggtattcctgctgaagtacgtatttatgatcgactgtttacagaagctgaccctgaaactggtgatgatttcttagcaaacttaaatccagattctttgaaagtggttcaagctgtaatcgaacctgctttagctcaagcgaagccagaagatcgcttccagtttgaacgcgaaggttatttcgttgctgatcaatacgatcatactcctgagaagcctgtgtttaaccgtgttcttgacttaaaagacagcttcaagcctgagaaaaagtaa

SEQ ID NO: 2971 - DNA, 1080 bp, Acinetobacter baumannii
ctaatacaattaataaaatattttattggccgctatagtggtgaatttacgtatgtgagcttaatatatgttcaatataacgtggttcagatccgtatgcgaattttagcatggaagacagtacgtcggttcttctataataaccttcataatcatgattacgaaacggcagtaagtagatgtattaactactttttagttttcttaattattgggaatgtagttgctgtattactagaaacagtaaatgatctgtattacagctaccgtatatggtttgactactttgaaaatgtctcaattgcaattttcagtgttgaatatctcttacggctctggagtatagtcgagcgtgatccgacacaagctgcatggaagcaacgtttagcatggatgaaaagtggtgaagcactgattgacctcatggcaattttgcctgcgtatctaaatttctttgtacgaatagatcttcgtatgttaagaattttacgattacttcgactattaaaattaactcgctatttcatctcattgcaaatattgctatgtgtgattaagcgagaaaaaggttcctttcaggcagtgatttttattttaatcattatgattattatgactgcctctggtatttatgtcgttgagaataaagcgcaaccagaagcttttagctctattcctaaagcaatgtggtgggcggttgtgactttaactacagtcggatacggcgatgtcacaccagtaactagtttaggaaagttattgggagccttaattacaattctaggggtagggattgctgctttaccggctggtattttagcttctggtttggccaatgaacttaaccagcgtaatcagcgccttgaacaagagttccgtgagttacttcaagtgcgtggtattgatatcatgcatgatgaagttgaaatagaacgtattcgacaaaaagtagggctaccaaaagaacaagcgcataatctgattattcaaattatgcgcgaaaaagtattagaagagaaagaagctgttagagagaaaaaatgttattgcccgcactgtggtgaaaagttaacagattag

SEQ ID NO: 2972 - DNA, 915 bp, Acinetobacter baumannii
caatataaatttttggagaaattcgtggatgatcatcatttaaaaagaaaagtcggcacgcttgaaatggtcgtagccatgctgctttcagggagtattggtctatttgtgattaagtcaggtcaatcacccgttaatattgtatttttccgttgccttatttcagcgctatgtttaataccgatttgttacttctatggtcattttagaaaagtatacttcggtaaaaaagaactgtttttaatggtgacttcgggccttctaattatttttaactgggttctactgtttgccgcttttcctaaaacttctatttctttagcgacgattgtttatcacgtgaacccgtttgtcattttatttttaggggctttggtctttcatgaaaagctcaataaaaatgatgtgctatggaccatcattgcttttatagggctaatcgtgattataggcttaggcagtgcttcggtgaactctaatgagttagtcggcttggggctggttcttattgccacaacactttattcaatatcggtattaatcactaaaaaattaagtaatacaccgcctttattaattgtatttatacaaactctgagcggggcgattgtcatggctccgtttatttcggtttttgaaaacccgccgatcggtcaacaatggctgtttgtggtcggattgggagttttgcatactgcatttctctactatttaatgtattcggcgattaagaaaatacctttaaataatattgcgatcttatcttttatttatccaatatcgaccatagtgattgattatttcttctttgatcatgtgttgactagtactcaagttttaggtgcaggtttaattttattaggcgtattgggcgtgaagttgcattggaatatttttgcgttgaagagcgcctaa

SEQ ID NO: 2973 - DNA, 1170 bp, Acinetobacter baumannii
aaagcattttcaaaaaaagtagagcaggcgcctgcgaatgagagcctgattaataatcttgcgcgtgtagaacgttggagagaaaaaccgctagaggcaaaaaaaacaatttcccggttaaatggtatagatccgattgctaaagacacccgcattaatgaaatgcaaaatgctcaagctttaggtgatattccgacatggcgaaaaacgactcaaaacttagtgcaatattaccctgatgatagtggggtcattaaaagtcgaaaagaattagaagatcgtaatagagccacaatttcacactcaaccacttggggccaaagtaaggccgacggtcgcgatactgtaagtgggcagaatggtttaaaagaccgtgaaatggaaacgcgtcttaatagcccttggattaatgataattatcgtttattcgcttggcatcaagatcgttatggggagtaccgttttggcgatgtgcatgaccagcgttatggggtcggagcagaatggcaggcgaaccgtaaggcgttgtcggcaattgtgtcgcaaagtacggatggtggacaagcaggagtccgtcttgattggtcccaatggctaaacgaccactggcagtatcaattgcaatataacagtcaggctgacattcctttacaagcccttgatgaaggggaagatggtcaatcttaccgagctgctgtcacatggcaaaaagatgaatctcgccagattggcgcgagttacggtttaactgatattagtgatggtaacaaacaacaagaattttcaacattttggcgtgaaagactattcgacgcacctcatcatattacgtatggcactattcgaggtttctacggtactaacagccaagatcaaacagcttattttagtccaagttcacattacagcgctgagttgaacttaagtcatgactgggtgacttggcgtgaatatgagcgttcatttaagcagcattttgaagcgggtgtaggcctttataaacaggccgattactctgctaaacctacttactctttgcaatatcaacatcaatggcagctatcccggacatggcagctcaattatggaattggttggcaataccatccttacgatggacatgatgaacaacatacctacggtatttttggatttgaagggcgtttttaa

SEQ ID NO: 2974 - DNA, 426 bp, Acinetobacter baumannii
atgatgaaattaaatgctttattatgtagtgctgttttagctacttctatggtaactgtagcacatgctgacaacacaactcatgtagcagcagcttctgctttaggtagtatcgctggtactgcaattggtaaaagcatgggtggtacatctggcgcaacaattggtgctgctttaggtggtgctggtggtgcagcagttgcaagtgaccgtcgtcaccgtacagaatctgcaattggcggtggtttaggtggcggtgcaggttatactgttggtaaaagcatgggtggtacgaacggtggttacatcggtgctgctttaggtgcagcaggtggttccgctttaggtaataaaatttctaaagaccgtgatgcagaccattcttctaagtattggaagaaaaaacaccgtcatcatcgtcactaa

SEQ ID NO: 2975 - DNA, 435 bp, Acinetobacter baumannii
ctccttgcttctaattttattaggggctgtttaaaccgtaaggagctgacaatgcgtcattacgaaatcgtacttttggtacacccagaccaaagcgatcaagttgtaggtatggttgaacgctatatctctcagatcaaagaagctgatggtcaaattcaccgtttagaagattggggccgtcgtcaattggcttacccaattaacaaaattcacaaagcgcactacattcttatgaatgttgaatgtggtcaatctacgcttgatgagttagaagaattattccgttataacgacgcgatcattcgtaaccttatcatccgtcgtgaacacgcaatcactgaagagtcattgcttgctaagagtgctgaagaaaagcgtgcgcgtaaagctcaacgtgaagaagcacagcaagttgctcaagaagctgaataa

SEQ ID NO: 2976 - DNA, 774 bp, Acinetobacter baumannii
aatagagaatttttacttatgcaaatttacttggcacgtaataatcaacaagctgggccttataccttagaacaactaaatcaaatgttggcaagtcaacaagttttgcttactgatttagcttggcatgaaggcatgacagaatggaaagctttaggagaattaacccaaggtaaacttgtatatcaacctactggttattctgctttttcagcaaatacaaatacgccttataatgagaccattcagcacattcgtgtagaaactaaaacacacgagcttgcttcaatttcgtctcgtgctcttgcaaaaattattgacttattactttggctacctattgcagctattccgtcttttttctttaatgaagctcaatataaacaactttttgagttacaaaaacagatgcaatctgcagaagttgcatcaactaaagcagctgaacttcaacagcagctttttacccttattcctatagaagcttggcatacaatgctactttatgtcgtcataatgctcgctattcaagcatttttattgactaagtttgggcaaagtattggtaaaaaaattgtcggaattagaattgtcgatgccgaaaccaatggtaaagttaatttaacgcgtatcttccttctaagaagtgtcgttttcattatattaaacttactatttatgcctattagtacaattattgactatgcttttgcattaggacaaaagcgacaagctctacatgacaaaattgcaagaacaaaagtgatcaaatga

SEQ ID NO: 2977 - DNA, 219 bp, Acinetobacter baumannii
atagtcgcatcttttaaattcgacaaattacttcctacagaaacacatgaatcgttatttgaacaaatatttgattctttaataaaaacttttgtattagcaaaagttaatctttcaaagttagatgtcgagttatttgtagaagaaagtaagcaaggctcagtaatatttctaccattcactacaaaacaacttttactgacttcgaatggcacttga

SEQ ID NO: 2978 - DNA, 372 bp, Acinetobacter baumannii
tttaaagggtttatggagtatataaaattgtcataccatcatcttaactttgaagatcgtactgcattaatgcttgagtcaagaaaagaaggcttttcagccagaaaatttgctgaacttattaaaagacatcctagtacgatctatcgtgagcttaaaagaaatagcatcaatgacgtttatcaagctcaatatgcttctgataacacttttgctagacgtagacgtggtcacagaaaactcaaaatcgattcaatcctctggaaatttattgttgaagcgatccgttgtttatggtctcctcagcaaatagcaaagcgcctaaagacgtcttctaccacagggggacgaggactccgcgctatgcgtatc

SEQ ID NO: 2979 - DNA, 476 bp, Acinetobacter baumannii
tttaaagggtttatggagtatataaaattgtcataccatcatcttaactttgaagatcgtactgcattaatgcttgagtcaagaaaagaaggcttttcagccagaaaatttgctgaacttattaaaagacatcctagtacgatctatcgtgagcttaaaagaaatagcatcaatgacgtttatcaagctcaatatgcttctgataacacttttgctagacgtagacgtggtcacagaaaactcaaaatcgattcaatcctctggaaatttattgttgaagcgatccgttgtttatggtctcctcagcaaatagcaaagcgtttaaagacatttcctgatttggatcaaacaatgaatgtaagccatacaacgatttattcaacgatacgagcattacccaagggtgagttgaaaaaagacttagtatcctgtctgtcttctaccacaagcgccaaggatccgcgaaaaggtctcac

SEQ ID NO: 2980 - DNA, 2172 bp, Acinetobacter baumannii
agctacttaaagattatgcaaaggactacgaaacactttcaaattaatgcattagcacttgcaatagcaatgagcacaatttcagcgcatgcagagactgatcagcagacttcggaatatggaactcttcctaccattaaagtaaaagctggaagtggcgaagaaaatgaaaaaagttatatagcagggaaaacagaaacagcggtaccactgggtttatccgttcgtgaggttccacaatctgtttctgtcattactcaacagcgtttacaagaccagcaattgtcaactttggttgaggtcgccgaaaatgttacaggggtaagtgtcaaccgttatgaaaccaaccggggtggaatctattcacgtggttttgtagtagataactatattattgatggtattcctacaacatatagcttgccttggtcttcaggtgaaattttctcaagtatggccttatatgatcatattgatatagttcgaggggcaacaggtcttacatttggtgctggaaatccatctgctgcaattaatatggttcgtaagcgtgctacgagtacagagccaacagctaacgtagaagtgagtgcagggagttgggataattaccgtgttatgggcgatattgccaactcccttaatcaatcaggaacagtgcgtggacgagcagtggcccaatatgaacaaggcgacagttataccgacttgttgtctaaagaaaagctatctttactgttaagtgctgaagcagatttatctgaaaatacccttttatcgggcggggtaacttatcaggaagatgatccgcgtggaccaatgtggggaggtttacctgtctggtttagtgatggcacaaaaacgaactggtctaaaaataccactacaagtgctgactggacacgctggaatgttaaatataccaacctatttgcagatttaactcataaatttaatgacaactggtcagctaaactgtcttattcttatggtaagcgtgatgctaattctaaacttttatatgtttcaggtagtgtagataaaaatactggtctagggctatctccttatgcatcagcgtatgaccttgaggtagagcaagataatgcttctttgcagctcaatggtagttttgatttgtggggcttagagcaaaaggttgttttgggttatcaatattccaatcaggactttacagcgtatgctcgttcaactgatacaaaaatggaaattggcaatttctttgaatggaacggcagcatgcctgagccagtgtggaatgcacctacactcaatgaaaaatataatattgaacaaaatgcactattcgctgcgacttatttaaatccgattgagcctctaaaatttattttaggtggacgttttacaaattatgaaaagaatatatatggtcgtagttcatccataaaatatgatcacgaatttgttccttatgcaggagttatctatgatttcaatgatgtctatactgcttatgcaagttataccagtatttttcagcctcaagacaataaagactttgatggaaactatttagacccggttgaaggaaacagtactgaagtaggcttaaaatctgcatggtttgatggacgtttgaatggtactttagcactttatcatattaagcaagataatttagctcaggaagcaggggacgtcactcgtaacggggtaaaagaaatatattatcgggcagcaaaaggtgcgacgagtgaaggtttcgaagttgaagtaagtggacaaatcacaccagactggaatattacagcaggttatagccagttgtctgccaaagatgcaaatgatgccgatgttaatacccaacttcctcgcaagatgattcagacatttaccacctataaattaccgggcaaattagaaaacataaccgttggtggcggggtaaattggcaaagcagtacttatgttaatgctaagaatccgaagaaagttattgagaaagttgagcaaggagattatgcacttgtaaaccttatggctcgttatcaaattacaaaagatttttcggctcagcttaatattaacaacgtatttgataaaaaatattacggtgttttcccggcatatggccaaattactttaggtgcccctcgaaatgcggcactaacactacaatataagttttaa

SEQ ID NO: 2981 - DNA, 1044 bp, Acinetobacter baumannii
gatggaataaaaatgaaaataaaattatcgaaaatagtaatagccagctcattattgatatttgcaaatatgagttatgcagagggagtaaaacggttttctgtctcggcaggttggttacatgtaatgcctcaaggtaaagctaatccatttaatatcaatacaagtgttaaaaatggaacagttgctaaagttggaagcatttcgccgaccagtttcttaaactccgttgatcctaatgctacagaggtagatgtaggcggtgaaccttttaatcaaaaagagtttcttgaactcgctttaaatgatgactttttaaaagggctcttacttgatgaagaaggcaatataaaacctgaagtagcaggtgaggcaacgattcaagggttagagcagtggcatcaaaatgatgccggccttgaagtagatgacacagacacattagggcttatgtttaactattacctcaatgacaatgtgtctttacaatttattggaggcattccccctaaagtcgatattaaaggccaaggtgaaatcttggcaccattaagcggtgtcgcgttgtcaccaaatgaattagttaaaattctttttccgaacggcattaccttaggtcaagcagtcccgattaccaatttaggcaataaacctaaagcagctagtgttcgtgcttggacccctgcaattgaagcacaatatcaatttgggaagagtggggtgaacaagtttagaccttatttaggtgtgggtttaatgtatgctcattttaatgatattaagctaaatgacgaaattcgttctgacctgatctctgcaggtcatatgattcaaaatgtattagatggtaaggctggggctgccttggatcgtaaagagtctagtgggaatatggtggttaaagtagatgcagatgatgcgattgcgcctatatttactgctggttttacttatgattttaatgattcttggtatacagttgcctcagtatcttatgcaaaactaaataatcgaacacaaattgatgggcagagtaaaacttga

SEQ ID NO: 2982 - DNA, 435 bp, Acinetobacter baumannii
atatttataggcagttttagactagatgttgattatatagagagaaagaacatgaagcgccttattatattatttctattagcttatgctacaagctcctttgctcaagtgccattcgaagtcagtaaaagttgttttgtagtgaatggtagaaatattactgagccttgcttactttcttctacaaataactcgacatctaactttgaaagattaacttttgctaatacaaaagtttttattaaagaatcaaatatttgttcaaataacgattcatgtgtttctgtaggaagtaatttgtcgaatttaaaagatgcgactatttattatcgtgatttaaagactaaaaaaattattgaaaaaccggaaaaagattcatggacctgttttaagcaaccaattgataaattagacttttgtatttcttataattaa

SEQ ID NO: 2983 - DNA, 528 bp, Acinetobacter baumannii
gaaaaacggatcaaacttaagatgaatatttttattcgcgatgagcgagaagaagatattaaagaaattgaagaattgactaaagcggcatttctaaatgctgaacatacgagccatactgaacactttattgttaataatttaagaaagcacaaacaacttacagtctctttagttgcagttgaagataatactattgttgggcatgtggcaatttcaccagtgcaaatttcatcaggtgaaaagaattggtatggcttaggacctatttctgtcgcgccgaataagcaaggacaaggcattggatcattgcttatgaatagctctttagaaaaattaaaaaaattaggcgcaaaaggttgtgttttattaggtgatccaaagtattacagtcgctttggttttaaggcataccctgacctaaaactacatggtgtgccccctgaatacttccaagccttaagttttcaaaattatgttcctaaaggtgatgtaagctaccatgaagcatttaatgcccaagaatag

SEQ ID NO: 2984 - DNA, 219 bp, Acinetobacter baumannii
atagctagatcaaatactatgagttttatgattgtttcgaacaactttgctgttccttactatttaaatgtgaggaaagaaaagggaatgacagcttattattgggcaactcatcaatctcagttagctctatttgactcttacgaattggcttatcgcttttactttccatctcgacatattttgattcgaagtgaaattaaagctttcgctcagtaa

SEQ ID NO: 2985 - DNA, 216 bp, Acinetobacter baumannii
aaaaggcatccagtgtgcctgataatttatatgcatattattattggtttgaaccgcctccaaagtatgttcagagtcgctgaatttatccgtatcaaacataaccattcctgtttattttcaaattatggtttgagtgtacatagcgagataagtttgataaattcaaattatcttgagtttagattaaaaaaaacaaaactaaatgaaacctaa

SEQ ID NO: 2986 - DNA, 819 bp, Acinetobacter baumannii
gctctgtttaccggagaaaagcttatgggaactttgaagcatcccttagtagaggaccgtatgatttcaggtgaaggcacacccgaattcatgtggcttgaggcatttaaaaaaaatcctttagatcggctgaatttaaagttgtttcagtctaaaagagtggtgattgttgctccgcatcctgatgacgaagtgctgggttgtggcggtttaatgcagcagctagttgagcaaaactgtcatattgtcattttggcagtcagtaatggaacacaaagccatcctcattcagtgaaatatactcctgaccaattgaacgatttacgtccgcaagaaacactggctgctttaaatactttaggtatttcagctttttctgaacggattggtttaaatctaatggatggtcaaattcatttacagactgatcaattgaatcaggcgcttagccaaatagttcagcccgaagatattttaatttgtagctatgcacttgatggacatccagatcatgaggctgtcgggaaaacagtacaagcttttgccgaagctcgggacttactatgtttgcatgtattgatctgggcatggcattgggcagagccttttgacacgcgaattaactggtccaaagcaaaagcttatgccttaactgaaaaccagttaattaaaaaacatcaggcggttatgcaatttaaaacacaacttgaagccgatgagagcacaggaaattccgccgttttatcctcaagtgcgattagccgtcttttaatgccttatgaggtatatctgagtgattcattctcgtgtgtattttga

SEQ ID NO: 2987 - DNA, 687 bp, Acinetobacter baumannii
  unsure (676): Identity of nucleotide sequences at the above locations are unknown.
tttaaagggtttatggagtatataaaattgtcataccatcatcttaactttgaagatcgtactgcattaatgcttgagtcaagaaaagaaggcttttcagccagaaaatttgctgaacttattaaaagacatcctagtacgatctatcgtgagcttaaaagaaatagcatcaatgacgtttatcaagctcaatatgcttctgataacacttttgctagacgtagacgtggtcacagaaaactcaaaatcgattcaatcctctggaaatttattgttgaagcgatccgttgtttatggtctcctcagcaaatagcaaagcgtttaaagacatttcctgatttggatcaaacaatgaatgtaagccatacaacgatttattcaacgatacgagcattacccaagggtgagttgaaaaaagacttattatcctgtctacgtcatgaaaataaaaagcgaaaagctaacggtgaacctaaaaaagattctatattacaggatattaaaactattcatgagcgcccagccgaagttcaagaaagaaaaataccgggtcattgggaagctgatttaattaaaggtaaagacaataaaagttcgatagcaacacttattgaacgaaatacaccgctctgttcttgcatcacaagggctgcaccggatccaacatataccttanaaaagggcgag

SEQ ID NO: 2988 - DNA, 1581 bp, Acinetobacter baumannii
ggagtaacgacaatgacaaatggcctagaagattttagctatgacgaagtttcaactgaaaatagtacgcatagtgaacaagccaaaaaagtgctagggcatttcattcaaggaagaattgtatctaaaacggcaagaaaacagccagtttacaatcctgcgacgggtgaaattagtaaagaagtcgaaattgcagatgcacaaacggtaaatgaagcagttcaggcggccgaacaagcatttcctgcatggcgagatacaccggtcattaaacgtgcacgtgtcatgtttaagttcaaacaattattagagcaaaatgccgaaaagatttgcgctttgattgggcaagagcacggtaaaatttctcatgatgctcaaggcgaactgcaacgtggtattgaaaatgttgaatatgcttgcggcgcaccagagcttttaaaaggggagttttcaaaaaatgtcggtccagatatcgactcatggagtgagttccaaccgctaggtgttgtggctggaattacaccatttaacttccctgccatggtggcgttatggatgttcccaatggcactggtttgcggtaactgctttattttaaaaccttctgaaaaagcaccttcagtggttttataccttgcagaattattaaaacaagcaggtttacctgacggcgtgttcaacgtggtgaatggtgacaaagaggcggtagatggcttattgcatcatcctcgcattcaggcagtcagctttgtaggttcgacgccaattgctgaatatatttaccgcacagcaacttcaacaggtaaacgttgccaagcattaggcggtgcaaaaaaccacgcgattattatgccggatgccgatattgataacgtagtcacttcattgttaggtgcggcttttggttcttcaggtgaacgttgtatggcactttcggttgcggttgccattggtgatgaagttgccgatgtcgtgattgataagctgacacaagaaatgaaaaaattgaagttcggcaactatgcagatgcaagcaacgactttggcccactgattacccaagcacataaagacaaggtccaagcctatattcaaagtgcagaacaacaaggcgcaaaaattgtggtcgatggccgtgatgcaaaaccagcaggctatgaaaaaggtttcttcgttgggccaactttaattgatcaagtcacaccaaacatgaccagttaccaacaagaaatttttggtcctgtgttgcaagttatgcgtgtgaatagcatgcaagaagcgatgcagctgattaatgaccatgaatatggtaacggtacttgtatctatacccgtgacggtgaggcagcacgctattttagtagtcacattcaagtcggtatggtggggattaacgtgcctttaccagttcctgttgcttatcatagctttggtggctggaaacgttcgttatttggtgatttacatgcgtatggtccagatggtgtccgtttttacacacgccgtaaaaccattacacagcgctggccttcggctcaagtccgtgaagcaaaacagttctcaatgccaactttaaattaa

SEQ ID NO: 2989 - DNA, 1260 bp, Acinetobacter baumannii
gaatgtaatcagaaagtagtatatatggaatttgtttttaatggtttttatacactaatttcggcggtcatcgttctattgttgggtcgctttcttgtcaatcggattgattttttaaaacgttataatatccctgaaccagtagcaggtggtttggtcgctgcggtagtttctttacttgtccacactttctggggatacagtattgtttttagcagtgaattacaaaccagctttatgctcgtgttctttgcttcaattggtttaagtgccaattttatgaagcttaaagagggtggtactgctttagtcatcttcttaatttgtgtagcctcatttattgttgttcaaaatgctgtcggtatgagtcttgcaaccttattgggtctagacccacttattggtttgattgcaggttcaattactttaaccggtggtcatggtacagcaggtgcatggggtgaaattctagaaagccagcatggtattcagggtgctttagcgttaggtatggcaagtgctacgtttggcttgattattggtggtgtcattggtggtcctttagccaaattgctcattaatcgttatagccttgctcaagcaaaaaccaatgctgagattcagcagcgtgacacgcatgttgaacaaaattcagatgatcttgcaccgtttgaaaatccgcatcaagttcgtttaattactgccgacaatgcaattaccacgcttggtatgtttgcagcatgtttagcatttgctgaatttatgactggcttcagtaagggaacttggtttgagttaccaactttcgtttgggcacttggtggcggtgtaatcttaagaaatattttagaaagcgtgttgaaggttgatatttttgaccgcgcgattgacgtttttggtaatgcgtctttatctctttatttagcaatggcattgctttcattaaagctttggcaacttgctgacttagcaggtccacttgtggttattttaggtgctcaaacactgacgatggctttatacgcagcatttgtgactttccgtgtaatggggaaaaattacgatgcggcagtattggcagcaggtcactgtggtttcggtatgggggctacaccaaccgccgttgcaaatatgcaggcgattaccaatatgtatggcccatcgcataaagcattcttaattgttccgctttgtggtgcattctttgtcgacttgattaatgcaactgtgattcagcttatgttgaaatttattgcttaa

SEQ ID NO: 2990 - DNA, 918 bp, Acinetobacter baumannii
atgaaacctaaaaaattaaatcaagttactgattttgatataaaacttctcaaaatatttaaaacggtttgcgactgtcacagctttacatctgcagaaagtattttaggtattagccgctctgcaattagtttgcatatgagtgatttagaaaatcgtctgggcattcggctgtgccaacgtggccgtgccggctttgccctcaccgatgaaggacgggaaattttagaatatatcgaagtgcttacggcagccattgaagacttccgctctaaagtcaaccaaatgcataaccgtcttaagggtgagtttaatatcggcattattaacaatcttgtgactatgcctagaggctatatcaccaatacgttgacccaacttgcagaggaacatgccgaagtgattattaacattagtatgagtactctgtcagatattgaatgccgcgtactcgataaccgtttacatgcaggtgttattccacttgttacgcctttgtctggtctagaatatttcgatttatatagcgaaagttcatttttgtactgcggcaaaaatcatcccttgtttagccagtgcagcaatatgaatctagatgagttaaaaacatggcaagcggttctccctaattatgccattacaccagaagcggcaaagttgcatcagcttttagactgtaaagcgacagcaagtgaccgtgaaggcatcgcatttctgattttaactggaaaattcttgggttttttacccgatcactatgcaaaaaaatgggttgaagatggttttatgcaagctgtttcaaaggaaaaaatgcattacagcacacccatttgtttaattactcacaagggcaaaaatcataataatattttaaaaacttttatggagatgcttgagaagcgaatagctaacaattaa

SEQ ID NO: 2991 - DNA, 1401 bp, Acinetobacter baumannii
aatatgaataatgatagaacaaaaaaattaggcgaaggactttcaaatcgccatatcacaatgattagtattggcggtgttattggtgcaggtttatttgtcggttcatcttctgcaattgccaaagcaggccccgcggtgattcttgcgtacctgattaccagtattatggtatttctggtgatgcgtatgttaggtgaaatggccgttttagagccggacaccggttcattttctacctatgcccgtaaagcaattggcccgtgggcaggctttaccattggctggttgtattggtggttttgggtacttgcgattccggtagaagccattgcaggtgctgaaattttacattcgtggtttccgagcgtttcagtttctatctatgcgttttgctttattgtgtttttaagcttagccaacttttttagtaccaaaagttttggtgagtttgagttctggttttctttggtcaaagtcgttgccattattggtttcattattattggtattttggcaatttcaggtatttggcctttagcaaaaaatgttagcggcgttgccaatttatataacaacgctggctttatgccgcacggcatgggaggcattttatctgccattttaatcacagcgttttcgttttttggggtggaaattgtctcaattgccgcagccgagtcatctaaccctaaacagaaaattagacgtgccaccaatttggtgttgtaccgtattattctttttttcgtggtctcaatgtttattgcggtttcacttgtcgattggcgttcaccggacttacaaaagtacgggacattccaatacgttttaatgagcttaaacgtaccaggcactaaacttattattgatacggtcgtgtttatcgccgtggcgagctgtatgaatgccgcaatttatacctcttctcgtatgttatttcgtttgggaacacgcaatgaagcaccgcaggcagtcactaaagtgaactatgctggtgtaccagcaattgcggtgttttcctcaacttttattggtttagtatgctgtgtcattaactatgtatttcctggaaaagtctttggcttattgctctcaagcacagggtcaattgctttactcgtgtacttggttattgcgttttcgcaactacgtttaagatataagctagaagcggctggagcggaaattccatttaaaatgtggttattcccatggctgacttggtttgtgattatcattattttaagtgtattggcttatatgttcttctcaccagcctatagttatgaaacgactctatctttaggtgtaaccttaggtgtggtggtttgcggtttgtttgtgacccgaaagcgtaaagcaacccgttcggttgcgatcaatcagagtaatttataa

SEQ ID NO: 2992 - DNA, 678 bp, Acinetobacter baumannii
tccttcatcaatagctcagcgagaacaattacgatgaaaataggtgttgtagttccagcgcataatgaagagcaacatttgccagcctgtttgcaatcaattcaggaggcgattgaaaaagtaccggatgaacaagtcgaggtcatggtcgtacttgatagttgtacggatcagtcgcgttcaattgtacagcgctacggagtaagctggattgaatgcaattatgcatgtgtcggaaaggcacgggatttaggtatccgccaacttattcaaaatggcgcaacttggctggcctgtaccgatgctgatagtgtggtcagtcctgactggttacgctgccagattttgcatcaacctacagatgcaatttgtggcatagtgactttagatgaccttagccgtttatcagttatgaaacaaaaaaaatatttatcgcattatcaggattgtatggatcatcaccatattcatggcgcaaatttaagttttagtgctgctgcttatatgcaagtaggcggttttgaacctgttccttgccatgaagatgtttcgctcattcaaaaactgataaggcagtgctgtaatattacatggagcaatttagttcgggtaactaccagtagtcgactcgaaggaagagcgccagaaggcttatcaaaatttttagaaaatctttaa

SEQ ID NO: 2993 - DNA, 975 bp, Acinetobacter baumannii
acatacagtgatactatcatcctatgtttaattgttcaatttctctttcatgcatttttaaaggttgagctcatggaattaagtcagacaatttcaaatcttatttttgaaattcaaaagcttactcaagcagtcgaaaaaatttctaaaacccaagaaatttctgtagatgtcttagatgaggcgattgcctttagatgggaaagagaaaataataaaggttcgctcgtcgcgatccgcaaacctcaactcatttcttttaatcatctttgcaatatcgacagccaactcaacaaagtaaaactaaatactgaagcctttgcaaaaggcttgttggcaaataatgtactcatgacaggctcacgtggtacaggcaagtcgtctattgtaaaagcctgtttaaatgaatatcaccacttaggccttcgggtgattgaacttgagaaaaagtatttagaagatttgcctaaaattattaacttactgcaagaccgtactgagcgttttatcatcttttgtgatgacttggcctttgaagccggtgactcaagttacgcaactttaaaaactgtattagatggttcactggcctctagttcagacaatacactcatttatgcaacatcaaatcgaaagcatatggtgaccgaatacaataaagataataccgagttaaatgtcggggaaaatggcgaattacgccctggcgacagcattgaacaaaagatttctttagcagacagatttggtttacaaattaatttctatggctttagccaacaagagtatttaaagactgttcaatactggctaaatgaatacaaatggcaacaacgtgaaacttgggaaacgattcagttaaaagctattcaatatgcaactcagcaaggcaaccgctcaggaagaattgccaatcaatttgccaaaatgattgtgggccaagaaatgctaagtgcagcagatttaacggtttaa

SEQ ID NO: 2994 - DNA, 972 bp, Acinetobacter baumannii
aaaaccagcctgttaaaccttaggctggttttaatgcacactaaatttttaaagtttttgcacaaatcttctagaactaattttagctcttttatactgtttcaggggctaaaattaaaagtttataggttagtgcttatgagtaactgggtggatatttcaaaagataccaatacaggtatcgaaacaatccgtgctcattttactggtcatgcttatgatccccattggcattcaagttatttaattggtgtaactgaatctggcattcaacaatttcattgccgtaaaaagcaaatcaatagtcatgctgggcaagtctttatgcttgagccagaagaaattcatgatggacatgcgcctgcatctgatggttttacctaccaaatgctttatctacatccagaatggttaaagcaacgccttcaaggtttgtttcacaacagccccgatcattacgaactagtgattgatgcgccattaaaatccgatgaacaactcgcaatcattacttcacaagcatttcgacacttacactataaagaaatgaatattgtgaaagacaatagtctagatgtgcttattcaatatattgcccaaggtaaatggttaaaaaaagtttctcaatcttcttgtattcattttccccacatcgcccatcaaatccgagatattctgcatgatcatttatttgaagatattgggttagaagatatatcacgtatggtgggactagaccgttaccatattcaccgtatttttaaatcaacttttcatttagctcctcatcaatatcttattcaactgagacttacacgagcacgtgatttactcgctagaagtatttctccagcacaagttgcttctgacttatgtttttcagaccaaagtcatttaagtcgttggtttaaacgctgttatggactaacaccagccgcttacagaaaaatctgcacaaatcttcaagattaa

SEQ ID NO: 2995 - DNA, 396 bp, Acinetobacter baumannii
atagctatagataaaataacgaggagaacattcatgaaaaaaatattatttaccacactcactggacttgttttattaactagtagtgcagcatttgcaagaacagatcccgctttacttaatcaagcagcaaaaaatgtcgtcactgtttcaaaagctaaaactttagctgatgaaacaggggtaaccttaacgggtactatcgttaagcatattgctggcgaccattatgaatttaaagataaaacaggttccatcgtgattgatgttgatgatgatttggcaaatggttggcagttaaaggttggagataaagtacgtattgtaggtgagattgatacccaccgcgttaaaccgactgatattgaagtgttacaaattgaacgtgttaaataa

SEQ ID NO: 2996 - DNA, 717 bp, Acinetobacter baumannii
acgctgttatggactaacaccagccgcttacagaaaaatctgcacaaatcttcaagattaaaaatcttaattatttcatcttgtctcttccaattaactaaggtagacaagatggaaaacctcactgcattttcattatttgcaattgttgcctcaattactccaggcccgaccaactttataattttaagtttaagtagtcattataaaatttctaaaacacttcccgttattttaggttcttgtattggagcagccttacttgtattagtagttggtattggccttggctccactattcttgcttaccctgttattcaaaaaattatggcatggagtggtttaatctggcttaccgttctagcttggaaattatataactacaatcctgttatctctttagaaaaaaatgaacaataccctcctattggttttaaagctgcttttttaatgcaagcgattaatcctaaaacatggatgatggcttttgcagttattagcgtctatacaaaacaaggacaagatatcttggtgaacgtctcaattttatcctgcatttttttacttatagcatttccttgtctctacctatgggccttagtaggtagactaagtactcggcttctttcaaaacccaaacatataaatatttttaacaaaataatggctattatattactagcctcagtctggtggcccatgttccctagattttga

SEQ ID NO: 2997 - DNA, 330 bp, Acinetobacter baumannii
agaatgtttattgcaaaaaatatatttgtatatttactatcaatgttagctttatgcttactaattattctttttaactatctaggaatgaatcagacactaaatctcatcatttcttcagcactctttggaatatttattacttggtactacaaaggaagcggactgtgtattgccctttttagctttttttactgggcaatgtttgtgattagtcaaagtttagaagtgatatggatgctgtcgatttcagtaattgtttatttagtcatgacacaaatcgtacctaaactcaaacacatccatatcggtatcgcatctaatagctag

SEQ ID NO: 2998 - DNA, 372 bp, Acinetobacter baumannii
caattttatatactccataaaccctttaaattaattaggtggtttatgtcgcacttcaagttttactctgccgagcaaccgatcattacaaatgcatttaaagagtttttctctatttcagatcatttaccctatgtatatgaagctttgtcaatcatacaaaagtataatctagaacttatctataaaatcatcctccccattcataataaaatatcttcagaagaatataaagaaagagcgattattataatcactcaacttaatggatatttagttcaacattcgaacaaaaatacagatgaaaattataaagaatttttaagaagtatactgttaaaaaatatattaagattagtcagtgaaccataa

SEQ ID NO: 2999 - DNA, 744 bp, Acinetobacter baumannii
gatgatagtatcactgtatgtttaagcttactagtaccaattttaatgattgagcaaattcaaaaaagatctctggtcgatgaagtgattcatgtcatacgtcagaatattaaaaatgacatttggaaagtagatgagaaaattccgactgaacctgagcttgttcaaggtttgggtgtgggtcgaaacaccattcgagaagcaattaaaattttagaatatttaggtgttttagaagtcaaacaagggctgggtacttttgtacgcacgaaaaatgacttttcgattgtgattaattcaattcatcattctgatttatatgaacacgtagaagtacgatgtttattagaaatcgaaattgctaaattagccgctagacatagcacgcctgaagatatgcgcgatgttatagcgtgtttagaacatagagcagcaacaaatcaacaagatgttgctaacttcatgttaagtgataagaaactacatttggcaattgccaaggcgactcataataaagctttacaggcaacttatgagtatttcttaaactcaagctatcaatacaccttagagctagtgactaataaaaatttacctgacccaaaccagcaaatacatagtgaacttgttcaagctattcaacacaagtctgagtcagaagccatgcgaattgcggagtctatgttggcgcccatattacgttcgctagattcaattaaagctgactttgtccaaaaccactaa

SEQ ID NO: 3000 - DNA, 1023 bp, Acinetobacter baumannii
ttatttgtaatgaatattaaaatatctataaatatgacaatcttgagtatgttgaatgaatttgaacatgctcaggccgaaaacaaaagtcagctccgccaagatttactctaccaattggtaagtttatctaaaagtttgccttatccagcttcaggtcatacctatcagcgatggcaattgtttgctcaaattgcagggtatgatttaagtctcgctaaattatttgagtcacatcatgatgctttaagtattttaaatgaattgggctatcaagacgaaatcgatgatcagacttgggtggtatgggcagcagagggtgggccggcacctatacaggtccagaacaatcattgtaatggtataaaaacctggtgctcaggtgcagagtttattcaaaaagtcctaatgagttataaggacaaagaaggccaagcacaactttgtatcgttgatttggctcatccctctgttcatgttgacttgagccactggcaagcagtcggcatgcagggaacccagacagctcaagtgcattttgacaatactcctgttattcctatcggactgccaaattgctatttggaacgtccggggttttggcatggtgctgctggtgtcgcggcttgttggtatggtgctgcggtacgcttggttagcttcttacataaaagttgcacccttaacccaaacgcatttaaaaaaatgtatttaggggagttggctcaacagctctctgtaaccaaacagtattttcaatatattgctaagctcattgatgatgagcctgcgctcagccatgagcgtgaaatccgtatattacgtgctcaaacagaacaatgctgccagagtgttattcaactcgtcggtaaagctttgggcgcgcgtccttattgtgaagagcctacattttcacagctcattgctgatttaccagtatttatccgacagagccatgcggcttttgattatgagtctattgctgagctctgtttaccggagaaaagcttatgggaactttga

SEQ ID NO: 3001 - DNA, 309 bp, Acinetobacter baumannii
aaattaaggatttctgccgttttatctagtaatttagtttctaccgtttttctatttccaaagaagaggtcaaagatgaatactttaaatattaatgatattaaaaaacatgcagacgttattgcttcttgtggcaccaaagtaggaactgtcgatcatcttgaaggtgaaaatcagttaaaactcaccaaagatgaaaatgatcaacatcatcttatccctacttcttggattggggaggtaaaagaagatcaagtcattttaaataaaaactcagaagaagttaaagaaaactggcaagcgatttaa

SEQ ID NO: 3002 - DNA, 1389 bp, Acinetobacter baumannii
acaggaatggttatgtttgatacggataaattcagcgactctgaacatactttggaggcggttcaaaccaataataatatgcatataaattatcaggcacactggatgcctttttcagcaaaccgaaactttgctaaagacccacgtatgattgtgggtgccaaagggtcttatctgattgatgattctggccgtgaaatattcgattcactttcaggcttatggacgtgtggtgcaggtcataccttgcccgaaattcaacaagcggtgagcgctcagttaggtcagctcgattactcaccggctttccaatttggtcatccgctttcttttaagctggcagataaaattgttcagcatatgcctgaaaaactacaacacgttttctttaccaactcaggttcggagtcggcagatacgtctataaaaatggcacgtgcctattggcgcattaaaggtaaaccaagtaaaaccaaattgattggtcgtgcccgtggctatcatggtgtgaacgttgcagggacaagtttaggtgggattggcggcaaccgtaaaatgtttggtcaactgatggatgtagaccatttacctcatactttgcaacctgatttaacttttaccaaaggctgtgcagaaacaggcggggtagaacttgccaatgaaatgcttaagttaattgagctacacgatgcttcaaatattgcagccgtcattgtggagcctatttctggttctgcgggttgtattgtgccgccaacaggctatttacaacgtttacgagagatctgtgatcagcatgacatcttgttaatttttgatgaggtgattacaggttttgggcgtttaggaacgtggacggcggcagaatattttggggttacgccagatattttgaattttgcgaaacaggtgaccaatggtgctattcctttaggtggagtggtggcaagccatgaaatttactctgcctttatgcagcaagacttaccagagcatgccattgaatttacccacggctatacctattcggcacatccagttgcttgcgcggcggctttagctgcgcttgaagttctagaaaagaaaaacttattagcgcaatctgcggcgttagcaccaagttttgaaaaggtgctgcatggcttaaaaggcgcaccgcacattttagacattcgcaactgtggcttgattggtgctttgcagttagctccgcgtgatggtgatgccaccatccgaggctttgagcttggtatgaaactctggaaagaaggtttctatgttcgctttggtggcgacacgcttcagttcggtccaatgtttaatagtacagaagcagatattgaccgcttaatgaatgctgtgggcgatgcactttatcaagtgaattaa

SEQ ID NO: 3003 - DNA, 495 bp, Acinetobacter baumannii
aattttatatttcacggaagtcttatgaacgttcgcctgtgttatgccagccaacgaaatgaaaaaaatgaagatttgctacaagatttacgtgatattctgacagaagctcgtgatttcaacgatttaaacgggatttgtggggtgctttattatgccgataatgcattttttcaatgtctagaaggcgaacaagaggtcgttgaaagattatttgaaaaaattcaaaaagatcaaaggcattataatattaaatggttatgcacatactccattgatgaacactcttttcagcgttggtcaatgaaatacgtgcagcgtaatacaactattgaagctttctttcttaacatgggagagaatacctttaacccgcttttgctgaaccagcaaaacctcaagtttttcttaaatgaactcttaattgcagagcaaactaagatgaatacggttaaaaaagttggaatggtgaatcggggagtaaacccgttctag

SEQ ID NO: 3004 - DNA, 1161 bp, Acinetobacter baumannii
gttttatattcaatgagtttattgcttaaagttcgacagaatgttccacaggtacagtcgattaaaacatctcttaaaaagcgtgctggtcagaaaatacctcacatgctctccaatgcatcagatctgttttttagagggtcggaaattgccctgtcaggaaaaacgccttttgatgtaatttataagcatgaaattataagccttcgccattatagaaatgagacagaagcatcagccaaacaccgtgtgccgttagtgattgttccacctttagctgtgaacatgctcatttacgatttgtttcctacccgcagtcttatacgttattttttagatcaaggcttcgaggtttacttaatagactggggcgtacctacccgaaatcaagccaaatacaattttggcacctacgtaaaagtctttatgcctgaaatgttaaagcaggtccgtatacatagtggacaacaacagctttcattacatggctggagtttaggtggcgcactttcactttgctataccgcgttatttaaagataaagatattaagaatctgatgattcttgcttccccgatcgacacacataaagcaggttatatgggtaagctctatggaagtctgactaaacctgcacagtgggtccgtaagcatacgccttttcgtattcgccaacatgtaccaagtgaagtatttcatattcatggatggcaaaacacactcggttttaaattaacggaccccattggtaatttaaaaacctattggcaacttcttaaaaatctggataaccgagaatttattgtcgaccacgctacctctagttcatttatcgacaatatgctggcctatccgggtggcgttatgcgcgacattattttacgtttctggattgataatgaactctcaacaggtgtaatcaaatttggggaacttacagcttatttaaaagatattgattgttcagtgttggctgtaggtggagatacagacattattgtaaccgccgatgctgttaagccccttatggatttaattagtagccaagataaaacattcaaaactgtgcccggtggccatatgggcgtagtgtccggtagccaagctccgacctctgtttggcctgaaatgagtaattggctggctacgcgttcagattaa

SEQ ID NO: 3005 - DNA, 600 bp, Acinetobacter baumannii
gtgattcattctcgtgtgtattttgaagagttgtaccgtagtaataatgacccatggggctatgactatcactggtatgaagcccgtaaaagacaaatctgccttgcattattaacgcgaccacactacgaaagagttttagaaattggttgttcaaatgggcatttaagtgtttatctggctcagcgcgctgctcgtctgttatgtattgatgtgtcgaagcaagccgttcagctcgcatcccaacggttagaagcatttgaacatgtgactgttgaaaatagaaaaatacccgaagatttttatgaacaaaaatttgatctgattgtaattagcgaagtggcgtactacctcacattcgatgagttaggtgagtttattgaacagttaaagcaggccttaaacccggaaggggaaattttatgttgccattggcgacaggatattcaggattttgaattgaatgcccaaaaagtccatcaaagctttcaacaatcttttccatttcatcactatttaagtctgaacgatccggactttatggtcgatgtttggacggttaatccttcatcaatagctcagcgagaacaattacgatga

SEQ ID NO: 3006 - DNA, 1116 bp, Acinetobacter baumannii
aaaactggttcaaggagcaacaccatgaaggaatttttaaaggcttacgttcaaacatttaaagatattgttagtaacagttcagttttcacaacacttattttatccgtcattctttatagctttttttatccgacagcctataaagctgagcgcgcagaatcaattccaattgtcattgttgatgaagaacaaagtcttttaacttctcaagtcattggccaaacagccaatagccctcacgttaaaattgttgatgtcactgctaattttcttgaagctgaacaaatggtccgcgaacaaaaagccgatggtattttacttttaccaagcaatttaacgcagagcttacgccgcggagaaactggcggaatcggcttatacttaagcacaaccaactttttaaaaactaaagaaattgggttaggtcttgccacttctattgaagcaaccttaaaggaatatattgaaaggtttggacaacgtacacacttccagcctgctctttctattcaccaaatgcctttatttaatacgctttcaggctacggtagttatatttttcctgcagttgcatcacttattattcaccaaacaattgtgttaggtctggccatgctggttgcaagttaccgcgaacaacatgaaaaaattacccctattcgttttgcaggaatttttgccagtatctttacaattggttgtttaggaagtttttatctttttggttttaccttgtggttcaatgactatccacacggtggaaactttgtcggtttgctagtcgctgttcctatttttattagctgtgtaattggtttaggtatgctgattggctcacttttagatataccggaacgtgccggacatattattgtatttagctcagttcctcttttcttattaactggtgccgcctggcctcaccaagccatgcctgaatggttgcaatggtttgcttggtgtttaccctctacacacgccgtacagatgtttgtacaacttaatcaaatgggcgtgcctttaaatgtcgtggccccgaaattaatttttcttgcgactattggggttatatttttaattactgcctattcacgtttaaaagtatctaaataa

SEQ ID NO: 3007 - DNA, 342 bp, Acinetobacter baumannii
ctacctagattgtaccctattaaattaaaccttaattcttttatacccaaactatcatataagaaggtagtatgtgcagtgttctcaacaatcgtattattctgtaaatttaaactactacttccgctcagtatagttgagggattagttgtacttccaggaacggcatctccagtaaattttagaatactaccatttatcttatcagcgatattttttgcaatcgtattaattgtcaatatggcgtttggttcaccacaaaattcaaatgtactcttagagttaagcgaaccatttttgaaaatacttgaagacattatagtgatatcacgtttagcataa

SEQ ID NO: 3008 - DNA, 693 bp, Acinetobacter baumannii
catgtgatgtctccacgctttaattttttagattatgatcataatctaaaatatacaggttttgatgtcaatcataatcaatgtataataatgacgagcaaggtgaataaaagtgagcgcaccaacatgaaagttagtaaaactcaggtaaaagaaaaccgagataaaattgttgaaaaggcgactcaactgttccgtagtaaaggctacgacggggtgggcattgccgaattaatgtctagcgcaggctttactcatggtgggttttataaacatttcagctcgaaaacagaccttgttactattactgccaaatatggtcttgagcaggttttaaaaagaatagaaggtttaaacttaacccaatttattcaaatgtatgtgtctcgtacacatcgggacaaccgtgatcagggctgtaccttaacagcgctatcttgtgatgccgcaagacagcccgacgaagtaaaagtcgagtttgaagagggtattgagcagcttattgagttcattatgaatgaacgcgcaaaacaagtttctttagaaacagaagagctgagaaagcaagctattaatattcttgctcagtcagtaggggcaattgcattgtcacgtgcctgcccagaccaatcaaaccttagcgatgaaatcttggagagctgtagagagagtcttttaaaattaaccgattaa

SEQ ID NO: 3009 - DNA, 387 bp, Acinetobacter baumannii
tttctaatgtttgctcatattcttcagcttgcgcggtttactactacagggaccgcagcagcacttactcattatagtgtagccatgcttctatttaagaaacatgttgcactgcaatatgccaatttatgcgcttttctactcgcctattgggtgagctattttgggcaccgcgtttttacgtttaaagcgcaacatcttacgcatcggcagactctcccaaaattcacgttggttgctggcttaggttttttatttaatgaaagttttcttttactttcaagcctctattttaacgtacctatttcaaccttagtgtgtactgcaattgttctgacatctatggtgacttttttacttaaccgtttttttgcattccaacattaa

SEQ ID NO: 3010 - DNA, 828 bp, Acinetobacter baumannii
ttctgtaaccctgccctatggtggaatttagatatggcaaaggtgtgctattgcgcagatgactttgcaatgaatgcagaaatatctgacgcaattattcaacttattgaacaaggtgcgcttcaagccacctcatgtatgacccaatctgatttatgggaaactgctgctgccaaattaaaaccgtttagtgatcgagttgatatcggtttacatttaaatcttacccatgctttcgcttcgggtaatctggtttttcccttacctatgcttatagtccgagcatggtctgcaagtcttaatcgcgaattaatcactcaatgtattgaggagcaatgggacttatttgtttcagtattaggaaaacaacctgactttatagatggtcatcaacatattcatcaatttccatttatacgtgatattttgctgcaattactaaaagagaaaaaatttacgggttggattcgaaatttacaacagccaatcaatccccctcattaccgttttaaaactcgtatgctctcagcattaggttctaactctttggcaaaagcttgccagacatatcactttaatcaaaatggccaatttgctggcatctatgatttcaaattgtccaattatggccaactcaatcaatattggcttgcgaatgcaaaagaccatttactgattatgtgccatccagcacttgtacaatcaaatgatcaagatccaattcagcacgcccgaattcaagaatatcaatacttcagttcggctcagttccaacttgattgtcaacaatacggtatccagctcaccagactaggggcaatgcaatga

SEQ ID NO: 3011 - DNA, 1044 bp, Acinetobacter baumannii
atacgtgcttttacaagagaatttacatatgttgacttgaaaaatagcaattaccctcgatttaatatatcaagtgagataaacccaacatcaatcgtacctatgaaaaatcaaaacagtccagaagttattacggtaaacgaccaaaattttggtagtcatggagagcattggaatctactgacttcccatccagagacagatgtaccaaaatggcttggactggcgcttgatgctcctgtaatgccaatgggtttatgccaaaatgaagacgaaatggatcaatctttttggctcattcaaggtccacaaggtcagaaggtcaccattaatcaaattattgcagttgaaaatcaaaaacctcgtgctttaaaaactgccttccctagttttgatagtccctatcaatataatgcccaaattgagcgcatcattacttgtgactctgctactcaagcagtattaagtttaaaattaaataaaagtacaacgatttatgcatttgataatttatttagcgttaatcgttgccaatatgacaaaacccaaacttatcaagtccaatttaatgcatgggcctatgaattagaatcagtgcctgcgggagaaacaattgtcgtagatgatccagcgtcaattaaacatcaccgtgcattaaatgcgattttaactgaacataatggaattgcacccgaaaacctacaagaactgattaatgaatggcaaccaaaaactaaagaagatcaagaacctgtaacggttgatttttctaaaatggttgcatatttatatggagaaaatcttggtcaagaagatgaagcttggttccaaggtaatattgtcggtaaaacttcaatgtcatttatgggtgcagaatataccctttatgatgtcactttagttttagaagacaaccttcctgccatattagtgcgcattgctacaaaaaatgatttgtacaaaaactttaatattggcgaatatattcgtggcaatatctggattcaggcgaatatttatgctaaaaatagtgaaactaattga

SEQ ID NO: 3012 - DNA, 984 bp, Acinetobacter baumannii
atgactagaccagattcaaaaagcatgaactatcaattactcaaaacatttagccgccaacccattcaatttgggcgttttcttgctcgtctgttagcaggacttgtaaatactctaaaaattactagaacatcaaaaagtattgagcttaacttaagaattgcgcttccgtatttaacacctcagcagcgtatagcgattacagaaaaagctgtaagaaacgaattaacttcatattttgagtttttaagtatttggggctcatcaaatagtaaaaatatctcacgcattcaccgtattgaaggtgaacatttttttcatgaagcattggctgcaaaaaaaggtgtagttcttattgttccacattttggtacgtgggaagtcatgaatgcatggtgtgctcaattcacatcaatgaccattttatataaacccgttaaaaatgctgatgcagaccgttttgtgcgagaagcccgtagccgtgaacaagcgaatctcgtccctaccgatgaaagcggtgtaagacaaatttttaaagcattaaaacaaggtgaaacgacagtaattttgccggatcatacccctaatgtgggtggagatatggtgaactattttggtgttccacttgcctcaagtaatttaagcgcaaaactcatccagaaaactaaagcaaaagctctgtttctttatgcgatccgtaatgaaaacgatggctttaccatgcatatcgagccaatggatgagaaaatctatgagggtactgcggacgatggaacgtatgtcatccatcaagcgattgagcaactcatttatcaatatccagaacactatcactggagctataaacgttttaaagcgaaccctgctttagacaatatctataatatcgatccgacagaagcacttaaaattgtagataggctcaaagcagaagctttaaaaacctctactcaaccagagcctatccaaacgtcggtcatgtaa

SEQ ID NO: 3013 - DNA, 438 bp, Acinetobacter baumannii
gttgttggaccagtcatccagaccacatcgccttcttgccattcaatttgtagcttaccgccagcaagttcaacttctacggagttggcaagtagaccacggcgcatgccacttaccgcagcagcacaagctcctgtaccacacgcaagtgtttcacccacaccacgttcaaatacacgtaagcgaacatgtttgtcatcaatcacttgcatgaaaccagcattaactcgctcagggaaacgtttatgtgattcaacttgcggaccaataccagctacatcagcagttagtacatccggaactatagtgaccgcgtgtgggttacccatgttgaccacatcaatactaatgttttggtcatttgccaactcaagggtatataaagcttcaggttcatcagccacaaatggaatttcatttggcagaaactttgggtaa

SEQ ID NO: 3014 - DNA, 1266 bp, Acinetobacter baumannii
aataaggacaccttcatgagtttcacccgcattaatggagtattgcatgcagagcaatgttctctagagcagcttgcgcagcaatttggcacaccgttatatgtttattcaaaagcagcttttgaaaaacattatttagatatggatcgtgcctttgactttattgatcatcaaatctgttttgcggtgaagtcgaactcaaatatagctgttcttaatgtcttggcaaaacttggtgcgggttttgacattgtgtctggtggtgagctagcacgtgttttaaaagcaggtggcgatgcttctaaaattgttttttcaggtttaggtaaaactgaagccgatattgaaacgtcattaaatgtaggtattgcctgttttaatgtcgagtcttatgcagagttggaccgtattcaaaaagtagcagctcgcctaggcaaaaaagcgcctatttctttacgtgtaaatcctgatgtcgatgcaaaaacgcatccttatatttcaacaggattaaaagaaaataaatttggtattccaagtgatgcagtttatgaaacctatcaatatgctgcatctttacctaaccttgaaatcgtaggtattgattgccacattggttcacagctcactgaaactaaaccatttgttgatgctttagaccgtgtcattgtgatgattgatgagttgaaaaaactaggcattagtctgaaacatattgatattggtggtggtttaggggtttgttataaagatgaaacaccgccaagtgttgaagaatatgcaaactctatgaagccggctttagaaaaattaggcttgaaagtctatatggagccgggtcgtagcatcagtgcaaatgcaggtgtacttttaaccaaagttgatttgcttaaaccaacgacgcatcgtaacttcgcgattattgatgcagcaatgaatgatttaattcgtcctgctttatatgaagcttggatggatattcaaccagttgtaccacgtacagataccgaagaaaaaacttgggatttggttggtgcaatttgtgagacaggtgatttcattggtaaagaccgctcactcgcattacaagaaaatgacttgttggctgtacttggtgccggggcttatggttttgtcatgagctcaaattacaacacgcgtggccgtgcagcagaagtcatggtatcaggtgaaaaaagctatttaattcgtgaacgtgaaacggttgagtcgctttgggaaaaagaacgtttattgcctgaggagtaa

SEQ ID NO: 3015 - DNA, 1002 bp, Acinetobacter baumannii
atgggcagcacatgggggaccacaggcatgagtttaagctatcaacctacttgttcaattgatgctttaaaggctcgtgctcagctttatacccaaattcgacagttttttgcagaacgtggtgtcatggaagttgaaacacccgtggtttcacaggcaggtgtcaccgatgtacatttagcttcggttcaggctttgcgccatattaatggcaaattgcaaactcaatatttacagacttcaccagagtttgccatgaagcgtttattggcgagcgtagttgggccgatttatcaaatctgtaaggtgttccgagatgatgaacacgggcgtatacacaacagtgaatttaccatgcttgaatggtaccgtccgggtctggacttaaaagcgttaatgcatgaaacagccgatttattgcaaacctgtttgcaacatcgttttggtgaagttcgtccgtttattttaagttataagcatgcttttcaggaccgtttagatattaacccgttgcaagcgactttaaagcaacttaaagacacagcaaatcgtgttgggttaaatctcgacttgggcgatgaccgtttagcttatatggatttgttgttttctcattttgttgaaccgagtttagggtttgatgcacctgtttttttaactgactttccaccagaaatggcgtctttggcaaaagtgaaagtagatgaagatggggaagaggtcgcagcgcgttttgaggtttatattgagggcttagagcttgccaatgcctatgatgaattgctcgattcagacgtgttgcgttctcgctttgaagcagataatgcagagcgagttaaacaaggacttcatgtcatgccattagatgagcacttgttggctgcgttacctcatatgcctgaatgctcaggcattgctttgggagttgatcgattactcatggttgcaaccgatcaacttaaaattgaaaaagtcattgcttttccagccgaaattgcctga

SEQ ID NO: 3016 - DNA, 225 bp, Acinetobacter baumannii
atatacgaaactcttatgttatttatgctcgaaaatgctatctttaataaaaatatttttccatttataacgattaaatcaaaaaaggctagattttatgcaagatcgtatactgcgccgtattttcttactcgcaggtattgtattgctggtatgggtattatacttgctcaagcctgtggtcatcccatttattggtgcttttttcctggcttatttatttag

SEQ ID NO: 3017 - DNA, 1134 bp, Acinetobacter baumannii
aacatgtttgccagcatattacgtgaactaaactatttaagaagcaataaatgggatttgtgtatggtgacactcatccctgcttttatcatttttttgtttagcagcatgttttatgcaggtaaagctgaacatttacccattgccattattgatcaagaccagagtgaactaagccgtaatattggaaagtatctttcactaaatcatacagtcgatgtaaaaacaattactacaagctcaagtgaagccgagagattactcaatgaaaccaaaatatggggttatgtttttattccggatggtgccgaaaaacgttttgtgaaagctcaagatgctcaaatcagtattgcttttaaccaatctttttttagtgtcgggaacactatttcctcggcgatgttagtcagcactctcaatgctttagcagactatgctggccagaattatcttgcaaataatattccctatatagatgtacctacagcacacgtcaaaatttcaacgctttataacccgagcatgagctatgagttctatttagaacccttcatggttccagccgtattacatttattactatgttgctgtgtggcatttgccattggacaagaaattaaacgcggcacactaacacagtgggtgaaccgagagagttttattcaaggcttattggctaaaaatttgctgtatagctttattttctgtttctggacttggttatggatgttttggctggttgaaattcgaggctggtttgtagcaggttcactaagtttcttattagctgctcagttcttgctttatttttcttatgctttaattagtagtaccgtcattctcgcgaccaaaaatttaagtaaaacttttggttttattgcagtatatggcggatcttctttaagttttgcaggcgttactctaccattaaataatgcaccgattttcactaaattttggtcactgattattccgtacaccccttatgcaaagctccagaccgaacaatgggtgattggaagtccacttttcatttcaatgtctcccttcttaatacttattggctactgccttatttatttctttttaagttgtttgctgcttaaaaaactggttcaaggagcaacaccatga

SEQ ID NO: 3018 - DNA, 840 bp, Acinetobacter baumannii
gcaaaaggcgctctaaacaagcgccattttgaagtaaaggaaataattttgacaccacatgcttatggggttgaaacattgccagtacagcggtttaacaaaaccgaatctgaaaatgtcttagatcatattgtgcaagagtacccaattgccttggtatataacggtatttcgcatacggtgatgatggcgacaccgactgatgtcgatttatttgccaaaggttttagtctttcggaaggaattttaactggcttaaaagagctctatgcccttgaggtgcatcaaaatgaattaggcattacggtggaaatgaccatttcatcaagagcattcgccgccctaaaggaacatcgccgtatgatggtaggccgtacaggctgcggtttatgtggaattgaaagcttaaagcagtttcagttagacgtgccaaaaattacaacgcatgcatcaaaaatatggcttgagcaaattccgagtgctatttcccatttaaaaactcaacaagaaattactgctttaacgggtggggcgcatgccgcagcatgggtagttgacggtcaaatcgtggctttatttgaagatgttggccgccataacgccttagacaaattgctcggttatttagcgcaagaaaattacgacaccagtttaggttttgtggtgatgaccagtcgggcaagttatgaactgatacgaaaatgtgctcagctcaatattagcttgcttgcttcaatttcagcgcctaccagtatggccattcagttagccaagcaatcgggcctgactttggcaagcttttgtaggggcgatggatttgttttatatacggaaatataa

SEQ ID NO: 3019 - DNA, 807 bp, Acinetobacter baumannii
aaaattaaagcgtggagacatcacatgtcagttcaatcaaaagtacttattacaggggcttcgtcaggaattggttctgtttatgcagatcgatttgctcaacgtggctatcacttaatcttggtggcacgagataccaaccgtttagataaaatttcaaaagatcttcaagaaaaatacggtgtacaggtcgagttcattcaagccgatttatcaaacgatcaagacatttgcaaaattgaagaagtactcaaaaacgatgctgatattgaaattttggtaaataacgctggaattgccctgaacggaaactttttaactcaagatcgtaatgagattgaaaaacttctaactttaaatatgactgcggtggtgcggttgtctcatgcaatgtcgcaatcccttatacgcaaaggtaaaggcgccattattaatttaggctctgtacttggcttagcgcctgaatttggttctaccatttatggcgcaagtaaatctttcatccaattttttagccaaggcttacatttagagctaaaagatcatggggtacacgttcaagctgtattaccttctgccactaaaaccgaaatttgggaacgttcaggtatagatttaagccaagttccgccattaatggatgtcaatgatttggtcgatgcagccctgattggttttgatcgtaaagaaacaattacaattcctgtgctgaaagatgaaaatcaatggaataattttgaaaaatcgcgtatgacattattaccaaacttctcttcggctgaagtagcccaacgttataaaaactaa

SEQ ID NO: 3020 - DNA, 369 bp, Acinetobacter baumannii
ttgaacctttacctaaaatatcttgtcgctttaagtttcgagcaacacttagcagtgcgccccacccgccagcaggatgagtatatggctcaattcgcgcaaaaccgttattttcctgtatgtgcttttgttcttctgaattatccactttttcatcctcttatctttttacactcaacaggctcagtgaaatcacaatttaattatggttttatcaaagctacccgctgtttaccgatgagtagagtccactttttatattatttccactatgctaaaagccggctcaaccgttcttataatatgtgccatattctttacaattacaataattcaagccaaccacgctatttatataaaaacatataa

SEQ ID NO: 3021 - DNA, 1098 bp, Acinetobacter baumannii
atgaaatcatattatttagacagtttttatcaaatcaacgtatataatgacatcatttcgattgatttggattggaattttatgtccgattggccaccaaaaccacaaaatgaacctataacccctaaacagaacggaccggaatggcaaatccttgagaaagctgtactggcttctgtagaagaacaacgccgtagtcgtcgctggggtatattctttaaaacacttacttttatttatctattgttcattatcgtcttaatgggcaaaggctgttcgaccactaaagatggctctacagcaagtagtagcagtgctcaccttgcagtagttgatattattggaactattgatgcttcaagcaatcaggctgtgaatagtgaagatacaaacaaagcgcttaaacgtgcttttgaggcatcgaatagtaaagcaattgcccttaatattaattctcctggtggttcacctgttcagtcagatgaaatctggcaggaaattcgctatttgaaaaaagagcatcctgacaagaaagtctatgcggtaattggcgatatgggtgcttcgggtgcttattatattgcttctgctgccgatgaaattattgtgaatccatcaagtttggtaggttcaattggtgtcattatgccaaactatggcattactggtttagctcaaaaactaggaattgaagaccgaactcttacagcggggacgaataaagacattttaagtatgacaaaaccgattaatcctgtacaaagacaacatatccaatctgtactcgataatgttcatactcactttattaacgcagttaaagaaggacgtgggaaacgcttaaaaactaatgatcctgctattttctctggtcttttctggactggcgagcaagcaattcagttaggcgtagctgaccgttcaggtaacattacaagcttgatgcgtgaactgaagcttgataataaagttgactacacgattgaacgtaacccattacaatccattctagggcgaatgggatcagaaatggggaaaggtttaagtgagtcggttgctgaacgcttacaaacaagtcaggacgcaaaactacaataa

SEQ ID NO: 3022 - DNA, 237 bp, Acinetobacter baumannii
cccaccattcaacccttgccaaaaaagcaccatgcgaaaaatatgaatggttttattagccaatatttacctaaggggattgatttaaatcaggcagatcagcattatttaaatcaagttgccatgtcactgataactcgtcctagaaaggcgttagattggcttacaccattagagaaatttgctcagcttgttgattatcatatggcttatgaaactgtcgcacctcatgtttga

SEQ ID NO: 3023 - DNA, 1221 bp, Acinetobacter baumannii
cgattaaatcaaaaaaggctagattttatgcaagatcgtatactgcgccgtattttcttactcgcaggtattgtattgctggtatgggtattatacttgctcaagcctgtggtcatcccatttattggtgcttttttcctggcttatttatttagtccactagtcgaagttctagtaaaaattaagatacctcgctggttggcaattagtattgtttttattggtataggtgtaactttaaccgttgcattgtggtacctggttccactgatctggaaacaacttgtttacgctcgagacagtattccagcggggatccattggattaatgcagagctattaccgtggatttcttcgacattccatgtccagcaaatggaaattgataccgatcaaatgtccaaagctgtgatggattatgttcagaccaattacagtgctgatagtattcaagcagttttattaaagcttgcacaatcaggacttaattttattcaaattggtggaacagttgttttaatcccaattattgctttttacttcttattagactgggaccgtatgttacaaaacttacgtcgtctcattccacggccatatgaagctacgaccttacaaatcgtccgtgaatgccatagcgtgttaggagcatttgttaaaggtcagttccttgttatgcttttgcttggtgtagtttatgcagtaggcttacaattaattggactagaggtcggcctaattattggtatggtggcaggtcttgccagtattattccttatctaggatttgcagtcgggattattgcagcggttattgcaagtttgtttcaatttggaatggactggacacacttattacttgttggcgtagtctttatgattgggcaggcagtagagggctatattctgcagccattcctactcggtgataaaattggtctttcacctgttgcagttgtatttgctgttttagctggggctcaattggctggctttttaggaatgttaattgcattacctgtagcggctgtcattgtggtgctcttaaaacacctcagagaaaattatgaacggagttcattctatgctccatcttctacattattaatccaagagggtaatattgagcaacttcatgtagaaactgaaaatactaaacttgatcttgaagttaaaaaacagcaagatacagataccccgaatctttcagatcagaaataa

SEQ ID NO: 3024 - DNA, 855 bp, Acinetobacter baumannii
ccgaaatgccaaacacattgcaagatagggtacctaaaaaattttaatcgaagagttaatatacttttctcaacatttacttttgctagaacagccgaggattacatgaaggctcttgttgctgtaaaacgtgtggttgatgccaacgttaaagttcgtgttaagccggacaatagtggggttgaccttaccaacgttaaaatgtcaattaacccattttgtgaaatcgcagtggaagaagcggttcgcttaaaagaaaaaggaacagtatcagaaatcgttgttgtttctattggccctaaagaagctcaagaacaaatccgttctgcaatggctttgggtgcagaccgcggtattttagttgaaactactgacgaaattggcgctctagaagttgctaaaatcttaaaaggtgttgttgacgctgaaaaaccagaacttatccttcttggcaaacaagcaattgatgatgactctaaccaagtaggtcaaatgcttggtgcattattaggcgctggtcaaggtacgtttgcttctgaagtgaaagtggatggcggtaaagtacaagtgactcgtgaaatcgacggtggtttacaaactgttgaacttgcacttcctgcaatcattacaactgacttgcgtttaaacgagccacgttatgctgcattgcctaacatcatgaaagctcgtaaaaaaccgcttgatacaaaatctcctgctgattacggtgttacagctggtactaagcttaaaacgattaaagttgaagcgcctgcagaacgtaaagctggtgtacaagtgaaatctgtagatgagcttgttgaaaaattgaaaaatgaagcgaaagtgatctaa

SEQ ID NO: 3025 - DNA, 1017 bp, Acinetobacter baumannii
atactattacaaattaactttaaacaggaatttcctatggaagtacaccagcgtggcttgattaccggtattttaatggctgctttagcaatttctccgcttgctgaagctaaacgtgcaggtggtggtaaaagccacggtatggcacgttctactacttcaagccagtcttatcaacaacctcgtcaagtgactccagttcaacaacctgctactacagcacctcagagatctggtccgggtgttggttcaatggttgccgctggtgtggctggtgctgccgtaggtgctgttgcagcaaatgctttagcagatgacaaatcaacatcagctgaacaccaagtaactcaaccgggtaatgaacaagctgttcaagcccaagaagagaaaaaaggtggtattcctggctggctttgggtattacttgcagctgctgtagctttctttgtattccgtaaattgggatcaaaaaaaaaattagcagctaataacccttatgcaccaaacaatggcggtcaaaacccatttggccgctcggcagctccaaccaatacaggtgacaataccaatatctttggtcaatctgtaggtggtggtgcagcaacacaagctccttttggtagcgcaacgacgaatagtggtaaccaattaccagatggtagcgaacctgcttctttcttacgtgttgcccgtcagcgttttaaccatattcagtcaatcaatagtgcaagtaacattgaaaaaattcgtcgttacttaacacctgaactttataactctatgtataacgacatcatggagaaccaagatcaggacgttgctgagtttagtaacttaaatgcaatggttgtatacagtgcgactgaaaatggtcaatacattgtgagcgtacgtttcacaggtacagtaagtgaagatttaaacagcttgccacagccatttactgaaatctggcactttgtaaaacctgttggttcacagcaagattgggttgttgcaggtattcaacaagcctaa

SEQ ID NO: 3026 - DNA, 183 bp, Acinetobacter baumannii
tcactaatgcacgagcaagcgcaacacgctgacgctcaccacctgaaagttcacctggtttatggtccatacgatgagatagcccaactcgatctagcaaatattcagcctgtgcctttaccgacttatattgactgtctgctcgaagcattaaaggcatcgctacattttcaagagcagtaa

SEQ ID NO: 3027 - DNA, 753 bp, Acinetobacter baumannii
gtttcttggcaactatttatccggcacttcgtgcagccaaagttcaacctgccgaggcattgcgttatgagtaaagtcgttttagaagcaaaagatatttataaacattttgatgacggtaaatctaaggttgaagtcattaaaggtctctctttacaagtggaagcagggcagtttgtatctattgtcggagcaagtggttcaggtaaaagtactttgttgcatgtacttggtggcttagatcagccgactaaaggacaggtatttttgaatggtcagcgctttgataatttaggtgaagcggaacgtggctttcaacgtaaccaatacttaggttttgtttaccagttccaccatttattacctgaatttactgctcttgaaaatgtagcgatgcctttaatgcttcgagcagacagtcaatataagtcggtaaaggcacaggctgaatatttgctagatcgagttgggctatctcatcgtatggaccataaaccaggtgaactttcaggtggtgagcgtcagcgtgttgcgcttgctcgtgcattagtgactaagcctgcggtagtactagctgatgagcctacgggtaacctagatcgtaaaacagcagtaggtattttcgagttgctcaccgatcttaagaaagaactaaacatggcaatgttaattgtgacccatgatgagcaattagctcaggcagcagattcaatcttgcatatggaagatgggctgtgggtaaacggttcttaa

SEQ ID NO: 3028 - DNA, 1134 bp, Acinetobacter baumannii
tgggggcataacatgaatcaagactcagctcattcagaacaaaattctcctgttgcggatacggcagaaactaaccaaaatcagcaaaatactcaaaccgacaatgctcaagaagtagaaacgagtaaaagtgattctcaacctcctaaaaatacgaaaattaaactaattattgcggtcgtggttattgctctcttaggattaatcattttcggtttgtggaaaagctatcaacctaagcctattgaattacaaggccgagttgaggctgaaacagttcatgtcagtactaaggttccgagccgtattgaagaaatttatgtgcaagagggccagaaaatttccaaaggccagccccttgttcgtttagtcagccctgaaatagaagctaaaaagcaacaagccttagccaccctacaatcggctttggcatttcaatctacggtagaccgaggctctcaacaggaaaatattgatactctttatgccaattggcagagtatgaaagcacaggcaaaccttgctaaaaccacttatcaacgtggagaaaatttatatagacaaggtgttatttctcgtcaaagacgagatgagatgttagccgcacagacttctgctcaagagttaagtgaagcagcttatcaacaatatgctcgagcaaagcgcggaagtaccagtcagcagaaatctacagcggacgcacaagttgagattgcaaaagccgcagtaagtgaagctcaagcacttgaggcagaaactcgattactcgctcctatttcaggtacagtttcaaaaacttatggtaaaccttctgaactcgtcgctatgggtgtacctgttgtcagcattttagaagatgatgatttgtgggttagtttaaatgtcggtgaaaaccaatacgcttctgtttataaaaacaaaacactggaaggtttcattcctgcgctaaatcaaagtgtgatgtttaaagtgaaaaatattgatgccgaaggtgaatttgccaccattaaaaccacacgtcagactggtggttatgatattcgtagttttaaattacatttggtgcctgagcgtcctgtcaaagacttaaaagtgggcatgagtgttctatttaaaattaaagaagaaaaataa

SEQ ID NO: 3029 - DNA, 1518 bp, Acinetobacter baumannii
aaagttgtcaaaaaatatacatttaaaagatacctgcaaatggtgcgatatcgtctttttgatttgattttagctaacggactaaaaaaattactggagtgtattcataaaatgtcgaatcaaaatctgagcgaccctcatgaacaaggtgagctccatcgtagtctctctaatcggcatttacagctgatcgcgattggtggtgccatcggtaccggattatttatgggttcaggtaaaacaattagtcttgccggaccttctatcttatttatttatatgattattggtttgatggtgttttttgtcatgcgtgcgcttggcgaacttcttctgtcaaatttaacctataaatcatttattgatttttctaccgatttaattggcccatgggctggttacttcgtgggttggacctactggttgtgttggatcacgattggtatcgccgatctgtctgcaattatttattacttacagttcttcaataatggcttacctttctcgcctgttgaaggcgcaatgattagtgttgccgcgattgtgttcattatgggattgaacttattaacagttcgattgtttggtgaattagagttctggtttgcacttattaaaatccttgcgattattattttaattgcagtgggtctgtggatgatctttacaggctttacgtctactacaggtgaagtcgcttcatttactcatctttgggcaaatggcggtttcttcccaacaggtgtgcatggcttcttggctggtttccagattgcaatttttgctttcgtgggtgttgaacttgtgggaacaacagccgcggaaactaaagaccctgagcgtaatttacctaaagcgattaactcaattccaatccgtatcattattttctatgtattggcgctactcattgtaatgtcagtaacaccatggaacagaattgatccagcgatcagtccatttgtaaacctgtttagtcaagcaggggtagcggcagccgcgattttgatgaacttggtggtattgtcatcagtcatgtcatccatgaacagtggtgtattctcaacaagtcgtatgttgtttggtttatctcgtgaagatcaggggccaaaagcttttggtaagcttaacagacgtgcagtaccggcaaatgcattgtatttctctgctgcgtgtttattgttaggtgcagcattacagtattttgtaccaaatacagttgaagcatttacgcttgcaacaacactttcaacgattctcttcatctgcgtgtggttgcttattatctggagttacatccgttattacaccacgcgtcctgaactgcatgccaaatcaacatttaaattgccgggtggcttatttacatgttggatcacgattattttctttattggtatgatttacgtattgtctttagagccagacacttttaaagcgcttaaagtcagcccaatttggtttgttattttgatcattggttatttcttcttctataaaccacgtcataaaaaataa

SEQ ID NO: 3030 - DNA, 1098 bp, Acinetobacter baumannii
tctgccgccaatgcggagacttcatttatgagcaactcaacttctaccccaaataccggtttaagctacaaagatgcgggtgttgacattgaagcgggcgacgcactggtcgatcgtatcaagtcagtcgctaaacgtacaactcgtccagaagtaatgggcggacttggtggctttggtgcactatgcaaaattcctaaaggttacgaagaacctgttttggtttctggaactgacggtgtaggtactaaattacgtttagcacttaaccttaatcgtcatgacacgatcggccaagatcttgtcgctatgtgtgtaaacgatcttttggtttgtggtgcagaaccactattcttcctcgactattatgcgactggtcacttaaatgtcgatgtagctgcaaacgtagttactggtatcggtaaaggttgtgaacttgcaggttgcgcacttgtaggtggtgaaacagctgaaatgcctggcatgtatgaaggcgaagattacgatcttgctggttttgccgtaggtgtagttgagcaaagcaaaattattgatggctctaaagtaaaatctggtgatgtacttattggtgttgcatcaagcggtgctcactcaaatggttattcattactacgtaaaatcttagatgttaagaatgtagacttaactcaagtaattgatggtcgccctcttgcagatgtagcaatggagccaacacgtatttatgtaaaaccagttctagagctttgcaaacaagttgatgtacacgcgatggcacacatcactggtggcggcttaccaggtaacttaccacgtgtattaccaaatggtgctcaagctgtaattaatgaagcttcttgggaatggccagaattattcaaacttttacaacgcgaaggcaatgtagaacgttttgaaatgtaccgtacctttaactgtggtgtaggtatggtcattgctgttgatgcaaatgatgcagaaaaagcaattgaagtgcttaatgctcaaggtgaaaaagcttggaaaatcggacatatccaagaaaatgctgaatcagtggaaggtgcagacgaaaaaattcgtgtgatctttgaatga

SEQ ID NO: 3031 - DNA, 201 bp, Acinetobacter baumannii
tggatgtgcaaagccaactcctttttattgggagttctgccagacatttatagaattatggtggcagaacgagaaagggttagcagactagtattatctcaaactagcacacccgaaggtgtccctctcccgtcctaccgctacgggaaagggacgagtagttcaccacacaagactgttcctcagaaggaaaagctctga

SEQ ID NO: 3032 - DNA, 927 bp, Acinetobacter baumannii
atggagagcaatttggattttgcattacaactgctctcaatgtggttaaaagaaagaaaaattcaaaaccagtctgagcatacaattaccgcttatgagcgagatgttagaagcttccttgagttttgtgagcttaaaaaagttgatttaaggaatgttgaagcttcagatttacgtgaatatttggctcaacgtgttgagcaagatcagttaagttcaagtagcatgcaacgtcatcttacttctattcgtcagtttatgaagtgggctgaacagggcaaatacctagaaattaatcctactgacgattttaaattgaaacgtcagcctagacctttaccgggcatgattgacatagaaacggttaatcaaattttagatcaacccatgcctgaaaaaccaattgatcagcagctttggttaagagataaagccatgttggaactactgtactcaagtggtttacggctcgctgaactgcaaggcttaacgattaaagatattgattttaatcgtcaactcgttcgtattacaggtaaaggaaataaaacccgtattgtaccgtttgggaaaaaggcaaaagaaagcttattgaattggctaaaaatttataatatctggaaaggccattttgaccaaaatgcttccgttttcatttcacagcgaggcggtgcattaacccctaggcaaattgaaaagcgtgtaaaacttcaggcacaaagagcgggtgtaaatgtcgacttacacccacatttacttcgacattgttttgctagtcatatgttatcaagtagtggtgatttacgctcagttcaagaaatgttaggtcatagcaatttatcgactactcaaatttatacacatattgattttgatcatttggcccaagtgtacgatcaggcccatccacgagccactaagcattaa

SEQ ID NO: 3033 - DNA, 726 bp, Acinetobacter baumannii
gtgtaccaaaaactatttaatcaggaaaatttgatatcgcacagcataatgaatccaacttatatattacactttataccaagtatccgttggacttacaccatgaccgccatactcattccttatttaattgccattactttacttacccttacccctggtttagatacaactttaattattcgtactgcaacacttgaaggaaaatctaaagcgtttcaagcagctctaggaattagtctgggctgtattgcttggggaattgtcgtggcatgcggtctaggtgccctactgatggcatccgacttagcattcaatatattgaaatggatgggcgccgcttatttagcatggttgggtttaaatatgattttaaaacctcgtagtcagctcgcagatatacaagacaatcattcaaatcgctctacttcagagaattggtttattaaaggtttctttggcaacttgctgaatccaaaagttggcattttttatatttcatttcttccccagttcattccagcgcaagcatcggctgttacttgggtgatggggctagtaatgattcatgtggtgattggcgtgttatggtcaagtctattaattctggctatgcagccactttcgcgctatctaaagcaacccaagtttgtaaaatatatggaccgaattacgggcagtatttttgttctatttgctttgaaattggcgttcagtaaaaggtaa

SEQ ID NO: 3034 - DNA, 2421 bp, Acinetobacter baumannii
gaggatgaaaaagtggataattcagaagaacaaaagcacatacaggaaaataacggttttgcgcgaattgagccatatactcatcctgctggcgggtggggcgcactgctaagtgttgctcgaaacttaaagcgacaagatattttaggtaaaggttcaattaccttactcaacattaaccagcctacaggttttgactgtcccggttgtgcatggcctgaaaagaaagatgctcatgcctttaacttctgtgaaaatggtgcaaaggcggttgcttttgaagcgaccagtaaaaccgtcactcccgaatattttgcaggtcataccgtcagttggttatcagaacaaagtgactttttcctagaagacctaggccgcttaacagacccagttcgttatgatgctgcaaccgataaatatgtgcctatttcatgggacgatgcctttaagctcatcgctcaacatttgcatgcgctagataatccagaccaagcggcattttatacctcgggccgtgccagtaacgaagcagcatttttatatcaattgtttgtgcgaagctttggtacaaataactttccagattgctcgaacatgtgccatgaaactacaagtgttggtttgctcgactcgattggtttaggaaagggcacagtcaccttagaagattttgatttagccgacgccatttttagttttgggcataacccgggaaccaaccatccacgtatgttaggtactttgcgtgaagtgtctaaacgcggtggcaacattattgcgattaaccctattaaagagcgaggtctcgaacgtttccaagacccgcaagcaccgcttgaaatgatgaccaatggcagtacgccaattagtcgctattatttccagcctaaaattggcggcgactatgcactgatgttgggtattttaaagcacttacatgagtgggataaaaaggcccttgcatcaggtaaaccaagcgtttttgaccgaaactttattgcagtcaataccgttggtttcgacgaaatgattgcggaggtagaaagaacggagtgggcagatctttataagcactcaggtctgtcgcctgaacatttagaaaaactggctaaactctttttagagtcagagcgttcaattttctgttggggtatggggattacccagcatcgtcacggaactgctaacgtacatatgctggcaaatttattgttggcgcgtggtcaaattggcagaccgggtgcagggctttgtccggttcgtgggcacagtaacgtgcaaggcgaccgcaccatgggcattaatgaactcccaagcccgaaacttctcgacaatattgaccgtgtgttcggtattaaatcaccaagaaaaaatggatatggtgtggttgaaaccattaaagccatggccgaaggtgatatcaaagtctttattggtttgggcggaaactttgctgttgcaacacctgacaccgcttatacacaagaagcgcttagaaaatgtaatttaaccgtacatgtggcaaccaagttaaatcgtagccacttggtgtgtggtaaagatgcgcttattttgccatgtttaggccgcaccgaaattgatgagcaacttcatggcccacaagctattacagttgaagactcaatgagtaatgtccacttgtcggcagggcgtaatactccaatttctaaaaatattttgtctgaacccgatattgtggcaagaatggctgaggccgtgctgccagagagtcagattaaatggaaatggtacattgaaagttatgaccgcattcgtgactcaattgctgatgtgtttgatgaattccatgattttaatttacgcgtttataaacccggcggtttccatttagaacatccagctaatcagcacatctggaatacaaagagtggtaaagcgcaatttctaattacgccacttgaagaagtctatgtggataaagaaaatcagtacgctgccgcatataccgaaagtaaggtttataccttaatgaccacccgatctcacgaccaatacaacaccactttatatggtctggatgaccgttaccgtggggtttttggtcagcgccgtgtgttgtttatgaaccaagccgatattgatgaagcgggctttgaagcaaatcagtgggttgatattgaaagtgttttctcggatggtgtgaagcgtattgtgcatagtttccgtattgtgccgtacaacattccacgcggcagcttagcggcttactatccggaaaccaatcctttggtggccttaagcagtcatgataaatatgccaagattccggcttctaaaagtgttcctgtgattttacatcccggaaatgcgccagagcattttaacttggcaacagccgttgaccctgaagatgccaataagaaagttagcagtctttaa

SEQ ID NO: 3035 - DNA, 1143 bp, Acinetobacter baumannii
tttaatacccttaacattgtactttgccacaactcaaaggataataacgtttttataagctatgggttgcagaccatgaaaatcgtcgcagatgaaaatttggcgtttaccgattactttttttcagagtttggcgatattcaacataaagcagggcgcaccttaacgcatacagacgtacaagatgctgaagctttattggttcgttcagtcaccgcagtaaatgaaagtttaattcaaaataccgccctaaaatatgtgggcagtgccacaatcgggaccgatcatttagatattcaagctttagaaaagcagggcattacatgggccaatgccgcaggttgtaatgcacaggcggttgctgaatatgtgattacagctttattgcatttagatgctagccttttagaacaacaagaaaaatttacgctaggtattgtgggtcttggcaatgttggtaagcgcttggcttatatggctcagttgcttggttggaaagtgattggctttgacccctttgtacagttagattcaattgaaaatgtaagctttcaaaccttgttgcaacaagctaatgcagtttcaattcatgtaccgctgaccaaaaaaggcgaacatgcgacgtatcatctgtttgacgaaaaagcttttgcagcgcttcaaccgaacacgattttaattaatagtgcacgtggtccggtcgtaaaagaagccgctttaatcgaagatattcaacgtacccagcgtaaagttgtacttgatgtatttgagcatgagccagtgatatctgaagagcttttaaatatgttggctttggcgacaccgcatattgcaggttatagcttggaaggaaaagcgcgtggtacgcaaatgatttatgaagcgttttgtcaaaaatttggatatgacattaataagcgtttcgaaacccagttacctgcatgtgaagactatttttcaggacatgatttaaaagcagtgttaaagcaaaaactatctcaaatttatgatattgcgcaagatgatgccaacatccgtgcttatattaaagacgggaaagtagagcaaaaagcatttgatttattacgtaaaaattatccgctgcgccgtgaatgggcagcacatgggggaccacaggcatga

SEQ ID NO: 3036 - DNA, 1359 bp, Acinetobacter baumannii
tcaaggatgaagactatgaaaaattataaaaaagcattattggcgttatctatacttgcgaccatgccattgtttgctgatagcacaaataaacggattgaggttacaacttttgctgacgaagatggtgaaaatccaaatgcgtgttcattacgtgaagcaattaaagtggcagctacacgtaaatcagactatggatgcactatttttagcttagatgataatcaggcaattcagttaaaagcagggacttatactttaaataaagaattagtaccaaatgcaaatatttctatctatggttatggagagcgcggagaagataaaaattgggcagaaaaaaaccctctaacaaatgattatcctgctctaccagaacttaaaacacgtattaatgctgcgggtaagtcacgcatatttaatactgcagagaataaaaaggctttaactttacaaaatattattttagaaaatggtatagcttcaacccaaggcggggctatttatgcaggtggtaatgtcaccttgttagattcccaaattttaaattctcaagctccaaaaggtggtgccatttttctgggcgggagtggggtaaacttatcaataagccattcattactacagggtaatcaagcagttaccggtagtgttttagcgatgagttgtaaagaagaaccagcttatgctaaacgtgatatcactataatgtcttcaagtattttcaaaaatggttcgcttaactctaagagtacatttgaattttgtggtgaaccaaacgccatattgacaattaatacgattgcaaaaaatatcgctgataagataaatggtagtattctaaaatttactggagatgccgttcctggaagtacaactaatccctcaactatactgagcggaagtagtagtttaaatttacagaataatacgattgttgagaacactgcacatactaccttcttatatgatagtttgggtataaaagaattaaggtttaatttaatagggtacaatctaggtagttacgcttgtcgttatttagtggggcctgctgcggacctaaaaaattctggttttacactatcatttaatgcattaaatttaacgaataacgttgaaaaatgtgatttaccaacagaagcacttacctcatctaataagactattgatattgcgaatattccttttagctcgttattagaaccgcaaagttctgcttcgccagaaacaggctttttacctgtttattacccattgaataacacctcatctccacaaaatgatttgatagatgtagatcctgatggtaaagatggcagagtaaaacttgaagtgcgacataaaccacctaattaa

SEQ ID NO: 3037 - DNA, 858 bp, Acinetobacter baumannii
ggagtaaatgagatgttattagaatttaccaaaatgcatggtttaggcaatgatttcatggtggttgatctaattagccaaagagcttatttagatacagcaacaattcaacgtttggcagaccgacactttggtgtggggtttgatcagcttttaattgttgaaccaccagatgtacccgaagctgattttaaataccgtattttcaatgcagatggttctgaggttgagcaatgtggtaatggtgtgcgttgttttgcccgttttgtccacgaacgtcatttaaccaataaaaccaacattaccgtacaaaccaaagcgggtattgtaaagccagagcttgggcaaaatggttgggtgcgtgtaaatatgggttacccaaagtttctgccaaatgaaattccatttgtggctgatgaacctgaagctttatatacccttgagttggcaaatgaccaaaacattagtattgatgtggtcaacatgggtaacccacacgcggtcactatagttccggatgtactaactgctgatgtagctggtattggtccgcaagttgaatcacataaacgtttccctgagcgagttaatgctggtttcatgcaagtgattgatgacaaacatgttcgcttacgtgtatttgaacgtggtgtgggtgaaacacttgcgtgtggtacaggagcttgtgctgctgcggtaagtggcatgcgccgtggtctacttgccaactccgtagaagttgaacttgctggcggtaagctacaaattgaatggcaagaaggcgatgtggtctggatgactggtccaacaactcatgtatatgatggacgtttggatttacgttatttccaaggttaa

SEQ ID NO: 3038 - DNA, 966 bp, Acinetobacter baumannii
agcgaaagtgatctaatacggaaggataaaatcatgagtattttagttatcgctgatcacaacaaccagacacttaacggtgctactttaaacgttgttgctgcagctcaaaaaatcggtggtgatattactgtattagttgctggttcaggcgctcaagcagttgctgacgctgctgctaaagttgctggtgtgagcaaagtattacttgctgacaacgctgcttatgcaaaccaattagctgaaaacgtagctggcttagttgctgacttggctaaaggttacaaatacgttttagctgcttctactacaactggtaagaacattcttccacgcgttgctgcgcttcttgatgtaagcatgatcacagacattatttctgttgaatctgctaacacattcaagcgtccaatctacgctggtaacgcaattgcaactgttcaatctgacgaagcaatcattgttggtactgttcgtggtacagcatttgatccagttgctgcagaaggtggttcagctgctgttgaaacagttggcgaagtaaaagatgctggtgtttctaagtttgtatctgaagaaatcgttaaacttgatcgtccagaattaactgcggctcgtattgtagtttctggtggtcgtggtgtaggttctggtgagaactaccacaaagtacttgacccattagctgacaagcttggtgcagcacaaggtgcttcacgtgcagcagttgatgcaggctttgtacctaacgacttccaagttggtcaaactggtaaaatcgttgcacctgagctttacattgctgtaggtatttctggtgcgatccagcacttggctggtatgaaagattctaaagttattgttgctatcaacaaagacgaagaagcgccaatcaacagcgttgctgactactggttagttggtgatttgaacgctgtagtgccagagttggtatctaagctttaa

SEQ ID NO: 3039 - DNA, 828 bp, Acinetobacter baumannii
tttaagcaggataacggtatgtcagtaaaaccggttatacactttgcgcatgccaacggcgtgccatctatggtgtatcaaaaattgtttgatcaattaaaagatgagtatgacgtaatttatgttccactcattggacctgacaaacgttatccgattaccaatcattggccttttttagttgatcaggtaattgatagtattgtacgtcaagcgaaggggcgaaaagtgattggactgggccattcactcggttcagttttaactttaatggcttcttttagacggcctgagttgttctcacaagtgatcatgttagatccgcctcttattttaggtagatattcttttgcttttcatatggcaaaattatttaaacccaaaatagttgatgatatgacaccagcaggtttatctgcgcgtcgtcgcgagcattgggaatcacgtgagcaagcagctgcattgttacgcctaaaaggtttttataaagactttgatgaagattgctttcaagcatacattgactatgctttaaaagaagactcggtacgtggtggtgtaacgttaactatttcccgtgaagatgaagttgcgattttccgtaaaaacccttcttggtggtggttacctatgccaaaaccgaaaatgccagtacatttagttgtaggaaaagagagcgcctttttaaaaagaggttttcctcaaatggcaaaacgtaaaatggggattccatttagtgttgttgaaggagggcatatgttccctctagagcatccgattgatacagtgaattatattaaggaacttattcaccgtaattcacgctaa

SEQ ID NO: 3040 - DNA, 1521 bp, Acinetobacter baumannii
actataagggatgatcaaaaattgttatataaaatgccaacacatcaatatcgacagtctaaacgtccttttttgtttaaacccaattaccttgcgttggtattgggagtattaattgcaacgcctatttatgcgcaaagtttaagttatgctgaagcagaacaacaggctttaaaaagctcatacagcactcaagccaaccaagcattacaacaagcctctcagttagaagccgaagcggtaaaaggtttaggactccccagagttgatttaaatgtgagagcatatgcttttcatagtgaaacagatgtacccttaggctcttttaaacaaaaacttgaaaatgatttaagccaaggactcaatgataaattatcccagtggaacaacgtcattccatcagatgttttaggtcaagttcaggaaggctcaaaccaaatcatacatgacggtataaaccgttttcctgactacgctaatttgactgtagaagaccaagtagtccgaccatctatttcagtggtgatgccgctctacacagggggcttaacaactagtgccaaaaaaatagccaacattcaggctcaacgctccaagctttcaagccaacaacaacaagatatccagcgcttcgaagtcgtacaaagttattttaatgtgcaattacaacaacaactggttgcaagtagtctatttaactttaatgcaatgcaaaaacattacagcaatgcgttaaagctcgaacagcaaggttttattagtaaagggcaacgtatgcagtttgaagttgctcgtaacaatgccgaacgaactctacaaaatgcgcaggcaaatctgaatgctagccaatttaatttaaacaatcttttgcaccagcaaaataatgctgatttaagtactcctctttttgtaaatactgttcgtagccaatcgttagaatctcttttaagcagttactctcaaaaatctagccttgtgcaaaaaatgcagttagatactcaattggcaaatgcaaatattcaggctcaacaagcagcaaaaaaaccgagtcttttcgcttttggtgagtattcacttgatgaaaatgaaaactggattgtaggtgttatggcaaaatacaatctgttttctggcgtagataaaaataagaatattcatgctgccgagttaaaacgttatgcttcggaactcatgactgaacgaactaaacaagagattgaagcattattgaataagtcctataacgagctcaattcagcacagcaaagtcatacgctattacaaaggaatatcagcgcagctcaagaaaacttacgtattcaggaactttctttccgagaaggcatgggtacagcgactcaagtgattgatgcacaaaatgcattaagtgctttaaaaacagaaatggctttaaatgcttataaatatgtcatgtcgctcgcaactctgttgcaaagccatggttctatggaccagtttaaagcttatgtgactcaaccacacactgactatattcgctaa

SEQ ID NO: 3041 - DNA, 1182 bp, Acinetobacter baumannii
aaatttatctgcattagagcatttatgaaggttgtgatcgcccctgattcatttaaagatagcttatcggctttaaaggtagctcaagccattgcccaaggatggcaagcggtatttcctcatgcagaaacgattttgtgcccaatggccgatggcggtgaaggaaccattgaagctgttttagaagtctgcgatggtcaatggcgtgaaaaaactgtagtcgggccattaggtcagcctgttcaggccaaatggggttggttagaaaaacaaaaaattgccatgattgaaatggctcaagcaagcggcatacagttagttcccccttctgagcgtgatgcctgccacagcacaacatttggaacaggccagcttattttggatgccttagacgcgggtgcaaaagatattattttaactgtgggcggtagtgcgaccaatgatggcggcacaggcttacttagtgctttgggtgcagttttactcgatgctaaccaaaaggttttacccgcgggcggccttgcccttagccacctatccaaaattgatttaacacatttcgactcacgtattcagcacacacggtttttattggctgccgatgtgaccaatccactttgcggtccaaatggcgcatcacatatttttggcccacaaaaaggtgcttccgctgctcaagtccatttactcgatgcagcccttgcccattttgccgatgtcacggcacaacttttaggttttgataaacgaaatgaagcgggttcaggtgccgctggtggtttgggctttgccgccaaaagttatttaaatgcggagtttaaagctggggttaaagtcgtggcggaactgaatcagcttgagcataaaatttctaacgcagattgggtgattacgggtgaaggtaaatttgaccaacaaaccttaagcggtaaaaccgtttttggggtaagccaaattgccaaagcccacaatgttccggtcattgtgattgcaggaactttaggggaaggctaccaagcactttatgagcacggcgtaagcgccgctttttcactagccaatggccccatcaccctagaacacgcctgcgaacatgcagcagaactcatttatgagcgaacagtcgatatagcgagattaattcagtttagtcaaactagcttaaaagataaaaaaacttaa

SEQ ID NO: 3042 - DNA, 2727 bp, Acinetobacter baumannii
gaaggagtatgcatgagcgtatcggaaatccgaccgattgccattgaggacgaactcaagcattcatatttagattacgcaatgagtgtaatcgtatctcgtgcattgccggatgtgagagacggtcttaaacctgttcaccgtcgtgtgctttatgccatgcacgaattgggcaatgactataacaaagcctacaagaaatctgctcgtgtcgttggggacgtaatcggtaaatatcacccgcatggtgacttagctgtttatgaaaccattgttcgtatggctcaagactttagcttacgttatttattggttgatggtcagggtaacttcggttcgatcgatggtgatagcgctgcggcaatgcgttataccgaagtccgtatgactaagctggcacatgagcttcttgcagatttagaaaaagacacagttgactgggaagataactacgacggttcggaacgtatccctgaagtacttccgacacgtgttccaaacttgttaattaacggtgctgctggtattgctgtaggtatggcaactaacatggcaccacacaacatgacagaagttgtgaatgcttgtttggcttatgctgacaatccgaatatctcaattgaaggattgatggaatacattactggtcctgacttccctacaggtggtattatctacggtaaatcaggtattgttgatgcctaccgtaccggtaaaggtcgtttacacattcgtggtaaataccatttcgaagaagatgaaaagacaggtcgtacaaccatcgtctttactgaaattccatatcaagtaaacaaagcaagagttattgaacgtattgccgagttagtaaaagagaaaaagcttgaaggtatttcagaacttcgtgatgagtctgataaagaaggtatgcgtattgcaattgacttgaaacgcggtgaaaacgcagaagtcgttgtaaataacttattcttaaatacccagcttgaaaactcattcagcatcaacatggtttgtctagacaatggacaaccaaaattgatgaatctaaaagatattattgcggcatttattcgtcaccgccaagaagttgtaacacgccgtaccatgttcgaattacgtaaagcacgtgaacgtggtcatatcttggaaggcttgacagttgccttagccaatattgatgaaattattgaaaccatcaaaacttctgcaaaccctgctgaagcgcgtgagcgtttacttgcgggtgagtgggctggtggtggtgttgttgcactacttgagaaagctggtgcaatttctgttcgcccagatgaaattgaaggtgaagatccaaatcgtccatttggtttaagtgattcaatttaccgtctgtcaccaacacaagtaggcgcaattttagaattacgtttacaccgtttaactggtcttgaacaagacaagttacatgcggaatatactgaaattttaggtcaaattgctgaacttactgcaattttaaatgactttaacttgttaatgggtgttattcgcgaagagttggcacaagttttacaacaatatggcgatgcacgtcgtaccgaaattgttgaatctcgtgtggatttctgccgtgaagatttaattcctgaagagcaagtggtattaacggtttcgcaaacgggttatgcaaaaactcaacctctttcagactatcaggcacagcgccgtggtggacgtggtaagtctgcaacctcaatgaaagatgatgactttattcaacatctgattgtggcatcgaaccatgcgaccgtactttgctttaccaatgtgggtaaagtgtaccgtctgaaagtatttgaagttcctcaagcatcacgtggggcaaaaggccgtccaatcgtgaacttgttacctctagatgcaacagaaaccgtaaccgcaatcttgccgttaaccgagttcccggaaaaccactatgtgtttatggcgacagcttctggtacagttaagcgtgttgagttagaacaatttgcaaacattcgttcaaatggtctgcgtgctattgaacttaatgaagaagataccttaattggtgttgcgattactgatggtaatcagcaaatcatgttgttctctaacgaaggtaaagcaattcgttttgctgaaactgacgtacgtgcaatgggtcgtacagcgaaaggtgtacgtggtatgcgtgtaagctttgcaagcagcaccttaagtgaagaagatgcagatgtagaaaatgatgattcagatgataatgatgactcagcagattcaagtctagtaagtcgcatcgtatcgcttgttgttgtacctgaaacaggtgaagtactgtgtgcgagtgccaacggttatggtaaacgtactccagtaaatgacttcccgaccaaaaaacgtggtggtaagggtgttattgcgatcaagacaagtgaacgtaacggtgagctagttggtgcagtttctattgatgaaaccaaagagttattattaatttctgatggtggtacgcttgttcgtacgcgtgctgcagaagttgcaatgacaggccgtaatgctcaaggtgttcgtctgatccgtttaagcgaagaagaaacgcttgttggcgtagtttcaattgaagctgtagaagacgaagaagaacttcttgaaggtgaagtagatacgactgaaactgatagcgaagaagctgtatctaataatgaagatacttctgaagagtaa

SEQ ID NO: 3043 - DNA, 681 bp, Acinetobacter baumannii
aacttgagatgtgccaagcacagtctttataggctttgctgtgcctttttttctcctaaaaaagtatctcatttacaaacaacaagaatttataacggtaaaactatgccaaatttagttctcccaacacgtgccttatacgttgtaaataaagcaattgatctgtttcatcaccgtggatttcacctgattggggtcgatagaatagtgagagaatcagagattacaaaagcgactttttataattattttcactctaaagaacgacttattgaaatttgcctgatggtgcaaaaagaaaagctccaagaacaagtggtcgcaatggtcgaatatgacttaagtacctccgcaatagataaactcaaaaaactttattacttacataccgatgtagaagggccgtattacttattatttaaagccgtttttgaaattaaaaatagctatcccaacgcttatcaaaccgtagtgcgctatagaacatggttaaaaaatgaaatttatagccagcttagattgcttaaacccgatgtctcttttaccgatgccaaactatttttatatatagtggagggtacaatcattcagcttttaagttctggtggggtagatgaaagggagagattattaaattgctttttggggcagtttataaccgagtcaaagtcaattttataa

SEQ ID NO: 3044 - DNA, 186 bp, Acinetobacter baumannii
gcattaagccgctttaactggaataaaaagcagaatgtagagatcatttgtatttttttacaaatttgtttaaaagaaatcgatgaaattacccaattgaccattttgttctttgcacattttgtcggcatatatagtctaaaaactataaattttgattcatttttgagagtcttatccttctga

SEQ ID NO: 3045 - DNA, 1041 bp, Acinetobacter baumannii
gcaatagtacggtctttcataataaaggtggttttattacgactgttcgagatggggatgtttgttaataatattacgatgaatttaaaaatgaacaaggattattccttggaagctccacaaggcaatgcttcaatttcaaatagtatattagttggaaatacaattaattgtcaggcgaattcaactgataaagcaattatccaaagtaatttagtgactacagaatgtaatcgtaacgcttcagtaaaagttccaaatattctttatcctgccaatcagaaattaattgttggtagtacagatgagggagtttgtgatgtagcttcaaaggatgggttgttatgtccttttaatacgccaaaggatagtttcttgggcttttttaagccacggttacttgaaagttataatactttagctgattcacttattattaataaaggccgtttgtacagtgatggtacttctgtaggcttggcaagttgtgaaactttagatcagcgtggaaaaagacgtactggttatgatgagttatgtgatttaggcgcaattgaatatatcctaaatagtgatatctcttcagttggtcaggatattagatatgggcaggttgcaaagtttagtattttaggctcattaagtgaagcagacttggttacacctgccacgtgtaagcgtttattcggtgaacgtcctgatggtaaagaatggcaacctggctgtttgaaaataaaacaaagtactgatacacctgtttcgaaaggtaccgtaactatagatcagaatggaaatgtaatttatacaccaaatggtaattggcatggtgcagatatttttagtattcaggtagttacaagtatttcaagatttaatgaaggagtcgagttccaatacattactattcctacaagaattgtacaggaacctttgtctggaattgaagataaatctgtcagctctggtggggggggaagtataggggctggttttattttaagtttactggggttggttgcgttacgtcgctttaagtcataa

SEQ ID NO: 3046 - DNA, 198 bp, Acinetobacter baumannii
atacgccctagcattgaaatatttactagagaagctgctgcaaccttaagcaatctgtggttaaatgcctttttttattgtgtttcacttttacaagggaaaaatcatgcgcgcgtacaatttctgtgctggtcctgctgcattacctactgccgttttagaaaaagctcaacaagaattgttggattggcaaggtaa

SEQ ID NO: 3047 - DNA, 765 bp, Acinetobacter baumannii
aaaacagcaagatacagataccccgaatctttcagatcagaaataatttcaaggccaattcattatatgcgtcaactccaactggatatagaacctcaacttgatgcccgaatcagtgatttttcgggaccaggttgggggcatgtagtggatgcagtgcgacaactacatgcgggtctagtaaatagattttatatctatggtggcgcaggaacaggcaagagccatttgctttcagcgatttgtgattcttatttagaggtcggtaaatctgcaattaaagtttctttgcttgaacttctcgatgctccaattgaggcaattacttgcttagagcactatgatctggtggctttagatgatattgagtcgattagtggggtgcctcactggcaaaaagctgtttttcatttaatgaataaccatgaaggacaacttgttttctcttcacgtgttgcaccgattgaattaaaactagagttaccagatttacaatcgcgacttacacaagcagtgagtgtaaaagtgccgagcggaagtttatatgctgatcgctatgctttagtcacttctgtaatggctagacgtgggatccattttgatcagcagattgtagactatttacttttacatgggcctcatcaagcttctgttctattgcaaaccgtagcacaattagaaaaactccttaaaggtgagaagactaaactttcaaatgcaacgttaagacaaatctatgctttaattgatgaatatcaacaataa

SEQ ID NO: 3048 - DNA, 420 bp, Acinetobacter baumannii
aattctaaaggttcagagtctgtccaaatgtcttgggtacaatcaataaaagaatgggcaaaacgtctaaaaaaacaaattattatgctttggtttgcctcaaggcatcctcaaatgccgtggttacccaaaattattgctgtggtagcggtggcttatgcgtttagtccaatcgacttaattccagactttattcctattttaggttttattgatgatgcggttattttacccatactcatttggttagcagttcgttttacgcctcagcaagtcatttttgatgctgaacaacaagctaaagaatggctagatgaacatgaaaagcggccaaaaaactatttggttgccgtacttattattttaatttggctcacacttgccgtgatggcttacttttattttggcggtggtttgtaa

SEQ ID NO: 3049 - DNA, 615 bp, Acinetobacter baumannii
gaaaatcttatgaatgttattgatgctctccgcaaacgccgtgcagttaaacgcttcgaccctgcttttcaactctctgaagatgacaagaagcagttattacaagaagttttagcaaatgcaccaagcgcttttaacttgcagcattggcgtccagtcattgttgaagatgcagagttaagacaaaaaattcgcgcgattgcttgggaccaaccacaagtaacagagtcatcattactgattgtgttatgtgccaaagtaaatacatgggaagttgacgctaaacgtgtatgggatggagcttctccagaagttcaagatattatggttggtgcaatcgaccagtattaccgtgaccgcccacaaacccaacgtgacgaagtgatgcgtagtgcgggcatctttgctcaaacccttatgttactcgctcaagagcatggtttagatagctgtccaatggatggttttgactttgatgcaatggcaaagcttattaacttacctgaagatcacgtggtgtgtttaatgattgcggttggtaaagcagcttcagaaccttatccacgcgtgggtaaacttccttacgatgacgtcattattcaaaatacattctaa

SEQ ID NO: 3050 - DNA, 1656 bp, Acinetobacter baumannii
ggattatgtatgcagcaatggcttcgtagttccaaatttttattaatattcttaccgatttggctatttgttttatcttggattaggcccttatctgtaccagacgaaggtcgctacggagatattagccgtactatgttcgaatctggagactggttaactccacgaatcgatggcttacctttcatgcataaacctcctttactacattggttaagttctatgtttatggagctttttggtgtgcatgtatgggtgttacgtttagtacccgttttggctggtaccctcatgttagtgggactattcttatttgtaaaaaagcatatttcagaaaacgttgcacaacttaccgttattattttagccacgaacctgcttttttttggtagtagccaatacattaaccatgatttactgctcacctcttggatcaccattagtgttttatgttttgttgacttcaccatttctgcacggaaatctattttatttttaggttatatcgctggtgcagcagccttcttaagcaaaggtttaattgggattttaattcccgggatgattcttttaccgtggttaatttacaccaagcaatggaagaaaataccttctcttcttaatccattggctatcttgttatttttactcatcgttagtccgtggctctacttagtacaaagtaaatatcctcaatttttacactatttttttattgatcaacaatttaatcgttttagttcaaaagagtttaataacaaacagccatggtgcttctatctgatgattttatttgtcagttttttaccatggctttttgcgagtagatttacgtctataaaaaccatttttaaagattacaaatcatgctctttacttgccctatttgtatggtggtttgtttctgttacggttttcttctctattccgccttctaagctagcaggctatattttacctgctgttccgcctcttgccattttcttctcgcttgtgatgaataaggttcttgaaagcagtaataaaaccagattgcagacttggggtattcctgtatttactgtacttgttggaattggcgttagtgcaacaccacattttattcgtgcacatcagccttttttccaaaaccaagccatatttatttatctcattggtgccttattaattgtgcttccacttgtgttagttgggctatataaaaaacagaaattgaactatttgacttatatttttataagtttaattgttctatgtagtgcagtcccatttgctgttcgtattttagataccaaaaacaatgtaggccaaacagattttgctgagtacattgccccatctacaaaaatcgttttctacgattattatttctatgatgttccattccttttacaacttaagcaccctgtttatatcgtaaaccaatgggatactgtgcattcagatagtgcctctttagaaattaaagatggtttgttatttgaaccgcaactcaaaaagtacttgtggagcgaacagcagcttcaagatgctctaatgcaaaaacaagatctgatcgtggtaagtcaacctcataattttgcaactaaagacccgtcagtaaaaactttgcattacagaaactatgatgtatttattttccatccctcgaaataa

SEQ ID NO: 3051 - DNA, 1482 bp, Acinetobacter baumannii
gcaaaatgtattccatatcgattaagttctctattgggctttttgctatactctgcttttaatgattatgaagttatctcactgaagtcgaatatgagcaaagtcaaaaccgtttaccgttgtgagcaatgtggtgccgatcatctaaaatgggcaggtcaatgttcagagtgtggtgaatggaattgtcttaatgaagtcaaactagaacccactactgctcatcgtgcacgtcctaaagttgggggttatgcgggtcaagtcgccaatattacaacgcttaataaagtctctgtttctcatgaaacccgtttaccaacaggcattagcgaatttgaccgtgtgcttggtggtggcttggtgacaggttctgtagtactcattggtggtgacccgggtattggtaaatcgaccattcttttacaaacagcaactcacatggcaagtgcaaaaagttctgcactttatattacaggtgaggaatcgctgtcacaggttgccttacgcgcccaacgccttgacctaccaacagaccagttaaaagtcatggctgaaacttgtgtcgaacgcatttgtgaagttttagaacaagaaaaacctgtagtcgctattctagattcgattcaaacgctttacacagaaacgcttcaatctgcgccgggtggggtttcacaaattcgtgaatctgctgcgttattaacccgttatgcaaaaaatagtggcacagcgctatttattgttggtcacgtgaccaaagaaggtgcattggcaggtcctcgtgttttagaacacatggtggactgcgtactttactttgaaggccaatcagactcacgttatcgaatgattcgtgcagtgaaaaaccgttttggtgcagtcaatgagcttggcgtatttggcatgaccgataaaggcttacgtgaagtggctaacccttctgctattttcttaagtcgttatgacgaagccattcctggttcaattgtcatgatcagccgtgaaggaactcgcccgcttttagttgaagttcaggctttagtcgatgatgctcaaggacaaccaagacgtgttgcacttggtcttgaacaaaaccgtttaaacatgctgcttgctgttatgcatcgtcatggtggtgtacaaaccaccggacaagacgtgtatgtcaatattgtaggtggtttaaaaattaccgaaacaggttcggacttggctgttttacttgcatgtgcctcgagtttgcgaacaaaagccttacctcagcagcttgcagtttttggtgaagttggtctttcaggtgaaatccgacctgtacctaatggtcaggaacgtttaaaagaagcagcaaaacatggctttaaatacgtcatcttaccaagaggtaatgccccgcaaaaagcaattccgggcgtacaagtgattgctgttgcccgcctgcatgaagccttgactgaggcgatgcaactcagtgatgaattgacataa

SEQ ID NO: 3052 - DNA, 1026 bp, Acinetobacter baumannii
ttgtcaacaatacggtatccagctcaccagactaggggcaatgcaatgaatataaaaccctttttatcctgcgttgttccagcctacaacgaagcagagaatttaaaaacctttattcctgctttggcaaatagtctaaaacagcaaaatcttagctatgaaattattgtggtagatgatggaagtaaagacgataccattccaattttacaaacaatgattgaggattatcctttagttgtgctggagctttcacggaactttggcaaagaagcagctttaagtgctggtttagaccatgtgactggtgaagttgctctactgattgatgctgattttcaacatccatttgaagcaattccaaccatgattaatctttggaaaaatggttatgacatggtctatggtattcgtaatcgtacaaccgaatcatggcttaaacgtgttttaacccaagcttattaccgtattttaaacttaagttcacctattgatattccagaaagtgctggagacttccggctactcgatgcaaaagttgttgaagccatcaaacagttaccagaaaaaaatcgttatatgaaaggtctatatgcttgggttggctttaaaagtataggcattaatttttctgagcaagaacgtcaacatggccgttctagcttcaacttaaaatctctttttaacttggccatgtcaggtttaacgggtttttctgatttacctttacgcgtatgtatttacttaggtgcaattctggccttaggtgcgatgagctacggagtgtggattatcattaaaactttgattgagggaatttccattccgggctgggcaacacttgcggcaggtatgacgctattaggtggcattcaattattattcattggaattttaggtgaatacattggccgcatttatgctgaagttaaaaaccgcccaaaatatattatttctaccgaacattctcgtactaagcaggaacattcaatcgcccaccaagaaaatacgttctctagtttctaa

SEQ ID NO: 3053 - DNA, 921 bp, Acinetobacter baumannii
caaagaaaaatgaaaaaaataggtaaggagaagggtatgctcaaacggagcattgcttttgcattattggctgctgctgggcacgcttattctgctgatattgaagtcacaactacaattgatgaagatgtcgataatacagtatgctcattacgtgaggctgtagaactaataaataagcgtaattcaagtgattctaccgtggttgcctcagtaaaagatgggtatcatggctgtggaaataaagatagttcatcaaatattattttacagcgcgataaagaatatacgttaaatagcagaataacgattacagcaccccttacaattagtacagcaaaaaacgattctacattagttgatactgatcagcccggttctcataatgcaactatcaaaatggcaggtacagatcagctatttaaaattgatgatgagagtgttgaaaaagcatcattttcggttttgttgagtgatcttaacttacaaggggcaggtgcaaactctaaagtgttaacaggtggtttaattttaaaccatgaaaaattgactattcaaaactctcgtttaacaggtggatatgcgaatcaaggtggagtgatttacaatcaagggtttgcctcaaaaagtgatagaacctttggttttgtttatattgtaaatagccttatccagaataataaagcagcccaaggtggggtaatctatagtgagcaaccattatttctaattactcaatcggtaattcgtgataatgaagttagtaatataagtggttcactcttcttcagtcaagattcatttgatgatgaaagtactggagaatatgtagttcaacgtgctataggattaagcaatagtacggtctttcataataaaggtggttttattacgactgttcgagatggggatgtttgttaa

SEQ ID NO: 3054 - DNA, 630 bp, Acinetobacter baumannii
atgatgaaaattgctgttctagtctctgggaacggcagcaacttacaagccttgatagatgcaaatctatcagggcaaattgtaggtgtactgtctaataaagccgatgcttatgccctagagcgtgctcaaaatgccaatatcgcgacagccgtaatctctcacaaagactttcctagtcgtgaagattttgatgaagctatgcatcagcaacttatcgcatggcaagctgacgtggttattttagctggctttatgcgtattttaactgctgactttgtcaacaaatggcaaggtaaaatgcttaatatccatccttcattattacctgcctataaaggcattaatacacatcaacgtgtattaaatacgggggatcgattacatggctgtaccgttcactttgtgacttctgaacttgatgctggtcaagcaattgctcaatctgccattgaagtaaaagaacatgacaatgttgcatccttggccgaacgtgtacataaacttgagcattttatttatcctcaagttgcagagtggttatgcaatggccagctcacatggaaaaatggacaagcctatttccgcaatcaaattcttgaacaccctattcgttttgcatcttggtaa

SEQ ID NO: 3055 - DNA, 2433 bp, Acinetobacter baumannii
atgtttaagattattctattggggtggattggcggtattgcattgatgggaatagatttccctttaatcatgcaatatgaaaaagtgggcgaggctctactgttacttgcctttattttttatctttataaacgaccaatgttcgttgatcgaccatttttaaaggcagtgttttgcttattatgtacaacaagtctttttatggttggttaccactatgctgaaaaagcactgattgaacgattagaacaaagagaaacggatacccgaaatttcgacattattgtctatataaaccgtttaagtgaagaaaaagataataaggttcaacaaactgcacaagttctaaatctttctaaagaaccggtgaattggttgctatatttaaaaagtaataatcaaaatttattaaagaataatcagaatcttgaattaggtcactattatcgaatatctggaaaaacaagacctgcgcatagttatgccaccccaggagcttttgatcaggaaaagtggtttattcagcgaaatattatggctggttttaacgtgagatatattgagcctttaagccttgatgaaatctatcgattaggctatcagcaacatttaaaagaacaacagtctttttccaatagttttcgtttaaatatagaaaaacttcgcttaacttctaggcaaatattaaacagctcatctttacagcaaaagggtttaattttagctttgctgacaggtgatgaaagtcttttatcagatgaaactcaactacagttcaaacaattaggaattagtcatttattggcgatctcaggcccacatgtgctcatttttgccattatgttatcttgggcatgtcatcaatttatcagtcgttattatcctcaaatttacttatggaaaccgaaacaggttttgatggctgtaccatgctgccttggtgttttaatttatactgcatttgtaggtttcgaaattcctgcactacgaacattattatcagcatttatatttattggatttctattattaaaacaacctattaaaccttttacattactcgtatatagcgcaagtctactgttgctaattgacccgtttagtgtgctttctgcaggtttttggctgtcttatggggcatgctttattttattaagaatttaccaaactatagcgcagctacctgagcaacattttttaagtctgagctcaaaaatgatttttatgggtaaggtgttaattgagtctcaaggcaaaatatttattgcattgagtcccttaaccttacttttctttcaacaaatttcttgggttgctccattaaccaatattattgccgtgcctattgttggtggtgttattgtccctttaaacatcatggctgcttgcgcatggtttatagtaaaaccgtttggaaatatgctttttcatttcaatgatatgttgctcagcatattgctgagttgtttgggcttattagaaaaactctctttaccattacaaggtataagcttgacgccactgtctttattagcgattagctgtgccataattattttatttttacctaaaggaattctgcccaaaacttgggggatattatgttgtttacccttagttattatgaacaaaacgagtcagcaaattcagcttaatattttagatgttggacaggggcaagccatttttttacaacattccgaacaaaactggttaattgatacaggcggttcttacgatgaaaaaatatttagtattggacaaaatgttgtagtgccttttctacgtcagcaaggcgtaagacaattagatcatgttgtgctatcccatcttgatcaagaccatagtggcgcgtttcctcttattcaacaagagattcctgtaaagcagcttatttcgaatgaacaattaccaaatgatttaaagcaaccattccaatattgccatcaagggcaacaatggcattatcctgagttagatattcaaattttatggcctaaagaaaaagatctggcttttgttacttctaaccagaatcaatattcttgtgttgtatatcttcaatttaaaaaagttggtggttaccaaaattttcttattatgggtgatgcaggatgggaagctgaatacgagttattaaaagattatcctaacttgaagatagatgtgttggtgctaggacatcatggaagtaagcacagttcggcttatgatttcttggcgaccttaaaacctaaactggctattgcatcggcaggttttgataaccgttatggccatcctagccaagaagttatagcacgtttaaaagctctgcatattccgctaaaaagcactgtggaacaaggaaccttaagttttgtgttggaaaaccacaaaatagttttacatgaccgacgtttggataggctctggttgagtagaggtttttaa

SEQ ID NO: 3056 - DNA, 513 bp, Acinetobacter baumannii
aatgcatctgttagacttatatttttagtggaaatagagaataacgtgctgccattcaagttgtgggtagacgcagatgcattacctaaaattttgcgtgaagttattttaagagcttcggatcgttatcaattagaagtgatttttgtagccaatcaaaatgtcggtattactccttcagtacgtattaaatctctgcaagttttaagtggggccgatcaagccgatcaggaaattgtgaatcgtatgtctgaaaatgacattgtcattacgcaagatattccactcgcagctcaagttattgagaaaggtggtattgcgattcacccacgtggtgaggtgtataccacagcgaacgtaaaagcacgtttacacttacgtgattttatggatacgttgcgcggcgcaggtgtacagacgggtggtccaccacctatttcagaacgtgataagcgcgaattttctagtgcactagaccaaacaattttaaagcaaaaacgtaaaactgcttag

SEQ ID NO: 3057 - DNA, 810 bp, Acinetobacter baumannii
attcgccctgtagagaaaacaattaaagcaataaaaaataaggaaagagttttatttgacagtgagtggaaagattcattggatatccaaattaaaagagctttaaaatctaatgaaatgaaagcgtatggtcgcacagaaccaggactattattccggatgcaaactgtaggtagaatgaccgtaactaatgagttgttgctcaaagccagacaactttcaggaactccaattatagaagctgcaacttcttggcagttctttaattggaaattggaatatgatgctgagcaagcccagaagtattatggttctgagaatttacatattactaaaggtttgacggatttatctaaaacagatttaccttggttagggaatattccacctgaatcattattagagttacgcaagcaaggcgctttagaggaaattagaaatatcttaggtcatgagattaaggaattaataaaaactaatcctactaattgttctagaactagggatcaaatattacaaaatatcgaacaaagttttgatagacatcggaaaaaacttgatgagctaaaagcaaaaaattggaaatttgctggaaaagatattggctcatgggttgttacaggaactttaggaataggtgctgctttgacaggtgaagcaacatgggggctacgagcttggatcgcaaatgaagttatggatgcacccaaattaagagaaataccacaaagatttcgtgatttggttgatcaaaataaacaagtaaaacaatcaccagttgggatgctctttaaggcaagtaaaagttga

SEQ ID NO: 3058 - DNA, 942 bp, Acinetobacter baumannii
agcaaaaacgtaaaactgcttagtgagtctcttatgccatcccaaaccaacttggcttcaacttatgtcttgcttgtatttatctgggcaacgacacctttagccattgtatggagcgtatctgacttacatgtcatgtgggctttactgttacggttttatatagctttgcctctgtcggttattgttttacttgttctaaaaacttcttttccaactcataagcaagctttacatagttattttgcagggtcttttagtttaatcggctcgcaaatttttacctatgctgcgacccaatatttaagttctggcatgattgccttgatgtttggtctagcgcccattatggctgggttgattggtcgttttgcttttggtcagcatctttttaaattgcagtggctaggtatggctgttgctgtttgtggactagcgatcatttgtttaaatggttcaaatcaacatgtgcatccatttggcattgtcttaatgttggtcagcgtttttgtttattcattttctatattttgggtaaagaaagtgaatgccaaaattcaaccaatggctcaagcgaccggttcgatcttggtttcttcaattttggcaagctgccttattccatttatttggcaatatgcaccgactcatttaccacaagctaaatctttatttgcattaatttatacagttctgatggctttacttgtggctatgttctgttacttcaaacttgttcagaatataaaaccaaccactttatcgcttacaacagtaattacaccaatgctagcaatgatcattggagctgttttaaaccatgaacaattgtcgattatggtttttgtaggagctttcattatcttatttggtctatttctatatttttataaagacattcaagcaaatcgtaattttgctcaccatattaagtctaagtag

SEQ ID NO: 3059 - DNA, 330 bp, Acinetobacter baumannii
aaagctggcgttttttatgcatattgtttttctattcaagtttactctttagccgcttgcctgatcacggtatactgcatcgaattgtttaaatcaggtgctcagatgcgtcgtgtcatttgcctcatcagtttattgagcagcagtattttgcttagcgcttgcggtcagtcaggagcattgcagctaccttctgatccaaattatgacaaacgtgcaaaatacttgctctatcgtaataaagaacagaaacaagttgtgcaacaagatgaacaggctgaacagtcagtcgaatcatcagcagctcaaccacaaactacatcaccttaa

SEQ ID NO: 3060 - DNA, 1122 bp, Acinetobacter baumannii
atgcctttttttattgtgtttcacttttacaagggaaaaatcatgcgcgcgtacaatttctgtgctggtcctgctgcattacctactgccgttttagaaaaagctcaacaagaattgttggattggcaaggtaagggtctatccatcatggaaatgagtcaccgtagtgctgactatgttgctgttgcggaaaaagctgaagcagatttgcgtaagctcatgaatattcctgaaaactataaagtgctatttttacaaggtggcgcgtcattacaattttcagcaattcctttaaatctgcttggaaaaaataacaaagcagattatatccatactggaatttggtctgaaaaagctttaaaagaagcaaaacgttatggcgatattaatgttgtagaagctggtattaaagtagacggtaagttcgcaatttctgagcaaagcgaatggaacttgtctgacgatgcagcttatgtccattatgctgataacgaaacaattggcggtttacagtttgctggcgttcctgatgttaaagcaccactggtatgtgacttctcatcaagcattttatctgctccacttgatgtttcgaaatttggtctcatctatgcaggtgcgcaaaaaaatattggtcctgctggtttaacaattgttattatccgtgatgacttactggatcaagctaaagcagaaattccaagcattttaaaatatgctgatcaagccaagaatggctctatggtaaatacaccatcgacttatgcttggtacttgtctggtttagtatttgagtggttactagagcagggtggggtagatgctatccacaaagttaaccttgaaaaagctcagttactctatggctatatcgattcaagcgacttttataataacccgattgccattccaaatcgttcaattatgaatgtaccatttactttggcagatgaagctttagaaaagcaattcttgaaagaagctgaagcaaatcacttattgaacttagcaggtcaccgctcagtaggtggtatgcgtgcaagtatttataacgctgtaccattagaaggcgttcaggcgcttatccgctttatggatgattttgctaaacgtaatggttaa

SEQ ID NO: 3061 - DNA, 660 bp, Acinetobacter baumannii
aagaggctttcttttatatgtacaatatttttgattttattaccttataaaaatatgaataatttaattttcttacctggtgcatcaggaagtattagtttttggtatcccttaattgaaaaattacctcagcactaccgtacaaaaattattggttaccccggtttcggcgatacatcagaatctcttgatgtgaagagttttaaagacttaacaaactatgttcttaatcaaattaatgaagaatctataattgtcgcgcaatctatggggggaatttttgccgttgccgcagctttgcacaaacctcaattagtaaaaggtctggtcttgattgcaacttctggtggaatcaaccttgaaccatttaatgtgcaagactggcgtgaagcataccgccaagcatttttaaaatatccagattggtttgttaccaccaatgccaattatgaagaatttttgtcagatataaatattaaaactttattaatctggggtgataacgatccggtgagtccagttcaggtaggtcaatatttaaatcaaaagtttgaaaattcgactttatatgttgtgaaaggtggtgaccatcaattagcagaaaaatatgccgatgatgttgcagttcaaataaaaaattacttaaaaggcctaatgtaa

SEQ ID NO: 3062 - DNA, 249 bp, Acinetobacter baumannii
gcatacccttctccttacctatttttttcatttttctttgtcaatattgcaaagtttccacttttgcaaatgcatcctttgtgcgtactttgtcacaggaatcagaatttctcaagatgttttgatcggtctatagcgtcattttcgatagggaactttctaaatatttgtacaattaaagatctattgatatatgaaaattttacttataaaaaatttaaaagtatttttccaaggttaaaagaataa

SEQ ID NO: 3063 - DNA, 1281 bp, Acinetobacter baumannii
atgaacacttctctttttccatcaatgaccttggatttagaaggtatgtttaaaccaatctcactgtatatagggttgagatatactcgcgctcgacgcagtaatcattttatttcttttattgcattggtttcgatggtcggtttgacacttggtgtcgctgtactaattacggtactttctgtaatgaacggtttcgaccgcgaattaaaaaatcgtgttttgggaatggtaccgcaagcgacagtttcatcgacgcaaatccttacggattggcctgaactggttaaacgagttgaaaatcatccccacgtgacaggagttgcaccttttacccaattgcaaggtatgttaactgctcaagggcaagtggcaggtattatggtgacgggtattgaccctaaatatgaaaagaatgtctctatcattcaaaatcatatagttgccggtagtctcgactcacttaaaaaaggtgaattcggtatcgtacttggtaaagacatggccgattcgcttggcttacgtctaaacgatagcgtgacattggttttacctgaagcgactccatctccagctggtgttgtacctcgttttaaacgctttaaagtggtgggtattttcagtgtaggtgctgaagttgactcgatggttggatacattgctttatatgatgcttcaactttattgcgtttacctgatggcgctcaaggcgttcgtctaaaattagatgacatttttgccgctcctcaagttgccgatgaccttgtgaaaaatttgccaagcaatttctacgcaacaaactggacttatacacatggcaacttatttaatgccatccaaatggaaaaaacattagttggtttattgcttgtactgattattgtggttgctgcatttaacattgtttcgtctttggtcatggtcgtgactgacaaaaaatcagacattgcaattttacgtactttaggtgcatcaccatctatgattactaaaatctttatggtgcaaggtacggttattggtgtgattggtacggttgcaggtacggttttaggggtaattctggcacttacgatcagcgatattatttcttggtttaataatgttctcggacttaatctgttcgatgcctattttgtacattacttaccttcttacttaagatggcaagacgtgacaattattgtgattgtttctttactcttaagtttcttggcaactatttatccggcacttcgtgcagccaaagttcaacctgccgaggcattgcgttatgagtaa

SEQ ID NO: 3064 - DNA, 2352 bp, Acinetobacter baumannii
aatttaagttctattttggaacttgttattttcattctagccagatgtataaaaataaacggagccagaaaaatgatggacgcagctgcagctcagcaaagtaaaacagatgtgaccgcatgtattttatgttcaagaaactgcggtttgagcgtagaaattaaagataaccaatttgtcaaaattaaaggtaatcctgagcatccattttctcaaggttacatttgccaaaaagccgcaagattacagcattatcagaaacatgcagaccgtttgaccgcacctttaaaacgccaaccagatggctcgtttcaagaaattagttgggatgtggcgatacaagaaattgccaatcaattggttcagattagagataaatttggcggcactgcttttgctttggttgggggcggtggacagggtaaccacctcggtgcagcttatggccgacaacttttattggctatgaaaagttattatgcatataactcacttgcccaagaaaaaacaggtgatttctggctcaatggccgcctgttcggtagtcaggcttgccatactacagaagatgttgaacatgcagattacgtactttttattggaacgaacccgtttcaggcacatggtattcccaacgcacgagacacgctaaaacatattaagaaagatccgaaccgaaccatggtggtgttcgacccgcgtgttactgaaacggcaaaacaagcagacattcacgtgcagctaaaaccgggaacagatgcttttttaatgtcggccatgattgcaatcattattaaagaaaagctttatgatgcagcgtttattgagcagcatacacatgggtttgaagaagtaaaagctgcatttaaccatgtcccgattgaagactatattgctaaagctgatgtacctgtcgatttgatttatcaggttgttcgagatttttcaaaggcaaaaagaggctgtgtacgtatcgatttaggtattcaacatactttgaatacaacattaaatggttatttagaaaagcttttatacttactgacagggaactttggaaaacagggtaccaataatttgcataccatgtttattccaattttgaccgatacggatgaaagaaaaccaaaatatcgacgtagtgtttatcataaaatgttcccgatttccgggtttttcccgcctaatattttacccgatgaaatcctaaaagcaggggaaaagcgaattcgtgctgtgtttgtagatagttgtaatccactattaacttaccctgatacaccagcttttgaggaagcctttaaagcattagatttattggttgtggttgatgttgccatgacagaaaccgcgagactcgccgactatattttgcctgctcatactcagtttgaaaaatgggagtttaccggttttaacttggaatttcctaagaatggttttcacctgcgtcatcccgtattggctgctcaagcaaacactttaccggaagccgaaatttatactcgattactggaagctatgaatgctattccgaagagtttcccagttttagaaaaaatagctgcggtcgactcgaaaaaaactgcctacttaccatacttgtcggcgttaggaattaccttggcacgacataaaaaatatatcccttttgctgcctctattatttatcgaactcttggcaaacgacttggcaattcagcagattcagttgcttttttattgccgctatctattcaatatgctgtattacataccaaagcagtacgccgtgcaggttataaaggtaatccgttaacacaaggtgtcaaactatttgagcagatattaaagcaacgttcaggtatggttttatcgcaacatgaatatgacgaagtctggaaactggtagcttataaagataagaaaatacgtcttgtaattcctgagatgttaagtgaactcgcaagattgaaaagccataacgttaatgttgaagagtttcctttcatccttttgtctggtgaacgccgtagctacaacgccaaccaaatttaccgtgaccctgcttggcgaaaagtagatgcagaaggtgcactgcgtattcatcctgaagatgcaagacacttaaatgtagatgcaggagggcagcttaaatgtatctcagcgcatggagaaattcaggtagctattgagttggatgatgggatgagaagaggtgttgtatcacttccacatggctatggtatgcgatttcaaaatggagaaccgattgggccacaattaaacttacttatttctgctgaacattgtgatccattgtcgaaaacgccataccataaatatgtacccatccgtttagaaaagtgttag

SEQ ID NO: 3065 - DNA, 1842 bp, Acinetobacter baumannii
tatatgagttcagaagcacattcaattagcttgattgcccctgtagttttattggcggctgcggtaattgcagtccctatttttaaacgtattggtttaggttcggtattaggttatctcattgcgggtctgattattggccctttcggttttgcatttttccaagattccaccgcaatcttacatattgccgagttgggcattgtgatgtacctatttgtgattggtctcgaaatgcagccatcacatttatggagtctacgacgggaaatttttgggctaggaacactacaaatcataagctgtgctgtggcattaacaggcgtaggtttgctatttggttttacgtggcaagttgcttttatcggcgcagcagggtttgtattaacatcgactgctattgtgatgcaactactgggcgatcgtggtgacttaactcagcctcgcgggcaaaaaattgtagccatcttattatttgaagatttattgatagtgccattgctggctattgttgcttttatggcaccgaatcatgtggtcgaaagcacagcggtacgtttcgaaaatataggaattggtttattagccattgcgggccttattgcagcagggcattggttacttaatccattatttagaatcttggctgccgctaaagcaagagaagtgatgacagctgccgccttgctggtggtattgggtgctgcattgctcatgcaagtgagcggtttgactatggcaatgggcgctttcttggctggtgtgttgctatctgaatctacctttaggcatcaaattgaagctgatattgaacctttccgtggaatcctgttaggactctttttccttggggttggcatgtcactggatttatcagtggttgctcaaaactggcagcttattgtaagtagcgtaattgctctcatgtttgctaaagccatcatgatttatatggtcgcgcgattaactaaaagttctcatactgaggccttagatcgtgccttattgatggctcaaggtggcgagtttgcctttgtacttttttctgccgcattaagtgcacaagtcattgatagtactattaaatcaaacctaactgcgattgttgtactttcaatggtgttaaccccaattgtaggtattatttttaagcgttttactcaatctaaggcgaatgtttcattagaaaacatcaatattgccgagggtttaactggtaatgttctaatgatcggtttcgggcgatttgggcaggtaaccagtcaattattgttggcaagaggagtagatgtcaccattattgataataataccgacatgatccgaaatgctgaaagatttggttttaaaatttattatggcgatggttgccgtttagatattctacatgcgtctggagccgcaaccgcacaagcaattgtagtatgtgtagatagtaaagaaactaccaatagaattgtagaacttgtgactcatgaatttccgttagcgaaattattagttcgttcatatgatcgtgagcattcactacatttagtcaaacaaaaagtagactacatgattcgtgaaacttttgagtctgccatcaaatttgggggcgttattttacaagaactaggtgtagatgaagacgagatagagcgaattaccgaagaaattcgagatttggacaatgagcgttttgaaactgaaattgccgccgatgatgtatatgccggagcgggtatgcaatatacgcatgcgcatcatccgagaccaacagcaccattaattcggccaaaacaggaagggcgtattttaaataaagatgatgcttcggataatgaaaatatggatgggtaa

SEQ ID NO: 3066 - DNA, 267 bp, Acinetobacter baumannii
ccggcacctttttttaagctaacggtagcaggtgtttgccccgtatggacttttaccccattacgatttttaatctcaatagttgctgactcaggcacacttgtaaaagtaagtgtttgtgaagaacctgtaatgatgcttgcacagccatttaaccctatcgttaaagctaccatagaagtaattagtaattttttcatcattaatccagaagaatttatctatcgttatttgaaaatgcactatattaaaataaacaaaaaataa

SEQ ID NO: 3067 - DNA, 765 bp, Acinetobacter baumannii
ttccgggtctcatcgctgcactacgtacttattttgaatacgaacgagtatcagcactttctaggagaagacgccttggactcgattaaacaatatgatgatggacacgtatttacagcgtgggttgcattaatcggcacagtaatggctgcgacatgcctgctttgttttcttgcagttactggctttgatttgcaccaaatatttaaacctgaatttgcattaactttgtcggcaaaagaccaagcacttttcagaacctcaatgatttctgattgttttgggttttatcttccttttctggctgtaggtgtatatctgtggagaaagctacgtccttcaggtggattattgtcggatatagctattttattccttgtgatttcaacaatgttaggtataacaggggctgctttacaagcctccgtgttaggaccacttgctgaaacatatatgtctggaaatgaaatagctaagcaggcagcgggcactgtttgggccaccatttcgcaaggctctcaaaatggtttatggccaatggaaggaccgacaataggtttttgggcaatagtcaacggactacttttgagaaaaaacaaatccgtattaggtttcccactggttctggttggcttgggatatgttggatttgctgtgcttcttttctcaggcttttctcaagcggctttattccttgaactgttcttattaccagtgcaagtagtttggttaggtattttcggtttgagtttattacaaagatag

SEQ ID NO: 3068 - DNA, 219 bp, Acinetobacter baumannii
agaaatagattctctgaacataaagactatcttcttaccaccaatgaccaaagtttaaatattgtattacttacaatgcttgattccggtcggaattttattcaagatgataaattaataaaacagaattttttaaactttaatagttgtatcgtcatttttttcaagctcggcccttctattctatatatgagatttatatcttttaatttcatataa

SEQ ID NO: 3069 - DNA, 2055 bp, Acinetobacter baumannii
gcaagcagattagcaagccaaggagttgttatgtcgttatatccacatttattaaaaccattagatttaggttttacgacattaaaaaatcgcgtattgatggggtctatgcatgttggtctagaagaagcgcctggtggttatgagcgtatggcagctttttatgcagaacgtgctaaaggagatgtgggtcttattgttactggcggtattgcacccaatcaggcaggtttaacctttgctcatgcttctaagttagatagcacagaagaagccgaaaaacataaagtcattaccgaagctgtacacgctgctggcgggaagattgcattacaaatattacatacgggccgatattcttatcagccagagattgttgcgccttcggcaattcaggcacctattaatcccattaagcctaaagcaatgacttctgctgaggttcaacaaacgattgatgattttgcaaactgtgcgaagcttgctcaatacgctggatatgacggcgttgagattatgggttcagaaggttatttaattaatgagtttattgcagccagaacaaaccatcgtgatgatgaatgggggggtagctatgaaaaccgtattcgttttcctgttgagattgtaaaacgtacacgtgaaatagtgggtgaaaactttattattatttaccgtttatcaatgcttgatttagttgaaggcggttctactttagaagaagtgattcaacttgctaaagcgattgaaaaagctggggctacgatcattaatacgggtattggctggcatgaagctcgtattccaacaattgccaccaaagttccaagagctgcatttacttgggtcactgaaaaattaaaaggtgaagtttcagtcccattaattacatcgaaccgtattaatacaccagaaatggctgaacatgtattagcgtcgggtcatgcggatatggtttcaatggcacgtccaatgcttgcagatcctgagtttgttttaaaagcaagtgaaggccgtagcgatgaaattaatacgtgtattggctgtaaccaagcttgtctcgaccacattttctctatgaaaattgcaacatgtttggttaatcctcgagcatgttatgaaacagaactaatctttaaagaagcacaaaatcagaaaaatattgctgtcattggggctgggccagcaggtttaagttttgctgtatatgcggcagatcgtggacaccaagttaaaatctttgaagcaagtcatcaaattggtggtcagtttaatatcgctaaaactgtgccaggtaaagaagagttctacgaaacattacgttatttcaatcgtcaaattgaattacgcccaaacattgaacttgtattaaaccatccagccacttatgaagagttaagtcaatcagactttgatgaaatcgtagtagcaactggtgtaacacctcgtcaattacaatttgaaggtattaatcatccaaaagtgttgagctatttacaggtgcttaaagagcgtgtaccagtaggtcagcgtgttgccattattggtgcgggtggtattggttttgatacggctgagtacctaacccatgaaggtgaaagtggcagtttaaatccagaaaaattttatgaagagtggggtattgatactcactatgaacatgttggtggtttaaagcagccaaaagttgaagcttctgaacgagaaatctatttgttgcagcgtaaagcttcctcagtaggcgcggggctgggtaaaacgactggttggattcaccgtaccgggcttaagaacagaaacgtgaaaatgttagcaggtgtgcaatacgacaaagtagatgatcaagggcttcatattactgttgatggcaaaccaacagtgcttgaggttgataatgttgtgatttgcgcgggccaagaatcatttactgcgatgtatgaccaattaaaagcagatggtaagaatgttcatttgattggtggtgctaaagaagcaggtgagttggatgctaaacgtgctattcgacaaggtgctgaactagcagcggttctttaa

SEQ ID NO: 3070 - DNA, 450 bp, Acinetobacter baumannii
ctgtttatatcattcgccatgtgctggggtaatcttatgaaaaatatctttgcttttatatttggtggtttgttttcattggggttaatgatttctggtatgtctaaccctgcaaaggttttagggtttctagatatttttgggcaatgggatattagcttaatgtttgtgatgctaggtgctattgctgtggcatttattccgtttcaaagggctattaaaaaaccaaaaaccatttttaatgaacaaattcaattaccaacaaatacacagattgaccaaaggttaattgtaggtgcttttattttcggtataggctggggaatagcaggcatatgtccagcgcccgctttaactctcattggattaggacattttgaagcgctttattttattgtggctatgttagtaggaatgtttatttaccgaattttaaataaaggaaattaa

SEQ ID NO: 3071 - DNA, 903 bp, Acinetobacter baumannii
aattatggatttatacacatgcaaatgaagaagcattctttattatttattgccttaatgagcaccacttctctatacgcaaatatccctatcgagtctcgtggtttaagtcaaaatgatggtagtgcatctaatacttcttcaagcaatatttcagttcctacaaatttaaactgggaactcatgcaaaaaaaccaacaattagaaaatgatattcgtacattaagaggtcagcttgaagaacaagctaatgatattgagcaattaaagaaagatctagcaaaccgatataccgatttagatcaacgtttagaattattacaccaaaaagttgaccctgacagtgctacacaagacgatagttcaaatgcaacgaccgataacactactcctgctagtgcaccagcccctcaaaccacagagagtaataaagtagctgcagtaccagccacacaaacttctgagcagcagcctagcgcactaacaaccactactcaaccagcaccagctgctgcgcaaaacccgtcaaattccctcgaattagaaaaagctgcttatactgtagctttagatgcgtataaacaaggcggtgctaaaaaagcaattgctccaatgcaaaactttataaaaaatcatcctaatagtatctatacaggtaatgcttatttttggttagccgagtttcatttagcgacagatccagtaaactataatgaagcaaagaaaaactataatgtcgtagctaaccaatacccaaattcaagtaaggcacctcgagcattgtaccaactttatagtattgctaaagatgttgataagaatactgtgtcagcaaatcaatacaagaacaagttacttagccaatatccaaagtctgaagaagcaaaattctttaacaaataa

SEQ ID NO: 3072 - DNA, 984 bp, Acinetobacter baumannii
atgacaggattatctccaaacatcggaccgtttggattatacaaggaacaaacaatgtatattcactttaaataccctccaatcattgcgatagctagcctttcattagttatagcatcaggacagattttggcagcgccaaatggtaaccctactctgcctggcggcactacccaattttttattgctgaatttcctccaattactggaaattatcttcaaattatttctagttattctaaagcggatcaatttaatgatcagaatggtgataaaaaatatgatcaagaccttaaagtagctgcacaaactttaagacttacaactacttgggataagaaaattttaggatcagatattacgatatctgagattattggaacttatgttgatttaaataatcaaatacatacgccatatggagatgtcaaacttaacgatgatggactcgcagatgttttatttgagccattaattcttcaatggaataaaggacaacagaaacaatggcaaatggttgctggtttaggttttgttttacccatcggtacttatagtaaaagtcatgatgtgaatgttgcgggccactatttctcgattgcaccacgcgtagctcttaaatacaagtttgaaaatggacttgaagcagccataagtccgatggttaatttcaactggaaaaattcagattctaattacaaaacgggtaatgaactgaccattgattacttacttgcttaccacagcaataactggcgcttcggagcgactggatattattacactcaacttgaaaatgacgaattagatggccaagaaattaaagattcaaaaacgaaatcattttctattgggcccgctatccaatatcaatttatgaatggaaaaggtccactagttagtgcgagctggattaaagatgtggagtctgaaaataaagctgaaggtcaaactttctggctaagtgcagcaatcaaattttaa

SEQ ID NO: 3073 - DNA, 1197 bp, Acinetobacter baumannii
atgacacaatctgtttgcatattgggtgtaaccggttctattggacgaagtaccttaaaaattttaggtcaacatccagataagtattcagtctttgcagtttcggcgcatagtcgaatttctgaacttgttgaaatctgcaaacagtttcgacctaaagttgttgttgttcctgaacagaaaatagctgaactaaaaacactatttgctcagcaaaatatatcggatattgatgttttagctgggcaagagggtttagtcgatatcgcatctcatacagatgtggatattgttatggcggcaattgtaggggcagctgggctgttgccaactttagcggctgttaaggcgggtaaaagagtactacttgccaataaagaagcattagttatgtctggtgaaatcatgatgcaagctgctcgtgagcatcaggcattgttattgccagttgattctgaacataatgcaattttccaatcattacctcataattatttacaagcagatagaacagggcaaccacagctaggtgtatctaaaatattgcttacagcatctggtggtccctttttaaatcattccttagaacaattgactcatgtaacgccgcaacaagcatgtaaacatccaaactggtcaatgggacaaaaaatttcggttgactcggctactcttatgaataaagggttagagttaatagaggcttgtcatttattttcaatatctgaacattttgttacagttgttgttcatccacaaagtatcattcactctatggtgcagtatgttgatggttcaacattagcacaaatgggtaacccggatatgtgtactccgattgcacatgcattagcctggcctgagcgtttacaaactaatgtacctgctttagatttatttgagtattctcaacttaattttcaggcaccggatacccaaaaatttcctgcattaaatttggctagacaagcaatgcgtgcgggaggtttggcgcccaccattttgaatgcagctaatgaaattgcagttgaagcattcttaatggaaaggattggatttacaagtattccgcaagtggtagagcatactttggaaaaattagagaatgcagcggctgaaagcatcgagtgtattttagataaagataaagtggctcgatctgtagctcagcaatatatatcaagtattggaggctga

SEQ ID NO: 3074 - DNA, 255 bp, Acinetobacter baumannii
atgcaacaatctatccaaattaaagtcgaagcatttggtgcaattgaaaaattgcttcctgaaaatcttttgctagtttgtcctagccatagtctggttaaagatgtattagatgaaattgttttattgcatccggaatctacaaaagccatggaaaaatgtgcatgtgcgattggtgataatgtcataaccagacaaactgtcttaagtgagccatgcactttggttttattatcacccgttgccggaggatga

SEQ ID NO: 3075 - DNA, 420 bp, Acinetobacter baumannii
tcaaagtttttaattaaagctcttaatgctatgttagaagtatttcgttccacttcaagcaaacttatattgctactggttattgttttagtggctatattgcaatatcagttttggttaggtgagggtggttatttccctcatcaagcgcttatgcagcagattcaacaacaagccgaagtaaatgacgagcttaaagagcgaaaccgtattttggcagctgaagttttcgacctaaagaatggtacggaggcgatagaagagcatgctcgcctagatctaggtttggttaagccacatgagacatttgttcaaatgagtacaattagtacccattacaaacctatttatattgacccgaacgctaaagtagatttggaaactaatgagacacctccatcaccagacatcccagactaa

SEQ ID NO: 3076 - DNA, 627 bp, Acinetobacter baumannii
ggtcgtatgtctgattgcactaaaacgaatgagaaagatcaaaaaattctggatgcagcaacaaagttttttctgatccatggttttagtgggacaacgacagatatgattcaaaaagaagcgggcgtttcaaaagcgaccatgtatggttgttttaaaaataaagaagcgatgtttgctgcggtcattgaacgccaatgtaccaacatgcaaaaacaaattatgtcggtcgagacaaaagccaaaaatttacgttcagccttaaccgaaattgggaaaacttatctgtgctttatcttatcgcattccggtttggctttttttagagtctgtattgcagaggctgtaaggttcccggaattatccgaaaagttctttgaagtgggaccacaacgtctagcaaatattattgcaggttatcttgaaaagtcggttaaacaaggagaaattgaattaacgtcttcttcggaagtcgcagcaaatatttttttatcactgttaagaagtgatgcccacctaaaatgtttgactcatcctgattatttaatctcagctgatgaaattagtacttgggttgaatacgctgttgatttatttttaaaaaatattaattacaaactagattga

SEQ ID NO: 3077 - DNA, 1467 bp, Acinetobacter baumannii
gtcatcatgtcaaatgcagttgaaaaaaataattggattgaattacagggtttagcaaatgcttcagtagatatcattactaaactcattcatgagagaaaagtatcttgtgaagaacttgtgcatcattactttgactctattgaaaaacagcaatctttaaatgcatttattagcacagataaagcttcagcaattcaacaagctcaatattgggataaatacctgcttagtggaaaaccatatccagctttaatgggcattttaattgcggttaaagataatattcatgttgcaggtttcccaaatagtgcaggcacaccagctttagctgattttaagcctcaaagttccgcaccgattattcaaaagcttattgaccacggcgcgatcattgttggtaaaaccaatatgcatgaattagcctttggggtcacaggctataatactgccatacatattgaaggtgttgtgggtacacgaaatgctgtagacccattgcacattgctggcgggtcttcttcaggtagtgcttcggctgttgcagcgggcatggttccaattgcgattggtacagatactggtgcttcgattcgtttgccaagtgccttaaatggttgtgtcggctttcgtccaacggtaggaagatactctcaagacagtattaccccaatttcacatacgcgggataccgctgggcctattgcacacacagtatctgacattattttaattgatgagcttattactcaagagccaaaaaaagaaccattacagcctcatcaaattaggctcggtatcaatacatatttttggaatcatttagatgaagatgttcgtgagcaggctcatattgcgcttgagcttttaaaagaggcaggagtcgaaattattaatgtcgatatgccgaatttagaacaactcaatcatgcgatttcatttccagtggtcgtctatgaaggcaaatatgaccttattcaatatttgaaagatcatcatgtaaatttgactattgagaatgtagttgatcagatttcaagcccagatgttcaggcaatttttaaacagaatatccttcctcaattaattcaagaccagacggggcaacttgttcctgttttacctttctacgaaaaggctatcagtgaagctcggcctcaattgcttgaactctaccaaaacacatttgaagcgcataacttacatgctttattatttccgacatcaccgattgttgcaccactcgcaaatgaacaagtcaattcaattgaaaatttccagacactcattcgaaatacggaccccggcagtaatatcggattaccagggttgagtttgccgattggaaagggagcgaaatcgaaactacccgttggattagaaattgatggtttacctcatcatgatagtgaaatacttgcgattggagagactttagaagaaatttttaaagatttaaatcaataa

SEQ ID NO: 3078 - DNA, 330 bp, Acinetobacter baumannii
gaaattacgtcgttaaggcaaaaggataaggagtttcccatgttatttcatgtacgtatggatgtgcatattccacttgatatgccagccgacaaagcaaatgaaattaaggccgttgaaaaagcttattcgcaagacttacaacgccaaggtaaatggcgtcatatctggcgaattacaggccagtactcgaacatcagcatttttgatgtagagagcaatgaagaattgcacaacattttacaaggtttacctctctatccatacatggacattgaagtgatggcacttaaccgtcatccatcttctgttcgtgatgatgattcgtaa

SEQ ID NO: 3079 - DNA, 603 bp, Acinetobacter baumannii
tctaatgagtcacactttacttttgcttacaaacggattgccatgtcacttcctcatgttttattgaccagtttactagaacggccaagcacgggctttgaactcgcccgccgttttgaccgatctatgggctttttctggaatgccacacatcagcaaatttatcgtgaactcaataacatgcttaaaaaaggctgggtttccactttagaaaatgagatggatagtggccgaaaaaaaacttatcaggtcgaacaacttggccgtattgaactcgcttcatggatgacacagcaaagcgaaccggcacagcttagagatgacttaatggtaagattgcgcgctgaggcgcaattgggcaataatcaaatattacccgaactgttacgacatcttggtctacatcaagaaaagcttaagctttaccaaactatttacgataaagattttaaagatagcgatgatttgaataatcgagtgttatatattcataaaatgatcttagaactcggcattactatggaaactgagtggatcaaatggttggaacaagtcatcccgcaattaaaactctttgctcaagataatgtatctggagaataa

SEQ ID NO: 3080 - DNA, 1320 bp, Acinetobacter baumannii
gaaatggagtcgaacatggatttcgaaaaggatgtaatacggacggtcacgtttaagctgatacctgcattagtcatactatatctggtggcatatattgatcgggccgctgtcgggttcgctcatttgcatatgggtgccgatgtaggaattggtgatgctgcctatggtctaggagctggcttattttttattggatattttctttttgaagttccaagtaatttgcttttagacaaatttggtgctcgtaaatggtttacccgcattttattaacatggggcctcatcaccatggccatggcgcttattcaaggccctaaaagtttttatctcttaaggtttttactcggtgtagcagaggcgggttttttccctggtgttttatacctaattacacagtggtatccggtgcggcatcgcggaaaaatcatgggaatgtttgtactttcacaaccgattgccatgatgattgcagggcctttagctggtctattacttggattggatggcattgcaaatttgcacggttggcaatggttgtttgttgcagttggcttgcccgcggttttattggctttacctacctttttgtggctgcccgataacattgataaagtaaaatggttaagcattgaacaaaaacaatggcttaaaaatgaactcgttaaagatgaagccgaatatgaccaaacccgacatgccaatccactacatgctttaaaagacaaacgcgtacttttattagcactttactacttaccggtaacgttaagtatttatggtttaaatctctggcttcctaccattattaagcaatttggcggaggtagtgatattcaaattgggttcttatctagcattccctatatttttggaattattggacttctcattattccgcgtagtactgaccgcctaaacgatcgttatggacacttaagttttctgtatgcactaggtgcttgtgcaatgtttttaagtggttggctaaattctccagttatgcagttggcagctttggctgtagttgcgttctgtctattttcatcgactgccgtgttttggacactaccgggtcgtttcttaacgggtgcaagtgcagcagctggtattgccttaattaactctgttggaaatttaggtggctatgtcggtccatttgggatcggacttttaaaagaatacacgggaaatatggctgctggtttgtatttcttatctatcgtcatgctttttggcttgattttgacctacatcgtctatgccaagctcgaacgtcaaaaaacacaaacagtgaatattcaaaagcctttgtaa

SEQ ID NO: 3081 - DNA, 1332 bp, Acinetobacter baumannii
acattcgttccagggaactttggaactatggaaataaataaaaatcgtaatcggcatgggttgccgattctaaggagaatttatatgagtcgccgtattatatttattggcgcagcaggtgaaatgtgtcgtttagcgatcgagcgttttgctaaagccaaaggtgattgggaacttgtactatgtgacattcgtcctgaattactttcaaatcttgttgaaaaactccctcaagggctagcaacgacacaacatttagatttatatgacaagcaaaagctacaagctgtggttaatggtgctgatttagttgtacttggagcaggtccatacatccgaacttcagcgcctgtcattgaagcatgtttagaagcaaaagttccttacttagattttgatgatgacgttgaaagtactgaacatgcgttatctttgcatgaaaaagcaaaagaagcaggtattccaatctatgtaggctgtggtgcctcaccaggtatggcaaatgtgttagtggtagatgccgcaaatgagctagataccgttgaaaatattgattgttgctggatggttggtgacgaacgcccaggtattggtcgtgccgtacttgaacatttcttacatatcacggcgggtgattgccttacttgggaaaatggcgaacgtgtcaatcacgagacttttgtagaaacaggcactgcacctataggaggtggattgggtgaaatattaatgtatgaaacagcccatccagaaccagttactttgccacgcaaatatccaactgctcaacgtatccgttgtttaggtggtttacaccctgctccatttaatggactaggacgtggtgttggcttggctgttcatcatggtgaaatgacagtaaaagaaggtgtggacttccttgaagatctacttaataacaaattaggttcagccaaaggctggaaagctgcaatcagtggcatgattggccaagttaaacgtaaagaatcctcgttctcagccatggtcgagtttttgacaaaatctgctataggccaaacctatacatataaaggcggtttactcgctcgagtgtatggaactaaaaatggaagacccgcagttgcaatccgaagaactgtcaaatcaggtgaagactcctatttaatgcgtgatatggccgcaattacaggaacggcttgtgctgcattcatggtattagcgctcgatgaaacaggtaaacgtagcggaagtttcgccccagaagattgggctgagccagaagctttctacactgctctcgaacgtgtaggtacaccgcgcgcagagattgtggagtgtgtgctatga

SEQ ID NO: 3082 - DNA, 1599 bp, Acinetobacter baumannii
agaggctatccaatgaaatttaatcaatggttgactctcggctcgcatcttattttaaaaaaatggtgcgatgcatctgaccgtaatttccaaaaacagtttaatgctttagagaccacgcaacgtcaaattttgcattcgatattacagacttctacctttgccaaagataagaaagttcaaaactatgagcagtttgtaaaagcttttcctgcaactcgctatagcgcttggcgagaagacattcagcgttaccgtgaacaaaagctttcactctcgagcagtaaactggttcgtttccagccgaccagtggttccagtgaacaaatcaagtttattccatacaccaagctgtttttagatgaacttgaccatgcgattgcgccctggatggcaagtttataccgcaaatgcccacagttgagttcgggtacacattattggtcagtgtcatggttacctgaaagtcagcgtgaagttttaaaagacaaaaacctaaatgatgacagtgcgctactcggtataggtaagcgaattttatccaagtttacccaagcggttccaagcaatgttgcttttgcagccaatgccgatgatgcactgtttgccaccatttgttatttggtagcaaaccgtaacctagccatgatttcggtgtggagtccaacgtttgcgctgcaattgcttgagcgtttggagtcactacaacaagacgtggttgaggttttgcaaagtggtaaatggggcagtcgtcaggcttccttaaaagaagtcactgcaccgcatagctctgaaagtgctcaagccttaattgcaagttcaaacggcgaacagatcgactttaaaaaactttggccaaaattaagtttagtgtcgagttgggacaccgcaggctcaaaagcgtgggccgaaaaattaaaagaaaaattacccagtgttcagtttgaaggtaaagggttatgggcgacggaaggtgtagtcaccattccctataacgaccaatacccattggcttaccaaagtcacttctatgagtttgaatatttagagggtgagaaacaaggtcaaatcgttccttcatggcaacttaaacaaggtgacgtggtcagcccgctgattacttcgggtaatggcttactgcgttactgtctagatgactgcttaaaagtgactggctttttagaacaaatcccgtgttttgagttccaaggccgtcgttttggtgtagatctggttggtgagaaactcgcacctgaaactgctcaacaattactgtcacaattaaacgaaacggaatctaaagcgatttccttactggcgattgatacccaacaacaagttaaaccattttattgcgtgctttttgaaggcgacattcatcacagcattaacaatgaatatatcgacagtattttacgtcaaaacttccattatgaacttgcacgaaacttagggcagctcgaccagcctcaaattcgccaagccaataatggttggaatgcgtacaagaaactagtcatgtttgatggcattatcgaaggcaatatcaaacctgagccactcaagaaagtcaccctgaatagtttggaacaactatga

SEQ ID NO: 3083 - DNA, 225 bp, Acinetobacter baumannii
ataaacaatccatgttttgcctcaatagttagttcttatttagaagagaacaaacggacaaactgcccagttctcaatattaaattttgtgataaagcatatttggcgttagggctacgcatggttcatatgtatagtcacaacctaacatgtatatacaactttatgcatataaaaatagcttatctaataaaaaaaatgcaatatttatctaatacttcttaa

SEQ ID NO: 3084 - DNA, 1488 bp, Acinetobacter baumannii
tatcatgatccaacttggtgcaatattgagttttggtgcaaatattggttgtattttggtgcattacacaaagagtggggtttccacctatgcttgagacgagaaaagacatacaatacgcgcattcaagtggagcgcagattcatgaagacccccaaagtcggttttgtttctttaggttgtcctaaggcattggtagattctgaacgaattttaactcagttaaagactgaaggttatcaagttgcatcagattatgatggtgctgatttagttgttgttaatacctgtggttttattgaatctgcagtacaagaatctttagatgcaattggcgaagccatgagtgaaaatggccgagttattgtgacgggctgtttaggtaaagacgaagataaaattcgtcaaatgcaccctaatgttctaaaagttactggtgcagcagcttatcaagacgttatggaagctgtacatgaatatgtcccagcaccgcctaaacataatccgtttattgaccttgttcctgagcaaggtatccgtttaacaccgaaacattatgcttatttaaaaatatctgaaggctgtaaccaccgttgtaccttctgtattatcccgagcatgcgcggtgatttagtatcacgtccggttggaagcgtattagaagaagctgctgcgttaaaacgtgcaggtgtaaaagaaatcttggtcatttcccaagatacctcagcttatggcgtagataccaaatataagctcgatttctggaacggacagcccgtaaaaaccaaattctttgacatgtgtgaagcacttggtcagcttggaatttgggttcgcttacattatgtatatccatatccacatgttgatgcagtaatcgatttgatggctcaaggtaaaatcttgccatacctcgatattccattccagcatgcaagcccacgcgttcttaaattaatgaaacgtccggcgcatagtgagaatacattagaaaaaattaaattatggcgcgaaaaatgcccggatcttgtgatccgttctactttcgtggttggctttccaggcgaaactgaagaagactttcagattttgctcgattggttggttgaagctcaacttgatcgtgtaggctgctttacctattcaccagtagaaggcgctacggcaaatgatttaccagatcatgtgccagaagaaattaagcaagagcgttacgagcgctttatgcaagtgcagcaacaaatctctgctgccaaattacaaaaacgtattggtcaaacgatgactgtattggtcgatagtttggaagatgaatatcctgttgctgttgcacgttcttatgccgatgctccggaaattgacggtaatgtctttgtagaagatatcgataagagcactattcaaccaggcgatatgttggaagtcgaaattaccgatgcggatgaatacgacttatttgcaaagttaattaaaattaaatcggtctaa

SEQ ID NO: 3085 - DNA, 183 bp, Acinetobacter baumannii
catgttcacccaatgccgttacgggcatatttcggggcaaacgctcaaagacctgaaacccaagaaggccctcaatttcctttagcattttacttacggcaggttgacttaaattcatctgctcggcagccaaatgcatgttattggttcgagctaacgtctctaacaaaaccaagtgcttga

SEQ ID NO: 3086 - DNA, 492 bp, Acinetobacter baumannii
aaaggagtacctatgagatctttacatcaggtagcagctagtgaaatagcagtaataccttactatctgaaagggtatcagcaacatggcttgcagtacggtataaacgaatatgaaagagctgaaccattaggtgcgcaatgtacaaattgccatactattctatggataacaggtcgtaatgatcctattttgaatgaagatgatagtaatatacctgacagtggaccaatttacagagagtactataaaaataaactaaaacggtttttaagttcattacctctctgcccaaattgtcatcaacaggcatatgatttattcattaataatacaacattaactagatttgaagatggtagcccagctccaaaatatccagaggaatattatggggttgatgaagaaatgtctgcactaatgaaagacaaagccgtgtggtggtatggcaatcaagctgaagctaaaagacttaatttgaaattgttataa

SEQ ID NO: 3087 - DNA, 1131 bp, Acinetobacter baumannii
cacgctgcttttcaaggaatcggcatgcaacaacaatcgaatatgcaaaataaattcttgatagatgctgagatcggggatgacgatgtcacattgcctaatttacctgctatcgatgttcctatcgttgagtcacctgttaagcaagaagtaaaagctgaagaagtggtcgaggctgcaccttctacagaacctgagcaaccaaaatctggtttctttggacgaatgaaagaaggcttgagcaaaactcgccgtaatttcaccgatggtatggttaatatcttaattggtgggaaagaaattgatgatgagttgcttgaagaagtcgaagagcaattattagttgcagatattggtgttgatgcaacaaaaacgattattaccaacttaactgaacgtactgctcgtggtgatttgatctattcacattcactttataaagccttgcaagaagagttagttgctttgcttgctccacgtgtgaagccattgcatattgaccctaataaatcaccttatgtgattttaatggttggggtaaatggtgttggaaaaacaactactattggtaagttggcgaagcgtttacaaggtgaaggcaaaaaagtgatgttggcggcaggtgatacattccgtgctgctgctactgaacaattgcaaatctggggtgagcgtaacgatattgctgttgttgctcaaggtcatggtgccgatagtgcatcagtaatttttgatgcttttgaaagtgcgcgagctaaaggtattgatgtactgattgctgatactgcgggccgtttgcataacaaaagtaatttgatggaagagcttaagaaagttaagcgtgttatgcaaaaaattgatgcaacagcgcctcatgaaattatgttggttgtagatgcgggtactggacaaaatgcaattaaccaagtacaagaatttgatcaagctgtcggtttaacaggtattactattactaagctggatggtacagcaaaaggtggagtattatttaatattgctagtcgtactcatgtgccaattcgtttcattggtgtgggtgaaaaaattgatgatttaagaccattctcggcgaaatcatttgttgcagcactatttgaaactgaaaaataa

SEQ ID NO: 3088 - DNA, 1599 bp, Acinetobacter baumannii
ggagacacgttgatgatttctgaaagcgtggttgatctttcgcggttccaatttgccatgaccgcaatgtatcactttcttttcgtacctttgaccctaggccttgcgtttattctggctattatggaaaccacttacgttatatctggtaaagagatttacaaggatatgactaagttttggggaaaactatttggtattaactttgccttaggcgtaactacaggcttaaccatggagttccaattcggaacaaactgggcatattactctcattatgtaggtgatatattcggtgcgccattagcaattgaaggcttaatggcattcttccttgagtctacatttatcggtctattcttttttggatgggaccgcttaagtaaagttcaacatctaggagtaacttggttagttgccctaggttctaacatgtcagcgctctggattttagttgcgaatggctggatgcaaaaccctgtaggtgcagcatttaacttcgaaaccatgcgtatggagcttgttgatttcggcgcacttattttcaacccggttgcacaggttaaatttgtacatactgtttctgctggatatgtaacaggtgcgattttcgtactcgccatttcaagctactatctactcaaaaaacgtgaccttccttttgcacgtcgttcatttgcaattgctgccatttttgggcttgcttctacactttcagtaattttactcggtgacgagtcgggttatgaactaggtgatgttcaaaaaactaaactcgctgcaattgaagccgaatgggatactcaccctgctcctgctccgtttactttgtttggtgtaccaaaccatgaagaaatgcgaacagattacgcagttaaaattccatacgcattaggcctcatcgccactcgttcaactacgaaagaagtcactggtttgaaagacttaatgcaacagcacgaagttcgtattcgtaacggtatgcttgcttatgctgagcttgaaaaattacgtgctggtgatcgctcaccagagttattagcttcatttgagaaaaatcaaaaagacttaggctatggtctacttcttaagaaatatgctccgaatgtagtcgatgcaagcgagcagcacattcaagcagcagtaaaagatactattccgaatgttacagctctgtttttctctttccgtgcaatggttgcttctggcttcttaatgctgcttcttttcattttagcaacttgggcagtagcgaaaagaaatgctgagaataaaccttggctacttaaatatgcattatttgccttaccacttccgtggattgctgcacaaactggttggtatgtagcagagggcggccgtcagccgtggtctattggtgaaattttacctacgcacttatcagcttcaagtttaagtacgggcgatgtgtggggctcaattctcgctctagcagcgttctataccgtacttttgattattgaaatgtacttaatgattaagtttgctcgcttaggcccaagctcacttcacactggtaaataccattttgaaaaacaagagccaaaagcagctgttaatggggaggctttatcatga

SEQ ID NO: 3089 - DNA, 651 bp, Acinetobacter baumannii
gcgatcatgccgtcgaatactgatatgaatcaattgaaaagattaagttttgtcgtgacattgagttgtttatgctcatcgcttgtttttgcagaatctatcgactgctccaactcaaaagcagagctaaaaatctgttcaaaaacctttagcgaagcacgaaagcagctcaacaataaatatctttctgcatacttggtcacagatgcccccctgcagcttctacaagatactcaaacattgtggcttagacaaacacaacaatgcaaaaccaattcatgtattcaacaacagtttgatgtacgtggtgatgatttaaatttttatgcttcacttaaacaaaccctaactcagcattatcttaaatttgaaaatggacatattgcatctcagcccgttcatttacaaatacatcaacttgctaaagataaaatcaaaattgaaggtttagcttaccgtaatccgaataaccgaaaagaaacccaaacggtttcacttatggcttacagctctcctgaacagaaaagtgaaattttagataatgaacataactgtaaatataaatttgactttcagaaagcactgctcatcgtaaaaacccagcaaaaaggttgtgagcgcttcacaggaatttatcgtctgtacgactag

SEQ ID NO: 3090 - DNA, 549 bp, Acinetobacter baumannii
agaatttttactatgatcgaaactgaacgtttaatcttaagacaatggaaagagtctgattcagaaccatttatcaaaatgggtttagacgaagatgttatgcgttttttcccaaagcttttatctgctactgaaagtataagtttaattcaaagaatatcagctcttattgatgaaaatggctggggattttgggcggtaggattaaaagaaactcaagaatttataggctttattggcttacacaaccaaccagaacaatttgatttttctccctgcattgaaattggatggagaattgctacagaacactggaaaaaaggttatgccactgaaggagcaaaagcagcattggactatgcctttaatattctcaataaagataaagtggtttctttcacagcaacagtgaataagccatctcaagccgtgatggaaagactaggaatgcgcaaagttaaatactttaatcatcccaggcttccagatgaacatgccttacaaaagcatgttctttatgaaatatatcatcctaagcttgagttataa

SEQ ID NO: 3091 - DNA, 1176 bp, Acinetobacter baumannii
atgaactttacgttaaattcccagaactcattaccagatgatgcaactcaaggatgcttaattggccgtgcgtggattccaagtcaaatttcgggtccatcccctattattttaagaggcaatcaagtttttgatatctcggaaaaatttcatactatttccgagttacttgaaagtgctgatcctttaaaagctttatctgaaattgaaggaagacgagttggttcaattgatgaattatttgccaatactatcgccgaaccagataccaacaaggcatattttttagcccctattgatttacaagtaattaaagcggcaggtgttacctttgctgcaagcatgttagaacgagtgattgaagaacaagccggtggcgatgcacaaaaagctcaatcgattcgtgaagttgtacaaggcgtaatcggtgataatttaaaaacaatcgaacctggttctgaaaaagcgctacaactcaaagaatatttaatcgaacaaaaaatgtggtctcaatatcttgaggtaggtattggtacagatgccgagatttttactaaagcccctgttttagcagctgtaggcacaggacaaaatattggtattcacccaaagtctgagtggaataatccagagccggaagtcgtattagttgccaacagccaaggtaaaattttaggtgcgactttaggtaacgatgtgaatttacgggactttgaaggccgtagcgctttactgttgagtaaagcgaaagataacaatgcatcttgtgcgattggcccatttattcgcctttttgaccatacttttactttaaatgatattcgtacttgcgatgttgaactgcaaattcaaggcaccgataactttgtgttaaatggggtaagttctatgtcgcaaattagccgagatcctgaagatttaattcaacaaactcttaatgaaaaccatcaatatccagatggttttgttttgttcttgggtactttatttgcaccgactcaagatcgagaacaagctggggctggctttacccataaagtcggagatgtcgtccgtattcattcgcctaaacttggtactttgtacaacacggttatgaccagtgataaagcaacgccgtggaattttggaataaatgctttgatgcgtaatttgaagcagcgtgaattactataa

SEQ ID NO: 3092 - DNA, 984 bp, Acinetobacter baumannii
aacatgaagtttgccacattaaaaaatggaactcgtgacggtcaactagtttttgtaagccgtgatctaaaatttgctcgacctattccagaatttgcacaaaccatgctgcaactattagaacaatgggatgagtgggaaaatgggctatatgaagcttatgaattatttaatgacaaccctgatcaaaatggatttgtatttgatacacaaaaaactttagcgcccttaccacgctgctatcagtttgtagatggctctgcttttttaaatcatggccgaattatgaaagaagcctacaaaattaaaaatgaagaaccggaagggattccgattttaatacaacgccaaagtgatgatttccgctcaggtgtagatgattatacttttccttcgacaagagatctgtgcgattttgaagcagaattcgctgtagctgtttcagatattccaatgggaagctcaaaagacacaattaaatcaagcatcaagttagtcatgattttaaatgatgtcagcatgcggggtattttaaatcgtgaaataaaaatgggatttggttttatccaagcaaaaactgccactatttttgccccagtcgccgttacacctgatgagcttggaaaagcttgggaaaatgaaaaaattgccttaaatattgaagttaaacgcaatgatcagtggtttggagcaccgaatggaaaagagatggattattcctttagcgatcttatttctcacctagtttataaccgtaatattaaggcgggcaccattattggctcaggcactgtatcaaataaagatgcaaaacataccggttctgcttgtctggccgaaaaaattgctttggaagtcattgaacatggggcagccaaaagtgaatttattcaatatggtgaaaccatcgaaattaatgtcttcgataaaagtaagaaatcaatttttggagctattaaaactaaatttattccttattcatga

SEQ ID NO: 3093 - DNA, 252 bp, Acinetobacter baumannii
aataaaattacactaatacttggcattcaatttattccactacttaaaaataaaagcaatttattctatcgagtctgtaaaggaatgctgttttcaaatgttgattacaccccatatttgtatcaacttaaaaacaatatgttaataattcatactcaatgtaaacaacaaaaatataaatgtgataaatatcacatttatattttatttaacttcaaaataatgtttttcagtaataagttttatttttag

SEQ ID NO: 3094 - DNA, 600 bp, Acinetobacter baumannii
aaaatgtctactttcttagataaaattaaaaaccgtcgtactatttatgcaattggtaaaaatgttgcattagatcgcacaaaaattgaagaaactattcgtgaagcggttaaacatagcccatcagcgttcaactctcaatcttcacgtgttgttactctttatggtgaatcacatgctaaattttggaatttagttcgtgaagcattacgtaaaattgttcctgcagatgcctttgccggtacaaatgcaaagattgatagcttcgttgctggtgttggtacagtactattttatgaagatcaagctgttgttaaaagcttgcaagagcaatttgaattatatgcagataacttcccagtttggtctgaacattcaagtgcaattgctcagtttgcgacttggactgcactttcagaacttggtttaggcgcatcgttacagcattataacccgattgttgatgctgatgctgctgaagcatttgatgttccagcgacttggaaattacgtgctcaacttgtatttggttctgttgaagcaccagctggtgaaaaagcatttattagcgatgaagatcgttttaaaacattcaactaa

SEQ ID NO: 3095 - DNA, 957 bp, Acinetobacter baumannii
atcatgactacactatatgatgttgtcgttaaaaatcgccatgtggaaggtggaaatattgcagttatggagtttgaatctgcaacttctgctgcattaccaaaggttgaacccggtgcacatattgatgtgcacttaccgaatggtatggtgcgccaatattcgctttgccaaaatccaaatgacgaaggaaagttccgccttggaatcttacgtgaccctgaatcacgtggcggctcgatttctgcatttgatgaaattaaagatggcatgcaaattcaggtgagtgagccgaaaaacttattcccacttttaaaagccaagcacagtgtgttgattggcggtggaatcgggattacgccattaattacgatggcatatcaacttgcacatgaaggtgcatcatttgagcttcactactgtggtgctagccctgaaaaatgtgcttttgttgatgaaattaaaaatggtgagttagcaaaatacacaactttccattttaaatctgaaggtgcaagccacagagcattttttgaatctgccattaaagatattgatcctgaaagtcatatttatacctgtggtccagtcggtttcatggattgggtgattaatctcgccacaactcacgattttcctgagcagcaaatccacaaagagtatttccaagtcgaaactgacacctcgggagattcatttgaggtggtggctgagcgtagcggaaaaatcattatggtcgaagctggcgaaaccattttgcaggctttggctaaagaaggcatcgagattgaaatgtcttgcgagcaaggcgtatgcggaacctgtatgtgcgatgtaattgaaggcgaacctgatcatcgagatgtttattttactgatgaagaaaaagccagcaatgaacaaatattggtgtgctgttcgcgctctaaaacaccgagattagttttagatatctaa

SEQ ID NO: 3096 - DNA, 198 bp, Acinetobacter baumannii
ggctttgctactctccatatattagtaagtcacttgatcttcactgtgaccatagtttggctaagtcttctaagcatacctaacaagtatcagtgccttacacaatgctgtttactgccattgtataaggctttatcgacccttcttaaaaccaatatccaaatttcaaaccatacgcaattgcctggttatttttga

SEQ ID NO: 3097 - DNA, 1302 bp, Acinetobacter baumannii
atcgtgaataccttattggtaaatgcaaataaggtaaatttttttaaggatatgcatgtgaaaatagatactgatgtcaatactggatacggcaaggataccgacaaaaatggatatgcaaatattaagtatcgtgagctaattcaaaaattaacagcaacattatcattgacgcttttgtcatttggatggggctctacagtaaacgcagcacaacaacaaatcgctttagtaggaacctggacatctatcccagatgcaccgcttgtgcaaaaaccagaaaaagccagtgaaggtttgtaccagctacaagttaatgctgacgggaccttaactcctgttaaggtattgcaaatgaaaagtccatcttgggttgtaaaatcgaaagatggccgttttgcatataccactaatgaagaaaatgaaggggcggtaacggcattatcggttcaaaacggaaaggtagaggtattgaacacggtaaatagccatggcgggcatccaacacatgcctctatcagtttagatggtaaattcttatttgtgtcgaattattctgcatttgataaaggacgtggcggtgtcgctgttttaccaattttaccaaatggtcatttgggtgaaatggtacaaaatattgtttttgcggagggttctggtcatgttaaagggcgtcaggatagtggccatgcccattcgacaacttttagcccagatggtaagtatttatatgcaagtgatcttggaaatgacaaagtctatgcttttcgttacaacccaagcaagtctcaaccacttgaagcggacaagagccgagatgtgagttttaagcatggttctggtccacgtcatatggtcttttcaccaaatggtaaacaggcatacattaccgcggaaatgcgaagtgaaattgtgacgtttaacgtacaagaaggccatttgaaaaaagtcgctgagctaaaactagttcacgaagataaaacacctgaattcaagagcgcaagtggaattattcttagtccaaatggtaagtatgtgatcgctgcaaatcgtggtgcggacaacaaacttttggtatttaaaatccaacagaatgggctgttaggtcaaccacaagtttataaggccaatggtattgaaccacgtgctttttcatttgatgagtcaggtaaatatctgtatgtgacgaatgtttatagtaataacattagcttattccgttttgataccaaaaatggctcattaaaacctttaggcgatgcagctaaaatatcgactccaactgatatcaaattcttttaa

SEQ ID NO: 3098 - DNA, 1704 bp, Acinetobacter baumannii
gggcagagtacagtaaaattgccaaacattgtaggccgatttcggcttgattgtacgagaaacttaatgacccattttatttttgtcactggtggtgtggtttcatcgctaggtaaaggtatttctgctgcttctgttgctgcacttttggaagctcgtggcttaaaagtcacaatggttaaaatggatccttatattaatgtcgatccagggacaatgagcccattccagcatggtgaagtttttgttaccgaagatggtgcagaaacagatctggatctgggttattacgaacgtttcttacgtcgcgcgaaaatgaccaaactaaacaacttcactagtggtcgtgtatatcaagacgttttaaataaagagcgtcgtggtgattacttaggtggtacagttcaggttattcctcatattaccgacaatattaaagaacgtgtactccgcgcgggcgaaggctatgatgttgctatcgtagagatcggtggtaccgtaggtgatatcgaatctttaccgtttatggagtcggttcgtcagttaatggttgagcttggtcataaacgtaccatgcttatgcatttaactttgttgccatatattaagtcagcagcggagttaaaaacaaaaccaactcagcactctgtaaaagagttactttcaatcggtattcagccagatattcttatctgtcgtactgagtatgatgttgatgctgacactaaacgtaagatcgcgttattcacgaacgtagaagctcgtgcggttgtcgtgtgtaaagatgcgaaaacgatctatcaaattccacgtggcttctatgagcaaaatgtagatgacctgatttgtgaacgttttggttttactgatttaccagaagctgacttaactgattgggataatgttgtagaagcattacttaacccggaatacacagtacgtgtagcaatggtcggtaagtatgttgaattaccggatgcttataaatctgtaaacgaagcattgttacatgctggtattaaaaatcgcgtaaaagtacaaattgattatgtcaatgctgaagagcttgaaagtcaagatgtttctattttgaaaacagctgatgcgattttagttcctggtggttttggtgagcgtggtactgaaggcaaaatgaaagctattcaatacgcacgtgaaaatggtattcctttcttgggaatctgtttgggtatgcagttggctgttattgaatatgctcgccatgttgcaggtatgccagaagcttcttctacagaatttaaccgttctacaaaatatccattgattggtttaattaccgaatggttagatgagcgcggtgaattacaacagcgtagccttgagtctgacttaggcggaacaatgcgtttaggtgcacaaaaatcagaattggttgaaggcacaaaaactcgtgaagtttacggaaaagctgagattaccgaacgtcatcgtcaccgttatgaaatgaataatcgtttcattgaagcgattgaacaagcgggcatgaagatttctggttattcttcagcgcaacatttagttgaaactgtagaaattcctgaacatccttggtttattgctgtacaattccacccggaatttacaagttcaccacgtgatggacatccattgtttgctagttttattgacgctgcaaaaacacagcatcaaaaaagtaagtaa

SEQ ID NO: 3099 - DNA, 1380 bp, Acinetobacter baumannii
atatacttcacgacaaagtttgctcgatatctctttaaaatgtcccctacttctagcttttggcgtagtctcttccgtctcatacatatttatgccggtatttttattgccccatttatatttgttgccgcatttactggcttactatatgcaattacgcctcagctagagcaattcatctataaagatgcattaaatgttcagcctttaaataatgagatataccctctaagccagcagattgaaagcgcaagaaaagtcatgcctgcaactgcaaaaattacagaagtcaggccatcaccaagccctgtacaaactacgcgggttattttttccgatcatacacaccatctaaataatgaagccatttttattgatccttatacgctttctgtaaaaggacaacttgctgtgtatggaaccagtggcgtattaccgttacgtacattcttagatcaattacacagcaatttattattaggaaaatggggacgtttttatagtgaacttgctgcaagttggcttggttttttaactttaagtgggctatacagttggtggaagcgtcgctcaaacttcaaaaacagacaaacaaataaaaatcacttattaaaatggcatagttctattgggttagctttactaccacttttattgttcattgcgattactggtcttacatggtctcaatgggctggtgataatattcgtattgcccgtcaatggttaaactggcaaacaccaacattgaccacctcactaaatcagatttcattgccagaaatgtctcatcatgaacatcacgaaatgatcatggaaacgccaaatttagacatcatgccagctgaattcgattctgtattagcaattgctcgagcaaatgggattaattcaacagaaatacaaatcaaaccgccagttgctgagaaccaagcttggactgttgcggaaatacagcgtaaatggcccacacaagcagatagtattgcgattgatatgcatgaacacaaggtaatcgataaactcgcttttaaagattattcattagttgcaaaacttacacgctggggagttgatgcacatattggggtactattcggttgggtcaatcaattaattctggttctgtatgcgctcgggctatgtgtaatgattgtttatgcgtataaagcttggtttaaaacctccaatgtaaaacttacgacccatcattttattaaccaaactttgttcgtatggaaacatgcaactacacaacaaagaataattacgacattaatgcttgctattctagggctgagtttacctatttttggatttagcttagtcatcaccttatttattttgctcataaaaaaacagctccctcttaaagcttaa

SEQ ID NO: 3100 - DNA, 330 bp, Acinetobacter baumannii
gtcatgctcacattcaaagaaaattttcttaaattaaagtctgagttaaaggcagatcaatgttttaatctagttgtgattattatcattggctgtatttttatgctgtcttatttggcattactacgtcctgtgaattcagaacagtatcaacgaattgtgcaactttctcgacaggctacttatccaagaactcaagatatggccgagttgattatggctcaatcagaaattcatagagcagagtatttaaagttaatgcatgcttatcagtttgaacatgatcacatcaagcaatatcctgcattagcgcaagaagatactcaataa

SEQ ID NO: 3101 - DNA, 426 bp, Acinetobacter baumannii
aggtctatcacaatgaatgatgaacaacgctataaacaaggcattgaggtgcggactgaagttttgggtgaaaaacatgttggtcggtctttgcagaacctaaatgactttaaccaggatttccaaaattttattagccgttatgcatggggcgaagtgtggtctcgtccaggcttaccacgtcatacccgtagtttagtgactatcgcaattttattggcactgggccgagaagatgaactacgcatgcatttacgtgcttgtttcaacaacggtgtaactaaagaagatttaaaagagctgatcttacacagttcactctatgcgggtttacctgctgcaaacgctgcaatgcatatggctgaagaagtctttaaagagttggggatagaagtaaacccaattgcagcgaaagaacaggattaa

SEQ ID NO: 3102 - DNA, 381 bp, Acinetobacter baumannii
aaaatggtcaccaggagaataatgtcaaataaaaatatttttatcgcaaaaacttcggaacttagtcaaagcacggcgaaaggaatttcattagacggagtaaatgatcagctttttttggttatgacagatacagaagtagcggtatgggtaaatgactgtccacataaccatcgtccactggaatatcaaaaggataagtttttatcggctgatgggaatcatattgtttgttatgcacattctgcacattttgacaaagtttctggagagtgttttgcaggcccatgtaaagggaaaaaattaagaaagattcagcatcacgtaatagatggtgagatttatgttgaatcgaaaattttaatcgatcttaaggattaa

SEQ ID NO: 3103 - DNA, 1599 bp, Acinetobacter baumannii
ttacatagcacttgccggcctgtcagtaccaaacaaatatcagtaaataaataccaaatttatttttggagagctaggatgcttgatcaatcaaaagaaataaaagtgtgcacttatctcggcctcaccactttaattttaagtgtagcccttgtcgggtgtggtggtggtagcagtagcggaggttcatctaacacgcctaaaccgtctgaacccactcctgaagtcatgacggatattacgcttaaaacccctgtcgaaatgcgcaatgttcaactcaaggtatatgataataccgacaatagtattttgattgatacccaagttgccagtttaacgagttacgatattaaacttccaagcacaaaactaaatcgtctttatcgtgttgaagtcacgacccaaggctcatcacaagtatttgatccaaccaaatctgaatatcaaaatatttctggtgtttatcacgcttttattaccccaagctcgataagcaataaaacacaattgatcagcccaagttcagaagcaatttatcaacgtgctgtgattcgttcaggtcagttgcctaatgagacaattatcccaacccgtattgaacaattacatgttgacttagcctctcaagatgtctacagatctcttcttaatgcgtttaaagataccaatattccaagtttaagtccggcaagtacgcttacaattttaaatttattgaaatactcaaccacaaagccaagtacttatgtggatagttatctaagctttggttatcttcaatattggtcaagcatccataatacgaattcaccttatcaagatctcacccaaagtctcgctacagatttaaaagatggatatttagacggcaaaaaacttattggggacaaaacatcttttacccctatcttcacctcagcccctgataatattgatccagcaaaaaatacacttttagatatcgcagctaatcaaaaggtaacacgtgattattttgctaccaatctaagagcagccacctttaaactagcagatttgcaagatcaatcccatctagacccaataggttatgatctactggacaagaaacaatattcggggattatacctgctggtaatacgtctgaatttttccgtatagatggtgcgggagattaccgacgtgctgttggctttagtggcattacagcgacctgcaatggatcagcttacccttgtaaacaaggtttaactagcatcaatatttctgacccaaaactaccagctacagactatttagttggtcactatgaagacagtacaacaggctgccaacttaatttccgtgctaatggtcaaattgaattaattaaaagctctcaaagctatcgctctgccttaagcgcagatagtacagataacttactgcaaaccgacgctgcaagttatagttatttacttaactcaagttcatccgaacctaacaattcaacacagcaatataattttatacagctaaatattaaagcgaacaagattgttagtgctcaagcaggccttgatagccgcaaagcaccagatgtcttacaaacaacacaattagagtgtagctttagctaa

SEQ ID NO: 3104 - DNA, 231 bp, Acinetobacter baumannii
ggacattttttgtgctcaatgaagttaaaacagatggcatgctggcattttaacaacttaataaattctgacttccttgactcggcagcttacattgttgaagttgccagctttaagccaaatccgaaaaataaaatgccaactaagaaaattccgcttgctgcaattttatggttttgtttgaaaaaagttgaaagtttaattccagagaaaataagcgcagttaaataa

SEQ ID NO: 3105 - DNA, 903 bp, Acinetobacter baumannii
tttttattaacaagttcctttttggaacttaatctaaaagaagattggagcaagaaaatgaaaacagctttaaaccgtacaccagcctcttttcctgtccgccgcatggactacaattttgaagatactccgcgctattggtgcaatcatgagccttctctcacccactatttcacgggcctttcgactttatttcctgaaggtgaatcatactttgttaggtctgtccgtgctttacgagctaaagctaaagaaaatgaaattctagacagagaaataggtgcatttattggtcaagaagcaatgcattctaaagaacatcatgctttccatgtcagtgcacaacaatatggtttaaatccagaatcactagagaaagctacaggtattgttcttaaagctattgagaaagtttttagtaaaaaatggaatttattagtaactgttggattagaacactatacagctgttctggtagtcagcatgatgcaatctgtaaatgagcttatgaccaacaatactattcgcaacctatggttatggcacagtgtagaagaaaccgagcataaagctgttgcattcgatttatatcaacatctatatggcaacggattagatgcatatattccacgtgttggaatttttacattcagtttagttttgattacagccttttcaactatttaccatattgttttaatgaaacgagataagcaactgaccaatttcaaaacttggcgcaacttttttaagtttgcgagcaaacaatataaagtgttgattcctaaatttcttgaatactaccgttttgattttcaccctaatcaaacagatgaaaaagctttagttgccgctacaaaagtaaaacttggaataaatgatagatcactcctcttatcttaa

SEQ ID NO: 3106 - DNA, 255 bp, Acinetobacter baumannii
gcgtgtctaacccgaatcgaaccattaccgttatctccaccactccccatgaaatcggcttctagctttccaaccaaatctcccttcgaggtcggcttaacgatatccacccctacacgtgaagtcgcagcagaaacatttaatgatttacttcttgagtttgaattgtctaatggtattgaccctgttttattcgcaattgaacgcgttgaaccttcaaaatcatatgcagcatcaacccgtatatttccataa

SEQ ID NO: 3107 - DNA, 249 bp, Acinetobacter baumannii
gtcgatataacttttaatgtaattacagccactttaatatcagaagtggctttcttttatctgagaagggctaatattgtggaacaaattaattatgccaatgcaagatcacaattttcaaaggtcatggaaagagtactgttaggctacgccgttaaaattacacgaaaagagaaagatgctgtggttctaatcagtgaaaagcataccttgaatataaaaatgcaatgtttgagctcaataaattaa

SEQ ID NO: 3108 - DNA, 975 bp, Acinetobacter baumannii
ttattaataaccagtggttatcaaaaaggaattttaaaaatggcagatttgacttactcaagtttaaataactggcttaaattcaagcacttggttttgttagagacgttagctcgaaccaataacatgcatttggctgccgagcagatgaatttaagtcaacctgccgtaagtaaaatgctaaaggaaattgagggccttcttgggtttcaggtctttgagcgtttgccccgaaatatgcccgtaacggcattgggtgaacatgtcattcgttatgcccagcgtgttttgaatgacgcaaaacattttgtcgaagacatcgagattttacggttgggtggacatgggtttttaaaagtagggggaatatttgcagcaaccgcagtagtaattccaaactcaattatcgaaattaagaaacaatggccgctactttcaatcgatgttgttgaacagaccagtgaccatttaatggaaatgttgagtgaacatactctagatttagccatagggcgttttaccgatgtaacgcaaagccagtttttcgatttccagccgttaggccctgaacccttctgtattgttgtcaataatgcgcacccatgtgcccagaaaaagttttgtacattagaagaattattaaaatggccgtgggtactttatcctaaaggcacaccgattcgagagcgtatggaaggtgcatttgcccgagctaaagtcaaaattcctttaaatacggtaaataccatgtcgatgcagacctttttacagatcttaaaaggcgcacctatggtgggcatgttgccagaagcaatggtgattgatcaggtgaaagaaggacaactacagattttagaaacagacctgattttagatgcccaagattatggaattttgacacgtaaagatgaaccagtgtctgatatagccgcagcatttattaatattttacttaaaaatgcaaaacgtaagtaa

SEQ ID NO: 3109 - DNA, 354 bp, Acinetobacter baumannii
agacggccaacgatgtccgttctgatcgaatttgtgagtgcaactgtacacacagaaaatttacgttcagtcggagtgaaggttatgtctttatttttattgcataaaaaagttacatctgaattaactaatttttcagtttcagcgatgcgagctttccgtatgagggggctcgctttttttatttgtttttatgactttgctatgcattgggtgtcgtcaacgagtggaaaaaatgggttccaagcagctatacgctttgtgatgttgatacgtttctcggtagagcacaaggcaaaacaacaatgtctatttgagaacgcaagaacgcagcttaaaagcaacgtgatttga

SEQ ID NO: 3110 - DNA, 1341 bp, Acinetobacter baumannii
tttggaacaactatgaaagggatgaagccatttaatactcggtttttaacacttcgacacgccttgtttctaggcgtgttggttgtgtcgaatacacatgccatgactttagatgaggctttgtcggctagtttaaggcatgaaagccagcttgaagtgagccgtttaagtgtgaaccagtccaccgctatgcttgaacaggccaagcaacgtgatggactcaaagtcaatttagtcgggcaacttgactatgaaagaataaatacgccttcacacgtcttgtttccaaccgaaggaaaccgtaaagggcgaagtttgcaattgcaggcagattatccgatttatacctctgggcggcaccgtttagggatagatattgccgaaagtcagctttctgcccaacaccaaggcttatcagatcaaagatcggaaaccattttaaataccgtgatggtctataccgacgtattaaaaaagaaagccattttagaacttagacaaaagaccatggcaaatctgcaacggtctttatatgaatcaaagcgccgttttgatgtcggtatgattacccgtgcagacttggctcaagttttagctcaagtcgcacaaggtcaagccgatattacacaggcgcaatctaacttgaccgtaagcgaagcacagttttatcaagtgacaggtataacgcctgacaaccttgttccaatcaatcaattacctactattcccgctaacctagatgagatattggctcaaaccaagaatcatccagcgttaatgcgggctaaatatgaaaagcaggctgccgaaaaacaatatgctttaactaaacgagaactctggccaacggtcatgctgaccagccgtgccggaaagcaagatgaagcgagttatattggttctgaaagtaataactatatggttggggtgcagctcaatgtaccgctctatgatgatggcttaaatcgggccaatattaaaaaagcgcaggccgatatcgatttggctgcacaaaaaattcgaagtcttgaactagatttgaataagcgtacccgtaccacctatgcacagcttcaaaccattcgacaaaataaagatgcattggcaaatgccatagaagctgcgtctattgcctttgtctatacacgtaaagagtttgatgtcggcactaaaaccacttttgatttgcttaataccgagcagaaactacttgatgcacaaacccagaaaaccgtgaatgatcaagacgaagtggtgtttgtttatcagctactcgaccaaatgggacgtttaaacaatttggttcctatgcagaccgcacaacaggtgaataatgaataa

SEQ ID NO: 3111 - DNA, 1626 bp, Acinetobacter baumannii
accaagacaaccttccaagacactctcattaatttcaggatatttgttatgaccattatcggacaaaactttattggtggttcacgcagcgcacaaggtacaaccttattaaaaagcattcatgctacgactggtgaagctctgccttatgagtttcaccatgcaaccgagcaagagattaatcaggcctgtgaagcagccagtcaagcctttaagacttaccgccatacgtcacctgaacagcgcgcagtttttttagaaaatattgccgatgaactcgatgctttgggtacagattttcttgaaatcgtctcacaggaaaccgctttgccacttgcacgtttgcaaggtgaacgtggtcgtaccagtgggcaaatgcgcctgtttgcaaaagtactacgccgtggtgattttttaggtgctcgtattgataccgctttgcctgagcgtcagcctttacctcgcccagacctgcgccagattaaaatcggtgttggccctgttgcggtctttggggcaagtaactttcctttagcattctcaactgcgggtggtgacactgcttcggcactggcagcaggttgttctgtagtggtgaaagcccatagtggacacatggccacagcagactttgtagcgcaggcaattgagcgtgccgtagaaaaatcaaatatgcctaaaggtgtatttaacatgatctacggtaatggcgtgggtgaacctttagtgaagcatcctttaattcaggctgtgggttttacaggttcattacgtgggggtcgtgctttatgtgatatggccgcagcccgtccacaaccgattccagtctttgctgaaatgagcagtattaacccgatgttgatgttgcctgatgccttaaaaaaccgtggagaaaaaattgcacaggacttggcagattcagtagttttaggctgtggtcagttctgtactaatccgggtttaattttaggtattaaatcagctgaatttagtcagctcattagcaacctgaccgacattatgggggctaagcctgcgcagactatgctcaatgctggcaccttaaaaagttataccgctggacttgagcacttaacccagcatcaaggtattaagcatttggcaggtcaaactcaacaaggcaatcaggctcagccacaactgtttaaagctgatgttgagcttttactggcaggtgaccagcttttacaggaagaaatctttgggccaaccacagtcatcattgaagttgaagataaagcccaactcattcaggcattacaaagcatgaatgggcaactgactgcgactttaattgccgatgaggctgacttaaccgagtttgcagaggtagttcctgtattagaagaaaaagctgggcgattacttataaatggctatccaacaggtgttgaggtgtgtgatgccatggtacacggcgggccatacccagccacttcagatgcacgaggtacttcagttggaaccttggccattgaccgttacttgcgccctgtgtgttaccagaactatccgcaaagtttattgccggaagccttaaaagacagcaacccgttgctgattttaagactggtgaatggtgagatgaccagagaagcgatctaa

SEQ ID NO: 3112 - DNA, 3123 bp, Acinetobacter baumannii
gggggcgcaaccatgatgtcacaattttttattcgtcgtcccgtttttgcttgggttatcgcgatctttattattatatttggattgctgagtattcctaaactgccaattgcacgttttccaagtgtggccccgccacaggtgaatattagtgcgacttatcctggtgctacagctaaaaccattaacgatagcgttgtaaccttaattgagcgcgaattatcgggtgtaaaaaatctactctactatagtgcgacaacagatacctccggtacagcagagattaccgctacgtttaaaccgggcacagatgtggaaatggctcaggtcgacgttcaaaataaaatcaaggctgtagaagctcgcttaccgcaagttgtacgtcagcaaggtttacaggttgaagcttcatcgtccggatttttaatgctggtcgggattaactctccaaataatcaatattccgaagttgatttgagtgattatttggttcgaaatgttgtagaagagctaaaacgtgtcgaaggtgtagggaaggttcaatctttcggtgccgagaaagctatgcgtatttgggtcgacccgaataagcttgtttcttacggtttatcgattagtgatgtgaataatgccattcgtgaaaataatgtcgaaattgcacccggccgacttggtgatttaccagctgaaaaaggccagctcattactattccattgtcggctcaagggcaattgtctagtctcgagcaatttaaaaatatcagcttaaaaagtaaaactaacggtagcgtaattaagttatctgatgttgccaatgtagaaataggttcacaagcgtataactttgccattttggaaaatggtaagcctgctaccgcggcagcaattcagttaagcccgggagctaacgccgtgaaaactgccgaaggtgttcgagcaaaaattgaagaattgaagctaaatttaccggaaggcatggaatttagtattccttacgataccgcgccgtttgtcaaaatttcaattgaaaaggtaattcatacattacttgaagccatggttctggttttcattgtgatgtatctatttttacataatgtccgctatacgcttattccagcgattgtggcgcctattgccttactcggtacttttaccgtgatgttgcttgctggcttttcaattaacgtactcaccatgttcggtatggtacttgccatcgggattattgtcgacgatgccattgttgtcgttgaaaacgtagaaaggattatggcgactgagggattatcgcctaaagatgcaacctctaaagcaatgaaagagattaccagcccgattattggtattacgctggtattggcggcagtatttttacctatggcatttgcgagtggttctgtaggggtaatctataaacagtttaccttgaccatgtcggtatctattttattttcagcgctattggcactcattttaacacctgcactttgtgccacgatcttaaagccaatcgatgggcatcatcagaagaagggcttctttgcatggtttgatcgtagtttcgataaagtcactaaaaagtatgaattgatgctgcttaaaattatcaaacatacagttccaatgatggtgatctttttagtaattaccggtattacctttgccggaatgaaatattggccaacagcatttatgccagaggaagatcaaggttggttcatgacttcgttccaactaccttcagatgcaaccgctgagcgtattcggaatgtagtcaatcaatttgaaaataatttgaaagacaatcccgatgtaaaaagtaataccaccattttaggatggggttttagtggcgcaggacaaaacgtagctgtggcttttacgacacttaaagacttcaaagagcggactagctctgcatccaagatgacaagcgatgttaattcttctatggcgaacagtacggaaggcgagactatggccgtattaccacccgctattgatgagttaggtactttttcaggtttcagtttacgtttacaagaccgcgctaacttaggtatgcctgctttactggctgctcaagatgaacttatggcaatggcagccaagaataaaaagttctatatggtttggaatgaagggttgccacaaggtgacaatatttctttaaaaattgaccgtgaaaagcttagtgcacttggtgttaagttttctgatgtttcagacatcatttctacatcaatgggttcaatgtatatcaatgacttccctaatcaaggacgtatgcaacaagtcattgtacaagttgaggctaaatcacgtatgcaattgaaagatatcttgaatttgaaagtcatgggttctagcggtcaattagtctcgttatcagaagttgtaacgccacaatggaataaggcaccacaacaatataatcgttataacggacgaccatctttgagtattgctggtattcctaacttcgatacctcatcgggtgaagcaatgcgtgaaatggaacagctgattgcgaaattaccgaaaggtattggctacgagtggacaggtatttccttacaggaaaagcagtctgaatcacaaatggcctttttacttggtttatcaatgctcgtggtcttccttgtcttggctgcactctatgaaagctgggcaattccactttctgtgatgctcgttgtgccactcggtatttttggagcaatcattgccattatgtctagagggttaatgaatgatgtgttcttcaaaatcgggctaattactattattggtctatcggcaaagaatgcaattttgattgttgaatttgcgaaaatgctgaaagaagaaggtatgagtttgattgaagccactgttgccgcagccaaacttcgcttacggccaattctgatgacatcacttgcatttacctgtggtgtaattccattggtgattgcctcaggtgcaagttcagaaactcaacatgctttaggtacaggggtttttggtggcatgatttcagccaccattctggctattttctttgttcccgtgttttttatcttcattctgggtgcagtagaaaagctattttcctctaagaaaaaaatctcatcttaa

SEQ ID NO: 3113 - DNA, 300 bp, Acinetobacter baumannii
atcatggcaaccgcaatgacagcatcaaatcaacgaaaagctcaagcattcgcaatggccatttcatttctgttggcattgccgcttgctgtaattttactggtgcatccttccctcatgttagatgcaaacggacactacaatcatagccagcttatgctagtgatggtgggtatttccggaggcttcatttatggagtgggttttgtgccgcacttctggttatggaagtggttgtttagtccatggatagcttggcctctcatgcttttaggctattacatctggtttctaacctaa

SEQ ID NO: 3114 - DNA, 570 bp, Acinetobacter baumannii
tttaaagggtttatggagtatataaaattgtcataccatcatcttaactttgaagatcgtactgcattaatgcttgagtcaagaaaagaaggcttttcagccagaaaatttgctgaacttattaaaagacatcctagtacgatctatcgtgagcttaaaagaaatagcatcaatgacgtttatcaagctcaatatgcttctgataacacttttgctagacgtagacgtggtcacagaaaactcaaaatcgattcaatcctctggaaatttattgttgaagcgatccgttgtttatggtctcctcagcaaatagcaaagcgtttaaagacatttcctgatttggatcaaacaatgaatgtaagccatacaacgatttattcaacgatacgagcattacccaagggtgagttgaaaaaagattattatcctgtctacgtcatgaaaataaaaagcgaaaagctaacggtgaacctaaaaaagattctatattacaggatattaaaactattcatgagcgcccagccgaagttcaagaaagaaaaataccgggtcattgggaagctgatttaa

SEQ ID NO: 3115 - DNA, 426 bp, Acinetobacter baumannii
aacgaaaaaacccgggtctgtatctggccaacattacctgatgcaaaggcagaatcagtgcgcaagcttttaactgaagctctgaaatattaccttgcagaattgcgtaaaacgttgacttatgaccgtggacgtgagatgtcagaacataaaatactcgaagaagatttaggcatagatgtatatttctgtgacccacattcaccctggcaaaaaggcacatgcgaaaatatgaatggtttaattaggcaatatttacctaaagggattgatttaaatcaggcagatcagcattatttaaatcaagttgccatgtcactgaatactcgtcctagaaaggcgttagattggcttacaccattagagaaatttgctcagcttgttgattatcatatggcttttgaaactgtcgcacctcatgtttga

SEQ ID NO: 3116 - DNA, 492 bp, Acinetobacter baumannii
aatattatgaccgagtctactacacctaaatttgccatccctgaattaccaatgcagattcaaacgattcgtcaatatttgccgcatcgttacccattcttattggttgatcgtgtgactgaagttactgacaatagtattgttggttataaaaatgtttctatcaatgaagagttcctacaagggcatttcccagaatatccaattatgcctggtgttctcattgttgaagcattagctcaagtttcaggcgttcttggttttattatgaacaatgaaacgccaaaaccaggttcattattcctgtttgctggtgcagaaagagttagatttaaaaaacaagtagttgcaggtgatcaacttgtattaaaatctgagttggtaatgcagaagcgcggtatctacaaatacaattgtacagctagcgttgacggcattgtagcagcaaccgctgagattatgatttcacaccaaaaaacagagcaggcatga

SEQ ID NO: 3117 - DNA, 378 bp, Acinetobacter baumannii
ccattaatgactatgctaaacttctcgaaaattttcagaaggaatgtgcttgaaatggaaaggatctgtatgacggaagaagttcctgagcgtgaagctagagcttttgacactttacaaggaactactattttcattacacagcgtgatggctctttctacgcctatcagaatttatgcccacatttgcaaaccgaacttgaatatctagaaaaccaatttctagatcaagaccaagaatatatccaatgctcaacccacggtgctttatttaacgtggagactggtgaatgtatttcaggtccttgtttaggtgagtttctaaataaagttgagattaaggtgcattcagatggcggtatttatatcgtagactga

SEQ ID NO: 3118 - DNA, 996 bp, Acinetobacter baumannii
atatcaatgactcatacagcacttgaccaattaaaaacattaacgaccgttgttgctgacagtagcgaccttgaagcaattcgtaaatttcgtcccttagatgctacaacgaatccttcgttaattaccgctgcggcagaacaaccagaaagtaaagagctcattgaagatgcttattatcaagccaaagaagaaggctataaaaatgatgaactgattgaaagaaccattgatattttaaccgtaaaatttggtgtagaaattttaaaactcattgaaggccgtgtttctacagaagtcgatgctgctctttcatatgacaccgaagcgaccattcaaaaagcacatgaattatgtgagctttataaggggtatgggatcgatcagtcacgtattcttattaaaattgcatcgacttgggaaggtattcaagcggctaaagtgttagaagctgaaagtattgcctgcaacctcactctccttttcggtttacatcaagcccaagcgtgtgcagatgccaaagttactttaatctcaccttttgtaggccgtattttagactggtacaaaaaagctgaaggtgtagattcttacccaatcgagaaagatccaggtgtggtttcagttaagaaaatctacacttactacaagcagcaaaatattccaactcaagtcatgggtgcgagcttccgtagcatcgaccaagtgctaggccttgcaggatgtgatttgcttacgatctctccaagcttgctaacgcagcttgagcaagatacgcgtacagtcgatgcagcacttgatgcaaacaaagcaaaacaggcagaagcgattgttagaccagctcaagatgagcaaagttttaaagatgaacttaaccatgacttaatggcattccaacttttacaaggtggtgttgatggctttattaaagcgcgagatcaattaagtcttttattacgtcaatcttttggaattgatgcagaaattaaatcttaa

SEQ ID NO: 3119 - DNA, 456 bp, Acinetobacter baumannii
atgagttcgaccattttggtaattcatggaccgaatttgaatttgctgggaaaacgcgaaccagaagtatatggtcatcttaccctagacaatatcaaccaacaacttattgctcaagctgaacaagcctcaattacactagatacttttcaaagcaactgggaaggtgccattgttgaccgtattcatcaggcacaaacagaaggcgtaaaactgattattattaaccctgctgccctcacccacacttcagttgctttacgcgatgccttacttggcgttgctattccctttattgaagtacatttatcaaatgttcacgcacgtgaagctttcagacatcactcttatttatcagacaaagcaattggcgtgatttgtggtctaggcgcaaaaggttatagctttgcactcgattacgctattgaaaaaattcaaccatctaacccaaactag

SEQ ID NO: 3120 - DNA, 450 bp, Acinetobacter baumannii
aacaacaggacagaagaaatgactatcgttgcacaagtaattaagaacaaatctgaacaagccatttttacaatttcacccgaagcaactgtcctcgaagcaattacgattatggccgaaaaaggtattggtgctttagtcgtagcagaaggtgaacaagttgttggaatattatctgaacgcgattacacacgaaaagtaacgcttatggagcgctcatcttatagcactacagttgctgaaattatgacagcaaaagtgattacggtaggtttaaataatacggttgaagaatgtttacagctcatgaccgatcgtcatttacgtcacttacctgtattagataatggaaaattggttggtttcatttcaattggtgacttggttaaagctgctatggaagaccagaaagttttgattgaacaattaaagcaatatatttcaggctaa

SEQ ID NO: 3121 - DNA, 957 bp, Acinetobacter baumannii
atcacttttgcagaaattgcacaaatggatttaacaaattcgattgatatccgcacgcttcgcttctttattagtgtttacaatgctcaaaacttctcgaatgtagcacgtaaagaagatgtgtctgcctccatgatttctcgaaccattcaacaacttgaagatgcgttggggcagcaacttttctaccgaaatacacgagcaatcacaccgaccgaatcgggcaaattattttttgaatatgcaaaaagaattaccgaacaatttgatgaagctcaaaaggctttacaagataaaaccatagaaccatctggactcgtccgcattaatgcccctgtattttttgggcaacgacatattgcgccgtggttggcgggtttatcagagcgttatccaaggcttctaatagaactaattcaaaccgatgaatttatagacccattacgtgaaagcacagatttaatatttcgtattggagcactgactgattcatcatttcatgcccgtatttttggtacacaaaactatcatttagccgcctctcctcagtatgttgccaaatacggtacgctcgaccacccaacagaacttaatcaacacaagtgcctagtctataaaggttttgaaggtcctaaccgctggttagtgagaaagtccaatgaagaatgggtacattatccaattaccccgttactttcttcaaacaatgccgagagtttaatgacagccgcgcttcatggtatggggattgttttatttcctgattggctgattggcgaagctttaaaacaaggtgacttaataaagcttttacctgaatacgaagtcgcgattaaatcgcacccccagcatatcgcagccatttatcccaatgtccgccatccaccacttaatattagagcagtgatagattattttgcagaaatctatggtgacacaccgtattggcagagttag

SEQ ID NO: 3122 - DNA, 1338 bp, Acinetobacter baumannii
agccgagttgccggtaccttcccaggaatgacccaggacatatttaaaaggactattgatatgaacagtattatcccaacgcataacattggcattgattacgatgctttagttaaaagtgaccgtgcccatacttctctttataaagatgaacgcatttttgatgaagaaatggaaaaaatcttttatagcacttgggtgtgggttgcgcatgccagcgaaattccagaaggcggaagctataaaacgattaatatcggtaaacaacctgtggttgtggtgcgtgaccgtaagaagaaagtccatgtacttttaaaccgttgtcgtcaccgtgcagcaaccgtatgtgaacataaaaaaggaaaaactaatagttttgtatgtccgtaccacggttggagttatgcacttgacggtagtttacgtggtgtgccatctccggaaagctacggtgattgtttagataaatcagaattaccactggtgagtctacgggtagaagaatataacggcatgatcttcgcttcatttaaagaagacattcaaccgcttgaagagttccttgggccagcaaaaaaatggattgatctgtttatgaaacaaggtgcgggttatccaattaaagtgttgggtgaacatcgtttccgtttcccgggtaactggaaaatccagcttgaaaataccaccgatgcatatcacttcccgctggtacacaagtcattcttaagttctgtagatgaaaaaaccgaagaactctttaacttcgaaaaccagccgggctttgttgaagacttaggtaatggtcacagtgtcatggtgatgattcctgaactggtcgatttagaagaagacttaatggagcgaccaattcaagagcgtttcgaagacttggctcaagctttgcgtgacgaagggcatgaagagttagaagtacgccgtattgttcgagcagtgggtggttctggctttaacttaaatttatttccgaatattgcatgctcaatggcgttcttccgtgtgttacagccaatttcagttgctgaaacagaaattcatcactcggtgattacgatggatggcggtccacaaattgccaatcaatatcgtttacgtttgcatgaacatttccaaggcccatttggttttggtacgccagatgactctgaggcttgggaacgcgtgcaacacggtgccaatgccggtaatgatttatggatcatgctcaaccgcggtttaccgggtgaagtcaaaactgaagatggcttaaaaagtgatgtcagtgctgaaacaggtatgcgtgcagcatatcagcaatggaaaaagatgatgacagcttaa

SEQ ID NO: 3123 - DNA, 549 bp, Acinetobacter baumannii
aatacttatttattttttagtttaagtggttggaataaatttctaatggaagcacagtataaggtgttatgtgtctgtttaggaaatatttgccgttctcccacggctgaagtggtttttagacattattgtgatcagcatcaactcaatatcattgtcgattcagctggaacaagtaactatcatccaaataaagcacctgatcagcgtagccaattgcatgcaaaaaaaagaggctatgacttatcttctttgcgggcaagacaactttcaactcaagactttttagattttgatttgattttggcaatggatcatcaaaactttgatgatatccacgacttgctacaaagagctatcttccaatttggcagtcatcaaattcgggcaaaagtggcattaatgagtgaacatgatcctcaatatccacaacaagctctgcctgacccttactatggtggagatgagggctttgaacgtgtactcgaccaatgtgaatcaagtgcgttggcgtggattaatatcctaaaaaaacaattgaatgtttaa

SEQ ID NO: 3124 - DNA, 1029 bp, Acinetobacter baumannii
agcgttggtgcaataaatatggaaaagctgaaatattattggttttacccgttacctttcatcatgatttttatctcattgcttattgggccaactcaaacattgagtgcatgggattatttgcggtggggtgtgcaagcagtctttggtacaccatattttgatgcggaacaatttaggctgatgcaaaacattttcgtaaatgtcaggctgcccagaattttactgacctttatggtgggagccgcattagcaaccgcgggtaatggcttgcaggccttgtttcgtaatcccttggtcgactcgtatgtactcggtatttcatctggtgctgctttcggtgcagctttggcactttctttaagttggctttcgccaaatctatccgcctttgtttttggcgtttgtgctgttgccttaacgtatttatttgcacatcaaaaacatgaaagtcagacgtctttagtcatggtaattttatcgggcatgattgtttcggggctgtttttggcaggtcttacggttattcaatacctaagcgatccatttaaattacaagcgattgtgcaatggaccatgggcaacttacatcaggcgtcttggcaaaaggttcaatatgctgtgcttcctatttgtattggcctagccggattatttgcgatgcgttggcgcttaaacttaatggcacttggtgccgaagaagcacaggctgtgggtgttaacccaaggtgggaacagcttcttttaattgcgctggtgactgtatgtacctcaacttctgtggctgcggcaggcattattagtttatatgggctgtttatgccacatattgtgagaatgttggttgggccagatcatcgctacagtattcctgccaatatggcgttgggcggcagttttctactgttgattgataacttttctcgggttttactgacatttgaaataccaattggtatttttaccatgctacttggcgcgccatttttcttattattaatgaaaacacagaggactcattgggcatga

SEQ ID NO: 3125 - DNA, 348 bp, Acinetobacter baumannii
cttccctatttctcttttaccgttatgtatgcttacatttacgggtgccatgattgcattgtatttaggaagaaaaccgacattgccaaaagtgcaaaaggttcaaaaagcagtttaggttttagaaataaaagatttaatcaaaagagaccattaatggtctcttttttaatttataaggaacttaaattcccttacttaaaaacacactcaattagagggcctgctcaaagctacttaagtaaatttacaatattggaccaccccatcttatgggccaagtctaaaggaatcattaattgtttattccttactaacttattaacattcaatcttaagagttcttga

SEQ ID NO: 3126 - DNA, 258 bp, Acinetobacter baumannii
cctaaaatcgctgggaaaacaccttctgggtcatcgccagataatgtaaaagcatcggtatggcatacccctgtatgggtaatttttattaaaacctcaccagccttgggtggtgcaacatcaacttcaacaatttctaaaggttttcctggggcaaaggcgacagctgcacgagatttcatctttgggtttcctttatatcattcggtacttatagtcgagcaaaatagattatgtaaccgtaatacaagagcttaa

SEQ ID NO: 3127 - DNA, 723 bp, Acinetobacter baumannii
acgatgagcgcacttttagaaaaggattttagcccgactgagtttacattgttttctgaaatattatggaaacttggttcagggaaagggcaatacaatttacgtgaaaatatcattgcagatattgccatcttgttgcgggctgattttgccgcgtcttatatttgggattcaacgcataacttatcgaaagatggtgtgatatggaaaatcgacccaaaagcgatggaggactatgagtgtatttggcaatttgatgatcccattactgcacagcttcataagctccagaaaccaacatttgtaaatgaagtcatgcctctctcagacctgaaaaaaacaggctattacaatgagtttttaaaaacctatggtttgtatcacggtataaatatttattttgttcgaaacggtgtggatattggtgatttacgaatttggcgtgcgcaagacgctgaaatgtttggtgaacgtgaaaaaagaatattaactctgcttgaaccttattttacccaagccttaccactagatttatcaacacaatatggtttgactccacgtgaacaagaagtggttcatttggtctctaaaggtttaagtgataaagaggtggcaagtttacttggtattgggtttaccacattaagaacccatctgaataattctatgagaaaaataggaggcaataatcgcactgaaatggccttactcattcaacattaa

SEQ ID NO: 3128 - DNA, 216 bp, Acinetobacter baumannii
aattcatatttggttggggagatagttgtttcagaaaatacaaaaggagaaaaagtagcagtacttaaaactaataaaattaattgtaatctattcatttctatggaagcccagatgaaagtgagtaaatcactgtattataacactaaatttaatattggactaaaaaataatatatctaaaatatacatatttttaattttcaaagttgtataa

SEQ ID NO: 3129 - DNA, 2571 bp, Acinetobacter baumannii
gcggacttagctatgccaaaaaaaaggcaagaatcttataaattattaaaacgccatatttgttattacttggcttctggcgttgttacaatgacaatgcctgtgttcgtgcatgctgaagaagcagctgcgagtgcgcctgtagaagctgaatttgattctgcttttttaattggtgacgctcagaaagtcgatatttctcgatttaagtacggcaaccctgttttaccaggtgaatataacgttgacgtttatgtaaatggtcaatggtttggtaaacgccgcatgattttcaaggcattagatccaaatcaaaatgccgtaacttgttttactggaatgaaccttcttgaatacggcgtaaaacaagaaattttaaccaagcatgctccccttcaaaaagaaaataatagttgttataaaattgaagaatgggtagaaaacgcattttatgaattcgatacgtctcgtttacgtgtagatatttcaattcctcaagtggcattacaaaaaaatgctcaaggctatgtcgacccaagcgtatgggatcgtgggattaatgccggctttttgtcttatagtggtagtgcgtataaaacttttaatcagtctggtgaccgaagcgaaacgaccaatgcttttatgggggttacggctggactaaatttagcaggttggcaattacgtcataatggtcagtggcaatggcaagatacgcctgcggaaaatcaatctaaatcagactatcaagaaacaagcacctatttacaaagagctttccctaaatatcgtggtgttttaacactcggggatagttttacaaacggcgaagtatttgactcatatggttatcgtggtatcgatttttcaagtgatgatcgaatgctaccgaatagtatgcttggttatgctccacgtatccgtggtaatgcaaaaaccaatgcaaaagttgaagtacgtcaacagggccaattgatttaccaaacaactgttgcaccaggtaacttcgaaattaatgacctttaccctaccggctttggtggtgaaattgaagtttctgttatcgaagcgaatggtgaaatacagaaattttctgtgccttatgcctccgttgtacagatgttacgtccaggcatgaaccgttactcattaactgtaggtcagttccgtgatcaagacattgatctggacccttggattattcagggcaaataccaacaaggtattaataactatttaaccggctataccggaattcaagcatctgagaattacgctgcaatattgcttggtgctgccgttgctacaccaattggagcaattgcattcgacgtgactcactctgaagctgagtttgaaaaacaggcttcacaatcaggtcaaagtttccgtttaagttatagtaagttaattacgccgaccaacacaaacttaacacttgcagcttaccgttattcaaccgaaaacttctataaattgcgcgatgccctacttatacgtgacttggaagaaaaaggtgtaaacacttatgctgctggtcgtcaacgtagtgagttccagattactttaaaccaagggttacctgagggttggggtaacttctatgtggtaggttcatgggtggattattggaatcgtagcgagagtactaaacagtatcagattggttatagtaataactatcatggtttaacttatggtttatctgcaattaaccgtaaggttgagtacggctcaaatgatgcgtcgcatgatactgaatatttaatgacgctttcattcccaattaactttaagaagaattcagtcaacgtcaacgttactgcttctgaagacagccgtactgttggtgcaagtggaatggtgggtgatcgctttagttatggcgcttctgtgtcacatcaagactatgcgaacccaacatttaacgctaatggtcgttaccgtactaactatgcaactgttggcggctcttatagtattgctgactcttaccagcaagcaatggttagcttaagtggtagtgtagttgcacattcagatggtattttatttggacctgagcaaggccaaaccatggtacttgtgcatgcacctgatgctgctggagcaaaagtgaataacacggttggtctaagtgtaaataaagcgggttatgcagtagttccttatgttacgccataccgccttaatgacattactcttgacccacaagaaatgtcgagcgaagttgaacttgaagaaacaagtcaacgtattgccccatttgctggtgcaattgcgaaagtagattttgcgactaagacaggttatgcagtttacattaatagtaaaactgctgatggcaacagtttaccgtttgcagcgcaagtctttaaccagaaagatgaagctgtaggtattgttgcacaaggtagtatgatttacttacgtaccccacttgctcaagatagtctctatgtaaaatggggcgacgaaagtaatgaacgttgttcggttgagtacaacatcagtaatcagttgcgaaataaacaacaaagtatagttatgactgaggctgtctgcaaatga

SEQ ID NO: 3130 - DNA, 1440 bp, Acinetobacter baumannii
attgcttcagcccgtgagttctttaaccagataaccgaggtttctatgcaaacacgaattgaacatgacacaatgggtgagattgaagttccgaatgaagcgctgtggggtgcacaaacccaacgtagcttacagaactttaaaatcgggcaggagcgtttaccccgtgccatgattcgagcgatgggcttggtaaaaaaagcagcggcaataaccaatgcagagttaggccagttaccacaagatttgagccaatatattgtgggggcagccgaggaagtgattgcagggaaatgggactctcagtttccactcgtggtttggcaaacaggttcaggtacgcaaagtaacatgaactgtaatgaggtgattgcaaatattgcaaatcaaaagctaggccaagcgcttggagcacaaaagccggtacatccgaacgatcatgttaaccgcgcacaatctactaatgactcattcccaacggctattcatgttgcggcaagtttgcaaattaatgaattactgattccagccgtagaacagcttaaagcgactttgcaaaaaaagtcggacgaatttcaagatattgttaaaattggccgtacccatttacaagacgcgacgccactgacacttggtcaagagtttagcggttatgtttctcagctcgagcatggtttagtacgtttacagcaagctttaagtggtctgtatgagttaccattaggtggcacagcggtaggaactgggttaaatgctcatcctgactatgctgttaaggcagcagctcagcttgcagctttaacgggtttgccatttgttacggctcctaataaatttgaagcacttgcaggacgtgatgctgctgtttttgcatcaggcgcattaaaaactctagcggtaagcttgaacaagattgccaatgatattcgttggttagcaagtggcccacgttgtggcttcggcgaaatccgtattcctgaaaatgaacctggttcaagtattatgccaggtaaagtgaacccgactcaaagtgaagccatgaccatggttgttgcccaagtgcttggcaacgataccactattaatgtcgctggtgcttcgggtaatttcgagctcaatgtatttatgccagtaattgcttataacttactgcaatctattcagttgcttggtgatgcatgtaatagttttaatgatcactgtgcagtagggatcgagccaaatcgtgagaaaattgatcatttcttgcataattctcttatgttagttacggcattaaatccggttattggttatgaaaactctgcaaaagtggcgaaaactgcttataaagagaataaaactttaaaacaagttgctgtagagctaggacttgttacagcagagcaatttgatgaagtggttaaacctgaaaaaatggtttcgccaaatagtaaataa

SEQ ID NO: 3131 - DNA, 858 bp, Acinetobacter baumannii
acaaattcagcaagagaaaatcgagaaattataatgttagagcggattgttaccgcattggtacttgttgcagttgttttgggctgtatgtttgctacgcaatcacattatccaatgttggtacttatgattgtagcagcaggagttgcggggtatgaatggtataagttaatgcctcgggaagttggtgcagtagtaaaacctaaagcttggggttatggtctacttgttgcttttgtttctggcgttgccttattctttcatgacattgctttactgttatggtctgcttcaattttaacttggctcgttagtgtttattgggtcaagtcttttcctgaattcgatgggtggtataacgcgaccctatatgtcattggtttgattcttatctgtgcagcagtgactgcaatctttgtagtatggcaaagctcaccatggtggttgatgtatttgttcttgcttgtgtggggtgcagatagtggagcttactttgtaggccgtaaattcggtaaaagaaaattggcgcctacagtaagtcctaataaatcagtagaaggtttatatggcggtattctcactacaattattgtaatgcttgtggtgcaatatcaatatttaaacctaacttgggttcaacaacttctattcttgattttgtctttaactacagtgttcggttcagtattaggtgatttatttgaatcaatgatcaaacgccgtgctggtattaaagactctggccgtgttttgccaggtcatggtggtgtattggaccgtattgattctttactcgcagcagccccgatttttgcaacgggaatgtatatattaaagcttattggtgtagatttatag

SEQ ID NO: 3132 - DNA, 654 bp, Acinetobacter baumannii
agcttgccagcaagaggtagaagtgtgaataagggatatcccataactgatctggtcattctggcgggtggacaagcccgccgtatgaatggtttaaataagctgttgcaacaattcgatggcgatacgcaacttcttaagattcaccaaaagctaaaatcttcagtatctgaaatttgggtgaatagtcatcgagactattcaatctatcaaagtattgtgccagatattaaatgttttcaagatgatgcttctggtttttttggtccgcttatggggatgaaaagcacatggtctcatgtacgagcagattatgttttgtttattccttgtgatgtgacctacatacctacgcaagtcgttgcgaaattacacagcgcacttcgcaaaaataaacaggctcaggcagcttacgtttcaattaacggagatgctttatacccattttgtttgttaaaacgtgaaagtctagaagttttagagcagcaaattgataagcaacaattgagtttaaaaaattgctttaaacttttacatgcacaagtagccatttttcaaaagcagaacttatttttccatagcattaattctttagatgaacttcaacaatacaaacaaattaaagcatttaaagagattttttcgacaaattag

SEQ ID NO: 3133 - DNA, 504 bp, Acinetobacter baumannii
tcattcttggctatgaatatgttgaattatcagctagtgggcaaaactgattatgagtcagcggtagagtttgcgctttatacaagacagctcttattcccagagatctatcatggacaaattcccaaagatttaaaaaattttgagcagcattatgtccatgatccactgggctgcttcattacagtaaaagaccaaaaccgcattattggcacgattgcatatcgggcttatgaccatcgttttgatttaaatttaccgtctaatacggttgaggtggttaagttatttgtattgcctgaataccgtcgtaagggcatcgcgacccagctatgtgacatgttgtttagccatgccaaaaacagtgaaattacgactttgtatttgcatacccatccatttttaccggcggctgaagagttttggcgtctacaaggttttgaggttattcaacgggaatggatcgatacctatgacacgattcatatgagtaaatctttatag

SEQ ID NO: 3134 - DNA, 222 bp, Acinetobacter baumannii
gaaaaaatggctaaaagaaaatataagagtgataagtttcaagtacgtcgtattaaccgtcaatggtgggtacttgaaaaagatttagaaactaactgttacagcaagcatgaacaggttgctactaagacattagctaacaattatgctgacgattatatagagcagtattatatgaacctctacattcaacaacagttgaaaaaaccggaaaccgtataa

SEQ ID NO: 3135 - DNA, 189 bp, Acinetobacter baumannii
ctactgatggctattatgcttaagatgttaaagttagggccattcatttaccctaagttatttattaaaaataagagctataccaatagatcttctatatattcccagccattagctttcatctcttcaaactttctttttaattcttcttttgtatattcatgtgagtctttagctaaaagaatatga

SEQ ID NO: 3136 - DNA, 1065 bp, Acinetobacter baumannii
atacatctttttattttgcactctatttgtgcacggggtgccataatgaagttattggcttcattactaactttactcattctatgtggatgttcctcatctgagcaaaatagaaaaactcaagaaaactcaacctctcattcaatatgtgtctttgatagtacaaatacaaaagtctgtgtagccaaacctgcccaaagaattgtctctttgtttgagtcgggtttagatggcctctatatgctagggcaaggtgacaaagtaattggtatacctgctgaagtatacattcaacctttattatttaatgcctattcaaaaatagataaacgcattgctaataagcagcttgcagcaccttcgcaaggagccaatgcaaccaatattgaaagtctcgtgttgctaaaaccagatctggtgattgtaggaagcgggcagactcaaacgattgaactgttacggcagtttggcattgctgtatatgtgatggagtcaggcacctataaacaagtgaaagaagagctgtctgaaattgctattctgagcggtgcccaaaagcgagctcaggaaattttaaatttctctgatgaaattgtggcagaagtcgcagccaaaacggcccgacagccaaataaacaatcgatttactatgcttggtctggtggacgaattttttctacctctggacgagagtcgattaccaatgactttattgaactcgctggtgcttacaatattgttcagaccaatgctaaccagcctaatgtaaatcccgagactctcattgaatggaaccctgacaatattgtgctttggaataccaatcctaaattgatttatgaacgaaaagaattacagggtttaagcgctgtacaaaaccgtaaggtatttaatttgagtcctgcatttatatataacccgcacaccatcaaaatcattattacggcgatttatctaaatcacagtatttatcctgaacagtctgatttaccagtaagtgctttacaacagcgtattttaaccaagttgtatggtgagcagcttgctaaagcgttggtgcaataa

SEQ ID NO: 3137 - DNA, 1278 bp, Acinetobacter baumannii
atgaaaaatttattttctcaggttatgagagggactctctttgtctcatttttttcaactgtgcatgctagtgagctagaaattaagccaacatttgatgcaacttttggaacttttagtagtggtaaaagctataacggcgaaaacctacatgatgaaagaatcaattggcaagaaggccatcttaaatatggtgctaaaggacaatacacctttaaaagcaatcagctctatgcaagtttgagtggtattagttcggccacatttggtgatggtgacgcaggccaaaatagtaatggcaaagaacgtaaaacagatgtgaatgaatgggtcattggttttaaagacggtactaataaagatgagttgaagacttatgatttaagtattggccggcaaaatatcatgattggtgacgggttctttattgcgggtgatgcattaaaccttggaaaagcgcctgcggatggcacactagatcggggcggcgcatattatctggcagctcgtcgaagctttgattttacaagtttgcttcaatataaaccgcaagagaatacaacgctaaagctggcttatttaaagtcagacaataaagcacaattttcacctgaactatttgtgactgatctgatgtatcagcttaaagataagggcgttgggtttacctatttaaacgtattagatcttacagatgctgaacacgtttcagggcgcgaagatcttaaaaattatgctttacgtttgaattatcaacctttaccagaactgcaagttaaaactgagtttgtagttcaagataaaaaagatggccaagaaaatgctggctacttagcgctgaactataactttttatcttcaaaatatacgccttcattaggctaccgttttagtcatttttcagaccaatacgaccctatgttttatggaaatacggtcggctttggtacatggtttcagggtgaagttgctggaaactatgctggaccattcaataaaaatgcagatattcaccaagtttcttacagtatgaatctaaaagaaaattttatgttgggtgctttggcctataagtttaaaacagtaaataagtctttaactaatatagatggacatgagctggatgtcttttcggtctggtcagttaataaaaaattcaacgtgattcctttagtgggactttataaaccaaaacacgatatccatagtggtggtacacaaaactacgatgacaagaccaatgtatatgcgcagttaattttgcaatacatctattaa

SEQ ID NO: 3138 - DNA, 1089 bp, Acinetobacter baumannii
cctgaattttattcaacaaactacagcaaatgtgagcaatggtgtaaacttatcgatctgattttttattctgtgacaacacatatggcaactgtagatctttttgcaattggtaatgcattaatcgaccaagaatttaaagtgtctgatgattttcttagtcaacaaggcttacaaaaaggcaccatgcagttgtctgacggtgaaacacaatctgccctttatgaaaaattaaaacaaactcaagattacaaaggtcaagcaagtggcggttctgctgcaaatacaactgtggcatttagtgcattaggtggtagcgcattttatgggtgccgcgttggtcatgatgaattaggtggaatttacctgcaagggttaaatgatgcaggcatccagactacaccaaagtccatcagtgaaggtgtgaccggtacttgtatggttctcattagtccagattctgagcgtactatgcatacctatttaggtattaccgctgaactctctcaagaccaaatcgattttgaaccattaaaaacagcaaaatggctttatattgaaggctatctttctacaagtgaaacagcacgtaaagcggtaaaacaagctagagaaattgcaaaagctcacggcgttaaaattgccctatctttatcagatcctgcaatggttcaatatgcccgtgaaggcctagaagagcttatggatgatggtgtggatttattgttctgtaatgaacaagaagccttaatgtataccaataccactactgttgaagatgcacttactcaattacgttttaaaaaccataccgttgtgattacacaaagtgcaaaaggtgctttagttgcaaatccaactcaccattttcacgtcgcaggccgtcatgttgaagctgtagatacaaatggtgcgggtgatgcttttgcaggtgccttcctctacgcattaaaccatcatgaagatttaactgctgctgcacagttagccatcttaatttcaagtgaagtcgtgtctcaatttggtcctcgtttagccattaatgactatgctaaacttctcgaaaattttcagaaggaatgtgcttga

SEQ ID NO: 3139 - DNA, 930 bp, Acinetobacter baumannii
ccagctatttacctcggacagttttccacaacaaccatcagacaaaatttcagtaattgcttttgcagcagaataaagagaacaaagatgacgattaaacttaatccattaaatgctatcgatttttataaagctgatcacagacgtcagtatccagcaggcacagagtacgtgtacgcaaactttacgccgcgttcatctcgacttgctaaaatgttgcctgacttcgatgataaagttgtgttctttggtcttcagggttttatcaaacattttttaattgatacatggaatgaaggcttttttaagcaacctaaagacaaagtggtagctgcatataaacgccgtatggatagttcactaggtgaaggtgctgtaccagtcgatcacattgaagcattacatgacttgggctatttacctttacgcattaaagctttgccggaaggtagccgcgtcaatatgcgtgtacccgtgcttaccgtaattaataccgacccgcgtttcttttggctaaccaactatattgaaacagttttaagtgctgagctttggaaaagctgtactacggccacaattgcctatgagtacaaacgcttattaactcaatatgctataaaaactggcgcaccactcgattttgtacctgtgcaaggacacgattttagtagccgtggcatgagtggaatttatgatgcggcacaatcgggtgtggggcacttaaccagttttattggaacagactcagttgcttcaattgactacgcagaagaatattacaatgcaacaggtgtgattggggtttctgtaccagcgaccgaacacagtgtgatgtgtatgggcactgaagacagtgagctagaaacatttaaacgtttaatttgcgagctttatccgtcgggtgttgtcagtattgtgtctgatacttag

SEQ ID NO: 3140 - DNA, 306 bp, Acinetobacter baumannii
ataggtacttataaaatgaaaaataatatatttaaaattttggttttggcggtattttctacttccccactattttgttatgcaaataacacaataatgattaaaggaaatattgttgaagacacatgctcaacaaaaagtaatgagatagaatgtaacgaagtcaacaatttgaatattaaacttgatagtgaatatttaaataaagatagtctctataaattagctcaacatacagagaagatggacactagcattgaaagtctaggttctaatcgaaagattatacttatcaattatcattaa

SEQ ID NO: 3141 - DNA, 1635 bp, Acinetobacter baumannii
aggagaacttatatgaatattgtacaagacaaaaatatgcttcctgatgatcaatggattgacgtttgtgccctcgatgatttaaccccaaacacgggtgcaggagcgctagtgggcggtcaagcggttgcaatcttccgtgtggggcatgaaaaacgtgtttatgtactgagcaataaagatccgtttagccaagcgaatgtgatgagccgcgggattattggtgatttacaaggcgaacgcgtcgttgcatcaccaatttataaacaacatttcagtttagctacgggccgttgtttagaagataaagaccaaaaattggcggtttatccgagcaaaattgttgatggtcgtgtttgggtcaatgcggtgccgcaaaaaacttatattaccaatacaggtgtatcacaagacaaacttagactggtgctgatcgggaatggtttggcagggatgcgttgtctggaagatttgcttgatatggccccagaccgttatgaagttacggtgattggtgaagaaccatggggtaactataaccgtattatgttgtctccggttttatcgggtgagaaaaccattgaagacattatgttgcatccaccgaagtggtacgacgataaaggcattaaatttattgctggtgataaagccgtaaaaattgatcgtccgcgtaaagtggtttacaccgaaaaaggccagacagttgattatgaccgtttgattctggcaacaggctcggcaccatttattccaccagttcaaggtgttgacctaaaaggggtgttaactttccgcgatatttatgatgttaacaccatgattgaatactgtggttcaaaaactaatgcagtcgtgattggcggcggtttgctgggtttagaagctgcctatggtttaaagcaacgtggtatgaacgtcacggtattgcatttaatggaccgtattatggaacgccaacttgatgggcgtgcgagtcaattacttcgtcatagtattgagcaaaaaggcattcaaatcattaccgaagccaataccgaagcgttaatcggtgatgaaaatggtcatgtcaaacaaatccgtttgaaagatggcacagtgttagatgctgaccttgtggtgtttgctgtaggtatccgtccgaatattgctttggcgcaaagtgcaggattgcgttgtaaccgtggtgtattggtgaatgacaccatgcaaacatttgacccaagtatttatgcggtgggtgagtgtatcgaacatcgtggacagacctttggtttagttgagccactatgggggcaagcttttatttgcgcgacccatttagcagagcacggcagcttaacttttaaagcaccgaccgtaccgactcagttaaaggtgagtggagtcgatgtattctctgcgggcaattttgaaccgaaagatgattatgaagacattattttaaacgatgaaaaacgccagatttataaacgcattatcattcaaaacgatcgggtaatcggtgcagtattgtttggagatactgaagatggcatgtggtatgcagagttaattgcagatcaaactcctgtttcttcatttagaaataagctgctatttggtcgagattttgcattaaaaaatgcaggctaa

SEQ ID NO: 3142 - DNA, 336 bp, Acinetobacter baumannii
gaaaataattactcatttgtactaatgaaaaaattaacaatacaaacccaagaccgtcagcagattcttatagatttatataaacaatatttgttgagtgagattactttggggcaattgctatcgtatttacgcaaaaatgtgttgggtttgtcgcaagaacaatatgctaatttggtgggtataagccgtcggactttaacggacattgagctggataaaggtaaactcactcagtctgtgttagataaagtgtttaaaccacttggtttaaaagcagggcttgtacctacgcatgaacatattgttagcaaaattataaagccaaacgagtaa

SEQ ID NO: 3143 - DNA, 1335 bp, Acinetobacter baumannii
tgcaggaatttgcatcgcgttattcattcaactgaggaattgttcatgagccaaatcgttgacattcgtgcacgtgaaattttggactctcgtggtaacccaaccatcgaagcagacgtcatcttagaatctggggtggttggtcgtgcatgtgcaccatctggtgcttcaactggttctcgtgaagctttagaacttcgtgacggcgacaaatctcgttacttaggtaaaggcgttcgtactgctgttcagaatgtaaatagctcaattcatgaattgcttgttggtcaaagtgtttttgaacaaaaagcgcttgatgaaaaaatgattgcttttgatggcactgaaaacaaatctaaattaggtgctaatgcaactttggcagtatctttagcagcagctcacgcagcagcagctgaacaaaaacttccattgttccaatacattgctaacttacgtggtcaaactactttgactatgcctgtaccaatgatgaacattttgaacggtggtgctcacgcagataacactgttgatattcaagaattcatgattgagccagttggtttcacttcattcgctgaagcattacgtgctggtgcagaagtattccattctttgaaatcagttcttaagaaacaaggtttgaacacagctgtaggtgatgagggtggttttgcgcctaaccttcgttcaaatgaagaagcgattacagtaattcttcaagcaattgagcaaactggttataaagctggttcagatattatgcttgcacttgactgtgcatcttcagaattctacaagaatggtcaatatattcttgaaggtgaaggcaacaagtcttttacaagcaatcaatttgctgattacttagctggtcttgttaagcagtatccaattatctctattgaagatggtttggatgagtctgactgggaaggctggagttacttaacttcaattcttggtgataaaatccaattggttggtgacgatttattcgtaactaatcctaagattttacaacgtggtattgatgaaaaagttggtaactcaattttaatcaaatataatcagattggtacattgactgaaactttagatgcaatctaccttgctaaagcaaatggttacactactgttatttctcaccgttctggtgaaacagaagattcaactattgctgatttagcagtaggtacagcagcaggtcaaattaagactggttcactttgccgttctgaccgtgtttctaaatataaccaattgcttcgtattgaagagttaactaaagcggtttaccgcggtaaagctgaattcaaaggtttaaactaa

SEQ ID NO: 3144 - DNA, 435 bp, Acinetobacter baumannii
atgcaaattctattactactcctaaccattttagggggaatggggctatcagtcgaagctgggcttttagggccgttaggaaaggaagtaggtgagttgtgggccacttttagtatttttggtgtgggtgcagcacttacttttttactcatgttgttttttagcccacgcaatagcccttcattttttacacttccatcttggcaattgctgggtggtgttcttggccctgcttacgtcattattttgaccattaccactccaattattggcattgcaatgaccatgattgggattttagcgggacagatatctaaaagtctgattatcgaccactatggtttactgggaactccacatcgaaaagtagaccgtaaacgggtagtggcactcatctttattgttgctgcacttgtacttgtggcaaaagcgtag

SEQ ID NO: 3145 - DNA, 198 bp, Acinetobacter baumannii
ctcacttcctacaagaagtacttaaccataaacggtagtgaaccagctctgcagcttaataaggaaatctttattaagctgcataaagaattaattaattgttatttcataatgaaaattatcggccaaaccataagactcacggtattcgaccgcgacaccttcaagattttttgcaatacggcataccttcactaa

SEQ ID NO: 3146 - DNA, 1377 bp, Acinetobacter baumannii
agcgttttatacataaggattaagtgtatgaaccaaagtaatatcgctgttgaaaggacacaaaagaaaatcaatgcatatgcatggtatgtggtcatactttgtatgttggcctatatattttcatttattgaccgtcaaattctggccttgatgattgaacccatcaaagcagaccttcaactttcagatactcaatttagcttgttacatggccttgccttttcactattctatgctgtgatgggcttaccattagcctatattgctgatcgtttttcccgaccaaaactgatttcaatcgggattattgtctggagcttagcaacagcaacttgcggtttaagtaaaaactttattcaactattcctaagccgtatggctgtgggcgttggtgaagcagctttatctccagcggcctattcaatgtttagtgacatgtttagtaaagacaaactaggccgcgcggtcgggatctattcaattggtgctttcttaggtggaggtatcgcctttttagttggcggttatgtgattaacctgcttaaaggcgtgacactcattgaagttcctttattaggtgcactcaaggcatggcaaattgcctttttagtggtggggttacccggcattattattggtttgctatttattttgacagttaaagatcctgcacgtaaaggacagcagctcaaccaaagcggacaagttgaccaagttaaattcacgcagtgccttcagtttatcaagaaacatgcaaaaacttttgcttgtcactatttaggttttaccttttatgcaatggcactctacagtctgactagttggacaccagcattttatattcgtaagtttcaactcgcgccgactgaaacaggctatatgctcggcactatattgctagttgcaaatactttaggcgtgttttgtgcaggatggctaaacgactggtttattaaaaaaggacgccaagatgcaccgatgttcacgggtgtgattggtattgttggcctgattattccaattgcatttttcacccaaacagatcaactctggctttcagtaactttgctcattcctgcaatgttctttgcctccttcccacttgtgatttcggcaacagcattgcaaatgttagcacccaaccaatttagagcacgcctttctgccctattccttttggtaagtaacttaattggactaggtgttggtacaacattagtggcaattattacagataaggtttttggcaatccattaatggtgggttcttctttatctattgtgggtggtttgtcctgtgtactggctttggctctactttttaaaggctgtaaatcctttagtgaaagcatgaagcttgaaaaattacgttaa

SEQ ID NO: 3147 - DNA, 252 bp, Acinetobacter baumannii
gtggtcgtatattcatcttttaccttaaattttaaaatgagcttaatgcttatagcggtgattaagctcaactgtaccgatcggtactctactatcttattaaatttacgtcaattctcgattttgaacttttcgatgagttacactaagaatgaaattgctaaatatgtttgtagggtcgtatgtctgattgcactaaaacgaatgagaaagatcaaaaaattctggatgcagcaacaaagttttttctga

SEQ ID NO: 3148 - DNA, 699 bp, Acinetobacter baumannii
aaatatacatatcacatagttaaaagatccaagctaaaggttaaatatccttacaaatcgaatttcattatgtgtgcaaattttaaaccccttaagagagagcattcttatcaattagacttacttgaacccacctttgattacaaatcagatgtctatccaagtgatgattgcccaataatcttatctcatcaaaatgaatggaaatggcgaaaagttaaatttggaatgttgccaccatatgcgaaagaagtttcatttaaatatgcaacttataatgcaagaactgaaacggttgatcacaaacgttcatttaaacatgcctggtcaaatgatcaatttggcctagttcctgttgaagctatttatgaaccgaaatatatcaatggtaaagcacattggtatggcatctttcgtcaagatggaaagccatttacgcttgcagcaatttatgaagaaaccataattgatgagcagaaagttagaacaatgtcactattaacaatcaatgcagatcgacattcttttatgaaacagtttcataaacctgacgatgaaaaacgttcaattattgtaatacctgaccatcttagaaacgattggttaaactgcaaacacactgacgctcctgactttttcttagatatgccattaaatgaatttacgtctctgcctaaagcagaaatgaacaaatcataa

SEQ ID NO: 3149 - DNA, 822 bp, Acinetobacter baumannii
gattatgatttcacaccaaaaaacagagcaggcatgagcaatcacgatttaatccattctaccgccattattgatccatctgcagtgattgcttcagatgttcaaataggaccttattgtattattggtcctcaagtgactattggtgctggtactaaattacattctcatgtggttgtaggtggttttaccagaattggccaaaataacgaaatctttcaatttgcaagtgttggcgaagtttgccaagacctcaaatataaaggtgaagaaacgtggcttgaaattggtaacaataatctaattcgcgaacattgcagcttacatagaggtacggtgcaagataatgcattaaccaagataggtagtcataacctattaatggtaaatacacatattgcacatgattgtatcgtaggtgaccataatatctttgctaataatgtaggtgtcgctggacatgtacatattggtgatcacgttattgtaggtggtaattctggaattcatcaattctgtaagattgattcttatagcatgattggtggggcatctctgattcttaaagatgttccggcctatgtgatggcgtctggtaaccctgcacatgcgtttggtataaatattgaaggtatgcgaagaaaaggttggtctaaaaatacaattcaaggcttaagagaagcttataaattgatatttaaatctggattaacttctgttcaagctattgaccaaattaaaagtgaaatcttaccttcagttccggaagctcaactcttgattgattctcttgaacaatcagagcgtggaattgtgcgctaa

SEQ ID NO: 3150 - DNA, 2085 bp, Acinetobacter baumannii
caaggagcatacatgtatcaagtacttgctagaaaataccgtccacgtaatttcaatgagttagtgggacaaaaccatgtttctcgtgcattaagtagtgcattggaacgcggtcgtcttcaccatgcttatttatttacaggaacgcgtggtgtaggtaaaactacaattgcacgtattttagccaagtgtttgaactgtgaaacaggtgtgacttctacgccatgtgaagtctgcgcaacatgtaaagcggtaaatgaaggccgctttattgacctaatcgaaatcgatgctgcttcaagaacaaaagtagaagatacgcgtgaacttttagacaacgttccttatgcaccaacgcaaggtcgttttaaagtttacctgattgacgaagtacatatgctctctacgcattcttttaatgcgttattaaaaacactagaagaaccaccagaacacgttaagtttttgtttgctacgacagacccacaaaagctaccgattacggttatttcacggtgtttgcaatttactctaagacctttagctgtcgatgaaattaccaagcatcttggcgctattcttgaaaaagaacagattactgctgatcaagatgcaatttggcaaattgccgaatctgctcaaggttcattacgtgatgcattatctttaactgaccaagccattgcttatgggcaaggtgctgtacatcatcaagatgttaaagaaatgcttggcctgattgaccgtacgatcatatatgatttgattttagcggttcatcaaaaccaacgtgaaaaagtgagccagttattactccaatttagatatcaagccttagatgtctcgttagtactggatcagctcatttcaacattgcatgagttggctttgttacaatatttaccagagctcggcttaaagtacagtgaagaaattaatgccaaaattcttcagctttctaaactgatttctgctcaagatttgcagctttactaccaaatcgcatgtaaaggccgttcagacttgcagcttgccgtaacgcaagagcaaggttttgaaatgtgcgttttacgattattggcattccgtcctttagcaccaaatgaaattttagtttcagagcctgttcaacaaaatgggcaagtagaagtaggcctaaattcacaagctcaaacagcccaagagattgctcctgtaagtgctgttcagcctgttgaagtgattagccaacccgctatggttgaacctgaacctgaacctgaacctgaacctgaacctgaacctgaacctgaacctgaacctgaacctaatcaggacttaatggtatttgacccaaatcatcatgagttgattggacttgagtcagcagttgttcaagagaccgttagtgttcttgaggaagatttcattccggtaccagaacaaaagttagtacaagttcaggctgaaacccaagtcaaacaaatcgaacctgaaccagcttctactgctgagcctataggtttatttgaagcatcgagtgctgaattttcacttgctcaagatacgtcagcttatgacttggtttctgaacctgttattgaacaacagtcattggtgcaagctgaaattgttgaaacagttgcggtggtaaaagagcctaacgcaacagataacagccaactgatgccacaagatattttaaagttgccatcacaaaatttggaaggtgagtggacacttgaaaagtgggagttttggtttagaaatagccagctttctccagccgttcaagaacttgctcaacatggtgtgatgactggggaaattggtggcaacacggttttccatattcctcaagaatatgaaaatatgttgactcagctacaacaagccttaattgaagctttaaagcagcagtggccaaatacacaatttacggtcgagtatggtgcagtcaatactgctacaccgtatgttatgcaaagcgttcgtaaagaaaaagctttccatcgggctacagaactattacagcaacaacccgttattaaaagcctcatagagacttttgatggtgagctgcaaaatattcaattaaagccttaa

SEQ ID NO: 3151 - DNA, 225 bp, Acinetobacter baumannii
aaagttcaatacaaattaaccataacttcgttcatcttgcgctttgccaaagctttagctgctttgtcttgctcaggtggcatttttttatacctatacaaaaccaaaattacctatttatctaaagccttacttcgccacttcagtcgtgacttagaaagtcccccttatccagcatttatttgtatagatatttctactcatcaatatttgtttacgatttga

SEQ ID NO: 3152 - DNA, 444 bp, Acinetobacter baumannii
acattagaatacttattacgcatcacagctatgaagaaaaatacaaagcttgatcaagacaagctatttattaaattattatttaaatctacctctgaagtaacagatgaggaaattgagtactatcgaaagtatcccgaccaaattgaccaagtcactgcacccctaaacattcataaaatattcttgtgggcgggcgccttattgggagttgtggtggtagctgtagccaaatttcttaaattttcaggctcattagattttttgtcagagggagtgctcgagtttgttatagatattatttatgaaaccggtatagccttaattggcgctgcggttacagcttatatgttaggtgtcctattaaacaaacaacaggaaaatgccacaaaatggcgagaagagattcgtagaagaataaaagagagtgagggggcactttaa

SEQ ID NO: 3153 - DNA, 501 bp, Acinetobacter baumannii
tacagtgatttactcactttcatctgggcttccatagaaatgaatagattacaattaattttattagttttaagtactgctactttttctccttttgtattttctgaaacaactatctccccaaccaaatatgaattttatggacaagagtcaaaacgccataagagtatgcttgaggtaaataatagttcagatcataaaattaacgaatcacaacacaatcctttccgctctgattcaaacaaacaaaacgtagatttttttgagattgcaaaacactaccaagaacagcaaccacaaaacacttattctcactctcccgaccatactgtaaatatgagtgatcatgaacgaagtctctattacattagaaatcatgacaatatgggccttcaaagagatgttcgttatcaacaatataggtcattaaaacaacaatatgataaaggtgtcatttctcgtgatgaatataaaaataaagtttacaaaatctcaagataa

SEQ ID NO: 3154 - DNA, 1113 bp, Acinetobacter baumannii
aacttcatgtatagaaccatagaaaccatacttgtggatattccaactatccgtcctcaccagttgtctgtgactactatgcgtacccagactttggtactcgttaaaattacgaccacggatggtattgtcggttggggtgaagccaccaccattggtgggctgaactatggtgaagaaagtcctgagagtgtcaaagccaatattgatacctactttgcaccattactgacatcagttaaagatttaaatgttgcacaaacactaaaactgattcgtaaaaatattaatggtaaccgctttgctaagtgtgccattcagactgccctacttgatattcaggccaaacgtttaggtgtgccattaagcgaagttttaggtggacgtctgcgtaatagtttacctgtgctttggacgcttgcgtctggtgacacggaaaaagatattgctgaagctcgcaaaatgattgagctaaagcgccacaacacgttcaaacttaaaattggtgcgcgtcctttacagcaagatgttgaccatgtgattgctattaaaaaagcattaggagctgatgttagtgtacgtgtagatgtaaaccgtgcatggtcagaacttgagtgtattcatggtattcaacagctacaagatggtggaatcgatttaatcgaacagccatgtgccattcaaaataccgaagcacttgctcgcctcacccatcgttttgatgtcgcaatcatggtagatgaagctttaactggccctgacagcgcataccgtattgcaaaaaatcatggtgcagatgtatttgccgtaaaaattgaacaatctggtggtctgattgaagcatgtgaagttggcaaaattgctggtttggctggtatcgacctatatggcggcactatgcttgaaggccctataggaagtattgcatcggcccatgtatttgcaacttttgaaacgttagcgttcggtactgaattatttggtccgttattacttaccgaagaaattttaaaagagccgctacgttacgaaaactttgaattgcatttgccgacagctccgggcttaggcattgaaattgatgaagataagattgagaaattacgtcgttaa

SEQ ID NO: 3155 - DNA, 564 bp, Acinetobacter baumannii
aattggtcgtactttctaagtacgatctttttgcataacgaaataaggaaagagatttacatgaataaattaaataaattaattttagggttaggcctgacagtagcttcagtagcagctaatgcagctggttatggggtaattgatcttgctaaagttgttgaaagtagtacttatttgaaacagcaaaatgcaagcttaaaccagtcagtgaaaccaactacaactaagcttgagcaattaggtaaagagttagaagggcttcaacgtcaagcgcagactcaaggccaaaaaatgaaagaagatgagattaaaaaattacaatctcagtatcaatcgaaattaaatgaatttaattcaacacagcaaggcttacagtcaagagttcaaacgagtttacaaagtatgaatacaacttttgagactagagttaagcaagctgctgagcaattacgaaaagaaaataatcttgactttattttgaataaaaattcgactgttgcctatgacgctaagtatgatttaactgataaaatgatacaaaaggttaattcaatgaaataa

SEQ ID NO: 3156 - DNA, 603 bp, Acinetobacter baumannii
aaagttgagtattggatgccaaatcaatttgaaacacatacttcagatgcgggaactactattcatttaaaaatgaacggtgagcttatagaaaatctaatagctttggactgtatagcgataactttgtttgacattgtatttgtatatggtgtttatgaagtgtatgcagaaaatgatagtgttctaacacttgttttaatatttctagtattaccatttattttctacttacattatgaatatagaaaaaataaacgatgggctaaaaatgcagaggaaatattttttatttctaaaaacaatcttcacatttccaaagaatgtcttggggaaaagttgttaacaaaggatattaatactcaaaagattattgaaattgtctacagaccgtggggtggacgcacaaatccgccgtttttaccagattgtggccaaggtactattcacttaattggatatgaaggtggttgttcatttggtattaatcttaacaaagaagaagcagaggcattcattaccgaattgcgttcattaattatgcaatatcaagaacctagacactttatttttgccccgcatatgcatttagcaaaagattga

SEQ ID NO: 3157 - DNA, 498 bp, Acinetobacter baumannii
atactggagtaccatgaaatgctacaagatattggggaccagtatccaaatggcgcaattaataaagaaattattgaaaattttgcagctaccttagaggtaacatttccgccagaatatgttgaacttatttctcaacatgatggaatttatcccgtaatttctagctttgactatgttgatactgatggtgagctaaatatcagtacattagaattaggaggatacttatatgaacctcgaatagaaggaatgcaatttcctgaaggtgatgatgactatgagggaaaattaattagctttggagctacacctagtgggaatttcatttgtttcgattacagatttccttggatcaatgatcaacctaagatcgtgcttgttttacacgatgaattctataattttggaatgaacgagggtaaaagaaaggttctgtatctagcagataactttgtgcattttataaattcattacatgaatttattgagtattag

SEQ ID NO: 3158 - DNA, 759 bp, Acinetobacter baumannii
agtgactggtatatgagaaagtatgacaatgctacaacggtagagaatgaaggtgaaatactagcaggcttccaatacagaagcttgctgagttatcaggcttattatcatataaaagatataaagtatggttcgaagaaccgatcaactctggatttttttcctctagaacatgtcagtaaaaccgtaatttttatacatgggggatattggcagtggtgtgataaatcggactttgcctttatagcgccgtacatattagcaaaaggagcgcagtgtgtacttttagaatatgacttggctcctcaaagtcatatttcacaaatcgttgctcaaactcaacaagcgctcgattttatcgctaaacaaaattggaaaataggcgaagtagtagtggtcggccattcagcaggtgctcatcttggtgctttatgtttaaaccatccgttattatccaaggcaactttattaagtgggatttatgatttattacctatacaagagactcatttaaatcacgctttaaacttatcgcaagaggatattttgaaatatagtcctattcatcagcaggaacagatcaatattccttgtacgattttgtgtggtgggttagaacttagtgaattaaaatggcaaagtcaaaattattttgagtaccgacttagtcaaggtgaggatatgatttcttttgaaattattcctgagattaaccattactctattttagagcactattttaaatttatatttaagtga

SEQ ID NO: 3159 - DNA, 513 bp, Acinetobacter baumannii
agtcaagatttatgttatatagctcatcaaattttaataaaacgaataatggaaattatggatttatcaaaagctgtacagctggctattgtctttagtggcgtctttttatggataggaatgttaactggagtatggaaatattggcaaattcgccgttccgaattaagccgcgcacattattatgtagatattgcacatagaagcagtttgctttatgcagcagccacacttattctggctgtattgagctatttcacgattttaaatgaagatattgctttatggtgtgtattggcaaatatactgttttttagtttctcaattttagtttatatcatccacggatttttgcaggatacgaccaatcagtttaaacaacctcataggttagggcattttagtttacctacatggttgatgacgtttatgatgttcgctttaattattactgagctattagcaactgttattttagtgatggggacaattttattgtttttaagcaaataa

SEQ ID NO: 3160 - DNA, 1494 bp, Acinetobacter baumannii
gaaaaaaatctcatcttaagttcaatgcatcaggggaaatactcaatttcctctgatgcttcatatgctcaaaatttactttatttggagaatactatgtctaaatcggcaatcgtatctcgtggactcattctttctacactctcaattgcactcgttgcatgtgtcaatatgcaagcgccacagcctgcaattacatctcatattcctcaaaattttagtcaaaatcattctggaaaaacgattgcagaaaaaagttataaagaatttatttctgatccgaaattagtacaggttattgaaataggtctaaacaataatcgggacttacggactgctacgcttaatattgagcgcgtacagcaacaataccaaatcacaaaaaatagccagctcccaaccatgggtgtaacgggaaatgcagtgcggcaggttagcccatcgattaaccccaataacccagtttctacatttcaggtgggtttaggaatgactgcatatgaactagacttttgggggcgtgtgcaaaatttaaaagatgctgcattaaataactatcttgcaactcaaagcgcgaaagaagctgtgcaaattagtttaatcagtaacatcacacaggtttggttaaattatgcttttgcacaagccaatttaaatcttgccgagcaaaccttaaaagcacaagtcgatgcttataatctaaataagaagcgctttgatgttggtattgatagtgaagttccattaaaacaagctcaaatttcagtagagactgctcgaaatgatgttgcaacttatgaaactcagatcttacaagcaaaaaatttactggatttgttagcaggtcatcctgttccgcaaaacttacttccggatcatgctattcaaaatattacctttgagaaaaactttgcagccggtttaccaagtgatttattaaatcatcgtccagaccttaaagctgccgaatatgagttacgtgctgcaggagcaaatattggtgctgcgaaggcacgaatgttcccgaccataagcctgacaggctcgacgggttatgcatctactgaacttaaagatttatttaagtcgggtaattttgcatggtcaattggaccaagtattgacctaccaatttttgattggggaacaagaaaaactaatattaaaattgcagaaactgaccagaaaattgctttagctaaatatgaaaaagccattcaatcagcttttcgtgaggttaatgatgcgcttgctacacatgcgcatattggtgaacgattagacgctcagcgtcgcttagtctctgcgactgctgcaacctataaactatctatggcgcgctacagagctggcgtggatagttattttacggttttagatgcccaacgttctgcttacgcagcacagcaaggcttgcttgcgcttaagcaaatgcaattaaataaccagattgaactctataaagttttaggaggaggaacatcaaaagtctaa

SEQ ID NO: 3161 - DNA, 1401 bp, Acinetobacter baumannii
tcgccaattcatgtgagagttattatggaagatatcaaaaatgtcactgctctcgaagagcagacaattaagcgtatttcgagtcgaatcatcccgtttcttattattttattcattatggcctttctagacagaaccaatattggttttgctgcgctacatatgaatgatgcaattggaattacccaaactatttttggcttaggggcgggtgtatttttcttgggttattttattgcagaagtaccgagtaatgttttacttcatcggtttggtgcacggatctggattgcccgaatcatgattacttggggaattattgccgggcttatgggatttatccatagtgggactcaatttattattttacggtttttactgggtattgcagaagcgggtttctttccgggggttattttttatttaaccttatggtttcctgctaaatattgtgcccgtgtcttcgcgactttctatttagggttaccaattgcccaaattattggagcgccaatttcggttggtcttatgcaatggggcaataccattggctatgaaggctggcgtttgatgtatgttttagaagggattccttccattattttaggattagtctgtctaaaatatttaaccaataacccgaaagaagcacagtggttaacagctgagcagcgccaatggctcatgaatacgctagaacgtgaagaaagagaaaaagagcaatctgccgatgctgctttaacaaaaggtgaactcattaaacaagtgtttaaaaatcctttagtgtggattatggcaattgtttattttggaattacgtctggttcaaatgcgatgttcttcttcttaccaagtgttttagagtcgttccgtaacacctttggtatgcaaattagccttatccaaaatggcttactcaccgctattccatatgcatttgcggcggttggtatggttttatggagccgccgttctgatcgtaaacaagagcgttataaacacggtgcttgtgctgcacttatggcggctttcgcaattgcaattgctttgattgtgaatcaaccgtgggcaattattgtgggctttattttgctcgcaattggtgtatttagtgcgattaacattttctggactattcctgggcaaactttaacaggagtgggtgccgcagccggtattggcttaattaactctgtaggtaatttaagtggttttactggtccatatttaacaggctatttatataccaccacgggcacctatacagtagcgttccttgctattgcaggatttgtcgccatgggcggtttagggttactgcttttggcaaaattaaagtctgatagcctaaaagtagaacaacagcgacttaaagtgcggactgctacggagatgaaataa

SEQ ID NO: 3162 - DNA, 597 bp, Acinetobacter baumannii
gtaatcactcaattattttatttgtatatggctcgtcctcgtagtgaagataaacgtaatgcaattttaagcgctgctatcaaaacattggcagagcttggtgagcgtgcgtctacctcaaaaattgccaaagttgctggcgtagcagaaggtactttatttacctattttagtaataaagaagagctgcttaaccagttatatctttcgctaaaggctgagttacgtcaggtgatgatgcttagttacccgactaacgctgacctgcaaacacaaatgtcgcacatttggcaaagctatttggactggagtctagaagctccccttaaacgaaaagtgatggcgcagctttcgacctcggaacaaattactgagcaaagcaaacaaattggcatgcaaatcttttgtgacctcacccaaaacattcaagaatgtattaatgatggcaaattaagagattatccgccgttatttattgcttcaattttaggtgcgcttgctgaagttacactcaattttattgcccaagacccttctcaaaccgagcgttatcgtaaatctggttttgaagcgttttggcacgcagtttcactatag

SEQ ID NO: 3163 - DNA, 915 bp, Acinetobacter baumannii
tggggaactcataacctaactataagaattaatttgttattgagaatgattatgtcaaaaaaatttgaatatttcgataatccaagacaaaaggcattactggggatgaagaatagtattcctacagaacagtgggaagaaaatctaaaatttctcaaacaattaagagcgagaattgctgaattaccagtatgtaaacatccggcgatcgaagttttaaataatggattgcttgataaattcactttaacaagaattcatttagaatatcgtcatgcgattgttcagatctttactgatgccttattaatggcccagttccagacaaaacaattggagcctaaactccattctggagctaaaatgtttccacgtgttttattaagtttaaatgtacttgatgaatttggttttagaccaggaacagacccagacaattattatctaggtaatccagagtatgcacattatcctttatatgaagatttattaaatgattatggtttgagtgagaaggaccgtagagagtatcaaccttcaaaaattgcagatcaggtaagaaattttctagaatcatcttatgatagttatattaaagtagttgctttacttgcagtggcggaagaagaagtgattctttttagcccaccacttcgtgaagcgactaaagccattggcgtcgatgttgaaggtggcggctattaccatgttcatggagtatctactgacgaaacctcagaagcagcagatgatgatcatgaagatgatctctggtttgcattagcgcaagcaataactaaagaagactatgagagcttaacaacgctttgtatggattactgtgctttatggaatgagttttgggatgcacaaattgctgatattcactatttagaagcaaagaagttagcataa

SEQ ID NO: 3164 - DNA, 195 bp, Acinetobacter baumannii
aattcatatcagaataaaattaaaaaaaatatactttttaagtggttattggttaagaaattgatatatgtgtattgttatatgaaattaaaagatataaatctcatatatagaatagaagggccgagcttgaaaaaaatgacgatacaactattaaagtttaaaaaattctgttttattaatttatcatcttga

SEQ ID NO: 3165 - DNA, 567 bp, Acinetobacter baumannii
tggaattgtcaagtaatttttctaatgtgtgttcaaggaaatatgcaaaattttgtttataatagaattaccctttttttactaagttattgcttagctatgcttgatcatttagaacaatttcttcccaataaagaaccgtcgagtattcaaaacttcccctttttctggatttcccaagttaatggtaaatattcacaacttattgaaaaatctataaagaaacttggcattgataatactcgccgcaaaattattttaagcactaatgcgcttggggaagccagtatcactgacattgccaatctttctactttaaaactcacaacagcaacaaaggctgtatatcgtttggtagaagatggaattgtggaagtctactcttctaccgctgatgaacggatttcgatggtgaaattaacggccaaaggtgttgagcttgttgaacagattaaccaaattagtgtggttaccttagcggggatcctcaatgctttttcagaagatgaactgcataatctaaatcatcagttaaaaaaattatttgatctcatgccatcaagttaa

SEQ ID NO: 3166 - DNA, 1101 bp, Acinetobacter baumannii
acatcctgtcatactaccgcaagtatagattcaaaatttgaggtaatgcacgtgatttctgtcggaattgttggtggaactggttatacaggcgttgaactattacgtattttattacgacatccaaaagcgcaggttcgagttctgacttcacgtacagaagcgggcaaaccagttgctgatatgttcccaaacttacgtgggcatacagatcttcaattttcagatttaaacattgatgcattaaaagagtgtgatgttgtattttttgcaactcctcatggtgttgcgatgcaacatgcgaaagatttgattgcagcaggcaccaaagttattgatttagctgctgactttcgtttacagaatcttgagcaatttgaaaagtggtatggtatggagcatgcttgcccagatgtactaaaagattctgtttatggtttaaccgagttaaatcgtgaaaaaattaagcaagctcaagtcattggtaatccaggttgttacccaacaactgttcaactgggcttggctccacttttaaaatcggcacaagcattgattgaaacaaagaatattattattgatgcaaaatccggtgtttctggtgctggtcgtaaagcaagtttgggcatgatttacagtgaaaatgcggataactttaaagcttatggtgttgcaggccatcgccaccatccagagattgtagaggctttggaaaatattgcagctaagaaagatgtttttgagggtcttttatttgttccgcacctagtaccgatgattcgcggtatgttaagtacaatttatgtagacttgacagaagcaggtaaacaaacagatttacaagctttgtatgaaaacttctatgcaaatgaaaaatttgtagatgtcatgcctgcaaatagttcacctgaaactcgcagcgtgcgcggagcaaatgaattacgtattgctttgtataaaccacaaccaaataaactcattattttggcggctcaagataaccttgtaaaaggtgcatctggccaagctgtacaaaatatgaaccttatgtttggctttaatgaagatgaaggcttacaagggattggtttattaccataa

SEQ ID NO: 3167 - DNA, 2283 bp, Acinetobacter baumannii
aaagcctgtcatgcgctgtgctccataaacttaaataataaaaagaatttgatcatgattacacgtcgtaaatttttaaattactctttaaatatgggctttggcgctgcagcgttggcggctttcccatcgagtattcaaaaagctctagcaattcctgcaaataataaaacgggcactattcaggatgttgaacatgtcatcatcttaatgcaggaaaaccgatcttttgaccattattttggtacgttaaagggtgttcgaggctttgctgaccgttttacgatccctctaccaaatggtcgccgtgtctgggaacagctgagaagtaatggtcaggttttaacgccttttcatttggatgggacggccaataatgcacagcgtgcagatggtacgcctcatacgtgggatgacagtcagttggcgtgggacaatggacgtatggcaaactggccaactcataaaaccgatatatctatgggttattttaaagaaaaagaaatcccatatcagtttgcacttgccaatgcctttacgatttgtgatgcctaccattgttccatgcacaccggaacagatgcgaaccgctcttttcatttaactggtaccaatggtgcaacaccgactaagcgttcatttgtaaataatgaatgggactggattgatggtaacccagcgacggcagacagtggttacacttggaaaacctatgccgaaagattagaagaagcagggataagctggatttgttatcagaatatgccagatgaatggggcgataatatgttgggtgcattccgttcttttagaaaggccaacattgcatccggttatcccgtttcaagcggtggagagccgaataaaccgtatgctgatacggggcaaaaactaccgtataaagcctatgatgcggctactgataatgctaaaaatccactctataaaggcattgcaaatacgctaccgggcaataaaccagaagagtatctcgacgcttttaaaagagacattcgtgaagggaagttacctcaagtttcttggattaacgcgccatcgatatactgcgaacatccagacccttcaagcccggttcaaggagcttggtttattcaagaaattattgatgcattaactgctgtgccagaggtgtggagtaaaacggctctgctcatcaactttgatgaaaatgatggttactttgaccatatgccatcgccatcagcaccatctcgactcaaaaatggccagtacgcaggtaaatcgacactaagcaatgctgatatgcaagatgaatattttgatcatgctgcacctgaggggagtcattcacagcctacacctgatggacgagtttatggcccgggtcctcgtgttcctttatatgtgatttctccatggagtcgtggcggttgggtcaactcacaagtttttgatcatacttccgtgctcatgtttttagaaaaacgttttggtgtaaaagagccgaatatcagtccataccgccgtgcagtatgtggtgatttaaccagtgcatttaactttaaaacaccaaatgcagatgttttaccgcagctgagtggtaaacaaacacgtgtgcaggcagatgcgctaagggaaaaccaagaagctttgccagctgttcctgtacccacggatattaagttacccattcagcaaagtgggatccgtctatcacgggcgctaccttatgagttgcataccagtgcgtgttgtaaagcagatggtaaggtgcaattgattttttctaatacgggtaagcaggcagcggttttccacgtatatgacaagctcaatttagaccgtattccaaagcgttatattgtcgagccgaataaaactttagatgatgagtgggatgctttaaacaataacttaggccgttatgacctatgggtacttggtccaaatggctaccatcgtcattttaaaggggatactcaacgtattatcgatagtggtgttaaacctgaaattcgagtgtgctatgacattgctaatggtgatgtttatgtcgaactcatgaatgagggaaccaaggatacaatattgacaataaaaccttgtgcatatcgacaagatgcgccattgcaactgaccataaaagcgggacaagttgttaagcaacattggtcattggctgatgttgggcattggtatgattttgaagttacgagccagagtgattcgtattattaccgacgttttgctggccgagtcgaaacaggtgaggattcctttagtgatcctgcaatgatctaa

SEQ ID NO: 3168 - DNA, 579 bp, Acinetobacter baumannii
acctgtttccataacggcttggaacatgagaagttgttcttgattaatattcatctgtcaaaaaaaatgaaagaacctgattggattaatcaaaattataaaaataaaatgcacattatccaagttattattgagtatttaaaaatgttgatttccaagagaagactcattcatgcaatcagttatgaaggaattttgttggtcatcattgcgattgcattaagttttatttttgacatgccgatggaagtgaccggaacacttggtgtgtttatggcagtggtttcagttttctggaatatgatttttaaccactatttcgaaaaagtagaacataaatttaattgggaaagaacgatccctgtgcggattttacatgcgattggttttgagggtggtttgctgattgcgactgttccaatgattgcatatatgatgcagatgacagtgattgatgcatttattttagatataggtttgaccttatgtattttggtttatacctttattttccagtggtgctatgactatattgaagataagtttttcccaaatgctaaagcagcatcacttcattaa

SEQ ID NO: 3169 - DNA, 1080 bp, Acinetobacter baumannii
gtttcagtccaaaggaaaagaccaatgaatgccttaaatactttactaactcaaagcaatacaaaagaaacaccagttagtttacctgttcagttaaaagctaaatacccgcttgtgcagaccttcgcacgacaaattgcagaacatcgtcaaattattcaaaatattcttgctggcaaagatcagcgcttaatggttattacaggaccatgttcaattcatgacccagttgctgtacttgaatacgcagatagattgcaaaaattacaagaaaaagtaaaagatcaaatcttcattgtgatgcgtgcttatattgaaaagccacgtacaacagtaggttggaaagggtttatgtatgacccaaaccttgatggttcatctaatctacaattaggtttagaaaaatcgcgtgagctatatttacaaattattgaaaaaggcttgccgattgcgagcgaaattttaagcccactggcaacaggctattttgatgatttattggcttggggtgcaattggagctcgtacgagtgagtcccagattcaccgtgaaatctcaagtcatatgccatacagtattggcttcaagaatggtacggatggctcaattcaaattgctttagatgctattcagtctgcacaaaatgagcatcaatttttaggtatgaatcagcaaggtttgccttcagtgattcagagtgctggaaatccattgccacacttgattttacgtggagccaatcatggccctaattatgatttggcttcaattcaggcaattagagaaaagcacaaacaaaacctacctgctttagttattgactgtagtcatggcaacagtggtaaagatcctttacgtcagccagaagttttacagcaaatcgttgctgaacgtctaaaaactcaggtaaagggtgtcatgattgaaagccatttagttgatggtaaccagaagatttcatgtgaaatgacttatggtcaatcggtaacggatggttgtttagggtgggataaaactgaacagcttttgttaaatgttgctaaacaattaaaagccagtgaattagctcattcggcttaa

SEQ ID NO: 3170 - DNA, 1263 bp, Acinetobacter baumannii
gtgcaataccaaatgattactcgtgaacagtgtttgtattgggatcaggaagatgaactcaaaaaatttaaagatgaatttgcattgccagaaggcgttatttatttagatggtaactctttaggtgctagaccaaagaaatctttggctgtcgctcagcatattatttcccaagaatggggagaagatctgatcaatagctggaataaggcagactggtgggggctaccaacacggctgggtgacaaagtcgctaaactggttggtgcggaacaaggtgaagttgttatttcagattcaactacactgaacttatttaaagttttatctgcagcggtaaaaattcaggctgataaattccctgaacacaaaattattgtggcagaaaaagatgcttttccaacagatatttacattattgaaggtttcattgacttaattcaaaagggctatcaggttgaattaattgatggcgtagaagacttatctcgtgctttagagaaagatgttgctgtagtggtactttcccatgtgaattaccgcactggttatttttacgatatggcatctattaatgaacaaattcactctaaagatgctttggtgatttgggatttatgtcactcagtcggtgcggttcctatgcaccttaatcaaactgatagtgattttgcgattggttgtacctataaatatttaaatggtggccctggttctcctgcattgctctgggtcaatgaaaagcaccgtgatcagttctggcagcctttatctggttggtggagtcataaaaaaccatttgatatggcacagcattatgagccagcgaatagtatccgccgatatttatgtgggactcagccggttatttctatgagtctgattgaatgcggagtggatattttcctgcatgccgatatgcaaaaaatccgtgagaaatcgttgaaattaactgatttatttattcaattggtacagcaagaatgttctgaattcggatttgagttaattacgcctttaggtcataagcatcgtggtagtcatgttagttatcgtcatgaattcggctatgaaattattcaggcgcttatcgcacgtggtgtgattggtgattatcgggaacctgcagtcttgagatttggtattacacctttgtatctgggctttgaagatatttggaatgcagtacagcacttaaaagaaaccatgctgaatagtgaatggaaaaacaaagagtatttagttcgcggtgaagtgacctga

SEQ ID NO: 3171 - DNA, 918 bp, Acinetobacter baumannii
gggatgaaccaatatgtaagtgatgcattactcacatggacgcaccatattaaaagtgtgtgcggcaattttgaaaccgattttgacggaacccgtaatttattcattggtgaggttcagtgctttttattgggcgataccgaaattgcttttatcaaaaacaatgccaataaaagtgtccgaaaagccgatgaaatcgatcgagtaaataaccggttttgttttttgattttacagtattcgggaaaaatgctgctcgagtataagaatgaaactctcagcctaaatgaaggcgatattgtgttagtggacccggtcgaaacaatttcgatgtatccgcaaggtttggtaagtcagatttccgtacacctgtcgcgtgaaaaattacttaaagaaaatattagtaccgaatattttggaaaactgattactcaaaatatgagtggttttttactcaagaatattttgaaaaatatgtctgctgaaaacatcaaactttggtacgcaaccgaagatggtaacgcttttgaagatgcactgattgctctaatcaaacccacaatcaattataaaaatgttcatagctccaataatctgatggaaaaagccgagcgctatattatagaaaacttagcaaaacccgatttaacccctaaattaattgcagagcatattggagtatcactacgacatctctaccgtttattccttcaagaaaacctatctattaacaaatacatacagctaaaacgcctagaaaaagtcaaagcggatttgcttgataaaaagaacaaacaaagctcgattacccaaattgccttgaagtggggtttctgggacggtgctcatttttcaaaaatctttaaaaagacctatggtatctctcctaaagagtttagagagggtatgacagtttaa

SEQ ID NO: 3172 - DNA, 393 bp, Acinetobacter baumannii
acgtatgaccatagtgaattctcaatgagtacattactactaataacctctgctcctacttcaatccatgcttggcatgcactgggccttgctcaggcactcaaaagtaaaaatgaagactttcgtgtattcttttaccaagatggcgttcaagttgcgaatgactttcagtgggttcctgacgaccagcgtaatttaacgcatgaatggcaaaagctcgcgatccgacttcctgtctgtgtcagcgctgctcttgcacgcgggattaccgatgcagaaaatgcgagtcgtcatcaacttagtcatcacaacctagcgaacaactttgagttggttggactaggtgaacttgctgatgcagtacagtcagcctctcgtcttcttcaattctaa

SEQ ID NO: 3173 - DNA, 183 bp, Acinetobacter baumannii
agttcacgccaaaaatatttaaatgtacctatagcattctcaaaagctagaatcatttctggagattcattcttatataatttattcatattgcacttaattaatattaaactcaactatattaacatcatgataaatttaaagatcttaaaatttatcatgaggttaattttcaaaaaataa

SEQ ID NO: 3174 - DNA, 1611 bp, Acinetobacter baumannii
ggtagcttacaagaatatcgttattatgcttggaaaagccttatgagcaaaacaactcaagaaaatccagcagtcgagaattctgctcaggaaaaagtgtcaaatacatcaaagtcggcttctaacacggctaagcgtaacagcactactcctaaagcagcaactaatacaccaaaaacgacacgtactcgttcaacgactgcacctgcacgtagccctcgtagtaagagcgctgcttcagcaaccccgtctacatcttcaaatgtagctgcagcaccaaaagcaacaaaaaccaaaacttctgttcaacaggataaaaccatgagtcaaaacactgttcgccgcgttgcaatccttggtggcaaccgtattccatttgcacgttcaaatactgcttattttaaagcgtctaattctgacatgctgacagcagcattgaatggtttggttgaacgctttaacttacaaggtaagcgtattggcgaagttgttgcgggcgctgttttaaaacatagccgtgacttcaacatgactcgtgaagttgtattgagcacagatcttgctcctgaaactcctgcttacgacatccaaattgcatgtggtacaggtttacaagcagcatttgttgttgctaacaaaattgcgcttggtcaaatcgacgtaggtattgcaggtggcgtagatacaacttctgacgcaccgattgctgtaggtgatggtttacgtaaagttttacttgagcttaatgttgctaaaacaggtaaagaccgtcttaaagctttaacaaagattgattttaaaaagcttcttgatgctccaagcaatggtgaaccacgtactggcctttcaatgggtgagcaccaagcaatcactgcattagaatggggtatcactcgtgaagcacaagacgagctagctgcaagcagccatcaaaaacttgctgctgcttatgagcgtggtttctttgatgacttaatgactccattcttaggtcttaaccgtgacaacaacttacgtcctgacagtacagttgaaaaacttgctaagttaaaaccagttttcggtaaaggcgaaactgcaacaatgacagcgggtaactcaactccgttgactgatggtgcttctgtggtattgcttgcttctgaagaatgggcaaaagaaaacggacatgaagttttagcttatctttctttctctgaaacagcagctgttgacttcattggcaagaacggtcctaaagaaggcttattgatggctcctgcttatgcagtacctcgtatgcttaagcgtgctaaccttaagcttcaagacttcgatttctacgaaatccatgaagcatttgcatcccaagtactctctaccctaaaagcttgggaagatgaaaaattctgtaaagaacgtcttggcttagatgcaccattgggttcaattgaccgctctaaactgaacgtaaatggttcatctttaggtgcaggtcatccatttgctgcaactggtggtcgtatcttggctactgcagctaaattaattaatgaaaaaggttcaggccgcgcattaatctcgatctgtacagcaggcggtgaaggtgtggttgcgattgtagaaaaataa

SEQ ID NO: 3175 - DNA, 1233 bp, Acinetobacter baumannii
aacctcatacagacagagttcgtgatgactgatattaccctagctccagtacaacctgatcaaccaacacatttaatggctacttatggtcgccaagcgatcagttttgttcgaggccgaggggcgtatctttatacacaagatggtacagaatatttagatgcactcactggtattgctgtatgtggtttagggcacgctcatccagctattgcagaggctattgcagaacaagcagctacacttgtgcatacgagtaatctgtttgaaattccttggcaaactgcggctgctcaaaagcttgctgaagtttcaggtatggaagaaattttcttttcaaacagtggcgccgagtcaaatgaaggggcaattaaaattgctcgtaaatttggtactcaacaaggtataagcttgccaaagattattgttgctgagcagtcatttcatggtcgtactttagcgaccctgtcagcaactggtaacaagaaagtacaagacggttttgcacctttagtggaaggctttattcgagtaccatttggtgatattgaagcgattcaagaggctgccttacagcatccagatatcgttgctattttaattgaaccaattcaaggtgaaggtggtattaatactgcaccacaaggatttagctatttagaagaagttcgccaaatttgtaaccagcacaactggttaatgatgctagatgaaattcaaactggtaatggtcgtactggtaaatactttgcgtatcaacatacaaatattattccggatgttttgaccacagcaaaaggtttgggtaacggttttccggtgggtgctgtaatgactcaaggtaaagcggtaggcttgttagggcctggtagtcatggttctacatatggcggtacagtattgggttctcgtgtggtttacacggtaattgatacgatccagaaggaaaatgcagtagagaatgcagcagtagtgggtaattatattgttgaccaattacgtgctcaattgtcggataagaacgtgcaagtacgtggtttcggtatgatgattggtatccaattacctaaagattgtgctgagctcgttgcgatagctcgtgatgagtacaaacttattattaacgttacggcaggttcggtggtgcgtttattaccgccaattaacatgacacaagctcaagctgatattttgctagagcgtttagtcgcattaattacgaattatctttaa

SEQ ID NO: 3176 - DNA, 474 bp, Acinetobacter baumannii
atattgtcacaagacaataaggagcaatatatgagttatcaccatattttagttccggtcgatggttctcctacttcacttattgctgttaatcatgctgcaagtcttgctaaagcctttagtagtaaagttactttggtatatgcgctcactattgatccatttatttcagttgaaattattgatagtacagaaattgcgcaagattattttaataaagcgagagcttcgattcagagcattttagatcaagctaaagaacaatttagccagcatggaatttctgttgaaaccaaaattgttgaaggtcaaacaattcatacagaaatcatcaaagcagcaactgagctaaaagctgatttattagtgattggttctcatgggcgaaaaggttttaaaaagttcttcttaggaagtgtaactcaagcactcttaggagaaattcatgtgccagtattggtcgtaactgaataa

SEQ ID NO: 3177 - DNA, 1323 bp, Acinetobacter baumannii
ggaacaccacaccaatatttcacaatacgtaatgccgaggactggcatatatcttggaaatggattatggaattatttcaccgttttaaaccacacactttagctgttgccactttaatacttatgtgcagcagttcttgggctgcaaatccaaatcagcaaactgaagatgagtggaaattcactttaaaaaatgcctatatcaatcgtgattttgataatgacgcccttaaagataccggtagttggtctcaggcagcatctttattttataaatcgaaaatgcatgacactccactagtcatagcagataaacctattacaattggagctgacgcttccgttcaatacgccgtacgtttgagttcagacaaacatgtcgcagatactgttttgccttttaataaagaaacgcaatctcaagcatctgattatctaaaatacggcgcgactttaaaactaggttatgacaaaacacttttaagtgtcggtgaactctggctagatttacctgtaacggctgttgatgctagccgccagttactcacctcgtattggggaaccaatcttaaatcacaactttcagatcaactttatgccgaaattggccgagtggaaaaagtctcgccacgaaatgaagaagattttaaaaagttttcgttcacagcaaatggaattaccaaagaatctgatggcttaaattatattgacctgcgctatcaatttacgccgtctttaaaaggcgaatattattttggtaatttagaagatctctacaataaacactatgtagggcttgagcatacgtggaaacaaccaacttttgccctgacttccaaatttaaatattttaatgcgaaagatgatggcaatacctttgatattgatgcccagaacattggtttacttgaaaccgtcaaagtaaaaaaccatacctttggtttgggttaccaacaaattattggagagtcggcttaccctctaccagatggtttcttgccagaaacctatttcattaactggaatgctacaggtttctttaaagaagatgaaaagtcttaccatgtcatgtatggctatgactttaaagattacattcccggcttaaacgcaatggtgaaatatgtttatggtcatgactttaaagcagctaatggtgagaaaaaccacgaaactgagtctaatgtgattttaaactatgcatttcagcagccgctcttaaaaggctttgccctgcaatatattcgtattgactacaacgttaaacacggcaatgactttggcgaagaccgtttattcgtcaattacaccaaaaaattctaa

SEQ ID NO: 3178 - DNA, 1305 bp, Acinetobacter baumannii
tttatgcaacagcttcgtaccggagatattattgccttaggttttatgacctttgccctctttattggggctggtaatattatctttcctcccattgtcgctcaacaagctggtgatcatgtatggctagctgccataggttttttgattactgctgtcggcttacctgtaattaccattatggccctctctcgtatgcagggttccattgaaattattagttcaccgctaggtcgtatcgcaagtctgatcttaactgtagtttgttatctatcagttggccctttatttgctacaccacgcaccgcaacagtttcttatgaaattggtttctcatcttattttggaacgtctagcagtagccttttaatttacagtgcaatttacttcgcatttgtaactgtcgtttctttatatccgaacaagcttttagacacagttggacatgttctagctcctctgaaaattatcgctttagcaattttaggtattgcagcggttatgattcctgcaggttatgttcctgctccaattaatcattacgttaactctcctgtttcagaaggtttcgtaaatggttatctcaccatggatactttaggtgccttagtatttggtatcgtgattattcaagcgatctattcgcgtggtgttactgacaacaagctagtaaccaagtatgcaattattgccagccttatttctggtgtaggacttactttagtttacttaagcttatttaaattaggtttgggtagtcatgaagtcgctcctaatgcagcaaatggtgctgtaatcctacatgcatatgttcaacatgcttttggaaatatgggttcactcttcttaacaggcctcattttcttagcatgtatggttactgcaattggtttaacttgtgcatgtgctgaatatttcgctcaactcaccaaattgccatataagcttttagttttcatcttagttggtttttctttcattatttccaaccttggattgactaagctaattgccgtatcagtaccagttttaagtgcaatttatccacctgcaattgtagttattatgctcagtttcttctggaaattttggcataaaccatcttttattgtcggttcagtaacaagcattgctttaattttcggaattattgacgggcttaaggttgcgggctttggtgattaccttcctaatttccttcaacacttaccgttaaatgaacaaaacttggcatggttgatcccatctttagttgttcttgtagtgactactcttatcgacaaagttaaacataaaagcatttaa

SEQ ID NO: 3179 - DNA, 216 bp, Acinetobacter baumannii
aataaaaaacaattaaagattaaaaagatacagagtacagtagagtcttcatataaattttattttaacaataagattgagactattgaccttaaagctaactttaatcttacgataaacattcatacctttataacgaatctagaagcagattttcagcaggagtacaaagatgggatatgtaaccacaaaagatggcgtagacattttctataa

SEQ ID NO: 3180 - DNA, 687 bp, Acinetobacter baumannii
aacttcgaacaactaaaacttgagatgtgctgggcacagtctttatggctttgctatgccttttttctcccaaaaaagtcagcagttttttatatctcatttatatacaacaaaaatttaatttataacggtaaaaatatgccaaatttaactctcccaacacgtgcattaaaagttgtaaatacatcaattgagttatttcaccgccgcggttttcatattgtgggcgtcgatagacttgtaaaagaatccgaaattaccaaagcaactttttataactactttcactctaaagaacggttaattgaaatttgcctaatagtgcaaaaagaacgactccaagaaaaagtggttgctatgttcgaatacgaccacgacacaaacgcaatcgataaactcaagaaactctatgttctacataccgatgtagacgggctgtactacctgttatttaaagctatttttgaaatcaaaaatacctacccaaacgcatatacaactgccataagatatagaacatggttaatcaatgaaatctatagccagcttagagcacttaaacccgatgcttcctttaccgatgccaaactatttttatatatgatcgaaggtgccattattcagcggttaagctcagatgaggttgatgaaagaatggttgaggtgtttttgagggggatggggtga

SEQ ID NO: 3181 - DNA, 222 bp, Acinetobacter baumannii
ccaagagaacaaggaatagcaacttttctaatgaatgaactcgaaaattttgcacgaggaaaaagtctgcgcttacttgttttagatacacgtgaaggtgatgtatccgagcttttatatagcaaaattggatttgttcgtgtgggtgtaattccgagttttgccttaagttcaaacggcagctatgacggtacagcgatttattataaaaagcttgtctga

SEQ ID NO: 3182 - DNA, 186 bp, Acinetobacter baumannii
gaaagtagacattttttatttcctacctatttaattgaccatgggccgttgtttgggaatgaatatagtctatggaactcatttcttataatcagcattaaaaatatgacagttcgttttattttcgcaacaataaaaaaagatatggatataaaaaaacctcactattttgtgaggtttttttaa

SEQ ID NO: 3183 - DNA, 765 bp, Acinetobacter baumannii
acccaattgcagcgaaagaacaggattaaggagataaagatgtcacaacatagctggggtgcttacgcccaacgtaatacagatgatcatccaccagcgtatacgccaggttataaaacaagtgtattacgttcgccaaaaaatgcattgatctcaattaatgagactttaacagaagtcactgcgccgcatttttcttcaaatctgtttggcccaaaagataacgatttgattttgaactatgccaaagatggtttgccaattggtgagcgtgtcattgttcatggctatgttcgtgaccaatttggtcgtcctgtaaaaaatgcacttctagaagtatggcaagccaatgcttctggtcgttaccgccatccaaacgataagtttattggtgcaatggaccctaactttggtggttgtggtcgtaccttaactgatgaaaacggtttttatattttccgtaccattaaacctggtccgtacccatggcgtaaccgtattaatgaatggcgtcctgcacatattcatttctctttaattgctgatggttgggctcagcgcctgatttcgcagttttattttgaaggcgatacgctcattgatacttgtccgatcttaaaaacgattccttctgaagatcaacgtcgtgccttgattgcactagaagataaaaacaactttatcgaagcagatagccgttgttaccgttttgacatcactttacgtggacgtcgagcgacttacttcgaaaatgatttgacttaa

SEQ ID NO: 3184 - DNA, 1023 bp, Acinetobacter baumannii
ggctgtctgcaaatgaaaagaatattattaacgggtgctctatttaccgcgggctttggtgtgtatggggaagcgaatgcttcatgtattatagttaattatcaaccaaatgatgttcgcatagcagtaggccgtgttgttgtacgtcctagtgatccagtgggtgctgttttaaggaaagcaactttccctatcagtagtagcggtacacaagcgatgtattgtgatagtagagatactgtagttgctcaattaacacaagcttatccattaagttccttaggcaatagcatctatacaaccaatattcctggcattggtattcgtttatatcgtgaagcagagaatagcagtaatttttctggttattacccttatgaacgtggcggtatttctggcactcgttatttggcatcaggttattttgttgtagaaatcattaaaattgctccacaaactggttctggaacattagtaccgggcagatatagtagttattacgtccgtggctttccaaatcagccatttttaacaagtactgttgatgctaatgcaattaccattgcttcttcttcatgtgaaattcaaggtaatattaataaagttgtacagttgcctacagttacaaaggcaggttttaaaggtgttggctcaactcaaggcgaccaaacttttgatatgaacattctctgtaatggtggtatcaaccctactggctatgaagagaaaaaccttattagtttaacttacgactttacccaagatggtaccaacaatcaggttttagcgaatactgctccaacatctgaaaaagcaaacggcataggtgtacagttactctggaattatcaaaataaaaatcaagtcatcaaaaaaggtgacaaattagccttaggtacattgtcttctaaccagacaattcaatataacgtaccgatgactgcccgctactatcaaactgcaacaaatgtgactgctggtaaagtgcgtgcaatggctactgtaactattgaatatgattaa

SEQ ID NO: 3185 - DNA, 744 bp, Acinetobacter baumannii
tgtttaacgcaaatgcttgatgagactgcatttaaaaattttaaattgccaagatatgaaaaggtccgttgggaacttcaaaaactactgatccagtcaaaatggacagtcgaagagcctattccaagtgaacaagaacttgcgcaaatgtatagcgtatcggtaggaaccgttagaaaagcggttgagggactggttgaagacggcttattggttaaacaacaaggaaaaggaactttcctcaaacaacctaattttgaaaattcgcttattcgtttttttagattacgtaataaaaaaggcgagttcatgcagccacaaggacagatcaaaaaagtagaagtgtgtgatgcaataccggaagtaaacgccgagttagggcttgggcacactgacaagttgctttatatcgagcgtgtccgtaagcatgaagatgtcgttgtattaagtgagagaatctggctacctgaacgcttatttaaaaatctggaagaaattccaatcgctgagtttggtaacttactttatcctttttattatcagcactgcggtcaatttgtttcttctgcaacagaacggttaacttttgagaaaaatattaaagatagctatttaaataaccaccttgaagaccctttagtgaaggtatgccgtattgcaaaaaatcttgaaggtgtcgcggtcgaataccgtgagtcttatggtttggccgataattttcattatgaaataacaattaattaa

SEQ ID NO: 3186 - DNA, 1548 bp, Acinetobacter baumannii
atgaataagcatgttgaagctgagtggaggtttcccgcaaaaactgcatgggcaatttttgctgccatgatttttggcaacttcatggcgattcttgatattcagattgtggcgagttctctaaacgaagtacaagctggcatgagcgcaagtcgttatgaagtcacttgggtacaaacggtttatttaattgccgagattattgcgattccaatgtcgagtattgtctcgcgagtgctttcaacacgggtgtattacaccatgtgtgcaatcggctttacggtgagttctttactttgtgctttgtcatggaacttggaaagtttactggtgttccgtggcattcaaggctttatgggtggcgggatgattccgacttccatgacggcgttgtacttactttttccagaaccaaaacgctcattacctttggtcatgtttggcatgatcagtactttaggtccagcaattggcccaaccattggcggttggctcaccaataacttctcatggcactggatgttcctgatcaatattattccgggcattatcattgctacggtcatctactcaggtccaaatattgaccgtgcaaactattcactcatcaaaagtatggactggttcagcctcgttggtatggcgatgtttttgggtgggctggaatattttcttgatgaaggcgcacgacatgactggcttgcagatacaggtgttcgggttgcttttatggtctgcgttgtaggcggcatgatcttcttctctagaagttttacccagcctaagcctttgctcgatttatcggtatttaaaaataaaaactttactttaagtgccatcacaacatttgtgattggcatggcgctgtatggcttgggttacatgattcctgtgtttcttgggcaagtccgtgaaatgaacagtagccaaattggtcacgtcatgatggtgacaggtattgtcatgttctgctttgcgccgtttcttgcgtggcttattcctaattttgatacccgcaaaaccgtatttgttggaatggtcctggctggttttggtgtttggctcaattcgcacctcagcattcatagcgattacgactttatgttttggccacagatttatcgtggtattggcctcatgatttgcctgattgtggtctcgcatttagctatgagtacattaccgctcagtaaagttgccgatgccagcggtatttataacctgatgcgtaatattggcggcgcggttggactggctcttattaactcatccttagattggctgaccgccatgcatgtcacccagattaatcagtccatgacaccgcaaaactggatatttacagaacggctcgatcagctcacggcgcaatatcaggaagtcggtgcaaatgcccagcaaatcgcactgagtgtgatctatcgcgatattcactttcaagcactgacatcgagtttcaatgacttattacgcatgctcgcaatcatcatgtttgtgaccgcctttttaaccatatttatggatcgggggaagaaaatgaatatgtag

SEQ ID NO: 3187 - DNA, 933 bp, Acinetobacter baumannii
atacatgagcacaatattatggaaaatattaaatttatcagtaaagggattacatgctcggcatggtatattcctgccacaacagataagtatatgaactctcgtgggcggccctgtgtagtcatggcaaatggcttcggaggcaccaaagataccggtttattaaatttcgcagaaccattgagtaaagcgggttttgatacatttatatttgattatcgtggttttggagaatctggtggttttccaagacagaatgtttcctataaaaatcagcgtgaagattaccatgcagcaatcgcagcagtacgaagtttgccaaatattgaccgaaaccgtatagcgctttgggggacgtcttattctggagggcatgttttagtcgctgcggcccaagatcagaaaatatctgcagtaatctctatgaacccggctacggatggtttagctgccctctcacaaatctgccgttatggtggtctaaaacaattaaccgttgcagtcgctcatggactaaaagatttagcttattctcttttaggccaaaaagcgcatcttattccaatcgtggggcaaccgggcacggcggccatcattagtacacctggctcggaggtctcctataaagccatggctgggccaacatggcggaatgaagtatgtgcacgaactgctttagaggttgcaagaaaccggcccattaatttcgcccatcaaataaagtgtcctttattggtacaagtgggttcaaatgatcaagttactcctcctgaagctgctcgcaagtcggcaagcttagcaaatggagaagttaaattacttgaatatccgattgatcattttgatttttataatgaaccgtggcaaataaaaattttagaggaccaaattaattttttaactcaagccttagctcgtccccgtgttagataa

SEQ ID NO: 3188 - DNA, 528 bp, Acinetobacter baumannii
ataataaggcaagtaggccagttttatattgaggaaagcataaagatgaaatgggatgacatcggtgatcagccttgttctgttgcccgtatgctatcagtgattggtgatcgatggacgatgctaatattacgtaatgcttttatgggaattcgtcgttttgatgactttcaaaaatcattaggtgtcactcgtcatgtcctttctgatcgcttaaaacggttggttgaatacgaaattttagtgaaagcgccttattttgaccgtcaggaacgctttgaatatcgtctcacggataaaggctttgagctttatccaattatcttatctatggcgaattgggcagataaatggatggaccaaggtttaggtaaacctttggaatatcgtcacaaagcatgtggacataagtttgaacctgttatggtgtgttcagtatgtcgtgaaccattacatgcaaaacaagttcaggtttcggctgggccgggctattttgcttatatggaacaaaagcaaaaacaggcttaa

SEQ ID NO: 3189 - DNA, 1398 bp, Acinetobacter baumannii
ctattgaggcaaaacatggattgtttatttaataaatctttcgaaaagacgatgaaaggatttcaaaaactggtgttggtgacacccttactcattaccgcccagacaagttttgccgattggattaaagattctgtttctaaaaatgaatcaaaaactattcaaattcgccattatattcatgagcatccagaacttgggaacatggagttcaacacttcaaaattagtgcaaaatgagttgaagtcttatgggatcgaagttcgaaaaggttttgcaaaaactggtgttattgggatcttaaaaggcgatctgcctggtcccgttatggcattaagagcagatatggatgccttacccatcgaagaaaaaacaaatttgagttatgcaagcaaagtaaaagcacaatatcagggtgagttacaacctgttatgcatgcatgtggtcatgatgcacatacggctatgctattgggtgcagcaaaaatacttgcagaaaacaagaatagactcgcggggactgttgtttttgtttttcaaccttccgaagaaggagctgctgatttggctggttttagccaaggtgaccaaatcggctcaagaaagatgattacagacggcgcacttaaaaagccagaacctgaagtcatgtttggtatccatgtcgtttcaggtattccaagtggcagcattttctataaagatgaagctatgcttaatagtgctgatgaattccgcattaaactgactggacagcaagtgcatgcttctatgccatgggctggtcgagatccaattgtggcatctgctgccattattaataatattcaaacgatgatcagtcgccgttctgatcttactaaaggtatggccgtgataacggtaggacatatttccggcggaactgcggccaacattattccgaaagaagttgatatggaaggtactattcgtaccaataacgaagatatccgtcaaaatattcttcaacaattgcctgaaatggtcactcatactgcgcttgcaaacaatgtaaaagctgatattgaactctcgccttatgcacctgtaacttataacaataaaatgttaactcaattaattttgcctacattagaaaatacggttggtaaaaataatttgcatcgtatggagactaatgcaagtgcaagtgatgactttgcacactatggcaagcttatgccctcgctttatatttcactcggtgcgactcctaaaaatcaagatatgagtaaagcagctcctaaccatagtccagaatttattgtagatgatgcaaccttaaaaacaggtgttgagtctcatatacgttttgttatggattatcctgctattgctagtcaggtacaaaaagcttggagaaatgataagaaataa

SEQ ID NO: 3190 - DNA, 432 bp, Acinetobacter baumannii
aacctatttaaaggaaaaataaaaatgacactcgaaataactaaacagtcattagaaaagtggcatcacatgattcaatcaaatgacttatcgaacttaaatgatttgctggcagatgaagtcgttttccgttcaccggttgcttataaaccttatgagggaagacaagttgttttctttattctcaccaatgtaattcaggtatttcagaattttacctatcatcgagagttttacacggaagatggtgaaaatgtagtgctggagtttagtgcgaatgtaggagataaatcattaaaaggtatcgatatgattcgttttaatgagcagggtaaaataattgattttgaagtaatgattcgtccaatgagcggtttagctgcattagctgagcaaatgagcatacgaatagctcaatttaaacctcaataa

SEQ ID NO: 3191 - DNA, 1050 bp, Acinetobacter baumannii
agtccatttaaaaaccaagcagattattcagaaggtaacaaggaacgtggcggcaattattcgctagcaaaacaaaatgcccgcagcgctgccacccaaaaccgtattgcatacttaaggagttttagtatgaaccgtcaacaaattgatgcgcttgtaaaacaaatgaatgtcgacactgcaaaaggcgaagttgatgcacgtgttcaacaaattgtggtgcgccttcttggggatttatttcaagccatcgaagatttagacatccaaccttctgaagtttggaaaggtttggaatattttaccgatgcaggtcaagcaaatgaacttggtcttttggcagcaggcttaggtcttgaacattaccttgacttacgtgcagatgaagcagatgccaaagctggtattacaggcggtacacctcgtaccatcgaaggtccactttatgttgctggcgcacctgaatcagttggctttgcacgtatggatgacggaactgagactggcaaaatcgataccttaattattgaaggtacggtaaccgatactgatggcaatattattgaaaatgccaaagttgaagtatggcatgccaacagtttaggtaactattcattctttgataagtcacaatctgactttaacttacgccgtactattttcactgatgcagatggtaaatatgtagcgttaaccactatgccagttggttatggatgccctcctgaaggtacaacacaggctcttcttaacaagttaggccgtcatggtaaccgtccatctcacgttcactacttcgtttctgcaccgggttaccgcaagctgactactcaattcaacattgagggtgatgagtacttatgggatgactttgccttcgctactcgtgacggtttagtggcaacagcagtagatgtcacagatcctgctgaaattcaacgccgtggtttagatcacgctttcaaacacatcacatttaacattgaactggttaaagaagccgctgctgctccttcaactgaagttgaacgccgtcgcgctagtgcttaa

SEQ ID NO: 3192 - DNA, 285 bp, Acinetobacter baumannii
ataagcattaactctaagtttccaaacataatttctattgggttgaaaagtgatattgtccaatatccatatacatttagaaagcgtactttaagacttacctgtactatgaaatttataataataaagactgatactaactctgtgattgagcttattgacttaagtttttcaataatcatgtattttcgatttcctttcctatataagattcatgtatgcaatggcgataaagggtgccatttcttctggtcgatctaccatattatttccacttgtctttga

SEQ ID NO: 3193 - DNA, 264 bp, Acinetobacter baumannii
cacgcatctaagtctaatactccaaaaaccagactttctaaaccaagaatgttcatgctttcaactccatttgagaaacttcaaactaaaaactcgaaggtttctaattcatctggaattattaaaatacaaatttcgttgatgtgtcaacaattattgttgacacatcaacatatttcatcttatcttttatttcggatgttttttgtccactcatacaatgatgaattaagaaaaaaactaatctttaaagggattatttaa

SEQ ID NO: 3194 - DNA, 1497 bp, Acinetobacter baumannii
ctacagactaaagtgctaaaaacgaaagcattaactttgaatacggtgaaaattatgaataaacacttattactaaacattgcttttttaggttcggtccagctttttacaatgtctaatgcattggctgatgttccattaactccagcgcaatttgcaaaagcaaaaactgaaaattttgaaaaaaaggttcttttatcaaatttaaataaacctcatgctttagtctggggaccggataaccagatttggttgactgaacttgtgacaggcaaaatcttacgagtaaatccggaaacaggtgcagttaaaacagtatttcaagtacctggtattattaatgatccgcatgcacaaaacggcttattaagctttgcattccatcctgattttaaaaataacccatatatttatatctctggaacttttaaaaatcctcaggcaacagacaagaactctccaaatcagacaattattagaagatacacctataataaatcaacagataccttgcaaaaaccagttgatttattagcagggttaccttcttctaaagaccatcaagctggtcgtttagtgattggaccggaccataagatttattacactttaggtgaccaaggccataaccagttaacgtatttgtttgagcctaactatgctcaaagtcttccaacccaacaagaattaaagaataaagacttccatgcctattctggtaaagtcctgcgtttaaatttggatggtagtattcctcgtgataacccaagttttaatggtgttacaagtcatgtttacacattaggtcatcgtaacccacaaggtttggcatttgcaccaaatggtaagctcttacaagctgagcaaggcccaaattctgacgatgaaattaatttggttgttaagggtgggaactacggttggcctaatgtagcaggctataaagatgacagtggttatgcctatgcaaactattcagccgcaaccaataaatctcaaattaaagatttaggacaaaacggcataaaagtagcggcgggtgttccagtaacaaaagagtctgaatggactggtaaaaactttattgcacctttgaagaccttatttaccgttcaggatacttataactataacgacccgatgtgtggcgatatgacttatatctgctggccaacggtagctccatcttcagcttatgtttatacgggcggtaaaaaagcaattccaggttgggaaaatactttgcttgttccatctttaaaacgtggggttattttccgtattaagatggatcagacatatagcacgacctatgatgatgctattccgatgttcaagagtaacaatcgctatcgtgatgttattgcaaaccctgaagggaatactttatatgtcttaactgacccggaaggtaatgttcaaaaagatgatggttccgttacaaaccagttggaaaacccaggggctttaattaagtttacctataaagctaagtaa

SEQ ID NO: 3195 - DNA, 732 bp, Acinetobacter baumannii
ccgctatataaatatagagtaaaaacagtgcatgatgtgattgagccatcagttcttagaaccaaatctccattttttattattgctaaaaatttctttatttttggattactttggattttatctttattcttgtatggagttttttactatgattcatattattccatatttatttatctaattagtttctatgctacttatttttttggatatttaatatctaaacctattgttgcagaccttgactctaacactcttaatcaagttaagttattcagcattatattttctactctttattatgtaatagtacctctacgctgctttctagttgaaattcatgatggtttatatggttttagactgggttttgggttcgtttttccgttctggaccctaaccccaatttttatcactaatctgaaggataagttttatatttatttatgtgtcttgctatgtgctctagaagtaatttttgggatattgttttctaaaatgagtgggtctgaattttacaagagacctctatctgttgctatcttcgtaagttcttttatatttgcattaacgtttccttggtatttatcttggttgagagaaatagacatcaataaatgggttttaccattcttttttaaagaagatagatttatatctaaactaatatcatgggtagcaataggactcggtagttgctttatgtttttattctatcttttcttctaa

SEQ ID NO: 3196 - DNA, 681 bp, Acinetobacter baumannii
  unsure (106),(161): Identity of nucleotide sequences at the above locations are unknown.
ttaatgaataaaagtgcttcagctgtaagtattctatttattggattgacattcttttttcttatattcagtatctttagcatattgtatttttattggggcgatntaaaggttatccaagatagcctttcaactacaggaagtatctttggagctattgntacattaggagcagcagcagtagcagcttacctttttaatgattggaaggaacagcataataaacaggttcagaatagttttgcacttcaagtctttgattgcttttcggtttttgaaaataatattttagaatattcaatgtttatttcacacttgcaagatctaagaagttcatatgaaaattatgaattaacttgggaaattttgaataaagatggaaatactatttatattcaaaatataggttctaaaaaagatgagttggatttatcgttttacaggttaatgagcaagttaaaaaactactatatatttaatcatgatatttatgattttaacaaaaaacatgagacctattttaataaatttattgaaataaacaaaagcttattacctacaaatacattagtagaagagctaattgaatatgaagcaaagcttataggatacaaagatctaaaaaatatgattgatattttagatatatctccaataattcagcaactaaatgcaaaataa

SEQ ID NO: 3197 - DNA, 1167 bp, Acinetobacter baumannii
ataatgaataaaacaaatccaccacttactgataatacgcttattacccgtgaagcaactttggcagatgacgaggctttacgagagttaattgccgtaccgatgaccaccaaaggcatacaaatcagctttcagcgtgaaccaagttattttaaggcgtccgacatcgtctatcggcataaactgcatgtcgtgattgaagataccgagagtcaaaagaaagttgcctgttatagcaatggttaccgtccgtgttatatcaatcggaacattcaaaacttacgctatgctggagatttacgggtagatcacaactatcggggtaaatcattggtgaaagtcttaggcaaacatgtaaaacagactatgcatgaaccgaactatagccaaatgattatttttgatgataaccacgcggcgcgtgctgccatccaaacaggcaaaacgggaatgcccgattattatgatgaagggcttatagagacactcagtctgacgagcactggcacaaaacggaaaatcacggcttttctaaagcagacttctcagcaaagtcatcttcaagagattcatacttgtacagcggaagaagaacatgtaccagccatgaaccagtttattagtaacatgggagaacactataactttattccagcctataactttgaagagcttgcccaaggtcatcagtatttttcaggaataaaactctcggacttttcactttattttaaaggtgaaaaactggtgggtatgtttggtttgtgggatcagcatagtattaagcaaaccaagattctaaattacagctcggccatagctgtgcttagacccgtttataacttattgacgccaataactaagggcatgcgtttgcctaaactgggtgactctattcagtaccatgtgctacatacgcttatatgccatcccgaagatttggctttgcatcataaaatgctcgaagatgcctataacaagtcaaaacagcagggcgttggtgtggtgagttttacgctttcacataaagatccgcgatatcagttaaaccagttttataaaggtgaacgtttaacgggtatgcatggttttattagctttgaaggtgaccctcggccaagttttgataaaaagctgattccatatttagaggttggacgtatttaa

SEQ ID NO: 3198 - DNA, 1170 bp, Acinetobacter baumannii
atgatgaataagttgtctaaaatggagtttgcttctcaagacaaagcagttgatttagatgctttgtgccaagaaattcgtgagcgtgcctgtgcaggtgagtttgataatcaggcctatgtgagccaagacattatcgaaaaacttaaaaaaattggtgtttaccgtgccttagtgcctaaacgttttggtggtgaagaatggtcaccgcgacagttttgtgagttgatcgaaactttatctaaagctgacggttcagtgggttgggtagcaagtttcggtatgagtcctgcgtatttaggaagtttgccggaagaaacgctgaaagagttgtaccaaaacgggccagatgtcgtatttgccggaggtattttcccacctcagcctgccgaaattaccgatgaaggtgtggtggtgcgcggacgttggaaattttcaagcggctgtatgggcgctgacattgttggcgtgggaatttcacctcttaaaaacaatgaaatgcaaggtttaccacgcatggcagtgatgcctgccaacaaagccaaaatcgaaatgacatgggacactgttggcctaaaaggtaccggaagccatgatttggtggttgaagatgtattggtcgaaaagaaatggacctttgtacgtggcgaaccttcaaaacttagcgagccattttttaaatatccatcactgtctttagcgactcaagtattaaccgtggtgggtattggggttgcagctgccgcattagaagaatttgaaaaattagcaccaggtaaagcatctattacaggtgggtcagaaattgcaaaccgaccagtgactcaatatgagtttgctcaagctgatgcagagtttcaggcggcaaagtcttggttttatcaaaccatggatattgtgtggaatgaaattattgctggtcgtgaagcaactgctgaacaaattagcgatatgcgtttggcatgtacccatgcagcgcgagtttgcgccaaagtcacccgaaaaatgcaaatgcttgcgggtatgacagcgatttataccaacaatccatttagccgttttgtaaatgacaccaacgtggtgacccaacatgcctttatgggtgatgcaactttacaaaatgcaggtttagtcagtttcggattaaagccaaccccaggttatctataa

SEQ ID NO: 3199 - DNA, 759 bp, Acinetobacter baumannii
aataaggataaaagcatggcgaagacaattttaattacaggtgcaagttctggtttaggcgcaggtatggcgcatgaatttgcagcaaaaggttataacttggcgatttgtgcacgccgtttagaccgattagagactttaaaaaccgaactagaacatcagtacggtattaaggtaattgcgaaaagtctggacgttaccaattacgatcaggtttttgaagtttttcgtgcctttaaacaagaatttggctatttagaccgaattattgtaaatgccggagtcggaaatggtcgccgtattggtaaaggtaattttgaaattaacagagccacggccgaaacaaactttatctctgctttagcacagtgtgaggcagcgattgaaatttttagagcgcaaaatgcaggtcatttggtggtcatgtcgtctatgagtgcgatgcgcggattaccaaaacatttatcgacctatgcggcgagtaaagctgcagttgctcacttggccgagggtattcgcgctgaattactagatactccaattaaagtctcaaccattttcccaggttacatccgaactgaaatgaatgaaggtgctaaacatctaccttttgaagtcgatgccaaaacagggtgtaaagctttagtcaaagcgatcgaaaaacaacctgtaaaagcttatgtaccgcagtggccgtggttaccaatgagtattgccatgaaggttttacctttgagattggttaataaattaggataa

SEQ ID NO: 3200 - DNA, 1398 bp, Acinetobacter baumannii
tcgcttagtaatttaaaaggaattggccttaaggaggcaaatatggcgtctcaggattacgctacaccaagcaaaagcatcgatgctcaagcactgattaatgatgctccacttagtaaatatcaatggatgatcgcaatcatctgtttcttaattatttttactgatggtatcgatacagctgcaatgggttttatcgctccagcattggctcaggactggggcgttgaccgttctcagttagggccggtgatgagtgccgcacttggtggaatgattattggagctttagtttctggcccgacagctgaccgctttggccgcaaaattgttttagccttttcgatgcttgtatttggtgggttcaccttggcatctgcttatgcaaccaacttggatagccttgtcgttttacggtttttgacaggtattgggcttggcgcagctatgccgaatgcgaccactttattttctgagtactgtccaacccgcattcgctcattactcgtgacatgtatgttctgtggctacaacttgggtatggctacaggtggttttattagcagttggcttatcccgacctacggttggcatagtttatttttgctcggcggctggtcacctttaattttaatgattttagtgattttggtgttacctgagtcttaccgctttttaattgtgaaaggcaagaatccagaaaaagtacgcaaaatcttaaaccatattgcaccagcacagattcaaaatgcgacagcatttcatgtgcctgaagaaaaaacagaagttgttcaaaagaaaaatgtctttggaattatgttttctaagccatatgccaaaggtacggttttgctttgggtgacttacttcatgggactcgtggttgtttacttgctaacaagttggttaccaacacttatgcgtgaaacaggtgcttcgatggagcgcgctgcatttattggcggtttgttccagtttggtggtgtggtgagtgcattgtttattggttgggcaatggacaaatttaacccgaaccgagttatcgccattttctactttgccgcaggtctatttgcaattgctgtcggtcaaagcttaggcaactcaaccttacttgcagtattggtactttgtgcgggtatcgccattaatggtgcgcaatcttcgatgccggcgttaagtgcacgcttctatccaactcagtgccgcgcaactggtgtgtcttggatgacgggtattgggcgttttggtgcggtatttggtgcgtggattggagctgtgttactcggtaatgattggtcgtttaccgccattcttagtttattactcattccagcgaccgctgctgctgttgcggtatttattaaatcaattgttgcgcataccgatgcaacttaa

SEQ ID NO: 3201 - DNA, 420 bp, Acinetobacter baumannii
atgaaaagtaaatattatttaacattagcagatgctgagtttttaatggaagaagctcagaaatatgcaatcgaacacaactttaaagtcagtatagccattgttgatgaaacaagctctttattacttatgaaacgtctagatggcgcttctcctctcaccacacatctttgcttagaaaaagctaaatgctcatcaatgagcggtcgtccttcaaaattttacgaagagcttcttcaaaatggtcgtcttggtttcttgagtatgccaagtgctaaaggtatgctagaaggcggaaaagcgattatttatgaaggccagattttaggcgcgattggtgtttcaggtgttcaatcttttgaagatgctgaaattgctcaacacgctattgatgtttttttaaaaaaacaaagtagctaa

SEQ ID NO: 3202 - DNA, 720 bp, Acinetobacter baumannii
aatatgagtaaagctgactataaaaatcctattccaagcaaaagccaacatgcattaatcgtacaacaattgggattaaaaattgtttctggagaaatttcagaaaatgcaaaactcccaagtgaagttgatttgtgtgaggaatataaagtcagccgccctgtctttcgcgaagcaatacgcgttttaaatgcgaaaggcttaacttattcaaggcccaaaatcggaacagtagttcgacctaaagaagaatggcatttactcgatccggatgtattgttttggctaattcaaacgacgcctgagcacgagttttttaaaacactttctaccgtacgacgcgttttagaaccggagttagcctatattgcggcaagtacagcaaatgaagaagatattgaacgtattaagcaagcctatgaaggaatggaaaaggcaacaacagttgaagaatttatagagccagatatccagtttcacttagcaattgccaaagcaacgcataatgacttattggcttatatgtcaaaaatgctggttttacctttgcagcaatcgattcaagtcaccagtctacgcccaaatttacaaggtcattcattaccaagacataaagctattttgacagcaattgaaaataaagatccgctctctgctcgtcatgcttcactggttcagctagacgatactaaaatggcttatgatttaattaaaaaataa

SEQ ID NO: 3203 - DNA, 942 bp, Acinetobacter baumannii
aacagtggtaattgcatgaaaacagatttaaatgatctttattattttgtaaaagttgtacaacatggagggtttgcttctgctagtcgcgaaattgatattccaaaatccaagttaagccgccgcattttattattagaagaaaggttaggggtaagattaatcaatagaaatactcgtcaatttgatgtaaccgagttaggacgagaatactatcatcaatgccaaaatatgattttaggtgcagaagctgcacagcaagtcattgaaagaaatcaggcagaaccttgtggggtaataagagtcagttgcccgcctgcatggttatatgaccacattgcagatatgatttcaaaatttatgaggttgtatccccaagttaatattcatcttgaagtaaccaataagaatattgacctgttaaatgacggaatagatatcgcgttaagaattagatttccgcccttggaagattccgatcaggtcatgaagatttttgcaaaaaatccgcaatgtatagtggggcattgtgagctggtccagcaacatggtatgcccgaaaccccattagatctatgtggttatccttcaattgggttaggtaactcggaacaaaaaagtatatggacactatacagccgagagaatggtaaaatcgaaaaagttatacatacaccacgtttgattgtgaacgacatgattggtgtacgagatgcggtattaagaggagttgggattgctcaattaccttttgccctgatttataaagaaattgagcgtggtgaattaattaatttaatgccaaattgggaattaaaaaatagcattatgcatgcagtttacccctcgcgaaaaggactattgccaagcgttcgagcactattagattttttatcggaggagttcgaaacacttattaatgaaagacccggttttgaataa

SEQ ID NO: 3204 - DNA, 1026 bp, Acinetobacter baumannii
gagaaaggtaagtatacaatgattttagtgacaggtggtttaggctttatcggttcacacattgcattgagtctcatggctcaaggccaagaagtggttcttgtcgataatttggctaactcgaccttgcaaacgcttgagcggttagaatacatctctggtatgtacgttccgtttgttaaacttgatgtacgtaacacgcctgcattgaacaaagtatttgaacagtactcaattgatgcagtcattcatacggctggttttaaatctattgaagagtctaatttaaaaccgcttgaatattataatgataatgtcagttgtatcatgagcctattgcgtgcaatgcaacgtacaggcgtccgtcattttattcatttatctagtttggcagtctatggaaaatctggttcacagttaagcgaaacagatgatttcaactatgcttatcctaacccttatattaagtcgcaacagatgattgaagaaatcatccgtgatacttacaaaattgatcatgaatggaaaattgcaattttacgtctatcaaatattgtaggtgcttttgagcatggcgtattaggcgagtatgtagcacagctccctaaaaatattgtaccgcttgccatgcaagttgcagcgatgcaacgtgatttaattgagttacaggatcagtcttctaccgaggaccataccgtagaacgtagctttttacatgtattagatgtatgtgaggcagtaagctcaactttacattggttacgtgatcaaagccattgctgtgaagcttttaatattgctcatgagcaagtgcattcgattcgtcaattattagatgaaatttcacaggttacccaagccgaaattccgacacaatctgcgatttataagcatgaagagttagcgcagattggtgcaaatataggaaaagcaaaaactttattacaatgggtaccgaagcgaactttaaaacaaatgattgaagatgaatggagattttatcaaaatacattaaatggaagataa

SEQ ID NO: 3205 - DNA, 474 bp, Acinetobacter baumannii
cagatactcaaacgacatgtgcaatttaatgattacccaagtgatcagcctgttaaatttctgttaaatcttaaaaagatttttccaagtactggtgatttattattacctgttttacctgaagataatgatctggaaaatgtaacttgggaatcaacctcaaaagactttgaaatcttcaaaaagttattggcaggttggggtgtaattgagcttcgtttaaatgccattactgcttataaagataaaaactttgcaaatgagctaattaaacaagctcaagcgaaacgtaaaaaagtagcacaaaaaaatcatcaactttctctagttgcattggattatatttttatgcacgaaattcatgcactcattgatgctgaactgttcacaataggcgagaaattttatttgccaaccttgcgggagcaatggaaaggtaccgtttcggaccaagtgcttaatggaaagctctaa

SEQ ID NO: 3206 - DNA, 1557 bp, Acinetobacter baumannii
ttgaatgccaatcagttcctggaaaaacaatgtttagcttatatttaccttgggagtcagaccgtgtcgcgaaataaaatatgggttattgatgacgatcgcgccatgcgatgggtacttgaaaagacctttaaagaagaaggatttgacgtcaccaattttgaagaagctcaaacagcacttgaacgtttacatcatgatgcgcccgatgtcatcttaactgacattcgtatgccaggtattgatgggttaactttcttatctaaagtgaaaaactctcaccccgacttgcctgttatcattatgacagcgcattcggacttagaatctgctgtatcaagctatcagactggtgcatttgagtatttaccaaaaccattcgatattgatgaagctttagctttagtcaatcgagcgattttacatatcaataaattgcagcagcaagaagcgacaaaaacagcttcaccactacaatcaacagaaattattggcgaatctcctgctatgcaagaggttttccgagcgattggtcgtttatctcagtcgcatattacagttttaattaatggtgaatcaggcacaggtaaagaactggttgcacatgctttacataaacattcaccacgacgcgctaagccttttattgctttaaacatggcagcaattcctaaagatttaatcgaaacggaattatttggtcatgaaaaaggtgctttcacgggtgcaaacacccaacatcaaggccgctttgaacaagcaaatggcggaacactattccttgatgaaattggtgacatgccctttgaaacacaaactcgattgttacgtgtgctcgcagatggtgagttttaccgagttggtggacatatacccgttaaagtagatgtcagaattgtcgcggcaacccatcaagacttagaaaaactggtgaatgaaggtcgtttccgtgaagacttataccaccgtctaaatgttattcgaattcatattccgaagcttgcgcatcgcagtgaagacatcccgatgctggctcaacatttcttggctcgcgcgggtaaagagctaggcgtaagtccaaagattttacgcactgaaacaacggactatatgcaacaattaccatggcctggtaatgttcgtcagcttgaaaatacctgccgttggttaaccgtcatgattactggtcgtgaggtttatccagaagatttaccttctgagcttaaacaggttccactccaaaaaagtagtgagactagtcaaccagcaccatcttttgaacgtatttctttgcaccattgggatgagctactaagccaatgggcaattcaaaaacttaaaaatggtgaaatgaagatattagacattgctactccaatgtttgagcgcaccttgattaatgcagcactacagcaaactcgtgggcgcaaacgtcatgcagccgaactgttaggttggggtcgtaacaccctaaccagaaagttaaaagagctaggcatggattctgctgatgacgatgatgaggacgaacataaagcaactttgtcagaagcttaa

SEQ ID NO: 3207 - DNA, 1593 bp, Acinetobacter baumannii
aactgctgcaagcatcacacatgcattagctcaaaaattagcaggatgaatatcatgaatagaaaagcgagttttcaatctttagatgcagatgttcttattattggtgcagggattgctggtatcagtgccgcttaccatttaaagaaatatagacccaattcaacctttatcatacttgaaggtcgtgatgatattggcgggacttggagcctatttcgctatcccggaatccgctcagattcagatatgcagtcttttgcttttggctttaaaccctggactcaaaaaaagactttcggtagtgcgcaaatgatctgtgattatttgcaggaaacagttaaagaaaatggtattgaccaatatattcaatttggcagctatgtaaccagtgcagaattctcatcgaatgaaggaatctggaccgttaaagtcaaacagaaagatcaaaaaagtttagttaccttacgttctcgcttcttactcatgggtacaggttattatgactataacaatggatatacccctgactttaagggcacagaagaattcaaaggacaaattgtccacccacaacattggccggaaaatctagattattcaggtaaaaaagtagtcgtcattggtagtggtgctacagcagtgacattaattccagctatggcaaaagacgttgagcatattactatgcttcaaagatcacctggctatgtagttgctatgccgagtgtcgatcctattgcagttgctttaaatacagttttatcaccgcaacgagcgtatgaaattatacgacgtaaaaatattgccattagccgcgggatttacaaactatgccaccgctttccaaaggtaatgcgtcatctactcattgcagatgtacggcgcagattacctaaagattttgatgtatcaacgcatttctcacccaaatataatccttgggatgagcgtttgtgtgtggtaccagatggagatatgtttaaagcgatttcatctggtaaagcatcagtagtgacagatcatattgaccgttttatcaaagaaggcatattgctgaagtcaggaaaagtactagaagcagatattattattaccgcaaccggcttaaacatgctggcatttagtaagattcaactcaccgttgacggtaagaaaattaattatccagacacgacgatatttaaatctatgatgctgtcagatatacctaattttgcctttgcatttggttataccaatattgcatggaccttaaaagtagatctggtatggcaacatttctgtcgtctgcttgactatatggatgagaataaatacggaacatttacaccgattattcataataaaaccatgaaacgggttccttttgttgatttgagcccaggttatgttcaacgtggtttggcacaattcccaatggcaggaaccgaaggtccttggacactacaacatgattataaggttgactttgagcggctcaataaaggacctgtgtgtgataaggaattagagttcactgcattggttcccaagaaaaagttagctgtcgttacggaaccatcttcagaagaattgatggtcaaagcttaa

SEQ ID NO: 3208 - DNA, 351 bp, Acinetobacter baumannii
cttggatgcaaattaaatgcttacatgatcaatcagctatatgagcagtatagtactatggccttaagcgcttggggctttactgatttgccttcttatacagataaatatgatcctaatgagaaagatatagtgataaagacaaataattggttgaatgatgaggcagcagaggaaaaaactcagcaaggtcttactgcctttgtagctcttgatgacgcattcatgagtattgcatcacggatttatttaattagaaatgccaaggaaacgattgatctacaatactacatttggaccaatgattttgtggggaaccttattttacatgagctgctcaaggcagcggat

SEQ ID NO: 3209 - DNA, 207 bp, Acinetobacter baumannii
atagtaagcaaaaaaacgccaaatttaccaactaataaaaactatttaatgattgggcaaaaagtctataaaagcgagtcaaataatttaatcatgtttatagcggtgagcctcgtgttaggactcagtttacctgtttttggatttagtattttatttaagctacttatctttgctatgcgtaaatatataccttctaaatcatag

SEQ ID NO: 3210 - DNA, 1323 bp, Acinetobacter baumannii
tcctttttaaacgccttctcagattttttcggacaatcagagaatggattcgctcaccctaaattttgtgatgagctagaacgtattgtccgaaaaatcgatcaaaaggataacccaatgagtaagcgtattattattgctggttctggctttgcaggtttatgggctgcactcgctgcacaaagagcaatccatttagcatcacaagaacaaaacattgaagtgctgatggtttcccctagtccaaatgtcgggattcgtcctcgtctttatgaggccgtgcttgaaaacatgaaccctgatatttcagagttattaagtgtggtgggagttaaatttctggcaggttgggtcaataaaattgatgtcaaccaacaaactatcgaagttgcaaccaccgatggcaacaaacaaaacttaagctatgaccgttttgttctggcaaccggaagtacgacttttatgccccctataccgggtctaaaagaatatggatttagcgtaaatacattagaagatgctgaaaaactagatcatcatcttaaaaacttagccactaaacctgcaaatgcagctcgtaatactgtagtcgttgctggtggtggtcttactgggttagaaaccgtgaccgaaatgcctgaacgtttgcgtagcattttaggtgaaactgatgtccgtgtggttttggttgattcctcgacagacattggtgcggcaatgggtgaccaagctgcgactgttattcgagaggcccttaacgaactcggtgttgaaggtaaagctgggctaagagttactgcgctagatgccactggcgtaacgctttctaacggcgaaaaaattgaaacagaaaccgtgatctggacagctggcatgcgggccaacccactcgcctctcaaattgctggtgaaaaagataatttgggccgtttgattggggatgcttatttacatgcacctgaagcaaaaaacatttttgtgactggcgatactgtaaaagttccaaccgatgatttaggcaattttaatgtgatgtcgtgtcagcatgctatgagcttaggccgtgtggcgggttataatgctgcggcagaattggttgatttaccacttcatccatacagccaaccaaagtatgtcacttgtgttgacttaggtccttggggtgcactttataccgaaggttgggatcgacaagttcaatttgtgcgtgaagaagcgaaaaaaattaaacaggaaattaatactgtttggatttatccaccagttgctgaccgtgacgcagtttttgcaatagcaaaccctgattttgtgattgttccttaa

SEQ ID NO: 3211 - DNA, 1518 bp, Acinetobacter baumannii
atccttttaaatgaattgagagaagtaaaaatgagtgaagttcagattttacaaagcgtgcaacaatttatggcacgtcaacacggacattttattgatggaaagttagttgctgccgagcttttagataaagtggatattgtaaatccatctactgaacaagtcgttgctcaaattagcattggtagtcaacaagatgtcgaaagcgccgtcaagagtgctgaacatgcttttcaaaatgcttgggctgaaactacgccgtatgaacgtggcgttaaactaaataagttagcagatttaattgagcaatatggtgaagaacttgcacagctcgagacgttgtctacaggaaaacttatcaatatttcccgtcatcttgaggtcgcacaatccgttattttcttaagatattttgcagggtgggcaaccaaaattaatggtcaaaccatgcaaccttctattccttctatgcaaggtgagaaatatacggcctttactttaaggcaaccagtgggtgtagttgcagggattgtgccttggaatttttcactgatgattggcgtttggaaaatcggttcagctttaacaactggctgtaccattgtgcttaaaccaggtgagttcgccagcttatctttattacgtttagctgaacttgccattgaggcaggtattcctgctggtgtaattaatgtggttacgggtaagggcgatacagggcaatatttaattgagtcgccgctcgttaagaaagtttcgtttacaggttcagtaccaacaggtattgcgattggtaaactcgcgatgagcagcgatttaacccgtgtaagtctagaattgggcggtaaaaatgccatagctgttttagccgatgcaaatattgatgagattttaccgactttattgcaagcaacttttgtgcatcaaggccaagtttgcgcatccccagagcggttttttgtacatcgtacaaaatatgatgaactagttgataaactctcgaaagcactttcgcagtttaaaattggatcagctatggatgaaggaagtatgtttggtccactttctaaccagccacactttcataaagtgaaacattatttagatatggctaaagctaacaaccagattattgctggaggtgaggctttagatcagatcggatattttgtacaaccgactttaatttcctttaaaaatacggatgatcctttattttcagaagaaacctttggtccagtggtcggggtaatgccattcgaaactgatgaggagctcattcaactgatgaaccagtcgcgctttggtttaacggcaagtatttggacaaatgacttatcgaaagctttgcgtttaattcctaaaattgaagcagggaccttatgggtaaatatgcatacgttcttagacccatcagtgccatttggtggggtgaaagcttcgggaattggcagagagttttcagatgcatttatcgaagattacaccgaattaaaatcggtgatgattcggtattaa

SEQ ID NO: 3212 - DNA, 240 bp, Acinetobacter baumannii
tttttattaaatttaactttatgtatagatttgatgagtagcgtttggatttgtaagttatttcttcgctattcaaaagtgagtgtcattaaacttaacttatcagctcttgaaattttacagccgaaatttatggtaatggccataatgagtcattttatcaaagtggctttaagtacatgtcctataaaaaccgtatgcaattcaatgcaagctatggaaaccaactggcacatataa

SEQ ID NO: 3213 - DNA, 261 bp, Acinetobacter baumannii
atattattaaaagttggaataaaagtgggattatatacaattagatatggttatcgtaacaacagtttttttattgcttcaaacacggctgggcagtttattgtgattgatgcattaggagcagatttccagattggtcatcaaatttcttatgaagggagcaaaataataaacgaaacattaaatgatgaaacggaagcaaaagttcatcttgagagcaacgaaaaagaagcttatgagtatttacggacaatgaaataa

SEQ ID NO: 3214 - DNA, 186 bp, Acinetobacter baumannii
aagagattaaaaagcctgtgccttttctgggagaaaaaaaggcacagcaaagccgtaaagactgtgcttggcacatctcaagttttattgttgctaagttttggtcgtgacgatttaaagcctgaaaagcctataggcgatcaaacttttttaaagcgatttaagttgtgtcgagatagtttttga

SEQ ID NO: 3215 - DNA, 1290 bp, Acinetobacter baumannii
tttcgtctaaaggaaaaggacatgaaatataaagggataatttctttatcattattaatgagtattactttgcagcaagccaaggctgaaagcgaagataactcggcgctaaatgaaaaaataattaaattacaacagcaaatagattatctcatggagaggcagaacttaaatcaaaataacggattgaataaagcacctgaattgagtccaaacaaaacatcaaacactgataagcctgtttcggctgatcagactaaaattaaattttatggaaatatacgggttgatgctgcatatgattttgaaggttcaacgcgttcaattgcgaataaaacagggtcaataccattagacaattcaaactcaagaagtaaatcattaaatgtttctgctgcgacttcacgtgtaggggtggatatcgttaagccgacctcgaagggagatttggttggaaagctagaagccgatttcatggggagtggtggagataacggtaatggttcgattcgggttagacacgcttatatttcactaggaaattggttgattggtcaaactacttcaccttttgtgaatagtgatacagctccaagtttggttgattttacaggtgcgatgggtacgggaactcagcgtaatatccaaatccgttatcaacacattgttgatgccaaacaaaaaatattagtcgctttggaaggcggtgatgttgaaaataaaaatgtagaaggtggaagtcgttttcctgcattaaccatgcgatatgaatttaagaatccagattttttggttcaattgcatggcatgcttcatgaaaatcgagcaatttctaatgcgaatgaggagcaaactaaacttgcttggggcgtcggattaggtacgaagtataacctttctgaaaatgactcagttgtgtttaattactatcacatagctggtgataatcgttatatgctttattcaaaagataatgatgccttctactttgatcaaaatcgaatgtatttaagtgaatttgattctgtcgagttggggtatatgcgtaaatggaatgaaaatttacgttcttctttgtccgctggtagcctcgtctacaaaaattcagatttttcagaaaataaccctgaacaaaataaaaggctaatcaatgcaagcgttaatttattttggacgcctgttgaaaaagtcgatcttggtgttgaatacacttacggtaagagagaaacattttcagatttagaagggaaattatctcgaatcaacttattaggtcgatataacttttaa

SEQ ID NO: 3216 - DNA, 438 bp, Acinetobacter baumannii
atgtcaataaagtatgtggctatgaatattagcgagttatcaaaactaagtggtttaagtacccctacaattcgttattacgagcaaatcaaacttttacccaaagccaaaaggaaatcgaatggctatcgtgaatataccgataacgatttgaaacaactttctttaattcagcaagctcagcaagtcgggttttctttagctgaaattaaagcatttttgccatcgaaggtggctgtttgggaccatgacgcactcatccaaacacttgaatctaaaattcaggaaatcgaacttttagaacaaaagctaaaagtcagtaagcaaaacttacgtactatggttgaagcaattaataacaaacccgatgaaattacctgtgaagaaaatgccgaacgtctcatgaatctctattacgataaatcaaaaactccgtaa

SEQ ID NO: 3217 - DNA, 471 bp, Acinetobacter baumannii
caacttgtaaataagaggaataacattatgaattaccgacatattattgtacctgtagatggttctgagatttctttggcagcagcacgacaagccgcccatatcgctaaagcttttggtagtaaacttacagcaattagtctagttgcagtggacccgtttagtggtgttgatttctattacatctctcctgttgtaaaagattattttgttgaagcgcgtgctaatgcagaaaaaacacttgcgaaagtaaaagccctatgcgctgaagaaggtgttgatattgaaacacaaattattcaaggtgaaatctcatctgatggcattcttaaagctgtagaagagttgggttcagacctgattgttattggttcacatggtcgtaaaggtttccaaaaacttattttgggtagttttgcgcaagatgttctaaacagcactaaaatccaagttttggtggtaaaagaataa

SEQ ID NO: 3218 - DNA, 294 bp, Acinetobacter baumannii
attagttcaaaggcagtggcctttagaaaaagtaatcataattacaataaggagttttatatgattcaacgtatctctcatcatgatttagaacatgtatacgcaactgcggttaacacaattcagtctcaaatgaatttccaagatgcagttgcacagttagaagaagttgctcgtgctggtcacggtaaagctgctttgttcttagcagaactatactaccaaggtttccgtgttgaacgtgattccatgaaagcacaatactggcagaaactagccacgatgcaagcataa

SEQ ID NO: 3219 - DNA, 954 bp, Acinetobacter baumannii
agtttctcaaatggagttgaaagcatgaacattcttggtttagaaagtctggtttttggagtattagacttagatgcgtgtcaccagtacttgctagattacggtttaaatcttgttgaaaaaaatgaacgtgggggaacttacgaagctttagatggcggtactgttatttttaaattagatacagatccatcattgccaaaagcgaatgctccagcacctaatatccgtgaaacagtgtacggcgttgctgatcaaaatgaattagatcttattgcagcagaactttctaaagatagagaagtgagtgttgacgatgaaggaacaatccattcttttgatgatagtggatttgcaatcgcatttcgtattacacgtaaacgtaaaatagttgcccctcatgtagggataaatgtaccgggtcaagaacctgggcgtgctgttaatgaatgtggcgtattgcttgaagatcatagtaaaacaccacgatctctttctcatgtcgtttatttcgttccagatcataaaaaggctgaagctttttatgccgatcgactcggtttcatcacgactgatcgttttatcaatattggaccttttatgcgtccagctggcttaaatgaacaccattctttatttctaatccaaagctttaatccacatatggtgggtgtaaaccattttactttccatttcggatcaggttatgaggttttaagaaatggttgggaatttgctcagaaaggatataagagcttctggggaccaggccgccacattatgggaagtaatttcttttggtatttcaatagcccatttggtggaacgatggagtttgatgcagatatggacttgcatgatgacaattggacaccacgtgcaatgccaatgggaagtgacgcctcacaagtcttcttatttgatcaacgtaaaaaatggtcaccaggagaataa

SEQ ID NO: 3220 - DNA, 207 bp, Acinetobacter baumannii
gaaatgccaaaatacttactattagcagaaaaaatttctaaaaatattaaacaagattcttcaaacaattatctagaaaacttaaataatttaattatagaaataaaaaaagccattacaggaacggaattaaaatttttatataattttttagatttcagtggttcgctacttaaccttcaagatgaagggcagagtaaaacttga

SEQ ID NO: 3221 - DNA, 4860 bp, Acinetobacter baumannii
gtttttacaaaaatgcaaaacatacttacttttattaaaaatggtcaaaaatttactttagatgcaagcaatattaaaagtgtaagagatacgggaaatggttttgaaatcactcttaaaagtggtgagataattcaagctgagtcctatagtgttactcctaatactcagccagtggagcaagtttctagtcagcaagtagaaaataattctgaagctgatgaggaatttgaaaaagaagaagttttaaaagaaaagagtttattggattcacaaacaatgttatggggtggtgctgcgatcgcacttggtggtattgcgatagcagcatcaggtagtggtggttcagcaccttctgatcaaactcctccagcaagtttaactaaaatactgtctaaagatggtaaagctgtaagtggtttaacagaagctggagcaactgttatagttgaaaattcggctggaaaagtaatcggttctgccaaagcaggagcagatgggacatatttaattaatttagataaagcctatattaatggtgaaatactaaaagtttctgctcaagatactgccggtaatagtacagttaaacaagagcttatcgcttctgatattacagctcctactttaacacatgctatttcttctaacggtaaaactattacaggtttgacagaggctaattcaactgtcaccgttaaagattcatctggaaaaatcattggaactgcaaagtctgataatgatggaaaatatacagtcatactggataaagcttatttaaatggtgaaaatcttactatttctgccgaagatttagttggtaataaatcaacaattcaaacaattttggctgacgataaaactgcgccaataggtttaacagttgcaattgatacagcgggtaaagtagttaaaggtgtaactgaagccaatgctgttgtgacagttaagaatgctgcaggaattgtagttggtacagctacggctgataccgcaggtaaatactcgattacactagataaagtatatttaaatggtgaaagcttaagcgctactgcatcagatcaatctggtaatgctacagcaccaaaaaccattatcgcaccagataccacggcaccatcaagtttaactgcaagtattggtactgcgggtaaagtagttacaggtgtaactgaagccaatgctgttgtgacagttaagaatgctgcaggaattgtagttggtacagctacggctgatgccacaggtaaatattcagttaccctaaataaagcttacttgaatggtgaaagcttaaatgtaacggctgcggataaagcgggtaatgctaccgtaccaaaaacaattgttgcaccggataccacagcaccatcaagtctgactgcaacgattgatgccgcaggtaaagcaattacaggtgtgactgaggccaatgcaacagtaacagttaagaacgtggtaggaaccatagtgggtacaggtacagctgatgccacaggtaaatattcagttaccctagataaaatttatctaaatggcgaaagcttaagtgcaatagcggcagataaagcgggtaatactacagccgcgacaacaattattgcatcggataccacggcaccttcaagtttaattgcaacgattgatgcttcaggtaaagtcgttacgggcgtaaccgaagcgaatgctgttgtaacagttaaaaatacagcaggaaccgtagtgggtacaggtacagctgatgccacaggtaaatattcaattacgctagataaagcttatctaaatggtgaaagcttaaatgctattgcagcagataaagtaggtaatactacaacaccaaaaacaattattgcaccggataccacggcaccttcaagtttaattgcaacgattgatgccgcaggtaaagtggttgcaggtgtaacggaagcagatgcaagagtaacagtagaacaagtaactgctgtttataaagaagtaacggttttagaaacccaatttattctaagtgagtcagtacagacaaattatttatcgaagacatattcttttgaagttacaggtacaaatgcacatgtttctttaaatttgagttcctcgactaattcactttctggtagttatagttcaattctttctggagcgagtttaaatacaagactaactggtaatgtttcccaagctggagacggcaattacagtattgatttagcacaaggttcggtattaccgcctggaacctatactttgacagtaaattattctagttcaatggtccccgttataaacgtaaatgtaacgcaagaagtgccaaaaactattttagaagtagaccattacgaaacaaaagtcgtaggtgcagctaatgcagatgaggcaggaaattattccataactcttgataaagcttacttaaatggcgaaagcttaagtgtaacggcagcagatcaatcggataataaaactgaagtgaaagaggttattgcaccagatagtacgccaccaattttgcatcaaccaactattcaaggtggatggactgaagggcaatcagtacaaggtacaactgaagcaaatgccacaataattgttaaaaatactgcaggtgatgtaatcggttcggcaatagctgatgcatccgggtattacaatgtaattttgaatacggtttatgaagatggtgaactattaaaagtaattgctgcggatgctaaaggtaatgaaagttcaattaatataaatacacctgatattacagcacctatattagctaatttgtttaattatgatgttagtacagataaaattatttttaatgcgccaagtgatagttatattgttgagcaaaaaattggtgatgcttgggttcaggtaaatgttgaggaaaaattcgattggttgaatacagaattcagagtaactgctaaagatctagctgggaatagctctcaaccactaaccattataattaatactgcatcgggaacttataagccaactgatcctacatttattcaaattattaaaggatctataggaaatgattatctttatggtggtaatggggatgatacattagtttctaatacaggctctgattatttgtatggtggctcaggtaatgatacgttgatttatggtggtaattccaatgtgtatacggctttacaaggtcaagctgggaatgatacttatattgtagataaagcattacttacttcatcaagctctattcatattttagataatgcagctgaagaaaatatccttcaattaaaatcagtgtcctctggtgatatttcacttaagcagtcggattcactcatcataatatcattcaatgattcagcatcgacaatacgttttggtgaggggcaattatcttctattgtatttgatgatggaacagtctggaataaagcacaaattgaagctaatactattggtaaattattaggtactgatgcagcagataatcttcaagcagatgctgagatttcaactatttatggtttgggaggcaatgatacgattcaaggtggtgtacagaatgattatctgtatggtgatgatggagacgatacattagtttctaatacaggctctgattatttgtatggtggtgcaggtaatgacacattgatttatggcggtaattccaatgtgtatacggctttacaaggtcaagctgggaatgacacttatattatagataaagcattacttacttcatcaagctatatccatattttagataatgcaactgaagaaaatacccttcaattaaaatcagtatcctctagtgatatttcacttaagcaatccgattcattaatcataatatctttcaatgattcagcatcaacaatacgttttggtaaggataatttatcttttattgtatttgatgatggaactgtttgggataaagctcaaattgaagctaatactattggtaaattattaggtactgatgcagcagataatcttcaagcagatgctgagatttcaactatttatagtttgggaggcaatgatacgattcaaggtggtgtacagaatgattatctgtatggtggtgatggagatgatacattagtttctaatacaggctctgattatttgtatggtggctcaggtaatgatacgttgatttatggtggtaattccaatgtgtatacggctttacaaggtcaagctgggaatgatacttatattgtagataaagcattacttacttcatcaagctctattcatattttagataatgcagctgaagaaaatatccttcaattaaaatcagtgtcctctggtgatatttcacttaagcagtcggatttactcatcataatatcattcaatgattcagcatcgacaatacgttttggtgagggacaattatcttctattgtatttgatgatggaactgtttgggataaagctcaaattgaacaacatattgccgaacctgtatttggcacaactgttaacgatgtaatcgagacaaacataccaaatcagagttactcttatattctaggagatggtgcagatactgtagtttttaatattctcgataatacagataatttaggtggaaatgttaagactgaatggacagattttaatcttgtagagaatgataaaattgatttttctcaactgtttataaatgacagtggagatcttcaagattatattactgtaaaagatactgaggcgggactaattatttcagttgatagagatggctctagtcaatctacgtatcattcgcaagaattaattttgcttactggtaagcactatacgttagaggatttaatggcttcaaatgcatttattcattaa

SEQ ID NO: 3222 - DNA, 1413 bp, Acinetobacter baumannii
gagtggacaaatgacatagcgttatacgtaaaagcatgtggatgcattttaattaaaaaggaattagaaatgagcctaaaaaaagttcatcgccactcttgggtatcattagtgatttgctggattatctgggtagttgttgcatacgaccgagagttgattttccgcgcagccaatatgatttgtaatgaatttaatttatctccaacgcaatggggatacaccattgctgcaattacactttctttggccgttcttagtattccggttgctgctttaagtgataaacatgcgtccggttggaagcgaggaatttttcagtggcccttagtaatcggatttacttttatttcgttgctttcaggcattacatctttaagttcaagtttttataagttcgtaaccttacgtattatggtttctttgggttgtggggtggcagagccagttggggtgagtaataccgcagaatggtggcccaaggaacatcgcggttttgccataggtgctcatcactcaggttatccggttggagcgctacttagcggtgttgcaatggccaccatcattacttattttggtccgcagaattggcgctatgccttttttcttggaattatatttgctgtaccggcattaactttttgggcgatttattcgacccgtaaacgttattcagagtttcaccaatcttgtgtagataatcaattcacaccaccaacagattttgtgcacgatgaaggagaagaaaaaacaagtacgcatagtacatgggaacgtttaaaacaaactctaagttctcgaggaattgtgtttaccgcagccagtactttaattacccatgtagtttatattggttttttaactatctttcctgcatttttatacaatattgtcgggttagatctggcgaaatcggctggcttgagcgctgtatttacaattaccggcatgatggggcaaattatttggccgactttgtccgataagattggcagacgtctcacattgattttatgtggttgttggatggcggtcagcattgcaagtttttgtttaacctcaggcgtggtttccgtcatcgcaatacaactgttttttggtctatctgccaacgcaatttggcctattttctatgcgacagcatcagattatgcgccagccggagcaattggaactgcaaatagtttaattacagttgctcagtatgtaggtggggcagtcgcaccgattattatgggatatttgcttacgagctttggtggttggcatagtcatcaggggtatatctggtgttttctcttaatgtcatgttgtgcgtttattggcgtgattttgcaaattatattgggttatctcattaaaaaagaaaaattagaacaagttgataatttaagtttgtgtgcaaattaa

SEQ ID NO: 3223 - DNA, 1800 bp, Acinetobacter baumannii
aaggatcaaaaaatgaatgatcaaaataaacggatttttttacgtagccaagaatggtttgatgatcctgaacatgccgacatgaccgctttatatgttgagcgttacatgaactatggtttgacccgtgccgagttacaatcaggtcgcccgattattggaattgcacaaaccggtagtgatttgaccccatgtaaccgtcaccacaaagaacttgctgaacgagttaaagcgggtattcgagacgcgggtggtattccaatggaattccctgtccacccgattgcagaacaaacccgtcgtccaactgctgcacttgaccgcaacttggcctatttaggtttggttgaaatcttgcatggttatccgcttgatggtgtagtgctgactactggctgtgacaaaactacccctgcatgtttaatggcagcagccacaacagatatacctgcaattgtgttgtctggtgggccaatgctagatggacattttaaaggtgagttaattggttccggcactgtgctttggcatgcaagaaacttacttgccactggtgaaattgactatgaagggttcatggaaatgaccacttctgcttcaccttcagtcgggcattgcaacaccatgggcactgcactttccatgaatgctttggcagaagcgttgggcatgtctttaccaacatgtgccagtattccggcaccgtatcgcgaacgtgggcaaatggcctatatgaccggcaaaagaatatgtgaaatggttttagaagatttacgtccttctaaaattatgaccaaacaatcttttgaaaatgcaatcgcagtagcctcagctttaggcgcatcgagtaactgccctcctcacctcattgcgattgcccgtcatatgggtattgagctgagtttagaagactggcaacgtgtgggtgaaaacattccgcttattgtgaactgtatgccggcgggtaaatatttgggtgaaggttttcatcgtgcgggtggtgttcctgccgttctacacgaattacaaaaagctggtgtattacacgaagattgtgcatcggttagcggtaaaacaattggggaaattgccaaaaatgcaaaaacctcaaatgcagatgtcattttcccttatgaacaacctcttaaacatggtgccggtttcattgtgctcagtggcaacttctttgacagcgccattatgaaaatgtctgtagtgggcgaagcatttaaaaaaacctatttatcagatccaaacaatgaaaatagcttcgaagcacgcgcaatcgtttttgaaggtcccgaagactatcacgcacgtatcaatgaccctgccttaaacattgatgaacattgtattttagtcattcgtggcgcaggtacagtgggttatccgggcagtgctgaagtcgtcaatatggctccaccagcggagttgattaaaaaagggattgattcactgccttgcttaggagatggtcgccaaagtggaacttccgccagtccatctattctcaatatgtcacccgaagcggctgtaggtggtggaattgccttacttaaaaccaatgaccgtttacgtattgatttaaataaacgttctgtgaacgtactcatttctgacgaagagttagaacaacgccgccgtgaatggaaaccgacggtatctccatctcaaacaccttggcaagaaatgtatcgcaacatggtaggtcaattatctactggtggttgtttggaacccgcaactttatatatgcgagtcgtaaaccaagacaaccttccaagacactctcattaa

SEQ ID NO: 3224 - DNA, 219 bp, Acinetobacter baumannii
agttgccaaaaatcatggcagcaaaaattgcccatgcagtttttgcgggaaacctccactcagcttcaacatgcttattcatttatgattacccaaaattttattattaagttcttaggtcaacggtggcgctcaccgacattccaggttttatcaaatcaatatgtgggcttgaatctatggcgatacgtacaggaatacgctgtacaaccttgttaa

SEQ ID NO: 3225 - DNA, 1062 bp, Acinetobacter baumannii
atgtttaaaaacaggtttttcaatacaatgcaaattcaaaatcaagtacagcttaagccattcaatactttaagtttagatgttacagcttctcattacactaaggtcaaatctattgaagatattgaagaagctttagcttttgctaaagagcatgagctaaatgtacttgtattatctggcggtagtaacatgctattaccgcaacaaattaatgctttagttattcatcttgatattcagggtatagacgttttatctgaagatcaggattttattcgagttaaagtcggtgcagggcaggtttggcacgatttcgttttatatagtacaaagcagaattggtttggcttacagaacttggcacttattccgggcttggttggtgcttcaccagtgcaaaatattggtgcttatggtgttgaggttggtgagtttattgagtcggtacaagtctatgaccgtctattaaaacaaaccggatcaatttcggcagcagattgtcatttttcttatcgacatagcatttttaaagatgacccagctcgttacatcattactcatgtcacctttaagctgcttaaacaagccaatctaaagctaaattacggtgatttaaaacaggcagtaggagataacctgactgctgaaaatttacaaaatcaggtcattcatattcgtcaaagtaaattacctgatccaaaagaatatccgaatgtaggaagtttctttaaaaatccgattgtaaatactcaagaatttgaacgattaatcgcacaattctcaacaattccacattatcctcaagcgaatggtaacgttaaaattgctgctggttggttaattgatcaggctggatggaaaggtaaacagctcggtgtagtgggaatgttccataagcaagccttggttttggtgaattatgccaatgcatctcttgcggatgtaaagaaaacttatcaagctgtacaacatgatgttgaacagcgtttccaaattatgttagaaccagagcctgtgctttataacaatttaggtttaattgaaaatcatacggaatag

SEQ ID NO: 3226 - DNA, 1383 bp, Acinetobacter baumannii
ataacaaaaaataaagcgcctcaaaacaggggcgcatctcagaaaagacaaaagggacttgaaatgccaaatgtaatgaaattgagtgtgctaacaattgctgtattgggcagccaatttgcacttgcaaatgagccgtggtcacaagaccgtcaatggttgcttggtgattggaatggaaaacgccagcaattagagcaacagggctataaatttactgcttcaattatgagccaaagcgccaccaatttagatggtggttataacgacagcaatacttttgaaaatgccgcacaactttctttaggtgccaacttcgatttagaaaaaattgctggttggaaagatacaacagcgagtctcgttgtgactaaacgtgatggtaatgcgcttactttagagcgtattaaagacccacgctctagccaattaggtaacgcgcaagaaatttatggtcgtgggaaaatttggcgtttatcccaagcatgggtgaagaagggctttgttgataatactgtacaggtcaaatttggtcgtatgggaatgtcagaggactttaatagttctcaatgtgagtttcagaacttattgctttgcggtgggcagttaggaaaatcaattggttcaatttggtataactcaccagtcggtgtttgggctacaaacgttaaatatcagtttgcacctgagtggactttaggtgttggtgtgtatgaggtcaatccagacaatattaaaaccgaatcaaacagtgatggttttaatctggatatgaataacgtcaagggcgctaccataccagttgaacttgcatggaaaccaaaacttgctgcttttaatggtttaccgggtgaatataaagtaggtgcgctgtactcaaccgcagaagcaaatgatattaaaactgcgggtaaagtgcatgacggaaaacaaagcttctggattaatgcacagcaacaacttagccatgccggccaagatccgaaacgcggtttatatgtaagttttaatggcgttgtaaatgataaagcaacgacatttgttcaaagtacgcaacagcttgctctttggtataagggaccgtttgatagccgtccaaatgattcgattggttttggtattgccaattatgtagtcaatgaccgtgctaaagataaacagatcgcgacaaacgaaagccgcggatactatagctatgattcgattgcatctgactatattccaattcaagacgacgagttaaatgtcgagttgaactatacctatcaatggtctccggccgtcatgttacgtccaaacattcaatatatccatcaacctgctggtgtgaaagaagtcgatgatgcttgggtggcaggcctgagtgtaaaagttaatttttaa

SEQ ID NO: 3227 - DNA, 183 bp, Acinetobacter baumannii
gtgcgaaaaaaagcaaaacaagctttttcacaaggtgactttgatacatctgcttttactttttctaatggtgtattttgtgataccactactaaattgtgccatgtgaataaattttttgaaaatggtcatagaagtagagtagataaaaaaatgactgataaaatttttaaaaataggtag

SEQ ID NO: 3228 - DNA, 927 bp, Acinetobacter baumannii
ataatgaaaaacgtaggaatgaagccggaaagttatcgtgttgccgaagcacaagcgattttatatgcaccaccgcactgtattgaactattaagacaaggaaacacggaaaaaggtgatgcattaaaaacagcacgtgttgcaggaattttggcggcaaaacgaactgatgagctgattccactatgtcatccgctaccgatttatcgggcagatgtagaatatgaattggaacatgactttgtaaaaattattgctgtcgttgagaccattggaccaactggtgtagaaatggaagctttaacggcggcaagccttgcaggtttaaccatttacgacatgttaaagccccattgtgaaccagaagaactctggatggatcaatgtaaactacttaagaaaaaaggcggaaaatcccattttaaacgggtattgcgtcagcctgtttcggctgcggttattgtattgtcagataccgtagccgcgggtagaaagccggatacggccggaaaatctgtagttgaaactttaactgaagctgggtttgatccgatccattaccaaattttgcctgatgaagcagatgatctcaaagaattggtcctagaactcaccaaatcgtatgcttgtattatgaccgtgggtgggacaggaattggtaagcgtgacattacagttgatacgctagagcctcttttagagcgtaaattagatggcttaatggaagctgctcgctcatttggacaaaaacgcacgccatacgctgctatgtcacgcggagtagccgggtttattgaccgttcgttagtagtgacgttaccgggaagccgtggtggagcaagcgaatcaatggccgctattttacccgcattagtccatatttttgatgtttgccgtgatttaccacatccaggaggctatgaataa

SEQ ID NO: 3229 - DNA, 219 bp, Acinetobacter baumannii
aaaatgaaaaattctaatttctttgtggtttttattggttctatttgttttgcgtttagtgcaaatacattggcacaaaatacagctgcagttttttcacctaaaagaggtgtagtctgtgataaatatatttgtgcagataaaaagggcgtttccaaatccttaactaatcaatatttaggtgcgaaaaaaagcaaaacaagctttttcacaaggtga

SEQ ID NO: 3230 - DNA, 972 bp, Acinetobacter baumannii
atgatgaaaaaaagtttattgggcggtcttattctgtctttgtgtacaactccagcttttgcattaaatattttattggttaacgatgacggcctaacgagcaatatcaaagcactttatgatgaattaaaagcaaatggtcataacgtgcttgtgtctgtgccgtgttcaccacaaagtggacgcggtggcgcgattgtaatgtatagctcaacaacgattaccgcggataatgataagcaaattgcggctgaaaatggttgtcacaacggcgcagcaccaattggcgcacctgccgctggaacttttaccaaagcgggttataccaatggcgactggaactacacgcatggcacaccagtcatggcaacagtttatggactagatgtggttgcaccaaaacgctggggtaaagcaccagatttggttttatctggcccgaatgaaggtcaaaatgtcggaaaagtcgttgtgcactctggcacgattggcaatgtacagttttcggcaggacgtggcattccgtctattgccttaagcgccgataccaacacggtagatgacaaaactttaagcaaccctaactctgcgattgtggcaaaacaaaccgtagtgttattaaaagaattacaagctaaggcaggcaaggaccagttgttgccaaaaggcattaccctaaatgtgaatttccctaaaaatttaacaaccagcacgccgtttgcgttttccaaaattggaacttacgacttatataaattgaagttccaagtgaccaaagatagtaaaggcaacaatcaatttggcttaggaatcgatgcggcaccatcggcaccaactgccgctcaaatgtcggatgaaagcgctgtaatgcaaaacaaaattgctgtgactgcaatgcaagttgcttatgaccaacgaccagcaggtcaagaatggcttaaaatccgtttaaaaagcttatttaacaagtaa

SEQ ID NO: 3231 - DNA, 1194 bp, Acinetobacter baumannii
cctattgaaaatacaaaggttcacgtcttgttcccaccatttacaatccaaaccagattaggcggattctacttcttttattattccattgttggcacatttatgccgtattggaatttatatctccaagatcaggggtttaattatcaagagataggtattttatcttctattgctattgtgacgcgcttctttgcccctttggtttggggctggatcgccgataaatccggtaaaagaatgctattagtgcggattgccacatggatggaggcatgtatatggctggctatttttataattcctaatacttttcagtcagttgctttactaatgcttatttttagttttttccaaaatgctattttagctcaatttgaaggagtaactttattttggttaggagaccaaagggcgaaactttatggcaagattcgaaaatggggatcagttgggtttattgtaggtgtatttacaataggggcaattttagaaatcattccgatttcaatgttgcctatattattgcttatcattgcctccttagcatttatttgggcatttacgatacgtgaaccagaaggagccccaacttcacaaaagcatttagaacctttattacctgtgctgaaacgtcctgaagttgctgcttctttcacaattgagtttattcttcttttttcacatgcacctttttatagcttctatagcaattttctgaaatcgttaaattttagtacgacggaaattggttttttatgggctatgggcgtggtttctgaaattgtgatgtttgcatatgcaactacgttttttaaatatttttcttggcgtagccttgtagcagtatgtttgattttgacaagtatacgctggttattagttgctattttctctcactatttcataggtcagttatttgcacagtgcctacacgcttttagttttggcttatttcatctcatcgcaatgcggcttatctttcaaaacttttcaatagggcagcaaggtcgaggtcaggctttttatagcaccatgtggggacttggagtggcgtttgggagcattttggctggtcattactggaaaattcttacgggcgagcatatttttatgatcgctgctttagtggttctattgggtttgtgctttgtctattggttgcctaaacgaatcgaaaagtcagtttcttag

SEQ ID NO: 3232 - DNA, 2886 bp, Acinetobacter baumannii
agccaaagaaattgttcaaggataattatgctagcactagagcctcaacatattcatatgaatcaacatgctgttgataaaacacatgcattaaagtgtctagtagatatattagaaaaagatgggttagttacgcctgaatatataacgggactcatcaatcgtgaacaacaaagcgcgacttatttaggccaaggcattgccattccccacggtactcctcaatcacgtgaatatattttaaaaacagggattcgcttagcccatttccccgaaggtgtgatctgggatggagaaaataaaatttatttagctgtagtgattgcagcaaaatctgatgaacatttgcaagttttgcaaattcttactcgtgcattaatgcatgacgtcagtgaacaagtaaaaaatgcttctaaacctgagcagattatcgaattactacaagctcagccattatctttagcgcttcatgaaaatcttattcaaaccgaaatcgacgcacaagatatcgaagatttattttgggcagcttctcaaacactcaaaaaacataattttgtaaaatgtggttttctaagttcacttgatccagaacaagccattcaactgcaagatcaaatctggtccatttctagcaatcactttgttcagcaaccagctattagcattactaaaccatcacaggctttagagctaaatggtaaaaagctgaacaccctcgtttgtatagcagccaatgaccaactcgataatgaaagatttaatcgtttaattgatattttatttaaccctgagcaagttgccgagctagataaaactcaaactccaaacgaaattgcaaaaattattggagctgacgttgttccggactggcctcaacgttcagtagtactggcaaatgcacacggcttacatgcccgaccagccacgcaccttgtcaatcttacaaaaacccttcaaggcgatatccaagttgcagtagacgatagtagctttgtttctgccaaaagtttaactcgtcttttagcattaggttgtaagcgtggccaaactctacgttttatcgctgagccagaaaccgatgccgtagaggctttagatcaagttattttggcagtgcagcaaggcttaggtgaagaagttgaagcgctacctgtaaccagtgaaatacctgaccagctccctgcccaaacggcaatatcaaatgctacaacattgggtaacaatacgggaattgcagcatcaagtggcttagcttttggacctgtccatgtgattaaaccaaaggtttatcaatatgaacgtatgggttcaggcgtaaaagtcgagaaagaaaatttagatattgccctacatgcagtaaaaaacaatattcaccaagtcatagccaaagctgatgcctctgaaattaaacaaatctttcgagctcacctagaaatgcttgatgatcctgatttaattaatggtgtatatcaaaaaatttatcaaaatttatcagcaccagctgcgtggcatgaacatattgaagctgcagctaaagcacaggaagctctaccagatcgtttactcgctgaacgcgcaacagacctacgtgacattggcgacagagttttaacccaattatgtggtgaagtggcaattgaagagcctaaagagccttatattctaatcatgcatgacgtggggccaagtgatgtcgctcgtctaaataaagaccgtgtcgcaggtattctaactgctataggcggtgcaagtgcgcatagtgcaattgtcgcacgtgctttaggcattccagctattgttggtgctggtgaacaagtcctagaaattgatccgaaaagcactttacttattaatggtgatacgggaacttttgttttagatccagatgcggcacaaatcgaacaagccaagcaagagcgtgagcaacagcgtcaaattcgtgaagaagctgaacgtcatagccacgagccagcaattaccttagatcaacaccaaatcgaaattgcagccaatttgggtaaagttcaagcgacagcgcaagcagtagaatgtggtgctgaagcaattggcctccttagaaccgagcttgtttttatgtctcatagcagtgcacctaatgaggctgttcaagaagctgattaccgagttgtattagatgcacttgcaggtcgcccgcttgtagtacgtacattagatgtaggcggtgataaacctttaccttacttaccaattgctgaagaagaaaacccattcttagggttaagaggaatccgtttaactttaagacgccctgaacttttaaaacagcaattaaccgctctattaaaagcatctgataatcgtccgttacgaattatgttccctatgattggacgcgttgaagaatggcgtgcagccaaagcaattcttgacgaagtaagagcccaacatccatgtgacaatttacaagttggcattatgattgaggttccgtctgctgctttacttgcaccggttcttgcacaagaagtcgactttttcagtatcggcacaaatgacctgacccaatatactttagcgattgaccgaggccatccaatactctcagcggaagcagacggattacatccaagtattcttaatttgattgatcaaacagtaaaagctgctcacaaacatggcaaatgggtaggaatctgtggtgagcttgcagcagaccctaaagctgtacctattctcatgggattaggtgtagatgaactgagtatgtccccaaatagcattcctttagtaaaagctcaaatccgtacactaagctatagccatgctcaaaagcttgcgcaacaagctttactatgcgatagcgcccctgctgtgcgccagctatctgaacaagacttataa

SEQ ID NO: 3233 - DNA, 993 bp, Acinetobacter baumannii
gaattaggaaaggatccctgtatgaatgtgttaattactggcggcacgggttttattggaaagcaaatcgccaaagagattttaaaaaccggaagcctgactttagacggtaaacaagctaagcccatcgataaaattattttgtttgatgcgtttgctggtgatgatttgccgcaagacccaaaaattgaagtggtgattggcgatattaccgacaaaaccacagtggcaaatattacagaaaaaattgatgttgtttggcacttagccgccgtggtgagttcggcagcagaggccgattttgacttgggaatggatgtaaacctttatggccttttaaatttattagaagaattaagaaaaaaacaaacaatgcctcgagtcatttttgccagtggctgtgctgtatttggtggtcaattaccggaagttgtaacagatgatacggtggttacaccaaagtcctcttacggtatgcaaaaagcagtaggagaattgctcgtttcggattattcacgtaaaggctttattgatggccgtgttttaagattaccgactattgtggttcgtccaggtaagcctaataaagccgcctctacattttttagctcaattatccgcgagcctttaaaaggtgaaacggcagtttgtccagtcccgccagatactccggtttttattacttcaccacgacgctgtgttgagtcaatgattaaggctgcgtcaatttcttcagaggcactccaagataaccgaattattcccttaccgggattgaccgttaccgttaagcaaatgcttgaggctcttgaaaaagttgctggtaaacaagcaactgatttagtgcagtggcaagaagataaaacgattcaaaggattgttcaaagttggccggttcaagtgaaagctgaatatgccgaatctttaggtttccaagcagatgagaattttgaaagcatcattcaggcacatatagaagatacccaaaattaa

SEQ ID NO: 3234 - DNA, 1128 bp, Acinetobacter baumannii
tataaaggaaacccaaagatgaaatctcgtgcagctgtcgcctttgccccaggaaaacctttagaaattgttgaagttgatgttgcaccacccaaggctggtgaggttttaataaaaattacccatacaggggtatgccataccgatgcttttacattatctggcgatgacccagaaggtgttttcccagcgattttaggtcatgaaggtgcaggtgttgtagttgaagtaggcgagggcgtaacaagtgttcaacctggcgaccacgtgattccactttatacagctgaatgtaaagaatgcttattctgtaaatccggaaaaactaacttgtgtgttgcggtacgtgcgacgcaaggtaaaggtgtaatgccggatggcactacgcgtttttcttataatggccaaccgatttaccactacatgggctgttcaacctttagtgaatatactgtagttgcagaggtctctttagctaaaatcaatcctgaagcgaatcacgaacaagtttgtttacttggatgtggtgtaacgaccggtattggcgccgtgcataacacagctaaagtacaagaaggtgattcggttgccgtatttggtttaggcggtattggtttagctgttgtacaaggtgcacgtcaagcgaaagcagggcgcattattgtcgtagataccaacccagataaatttgaacttgctaaacagtttggtgctaccgatttcttaaatccaaaagattatgaccaacctattcagcaagtgattgtagaaatgacaggctggggcgtagatcattcatttgaatgtattggtaacgtcaatgttatgcgctcggctctagaatgtgcacatcgtgggtggggacaatcagtcattattggtgttgctggtgcaggccaagaaatttcgacacgcccattccagttagtgacgggccgtaaatggttaggtactgcgtttggtggagtaaaaggccgttcacaacttcctaaaatggtcgaagatgccatgaaaggcgatattcaacttgagccttttgtaacacataccatgcctctacaagacattaataccgcttttgatttaatgcaagaaggtaagtcaattcgtactgttattcatttctaa

SEQ ID NO: 3235 - DNA, 1257 bp, Acinetobacter baumannii
tgtaaaggaaaaagaatgtttgaactctccaagaaagctcaagattttactgagcgaactaaaaaatttattcaagaagaaatagaacctgtcgaagcaaaattttgggaagaagttcatgagttaaatccagatggaaactggaaaaaatggcagtggcccgagcttttagaaactctaaaatctaaagctaaacaagctggtctttggaatatgtttttacccgatgaaaagctaggtgcagggttatcagttcaagaatatgcgcatattgctgaattaactggtcgtagtttattggcgcccacggtttttaactgtaatgcaccagatacgggaaatatggaagtgttatggcgctatggcagtgaacagcaaaaacaacaatggttagagcctttattggacggaaaaattcgttcggttttttgtatgactgaacccgatgttgcgtcaagcgatgcaaccaatatgcaagcgactgcactcattgatggtaatgaaattgttttaaatggcaaaaaatggtggtcgtctggtttaggtgatccaaatgctaaagtcattatttttatggcccatactccagatgaaactaaagaccgccaccatcaacactctatggttttagtaccgattgatacggcgggtgtcgaaattcaacgtatgttacctgtgtttggtgactacgatgcgccgcatggacatggtgaggttcattttaataatgttcgagtgcctattgaaaactttattggtggagcgggtcaaggttttgaaattgcacaaggtcgtttagggccggggcgtattcatcattgtatgcgctgtatcggagctgctgaaaaagcactagagcttatgattgatagaggtatgtctagaacggcgtttggcaaagaaattctaaaactcggtggaaacctagagcgtgtagccgatgcgcgagtagccatagatcaagctagacttttaaccttgtatgctgcttataaaatggatactttaggaaatatggctgctttaacagaaatatctgcaattaaagtagtcgctccaagcgtattagaaaaagtagtcgacatggcaattcagctacatggcggtgcgggcgtttcaagagatacgccattaacaggtttctttgcccaagcacgcagtttacgtttagctgatggtccagatgaagtacataaaggcatgattgccaaattagagttggccaaacgtggttatggtcgtcataagaaagtataa

SEQ ID NO: 3236 - DNA, 693 bp, Acinetobacter baumannii
tgtaagggaaaagttatggcaattggttttagagtgctaaaaaacgacagaaaagttgagcaaaaatggattgagcaatatcgagatctaccagtcgctaatgtaagtgactcaatgaaccggatgacttcaggtggagctcaattaagaccaatgcataaaaagggatatctttgtgggccagccattacagttaaggctcgtccgggtgacaacttgatgttgcactacgctatcgatatcgccgaagcgggagatgtcattgtggttgatgctggtggcgatctaaccaatgcattaattggagagatgatggttgcgtatgccattaaaaaaggtatagctggcattgttattaatggcgcgattcgtgattcagttgtaattggagaaggtgaatttccactttttgcagcaggaatttcacatcgaggaccttataaagacggaccgggggaaattaatgtccctatcgcaatcaatggaatggtaattgaacctggagacttgattttaggtgatgaagatgggcttttaagcgtgccgtatttggaagtagaagaagtttatctgaaagcaagcgccaaacatgccgctgaacaaaagcaattagagcaaatcgccgtaggtgaaaatgaccgtagctgggtgattaacagcttaaaacaaaaaggatgcgaattaccggaataa

SEQ ID NO: 3237 - DNA, 681 bp, Acinetobacter baumannii
aaagttatgaataaattattaacgattctattattaagtgccttggttgctgcatgtaataaccctaatagcacaaccaaaatcacccaagtgcagagtgaacaatctaataaccaaaaagaagcgttaaaaccacttgtggcagagttcaatgaaattatgaactctcttcagacagaagctgacattacatccacacaaacaaagttggaaaaacttttaaagaaatttccaaatgacaatgattcaagcatacaagtgcaaaagttgaaattaaaagtactactgcaactaggttatttaaatgaagccaatattttggcaacaaaaattctcgctttagatagcacggcaggcattcaagaaactcagtgtctaattcaaagaaaattgcaaaagccagaaaaccaaattaatagctgttatgaaaaagcagctaagctatatcaggcacaatacgaaaaattaagtaatgataatccacaaaagcaatatgctctctggtcaagttacgctgccctgtaccaagctggtcatactgaatataagcaaaagttgaaagctattgttaatgctcaaaccactgaagatgagaaacatactttcaacactatgtatgaaaacgtagtggacccagctgttattaaagaaattcttgaatctatgccatataagaaataa

SEQ ID NO: 3238 - DNA, 318 bp, Acinetobacter baumannii
gaagttatgaataaatatcttatgctaactcttcttgcaacatcttctctttctttgacaggttgcgcacaaatgtttccagctcaagctaccaaacttgaaaatggaaattatatgattcaaaccacctctaatattttaggttctaatgaagcaatggaaaacaaagtaaacaaaaaggctgaaaccgtttgtgctggaaaaggctttagtgaaataaataataaccatcaaactcatagccaacagatttatacagctcaagtaattacaacaggcacctttaagactttcaataagacgattaaatgtaattaa

SEQ ID NO: 3239 - DNA, 927 bp, Acinetobacter baumannii
tgcatcatgaataatattcataacctacatggcctagacttaagtttttttcaccgaattgatatcaatttatatccgctttttatcgcgatttatgagcaaaaaagtatttcaaatgcggcaagtagtctcaatattacgcagtcagcagcaagtcatgctttgcagcgtttacgtcagcaacttgaagatgatgtattcatacgagtaggcaataaaatgtctgcaacgccttttgccgagcagatttacccaactgtgaaacaagcacttttaactattcaaaatattagccagcagaagcatgtgttcgacccaacaagtttaaaaaacttaaaaatcgccgtgcatgatgaaattgagccgattattcttccaagattggctcaacactttcaaaatcttaatttagatttgcagtttgtcagtatgaaactcgatcgaaaacatattatggcggacttggcaacacagcagctcgatttcgtgattgacctagaacaatacttgtctccaaaaattacctttgatcatttggtcacagatgagttcgttatttgcagccaacttaaagaagtcgatttagctcgttatattagtggtcgtcacattggtgtttcgtcacgccgtacgggcgctttacttgaagatatttatttaaaccaacaccaaaaaatttcaagaaatgtatttatgcgctgtcaaaactactcaacggcgttacaagttttgggagcccaagtcgacgcaatacttaccatgccccgtatgattttgcagcatttatcttatagccctgagattcggttacattctctaccttttgagatgaccaatattaaaatgggtatgttttggcacgaagatttaagggataatttaagacatcaatttttgcgacatgaaattattaaactttttcagtaa

SEQ ID NO: 3240 - DNA, 231 bp, Acinetobacter baumannii
ttaataatgaaattaatatgtatcgaggtttattttatgagccttaaaaatctagatattaactcccgattaattagagaaatcgcaattattctaataattaaagtcgcgcttctcttaacaatcaaacatatttggtttgacgctcccactatccccaaaaattttgacaatcaggtcgccgagcatattgcaggcgataactcttcccacattaaggagacacgttga

SEQ ID NO: 3241 - DNA, 903 bp, Acinetobacter baumannii
actccaatgaatataaaacaacaatttactgaggttgaatttggacaacaaaaaatcaaagtacccaaaggtggttattatgaccgttttagaatgaatcccgatttagataaagtcgctcaagaccctgctgctggcaacatcgattttttccgtcatattcctaaaaaaattgtagagtcacgtgttggtcctgtttgggcacccaacttttattatcgtagtgcaaatgtacaactgctcatgcttgcacctattaaacagattaaggcaaaacttcctgctgacttaacgccattacaaccatttccaggttatgggttggtcgcagttacgttctttagctattcggtttgtgacaatgacccgtataacgaggtgtcgattgcggttgttgtacgtcaacctcatgctcgtgggcctcacatcgcagagttaatgaaatcgatgcgtcaacgccacttttatgcacatgttttagctttgcctgtacatacagaaattgctagagtccgtggtgtatatggttaccagttaccaaaatggttaacaaaaattgatatcggtattagttcaaaagaggttcaagccaaaattttcgatgttaatggaaaattagatttaagcttaaaaacccttgtaccgactttaaaacatgtcgattctgaaacacatattaataaagcaaccatgctacatgttgttgatggcaaatggcaccagacagaggttcaatcaaacattctttctttcgcgcaaaagctttttccaaagaaagtaagattagtgaaaaatgaaggccctttgacaaaattattaaatgaactaggtgcttcaaaaattctccgcttagatattatagaagatgcacaagtcgtccttaatttgcctactccgctataa

SEQ ID NO: 3242 - DNA, 825 bp, Acinetobacter baumannii
tgtgagatgaaaatgaactgtatagatacacatgcacatgttttttcgacacaggacctcagtatcgaaacagcacgttatgcacctgattatgaggcaactgtacaaagttttatctctcatcttgatgaacacaatttcacgcatggtgttttggttcaacccagctttttaggtaccaataaccaagcgatgttaaacgcaattcagcaataccctgaccgtttaaaagggatcgccgttgttcaacatacgacgacgtttgatgagctagtgaatctcaaggcacaaggcattgtaggtgttcgcttaaatctattcggtcttaaccctcctgcgctaaatacgcctgactggcaaaaatttttacgaaatgtagaaagcctcaactggcaagttgaattacacgcaccgcctaaatatctggttcagcttttaccacaattaaatgaatacagctttgatgtcgtaattgaccattttggccgagttgaccctgttaaggggattgaagatccagattatcagaagtttttaaacttacttaacgtaaaacagcactggattaaagtgtccggtttctaccgtttgggcactactccaaacaacataaatacggcacaacaggcctataacatttttaaagaaaaaggctttttacacaaactcatttggggaagtgattggccacatacccaacatgaatccttaataacttatgaagatgcgattaaagcttttaaacagattgtgtttgataaacacgagcaatgtttaattttaaatcagaaccctaccgagctgtttggtttctcacgtacataa

SEQ ID NO: 3243 - DNA, 549 bp, Acinetobacter baumannii
ggttttaagaagggtttatataaacaaaaacttgcactgatgaaaagtctcatcattcatttatctaaaatttcgtctgctttttactatcacttcggtttatacaataaaatattgaatattctgtgcaactttaagcaacaaggcggtttgcaaagcgatgtgaacaccccctataatgctgcaagattagttgaggatctatttatgactgaacaagcacgtgatactgaagcgttaattcgcgatcaaattgcgaagcatcccgttttactttacatgaaaggcactccacagtttccacaatgtggtttctctgcacgtgcagtagaggcgctcagtcaaattggtcgtccatttgcatatgtgaacatcttagaaaaccctgatattcgtgcaactttaccaaaaattgcaaactggcctactttcccacaattatgggtaaacggcgagcttattggtggtagcgatatcatgcttgaaatgttccaaaatggcgaattaaaaccattaatcgaacaatacagcgcagctccagaagcttaa

SEQ ID NO: 3244 - DNA, 693 bp, Acinetobacter baumannii
acaagtgagaaaaagatggatctttctaatattcttataggtgacacaacgtggtcctttgttttagaaattttggtccgttgtaccatcatgtttatcattatcattagttttctaaggctatctggtaaacgtggtattcggcaactctccttatttgagcttgccattattttatgtttaggttctgctgctggcgatcctatgtttactaaagatttaccgattgcccatgcattgatagcttttatcgctattctttctctatatcgcctggtcacttggggtatggtaaaacataaaaaaattgaagatttattggaaggaaaagcgctctgtgtcgttaaagaaggccttttagtctacaaagatttccaaaaacagacttattctcatgatgagtttttttcggaaatgcgccaacagaacgttgaacatttaggccaagtcagaacagccctgcttgaatcggatggtattctaagcttgctttattatgaagatgaagatgtcaaatggggacttcccttattccctgatgcttatcgtaaagcagaagttcttaaaattaatactttttattcctgtatgaaatgtggcgaaactaaaattttaaataagctagatcaagaatgctctcgttgtcatcaccacagttgggctgaatctttaaaaacccggcgcttagggtaa

SEQ ID NO: 3245 - DNA, 501 bp, Acinetobacter baumannii
caaacggggaatttgggatattgttttatggatgagcaggctgaaaatttaacacctcttgaattgaaaattatgcgctgtttacaagagaatggacgtttaagtaatgctgaactggcaaaacttgttggcattagtacttcgtcatgttggaaccatactcagcgtctttttaagattggggccatcttggatgtacgtgctcgaatcaatccgggtatggtgcaacgtgagactattgttttggtcggagtagtgctggatcgctcgacacctgatagctttcaggcatttgaacaagcagcaggtgatttagagaatgttcttgaatgttacttggttgccggagaagtcgactactttctaaaaattcgtgttaaagatttggctgcttttaaccgttttcatagtgaaaaaattattgccttacccggggtaagacaggtgaggacattttttgtgctcaatgaagttaaaacagatggcatgctggcattttaa

SEQ ID NO: 3246 - DNA, 819 bp, Acinetobacter baumannii
tgcggttttgaaagaagcacaaggagagtcaaagtgaaacagactattagcaatcgtcaaggaaaacagttagcagtttatacagatggtctaaaagatgctcctgtgcttatgttttctaattcattaggaacagaccatggtatgtggcaacctcagctgaatgaattaaaaagtcattttaatgtcattacatacgacacacgtggtcatggcgaaagtgatgtaattagtgacaccacattgcaaaacttagctgaagatgttgttgatattttagatgccttgaatattgaaaaagctcatttttgcggcatatcaatgggcggaattacagggctttggttgggtattcatcatccaaatcgttttaatagcattacggttgcaaactcagcagccaaaattggtcagactgaggcttggttaagtcgtgctgaatcggtagaaaaaaatggtttagccgagctagttaaaactacgcatacccgctggttcagtgaaaaatttgactatcaacataatgtggttgcacagacaacgattcaaagtctcgcaaacacaccagcacaaggttatgccaatgcatgtcgcgctttagcgtatgctgatttaagagatgaaattgcacaaattcaaattccagcgctactgattgcaggaacagaagatccggtaacgacagtggcagatgccgaatttatgcagaaagcaattaataatagccagcttgcaaaacttgaagcatctcatctttctaatattgagcaaccacaaagatttactcaggaattgactagatttattcagcaaatctaa

SEQ ID NO: 3247 - DNA, 1464 bp, Acinetobacter baumannii
ggatatgatgaaatgaatacattacgtttaactactcttgcattaggtttgatggtttcaggcatagctgcggctcaaacttatgtggttgaccgttatcaagacgatagcaataaaggctctttacgctgggcaattgaacaagccaatgcaaacccaagcgaagctagcgaaattttgattcaagcagtaggcaaagcaccttatgcgattaaattaaatagtgcacttcctgagattaaagcacctgtcaaaatcattggtacagagtgggataaaactggcgaatacatcgcaattgatggttcaaactatattaaaggtgaaggtgcaaaagcttgtccaggtgcaaaccctgagcagtacggcaccaatgtacgtactatgactttaccggggttggtattacgtgacgtcaacaatgtcactttaaaaggtttagacattcatcgcttctgtattggggtattgattaaccgctcgagcaataacctgattcaacacaaccgtattagtaataactacggtggtgcaggtgttatgttgacgggtgatgatggtaaaggtaatccaaccgcaactacgactaataacaacaaagtcttagataacattttccaagacaatggtgatggcttagaactgacacgtggtgcagcatttaacttaattgcgaataaccattttgtttcaacaaaagcaaatcctgaaccatcacaaggtattgaaattttgtggggtaatgacaatgccgtagttggtaataaattcgaaaactattcagatggtttacagattaactggggcaaacgtaactatatcgcctacaacgaaatgaccaataactcgattggtttcaatatgacgggtgatggcaacattcttgatagcaataaagtacatggtaaccgtattggtgtagccattcgctctgaaaaagatgcaaatgcaagaattacattgactaaaaacctgatttgggacaatggtaaagatattaaacgttgtgaagcaggtggttcatgtgtaccagatcagcgtttaggggcaattgtatttggagtacccgcacttgagcatgaagggtttgttggttctcgtggtggtggtgtggtgattgaaccatctaagcttcaaaagacatgtactcagccaaatcaacaggactgtaatgctcagccgaatcagggtattaaagctcctaagttaacagcgaataaaggttcagttacagtagaagttaatggcttaccaaaccaacgctatcaagttgagttttttggcaaccaaaatgcagcatcaaaagaagctgagcaatatttaggaacaataacagtagctacagatgcacaagggggcgcaaaagcgaattggaagccgtctgtaaaagttgcctcaattacagcaaatatgacggatcgcttcggtgctacatctgagctcgggtttgtgcaagttaaataa

SEQ ID NO: 3248 - DNA, 2574 bp, Acinetobacter baumannii
aagcaacgtgatttgaggagaaacactatgaaattggtaatgattggtcatggtatggtgggccacaaattcatcgaagccattttagaaaaagcagatgatgaattggaaatcacgattcttgcagaagaacctcgtatcgcatatgaccgcgtacatttgactgaatacttctcagggaaatcggcaaaagatttatctttagcacgttttgattttgccgatgcgtatggcattgacctgcgtttaaatactaaagcagtggcgattgatacgactgcacaaaccgtaacaaccaatcatggtgatgtgattagctatgacaagttggtgctggcgactggttcatatgcatttgttccgccaattccgggtaatgaccgcgagaactgctttgtttaccgtaccattgaagacctagatgctattcgtgcagcaagtttaaaggctaaaacaggtgtagtaattggtggtggtttacttggacttgaggcagccaaagcattacgtgatttagatttggaaacacacgttgttgagtttgcaccacgtttgatggcagttcaaattgatgacttagggggcaaggttttacgccgtaaaattgaagatttaggtgtaaaagtccatacacaaaaagcgactcagtctattgagtctggtgtaaataccactcatgtgatgaagtttgccgacggtagtgaactcgaaactgatgtgattttattctctgcggggatccgcccacgtgatgagcttgcgcgcaacagtgggcttgcgattggtgagcgtggcggtattgtgattaatgattattgccaaacatctgatcaaaacatttatgccattggtgaatgtgcgctttggcaaaataaaatttatggcttggttgcaccgggctatgacatggcgcgtattgcagcaaaacacattttagatgaagagtgtcattgcttcgctggcgcagacatgagcaccaagttgaagttgatgggcgttgatgttgcttctgttggtgatgcacatgctatgacccccggtgcattaagctatttctatgcagatgaacatgcgctggtttataaaaagattgttgtaaatgccgacaaaaccaagttgcttggcgcggttttagtgggcgatgccaaagaatacaacgaccttttacaaatgatgttgaatggtctggctttaccggaagtgcctgaaagtttaatcatgccgggttttgagcaatcagcagcaaaatctggtggtagcggagtcgatttgctgccagacagtgcgactatttgttcatgtaacaacgtatcaaaagcggacatctgccaagcaattagtgatggttcgacctctttaggtgcattaaagaaatgcaccaaagcagcaacagcatgtggtggttgtgcaccattagtgactcaagtattgaagtcagagttacaacgtcaaggtgtgactgttaataatcacatttgcgaacactttccgtactcgcgtcaagagttgtatcacttggttcgtgtcaatgaaatcaagacatttgatgatttgattcatcaacatggtcatggtttaggttgtgatatttgtaaaccggcagcagcaaatattttggcatcttgctggaatgatttcgtacttaagccaagtcatgcaggtctgcaagacagtaacgactactacctaggtaacattcaaaaagatggctcttactcaattgtaccgcgtatggcaggcggggaagtcactccggatggcttaattgcgattggtcagattgcgaagaaatataacttgtacaccaaaattactggtggtcaacgtgttgatatgtttggtgcgcaagttcatgaacttccatttatttgggaagagttaaatgctgcgggcttcgagtctggtcatgcctatggtaagtcgttacgtacagtgaaatcttgtgtgggtagcacttggtgccgttacggggtagataactcggttggtttagcgattgaacttgaaaaccgctacaaaggtttgcgttcaccgcataaattgaaaatggcagtgtctggctgtacacgtgagtgtgcggaagcgcaaggtaaagatgtaggcgtgattgccactgaaaagggttggaacctttatgtatgtggtaacggtggtatgaaaccacgtcatgcagaattactcgcatctgacctcgataaagaaacactcattcgttatatcgaccgtttctttatgttctacattcaaacggcagaccgtttacaacgtaccagtgtatggcgtgacaacatggaaggcggtctagactaccttaaatctgtgatcgttgatgattctcttggtttagctgccgagcttgagcgccgtatggaacacattattggtacatatcaagacgagtggcgtacagctgtcgaaaacccagaagttcgtaaacgcttccagacctatatcaatgcaggagcgaatgaacaagctgatccgcacattcaatttacaactgaacgtggtcaaatccgcccattaactgaagctgaacgttcagaagaccgcattccaatggttgaagcataa

SEQ ID NO: 3249 - DNA, 231 bp, Acinetobacter baumannii
gatatggccgatttaacagcaaagaaagtcagtaaacttatcgaggaatttcgccaaactggtaaagagccagaaaagctagtgattggatataaaacttatgcaagactcatggcagatgataagtttgcagaaaaagttgttccttcgttagaaaactcaaaagatcgattatataaaaatctaaaaataaaacttattactgaaaaacattattttgaagttaaataa

SEQ ID NO: 3250 - DNA, 270 bp, Acinetobacter baumannii
cagtgtcacgaagcttcagcccgactcatacaaaccgaattaattaaatcatctaacaaaaatgatccccagtacagagacgccgaatttgtatatttaactgaaatgtataaagctggtcacaatgactataaagctaaaatacagaaatttattgatgaaactaaagatgtcgcatcaaaagataaatataagtctttgtatgatgccgatattgagtcattttatggtactgattcaccaaattatgtaccagaatcattaaagtaa

SEQ ID NO: 3251 - DNA, 1128 bp, Acinetobacter baumannii
gacaggaacgattcgctaatggatcaacacacacctatcgactatcgcctattggtagacaatttaactactgcgattttattaatcgatagtaactttaatattttttatttgaattccgcttgtgaagcactttttgacattagtttgcttcgcgcttctggacaaccggttttaaatttacttcatgcacctgatgatacctttaatacgcatgaagccttattgaacacgttaaaaacgggacaaccttatacacgtcgtgaagctatcattaatgtcaattttaaagatttacatgtggattatacggtctcgcaattaaatgcaggtaaaagctaccacccgctgttacttattgagttaaatcctattgatcgtatgttgaaaatttctaaggaagaaaatctaattcaacaacatcaagtggctagacaactggttcgaggcgttgctcacgaaattaaaaatcctttggctggtattcggggggcaactcagttacttgctcgtagtttaaatgacgagagctatgctgaatttacagatattattattaacgaggttgatcgtctcaccaatttggccgatacaatgttgggctcaagacaattgccaagttatgaaaatgtaaatgtgcatgaacctctagaacgggtacgctctttaatcgcaaatcagaccaagaaaaaaatcaaaattacgcgtgattatgatttgtctctacccgatgtaaaagccgatcgagatcagctcattcaagtcatgcttaatattagcgttaatgcgattcaagctattacagaaaataaatcattttttacagatcaagagcctgaattaattttacgtacccgtattcaacgtctagtcactattaatggagtacttaaccgctctgctgtacgagtcgatattgaagacaatggaccgggtattcccgaaagcattttagagtctgtgttctatcctttggttacaggacgagcaaaaggcacagggcttggcctgagtattgcacagaacatcatgcatcaacataacggaatgattgaatgccaatcagttcctggaaaaacaatgtttagcttatatttaccttgggagtcagaccgtgtcgcgaaataa

SEQ ID NO: 3252 - DNA, 1002 bp, Acinetobacter baumannii
tgctctcgcgatttatatggatgtaagagaaggtttaggagaaagatgatgaatgtattacaacaaatagatgagtttacggtcgatccactacagttccgacgagcattaggaaattttgcaacaggcgttaccattgttactgcacaaaatgcacaaggtgagaaagtcggtgtaaccgcaaatagttttaactcggtgtcactcgatccaccgcttattttgtggagcattgataaaaaatcatcaagtttttcagtatttgaagaagcaacacattttgctgtcaatattttatcgggcacgcaaattgagctgtctaataagttttcgagacgcaatattgataaatttgccgacacaaattttcaacttggcgcaggacgcgcacccattttagaaaattgttctgcggtgtttgagtgcgaacgttatcaagtgattgaaggtggtgaccactggattattgttggcaaagtggttcgtttccatgaccaagggcgaagcccgttggtttaccatcaaggtgcatattcttgtgtcatgccgcatccaagccttcaagttaagcaaactgaagagaacggtgtagatcaaacacattatgggcacttatataataatgtctgctacttaatgagccgtgcttttaaagcttatcaaaccgactatattcctaagcaaatggcttctggtttccgtaccagtgaatcacgtcttttactggttttagccagtggtactgcttcaagtaaggaagatttaccgcgagatattgctatgccaatgcaagaagttgaaaggtcggctgaaattctaaaatttgaaggattattggtcgatcacgataatttgtacgccctgaccgagaaaggcaaacaaacggcgcagtatttatttgatattgccgatagccatcaaaatgaggtgtttaaaaaatattctgatgagcaaaaggatatttttattaccatgctgcgagattttgcaggagtagcataa

SEQ ID NO: 3253 - DNA, 780 bp, Acinetobacter baumannii
tcgaatcgcgattcaaaaagcattcagtttaagaggtcttggagcaaaatcatggcggaaacaatcagcccccgttattcacgaattttattaaaattatctggtgaagctttatcaggtaataaagatatgggtattgatgctcaagttttagatcagatgtcactttctattgcacatttggttggcttgggtgtgcaagtaggtatcgttgtgggtggcggtaacttatatcgtggtagccagttacaaaaagacggtttggttggccgtgtaacaggtgatcagatggggatgcttgcaactgttatgaatggtttggcaatgcgtgatgcattggtgcgccgtaatatcagaactcgtcttatgtcagcgctaccaatcggtactgttgtagagtcttactcaagtcgtgatgcgattcgtcatttaagccaaggcgaagtgtgtgtttttgtagcagggacaggaaatccattctttacaactgatacagcagcatgtttacgtggtattgaaattgaagcaaatttaattttgaaagcgaccaaagtagacggtgtttataataaagatccgagcaaatacgaagatgcagtgaaatatgaccatttaacatttgaccaagtgttagatgaaaaactgggtgttatggatttaacggcaatttgcttatgccgtgaccataatgttccattgcaagtatttgatatgaataaatctggtgcgctattgtcagtggtaatgggtgaaaaagagggtacacgcgttactaaataa

SEQ ID NO: 3254 - DNA, 648 bp, Acinetobacter baumannii
agaaagcgttttatgaatgtttcgccaatcattgtacttgatttcgagaccacaggagccagccctgaggctggtgatcgtattacagaggtcgcggctttacgtattgtagaaggtgaaatcacagagcgttttgtttcattaataaactgtggtgtaaatgttccatactacatcacaaagttgactggtattactcaagatatggttaatcatgctcctttagtagaagaagtcattccttctctattggactttattggaacagatcctttacttgctcacaatgcaggatttgatgagaaattcctaaaagcagaaagtattcgacaggagttaactccatcacacaatggactcatttgttctttgaaacttgctcgccgtattttacctcatcaactcagttatcgacttggggcaatggcagacttattcaatattaagtttaatggcacagctcatcgtgcagaagcagatgctgaagttacggctcaattatttaactatctttgtatgaatatttgtcacacatatggcttcaatagcattgatcaagatttattgttagccattaataaacttactatatctagagtaccgaaatacctaaaaaatatagctgcccaatccttacttcttaaatag

SEQ ID NO: 3255 - DNA, 618 bp, Acinetobacter baumannii
tctcttttagaaacaacaagaatttataacggtaaaactatgcaaaatttaaaaacttcttccaaaaaattacaggttattcatactgccatacgtctatttgttacttatggttttcatacgacgggcgtagaccttattattaaagaagccaaaataactaaagcaactttttataactactttcactcaaaagaacggttaattgaaatgtgcattgcttttcaaaaaagcctgctgaaagaagaagtacttgccattatttactcaaaccgttaccgcacttcaaaggataaaatcaaagaaattataaacttacacgttaactttaatagcttatattaccttttgcttaaagccttttttgaaattaaacatatgtatgcgagcgcttaccgtatggcggttgagtatagaaggtggctacttcatgagatttttgacctcatttttagtttagaaacccatgtattaaagcctgatgctaatttggttttaaacctaattgatggcttgatgttccagattttaagctcaaagagtttggaagaaagggatgtggtggtggagaggttttttggggttgtaaatactgcacctaactatttgaaaatataa

SEQ ID NO: 3256 - DNA, 828 bp, Acinetobacter baumannii
ctgagtttagatgagccgttgcatgtgtatcggctcatcattttcattgagagactgaacgtgactattcaaactgaacaagaattccttgccagttatgatcgccgagattatgacgcacctttactcactgtagatatggctattttctcggtatttaatggtcagttgcaggtattactcattaagcgaccaaattttccagccaaagatcaatgggctttaccgggtggttttgccgatttaacccatgaccaagacttgatggccacggcttatcgtaagctggtcgaaaaaacagggattgcttcaccttatttggaacaagttgcctctgtcggcaatgccaaacgtgacccgcgtggctgggccgtaaccattttgtattttgctttaattgattttaatgcttatcaacatcaagccttagctgagtacagcgaatgggtgcctgtagcaaaagcaaaagatttagcattggcttttgatcataatgaattgcttaacttggcattagagcgtttaaccaataaaacccgttataccgcattgccagccagtctcatgcctgagttgtttacgctgactgagctacaaaccatttatgaaattattcttgggcaatccttagataaaaaagcatttagacgccgtatgatagaagcgggtgcagttgaagaaaccaaccacagtaaaattgtgggcaaacgaccagctcagctttatcgctatgcactcgattctttcgattttatatttcctcgctcactcgaattacctagaaataaagagggtgaagataagcaaaacaatgagctttctgactag

SEQ ID NO: 3257 - DNA, 1344 bp, Acinetobacter baumannii
tcaaacatagaaaatctggctacagaaagtgcttcaactcatcatacgctaaattatcggtatttctccacacttactccacactttagtgattatccctacacactcatcaaaaataatacgaacatcaaaaagtcactaggtttggacagtatgcaaaagcatcttttacttcctttatttttatctattgggctgatattacaggggtgtgattcaaaagaagtcgctcaagctgagccaccaccggctaaagtcagtgtattaagcattcaaccgcaatcggtaaattttagtgaaaatcttcctgcacgtgtacatgcgttccgtacggcggaaatccgtccgcaagtcggaggtatcattgaaaaggttctatttaaacaaggtagtgaagttagagcagggcaagctttatataaaattaattccgagacttttgaggccgatgtaaatagcaatagagcttctctcaataaagctgaagctgaggtggcaagactcaaagttcagttagaacgttatgagcagctattaccaagtaatgcgattagtaagcaagaagtaagtaatgctcaagctcagtatcgtcaggctctagccgatgtcgctcaaatgaaagcattgctggccagacaaaacttgaatctgcaatatgcaacagttcgagcgcctatttctgggcgtattgggcaatcttttgtcactgaaggtgcattggtcggtcagggcgataccaatacgatggcaaccattcaacagattgataaagtctatgttgatgtaaagcaatcagttagtgagtatgagcgcttacaagctgcgctacaaagcggtgaattatcagcaaatagtgacaaaaccgttcgtattaccaatagccacgggcaaccttataacgtcacagcaaaaatgttgtttgaagatattaatgttgacccggaaacaggcgatgtcacattccgtattgaagttaataacactgaacgaaaattacttccgggcatgtatgtgcgtgtcaatattgatcgtgcttctattcctcaagcgctattggttccggcgcaagcgatccaacgtaatatcagtggcgagcctcaggtatatgtcatcaatgcccaaggtacagcggaaattcgtcctatcgaaattggacagcaatatgagcagttctatattgctaacaaaggcttgaaagtcggtgacaaagtcgttgttgaaggtattgagcgtattaagccaaatcaaaaattggcattggcagtatggaaagcaccagccgtggtaaatcatgcttcaagtgtagaaaccaaaacttctataactgagggggcgcaaccatga

SEQ ID NO: 3258 - DNA, 492 bp, Acinetobacter baumannii
gtcatgaaagagttcgcaagaatacaagagcaggctttaagcttggatacttttgatccgattcaatcttttccggaatgtggcggtatcgatatttttatgggtacggttcgtaatcaccacgaaggtaaagcggtaaaggcgctgaaatatacatcgtataaaccgcttgcagaaaaaatgatacgtgaaattgaactagaaattgagaaaaagtatcaggtatcttatgtgcgagtggttcatcgaattggatatctggatgtcggtgaaacagccattattgcgattgcgtatgcagctcatcgccgtgaagcttttcaggcatgtgaggaagcggtcgaacgggtaaagcatgaagtacctgtctttaaagaagagttttttacagatggtacaagtcattatgtagagggctgttgtattcgtaaggatgcaccgcacgaccacaaacatcaccatcatcatgccggccatgagcactcacactga

SEQ ID NO: 3259 - DNA, 207 bp, Acinetobacter baumannii
agcaaaagagatcatgatcaagcgctattttatgtgaaaaagcttttttttaggccgtatcaatcatccagagatattaaaaatatcaactggttaagttatctacttgaaaactcattgaaagaaataaagaaaacattttttaggtctgactttttaaagaaattgtgtaaaaatgaaaatataaatttctattatgaatgttga

SEQ ID NO: 3260 - DNA, 822 bp, Acinetobacter baumannii
agatttctggatagtgatccatgcactacatatcagagctttaaaacttatcgcccagcaaaaattgcaagaatcggaatttgctcagcaatctctacagaaaatacagggtattttaagaagatgaccacaatttatctggtaagacacggacaggcatcgtttggtaaaagtaactatgatgagctgtctgaaaatggtgaggctcaggcgactttgttaggtcgttattttaagcaaatattgaaagaacaaccttatgtggttgctggaactatgcagcgccatgaacaaactgcacagcttgcactaaaagaatgttttccagatgcggtaattcatcataataatttatggaatgagtttaaccatcaacaggtttttgcccgttatgaaccgcgttttgaacagcctgaactgttaaaagcagacgtggcacaagaacagaacccacgcgcatatcttgccaaaatctttgaaggtgcgattgaacgatggaccgatggcgattttcatcatgaatatgatgagtcttggccgcattttaaaaatagagtcgaaacggcgctacagcaactttgtgatgagttggcaaaaaccaaacctcgttatgcagtcgtttttacctcgggtggtgtgatttcggtagcaattggcaagctgcttgaactgagccctaatcgaacttttgctttgaattgggcaattaccaatacaagcctcacgactttacgtttagttggaaatgaagctcaggttttaagtttaaatgaacatcattttataaaagctgagcgtccagatttactgacatggatttaa

SEQ ID NO: 3261 - DNA, 426 bp, Acinetobacter baumannii
tcgcccatggatatccgcaaaattaagaaactcatcgatttaatgattgagtctgacttgcaagcgattgaagttaaagaaggtgatcaatcgatcgctttaactcgtcgcaatcctgtcgttgctgcggctggtgtagcacttccggcagctcctgttgctgaagcacctgttgcaaaaacaccacgtggagcagttgaaacttctcctatggttggtgtgttctatgctgctccaagcccaggcgaagcaccatttgttaaagtaggtcaaacagtatctgctggtgagactttgggtattattgaagcaatgaaaatcatgaacccgattgaagcaactcaaagcggtgtgattgaagaaattttagtgaaaaatggtgaagtgatccaattcggtcaacctttattccgttatcgcgcgtaa

SEQ ID NO: 3262 - DNA, 504 bp, Acinetobacter baumannii
cagcttaaggagagagcaatgaatatgaatctgcaattattaaatgaagtcactgctttcatctgggctgaagcagatatgttagaccacagcgagtaccgtgaatggctcaatttatggaatgaaaaaggtgtttatatcattccgattgacccgaacctcacagactacgaaaacaacttaaattatgcctatgacgataatcatatgcgtaagttacgggtagagcgtcttgaaaatggtgaggcaatttctacggcaccaaaggcgaatacggtacgcagtatttcgcgagtacgagtgattcaagatcaagatgatgaaatcgttttacgctgtgctcaaaacctacgtgaatttcgtaaagaaaacctcaagcattacacggccgatattacataccatctaacccgtgatgctgatactggttttaagattaaccgtaaaatcattaacttggttaactcaaccgataccttggctggtattagctacattctttag

SEQ ID NO: 3263 - DNA, 573 bp, Acinetobacter baumannii
ataagtaaggaagatcatatgattaacgatctgaaaaaagacagcgaacagcgtatgttaaaaactcttgagtctttggaacaagggtttgctaaagttcgtaccggccgtgcacacccatcaattttaaatggggtaatggttccttactatggttctgatgtgcctttaaaccaagtagcgaacgttggtgttgaagattctcgtacgcttatcgttcaaccatttgaacgtacgatggttgctgcaattgataaagcaattcgtgaaagtgatttaggtttaaatcctattactgctgattcaatccgtgtacctttaccagctttaactgaagaaacacgtcgtgatatgcagaaaatcgctcgtagtgaagctgaaaatgcgaaagttgctatccgtaatattcgtcgtgatgtattaggtgatatcaaggcattgttaaaagagaaagaaatttctgaagatgatgagcgtcgtgcaggcgatgatatccaaaaaatcactgataaatatgttgcagaagtagacaagcgtctagcagcgaaagaagcagaattgatgaaggtctaa

SEQ ID NO: 3264 - DNA, 873 bp, Acinetobacter baumannii
ttattcaaggatacgtgtagcctttttaaggatgaacctatgaacatgaaaacattattaagcctaagtttgcttgcactcccattttttactgcacaggtaaatgctgaacctgttgctttagctgctcaggcacaacctgccgctacagccgttaaaacgattgttccgattaccgcaaaaactaaagaacaagcattggcacaagctcaagtcattgcaaatacggcagatgctgatttagcagagttccgtatcgatttattaagctttgccagcgatacaaaacaagtgattgccttgggccatgagttgaaaaagattttaggcaataagccaatgattgccactattcgtacaaaaaacgaagggggtcagcttgaaattagtgatgctgattatggtaagacttatcaggcttatttaaaaaatccgttcatggactggttagatgttgaaatgttccgtgatcaaaaagtagtttcagaaattgttcaacaagcacatcaaaagaaagtgcttgttgtcatgtctaatcacgacttccaaaaaacaccaagccaagatgaaattgaaaaacgcttgttaaaacaagatcaaatgggcgcagatgttctcaaaattgctgtaatgcctaaatctaaacaagatgtcttcactttaatgaacgcaactttaaaagtaagccagcaaaccactaagccattattgacaatgtcgatggggcaattaggtacgatttctcgtgttgcgactgccaatatgggcggaagttatagctttggcatgattggtcaggcttctgcaccgggtcaaattgatgtgactaagctcaaacagattttacaaaccgttcaaccaacaaacccgtaa

SEQ ID NO: 3265 - DNA, 360 bp, Acinetobacter baumannii
aaaatggaggatttcgtgatgaaattctggcaacgactcttcacatcatttttacaaagatttcatttgatgcgttttttcggtcgtaatcgatcttttaaagagctacatcaatctagttatgctcaagaaattagcaaaaatttatctaagcgtttgcttaatgcatcaagggctcaaacgaatgatctattaaaacaattcgatactcatttgacggggcttacagaagagcaagcgtatacccaacaaatgacggtgggacttaatgaagttactcatgaaaagccattaacttggtggcaacacctttggtattgctaccgtaattcaatattttacttagcctgttggcattga

SEQ ID NO: 3266 - DNA, 1296 bp, Acinetobacter baumannii
ggatttagggaaataacaatcaaaaaggatatagatatgaatgaaataacaactaaaaaggcaaatccgattttattaggcgtacttggtgtattcgttagcaatatcagtcacgcttcagcacttgaacaatcgggccaatctatcttgccatttcttgaaaatgggaattatgcagaagcaaatttatttgcagttgattcatctgtttctggtgtagtcaatgatagagccgatcttgtaagagatcatcaaagtcgagatacaggtgatattgcagaaagtacgcaattttatacagctgcaataaagttacaactcacagatcgtttaggttttggtgtgctatatgatcaacctttttcagcagacatcaaatatccggcacgttctaataatagttactttgataatgatattagctatgaaggtacatcagtaaaagccaatactcaaaatttaagtttattattcggatattctccatatcagcattttcaaatttatggtggacctgtttatcaaactgtaaaagcaaatgtagcgcttagaggtaatgcctatactcaggcttttaatggctataatgctaagtttaaacaacaaggtgaagttggttggttgttgggagggagctatcaactacctgatatagcattaaaagcagcaattacatatcggtctaaaatcaaatatcaatttcaagtggaagaagatatttttggtgaaccattaaaacttgttgaaaatgagaaaaccaaattagagactccagcatcattaaatattgattttcaaacaggtatttccgaaaaatcacttgtttatacgaatttaagatgggttaactggaaagagtttgagactcggccaccgcaatatggagctctttctgaaattttaatgaaagaattaaccaatggcgaatatattcaaggattcaagctcgattcttaccaaaacgatcaatatagtgcaactttaggaattgcacaccaatttacagaaaaatggagtacttcaacagatgtaagttgggattcaggtacaggtaatcctgcatcaacgatgggacccataaaaggttcatggtcacttggtttaggcgtccagtttaacccagctaaaaactactttataactggtagcttaaaatatttttggctaggtgatactaaaactgaagatgggacttattacttgccaatagagggaatcaagccatacgcagaacaggaaaatttcaaaaataaccaggcaattgcgtatggtttgaaatttggatattggttttaa

SEQ ID NO: 3267 - DNA, 1224 bp, Acinetobacter baumannii
ggaagtagggaaatgacattaaaaaacgcttatatcatcgatgccatccgtaccccattcggccgttatgccggtggccttgcacctgtccgtgccgatgaccttggcgctgtgccgattaaagcgctcatgcagcgtaacccaagtgtagattgggaacaggtcgatgatgtgatttatggctgtgccaatcaagccggtgaagataaccgtaatgtcggccgtatgtcagcactacttgctggtttaccgtatcaggtgccggcgaccaccattaaccgtttatgcggttcatcactcgatgctattgctattgctgcccgtgccattaaagccggcgaagcgaacttggtaattgctggtggtgtggaaagcatgagccgtgcaccttatgtaatgggtaagtcagacagtgcctttggccgtagccagaagattgaagacaccactatgggttggcgcttcattaaccctaaacttaaagagttgtatggtgtagatactatgccccagactgccgaaaacgtggctgaacagtttaacgtcaatcgtgcagatcaggaccagtttgccttggtgagccaacaacgcaccgcaagcgcgcaagccaaaggctttttttctaaagaaatcgtggcagttgaaatccctcagcgtaagggggatgctgttgtgattgataccgatgagcatccacgtgcatcgaccacgcttgaaggcttaagcaaacttaagcctgttgtgaaagcagatggcacagttactgcggggaatgcctcaggcatcaacgatggtgcggcagctctactgattgcttctgatgatgcagttcaggcatacaacttaaaaccgcgtgccaagatcattgcttcaacagcggtgggtatagagccacgtattatgggttttgctccagcacccgccattaaaaaattacttaaacaagccaacctaactttagagcagatggatgtaattgagctcaatgaagcctttgctgcacaggctttggcagtgactcgtgatttaggtttgccagacaactctgacaaggtaaatccaaacggtggtgccattgctttaggtcatccacttggtgcatcaggtgcacgtcttgtgacgacagctttaaaccagcttgaacaaacaggtggccgttatgccttgtgttcaatgtgtattggggtaggtcaaggtatcgcattgattattgagagagtctaa

SEQ ID NO: 3268 - DNA, 1200 bp, Acinetobacter baumannii
tttttcagggacttagaacatttagctatgcaaaagattcttcaagatttctcaataccagccgtatttgctggttttattacctttcttattggtattagtgtttcggctattttagtgattcaggctgctcaagctttaggtgcgtcatctgaacaaatcacctcatggttttgggctttaggcttaggtattggtttatcaggactcatcctttcttggaaatttaaatatcccgtagcaacagcttggtcaacagcgggcctcgctttaattatggcaacaggtagtggctatagtttaaatgaagcaattggcgcttttttagtaggtggtttacttactgcgattttaggcttttcaggtatattccaaaaagcgctttcctatataccacaaagcttaaccagtgccatgcttgccggagttttgcttaagtttgggatttcacttttcgcgagcttgcaaaatgattggacatttgttttatctttactcgccatttatgtcattacaaaaagattatggccgcgttacagcatcgtatttaccgcactggctggtattggcctctgccctgtttttttagactttcatatgcctactcttgagtggtccttggctaaacccgtttggattagtcctgaatttagctggtcagcacttttaggcttagcattaccactttttgtgattagcatggcgtcgcaatatttacccggtatagccatgatcaagagttatggctataaaccacatgttaatcaactgattggttggactggtttaactcaagttgtgcttgtaccttttggatgttacagcgttaatattgctgcgataagtgctgccgtaagcttagacgaccaagttcatcctgatccaagcaaacgttatattgcgggtataagctgtggctttttttatgtgttgatggggctatttgctgcaactctcacaagcttgctgatgtcttttcctcatatttttattgtagcgttagcaggcattgccttacttggtacgattagtcacaacattgcgcttgcgtttggtccagttgaagaccgcgaagcggcattatttacctttttatgtagtgcatcaggtatccaatttttcggtgttggttcagctttctggggactggttgtcggtattgttgtatttatagtccttaaatttaaacctaaaaaataa

SEQ ID NO: 3269 - DNA, 189 bp, Acinetobacter baumannii
acctttggtttaatcacatggacaggtccaaaagctaagccacttgatgctgcaattcccgtattgttacccaatgttgtagcatttgatattgccgtttgggcagggagctggtcaggtatttcactggttacaggtagcgcttcaacttcttcacctaagccttgctgcactgccaaaataacttga

SEQ ID NO: 3270 - DNA, 1632 bp, Acinetobacter baumannii
agcttgacactcctattttgtacatcctgtatttatgaggttcttatgactcagcagcaggcatgtgtaatatcacaactcactttggagcttccttcaaaagtggtgtttaaagaattgaatttctcacttgagcatcatcaagtatcagccttaattggccgcaatggtcaaggtaagtctttacttatgcaattacttcacaagatttcacccattacagaaatgtatataagtggtcaaataaactggcaaacaaaccatgcatatttatctcagctcactcgtctccaatcagacacaattgcagaagctttagaggtcaaccatctttacaacgcttttcaaagagtggaacaaggtgaagctgaatacgatgattatgatttgttagaaggacattgggatcttcctaatatttgggaggctttactacggtctgctcagctaccaaccgatttagactttcctgttaagcagttgagcgaaggccaaaaaactaagttagccttatccgcattatttttaaaaactgatcattacctattacttgatgagccaagcaaccatctcgatcaagaagctagacagtggttaattgctcagttaaagaaacatccagtaggcgctcttattattagtcatgatctgactttgttaaatgaagtcgaccatatttatcacttaaatgagcatggcctacagcacactacaggaaattatgaaaaattttatgcgcaatatcagtcccaaatcgaggctttagaacagtcagtacatcagcatcaacgtgaagttaagcacatgaagcaaaagcagcatgaagttttaatgaaagcccaaaaacgtgagcgtgctggcaataaacttcgtgactcaaactcgcaagctaaaattttgctcgattttaaaaaagaacaggctgggcaaagcctaggtgcaattcattctcaacatcagcgtcaaatcgatcaaagccagcaagacttgaagagtaaaaaagtacttctagaaactgttaagccccaacaatttatattcccctcttttaacaaaagaacaggagaaattcttagaattgagaaattaaaactcaactatgggacacaacaaccaattcatctcgccttaagagcttgtcaaaagattcatttggttggccgaaatggtattgggaaatcaactttgctgaaacagattgatcaatcagctgtaactgctacagatgaaattaaactgtttgcaaattgcttctatctcgatcagaactttagctttttattagaccatctctctgctgttgaaaacttaagaaatattaacccaaatattactgagttagagtggagaaatttattaggtcagcttcggattcgtggtgataaaagcacatatcccttagctcaactcagtggtggtgagaagttaaaagttgctttactaggtttgagccatgctcagcctatgcctgaacttttactacttgatgaaccagaaaaccacttagatatcgagtcaagagagttatttgcaaatgctatttctagttatgaaggtgctgtgctattagtttcacatgatttaagttttgtcgaaaaatgcgggattgttgattcaatttatttaaattaa

SEQ ID NO: 3271 - DNA, 774 bp, Acinetobacter baumannii
gttgaagcactttctgtagccagattttctatgtttgatcattctttttcttttgattgccaagataaagtgattcttgtggtagaagatgactacgatattggcgacattattgaaaattatttaaaacgtgaaggcatgagtgttattcgggccatgaatggaaagcaagcgattgaattgcacgctagccaacccatcgatttaatcttacttgatattaaattacccgaattaaacggctgggaagtgttaaataaaatacgccaaaaagcccagactcccgtgatcatgctgacggcgctagatcaagatattgataaagttatggcattacgcataggtgcagatgactttgtggtgaagccttttaatccaaatgaagtcgtcgctagagttcaagcagtcttaagaagaactcaatttgcaaacaaggcaactaataagaataaaatctataaaaatattgaaattgataccgacactcatagcgtttatatacactctgagaataagaagatcttgcttaatctgacgctgactgaatataaaattatttcattcatgattgatcagcctcataaagtttttacgcgcggagaacttatgaatcactgcatgaatgatagcgatgcactagagcgaaccgtagatagccatgtaagtaagctgagaaaaaaactagaagaacaaggcatatttcaaatgttaattaatgtgcgtggcgtgggatataggctagataatcccctagctataaaagatgacgcctaa

SEQ ID NO: 3272 - DNA, 189 bp, Acinetobacter baumannii
ccggcaaaactgaaattgatgagtaaaaaaacaaaaattagagctttagaaaatttaacattgagcaaaggggaattggtaagccaaactggcgcaattttttttaatagctggcttggccgtaaaccaacatacataccaatagtttctaccacgctgagcaatatcaaagccacaacacttaaatga

SEQ ID NO: 3273 - DNA, 642 bp, Acinetobacter baumannii
actgacttttgccagagcactagccttaaaaaagaaacggatttcaaaagatttactacggggaaatcgatgtcaaaaagagacactattataaaaacagcaactgccctttttaatgaaaaaagctataactctattggagtggacagaattattgctgaatccaatgttgcaaagatgacattctacaagtattttccttcaaaggaaaagctaatagaatcatgcctttacaaaaggaattctgatatacagtctgctatattagaaagaatcaatatcaatgacctacctttagttcaactcagaagcttatttaattggtatattgattggatttacacagaagactttaatggatgcttatttaaaaaggcaactatggaagtagtacaactttatccatccgttaaaaatcctattaatgaatatagagaatggctctatgagcttgttttttctattttaattaaaattcaggtagaagacgcagctgcattaaccaatctatttcttaatatcctcgatggagttattaatgatggaacaattgataaaaatttaattaatgctgaaaaaacttggtcttatattaaaaaaataatcgatcttgagaaaattgaggaattagtcgctatttaa

SEQ ID NO: 3274 - DNA, 729 bp, Acinetobacter baumannii
atttggaaactaatgagacacctccatcaccagacatcccagactaaattatgggcagttatccctgcggctggttcaggaagtcggttttccaaaactgaattaaagcaataccaatatattcaagatgctactgttatagaacatacggttaagcgtttaagtcagcttccgctgacgggttatgttttggcaattggaaaacaagatacttttgcctcaactttatcttttcaagataagcataaagcgcatttttgtaatggtggcgttgaacgtgtgcactcggtattaaatgctctgaattatctatcacagattgcggatgaagatgattgggtattagtacatgatgcagcaaggccttgtgtgacttttgaatgcttgaatactcttgttaaaaatgcaattgagactaatcagagtgctattttggcaattcctgtacgcgatacgctaaaacaagtgaatcaggaacagcaaattgacaaaactgtaagtcgagagctgttgtggcaagctcaaactcctcaaattgctaaaattggaattcttaaaaaagcgatagaaacagcgctaaaaaaaaatttgactattactgatgaggcgagtgcacttgaatctataggagagagtgtacaggtggtcatgggacgtactgataatataaaaattacttaccccgatgatttagaacttgcccgcttgattttacaatcacaaaattaa

SEQ ID NO: 3275 - DNA, 1314 bp, Acinetobacter baumannii
acagaggtttgggctgcttttgagcaaaataacaaaaaatgcaaggaacttcatgtgattaaagaaattttactggccgatacccataactatcacggtattttagatgaacgttttattgatttagctcaccagttcagccgtcttcaagatgctagaacaggacaaggtggagctgctttagcggtttattttagaggccaaaaagttgtagatatctacaccggtctaaaatcacaaactgaagcttggcaacctgacacattggcagtttgctactctacgggtaaaggtgtacttgcaactttagcgcatattttggtaagtgaagggtttttagaatacgacaaaccgattgcgacctattggcctgagtttgctcaaaatggaaaagagcaaatgactttgcgtcatgtgctaagccatcaaagcggcatgtttgatgttcgaaatatcatcgaaagtgcgagagaaatgctcgactggtcacatatgttagatgtggtcgcggcgactaagccaagattccttgcaggagagggtaatgcttatcaagctttaacattcggttggcttgtcggtggcgtacttgaaaaagcaactggtcaatctctagatcagctcatgcaaaattatcttgttgagccattacagttagatggtgcttattttggaacgcctgcaagtgagttggatcgtgtagcacgtttaattattcaaccaaaaccagaaaaaacagcatctactcaagttgaaaaacctaaaaagccacagacgcgtaagagttcactctctgaaaaagtgattacatggacgggtcaagacccgcaagactttcaggatgcgatgattccaaaaggaatgaaaaattttagtttctttagtgatgagggactgcaagcagtcattccggcagcgaacgggacatttactgcaaatagccttgctaaaatttatgcgatgctagcaaatcaaggtgaatgggatggacagcaattgattcgcccagaaatatttaaagaacttagtactattcaaagttatgcacgtgatcgtgtcatgccaataccgatgaattggcgcttaggatatcaccgcattattactatgggtaaacgtgcaaaaaatggctttggacatattggttacaatggttcaggagcgtggtgtgatcctgagcgtgacctcagctttgcttatactcataacttccagattggttcaatcacaggcgattatcgtttgtgggggctgacccaagaagctttacgttgcacagaccaaattttaaaaggccgtaaaggctggttctaa

SEQ ID NO: 3276 - DNA, 603 bp, Acinetobacter baumannii
ttttctgaacttatgccaaaactcaaaatagctcttatcgatgatgatcatgcgcgggccgactatataaaaaatagtctgcttgaaaatgactttgaagtggttgcctgccttactttggaccacttaaatatttttcgtcttgaagatttacaagccgatgtcatcttgctcgatatggatcatccccatcgtgacattattgaaagttgtgtgagtagctatgacctaccaactgttctattcactaaaaattcagataaagacaccatcaaacaagctatagatgcaggcgtaacggcttatattgtagatggcatagaccccgcccgcttacataccattttagagatttcaattgagcaatataaaaaacataaaaagctcgaaggggacttaaaagaagctcaaaccaaactggcagaccgtaaagatgttgaaaaggccaaagtgctactcatgcaactgcatggtttacctgaagacacagcttttcaattactcagaaaaaatgccatgagtcaccgtataacgattggagaaatggcacggcgtttacttgacgctcaaaaattactaaatgatcaactaaaggatgaataa

SEQ ID NO: 3277 - DNA, 3027 bp, Acinetobacter baumannii
tgttttgcttggcttttattcgccattctcaagccgactcaggctataatgagacttattcacttatccgatatgttaggagatcacatgactgtagatgtcactgaaaccatttctcaaactgttcaccctgcgtttcagttgctacgtcagcaccatgttgaagcattagatattttagtgtctgaatataagcataaagtcacaggtgcggtgcattatcacttggcaactgattatgatgaaaatgtatttcttgttgcgttcagaacacaacctatggactctaaaggaactgcacatattttagagcatactgctttatgtggctctgaaaagtttcctgttcgtgatccattcttcttaatgatacgccgttcattaaatacttttatgaacgcgtttacagcagcagattggactgcatatccatttgcaactcaaaataagaaagatttccaaaacttattatctgtttatcttgatgctgctttctcggcaaatttgaatcctctggattttgctcaggaaggtatccgtattgaacttgaaaatggtcagcctgtatacaaaggcgtagtgttcaatgaaatgaaaggtgcaatgagtgcgccttctgatcagctttatcatcagttggctcatcatctattccctgaaaccacttatcactacaactcaggcggcgatccaaaagacattcctgacttaacgtatgaacaattggttgaattttataaaacccattatcatccgagtaatgcggtatttatgacttttggtaaccaaaccgcctatgaattacaagagcaatttgaaaagttggctctacataagttcactgctggtacaactttatattcgaaaccagaaaaacgcttaacggcacctgttgaagtcactgaaacttatgctgttgatggcgatgagttaaaggacaaaacttaccatgtattgtcgtggttattacctcaggcaagtgacattaaacttcgtctgggtatgcgattagtagaaggcgttttactcgaaaactcagcttcaccacttcgtcattatttagaaacttgtggctatgctcagtcgactggtcctttaatgggggtagacgatagtaactttgaaatgacgttctattgtggtgttcaaggttcaaatccagagcatgcacagagctttagagatggtgttttaaacgttttacgtgaagtagctgcaaaaccaattgactcatcgttagttgatgcaattttgcatcaaatcgagttacaccaacgtgaaattaatggtgatggtacaccatatggcttaagcctaattttaaatggtttaagtggtgcgattcaccataacgatccgattcaaatttgggatgttgatagtgccattgctcaggttaaagaagaactccaagacccaatgtggttatctaacctgattcaaacgcatttattagataatccgcaccgcgtgcaaatgactttagtaccggatgcaaccaagtcagcgaaagaacaagaagctgaaaaagcacgtttagctgcgattggtgaaaagctaactgaagaagataaagcagagatcatcgctaaaaccaaggcattgcaagaacgtcaagatacaccagataatcttgaactgttgccaaaagtaggtctagaagacgtaccggccgacttgcatattgtacaaggtcaattgcgtgaaattatctgtaatcgaatggatacgccgttgaatttgtatcatgccggaaccaatggtatttactatcaacaagtacttattcaaattccagatgatgtggttaaatcaccatacttcaatttgctctctattttaatgggtgaagttggtgcaggtgagtatgactaccttgaactccagaacttacaaacagctgtaagtggtggtttgggaatgggtgcttcgttacgcagtaaggttgatgataaagacaaaattagtgcttggttaactttaacaactaaatctttaactcagaagttcgatgcgattcatttattaaaattagcatttgaacaacttcgttttgatgaaaaagagcgaatcattgagttattgcagcaacgtaagacacgctggcagtctcgtttatctggtgctggtcatagttatgcaatgcagattgcttctcgtaatatgagtgcgttagctcaacgcgactatcaaaacactggcttaggtgcgttgaactggttaggcgagcttgttactaaaattacccaagatgatgctgcttatgatgcgcttattgctgaattgaagcatattcatacaaaattattgcaagcacctaaacagttcctgctcgtatgtgaagagcatcagtcagagcgtttagttgaagaaatacaaaatgtttgggataaattaaacgttgatacagcagcgactgagttaacccaagttgagcaagaaaatgataatgaacatgaagcttggttaattcaaaccaatgttcagttctgtgcctctgcatatcaagctgtggaagtatctcatccagatgcggcacctctaatggtattggcagcttacttgcgtaatggtttcttgcacagtgctatccgtgaaaaaggtggtgcttatggtgggggggctagttatgacggaaatgcatgttcattccgtttctttagttaccgtgacccacgcttagctgagacttttaaagattttgaagcgagcgtgcaatggttgttaaacacagagcaacaacctcatcagcttgaagaagcaattcttggtctggtggcaagtatggacaaacctggttcaccagcaggtgaagcaataacagcgtgttatgcattgttgcatgcaagaactccgactttccgtcgtacattacgtgaaagattattgcatgtaactttagaagatttacaacgtgttgcgcgtcaatatttaattgaacaaacacctgtaaaagctgtcgttgcaccttttgcaaaacgtgatgaattgcaacaactgggctttacgatcaaacaagttaattaa

SEQ ID NO: 3278 - DNA, 363 bp, Acinetobacter baumannii
aaggtatattgtgtgaaaactgtactcgttattttgacccaagccaatctaaccagcctacaagtaaatgaaagcctcgccgctactatggttttagcaacctttggctcaccagtcaaagtattattgaaagatgcagctcttagcctcttacaaaatgaacacaactttgaccagttgcagcatgcttttaaaattgcttcaaacatggtggatagctttgagttttatgacttaagtccaatccttgttgagaccaaaaataaacagcatccttttgttcaaaacagtgaacaggagctagagtttgttcagttagatactgaactcatccaatctttcgatcatgtcttatattggtag

SEQ ID NO: 3279 - DNA, 846 bp, Acinetobacter baumannii
aataccaattggtatttttaccatgctacttggcgcgccatttttcttattattaatgaaaacacagaggactcattgggcatgattcaaattgatcagttaaattatgcctatgggcacaaacaggttcttaaaaatattcatctggagtttcctgaaaatcagttttccgtaattttagggcgtaatggttgcggaaaatcgacactttttaaattgatggctggcctagaacccgtaaaagatggcttgattcgttactctggaaaagcactatcggactttaaagggaaagatcgtgctgcattactaggttttttaccacagtttcataaaaccgtatttccatttttggttaaagatgtagtgattacgggacgtgccgcttttagcagatataggccttcaaagtcagattgggaacgtgtagatcaagctttacttgatttagatattgagcatttgcgtgaccgtccttataccgcgctatcgggtggcgaacggcaattggttatgattgcgcgtattttagtgcaagcaccgaaagtcattttgcttgatgaaccaaccaaccatctcgatgtttattatcagtcttatttaatgaaaaaattgcgtcagttgtcgcggcaaaattttacggtgattgcaattatgcatgatcccaacttggcttttttatttgcagatcatctgttttttatgcgccaacatgaggtggttaagcctgagtctaaaacacgaataaccgatccgaagtttttaaaaagtgtctatgatgtcgagttccatgaagccatgattcaagacaaaaccattgtgattcctgatcattcttggctatga

SEQ ID NO: 3280 - DNA, 699 bp, Acinetobacter baumannii
agagcgtactgcacagtaatgtctgtggaaatgccagaaattaaaattgttcgtcacgtaagggcaagaaaattgcgcttacgtgttgagcctgcgtctatacgacttactgtgccgttattttgtagtaagaaacaaattcagcagtttttagctcagtctgaacaatggttaatcgagacgtggaataaacagcaccacgttcaatctacctcgtttgaaattccttcagaaatttctttttttaatagagaacagccttttcaaattgttgtgcagaagcaacatcgcatttttcaatttgattgggaaaatagttatttatttattaaagatcaacaaccctatcaagctttacaaaacgctgttattgcttatgcaaaacaagagttaccagtacttttgtcagagcttagccaaaaaactcggctgagttatgcagagtgtgcaatccggcgtcctaaaactcgttggggaagttgcagtagtcaacataatattatgctgcatgcaggtctggttcttatgcctgctcaaattacccgttatatttgcattcatgaattagcacacaccaaacacttcgaccatagtcctgcattttgggccgaagttgcaaagttcgaccctaactatatgcagcatcgcagacaattaaaaggtaatccattgcctgcatggtggtatgttacaacttag

SEQ ID NO: 3281 - DNA, 900 bp, Acinetobacter baumannii
agtgcggactgctacggagatgaaataatggctcggattggttttgttggaacgggcattatgggaatgccaatggccatgaacttattaaaagctggtcatcaaattaaggtttggaatagaacttcatctaaagcagaaagtttaaaagaagctggtgcacatgtttgtagtgaacttgaacaaatcggaaaagatgtagactttctgatttgtatgctcagtgatggaaaaatctgtaatgaaattttatttcaagaacgtggagcaatctcacagctaaaacccgaaagcacggtcatagtgatgagttcgatacctgttgaagttgcaaaaacacaaagtgaaaaatgtaaagaaagaggacttagatatttagatgcacctgtttctggcggtgaaaaaggtgctcaaaatgcaagtctggcgattatggtaggtggcgatgctcaaacattttcacatgctgaacatgttctatctgccatggggcggccaattttagttggagaggttggctgtggaatgctggcaaaactcgtcaatcaaatgatagtcgcatctactattgcaaccgtgagtgaaggtttattgcttgccagtaaagcaggagcagacccgataaaactcaaacaagcattaacaggcggttttgcagattctccgattttgcaacagcatggcgaacgcatgttaaatcgagattttaaaccgggaggtacagctcgaaaccagcataaagacattcatacagccgttagctatgctaaatcgcttgagttgaatttacctatagcccaaaaagtcagtcaattatttgaaaatatgcttgctgccggagacggtgagcttgatcattctggtttaattcgtgagcttgaacgaatgaatcatgtgtaa

SEQ ID NO: 3282 - DNA, 615 bp, Acinetobacter baumannii
tgtagtttgtgtcgaattcagtcaggtgtaagaaacatggcctatcttaatcgcgatcaacgcagagaaatgattctgcaagctgccatgcaaattgctttggctgaaggttttacagccatgacggtacgtcgaatcgcaacagaagcacaaacctctaccggacaagtccatcatcatttttcttcggcatctcatttaaaagctgaagcttttttaaagctgatggaacagcttgatgaaattgaacaaactctccaaacaactagccaatttcaaagactcttcatcttattaggtgcagaaaatatagacaggcttcagccctacttacgtttatggaatgaagctgaactcttaattgaacaagatattgaaatacaaaaagcgtataacctcgccatgcaaagttggcatcaagctattgtgcaatcgattgaatgcggtcaaaaagaaggcgaatttaaaaataggtctaattccacagatattgcgtggcgactcattgcctttgtgtgtggattagaagggatttataaacttggtttacaaggtttagttgaagaagattttaagcgtcataccgaagcaattattcgcctagaattattataa

SEQ ID NO: 3283 - DNA, 432 bp, Acinetobacter baumannii
aatgtcatgtggttctcttataataagcaggacaagttgaaaacctttaaatttaaaatgaacagtttaagtaatctacaaccggtttctaaagacttgatgatcaagatttatattttaagaaccatgatgtactgcggggttctgtggggactatttgatgaaggctgggccattaaatcagatcaggaagattttatttttccgttctggctaaatggagtacaagcacatcgatacgccaaaactcactggcccaattacaagccaagaaaaattaccccaaaagacttccatgaatctttattacctactttaacacggttaaaagtcactcctgctttatttaactcatctcatcgcaagttgaagttatctacacagcaaatgcatcatttcttttttaatcatccaaaatggcaggtagcttaa

SEQ ID NO: 3284 - DNA, 735 bp, Acinetobacter baumannii
aacaataggtgcaaaatgaaattgcaatttctacaacatacagacttatcaaatattattgatactttaattagtctctcggttgcttttgttttaggggcgttaattgggttcgaacgtcagtataggcaacgtacagctggtcttcgaacaaatgttctagttgcggtaggtgcagcaatttttgtagatattgcatttaatcttactggagcagatggagctgttcgggtaattgcctatgttgtttcgggtattggttttttgggtgcgggtgtcattatgcgccaagaaggcaacatccacggtttaaataccgcagcgactttatggtgttctgcggcagtaggtgctgccgcgggtgctgatttaattattgaagcaatattggcgacagcctttattttatctgccaatacgctattaaggccgattgtccatatcattgaccgtcgtccgttagacgatgacacagaagttttacatgtaatttacattatatgtgaccgaagtcagagcaaggtcgttatggatgaattaaacctaaccttaaagcatcataattatcctgctaaagatattgatgtcacaccttttggagaaaaagaggttgaaatagaagtaacactaattgcaacttcaatcgaagcagaagaagcacaacacattattaatcacttaaatgcaatgccgcaaatacggcaagcgttttgggataaaaacacaattaactaa

SEQ ID NO: 3285 - DNA, 519 bp, Acinetobacter baumannii
aacgcccttcggggcgttttttacaaggaattttatatgttcaaaagaaacgatgagcaatctcagcagcgccctcctcttactggccaacgtttacgctcatatgcttttgctttactcactcgccgagattactctaaagcagagcttatcgagaaattagctcgttacgcacaaaatatagaagaagtaaaacaactggttgaggaattatctgaacaaaattaccagagtgatcagcgtgttgccgagcaaatgctagcaagccaaattcgtaaaggtaaaggaccgaaacggattcaacaagctttaaaaactaaacaaattgaaaatgatttaattgcagatgaaattcaagaaattgattgggtagaacaagcttatcaacttaaagttaaaaaatttggagaagctgtagagaaagatccaaaacttaaagcaaaacagatcagattcttacaatatagaggatttgatttagatgtaattttaaaagcaatccaaagaaaattggattaa

SEQ ID NO: 3286 - DNA, 1098 bp, Acinetobacter baumannii
ataaaaaatcgaatattacaaataagcggaatgattatggataacgtagctcagctagaaactgatactaatttccaaagccgaaagaaaataacttggggtgtttttagtgtcctgctgttatttttagttgctggcatcttatattatttttttgtataccgattctatcaatctactgataatgcttatgtacaagccgatgtcacttgggtaatgccaaagatttcaggcgaagtgttggagttattaattaacgataatcaggtggtaaaaaaaggggaaactttagcggtattagaccatcgtgactaccaagctcgttatgaccaagcccattctgtggtcagcttaaaagaagcagcgcttggtgtacaacaacaaaatgaaaagtctgcacggtcgtcaattattgaagcaaatagtggtgtagtggcagcgcaagcagacctagcgcgtttgaaaaaagagttcgagcgttatcaagatctattaaaagatggcgtaattacccgacaaaattttgaagggattcagtctcaatatttaacggctcaggcacagctcagcaaagcgcaagccgccgtaaatgcagcagaagctcagttagggagtttacaagccagtcgagcgcagcttttagcagatattcaaagtgccaatgcaaacttaaacctgtatcaggtcgatttggcttcatcaaaagtggttagtcctgtaagcggtaaaatcggtagtctggcaattcaaaaaggctcacgtgtttctccacaaacccgcttaatggcgatcattcctgaaaatagtttgtatgtacaggcgaactttaaagaaactcaaatagaaaaaatgcatatcggtcagaaagttaaattaaaacttgatgcttatccaagcctcaactttaccggaaaaattgagagcttttctcccgcttcaggtgcgactttctcacttatgccaccagacaatgccacaggcaactttaacaaggttgtacagcgtattcctgtacgtatcgccatagattcaagcccacatattgatttgataaaacctggaatgtcggtgagcgccaccgttgacctaagaacttaa

SEQ ID NO: 3287 - DNA, 1731 bp, Acinetobacter baumannii
ttttggctgcttcttggcaaggtatgtgccagtaaaacattaggaatttgttcacatatggcgagtccggcacaaatcattcgacataaatttctcaatacattcttttcacgccactctatttggttcttgtgtatttttactgcactcacaatcacgtggtttagaaccgtatatacacctcatagtatttattattttatttcggatactttactcaacggtttatgggtcgtcagtggcgcattaagcttattaggtctatatgatgtcttacaaaatagacattcaatcttaagaaattacccgattataggccatttccgttttttatttgaagatatacgccctgaaattcgccaatactttattgaagcggatcaagatgcccttcctttctcacgtatgcaaagaagtttggtttatcaacgtgctaaaaatgagaatgcagataaaccttttggatcaattattgatgtctaccaagaagattatcgctttattgttcattccattagtccatgtccaccagcggatcctaagagtttccgtattcaaattggtaatgcccaatgccttcaaccttatagtgcatccattatgaatatctctgccatgagctttggtagtttaagtgcgaatgcaatacgtgcattaaacaaaggagcacaattaggcggtttttatcacgataccggtgaaggtagtctcagcccttatcatttagaaaatggtggtgatattgtttggcaaattgccagtggatattttggctgccgaactttagacggaaaatttgatgaacagaagtttgctaagcagtctcaattgccacaaatcaaaatgattgagcttaagctttcgcaaggggctaaaccgggccatggcggtattttacctaaacataagattactgctgaaattgccgaaatccgtggtgtttcccgtgaccatgattgtatctctcctgccaagcattcaagcttttcgacaccaattgaaatgatgcatttcttacagaagttacggactttatctggtggtaaaccggtaggtttcaaactgtgtattggtcaaccttggcaatttatgagtattgtaaaagcaatgcttgaaacaaaaattgtgcctgattttattgtagttgatggttctgaaggtggtactggcgcagcccctattgagtttagtgactatatcggaacaccattacgtgaaggcctacgttttgttcataatacacttgtaggtgctggcctaagagatcaagttaaaattggtgcaagcggtaaaattattagtgcatttgatattgccagcacatttgctctcggtgcagattgggtgaactcagcacgtggctttatgtttgcagttggatgtattcaagcgcaaagttgccatacaaaccaatgtcctgtaggcgttgcaacccaagataaagatcgccaaaaagcactccacgtaccgaccaaagcagaacgtgtatttaatttccacaaaaatacattacatgcattatcagaaatgattgctgcggcaggtttacgtcatccatcggatattaaagctcatcatttagctcaacggattaatgaccgtgaaattaaaaactatgctcaattacacttcttcttaaaagaaggtgagcttttacaatctgaactgaaaaatgatgatgataatttctattatcgtatgtggaatatggctgacgccaatcatttttaa

SEQ ID NO: 3288 - DNA, 594 bp, Acinetobacter baumannii
acatgcttccgcaggttttgtgcgtgctgttgctatcttataaagattaaaaataagataaatattaaggatatatttttctacaaagttaaatatatccttaatttattgattctgtataatttcattctctcctctaattactacgatcatcgaatgcaaaaaattaatattgaccgtcatgcaacagcacaaatcaacatgttagcaaacaagcttatgttgaaatcaagtaccgcttatacacaaaaatttggtatcgggatgactgaatggcggatcatttcagttttatccagtgcttctgattgttcagtacagaaaattagcgatattttaggattagataaggcagcggtaagccgcacagttaaaaagcttgaggaaaaaaaatatattgaagttaatggacattctgaggacaaacgcacctatgttattaacttaacttcaactggacaagagctttatgacgtagcttcggattttgcacttgagagagagaaacaacttcttgaagaactagaagagtctgagaaagaccaattattcaatttattaaagaaactgcgtaacaaagttgatcaaatgtaa

SEQ ID NO: 3289 - DNA, 843 bp, Acinetobacter baumannii
cccgtgatgctgatactggttttaagattaaccgtaaaatcattaacttggttaactcaaccgataccttggctggtattagctacattctttaggagcggtaacatgaaacaggttgttttagtgacaggtgctgcttctggactcggtaatgtgattgctgaatattttgcgagccaaggacatcaagtgattttgtcagccagtacgcttgaaaaagccgaaaatgctaaggcacaaagtcagtatgcccaaaatatgttttctttaaagctggatatttcggtcgaggcagattttcatgcagcggtgcaatggattgaagagaaattttctaaacttgatgtgttaattaacaatgccaccgtcaccaaagcaacccctgtattagaaattaccgcagctgattttgattgggtgacccaagttaaccaacgcggcacctttcaggcttgtcaaatcattggtcaatacatggccaaaaaaggttatggacgcatcattaatatggcgtctttagcgggacaaaacggcggtactgcaaccggtgcacactacgcggcaaccaaaggcgctattgtgacattaaccaaaatttttgccaaagagtttgcggcaaaaggtgttacggtcaatgcgattgcaccgggaccaatggagtcaccaatcgttcatagtgtggtgccagacgaaaaaatggaacagttcatccagaatattcctgttaaagccttaggaagtatgcattttattgctgaaacttgtgggttgcttgcaagtccaaatgcgagttttgtgactggtgcaacatgggatattaacggtggtttattcatgcgttaa

SEQ ID NO: 3290 - DNA, 915 bp, Acinetobacter baumannii
ataggggtgcttgtgcatcccttttttattcaagaatttataaattataaaaggttaggtatgaatactcgtcattttagccagctaccaaaagcggcattggcttatccaaaagtagtgcaaggtttaatttttaaaaaaccgaaaggcccaaaaatcttaccgcaagttgaatatgtggtagatactttagaaattgatcagaaccatctcaaagcttataacgaagtatgtggctttcaaaataatggctttgtaccagcaatttatttggctgtgctttctcaaagcttgcaaatgcacatgatgacggcagaagccttcccatttccaattttaggtttagtgcatatccgtaaccagattaaacagaccagaccgattggcgtaactgaaaaactcactctgtcatgtaaatttggggaactaaaaccacatgataaaggagttcagtttgactttattactacggcaaaagttggcaatgaagtggtgatggaaggcttaacgacttatttatctcgccaaaaagtcgagaaaagagtgggtgagaaagctaaagaagaacaagtgccagcttatgttccaaaggcagagtggaatattttagaaaacacaggccgccgttatgcgaaagtgtctggtgattttaacttaattcatattcatgccattacagcaaaagcatttggctttaagcaagcaattgcgcatggcatgtggagtaaagcgaaagcactagcgaaccttgaattaccaaatgcttatgaagcagatgtatggtttaagctgccaatgttcttgccatcaaaagttgagtttttaacggcaaacgcagataaaaagacagatttcttgattcgtaatgccaaatcacaaaaaccgcatgttgcaggaactgtaaaagcattataa

SEQ ID NO: 3291 - DNA, 351 bp, Acinetobacter baumannii
cttttaaaacgcgccacactactcaaatcttctctacgaataaaggagatagcaatgaagattcgcgcttcacgtacctattcaacttattcaaataattattttatttctaaagagtatgaatgcagtgttattccggtaaaaggaatgtgctttactgatcttggtttgaccgaaaatggtgtgattcagccagtagaaattaatgaggtcactatagatccggcatctaattcttatcatattcttttagctaaagactcacatgaatatacaaaagaagaattaaaaagaaagtttgaagagatgaaagctaatggctgggaatatatagaagatctattggtatag

SEQ ID NO: 3292 - DNA, 420 bp, Acinetobacter baumannii
catcatatgcgaacaaataagcgtcaaacaaatttaaaagatattaaggcttcttttcagcagtctggctatgtcgattggcacttcaatccacgcttaagtgattcgcaaaacgaagatcatgacggagaggttgttgtgcaaacagcacctcccgaactcaagcgtcctcccttatatgcagtggtattattgaatgacgattacacgccaatggactttgtaattgaaattttacaacaatactttgcaatgaatcttgaccaagcaactcaagtaatgctaacagtacactatgaaggtaaaggtactgccggggtatatccaagagacatcgcggaaaccaaggcaaaccttgttaataattacgctcgatcgcaaggtcatccattactttgccagattgagcctaaagcataa

SEQ ID NO: 3293 - DNA, 468 bp, Acinetobacter baumannii
aagaatcagcgtataatacagattataaaaacatatattgttaagagtgcttatatgtcaagtattgtctatgcctttgtgggtggtttattactcggtaccgcaacagttgggtatttatatataaatggtcgtatagctggaattagtggtttgcttgctcaattcattagcccatctagagatatatttaaaagttctgcattctggttcattgcaggactcgtgattacacctttcatatatggttacttttatcagcctgaaatcgaaattaaagccaattcatttgtacttattctggcagggatacttgttggttttggtacacgacttggatcaggctgtacaagtgggcatggcatttgtggaatgagcaggctatcaaaacgctcaataatagcgaccgcagtttttatgtttgctagcatgctgactgtttatatcattcgccatgtgctggggtaa

SEQ ID NO: 3294 - DNA, 651 bp, Acinetobacter baumannii
gacttttggcgagtgattacagaatttacggtggctttaaaatctgaaattctggcaagacaacccaatgctttaggtttggcgaaattggttttccgtccagactctggtgacccagttaaaattatttgtggtgacccagatgccgaagtcggcagcccagcatataaaggcgcggtagaatgtttatgggaagtgtttggtggtacaacaactgaccaaggctataaagtactcaatgaacgtgtcggtttaatttatggtgactcaattaccctagaccgtgcacagcgtattttagaagggcttgaagccaaaggctttgcttcaaacaatttggtgtttggtataggcagttttacctataactacttaactcgcgatacctttggatttgctgtgaaagcgacttgggggcaagtgaatggtataggccgagaactatttaaagacccaattactgactcaggtgtaaaaaaatctgcgaaaggtctattacgcatcgaagaaagtgaaaatggttttaccttgtttgatgagcaaactgccgaacaagaacaaggcggagcactaaaaactgtctttgaaaatggtaaacttcaatatgattgtactttggatcaaatacgtgagcgtttatccatcgcatag

SEQ ID NO: 3295 - DNA, 2442 bp, Acinetobacter baumannii
ttcaatattttacttagcctgttggcattgattgctttctttaccgatgatctaacgggttcaaccattattagtgtgatggtaattctttcaacactacttcgttactggcaagaagcaaagtcaaatcaagctgcggatgccttaaaggcaatggtgagtaatactgctactgtattgcgccatcaagtcagtgcagaagatttagaacttatgcatgaacgttatggcattgatactaaaaaccaaaccattcaccaatttgagataccaattcagtatttagtgccgggtgatgtgattttattatctgcgggtgacatgattcctgcggattgtagaattttgtctgctaaagatttgtttgtctctcaagctgcaatgactggtgaatcaatgcctgtcgagaaatttccgttgcagaaaaatctcgaagaaaccagcgctttagagctaggtaatattgtattcatggggactaatattgtttctggttcagctcaggcagtggttttaagtacgggtattcaaacatatttcggtgcattggctcatcgagttacggctactgattggagcacgactgcatttcaaatgggtgtcaacaaagtaagttggttgctcattcgctttatgttggtgatggcacctgttgtacttttcattaatggcttcaccaaaggcgattgggccgaagcatttttattcgcattatctgtagctgtcggtcttactccagaaatgctaccgatgattgtgacttcaactttggcaaagggggcggttttcttatctaaaaagaaagtgattgttaaacgtctagatgcgatacagaactttggtgccatggatgttctatgtaccgataaaactggaactctaactcaagacaaaatctttttatcccaacatattgatgttcaaggcgggaaatcagactttgtactcatgcaggcatttttaaatagttattatcaaacaggcctaaaaaatttgcttgatgtagctgttttagaagctgttgatgatcagatcaaaatacagaagttacgttacaagaagttagatgaagttccttttgattttgatcgccgccgcatgtcagtcgtggtacaaacgcctcaacaaaaagcccgtatgattaccaaaggcgcagttgaggaaatgttaaagatttgccgttatgtcgaggtaaatggcaaagtagagcctttaacaaagcaacgtgaagtggcaattgaggcattaactcaacgctataaccgagatggtttaagagtggtggcagtagcgtatcgtgagtttaaaaatcatcaggaaaattattcagttgttgacgaaagtgatctgattttaataggttatattacttttcttgatccacctaaagagtctgccaaagaagctgtacagagtttacatgcccatggtgtaacggtaaaagtgctaactggggataatgagtttgtcacccaaaaagtgtgccgagagattggtctgaattatgatcaaattttattgggcggtgtaattgaaaccttaactgatcaacaactcaaaagagcagtagagcaataccacatttttgcgaaattaagtccggttcacaaagaacgtattgttgagcagttaaaagcaaatggtcacgtggttggttttttaggagacggtattaacgatgccgctgctatacgtgctgccgatattggtatttcagtagataccgcagtagatatcgctaaagagtcagcagatttaatcttgcttgaaaaaagtctgatggttcttgaaaaaggtgtgattgaaggccgtagaacttttgccaatatgctgaaatatatcaaaatgacggcgagttcaaattttggtaacgttttttcggtacttattgcgagtgcttttattcctttcttacccatgttgcctatccacttattgattcaaaacttactttatgatgtttcacaaattgtgatcccttttgacaatgtggatgaagagctaattgcaaaaccacagcgttggcaacctgaagaagttggccgctttatggtggtgtttggaccgattagctccatttttgacatgattacttttgggttaatgtggtttgtattttcagcaaatactcctgaacatcagacgctattccaatcaggctggtttgtggtggggttacttacccagacattaattgtccatatgatccgcacagctcaaattccatttattcagagtcgtgccgcgactccattattaataatgacagcggcgattatgtgtatcgggattttcttaccaatgggtcctttagcaagctatttaaaactacaagctttacctttaagttatttcttatatttacctttaattttaggtgcttatatgtgtgttactcaatgggtaaagaaaatctatatccgccgttatggctggcaataa

SEQ ID NO: 3296 - DNA, 183 bp, Acinetobacter baumannii
tacaatattttttatttaaaaacaatatataaatcaatttcaattaaaaaacataatataatatgtgacctatatctcattaattatttaatttgtataaataggttatatttctacatctattttattaaaacgataattaaatcacactttacaaatattaatgtatcttggttattgtaa

SEQ ID NO: 3297 - DNA, 210 bp, Acinetobacter baumannii
tcatgtattttcgatttcctttcctatataagattcatgtatgcaatggcgataaagggtgccatttcttctggtcgatctaccatattatttccacttgtctttgaattttatactaaatgtaaagcatttattttgcatttagttgctgaattattggagatatatctaaaatatcaatcatattttttagatctttgtatcctataa

SEQ ID NO: 3298 - DNA, 1020 bp, Acinetobacter baumannii
ggatgtattttgctcaaaatacttaaatggagtgcagtcaaaatgaaacgtaaagttcttatcacggggccaacattaacttcagatgcgttactgtatgctcagtcccatgatattcagttgattccaactgaaccctacatggcaaaagataaaatggaaaaactcatccatgatgaacagcctgatgcaatcattgttcgaacaggcaaactttctagagatatgatttttgcttctgataatttaaaagtgattgcaaaacatggagttgggtttgacacaatcgacactcaagctgctgctgaacgaaaaattcctgtcactattgcagtaggtgcaaatgcacaatctgttgccgaacatgcttttgcactcatgttcaatgttgctcgacaagttacatggttagaccaacgtattcgagagggacattgggacaaagccagtgctaatggtatggagctttatggcaaaacgttgggcttaattggtttaggggcaatcggtagcatacttatgaagttagtggctcccttaaacatgaaagtaaaagtatatgacccgtttctacaaaatttgccagagctcgattatgtagaacagcaacacgactttgaaaaacttatcgaaaccagcgatattattagtctacattgtccacttacggcagaaaataaacacttattttctcacgcccaatttgaaaagatgaaaagctcaagcatcttaatcaatacagcacgtggtgaattaattgatcaggctgcattagtcgatgctctaaaaaataataaaattgctggtgcaggtttagataccttttcttcagaaccgccagaaaaagataatccattatgggaattacctaacttggttgtgactcctcacataggagcaaacacaacagattcacgcaatcgtgttggtcttttagcactcgaacaaatcgtgagtatttggaatggccaattactaaacccacgagctatcgctaactggaagttactcaatagctaa

SEQ ID NO: 3299 - DNA, 504 bp, Acinetobacter baumannii
atgttgtttagggcaatggcaaataaaaaacttttaatctgtgctgcaattgcggctggactattgttaaccgcatgcgttaaaaaagagacaccgaaagaagaagagcaagacaaggttgaaactgctgtttcagaacctcaaccacagaagcctgcaaaatttgaatctttagagagtgtagatactcaagaagctcaagttcaagagcaaccacaagttgaagttcatcgtgaagaaactgctaacacgacaactgaaattcaccgtgaaactcgtcctgcgcgttctgatgaatcttcacagacacaagttgctgaacaacctaaatctgagacaccaaaagtagaacctaaaccagaaaaaaaacctgagcctaaagctgaacctaaaccggaaaaagctcagtcaaaaccagctgctaaggcaactgaacctgcgaacacagaagatgatgccgttgctgctgctattgctgctgcaacaccagcacttaagaactaa

SEQ ID NO: 3300 - DNA, 1107 bp, Acinetobacter baumannii
aaaatagctagggaatattttatgaaaagtaagttaggaattagtaagcaactttttattgccttaactattgtgaatttaagtgttacgctattttctgtagtactgggttatgtgatttataactatgcgattgaaaaaggctggattagtttaagctcatttcaacaagaagattggaccagttttcattttgtagactggatctggttagccactgttatcttctgtggctgtattatttcattagtgattggcatgcgcctcgcaaagcgttttattgtgccaattaacttcttagccgaagcagcaaaaaaaattagtcacggcgacctctctgctagagcttacgataaccgaattcactccgccgaaatgtcagagcttttatataattttaatgatatggctcaaaagctagaagtttctgttaaaaatgcgcaagtttggaatgcagccatcgcacatgagttaagaacgcctataacgatattacaaggtcgtttacagggaattattaatggcgtttttaaacctgatgaagtcctatttaaaagtcttttaaatcaagttgaaggtttatctcacttagtcgaagacttacggactttaagcttagtagagaaccagcaactccggttaaattatgaattgtttgactttaaggcggtagttgaaaaagttcttaaagcatttgaagatcgtttggatcaagctaagctagtaccagaacttgacctaacatccactcctgtatattgcgaccgccgtcgtattgagcaagttttaattgctttaattgataatgcgattcgctattcaaatgcaggcaaacttaaaatctcttcagaagtggttgcagacaactggatattaaaaattgaggatgaaggccccggtattgcaaccgagttccaagacgatttatttaagcctttctttagattagaagaatcaaggaataaagaatttggcggcacaggtttaggtcttgctgttgtacatgcaattattgtggcactgaaaggcactattcaatatagcaatcaaggctcgaaaagtgttttcactataaaaatttctatgggtcatgaagagatagggtaa

SEQ ID NO: 3301 - DNA, 1017 bp, Acinetobacter baumannii
aatgcttatagtatagtagacttcttttttcccacttccacccagccaacaacagataattgttgtaattcaaaacaattattatggagtagctacatggctctaagacatttcctgactttacgtgatctatccactctagaacttaatcgcattttggaacgcgcaagcgaacttaagaaaatgcagcaaagcaataaggtatatcaaccttttgttggtaaagtattgggaatgatttttgaaaaatcgagcacacgcactcgtatttcttttgaagctggtattaatcaatttggtggtagtgccattttcttatcaccacgtgatacgcaattaggccgtggtgaaccgattgaagattcagcacgtgttatttcaagcatgcttgatatcgtaatgattcgtacttttggtcacgatatcgttgaacgttttgcatcttattcaaaagttcctgttatcaatggcttaactgacgatcaccatccttgtcagttacttgcagatttacaaacttatattgaacatcgcggcagtattgaaggcaaaaccgtagcttggattggtgatggcaataatatgtgtaattcatacattgaagctgcacacatgatgggtttcaaactcaagattgcatcaccaaaaggttatgaacctaaacctgagtttttagcagagtttgggcattgtgttgaactttttgataatgcggaagatgcggctgtaaatgctgatcttatcgttacagatgtatgggcaagcatgggacaagaagaagaacagaaacttcgtgaaaaagcctttgctaattttcaggttaacgagaaattaatgggacttgcacatccggactgtttatttatgcattgcttacctgctcatcgtggtgaagaaatttctgaaaccatgctcgaccataaaaatgccgtagtatgggacgaagcagaaaaccgtctgcatgcacaaaaagctttaatggaatttttactcaacgaaaatttgaaaaaagcttaa

SEQ ID NO: 3302 - DNA, 642 bp, Acinetobacter baumannii
atcttatataggaaaggaaatcgaaaatacatgattattgaaaaacttaagtcaataagctcaatcacagagttagtatcagtctttattattataaatttcatagtacaggtaagtcttaaagtacgctttctaaatgtatatggatattggacaatatcacttttcaacccaatagaaattatgtttggaaacttagagttaatgcttatttatattctgattttttcaagtataatttatgagaaaagtttagcacaaatggtatatatggttttgtgtattacaatattaccatatattattcctatgttgctccataaatattacttatcacctctaagtatttatggggtaatagttggattaatgggaatttttataactaaatttgcaaaacaaaactcaacttcggagatcgcatcattaacaattttacttataattgcacctctattatttgggattcatctcaataatagactaaacacaaacgacctatcatttattaatttaaaagatcaaacttctgagaagtggtttatattagataaattttcagacagttttttactaattaatgaagataaaagtaaactaaaaattattaagattgaggaacaaaaatcgataattttataa

SEQ ID NO: 3303 - DNA, 435 bp, Acinetobacter baumannii
atcatgaatagaaaattaatcagtactattgttctcatttctgtatttggagttactgcttgtagcaaggcatcaaatgaacaaacaaagatagatactactgcgaaaagcagttctcaaaacgtaaaaacggaattatccgaaagtgataaagcgattttagatagatatgaaacaattacaaatgaagttgtaatgtctggtgaagatgaaaagataaaacaaactttagtacctttaatacctgaaattaagaaagttactgccaagaaacaaagagaaatggcattgatgaatatttatatgctgtctggtatgtacaaagaggcttatgagttaaatgagcaacagatccaagagaaacccttgcctcaacgggtaatgttcagatgtacattgcttgaaaaattaaatgagactaaagtaaaaatttaa

SEQ ID NO: 3304 - DNA, 885 bp, Acinetobacter baumannii
atggcgaataggtctaaccataatcaagaattggctcaacttgtcgatcaatggacacgagaaaaaggcacattcgaaacagctattacgggactgactttatttcgtgcagatacattgaccaaaccaaatagcagcatgatggatgcgagtctatgtatgattgctcaaggcaaaaagcaggtgattcttagcgaagagacttatacttatgactctaaccatttcctttttactgcaattgacctgcctgtaattgctcaagtgcttgaagcttctgttgaacaaccctatctctcaattgtgctaaggctagacccatatttacttgctcaaatcatgcttgaggcccatattccctttaaagatgtaaatactgagaaaaaaggaatggctgttggagtagtcaattcagagctgaatgatgcgtttatacggttaataaaattactagatacgccacaagacattcccatcttgtctcctcttattattaaggaaattttttatcgtttattgatgagcccgcaaggcgatcgacttaaacgtattgtagcggcaggcactacaggtcatcgaattgtgaaggcgattgaatggctgaaaacaaattttgcgaaaccatttagtattgaagaactggcaagcacaatggggatgagtgcatcaagttttcatcaacattttagggatataacctcaatgagtcccttacaatatcaaaagagaatgagattgaccgaagcacggcgtttgctaatgaccgaagaatacgatatttcatctaccagcatgcaagtcggttatgaaagcttgtcccaattttccagagaatataaacgcttttttggggtttctccgtcagtagatattaagaatatataa

SEQ ID NO: 3305 - DNA, 204 bp, Acinetobacter baumannii
gtatcttgtagaagctgcaggggggcatctgtgaccaagtatgcagaaagatatttattgttgagctgctttcgtgcttcgctaaaggtttttgaacagatttttagctctgcttttgagttggagcagtcgatagattctgcaaaaacaagcgatgagcataaacaactcaatgtcacgacaaaacttaatcttttcaattga

SEQ ID NO: 3306 - DNA, 234 bp, Acinetobacter baumannii
aaatgccgtagtatgggacgaagcagaaaaccgtctgcatgcacaaaaagctttaatggaatttttactcaacgaaaatttgaaaaaagcttaatttctaattcaaaaaacagcatcgttaaggtgctgtttttttatttttataagatccctattaccctcatttattattttaaaaatttttatgatgttgcccaatatataaacagcctatatttcaactgtcacacataa

SEQ ID NO: 3307 - DNA, 1428 bp, Acinetobacter baumannii
aacaaatggctaggagggcctatgagtagttttgatgaaatacaaaatagagaagctgggctgcataaaaagttatctgcaaaacagatggggatgattgcgattggtggagcaattggaaccggattgtttatgggaagcaaatttgcaattagttttgcaggtccagcagtcatcgtcagctatgcgattggtggtttaattgcttttgcacttatggcttgtttggctgaaatgacagttcagcatcctacttcaggttcatttggtgcatatgcagaacattatataagtccacttgctggcttcttagttcgctactgttattgggcttgtattgtactggcggtaggtacagagattaccgccgttgctgattatatgaagctctggttcccgaatgtagactcttgggtctggattggatttttttcactgaccttacttgttgtaaatgcctatagtgttaaagcttttggactagtggaatactggttttccacaattaaagtttttgccattattgtgtttattcttttatctattggtatcttgacgcaaagcaatcagggaatgacgcaagttgtaactcatttatcaggacatgggggcttttttccaaatggttttagtggggtatggattggtgtcattatttcaatatttagttatttaagtatagaaatgattgctgtcgcggctggcgaagctaaagacccggaaaaggcagttaaaaaagcattcaaaagcacagcacttcgactcattttgttttatttattgtccttattcctaatcgttactttggtgccgtggactgttttgattggagcagatgcaacaagcccttttgttatggtcatgaagattgtcggtatcccgtatgcggatagcattttaaactttattgtaattgtagctgccttatcagccatgaatagcatgctttatatttcaactcgtatgctgtttagcttgtcacgtgcaggtgatgccccaaaagtctttggtcgaattagtagtaatggtgtaccggtaaatgcgctgttgttatctgcggtagggattggtattgctagtattgtttatacgattaatccagcttccgcatttccaattatgattgcgctatccatgtttggtgcgttgttcacgtggggaagtatatttgtgactcatatgttttttagaagacatatggttcagcaaaatatacaactaaaatttaaaattcctgctagtcgatttatctctttgtttgggtttattgcgattttaagcattacagtgactacctggtttaccagtgaatttaagtctactttacaatttggcgtacctttagtgcttgttcttatatttttctattatttgaaacgttctaccgtaaagttaaatctcaactctagtgaagaaacattgaagtga

SEQ ID NO: 3308 - DNA, 819 bp, Acinetobacter baumannii
atatgttgcagaagtagacaagcgtctagcagcgaaagaagcagaattgatgaaggtctaatttttatgaccgattcagaagagtatcatcttcctcagcatgttgccatcatcatggatggcaacaatcgctttgcaaagaaaaatcaaatgcaaaaaggcgatgggcacagagagggtaaaaatgttcttgaccctattgttgaacattgtgttaaaactggcgttcgtgctttaactgtttttgcattttcgagtgaaaattggaatcgaccacaatatgaagtcgatctgcttatgaaacttcttgaagaaacgattcatgagcaaatacctcgcatgaagaaattcaatattgctttgcgctttataggggatcgttcccgattaccttcacatttagttgccttaatggaagatgcagagcaacaaacagcacatcatgacgccatgacattaactattgcggtaagctatggtggtatgtgggatattgcaaatgcagctaagcaggttgctcaagcagtttcccgtggcgaaattgacgctgatcaaataaatgttgatttgttcgaaaaatatgtcagtctaaacgatctgccagctgtggacttgttgatccgtacaggtggagatttccgtatatctaacttcttgttatggcaagcggcttatgcggagctgtattttacggatactttgtggccggaatttacagtggaagaattcgaccatgcattgaatgtcttttcagggcgtgaacgtcgtttcggtaaaacatctgaacaaattcagcaagagaaaatcgagaaattataa

SEQ ID NO: 3309 - DNA, 201 bp, Acinetobacter baumannii
cgaacgtgcagatattcgtgcggctttaacaggtttaattccagcctttttacatgcaaagccgaaacatttttattattaaagtttgaagctgcctatagaggcagcttcagttttaactatttaaaaatgattggcgtcagccatattccacatacgataatagaaattatcatcatcatttttcagttcagattgtaa

SEQ ID NO: 3310 - DNA, 2118 bp, Acinetobacter baumannii
ctcttcagcagttttaggcatgttatgacttcaatgtcgaacactacccaaaagcattttattgttgagcagtttcctttaccgacttgggtcagtgatgaaaaaggcttaattttatactgcaatacggagtgtacaaagtactggcgcgatacttctcctccattgtttcaacaatggctagatttcgtgtaccctgccgatttagaagaagttaaaaacaaatggttagatgcgatacgactccgatcaagaattgaatttaaatgccgtcttttgcataaaacccattattatcgatggtgtaaaatttctattcaattgtcgaaataccatgaatcttctcaagaaaatgaatggtttattagttttctagatattgaccaagatatacaagagcagcaaagcttacgaaaagatatcgatatacaaaatcaaatgctcgatatcagtgtcgattgtattaaggttttaaatacagatggcacagtatctcatatgaataaatcagggtgccttgcattaggtgtacctgtagatgaaaaaaaattcggtatgcggtggttagatcttttaccccctcatattcgtaaacgtggaagagttgctttaaaaaaagccctgcaaggtaaagtagcccgattcgccggcatgagttgtttaccaaatcaagagcctgagtattgggataatatgctcaccccaattcaacatacaaatggtgaaattattcagatattgtgtgtttcgcgaaatgccactcaacagtatcttaccgaaaaccgtctaagagatattagtgagagagatgaactcacaggtttatttaatagacgttcatttaagctacaactaaaacgcaccctagcttactcaagagaaacccaaaccagtgtagggctacttttaattgatctagatcatttcaagcatattaatgacactataggtcatagtgctggtgaccacttattaaaaatactttccaaacgttttaatcagtgcgtagaccctgaaagatgttcagttgccagattaggtggtgatgagtttgcagttattgttagccatttagaaaatgagaatgatgttcgtgaacttgctgaagtattgcttcaacaactcaatcaacccattacatatgctgggaatgtgctcaacggcggtatgagcatcggctgcgccatttaccctcaagatgcagttgatcaatcgagcttattaagttgtgccgatatggcattacatgacttaaaagcccgtggtcgtggcggcatacgtatgtataacccaagtatgatgcagttaaccgaggcaatcgcctctcaactcaacattgctcgccagcttattcgtcatcataccattcagccctactatcaacccaaagtcgatctaaaaactcatgctgtagtgggctttgaagcattactccgctggcatacgacttcggcccaaagaggtttgccttctcagattgctgaagcttttaaagactacgatttagccagtaaaattggtgaaatcatgcaacaacaagttttgcatgatattgctaaatggataaaattaggttttgagccgcttcctgtttctctaaatgctgcaccagttgagttcttaagagataactatgctgaacgtttattaaaaaagattaatcaacttgaaattcctacccatttaattgaaatagaagttactgaacatatgctgggtgaccgtggttctgaatatgttattcgcgcactcaataaactaaaacagcatggagtacgcattgctttagatgacttcggaacaggtttctcttctttaacacatataagagactatccaattgattgcttaaaagttgattgtagctttatacaaaagatgcaacatgatccatccatttatgcaattgttcaggcaattggcttacttgctccaaatctctcactcggattaattgcagaaggtattgaaacaccagaacaagaagaattacttcttcaatttggatacaacatagggcaaggttttttatttgaatcagctattgatgctaatcaagtgatctctattcttaaacagggtcaggcttatctagaaagtcactattctatgaattaa

SEQ ID NO: 3311 - DNA, 1188 bp, Acinetobacter baumannii
tcgatcttaaggattaagaggttttttatgtttgtttattttccaaaaaactatgtttggagtatgtccaccgttattgctgcaacacatggtggaagtatcggtgaaattgatgagttttgccgtccattattagaaaagtcttctgatgatgcagatgttggcactgtcgagtttcttcatgcatggattggcggtgcagataagctgattaggatggctgaacaagatcttgagaaaaacagagaattgtctgctgcaaaaaaatattatcgtgctgccttatattatttaattgcagagcgtatgcaagaacaaggtcatcctgaacgtttaaaagtatataaacgctatttagagttagctgagctataccgaaaatataagaaagatgatgttaagcgagtagaaattccatatcaaaatagccatctaagcgcgatttatgcaaaaggaaaaacgacagatgaaaagcaggccattgttgtcatgatgaatgggcttgattctactaaagaattaatgtcttacagtcctttagctgatgaactcgtagagcgtggaatatcagtacttatggttgaccaaccaggtacaggagaggcgattcgcttacaagatttacgagctgtctataactctgaaatatgggctactccaattgttgactggttatgtgaacaaccagagattgatcaaaatcgaattgctgcttttggaatttctttaggtggatattattgcccacgagctgttgcttttgaacctcgcttttgttgtgcagcaatttggggggcaaatcatgattggcgagcagttcaacaagctcgtctaaaacgtgaaggcgaaaacccggttcctcactattggaaacatgtggaatgggtatttggggctaaagaccagaaagaattttttgagatagcagagaacatgcacctcaatggaattcttgaccgcattaaagtgcctttcttagtgactcatggtgaaaaggatcgccagattccattgaaatatgcttatgaaacttatgatcaattaattaattcaccagataaagagctattggtcattgatgatgagatgggaggcgttgaacacagttcaattgataatccattaaatgccggtgcgtatattgcggattggttggcagaacatttaggtggtagaacctcaaagtaa

SEQ ID NO: 3312 - DNA, 1149 bp, Acinetobacter baumannii
gaaagtataagtttaaaggaagtgaatatgtcggtaattgatgtaggcggtgaagtacgtgatggtgaagaacttgatattggggcagttgaaaactggttaaaaaaccaaggtgttgagctagttggtccagcagtcgttactcaatatacgggcggggcgtcgaattggacttatcgtttaaaatatgaaaataccgatttaattttacggcgtcccccaaaaggaacaaaagcgaagtcagcccacgatatggcccgtgaatatatggtgcagaaaaatcttgcgccttattatccagtactccctaaaatggtggcactctgtcaggatgaaaccgttattggctgtgatttttatgtcatggaacgcattgaaggaattattcctcgtgcaaaattaccgcctgagcttggctttactgaagaagatgttcatgagctttgtgtaaacgttattgataaattgattgagttacatcaagttccttatgagaacacgcctttagctgaactaggcaaaggtacaggatattgccgtagacaagttgagggttgggataaacgctatgaaaaagtccgcacaatcaacgttccttcttttaaatatgttcgaaaatggctaaacgataatatccctcaagactctacgacttgtattattcacaatgattggcgttttgataatgtgattttagatccaaaacatccaactgaagtgattggggtgctggattgggaaatggcgactttgggtgatcctctaatggatttaggtagcgctttggcctattgggttgagcccacggataatatgatttttagatcgacacgccgtcagcctacccatttaaagggaatgttctctcgtaaagaagtcgttgactattatttgcaaaaaactggtctggaacctcaaaactggactttttatgaagtcttcggtgtattccgtttagccgtgattgctcagcaaatctattatcgttattaccataaacaaacccgaaaccctgcttttaaagatttctggatagtgatccatgcactacatatcagagctttaaaacttatcgcccagcaaaaattgcaagaatcggaatttgctcagcaatctctacagaaaatacagggtattttaagaagatga

SEQ ID NO: 3313 - DNA, 906 bp, Acinetobacter baumannii
ctgaataaaaggactaaaaaaggaattatggaaattaaagtactggtagatgtaaaaacaaaacttggagaatgcccaacttgggatgctgttcgccaacgcctattttgggtagatattgttgatggacgattattctgttgtgatgaattcggtgggaatatacgggcgtgggaagttcataaaaaaataggttcttttgctttacaagaaaattataacggcgcaattgttgcgctcgaagacgggctatatcaactcgactttgacacaggcaacttaaaatttatttgtaaccctgaaccagacctacctcaaaatagattaaatgatggtcgtgtcgatcggcaaggtcgattcgtttttggctctatgaaccgccttgaagatgggaatactgcgtctctctatcgattagatgcagattataaaatagaaaaattagaaaataatattaatacttcaaatagtatttgttggagtcctgatggtgctaagctctattttgcagacacatggcaaggtgaaatctggtcttatgattatgatcttgaaacaggccaaatctcaaataaaactattttttgtaagatagatacctcagacggtggttcagcagatggctcgactgtagatcgtgagggttatttatggaatgcaaaagtatattcgggtcagttagtacgttatcgtcctgatggacaaatcgatcgtattattgaaatgcctgtaaaaaaaattaccagtgcagtttttggtggaaaaaatcttgatgtcttgtttgttacatctatgtcgcaaccgcctcttccgaggttctctgatgacaaccaattgcgaggcagtgtttttgccatttatgggctaggcatccaaggaatagccgatgctcgatttatggggtaa

SEQ ID NO: 3314 - DNA, 630 bp, Acinetobacter baumannii
gttgaaaaaagattattatcctgtctacgtcatgaaaataaaaagcgaaaagctaacggtgaacctaaaaaagattctatattacaggatattaaaactattcatgagcgcccagccgaagttcaagaaagaaaaataccgggtcattgggaagctgatttaattaaaggtaaagacaataaaagttcgatagcaacacttattgaacgaaatacacggctctgtatcttggcaacattacctgatgcaaaggcagaatcagtgcgcaaggctttaactgaagctctgaaatatttacctgcagaactgcgtaaaacgttgacctatgaccgtggacgtgagatgtcagaacataaaatactcgaagaagatttaggcatagatgtatatttctgtgacccacattcaccctggcaaaaaggcacatgcgaaaatatgaatggtttaattaggcaatatttacctaaagggattgatttaaatcaggcagatcagcattatttaaatcaagttgccatgtcactgaatactcgtcctagaaaggcgttagattggcttacaccattagagaaatttgctcagcttgttgattatcatatggcttttgaaactgtcgcacctcatgtttga

SEQ ID NO: 3315 - DNA, 480 bp, Acinetobacter baumannii
catgacagaagcagctgctttagcaatttatcaggcgatttattaatgactaaacccgttttaaaaactcgtgatcaatttaaattctttttagatattcaaacgcgctgggcagataacgatatttacggtcatgtgaataatgtgacctactatagctattttgatacggcagccaatgctttgctcatccagaaaacaggttttgatattcatgaagcaaaatcaattggtttagtcgtcgactcagcttgtagcttttttcaagagttatcatttccagaagttattcaggtaggcgttgcgattggtaaaattggtacgacatctttacgctatgaattggcaatctttaaacaaggtcaagaccaagcatcagctcaaggacattttgtgcatgtgtttgttgaccgtgaaacacgcaagactgttccaatatccgagtcagtccgtgaagttttagagaattttttattataa

SEQ ID NO: 3316 - DNA, 795 bp, Acinetobacter baumannii
cctttcattttgataaaaaagccggcaaatatgtcggcttttttatcatttaagcttattattttttatatttacattgcttctctttatctcaaagaaaatatcattaaaaataaagccctaactaagtataaaaggacaactatggcacagttcgcggtcatcggcttgggaagttttggggcaactgttgctcaggaacttacgagattaaaccatgatgttattggtattgatacagtcaaaaagaatgttgagaatcttgccgatgttttaactcatgctgtcattgctgatgctacagatgaacatgtattggatgaattaaacattcaaaattgtgatgcagtggttgtagcaattggtgaagatattgaagccagtattttatgtgtgctgaatttaaaaaatctgggcattgataaaatttgggtaaaagcaaaaaccaaagcacatcacaccattttgtcacaccttaatatcaataagattattcatcctgaagaagatatgggggtaagagttgctcaagctctgaactaccctatggtaagccgctatatgtctttagaagatgatcattacattatcaaaattgagatcccagataagcttaatggcatcaatttatatggcattatgcagcaagcgcctcaagtcaaaacattgctcgtgaaaagacagcaacaaattttgtttgagactgaagaaaatttcactttgcaaacacatgatattcttattttagaaggtcatttatcacagttaaagaaactttctaattgcttcttataa

SEQ ID NO: 3317 - DNA, 693 bp, Acinetobacter baumannii
atattacagagacgtgaacagatgactttaagattaagtgtcgctgcgatgggtttattactcagcggttcagtattttcagcagttacaattacagcgccagaggaagtcgtaatccttgcggtgaatggtcaggaagtcaactctggattattccgttcttctaaaaataattataaagtcgatgctggtgagacaagcctaagtgtacgttatcaagaatattttgagcatttaagtggcgaacacgatattgttaagtcaggagtggttactattcaaactccagcgctcaaagatggtcaaacttataagcttgcaatggtagatgctccaaaacaatttgaacaagccaaaaaatatgctgagcaacctacagtggctttatataattcaaataatgagttaattgttcaacaaactggtgccaataatgaggcaagaccgtggtttgcatcgggtttgctaggtaaggttactgatttcacgactaaatcatctaaacaacaacctgacgctgtgtatgctgctgcaaaacctaccacgactcaagctaatgcgcctgttgcaacaactatgcctgctactggtgtagcacaaactaatgatcagcgtttggcagaaatttggaaaaaatcttctaaagcagagcgtcaaaagtttatggcttggttagctgagcagtcgaattaa

SEQ ID NO: 3318 - DNA, 936 bp, Acinetobacter baumannii
tgtatctggagaataatcatgccttattacaccatgcccgatcaggaaagtttatttgtacgccgtgttggtcgtggtgaaccggtattagttttatctggcttaggtatgcaaagttggcaatggctaccttttatctatgcaaatcgtaaagaatacgagtttattattcccgactggcggggctttggcggttcaaaaaattgtgcaattcccgagcaagatgccatatcaagccactggcaagatgttgctcacttaattgagcaattaaaattagataaatttattttaatgggctactcaatgggagccaccactgcaatgcatggcatgaaacatgctcatctcgctcagcagttaaaggcctatttacatatcgatcaaacgcctaaaatttcagtagatgctacatggcaatatgggttatttgggccattacatgcccaatttaaacaattactcaatgatatttatcagttattatcaatccataaaaatgctaaatatctttatgaattatcacttccggaccgtcaaaagttggtgcgtttgtgggtagattttattgaattgcaaagtagcaatccgtttagtccttttgtttttaaaactgcattaaaacaaccatttttacaaaaatatcttcttccgattcagcgtttagactacttattttggtatgtcgaaaattatcttttccacaatgaagattatcgtgaagcacttcagcaattacagtgcccaacaactttctttattggacgcaattcgacactctatccagaaacgggccaaaccctaattgcacatagtgtcgaacatgcaaaaacaatttattttgaacgttcaggccacacgccattattaaccgagccaaaaaaattcgggcatgaaatcactacttttttatccgaacttaaacatgcttcttaa

SEQ ID NO: 3319 - DNA, 690 bp, Acinetobacter baumannii
gcacaatggagttgtctaatgattgacaaaagtaagtcctcactaagcgaggttttatcgcagattaaagatggtgcaaccattctgattggtggttttggtaccgcaggacaacccgctgaactcattgacggtctgattgaacttggcgttaaggacctgaccattgtgagcaacaatgccggtaatggggattatggtctggcgaaactgctcaaagccggttcaattaaaaaagtgatttgctctttcccacgtcagtctgactcttatgtgtttgatgaactgtaccgtgccggaaaggttgaacttgaactggtaccgcaaggcaatctggcgtgccgtattcaggcagcaggtatgggccttggggcggtgtttaccccaactggctttggcacacttttagctgaaggtaaagaaacccgtcatattgatggtaaagattacgtgcttgagtatccgatcaaggctgactttgccctgattaaagcttacaagggcgaccgctggggcaatctggtttaccgtaaatctgcacgtaactttggcccgatcatggccatggctgctgatgtcaccattgcccaggtctctgaagtggttgagttaggtggattagacccggaacacatcattaccccaggtatctttgtacagcatgttgtacaagtacagcccgcacagtaa

SEQ ID NO: 3320 - DNA, 672 bp, Acinetobacter baumannii
gcaataaggagaaataacatgagctaccagaaactcagccgtgaccagattgcaaaacgtgtggcacaagatattcccgatggtgcctatgtgaacttgggtattggtttaccgaccaagattgccagctacctacctgctgacaaagatgtcttcctacattctgaaaatggcctgttggcttttggcccaccaccagctgcaggtgaagaagaccctgaactgattaatgcgggtaaagagtttgtgaccatgcttgaaggcggcagctttttccaccatggagactcctttgccatgatgcgtggtggtcatcttgatattgcggtgcttggggcatttcaggtggcagccaatggtgacttggcgaactggcacacgggtgcaccggatgcgattcctgccgtaggtggtgcgatggatttagcggttggtgccaagaaagtatttatcactacggaccatgtaaccaaacaaggtgagccaaagattgtcgctgagctgacttatccggtaacgggtaagcactgtgtggatcgtatttacactgacctgtgtgtgattgatgtgaccagagatggtttaaaggtgattgagaaagttgaaggtcttagctttgatgagttacaggctttaaccggtgcaactttgattgatgcgactcaagggtaa

SEQ ID NO: 3321 - DNA, 672 bp, Acinetobacter baumannii
gcaataaggagaaataacatgagctaccagaaactcagccgtgaccggattgcacaacgtgtggcacaagatattcccgatggtgcctatgtgaacttgggtattggtttaccgaccaagattgccagctacctacctgctgacaaagatgtcttcctacattctgaaaatggcctgttggcttttggcccaccaccagctgcaggtgaagaagaccctgaactgattaatgcgggtaaagagtttgtgaccatgcttgaaggcggcagctttttccaccatggagactcctttgccatgatgcgtggtggtcatcttgatattgcggtgcttggggcatttcaggtggcagccaatggtgacttggcgaactggcacacgggtgcaccggatgcgattcctgccgtaggtggtgcgatggatttggcggttggtgccaagaaagtatttatcactacagaccacgtcaccaagcaaggtgaaccgaagattgtggctgagctgacttatccagttactggtaaacattgtgttgaccgtatttacactgacctgtgtgtaattgatgtgaccagagatggtttaaaggtgattgagaaagttgaaggtcttagctttgatgagttacaggctttaaccggtgcaactttgattgatgcgactcaagggtaa

SEQ ID NO: 3322 - DNA, 663 bp, Acinetobacter baumannii
caagtaaggagaaagaccatgaaacgttgtttattggttttactccttggacttggattggcggcttgtaatgacaatgatcatgatgaccaagtctcgactgaaaaacctgcactagcaccgagcttagacgtcggaacttatattattagtaccgaaactgatcaagaattacctatggcgggtaaatactattctggtgcagatgggactaaattattggttttagatgatgacgaaaaccgcgccaagattgtgatgagctatgatgcaaaaacaaaagcttggcgaagcaaccagtctaatcaagcgatgacagtcgaattagcgcattatgaaaaaattgctgatcaaaaacttttgcttaatcaattggtcggcacctacgatttatcgtttccagatggaacgacggtaaatgccgaggtgaatgcacaaggcaaaattgtctcgaaagacccaagttgtgtgtttacaggtgttattactgaaagtgcattagccaataccgcaaactatcaactgaccgataatcagtgtgatgcgctaaaaaataactcgaaaggttatgttgtggtagatgaagacttagatcctatgagttttaggcttgtatctgacacgattgcatcaaaagacatttgggcatttgcacaatcttaa

SEQ ID NO: 3323 - DNA, 378 bp, Acinetobacter baumannii
aagacaaggagaataactatgacaaatactattgatggctttgtttttgataatcctcctaaagaggagcaaatcatagaacttgcccattaccatcgtaaattattagacgaagcaattttccatcaagaaatacatttaggggattattgtttagcacaaaggaaacgggttttcgactatgctcgtcaattagaccctaatcaaaaagcttggttctatcaagtttatgatggtgaacttagaaaaattgcagatgaagatgaattgcacccagcagatgcagaagaaggtttaagtatttttgctatgctattagtattagttattattgctgcaattttatacttctctgtaattcgttccttaatgggctaa

SEQ ID NO: 3324 - DNA, 882 bp, Acinetobacter baumannii
ctccttcatggaaaatcagcctttatgaatagtattaaaaataaggaagaatatcaaaaagcattagcacatgtaattcaacatgctgaatttaatgaagatattgttgaatttgtggattatgttacaagtcaaaagggtaatataccattttgtattagacggttaagaagttattgtgaggcgaatgcaattgtatcttggtttcgcgataaagacttaattggttttaagcaatggtgttatattgcggctaagttgaatcgcatggtcattcaatttgatcctattggatggtttccggcatatgagcatttctcagcattattatcagataatgaggaaatcatttcttggtatagtcagcaccgagtatcgtatgatcgacaaggctcaattaaagaccgtgataatccgcgtaagccagattttcatggatatcagttgatattagctcttaatcatgagtgggataaattacgtgaacgttgtgaactcattttacaaactgatttaaaaaaggataaaaagtatttaattgaccatcgtttttatcttgctttagccaatggtgataagaatgaaatagaaaatgttttgactgagttaactagtccaaaaattgcaaaagttcgtaattttgaatttgcatttacttttactgagcattttattgctactcatgctgtaatttataccaaattagcatggagaaatggatatcagttaaatatagatactccttggatacctaaagaatggttgcctgtagagcctttacttgaatatcccgaaccttgggagtttatgagagaatttgatatttttactccttttgaaggtgaatggaaagattggtcccccaaaagagacaatagataa

SEQ ID NO: 3325 - DNA, 1563 bp, Acinetobacter baumannii
actgttatagggaagatgaacatgctgtctcgtgtggtacgacaaattttacaagcaacggtttatgatgttgcaattgaaacacctctcgaagcagctccacgaattagtcaaaaattaaacaacacaattcgttttaagcgtgaagatttacaaccggttttttcttttaaattacgcggtgcctataaccgtattagccaattaccgaaagaacaacttgaacgtggcgtcatttgcgcatctgcaggcaaccatgcgcaaggtgtagcgttgtctggtcaacgtttaggtattcctgcaattattgttatgccaagtactacccctgacattaaagttcaggcagtgaagcgtttgggtggccaagttgtattgcatggcgatagttttgatattgcaaacaaatacgctcagcaacgtgccgaagctgaaggattagtttttattccaccttatgacgacgagttggttattgcgggccaaggcacaattgcgaatgaaattttacgccaatggcgtgatgtagaatatgttttcgttgctgttggtggtggcggcctaattgctggcgtagcagcttacttgggtgatgttgcaccgcatgtcaaagtcatcggtgttgaatatgaagagtcagcttgtttaaaagcagcgctagaagcaaatgaacgtgtagtcctaccccacgtaggcttatttgctgatggtacagcagttgctcaaattggtgccttaccttttgatatcgttcgtctacgcaaatcagataattctggaccaattgttgaaccagatattgttactgtaaatacagatgagatctgtgctgcaattaaagatacttttgatgaaaaccgcagcatcgttgaaccatctggtgcaatggccctagctggtatcaaaaaatatgttgccgagcataaaattagcggcaaaaacatggtctcgattgtttgcggcgccaacatgaactttgaccgcttacgttacattgcagagcgcaccgaattgggtgaacaacgtgaagccatttatgcagttactctttctgaagaaaaaggcgcattcttaggcttctgccgtgctctacagggccgtaacattaccgagtttaactaccgtgcaaataacacagaagaagcacaagtttttgtgggtattagcttaaaaggtggtgacactgaacgtcatgaaattttagaacaacttaaacagcaaaattatgttgtagatgatttatctgatgatgaagttgctaaattacacattcgttatttgattggtggtcatgccaatctggatgacgaaagattgttccgtgttgagtttccggaacgtccgggtgccttactcaccttcttaactcgtttaggtccaacccacaatattacgctgttccattatcgtaaccacggcgctgccgaaggtcgtgtactagttggcttacaagcaacagatgctaaacaaaacccagatggtttaattgaaactcttgagcaaattagctatccatatgcagaaattactgacaatgtgggctataaacgtttcttgaagtaa

SEQ ID NO: 3326 - DNA, 1236 bp, Acinetobacter baumannii
ataatgtcaggttgtggtgctgagcgtggattaatcagtatagatgaagcgctagatttagttattaataagcctaaaaacttaagctctattcaaaagactctaataaatagcctaagtagttatcttgccaaagatatttactctgaaattaatttaccaagtttttctcaaagtgcggtagacggttatgcactttgtagccatgcagaagatttaaataatcaaaagttccaagtcacaggtgagattcgtgctggaagcgagagtcatgacatactcggtgaaggtcaggcgattcgtatatttacgggcggcaaaattcctgaagggacaacgcatgtagcacggcaagaaatcgtatcggtttcggcccaagaagtttgtttaacggaacatatacgccctcaagccgatatccgctttaccggagaagaaatccagcaagggcagttacttgctcaagtaggacagtttctaaatattggaagcttggctgctttaagtatggcgggtgtacaagaacttactgtttaccgcagaccaaaagttgcagttttagtcacaggtgatgaagttgctcaaacggcagaagatttaatcgatggaaaagtctttgatgcaaatggtccattactaaaagcttggtttaaagattatggtttagatgttgaactcattcatgtggcagatgaagcagatcaggtcacccattactttaaccaactaaaagacagctatgatgttgttataacgactggcggagtttcggtaggagactacgactttgttcggccctgtgctttcgaagttggatttgaacaaatcttttggaaagttaaacaaaaaccgggtaaacctttattctttgccgaataccataattcacaagctatccattcttgctatttgctaggtttgccgggcaatccggctgcggtatatgtcgcaatgcaagtttacggcaaatctttgcttgatgcattgcagggcaatagacagggaccagaatggtttaccgcaattttagagcatgatttaaaagaagatgcacgtgagcgttttttacgaatgtatgcttattttgatgcagggcaacttagggtaaaaagtttggccaagcagcagtcccatatgctgagtaatcttatgcaagccaattgtttagtccgtattcctgcgagtacaaaactagcatcaggaactgtgctaacgggaatctttatttcaaattaa

SEQ ID NO: 3327 - DNA, 2799 bp, Acinetobacter baumannii
atagggaaaggagcagttatgaatagtattccaagcgttgaaatcgatagctccgaccatgttgcaaaaacaactaaaacaacatgtccatattgcggtgtaggttgtggtgttagtgtaaacgttcaacaaaaacctcaaggacctgtggtgcaagttgagggggatgctgagcatccttccaactttgggcgcttatgcattaaaggtagccgacttgcggatactttggggttagaaacacgtctacttcaaccgatgtttggtcgtaagccacttcggactgtaaccacatgggatgcagcaatcaataaaattgccgataaattccagtcttgtatcgacaaatatggtcgtgacagcattgcattttatgtttcaggtcagcttttgactgaagactattatgtggtgaacaagtttgtaaaaggctatttgggcactgcaaatatcgataccaactcacgtctttgcatgtcatctgcagtggcaggtcacaaacgtagtttcggtgaagatattgtgcctgcaagttatgaagattttgaacatgcagatatggtggttttggttggttccaataccgcatggtgccatcctgtgctgtatcagcggattatgcaggctaaaagccacaatccagatatgtttgttgtggtgattgacccacgttttaccagtacttgtgagcaagcggatttacatttaccgattttaccgggccaagatgtcgcattgttcaacggtctattccaatatttatatcaaaatggtcatgccgatcaggcttttgtggatgcctatactgaaggtttgcaagaggttttggcaagtagtcagcaagaaacggatattggctatgttgccaaacgcagtggtatttctttagacaaattacagcagttctttgagatatttgcgcagactgaaaaggtaatcacgctattttcaatgggtgtgaatcaatcaagtcagggcgttaataaagccaacagtattattaattgccatttactaacaggcaaaattggtaagctcggcgctgcaccattttcaatgacaggccagcccaatgctatggggggccgagaagtgggtggcttagctaatatgttggctgcccatatggatttagataatcccttacaccaaaaagtagtgcaaaccttttgggacagcccatttattgcaactcaagctggcttaaaagctgttgatttgttccgtgctgttgaagctgggaaaattaaagccatctggattatggcaaccaatccggtggtaagtttaccagatgccgatcaggtgaaacgtgctttagagaaatgcgaattggtcgttgtgtcagatatctgtgccgataccgatactacagcttacgccgatattttgcttccagctttaggttggggtgaaaaagatggaactgttactaactctgagcgtcgtatttcacgtcaacgtacttttttacctgcgccgggtgaagcaaaggcggattggtggtcagtgagtcaagttgcgaaaaaattaggctttaaaggttttgattttaatagtgctgttgatatttttaatgaacatgcggctttgtcagcacaagataatgcggacattgaagcacgtgagcaaactgatacgtttcgttatttcaacttaaaaggcttaatgagcctaagtattgctgagtatgacgctctacaaccagtgcaatggccagtatgggataaaaaacaagacgctaaagctgttcaacaactgtttggcaagggccagtttagtcacaaaaataccaaggcaaaattgattccgactgttgcaattaatccggtacatgcaatttcagaagattatccgctcattttgaatacgggacgtattcgtgatcaatggcataccatgacccgtactggtttgtcgccaaatttaaccagtcatcgtgctgaaccattctgtgagattcatccgagtgatgcattgaagtttggtgtgcgtgatcaaggcttggtagaagttcgttcgaaatggggcagttgtgtactgcgcgtgacattctcatcaggtgtccgtcgtgggcaaatttttgcaccgattcactggactgaacaggtcgcatccgacgcgcgtattggtaaagtcgtgaatccagaagttgatgcaatttcaggtgagcccgagttcaaacatacgcctgtaactattcagccgttctataccacttggcaaggtgtgctctatattcgtgaaggatacgattcgcatattcaagaatcgctacatcactgtgcatggtggactaaagtcaaaatggtgaaaaccaatcgctatgaacttgcagaccgccaaacttttcatgatactcaaaagaatctgaaaagctttttgccatttgccgatgaaacctttgaatggttaagcatagaagatatttcttcacaactgagccatagtattattttgaaagatggcattgtaattgcaagtttatatattgcaccgccagatttattgccagaccgtgactgggtagcaagtctgtttaaacgagaacgtttgagcgccttgcaccgtaaagctttactagcaggtatgccaatgtcggctactaataatgatgggcctttggtgtgtagttgttttaaagtaggtaagaataaaattatcgaagcaataaaaacacaaaatattacccatgaaaaacaggtcactgcttgtttaaaagctggtggcaattgtggatcatgtttacctgaaatccgtggcttaattaaagcttgccagcaagaggtagaagtgtga

SEQ ID NO: 3328 - DNA, 462 bp, Acinetobacter baumannii
caaaagcgaggtgaacacatgacctataaatatgaatatgcagggttttggttaagatttggcgcaatgatcattgatactcttattctttttttagcaattattccagccgcatggatcttttatcatggagattacgatctcatatttgctacaggtatgagtagtaaaccgcaaaactattggtttgatatgatcgtaaattatgcatttccatttttatatactgttttgtgttggatctactttgcagggactccaggaaaacgtctaatgcgtttaaaagttctcgatgaaaagacaggtaataagttaactttcgtacaatctctcattcgctatatcggatatattccatctattttagtgttttgtatcggtcttatttgggtcgcatttgatgctaaaaaacaaggatggcatgacaagatggcgaaaacagtggtggttagagaactgtga

SEQ ID NO: 3329 - DNA, 1047 bp, Acinetobacter baumannii
ttgtcgagaggtgccttaatgtctgagattccatttctcaatcctgccgtattaaaacaattagatttaccggttccgaaccgtgaactcactccgcaagttttaagcccactcaatttaaataccttagaagagccttctcgcgagcttttagcatatcgtaaattatacggtttacatttactggactgtgagcattggcaaggctatgtccaaatgcctttatttcgtctgcatgtccaagtttttaaacctaaattagacaaaatccaaggaaccgtatgtttattgcatggttatctggagcatagcggaatttatcagcccattattcgcgaaatacttgaacaaggctttagtgttattacctacgacttacctggtcatggtttgagtaatggttcacctgcaagtattcaaaattttgaccattatcaacaagttctgatggcggtttatcaatatgtcaaacatgctgatcaattaccgaaaccatgggtaggtattgggcaaagtacgggtggggcaatctggatgcatcacttgcttgagtatgcagaaaaaagacaagacccaatcgtcgatagggttttattgctttcaccattaattcgtcctgctaaaacagcatggtggcataatccggtaggtctaggcattattcgtcgtattaagcgccaagtgcctcgacactttagacggaataaccataatcctgaatttttaagatttattcgtttaaaagatccattgcagccacgcatgatgggcatggattggattttggcaatgtcaaaatggatgcaggaaatggaagagcgacctgcttgtcgtattcctgtctggcttgcacaaggggcattagatcaaacagtagactggcgttacaacatcgagtttattcgccgtaagtttaggcttcaaaccttattgatgctggaagagggttcccatcaattaattaacgaacgtgcagatattcgtgcggctttaacaggtttaattccagcctttttacatgcaaagccgaaacatttttattattaa

SEQ ID NO: 3330 - DNA, 816 bp, Acinetobacter baumannii
ttgatagcggggtttctatgtccgcatggaaaccctgttttgtgtagcactttcctgaatctttcttggttgagaactcgaaaaatgaaattgaacagttataattttttgttaggtttggcgtttgcttcatctgttgctgctcctgccgctcaagcagaaattgtaattcatggcacccgtgtaatttatccgtcggatgctagagaagttacgctacaagttagcaataacggttcaaagccagcacttgtccaagcttggattgatgaaggtgatccaaaaagtactccggatcaatcaaaagttccttttatgattgctcctccaatttctcgtgttgaagcgacaaaaagtcagacgcttcgtattactgcccttccaaatgcttctcaatttaaccagaagcaagaaactgttttgtggttaaacgttttggatattccaccaagacctacctcaaaaaatgcagatacgacacctgataacttcttacaacttgcaattcgttcccggattaaatttttctatcgtccggcttcaattaaagaagatgcgaatttagcagcagataagcttcaatgggttaaatctggtcagaatttaacggtaaaaaatccaactcctttccacattacgatgacttctgtttatcaaaaggttggagataaaaaagttgatttattgcctcaagggctaatggttaagcctttttctgaagcttctattcagcttaagaatagcaaccttcaggatatgagttttattaatgtcaacgactatggtggtcgagttgaacaccaaataaaactttaa

SEQ ID NO: 3331 - DNA, 1194 bp, Acinetobacter baumannii
tctttaaagggattatttaaaggaataaggatgatgcataaaatcgaaagtaagcgaggaatgcttgcgctcatgacgtctcactgtgcaggtatggttgacttggttgccttacctatctggataggcacactcattgcgaattatcattttggttttcaacaagcaggtggcctagtcaccctgttcttattaggagcaatgctggcaagtttaatatttgcgcctatttttaaccgttttaatcctaaatggcccgtgtttattggattcttttccgcttgttgtgctttttacctagcctcaaaaaatactcatttttcagtattagcaatattacatctggtaggtggcttttctgcaggtcttgccttgagctttacgcatggcactatgggaagaggtttaaaccctcatagaatatttgggtttgccggtctagcacttggtatttttgctattttgtttttagcaggttctttaaatttaattaggaattttggcggctctacactatttttgattcttgcctcaattatggctgttgctgcgtttattgcttttttattctacccccaagtcaataaaaaacaggacaatattcaatttgaagcgtaccatcgtcctaaattttcaaaatacatttggtgctgtatttttggaatatctttattagccatgacaaattctatgaatgtcagcttttatgaacgtattggaattgcacgtggttttggagaaagttctgttgcactgacattaattatttacagtattgtttctatttttccagcaccgatcgcggctttcacccaaaagtatttaaatccactcgccgttatttgtattggtcccatttttcaagccatattttcattagtgcttacccatagtcataattattttctttatacagtggctgggtcatgtatggttttcactattttatttactcatacatatgcttttggattactcgccagacttgagccaacaggacgagctgttgccggaactcctgccatgttaatgttcggtgcagccttaggaccaattttagcgggtactttagttcaatatattagctttgaagctattgggatcatgggctgtattttggttgttggtcaattgattttatttaatatcgttagagcgtactactctaataatggtttagctcaaaatgcttaa

SEQ ID NO: 3332 - DNA, 975 bp, Acinetobacter baumannii
acaagacttataagattgggaatagtaatggctaaaattttaacaattactttaaaccctgcaattgatgtaaccattcaactgaatgagttattagtaggagaagtgaaccgacaagagtcggtagaaatacatgcggctggcaaaggccttaatgttgctcaagtattaaaagacttaggtcatgatgtaatcgtaaccggctttttaggtgagcataatcgacaaattttcgatacacattttgcacaagctcaatttcaacctgagtttatttatattgatggtgaaacccgtcaaaatataaaaattgctgagcattctgggcggatgacagatttaaatggcaaaggtttctttgtttctgaaacagacaaacaaagcctatttaataagattgaagctctgttaccacaagtcgaggttgttgcaatagctggtagcctcccgcaaggttttagtattgatgagttacaacaacttattcaactaatcaaaaaaaataataagaaagttgccctagataccagtggtaaagcattggttgctgcaattgaatgtcaaccttggatgatcaaaccgaataccgatgagttggttgaaagttatcaacgtccagcaacaagctatgctgaacaaagagaactttttgatagcttaaccaatattgagcatgtggttatctcaatgggtgaagatggcgtaaattggttacacgccactcaccccttacatgctcaagcaccaaaagttatcgtaaaaagtacagtaggagctggtgattcactcttagccggcatgatccatgggcttgttaaccaactgcctcctgaagagaccttaaaaactgcgacagccattgcaagccatgctgtaacacaaattggttttcgaatccctacttctgaggttctaaaccaattaaaagcacaaactattatcaattcattgagtgaatctgatgcaaactgctaa

SEQ ID NO: 3333 - DNA, 1110 bp, Acinetobacter baumannii
atgaatattattagccaaagtgtgcaaaaaggaagaggcaaacttaaggtgatggtcaaggacacaattgatattcaaggtctaaaaaccattgctggcagtagagctttattagaagtcgaacccgcacatgatgatgctgaggtagttaaaaacatcttaaaagctgattgcgaaattattggcaagacaaatttgcacgaattggcttttggaattacaggcattaaccacgcttttggtacacctattaaccctaaatatcctgaacttattccgggcggctcttcaagtggttcagccgcagcagttgcagctaaacaagctgactttactttagggacagacaccggtggctctatccgtatgcccgctgcatgctgtggagtttatggtttaaaaccgactttcggtcgggtaagtcgcgaaggcgtatacccgccgtcaagttctttagattgcgttggtccttttgcaaattcagtcgaaatgattgaaaaagccatgcaaattattgatccaacttttaagccggctgaatgcactcttacaccaaaacttgcagtgctcgatgtcaaagcagatgaggttgtttggaactgtatatatcaaacacttcaaaaagcaaatttagagaccgttttagaaaaagttgaacattttgaagcggcttatgatgcaggcatgcagattattaattatgaaaattggcaagcttttggtgaattaactcaaacgggcttaattggttctgatgtaaatggtcgtttattaaaagctgccgcaacaactttagagcaagtgaaacaagcagaagttgtgagagcacagctgacccaagaactcgatgctttattagaaaaatatgatgcattggttctaccgacacttccacaaattccaccaaaagtttctgaagctgaaaacacggtcgcttttttgaacctaaccggtttagttcgaccatttaatttatcaggacatccagctatttcagtgccacttgaaaccagtgaaggtttgcctgtgggcttacagatcgtatcaaagcatcaaaaagatgagcaattatgtgcaatagctaaattttgtgttgatgcaatgcaataa

SEQ ID NO: 3334 - DNA, 615 bp, Acinetobacter baumannii
ctcgtaattatgactgtgaatcgccgacgtcctaaacatgacccgaaagaatctgaaagggaaattttaaatgctgcagaaaaatttttaagtgaacgaccatttcgtgaactaaatgtagatgaagtgatgaagcttactggacttaagcgtccagctttttatgtacattttcgtgataaatatgacttagctttacgtgttgttcaggacattggtcaggaattatttacattagccaatcattggttaaagggaaataattttccggaagattctcttcaggcattacaaggaatagtcaatgtttatcagaagcatggtgctgttttacgagctttatcagatgcagcaggagcggatgagcgggttgagcaaatttatcgttctttaatacaagattttattacagctacagcacgccatatatgtgaagaacaggaaaatgggcgtattagcttagaactgaatgtagatgaaactgctcgtgcattagtatggttagaagaacgctatttatcagaagcatttggccgtacacctcaagctgatcctatagttgttgtacaggtcttgcataatatttggatttctacactttatcgtactaattaa

SEQ ID NO: 3335 - DNA, 534 bp, Acinetobacter baumannii
agtgcgattatgacaacccttgaacaatcattatctgaaatcactgcattttcgatcattcatgaacatttatttagttcagcgcaaccttctatcgaacaacttaagctcattaaagagtatggttgtagcactgttataaatttagctttatcgaattcaccagatagtattaaaaatgaagatcaggtctgtcttgaatatggtttaaattatattcatattccaattgactgggaaacaccctcttctgaccaatgcttattagttttagatttgattgatcatttagtgcagaatgaaattgtttggatacattgtgccaaaaataaacgcgtaagttgtcttatgtatgtctacagacaattttatatgaatatggatatgccaacctgtcaggatttgcttcatgaaatttgggagccaaatgaaacatggacaggactcattcatagtattaccttacagcttcaaggccgtaaggctaccttagaacttcaacaatctttgcaacaaaccaatgatttagtttaa

SEQ ID NO: 3336 - DNA, 1449 bp, Acinetobacter baumannii
aaaactgttatgtataaacaaacagtacagttagagataattagtgtgaaccagaccaaaacaaaaatcgagtttgttatttcacagattgaacaacaaattaagaatcgttctttaactccaggaactcgacttccctctgtacgtaaattagccaaagatttaggtttttctgtttctactattgtcgaagcttatgagcgattaattgccctaggtaaaattgaatcacgtagtggttccggcttttatgtagtagcaccccttgcacctttagccttaagtgaattaggacccaaattagatcgctctatagatccgttatggatttcatgtcagtctttagaagcagaacctaatgcgtttaaacccggttgtggttggttaccaaatgattggatgccacttgaaagtatccgcaaagcattaaggtcggccacacgtagcgaagacgatagtttattgggttattcttcaccgttggggctgcccgcattaagagatctactggctagatgggcacaaagtaaaggtatagaggcaaaccttaatcaagttcttctaaccgattcaggcactcaagctattgatctggtttgtcgttttttacttaaaccagatgatgtagttctaattgatgacccttgctactttaactttcatgctctacttaaagttcatcaagttaaagttgttggtattccctacactccaaatggcccggacttagaggcatttaaagaagctatcgagagctataaccctcggctttatattacaaattccggaatacacaacccaactggtgcaacactctcactctcgacagctcatcaattattaaagttgattgatcagtctaatttaattgtgattgaagacgatatcttctcagattttgaatatactcccgctccacgacttgcagccctagacaacctttcacgcgtgatttttattggaagtttctctaaaacgctctctgcttctattcgctgcggctatattattgcgaaaccagaatggattgatcaaattaccgatttaaaaatagccaccagcttttctcacaatggactctcagccaagattttacacacagctttaaccaatggttcatatcgtaagcatctagatttattaaaagttcgtttagctcaagccatgcaagaaacaatctcgaagcttaaatcgattgggatagaaccgtggattgagcccaaggccggaatttttgtgtggtgtcgtctaccggaaggtgtagatgcagcgaagattgcccagttttgtctgaatcggcaagtgatactcgccccgggtaatgcctttagccaagcacaatcggcaggtcaatttatccgttttaatattacacaatcaaatcatgattatatttataagactcttgcagaagcgcttctacaagagtcgttagagaaacaagtttaa

SEQ ID NO: 3337 - DNA, 1200 bp, Acinetobacter baumannii
aatgcatctataataattttcaaaaataaggaaataatgtatatgagccattttcaatttcagaccgttcccaacattatttcaggactcggttctatacaagaattacagaatgtgttggcatcaaaaacttaccgcaagttattattggtaactgatgcgggtatgattaaaaatcagttacacctgcctattcttcaaattttagatactcttaaaattgaacatgtcatttatgctgatgttcaggccgacccaccagagcaagtggtattagatgcagcaaattatgctaaacagcaaaatgtagatgttattgtcggctttgggggcggaagttctttagatgtagccaaagtgattgccttactcgcacatcccaaccaaactcaaaacctacaagaaatgtatggggtaaatcaggtcaaaacagcccgacttccacttattttgattcccactacagctggtactggctcggaagtgacgcccatatccatagtgactacaggtgaaacgacaaaaatgggaattgtctctccggtactctatgccgatacagcaattcttgatgcaacttttactcaaaatctccctgcccatattacggctgccacaggtattgatgcgatggtccatgccattgaggcatatacctctaaacataagaaaaatatttataccgatattttagcgaaacacgctttgaagctgctgaaccataacttaccgaaagttcttaaaaacggtaatgatttagaggcacgtcagaacatgctgttcggctcaatgcttgcaggtcaggcatttgcaaactcacctgttgctgccgtgcatgctttagcctatccattgggtgggcattttcacttgtcgcatggacataccaatgctttggtgctcgttgaagtactgaaatttaatgcgccttatgccaaacaatactatgcagaacttatgcaatggcttgatccatatagtaatggcagcaccgatgggttgtgtgatctgtttattgaccatatgcaaaatcacttagaccgtagtggtttgactttaaaacttagtgatttaggtattgaagagtctagcttaccaagacttgctcaagatgccatgttgcaaactcgattactacaaaataatccacgtgacatgacagaagcagctgctttagcaatttatcaggcgatttattaa

SEQ ID NO: 3338 - DNA, 1341 bp, Acinetobacter baumannii
aatatgtctatatatcccaagcctcataaaacgttaaatttaagccctccttcacttttagcgctagggtttttaggctttattacttttggcactttattactcaaattgccatttgcgaatacaggcaatgtcagttggatggatgcgctttttacagccacctcagcagttaccattaccggtctatctgttttaaatattcatgaatctttcaccctctttgggcaaactattattttattactgatccagtctggcggtttgggttttatgacttttgcgatattggccgcattaagtttgtcaccaaaagttggtcttaaacagcaaatgatggctcaagatagtctcgggcaaacaagcctatcaaaagttacttttgttgctaaaggagttgtcacttacacccttatttttgagctgattggtacagttattcttaccgccgcttttgcaccaacatatgggtttgcacgcggtttatattatgcagctttttacagtatttcctcatttaacaatgctggtttttcattgttttcaaatagcttaatgaattttcaaagcagctatattatttgtataaccattagcatcctttacaccttaggtggtcttggttttttagtgctcatggatattaagcaaaacaaaagatggaaaaaactaacaccaaatagcaagcttattctgacaaccattgcaattattaacctagttgcctttattttaatatgggctttagaagctcaaaatcccgcgactttagggattttaaactcaggtaaacaagcattaaacgcttggtttcaggcaacagtccctcgttcctcaggttttaataccattgatacaggtgcaatgaccaacagtagctcactactaatgatgttattgatgtttattggtggtggctcactgagtacagcgggtggaatcaaagttggaacctttgtcattttagtacttagtgtaatttcatttttacgccgtacagatgaaattagaatatttaaccactctgtctctcacgaaactacttataaagccttagctgtcaccgcaattaccagtattctcatatttatcgggttctttatacttttacttttagaacctaaagcagactttatgaacttattatttgaagtcgtttcagcagcctgtacggtagggctttcgcgcggtatcacgccagatttacacaatggtagtttatttattttaagcttacttatgtttgcaggtcgtttaggccccttaacactcgcctatttaattgctactcctaaaaaaagccgtctcaaacatcctcaagccaatattcaaattggttaa

SEQ ID NO: 3339 - DNA, 543 bp, Acinetobacter baumannii
gaaaacactatgaaaaaacttgctttgatcgctgctctttcggttgtagggattgcgaatgctcaagctgctgatggtacaattacaattaatggtttagttacagacaaaacttgtgacatcgttactcctgctggtaaagatttcacagtgactcttcctactgtttctaaacaaactttagctgttgctggggatgttgctggccgtactcctttccaaatcaacttagctaactgttcacaaggtaaagtagctacttactttgaaccaggtgcaactgttgacttcaatactggtcgtttacttaaccaagacgctactggtgctaaaaacgttaacgttcaacttttaggtagcaacaataacttcatcccagtacttgctgctggtgcaaacggtgctcaagctaactctcaatgggttgacgtagctgaaggtgcaagtgctgaccttaactactatgctgaatactatgcaactggtgcttctactgctggtaaagtaactacttctgttcaatacacaattatctatcaataa

SEQ ID NO: 3340 - DNA, 1452 bp, Acinetobacter baumannii
ggtggaactatgaataaacatttattagcaaaaatcactcttttaggtgctgcacaactatttacgtttcatacggcatttgcagatatacctctgacacctgctcaattcgcaaaagcgaaaacagaaaattttgataaaaaagtgattctgtcgaacttaaataaaccacatgctttgttatgggggccagataatcaaatttggttaaccgaacgtgcaactggcaaaattttaagagtaaatcctgaatctggtagcgcaaaaacagtatttcaggttcctgaaattgtgagtgatgctgatgggcaaaatggtttgttaggctttgcttttcatcctgactttaaacataacccttatatctatatttcaggcacttttaaaaatccaaaatctacagataaagagttacctaatcagacgattattcgtagatatacctataacaaaactacagatacatttgaaaagcctattgatttgattgcaggtttaccgtcatcaaaagaccatcagtctggtcgtcttgtcattggtccagaccaaaaaatctactatacgattggtgaccaaggtcgtaatcagttagcttatctgttcttaccgaatcaggcacagcatactccgactcagcaagagctcaatagtaaagactaccatacatatatgggtaaagtattacgcttaaatctggacggaagtattcctaaagacaacccaagctttaacggagtagtgagtcatatctacactttagggcaccgtaatccacaaggtttagcatttgctccaaatggaaagcttttacaatctgagcaagggccaaattctgatgatgaaattaaccttgtattaaaaggtggtaactatggctggccaaatgtagttggttataaagatgacagtggttatgcctatgcaaactattcggcagcaaccaataaatcacaaattaaagatttagctcaaaacgggataaaagtagcaacaggtgttcctgtgactaaagagtctgaatggactggtaaaaactttgtgccacctttgaaaactttatatacggtacaagatacctataactataatgaccctacttgtggtgagatggcatatatttgctggccaacggttgctccgtcatcggcatatgtatatacgggaggcaaaaaagcgattccagggtgggaaaatacattattggtcccatctttaaaacgtggggtgattttccgtattaaattggacccgacatatagcacgactttggatgatgctatcccaatgtttaaaagtaataaccgttatcgtgatgtcatcgctagtccagaaggtaataccttatatgtgctgactgatacagcgggaaatgtacaaaaagatgatggttcagtcactcatactttagagaatcccggttctctcattaaatttacatataacggtaagtaa

SEQ ID NO: 3341 - DNA, 2112 bp, Acinetobacter baumannii
cgaacttatatgaagcgttcagttttatttatttcatcagttggggttatgacaagccatgtatatgctctagaagcagatcaacaggcagtaaccaaccttccaacaatttcagtcaaagctgataaggaaagcagtttaaaacaagaagtggggcaagcatcaagtgcaactaaaggacttatgcaattaaaagatgtccctcaaattgtaaacgttgtacccaaacaagttttaagagaacagacagttacctctatgcaaggtgccttgcaaaacgttgcaggtttaagctttagtgtaggagatggacaacgtgatcaggtcatgattcgtggtttctctgcaatcaccgataactatgtagatggtattcgcgatgacgcattgtattttcgcgatatgtcgaatgtagagcggatcgaagttttaaaaggacctgcttcggtattatatggacgtggttcagcaggtggtttagttaacaagattaataaaaaaccaatcgatcaatctttgcgtgaagtgagcctgattggtagtacaacaggacaacgccgcgcagaagtcgatgtaaatgaaaaagtcgcagagaatgttaaggttcgtttaactggtgcagttgaagattcagatggttaccgtgatcaggcttttttaaaacgtcaagcggttgctccatctgtacagtgggatattactgataagaccaaacttttacttcaggctgactatttgcatgataaccgtttggcagatcaaggtttcccgacagacccgattacaggtaaacctgttaaaacaaatcctaaaactttttatggcgctttaaatggtaaagaggctggggatgttgatactgaaatctcaagccaaactatcagcttagaccatgagtttaatgataattttaaatatcatggcgcagttcgccactataactactcacttgatcgtcaatatagtgtagattcacatccagctgctgataagtcaaaaattactttaacccagaataaacgcttacgtaatgaagatggtgtgtatgttcaacaagagttgagcgctttatttaatacagggtttttaaagcacaataccttaattggtgctgaatatagcaagcagcataaagatgagatactttggcaaggtgctaaaacaaccactgatttatataaccctaaattagagtattgggcacctattaatacagggacaacagttgcaagtaataataatagcaatacctttgaaaattatggcttatatgtacaggacttaatgacagttacagatcagcttaaagttttagtgggtttacgttatgacaatttgtcgcaagatcgtgacgataaaacgagtaagaatctggatttaaatcgtactgataatacttattcaccacgaataggggtagtttatcagccagtaaataatatctcactttatacttcttataaccgctccttccaacctttggcagattcatttgttttttatcaaaacagtgatgatttaaggccaacaaaaactgagaatattgaggtcggtgcgaagtgggatgtaaatgatcagttgaatgtaaccttggctttatttgaaatgagccaaactaatattcaaaataaagacccgaatgatcctaatggttcaaatgcaattttagcaggtgagcaaaaaaccaaaggtgttgagctttcattaacaggtcagttgaccgatcaattgtcagtattggctggttattcgtatatggatggtaagattgaaaaatcgactatcggatttacaggcaatcattctgcgctcacgccaaacaatactgctaacttatggttaaaatatcaaattaatgatcattggtatgcagctgtgggtggtcgtggtgaatcatcacgttttagtgcgccagacaacaaaaacgttttaccgggatatgcagttgtaaatgtggcgttaggttatcaaagtgaacgctatgatgtgaacttaaacttaaataacttgtttgatcgcgattactttgtgtcaggtcatagtggagcaaatgattcgaatatgatgggcgatcctttaaatgctcaagttgcacttcgctatcgtttttaa

SEQ ID NO: 3342 - DNA, 549 bp, Acinetobacter baumannii
atggcttatatcactagtagcgtcgagtatgcgattcactgtcttctttttcttgtgaacaatgaagataaacctttgagtagtaaggatcttgctgaattacaaggagtctctccgagttttatggccaagatttttcctaaacttgaaaaggcaggacttgtggttgcacaagaaggtgtgcgcggcggctatttactggctcgatctgctcacgaaatcagctttttagatatcgtgaatgcaatcgaaggtgaaaaaccgctttttgagtgtcaagaagttcgcggtaaatgtgcagtctttaacaatgccccaccagattgggcaaccagtggtgtgtgtgccgtacatgctgtcatgctacaagccgaaaaagccatgcgagacgctttaggtgcccatacacttggcgatattgcagaccgttttggccgttatgcacccgacgtgttttttagtgatgtaaatggctggatcaacgagcgcattgaaggaagaacagcaaaaatgcgtaaaagtaaaatatcgcgggatactcccgactaa

SEQ ID NO: 3343 - DNA, 825 bp, Acinetobacter baumannii
aaaagccatatttttatttgtttcagccaaaaatacatgcgtaatattccaattaacgatgtagaccatctaccacaggcagttctagcgttagggtcagattatcctgctgataccttgttagatacgcatagccatcgccgtgcacagttcttatatgcacccgaaggcctcatgaaagttgaaactgaagatggacaatggctcgtattaccgtacagcggtgtatggataccggcaggcaaaccacatcaggtatggttatctaaagtcagtacttatagtttgtatatagaagtgagtaatgccccaagacaagcaaactattgcgaggttatacaagtctcgcctttgttacatcaattgctcattcaggcaaatcagctacctgttgactaccaacgtgcaggccgtgacggcgctcttatcgatttattgttatatgaattagaagctgcaccagccctgcctctgtttattccattgcctcacaacacattactatctcaacaatgtgctgagtttatggagcgtcccgatattcatagcagccctaaagattgggcacatgaccacaataaaagtgaacggacttttcaccgctggtttaagtctgaaactggcttgtcctttcaagcttggcgtaatcgagtctgcattatttatgctttaaatgccttaaaagaaaatatctcgattacggaaattgcttttagtttgggctatgaacactcggcagcttttaccgcaatgttcagcaaaattatgggttatccacctacccattttcaaaaaagatttcatgcgtatgataagacgctataa

SEQ ID NO: 3344 - DNA, 1518 bp, Acinetobacter baumannii
tttgaacatatgtccaagttttggatattgaagagcgttatgcaaaaaaaatggttaatcctgacaattatcgtcctcatttatttacctgttacgattgatgcaacggtgatgcatgttgcaacaccgtctttaagtgcagcattaaatttaactgccaatcagcttttatggattattgatatttattcgctgattatggcgggtttgattttgccgatgggtgcactcggtgatcgtatcggctttaaaaaattattatttattggaaccgcagtttttggtgtgggttcgttagctgcggctttttctccaactgcctatgccttaattgcttctcgtgctgtcttaggtctaggggcagctatgcttattcctgccactttatccggtatccgtaatgcctttaccgaagaaaagcagagaaattttgcacttggtctttggtctacagtagggggaggcggagcagcttttggcccattagtcggtggttttgtattagagcatttccactggggagctgtattcctcattaacatcccgattattttggtggttctagttatgatcgtgatgatcattcctaaacaacaagagaaaactgatcagccaattaacttagggcaagctttagtgttggttgtagcaattttaagcctcatctattcaatcaaatcggctatgtataatttttcggtgctcacggttgtgatgtttgtggtgggtataagcacattaattcacttcattcgaagccaaaaaagagctacgacaccaatgattgatctggaattatttaaacatccagtgatttctaccagtattgttatggcagttgtgtccatgattgctttggttggctttgaattacttttgtctcaagagttgcagtttgtacacgggttttctccattacaggcggcgatgtttattattccatttatgattgcaattagtttaggtggtccattagcaggtatttgtttaaataaatggggtttacgtagagtatcgagcctaggtattttagtgagcgcgctcagtttatgggggcttgctcagcttaatttttcaaccgaccactttttagcatggacatgtatggtctttttgggctttagcattgaaattgccttactggcctcaactgctgccattatgtcatctgtgccccctcaaaaggcgagtgcagcaggtgccattgagggaatggcctatgaacttggcgctggcttaggtgttgctatttttggtttaatgttgtcttggttttatagccgctcaattattttgccagccgagcttccgtcagacttaattgaaaaagcgagtatctcgattggagaaaccatgcaattagcctctaatcttgaaaatcctttaggagggcaattagttgtagtggcgcagcaagcttttagttatgcacatagttgggtgcttaccctctcagcgatctgtttcttccttttaactgtatttgtctggtttagttttccgaagaaagtaaattaa

SEQ ID NO: 3345 - DNA, 1374 bp, Acinetobacter baumannii
atgaataatattccacatgcaaataagtcattctggctagcccactcaggcgaatatattccatcaccaccacttagaggtagcattgatgtagatgtggtgattattggaggagggtttactggattatctactgcctatcatataagaaaagctgattctgctgcatcagtggctgttcttgaaggtgaatgtgtggcatttggtgcttcaggccgtacctctggctgggttgtgccagttccagtacttgaccccaccacggctaaagtactttatggaaaagaaagattaactgaacttcaaaatttcgcatggaatggtctggactatgtgcaggacttaatcaaacgcgaaaatatggatagcgattttgaaatgcctggtgtgacatttactacacttcgcggccatgaaaaaagattagagcactttactcaatattggcaagatcaacctcgctctaaagacagcgtctatatggacagagctacggtaagtcaagccctaaatagtgatgcattttctggtggatgccgaatgccacattctgggcaagtcaatcctgtaaagcattctcgagaactaaagcgaattgcagaacaggctggtgcacaaatttttgagcaaacgccagtattggatatagaagataaggaaacgttctttattctcaaaactccagaaggagaggtgagagctaaacatattgtattaggtaccaatggttttactcatttattgccaccagaattaggacttaaacgtgcacaactccccatgtttgtatatcagttaattaccgaacctttaactgatgaagattggaaagcgcttggatggaaacatcgtggtcagttttatgacaaaacaacctattgtcctccaacctgtagaacgactgtagatggaagattgcaatttaacctatgtgatatctatgtaggagaagggcgttctatggatgaagcacagaaagtgcaattttatgatgccgctgagcgaatgtataaaaaggtatttcctgcatttcagaaattaaaaattgctcaacgttggagtggtgcttgttctattccttttgacgtaaggtctcaagtgggcacacttcataatggtcgtatttcttatgcctatggatacagcggcgcaggcgtcatgatgtcacaaaattatggccgaattttagctgatctcgcattgcaacgtaaaacggagcttaccgagcattggtttgttgccaatggagaaaaaggacacgctaaatttaaacgtttcccattaattccgggtctcatcgctgcactacgtacttattttgaatacgaacgagtatcagcactttctaggagaagacgccttggactcgattaa

SEQ ID NO: 3346 - DNA, 1389 bp, Acinetobacter baumannii
ctcagcaatatatatcaagtattggaggctgaaatgaatgcactgtttatgattgcagcagcagctcttttacttgggcctctaattgcaatccatgagtttggccattactgggttgcgcgaaaacttggtgttaaagttttagtttactcaattgggtttggaccaactttactgaaatggacgtctaagaagtctggtattaaatatcagctttctgccttacctttaggtggctatgtcaaaatgttggacgagcgagaaggtaatgtggcagaacaagatctaccatatgcttttaaccgtcaaaaaccgtggaaacgtatagcgattgttgctgctggaccattaattaacttgatttttgccgtactcctcttttggattttgtttttaccagcccaagaacaattaaatactaaaattggcaaaattattccaaactctccagctgcagcagcccagttacatgtaggtgacaaaattattgctgttgatgggaaagagacaacaacatgggaaaagctaaactttgctttgatcgatcgagttggggaaacaggtactgtaaatattgatgtggaccgtgctggttccgaaaaaaattttgtattaccaattaaagattttttaaaaaatcaaaatgaatctgcactggacgtattaggtttcttgccttatcgacctgtgattcctgctgttgtaacagagttaacggaagatggtgcggcaattcgtcaagggatgaaagtgggcgatcgtattgttgcgattgatggccagcctatgaaagattggttcgacgtggtagaagttgtccagcgttccccagaaaagttacttaagattgatgtcttacgtcatgaacaactagtacatttacaagttatgccacaaggtaagcgtgatagcatggggcaggtaaatggagtacttggtgtaaaaagtgatgctggaaaaattacaattcctgacgaatataagcaaacaattcaatatactccaatacaagcttttgaaatggcacttgataaaactggccaaatctctagcatgattttgaattcaatagtaaaaatggttaagggactaattggattagaaaatctttctgggccaattaccattgcaaaagtagctggccaaagtgcagaaatgggttgggaaacctttatctcttttatggctttaatgagtgtaagtcttggaattttaaacttattaccaattccaatgttagatggtggtcatctagtgtattacattattgaagctattcgtgggaagcctgtttctgaacaaatacaaatgtttggtctaaaaattggtatggtactgctcggtagtatgatgcttttagctttatttaatgactttatgcgtttgtaa

SEQ ID NO: 3347 - DNA, 1062 bp, Acinetobacter baumannii
gagaaaaatatgacaactgaagttttaggttatgccgcgctgtcatcagaaactcctttagttccgtttaaatttgaacgtagaaccccacgtgaagatgatgttgtcattcaaattgagtattgtggtgtttgtcactctgatctacatcaagctaaaaacgattggggatttagtgcttatccattagttccgggccatgaaattgttggacgtgttacctcaattggtcctaaagtcacaaagtataaagttggtgatttagtgggcattggctgtatggtcgattcgtgccgtacttgttctgcttgtcattcaggactcgagcaatattgtgaagaaggtaacatccagacttatggcggcgtagatcgccatgaccaacgcccaacttatggtggatattcacaaagcattacctgtagtcaagattttgtattaaaagtacctgaaaatctggatgctcaagctgtaccaccactactttgtgcgggtattaccacatggtcaccgctacgtcactggaatgttggaaagggcagtaaagttgctgtctttggtttaggtggtttaggacatatggcaattaaacttgccaatgctctaggcgctgaagtgacactatttactcgctcagcaaacaaagaacaagatgcaaaacaacttggcgcacatcatgtagtgttatcaacagatgagaatcaaatgaagtcggtattaaatcaatttgatttaattgttgatactgtgccttataaccatgatttgaagccttatattccaactttagctttaaatggaaccattgtattagttggatatttaggtgaaattagcgcaaattcagtacctatgattttaggtagaaaatcaattgcaggctcggttattggtggaattaaagaaacacaagaactactcgatttttgtggtgagcataatatcgtttctgaagtagagatgattaatatgcaaaacattaatgaagcttttgaacgtatgctaaagagcgatgtgaagtatcgttttgtgattgatatgaaaactctatctgaagattaa

SEQ ID NO: 3348 - DNA, 897 bp, Acinetobacter baumannii
cagatgaatattaatcaagaacaacttctcatgttccaagccgttatggaaacaggttcattttcagcagcagcaaggaaactcggtaaagtcccctctgctgtgagtatgtcgattgctaatttagaaattgatctgaatctgactttatttgaacgtaaaggccgcgaacctactcctacagccgaagcacgagtgctatatgaaaaaacggcgcaactattgattgaaatgaatcaatggaaacagcacgcgcatgcattaagtactgggctggaacctaatcttactattgttgtggtgtctgagctgctacataccaattggaccgactatgtttgcctgctagaaagtcgctttcccgatctacaaattaatattgtgtctgcccctcaagaagatgcgcttcaaatgttgttagatggatctgcccaactggcccttatgtttgaacgtgagcatttagacaatagagaacagtttgttgaactcaaacgtgaagccttaattcctgttatttcaaaaacccatccgctcgcaagccaagagcatgtctcatatgagcagattttgggtacaagacaaattgtggtggcaagtcgagatgaaacattaaaacccgaattattattttcaaaacattactggcgtacagacaaccaccactctgcttgcttaatgattttacgtaatttaggttggggtgtactgccacaagagatgtttaaagaaaatcccgagttaaacaacaagcttaaagcattagatgtatttgattttacgcctcgatttgaatattacgttgatttggtctggagccgcgaaagtgaactcggagctgctgcacggtttttgattgactatattcgtaataagcgaatgcaaccagctccgtaa

SEQ ID NO: 3349 - DNA, 1581 bp, Acinetobacter baumannii
aagatgaatatacgaccactcatcggtttggcaggtgcaatttttgcagccatgactgtcgaatttaataaccgaattagcagcattaccttggtcgatattcgcggtgagatgggtattagtgtcgactctggttattgggtcagcagtatttatgccagtgccatgattattgggatgatactgtccaccagttgggccgttattttttccatgcgtcgggttcttctttttgcgataggactttgcctcttctctagcgtattaattccttttagtcccaatatcgaaatattttatttattacggggcttacaaggactcgccaatggcttaaccattcctttattaatggcatgtgcacttagattcctaggacctgaaattcgtctatggggcttggcctgctatgcattaacagcaacttttttcccaaacttaagcgctgcgcttgctgccttttatttagatgtgattggttggaagatgatatttttccaaaccattcctttttgtgctttaagtgctgcgttagtttacttcggtattccgcaagatccgttaaattactcaagaataaaaacttacgattggactggcgcgattctagccattattggtttggcaagccttagtaccatgcttttgcatggcaatcatttggactggttccactcaaaattgatttgtgttttggctttaatgagtgccattaccctacctttatttttaatacatgaatggcgctatccaacaccattaattaaaccgcaaatgctcgaaatacgaaattttggttatgctgttattgcgttgttctgctttgtggttattggtatgtcaaccagtacattaccccttaattacttaagcgctgtgcatggttataagcctactcaaaccatgtggattggcttacaaattgccgcattacaatttatctatatcccgattgttattaaagttttgaaccaagcttgggttgatagccgatatgtacatgggtttggtttacttttggttatggttggctgcttaggtgcaagtcaacttgatacgacttggaaccaagaccaattctatttttggcatgcaatctcatgtttaggacaaacctgtgtagtgctttcgctcctcatgatgggtacaaatagtgtccacccaactatggcaatctatgcttcacctatgattaacaccccgcgtgctattagcggcgtacttggtgtgtgccttttggactgggtcaatcgagtacgtggtgaataccattcaacacggctgattgaaaataccgcacaacatgtttttcaaaatattcaaggtcctgttattaatcctcttaccccgcctgtgctgagtgcagatggtaccgaacgtgtttccggtggtttatctgccttaaattctgcgattcaggcacagcaatcagtgttagtcattagtgatcaatatctgattttagcgggacttactgcaattttatttatcgttatgctgattttgccagttagaacttatccaccacgcattgctctcattaagttaatgaatagtcataactcaggaaaatctttatga

SEQ ID NO: 3350 - DNA, 375 bp, Acinetobacter baumannii
aaaaggaatattgagatggaagctaaaaaaccattacgcgtgttgttttgcatgggtattaaccagaacttttttgatgcagaacctgctgaagcaaaagcggtttgggcagcatttggtgaaatgtggaatggcattcatgacctacctggtgtgcatgtttttgggaatcttgatgatgaccaaagcatggtgggtggaagtacgggctggccttggaccacttatttgcttgcagatgttccggatattgagacagtacatgcagcttgtaacttgtttagaacgaccgtggtgggtgaagggccatacaaactttggaaatattgcaaagttgaaactcgtgttgggcgtgaattgattattcaacgttag

SEQ ID NO: 3351 - DNA, 558 bp, Acinetobacter baumannii
agtcctgatataacttgcttagtgaaactatatttttccactattaaaataagtttcataaaatgcgatccaccaaggtatggggaaaagtcaatgacaaagaagtatgcgcgttttttacctacaacagaatctttcactcttgaagattttccatattattggattactcaggtccatgctcaatatgttcaaaatattgataatgccctcaaaaaatatggcctagataattcacgtcgtcgtattatgcttgcgctaagtagtaaacctcacgctagcgtatcagagctatctgatatgattatttcaaaaatgtcgactaccactaaaattgtttatcgcttaaaagatgaaggcttagttgaaacctattcttgtcaatcagatggccgtattacacgtgtatatcttaccgaacgtggtacagaaatgattaataaaattaatgatctaacgagtgtagtacttgaacaatcattcgaaggtatcacccctcttcaactagaaaaaatgatggaaagcttaaaattgcttttaaaaaatctttctcgataa

SEQ ID NO: 3352 - DNA, 1104 bp, Acinetobacter baumannii
ttattggatatgggcatatctgtttttaataaaattaaagatttcggttcggagctgttcgatttagtgttgggcgctgagcatccaaaagtctattatcatcctcaaggaaaaataaaagatattttggataagttgccacaacttaaacagaaatatcgtcctacgccttggcttacaaatagtcatgttcacttactttattttgatcttattagaaaacaaacaataaagttggcatatgatcgaattgatcaactcactatgagtgatggtggtattaccgcaattgcttggtatggctataacttaccgccagatacaccaacagttgtaattatgcataccattacaggtacacctgagagtatgcgtgaattggtacgtgatttaaatcaatacacaggctggcgaattgcattatgcctgcgccgtggtcacgcaggtttgccaatgcctgtgccgcaaatttctctttttggttctacgagtgatttaaaggaacaacttaaccatattcaaagtttatttccggcatcggatttatatgcggtaggttcttcggccggtacggggctgctagttcgttatttgggtgaacaaggcgaagatacaccttttaaagctgcttttgcaatgtgtccgggctataacacagaaattggttttaaaaatgtccatcctttttacagtaaaatgatgactaagaagctcttcaagtattttatttatccgtaccaaaatacatggagtcagattgcatctttagagaaagttttatcagcaaccaatttagaagaatttgaaaaagaatacttcgaaatggcgggttttgaaaattatgaaacttactgtaaatctattaacccgatttatgtgttcgaaaatattaaaattcctttaatgattttgaatgctgaagatgagggtgtccgttctattaaaaatttagagccatataaagagccaattcagcagatgagcaatgttgctgtggtgacaacgaataaaggaagtcattgtgcattttatgagggatggcgcagtacatcgtgggcagcacgtctcatggctgattattttttaattgaacataataaatag

SEQ ID NO: 3353 - DNA, 336 bp, Acinetobacter baumannii
aagttttgtattatccctattcaaaggatacacattaaaatgagtgctgtttatttagtagtgggacttcgagcaaaaccagaaaagattgatcaggtcagaagtgatcttattgaagtggtagctccatcccgcaaagaaagcggctgtatcacttatgaattattccaagatcaaaatgatcctagtctatttatattttatgaacattgggctagtgaaaaagatcaggaacatcatcataattttggaccacatatccaaaactttcaaaaagaaggcatgggtaacgttgaaaaaatagaattttttcatcggcttcaagcgttggcttaa

SEQ ID NO: 3354 - DNA, 528 bp, Acinetobacter baumannii
tggagttgtattgtgcaaaatattaaaatgaaagatgactcatgtcatttttttactgaacaagatattacaagtaagcaagttattaaagtttgctttgacatatctgattttgaagaaattcaacaagtttatgatttttttggcaagaaaatatatggaaataatcgagagcatttaaatgacattcatccaaatacaaaacattttggaagtaatttgtctgcatttcatgactatttaagaggatatctgattggtattttttcagaaaaaagaaatgaaattttatcaataactataaccaataacagcaataaaaatgttgatgatgattggttggatttctttagtataattatgcaaacattttttgatgcacataaaaagataaaatatggaatttatatggacttgaatttttcaagaagcattatggctaatatgatggattattttagttttttaatttctgattatcataataggccaaaagacgagctggatgagaatggtaattatgtgtga

SEQ ID NO: 3355 - DNA, 1350 bp, Acinetobacter baumannii
ggagtatgtatgaaaaatgatatatctatatcggaagtagaaaagtcaacgatccgtaaactttcttttcgtattcttcctttcctcattctttgttatttcattgcatatattgatcgggtgaatattggtttcgccgctttaaccatgaaccaagaaattggtttaactgctactgcctttggtttcggtgcgacattattctttattgcttatgtgatatttgaaattccaagtaacatggctatggaaaagctaggtgcacgtatctggattgccagaatcatgattacttggggaattgtcggttgctgtaccgccttcattaccggcccaatttcatatgcaatttcacggtttttacttggagctgccgaagccggatttttcccaggtgtattactgtatttaacactatggttccctaaacgatacatggctcgaattgttgctgtatttatggttgcgattcctttatctaactttatcggttcaccattatctgccttactgttaggcttgcatggtttactgggtttaagtggatggcaagtgcttttaattcttgaagcattacctgcaatccttcttggtgtgttgtgccttgtatggctgccgaataccgcaaataatgttaaatggttaaatcaagaagaaaaggactggttaacaagcactttaacttttgaaaaaaatcaattgttgaactctgaaaaacaagacagtgccgaacagaaaaagagtaagttcaagttgctgattaccaataaatatctatggttctttgcaattatttatgcaggaagttcagcaaccagcaatattttatcgttatggatgcctcagattttaaaagccttccatttaactgccatgcagacaggtcttttaaatatgattccgtttggtttagctgccgctttcatgattgtttggggcgtacatgccgataaaagtggcaataagagtctcaacacagctattccgttatttgtgaccagttttggtttgcttcttactatttttacttcatctttaaccttgagcttacttttattctcactcgttttgatgggtaactatgccattaaaggtcctttctgggcattggtgtctgagcgcttaccacctactttagtggctgtaggtattgcagcggtgaatacgattgcgcatatcggtactgggcttatgaactctattatgggcattgtaaaagattattcgggtagcttccctatttctcttttaccgttatgtatgcttacatttacgggtgccatgattgcattgtatttaggaagaaaaccgacattgccaaaagtgcaaaaggttcaaaaagcagtttag

SEQ ID NO: 3356 - DNA, 891 bp, Acinetobacter baumannii
attcttcgtatagttgcggagaataatatgcaaaagtttatgaacggttgggtgaatggttttattggggttgcaatttttgctggttcattaccggctacccgtgttgcggtaacaggttttgagcctggttttctaacagcagcaagagctgtcattgcaggagttttgggtttaattcttatctttttgcttaaggaaaaaaagcctgctaaacaagattggtggccactcgctattgtggctttaggcgttgtagttgggtttcccttatttactgcgcttgctctacagtatatgaacgcagcccactcgattgtctttgttagtcttctgccattagctacagccatatttgcagtagtgagaggtggagaaaaaccaaatttatttttttggatatttgcaattttaggcagtctggttgtttttacctatatgtttttcttatcgggtgaagcttcttttggcatcggcgatttatacatgcttattgcaattattttgtgtggatttggctatgccgaaggcggagtactttcgaaaaaaataggtggatggcaggtgatctgttgggcgcttattttagctttaccgattatgctgcttgctactcttttttatatgcccgtttcctttcaagatgtatctccatcagcggtagcagggctagtttacgtatctttatttagtatgctcatcgggttctttttttggtacaaagggcttgcacaaggtggtattgctgcaattagccagctacagcttttacagcctttaatgggacttgcgattgccgcgcttttattacatgaacacgtaagttggtcgatgttaatgataacagcagtaacaattttatgtgtcgctgccgctaaaaaattcgcataa

SEQ ID NO: 3357 - DNA, 858 bp, Acinetobacter baumannii
aagcagattttcagcaggagtacaaagatgggatatgtaaccacaaaagatggcgtagacattttctataaagactgggggccacgcgatgcccaagttttattttttcatcacggttggcctttaagttcagatgattgggatacacaattacttttctttttagagcaaggttatcgtgtagtcgctcatgacagacgcggccatgggcgttcaagtcaggtgtgggatggtcacgatatggaccattatgcagatgatgttgcagaagtggttaaacatctgaacattaaaaatgcaattcatattggacactcaaccggtggtggcgaggtagtccgctatattgcacgtcatggtcaggaaaacgttgcaaaagctgtacttgtcagtgcagtaccgccactcatggttcaaactgaaaataatcctgaaggtttaccaaaagaagtttttgatgaccttcaaaatcaagtactcacaaaccgtgcgcaatttttccgtgacctgccatctggtccattctatggttttaaccgccctgatgcgaaaccatctgaaggtatcatttcgaactggtggcgtcagggtatgacgggtagtgcaaaagcacattacgatggtattgtggcattctcacaaactgacttcaccgaagatttaaagaaaatcacggttcctgttttggtattacatggtgacgacgaccagatcgtgccgtataaaacttctggcgtaaaatctgctgaattacttcaaaatagccaactcaaaatctatccaggtttttctcacggcatgttaactgtaaaccatgaagtgattaatgctgatttattggcctttattcgtgaataa

SEQ ID NO: 3358 - DNA, 1155 bp, Acinetobacter baumannii
ttgaaaatcatacggaatagttttatgccaaaagtacacttgatggtacgttttgtacaagtagttactgtactatttgtactattaggctgtttcgtgatttttttgtattcgccgttttattcaaaacttattgtagctggacttaactattttgttccggtagatgttaatgaggtggctgcggaaagccagcgaaaagcagcattaagtgaacatgataacttagagccggggtcaaatttatggattgctcgtcaggcttatttgaagttaacagaagatgctttacgtgaaaataagactgcagatttgggttacatacaagaaaactataatgctttgcagcaaattattcttttagaagaaaaagaacaagaactacaggaagagaaagaaacgacggctgtgagtgttcctttggttgcgaaaaactcagaaattgatgcggccgatgaagcaagtagtcctatcgatgcagcactttctattaatagttctgaaaataaagcccttacagagcaatatacggagtttttagcaagaaaacctgtagtgccagagcatcaaaaagcggcgagtgagcctgagcagaaagttgaatatgttcgtaaaaaccctctgcctgctcaacctaaaaagttatcagaaccttatgcgattgtagtattgggcggtggtttaactttagataaaaatggcaaagatattgtagttaacagctatacgcggttaagactagaaaaaaccttagaagttgaaaagaaaaaccatctacctatcgtactaagtggagttgaagccccttatatgcaagcatggttgaaagcacgtggagtagatgcaaaattattagaaaagcgcagtatgaatacctgtgagaatactcgctttagttcattgttacttcaaaagaaaggtggtgcgcctacagttatgttggtcacagatgaatatcatatgccacgtacgcgccgtttatttgctttaaatgggatagaaactattcctgttactgctccaatgccaacaccgcttacacgttggcaaccgagtacacaaaactacgatcatagtcgtcgtgcaaattatgaattacttgcgacaattcgtgacatgttatttggttcaagtgattgtcgagaggtgccttaa

SEQ ID NO: 3359 - DNA, 639 bp, Acinetobacter baumannii
actgagatcatcaaaattagagtttctaccatggctgatttcttttttaattattatcttatgccatttcatttaagtgttgtggctttgatattgctcagcgtggtagaaactattggtatgtatgttggtttacggccaagccagctattaaaaaaaattgcgccagtttggcttaccaattcccctttgctcaatgttaaattttctaaagctctaatttttgtttttttactcatcaatttcagttttgccggttattttttacagctttctttctttgctatacagcattactttatcacgccgttttacttaatcatccctgcactggtcatcgcgattttctttaccgtatttatgattcactgccttgatcaagtcattaaacccaagcttacacataccaactataaccttttagggcgtctagcaactatttccagtggtagtgcaagacctggtttttcagcacaagctcgtgtacgtgatgagtttggacaactgcactatgtccaggttgaacctgagtatggtgagttagaactatattcacaagtcattcttatcaaagtgcataaaagccattatgttgccaagaaaatttctgtttcgaatgaccttttcgcgcctgattaa

SEQ ID NO: 3360 - DNA, 816 bp, Acinetobacter baumannii
ggacctgtcatgtttaaagtgtggaattttcaacgttgtttaagcattatttttgccattcttttatctacaaatgcggtttatgccgcaggttcagataaagctcaaagctctgcaaaaataaatggaaaaattttagtcgtcatgactaatcactcggcttacccttctcgttcggataaaacaggactttggttgactgaactcacccatttttatgatgttgcattagctgccggctatgaaatggactttgtaagtcctttaggtggtgaagtgcctctagatgaacgtagcttaaagtctatttacttagacaaatctgcccgtcagcatttagccgacccagcatttatgcaacggttaaaaacaacattaattccgaacgcgattaatcctacccagtacaaagccatttactatacgggtgggcacggcaccatgtgggatttcccaaataacaaagccttgcaaaacattagcgaacagatctatcgccaaggtggagtcgtttcagcagtctgtcacggcgtaggtggtttattacctttacaggatgaaaatggcaaaccgttaattgcagatagaactgtcacgggttttgcaaatatagaagaaacactttcaggtattaagtctcaagttctattttctttacaaaatggactcattgaacgtggtgcaaaatataaagaagcatttattccgtttacctcatatgtggtttcagacgacagaattattactggacaaaaccctcagtcgagtaaagaaattgccgaagcagtcgttaaacgtttaagcagcataaaataa

SEQ ID NO: 3361 - DNA, 1464 bp, Acinetobacter baumannii
gctatttccatgttaacgaatcttcgagaacaatggttctctaatgtccgtgcagatattctttctgggcttgttgttggtttggctttaattccagaggcgattgccttttcaattattgcaggtgtagatcctcaaatcggtttatatgcgtctttttgtattgcggttattatttcttttgtaggtggccgtcctgccatgatttcggcagcaacgggtgctatggctttagtcatgacgaccctagtgaaagaacatggtcttcagtatttattcgcagctactattttgacgggcgtcatacaaattatagtaggatatcttaagcttgctaagctcatgcgctttgtctctaaatcggttgtaattggttttgtaaatgctctcgccatactcatttttatggcccagcttccagaactagtcaatgtaacttggtacgtctatctattagtcgctattggtttagcaattatttatctattcccttatgtaccgaagcttggaaaaatttttccatctccccttatatgtattgttatagtcacattactcgccctctttttaggccttgatctgcgaacagttggcgatatgggggcactaccaaatactttacctatttttttaattccggatattcctcttaatttagatacacttcttatcattcttccttattcattggcattagctgcagttggcttacttgagtcaatgatgacagccacaattgttgatgaaatgacagacagcccgagtaataaatttaaggaatgtaaaggccaaggtattgccaatattgcctcgggtcttatgggagggatggctggatgtgccatgattgggcaatcaatgattaatgttaaatcaggtggtcgcacacggttatctacattatgcgcaggcatattcttgctgattttagtagtatttttaagtgattggttaaaatttatccctatggctgcgcttgttgctgtcatgattatggtatcaataagtacttttgagtggcgttcgcttacccaatttaaaactaatcctaaaagtagcaataccgttatgattgcaacggttggtgtagttgtagctactcacaatctagcattaggcgtattgacaggtgtactactctccgcgcttttcttagccaataaacttgaaaatgatatacaggtaataagttcattagaaggcaacgctcgtttatatgatttaagaggacaaatcttttttagttcttcagataaattcatgcacggctttaactttaaagaagaagtaaaagaagtcattattgatctgactcattcacatatttgggatgtcacttcggttgcaatgcttgattcagcagtagaaaagttccaaaagaatggcatacaagttactgtacgtggtttaaatgaagccagttcaatcatgattgacaagtatggtacacatgcaaaaatttaa

SEQ ID NO: 3362 - DNA, 792 bp, Acinetobacter baumannii
atgtgtgtcttgactctgatcttaaacactgagatgacgatgcaaaactcggaacagacgacttctgtagaaagttcgttgcaaaagaaaaaatttttaaacaccaataaaccattatttattggtgccgctattttaatgagtggttgttttgcgctcggctatacaattgggcaccgtcaaggtttaactgttgttggttacgatgcagatgcagagcaattggttgaggtagtgcaaaagcaaaaaacagcattagatgcagttaacaaaagtttgaatgctgctgtacaagagcgtgatgttgctgttacaaatgccaatgatttgtttgaagcacttaatcaagccaatgctgataaaacgcagcaagaaggtatgagtaacatctaccgtgaaattttaagacaacgtggtggtttaagcttaacaattcagaatttggcgattaaaccgttaccggaaaatgcttatgaatatcagcttgatctggtacaagttagcccgagtaaacgccgtgctgcaggttcagttgaaataagactgattaaagatacagaagttttagtggtaccacttgaagataagaactttaacttcactgattttgagcgtttgactggccgttggacgatgcctaagggcttcacacctcaatttattgaagtgcgtctaacaggcggttctgatacaccggttattaagcgttttagttggcagcgtggtaaacctgtcgaaacaccttctgcttttgttgcagaaattcctcaagctgaagcaaattcacaatag

SEQ ID NO: 3363 - DNA, 513 bp, Acinetobacter baumannii
cttaaacccatgcgtttaatgattaataaatctatgaaaaatatttatattatgggattattattggcttgttctggttttgctatggctgagacagcgactcaacagccaacagcacaacctgttcgcactgcaagtaatcctaatgctatacgtattgttacgcgtcctgaaattatgggattatggggaatggagattccaaataataaaaaatgtgtagagtattataatttccgcagtagtaacgatgtggtgattaaaagtggtgaagagtggtcatacggtatttatgaatatcagccatctgatgaccctaaagagcagctatcggctttagtaatgcaaattaagtttgataataataaagtagattgttctggtcagaagcaagatcagacaggtgatatttctcaatatttcgtgcaatggaaaaatgaccatactattaatttctgctcaacggctaagggtgagcaatgtttcgcaactttacgccgaatgttgccataa

SEQ ID NO: 3364 - DNA, 468 bp, Acinetobacter baumannii
gagacagccatgacaattttaatgattcttctcgctgtcattggcggtgctttgctgagtgtacaggccgcaattaatggtcaacttggagcgaaagttggtgtatttcgtagtgcttttttgactttctcggtcggtgctctaattacggctctccttattttttattttgaacctaaacaagccttaacactattagatgttcctaaatggcagttattaggcgccatgtgtggcgtaccttatattgtcattatggtactggctgtacaaagaattggggctgcagttgctactgttgctgtgatttttgggcaacttttgatgagtatcttaattgataactttggctggttcggcaatgaaacgcttcctttttcgctgtatcgattaggggcgctaatttgcttagggattgctttatattttatttattcaagcagtaaggataaaaaggtagaagggtaa

SEQ ID NO: 3365 - DNA, 1269 bp, Acinetobacter baumannii
agtaaagccatactgaatgaggtcattccaatgaaagtgttcgaaaaattagtattcccaaatggctcatatgttcctaaccgtattgctaaagcagcaatggaagaaaatatggctgatttaaaccatgcaccatcagaagaattaatgcgtttatatcaggcttgggcaaatggtggcgtaggtctaatcattaccggaaatgtaatggtagaccgccgagcgatgactggaccgggcggcgtagtgcttgaagatgaaaagcatctagatacttttaaaaaatgggcacaaattgggcgctcaaaaggcgctcagatgtggcttcaaattaaccatccgggtcgccaaatgcaagccaatcttggtcagcagacgtgggcaccatccgctatttcacttgatcttggcaaaatgtcaaatcgctttaacacgccaatcgaaatgacggaatctatgattgcagaggtgattcagcgttttgcaaacacggcgcgtttaggtgaaaaagctgggtttactggtgtagaaattcatgcagcgcatggttatttattaagccagtttctttctccactgagcaataaacgccaagatcaatggggtggttctttagaaaaccgcgctcgcattttaattgagattgtggaagcggttcgtaaagtggtttcgcctcagtttactgtggcagtgaaactaaattcagccgatttccaacgtggagggtttagcgctgaagatgctcaacaagtggttaaaatgctaaatgagcatgcagtcgatttggttgaactttcaggcggtagctatgaagcacctgcaatgcaaggtcaagcacgtgatggccgtacacttgctcgtgaagcttactttttagaatttgcgcaagagattcgtaaagttgccaaaatgcctgttatggtgacaggtggcatacgccgtaaacaagtggcagagaaagtgattgaaagtggtgtagatatggtcggtattgccacagctctagcaattgaacctaatttgccaaatgcttggaaacaagggcacaatgttacactagggttaaaaccaattacttggaaaaacaagacacttgcttcacttgccaatatggcagtggtgaaattccagttacgtaatttaagcgctggtaaaaaaacaaaaccaaatgtttcaccagcttgggctttaattttgcaacaatcagctatgtcatgccgtactcgccaatacaaaaaaggcatgcgtgactattcatttgcttcttaa

SEQ ID NO: 3366 - DNA, 2286 bp, Acinetobacter baumannii
gggggtcacatgctcagtcgtcaattagaagtatcattacgtttggctgttagcatggctcgtcaaaagagacatgagtttcttacagttgaacatttactattagccttactcgataacgattcggctgtgaatgcattaaaagcatgcggagctgatattgtttctttacgtaaagaattagaagaatatgtagaacaacatactcctaagcttggcgaaaatagcgagcaagctccacatccaacagaaagtttcgaccgtattttgcaacgtgcaattttccacgttcaatcgagtggtggtgaccgtactgttgaaggtgcggatgttttagtcgcaatgtattcagagcgtgattcttttgctgtttatctgcttaaacgtcatcaaattaatcgattgactttaactcaatacttgtctcatgggacacgtaaagacgaagttcaggttgaagaagaagttgaagacattgaaggtgaaagcaattcaggcaatgccggaccattagaactttatacgctcaatttaaatgttgaagcgcaaaaaggtaaaactgatccactcattggtcgtgagaaagaaattgagcgtacagcacaaattctttgccgtcgtcgtaaaaacaatccattgttagtaggcgacccaggtgtaggtaaaacttcaattgcagaaggccttgcttggctcattgtaaatggtaaagcaccaaaaccgctaagccatgcagaaatttacagtcttgatattggtgcattggttgcgggtacaaaatatcgtggtgactttgaaaaacgtttaaaacaattgttaaacgctttgaagaaaaatccgaatgcgattttattcattgatgaaatccatatgatcattggtgcaggctctagtatgggcagcacaatggatgcatcgaatctcatcaaaccagctttagcaaatggtactttacgctgcattggatcaaccacgttccaagaatatcgtcaggtatttgaaaaggatcatgcgttatctcgtcgtttccaaaaaattgacgtaaatgaaccgagcatttctgaaactattgatattttacgtggcttgaaaacgaagtttgaagatttccaccatgtacagtatgacgacaaagctttggtttctgcggttgagctttctgcgaaatttattaatgatcgtttcttgccagataaagcgattgatgtcattgatgaagcaggtgcacagcgccgtttaaaagcagaaagtgaagacagcttaattactgtagaaaacatcgaagatatcgtttctaagattgcgcgtattccgcctaaaactgtatctaaagatgataaatctgtacttgaaaatcttgagcgtgacctaaaacgtgttgtatttggtcaagatgaagcaattactgcactagcttctgcaatcaagttgtcacgtgctggtttgaaatcaccggataaacctgttggtagctttgtgtttgctggtcctactggtgtaggtaaaactgaggttacgaagcaattagcaaaacttttaggtgtagagcttgttcgtttcgatatgtctgagtatatggagcgtcatgctgtttctcgcttaattggtgctcctccaggctatgtaggttatgaccaaggtggcttactcacagatgcgattcataaaaatccacactgtgtattgttactggatgaaattgagaaagcacatcctgatgtgtttaacctgttattacaaatcatggatcatggtgcattaacagacaataatggtcgtaagtcagactttagaaatgtcattattgtgttgacgacgaacattggtgcagaaagtatttctcgtgcaagcattggatttacagagcaagaccatagttcggacaaccaagaagccatgaaacgtgcattctcacctgaattccgtaatcgtctagatggtgttattcagttcaaagccttaccaaccacagtgattgaatctgtagttgataagttcttgacagaattgcaagcgcagctagatgaaaaacgcgtagttctagatgtcgatcaaagtgcgcgcgactggttagcgacaaatggttatgatcgtttaatgggtgctcgcccaatgcaacgactcattcaagaacacttgaagaaaccattagctgaaatgattctgtttggtgaacttgcagatcatggcggtaatgtggcggtatcagtgaagaaagaagatggtaaagcagtgggtctaaaacttgaagtgtttgaagatcaccatacggcagaaccagcttaa

SEQ ID NO: 3367 - DNA, 198 bp, Acinetobacter baumannii
aataaaaacataaagcaactaccgagtcctattgctacccatgatattagtttagatataaatctatcttctttaaaaaagaatggtaaaacccatttattgatgtctatttctctcaaccaagataaataccaaggaaacgttaatgcaaatataaaagaacttacgaagatagcaacagatagaggtctcttgtaa

SEQ ID NO: 3368 - DNA, 846 bp, Acinetobacter baumannii
aaacaatgcataaaaacaataaattacaagaaaaacaatattaaattgattttatcaaaacagctatattctatatggatatatagtaaaaaattatacaatattgatacctattttttaatgttattaattaatctcttaactaataaaataggtaaaatcgtaatgtataaatttttagcactttcttttattagtataggtctggttgcttgcaataaaactagtgaggattctgcattaactataaataatcaggaatatatgccgaaacaccaactaacagctaataaatatatttatgaatacaacaatattatttataacttacctaacaatagtgaccaaaaatcgatcaatttaaaattaaaaaaattattaaataccatgccatctaatgaagataatttagccattttaaaaactaaaaggaaaattcttattcgtctgggttgccttgaacaagcatatgccattacagaaaaaatgttaacgaaagctaataattccaaacttcaagaaacgcaatgtattttcttaaaacggatgaaaaaagatatatcacttataaagcaatgttatgaaaaaactgcgtccagctatttaaacgaaataaacctaattcctaaagcacagttatggtaccaatatgcattatggggaaattatgcggcaatgtaccacgctggtcataaagaatataagcttaagctactcgaactaattaactatcataataatgaagatcatcgtttaacgtaccgacaaatgtatgaaagcgtagtgaatccgtcaattttacaaaaaagaatcgaccggattccttatagccctgagtgtcgttag

SEQ ID NO: 3369 - DNA, 183 bp, Acinetobacter baumannii
acagtcagcatgctagcaaacataaaaactgcggtcgctattattgagcgttttgatagcctgctcattccacaaatgccatgcccacttgtacagcctgatccaagtcgtgtaccaaaaccaacaagtatccctgccagaataagtacaaatgaattggctttaatttcgatttcaggctga

SEQ ID NO: 3370 - DNA, 186 bp, Acinetobacter baumannii
tttcttttaattgtcgcagaaagggtacaccaaattcggcttatatattgtaaattttgcggcgaattagcaatgttaaaaaatgacaaaatttcaagtaatttaacggagcttattttaaaccgaattgacaaaaacagttcatgtattttgtgtaacgggggtataagcatcttcaatcgttaa

SEQ ID NO: 3371 - DNA, 912 bp, Acinetobacter baumannii
gatattttaatgctcacagatcttgatgatttttattgttttgcccttgttgttgagcatggtggatttagtgccgccgaacgtgttacggatattccaaaatcaaaattaagtcgtcgtgtttataacttagaggaaaatttaggggttcgcttaattcagcgcagttctcgtcattttgcagttaccgatattggtatggatatttatagacacgcccaagtcatgatgaatgccgcacaagcagctcatgatttggttgatcacttaagtattcaacctaggggggtagtcaaagtaagcgttcctgtagatatagcacaaaaccagctccccaaaattttgccagcatttttaaaaaaatatcctgaaattcgtttacaacttattgtaagtaatcgacgcgttgatgtaattaatgaagggattgatattgctctacgagtcagatctaaactagatgatgaccctagtctggtactaagacagtttgcactcatagaacaaagtctctttgcaagccaagcttatttaaatgagtttggtaatattaagtcacctgatgagttaagtgatcatcgtattttaagcttgtctgaagagcatttagaccaacaatttatattgcatggtccagacaaccaactgaagaaagtgaaagttagcccaaccatcatgggaacaaatatttatatgcttgcccaacttgcaagtcaaaattgtggtattgccttgctacctgacacagcagctgaggattttgtaaaatcaggtcaacttgtacaaatcttgccagattggaaagcagcccacggtatattccatgctgtttatccgtcacgaagaggtttactgccagctgtacgtgtatttattgattatttggtagaacatctttcagaacatccataa

SEQ ID NO: 3372 - DNA, 2598 bp, Acinetobacter baumannii
ctttatttaatgactttatgcgtttgtaaacgtatatggatttataacttactggaaaaaactggcatgcggcacacacattttttaatgcctttggcacttgttagcgctatggcagcggtacaacaagcatatgcagctgatgatttcgttgttagagatattcatgtaaacgggttggtccgtcttacccctgcaaatgtttataccatgttgccaatcaacagtggcgatcgcgttaatgaaccgatgatcgccgaagcaattcgaacattgtatgccactggactttttgatgatcttaaagcatcaaaagaaaatgatactttggtttttaatgttattgagcgcccaattatttcaaagcttgaatttaagggtaataaacttattcctaaagaggctttagaacaaggccttaaaaaaatgggtattgctgagggtgaggtttttaagaaatctgctttgcaaaccattgagacagaattagagcaacaatatactcaacaaggccgttacgatgctgatgttacagttgatacagttgctcgtccaaataaccgcgttgaattaaaaattaattttaatgaaggaacgccggcaaaagtctttgatattaatgtaattggtaatactgtttttaaagacagtgaaattaaacaagcatttgcagttaaagaaagtggttgggcttctgtagtcacacgtaatgaccgttatgcacgtgaaaaaatggctgcaagccttgaagctttacgtgccatgtaccttaacaaaggctatattaattttaatattaataattcccaactcaatattagtgaagataaaaagcatatctttattgaggttgctgttgatgaaggtagccaatttaaatttggtcaaactaaattcttaggtgatgcactttataagcctgaagaattacaagcattaaaaatttataaagatggtgatacctattcacaagaaaaagtaaatgcagttaagcaattacttttacgtaagtatggtaatgcaggttattactttgcagatgtaaatattgtgccgcagattaataatgaaactggcgttgttgacttaaattattatgtgaatccaggtcaacaagttaccgtacgtcgtattaattttactggtaatagcaaaacttctgatgaagtattacgtcgtgaaatgcgtcagatggaaggtgcattagcgagcaatgaaaaaattgacttatctaaagttcgtttagagcgtacaggtttctttaaaacagttgatattaaacctgctcgtattccaaactctccagaccaagttgacttaaacgtgaatgttgaagaacaacattcaggtactactacattagcggtcggttattcgcaaagtggtggtattacgttccaagcaggacttagtcaaactaactttatgggtacaggtaaccgagttgcaattgacttatctcgttctgaaactcaagactattacaacttaagtgttactgacccttactttacaattgatggagtaagccgcggttataatgtctattatcgtaaaacgaagctgaatgatgactataacgttaataactatgtaacggatagtttcggtggtagtttaagttttggttacccaattgacgaaaatcaaagtttaagtgcttcggtgggcgttgataacactaaagtaaccacaggtccttatgtttctacatatgtacgtgattacttattggcaaatggcggtaaggcaactggtaagtcatcttggtgtccaagtggtaagaataaaacagatcctaacacgcaacaaccaatacctgatacatgtgaaggcggttttgaagactataatagtgcttttgagggtgaattttttacctataacttaaacttgggctggtcttataacacattaaacagaccaattttcccaacatctggtatgtctcaccgtgtaggtcttgaaattggtttaccaggtagcgatgttgattatcaaaaagtaacttatgatactcaagcatttttccctatcggcagtaccggctttgtacttcgtggttatggtaagttaggctatggtaatgatttgccattctataaaaacttctatgcgggtggttacggttctgtgcgtggctatgacaacagtaccttgggacctaaatatgcgagtgtaaatctacaagaaactaaacaaaatgatggttcaccggaagaagtgggcggtaatgctctggtccaatttggtacagagttagttttaccaatgccatttaaaggtgactggactcgacaagtacgtcctgttctttttgctgaaggcggtcaggtttttgatactaaatgtaatattgataactctgtttatggcaacaaaggtatgaagattaatggccagaccattacggatgttagaaaatattgtgaagataattatggatttgatttaggtaacttacgttatagtgtgggtgttggtgtaacctggattaccatgattggtccattgtcacttagctatgcattcccgttaaatgataaaccgggtgatgaaactaaagaaatccagtttgaaattggtcgtactttctaa

SEQ ID NO: 3373 - DNA, 666 bp, Acinetobacter baumannii
ttatatttaataaaggtgaaaaaaatgactagtgaaaacatccgtgacccaaaacaagatcatcttttaactccagaaaactctgcttttattgtcattgattatcaaccggttcaagtaaactctattgcttcgatggatcgtcaactgttgattaataatattgtaggcacggcaaaagctgcccttgtttataatttgccaattatccattcaaccgtaaatgttaagactggtttaaataaaccacctattccacagttgagtaaggttttgaaagattaccctacctatgaccgtacaagtattaactcttgggaagataccgaatttaaagaagccgtaaaagcaacaggccgtagaaaactcattatgacagcgctttggactgaagcttgcttaacatttcctgcactagacgccctagctgaaggatatgaagtatatgttgtggtagatgctgtaggtggtacttctgttgcagcgcatgaagctgctttacgtcgtattgaacaagcaggcggcaaaatgatcagtgttgctcagttattctgtgaactgcaacgtgattggaaacgttcagaaactgtacctcaatttatgaaattatttattgagactggtggtacagcgggtatccaattctcttacgacaaagctgaataa

SEQ ID NO: 3374 - DNA, 774 bp, Acinetobacter baumannii
ttgagtttaatattaattaagtgcaatatgaataaattatataagaatgaatctccagaaatgattctagcttttgagaatgctataggtacatttaaatatttttggcgtgaactttattgggaatctcgacgaattgttcctgctctagagctggcttatgtgaagtgtgcatttatccaagaaaaccttgaagataaaaatgaacctttaattgagtatatgtggattgatcaagttgattttgatgggagtacaatttcaggaattttgttaaatgaaccttatattattgaaaatgtgcaagctggtgaaactgtaaggcttcaatttgagtctatagttgattggatgtttttatctaatggcactgttcatggtgcgtttacgattcaagaatatcgtaagactttaaatgcatcaggacgtaaagaatatgatgaggcatgggggattgattttggtaatcctgatgaaattcttctagtttatgaccaaaaaaattgtcccgaaaatctagaagaacatcctatgtgtaggagtattttggaacagttcataaatattataaatacagaccctacaatcattactgaaaaagatgaaagtggtaatcaattattacatcgtgaagttatagcggataattatttatttgttcaagaactcttaagattgaatgttaataagttagtaaggaataaacaattaatgattcctttagacttggcccataagatggggtggtccaatattgtaaatttacttaagtag

SEQ ID NO: 3375 - DNA, 654 bp, Acinetobacter baumannii
tttgacttaatcgggagcacgagcatgaacaactggaattttcaggaattaaaagaaactccatctcaaacaggtggtccttacgttcacattggtttattgccacaacaggccggtattgaagtttttgaaaataactttaataaccagttggttcaagaccagacaaaaggtgagcgtattcgtcttgaaggtcaagtgtttgacggattaggtttaccgctacgcgatgtgctgatcgaaatttggcaagccgatgcgaacggtatttatccaagtcaggcagatacacgcgagcaaaaagctgacccggcatttcaaggttggggccgtacaggtgccgactttgaaacaggcgtttggagctttaatacaattaagccgggcgcgacagcagggcgtaaaggttcaactcaagcacctcatattgcattagtcattttcgctcgcggtattaacttgggtcttcatacacgagtttattttgaagatgaagcagaggcaaatgctaacgatccaattctaaatagcattgaatgggcaccacgtcgccaaactcttattgcaaaacgttttgaagaaaatggtgaagttgtttaccgctttgatattcgtattcaaggcgatgacgaaactgtattttttgatatttaa

SEQ ID NO: 3376 - DNA, 1080 bp, Acinetobacter baumannii
aataaattaatgaaagtgcaacaatatcgtttagatgaattagctcaccttgttaaaggtgagctaattggtgaaggtagtcttcaattttcaaacttggcgagtttggaaaatgcagaggttaaccatcttacttttgtgaatggtgagaaacatctcgatcaagctaaagtaagtcgtgcgggcgcttacattgttaccgcagctttaaaagaacatcttcctgacaaagataattttattattgttgataatccctatcttgcgtttgcaatccttacccatgtatttgataaaaaaattagctcaacaggcatagaaagcactgcccaaattcatccatctgctgttatttccgaaactgcttatattggtcactatgtggttattggtgagaattgtgtagttggcgataataccgtcattcagtcacataccaaacttgatgataatgtagaagttggaaaagactgttttattgattctcatgtcactattacaggtggttctaaattacgagatcgcgtccgtattcattcaagtactgtcattggtggagaaggttttggttttgctccatatcaaggcaagtggcatcgtattgctcaattaggttcagttttaattggaaatgatgtccgaattggatcaaattgtagtattgatagaggcgcacttgataatacaattttggaagatggggttattattgataaccttgtgcaaattgcacataacgtccatattggttcaaatactgctattgcagcgaagtgcggtattgccggaagtacaaaaattggcaaaaactgtattctagctggggcgtgtggagtggcaggacacctttcaattgctgataatgtgactttgactggaatgtcaatggtcacaaaaaatatttctgaagctggaacttactcttcgggaaccggattatttgaaaataatcattggaaaaagacgattgtacgtttgcgacaattagcagatgtgccattgacccaaatcactaaacgacttgatcatatacaagctcaaatagagtctcttgaatcaacttttaatttgcgtaaatag

SEQ ID NO: 3377 - DNA, 366 bp, Acinetobacter baumannii
tttatgttaattgatagtctttctataacccgaatatttagtgtgttcgggttatttattattactgcaatcgctgagattttgggttgttactttccttatcttattttaaaagaagggaagtctgcgtggctatggttacctacagctctgagtttggccgtgtttgtctggttgctgacattgcatcctgcagcttctggacggatttatgcagcctatggcggtatttatatttttactgcgcttatgtggcttcgttttgtagatcaggtcgctttgaccagatgggatatcttgggtggcgtaatcgtgctttgcggagcaggtttaattattttacagccccaaggattaatccgttaa

SEQ ID NO: 3378 - DNA, 1770 bp, Acinetobacter baumannii
ttaattctaatagtaatactatatagggaaatttgtatgaataacaaacaagttcttcgttcggctgcctggtttggtacaacggataaaaatggctttatgtatcgcagctggatgaagaaccaaggaattccagatcatgagtttcaaggcaagcctatcattgggatttgtaatacgtggtctgaactcaccccatgtaatgcgcattttcgaaaaattgccgaacacgtaaaaaaaggaattttagaggcgggcggctaccctgttgagtttcctgtattttcaaatggtgagtcgaatttacgtcctaccgccatgtttacccgtaacttagccagtatggatgttgaagaagcgattcgtggtaaccctattgacggtgtggtgttactgacaggttgtgacaaaaccacccctgcattattaatgggagctgcaagttgtgatattcctgccattgtagtgactggtggaccaatgctgaatggtaagcacaaaggtaaagacattggtgcaggtaccatcgtttggcaaatgcatgaagagttaaaagcaggcaaaattgatttaaatgaatttttatctgccgaatctggtatgtcacgctcagctggtacatgtaataccatgggcacggcttctacaatggcttgtatggctgaagccctaggcacttctttaccccacaatgcggccattccagcggtagattctcgccgttatgtgttggctcatctttcaggtatgcgcattgttgacatggttcatcaagatttacgcctttctaaaatcttaaccaaagaagcctttgaaaatgcgattaaagtcaatgcagctattggtggttcaaccaacgccgtgattcatttaaaagcaattgctggacgcattggggttgatttacaactggatgactggaaccgtgttggccgcggcatgccaaccattgttgacttacagccttcgggtcgttttttaatggaagagttctattatagcggcggcttgccagccgtgattcgtcgcatgggtgaagccagtctcttaccacatccacaagccttaaccgtaaacggtcaaaccatttgggaaaactgccaacagtcacctatttataacgatgaagtgattcggaaaatagataatccaattcgacaagatggcggtatgtgtattttgcgcggaaatttagcgcctaaaggtgcggtgcttaaaccatctgctgccacaccggagttgatgaaacaccgtggtcgtgcagtcgtatttgaaaacttcgatgattataaatcccgtattaacgacccagatctagatgtcgatgaaacttgtattcttgtgatgaaaaatgccggccctaaaggttatcccggcatggccgaggttggaaatatgggactaccgccaaagattttagctaaaggcattaccgatatggttcgtatttccgacgcacggatgagtggaacagcgtatggcacggtcgttttacatgttgcccctgaagctatggcgggtgggcctttggccgtagttcaaaatggtgactttatcgaacttgatgcctatgctggaaaacttcacctagaagtgagtgatgaagaacttaagcaacgtcttgaaaatttagcgccaccagctccaccaagttttattggcggctaccgtaagctctatgtagaacatgttttacaagccgacgaaggttgtgattttgatttcttggtcggttgccgtggctcagaagttccacgtcattcccattaa

SEQ ID NO: 3379 - DNA, 1368 bp, Acinetobacter baumannii
gagagtctaatcatgagccagttatatgccagcttgttttaccaaaaagacgtcactgaaatctttagtgattcatctttagtcacttacatgattcaggttgaagttgcgttagcccaagcgcaggcacaagttggcgtgattcctcaaaatgcagcaaataccattgcccaagtagctgagcatgcactagacaagtttgatttttccgctttggcggtagcaaccggtttagctggaaatattgcaattccatttgtaaaacagcttacggcaattgttaaagatattgatgaagatgcttcgcgttatgtgcattggggcgcaaccagtcaggatattttagacacagcttgtattttgcaatgccgtgatgcgttgaatatggtggaaggccaacttcaacaatgctatgcgactgcattacagcaagccaagcaatatcgtcatcaagtcatgattggacgtacatggttacagcaagctttaccaattaccttagggcataaacttgctcgttgggcttctgcatttaaacgtgatttagaccgtatacaagctatgaaatcacgtgtgctcactgctcagttaggcggtgctgtgggttcactggcttctttgcaagaccaaggctcgcttgtggtcagcgcatttgcgaagcaactgaatctgactgtaccaacaagtacatggcatggtgagcgtgaccgtattgtagaaattgcaagtgtgcttgggatgattgtcgggaatacgggcaagatggcacgggattggtcactcatgatgcaaactgaaattgcagagttgtttgagccaaccgcaaagggtcgtggtggttcatcgaccatgccgcataagcgtaatccagttgcggcagcatccgtattggccgcggcgaatcgtgtaccagcactgatgtctagtatttatcaaagcatggtacaggaacatgaacgtagcttaggtgcgtggcatgcagaatggttagcagttccagaaatctttcagctttgtgctggagcattaagccgtactggtgaagttctacaaggttttgaagttaatgctgagcatatgcaacagaaccttgagtgtaccaacgggttaattatggcagaagcggtgatgatggcacttgctcccaaaattggtcgtttaaatgctcatcatttagttgaagctgcatgtaaaacagcagtagcacaaaatgaacatttgtttgatgttgttagccaactagatgaaataaaagggcagtttagccaagaagagataaggaatattttcaaaccagaaaactatttaggcaatattcagcaacagattgatgcggttttgaaagaagcacaaggagagtcaaagtga

SEQ ID NO: 3380 - DNA, 471 bp, Acinetobacter baumannii
aggttactaatgattttatatgtttgtagttatgttttaagaaaaccatttttttcagagaaaagagttgatctaaaagaaatcggttgggaaaaactatcaaatatagtcaagaaggttttttcttgtgggggaagcataattattcataaaacagatgctgactattctgaagagtctgagcgattagtatatagtgatattaatagctacagcatggtttgtgattctagatatggttatttatttggatgcagtattagtgaaaatgaggaatatcctgctggtacttatttacgccttgtaaacagaaaaactaaaaatcctgatgagatttatatttttgagccccatgaagatgaatggaaagcaaagtatgttaaccaagatttagagttagccttaaatttatttaaagatatttatgagtatggcgatttattagaagattcaaatattatgcttgagtag

SEQ ID NO: 3381 - DNA, 192 bp, Acinetobacter baumannii
gttgaactaattgagaaaaatatgaaagatattgaaatcttagaaataaatgaaatgggcgattatgaaaaagacttatcgctattgttagaagattctatcaatagcggagcttctataggtttcttagctcccgtagaaaagaacgaggtcttaaattattggagtgaggtcaaccataaattagcataa

SEQ ID NO: 3382 - DNA, 207 bp, Acinetobacter baumannii
gctgccataattgttaaaatgcccaccttatcctgtttttatattatttttttaattgcttttgttcttgcagtttttaaattaattatgaaacacagtcgcttagttaaggattttttgaatgctctctatttatttaacagatactcaaacgacatgtgcaatttaatgattacccaagtgatcagcctgttaaatttctgttaa

SEQ ID NO: 3383 - DNA, 1047 bp, Acinetobacter baumannii
atattaataataaattttactttaacactactttctaaaaatttaacacttaactcgataggaatatttatgaaaaaaataggtatagttgctgttagtgcagtgacattatgttgggctatgtatgaggtatcttctgacaatacgaatacagtaccgcgtaacgaatctaaccaaaaagtagcatctaaaagcatttcatccactacaaagaatgaaaagttagcgtctcaaactctcttggctcaaactacctcccttaattcctctgccccagtctgtaaatataattttgatgcgactcaagaagattacgatctttggaacaatgaacatactgactattggccaattaaaatattcccattaataattggtcaaaaatttggttttaaagtagaacctacgccagaaagtcagtatggctacgtagattatgtagctacaagtaaagtagatagtctgaattcggttaatgaaattggtgatttaataatacctcacacaggtattattgcatttgaaatggaacttaaaattccaacatcaactcttgggagttcatcacttggaaattctacttattactcctctagcattggatttagtggggtaacaaataatggttatacaattagatccaactattggtttgatatgggggggtatgatccagattttggcgagaatcctgctagattaaactattatgtagcttatcgacttagtgataatagtgggcctaacaatccatattataaaggtcaaaacatgacaaataattcaaatgaataccaaagattagggatgtatattaatcagaatactaagcaggttggctttattttaaatggtgttgatcaggggtatcaatctactttacctgctccactagagaatatacgtttttctgtctcaagtagtataggaatatattctaatcaattatttggacaagagttgtctaatgaactcattactgaccgtaatgcgctacagtttaactaccctcagggcacaacagacatgtgtggtaatgccatctaa

SEQ ID NO: 3384 - DNA, 1404 bp, Acinetobacter baumannii
gagataataatcatgactgatcaataccaagcatttacgcaatctcctattggtaaattcgttgttaaaaatctgggattaccttcgcctgttgtattagagcgttttgaaagtgctcagccagtagtgaaaggtgcagtattggttggcgcggcgccatcaagcgttttgtctggtgcgattgcacaagtacttagcaatattcatgcagatagctatgtaggcaataatgttgcattacaacaagaagctgcaaaagttggtttaaatttacgtccattcaatgcaggcgataaagaatcaaaatttaaggctgttgtatttgatgcatctggtattcaaaactcagaacagttaaacgaactttataaattctttaatccgattgcacgtcaagttgcgacttctggtcgagtgattgttattggtactacgcctgaaactgcgaaaactgtaaaacaagcgattgctcagcgtgcacttgaaggttttatcaaatctgtaggtaaagaatttaaaaagggtattactgctcaagttgtgtatgtagacgaaggtgctgctgcaaaccttgaatcaacattacgtttcttgctttctccacgttcagcttatgtatctggtcaagtgattcgtgtttctaaagcagttgtggttgatgttgattgggcaaaaccacttgctggaaaaactgcattagtaactggtgcaagccgtggtattggtgaggcaattgcacatgtattggcacgtgacggcgcgcatgttatttgtctagatgtaccacaacaacaagctgatcttgaccgtgtagcagctgacattggcggttctacattggcaattgacattacagctgctgatgcgggcgaaaaaattaaaactgctgcggcaaaacaaggcggtttagatattatcgttcataacgcaggtattacacgtgacaaaactttggcaaacatgaagccagagctttgggacttggtcattaacattaatttgtctgctgctgaacgcgtaaacgactacttgttagaaaacgatggtctgaatgcaaatggccgtattgtttgtgtatcatctattagtggtattgctggtaaccttggtcaaaccaactatgctgcatctaaagctggtgtgattggtctagttaaatttactgcgcctattctaaaaaatggtattaccattaacgcagtagcacctggctttatcgagactcaaatgactgctgcgattccatttgcgattcgtgaagctggtcgccgtatgaactcaatgcaacaaggcggtttacctgttgatgtggcagaaacaattgcatggtttgcatcaactgcttctacaggcgtaaatggcaacgttgtacgcgtgtgcggtcaaagcttgttgggcgcttaa

SEQ ID NO: 3385 - DNA, 765 bp, Acinetobacter baumannii
acctcaataattttgttaaatagcctaagaatattgaggtatataaaaatgtggttaaaactttcaacgttgtttttattacccgtattattcatacaaggccataaagttcggaagaacaaaccacgtttagcagaagctaaaggtgaacgagaaggtagagctggtcaaggtaaatctttatctctgcttatttttggggattctgccgcagcaggtgttggtgtagaaaatcagaaagatgccttgtctggtgctattattcaagaactgcaaaatgaattttccctacagtggaaacttcatgctaaaactggtgatacaactcgacaagtttttaatgctttgcagcatttggaagagcagaagtatgatgtgattgtgacatctattggtgtaaatgatgtcacaaagttgacttctgctaaatcatggattaaacaacagaagcaattatttgagcatatacagaaacgttttcagccaaagttgattatcgtttccggtgtgcctccaatgcaacatttcccggctttaccgaatccactagcttggttgtttgggcaatatgcagagcaaatgaatcaaaaattacaacaatggttagcaccacaaagccattttaagtttcttgaatatgatattgaaacttttcaagccatgaacttgcctatggcaagtgacggttttcatccaagtaaagaagtttacgcagtttggggacggcaggttgcagccttagtgcggcaatcatttaactcatag

SEQ ID NO: 3386 - DNA, 1350 bp, Acinetobacter baumannii
ttctgtgtaatacaaaaaaccaaacatatatatgtttatatatttatcaaggaagataatatgactgcattgatgctgatggctttagccgtatcgataggtttaggttataaaacgaaaattaatatcggattttttacgatagcgtttgcctacctgattggttgctttggcatgggtcttaaaccttccgaagttattgaattatggcctgtcaaaattttctttattattttatccgttactttgttttataactttgctttggcaaatggtgctttagagaagcttgccagccatcttttatataaatgccgtaagtttcctcagtttttacctttagcgatttttttcgcagcaaccattattgctggcctaggtgctggtttttatacagtacttgcctttatggcacccattacactgctgctgtgtaaaaaaaccaatatgaatatgattattggtgggatggctgcaaattacggcgctttagctggcgcaaattttatgacatcgcaaagtggcattattttccgaagcttaatggaaaatactggcattagctcacaaacagctttttcatatagcagtggaatttttgtcttaactttaattattccaattgcggtgttgggaatttataccctttggaatagaaaaagtaattcaattgtaattgaagatcaaaagcctgagccattcgacaaaaaacagaaacaatctattttccttattattttaatgatgtcgattgttttagtttttccaatcttgcaccttgtttttcccgatgtaaaaacaattagctttttaaactccaaaattgatattgccttccttgcgattaccttctccctcattagtttacttatgaaacttgccgatgagaaaaaggtcattgcacttgtgccttgggggacactgatcatgatttgcggtgtcggtatgctcatcgcattaggtgtgaaacttggcattattactaccctatctgaatggttagcaaacaatgttcctgtgtgggtcattccagtacttttatgtctgatcagtgccattatgtctgtattttcaagcactctcggcgtggttgctcctaccttatttccaattgttccggcgcttgcacttacctctggcctaaacccactagtgctgttcatttgtattgtggttggcgctcagtctacagcgatttctcctttctcgtctggcggtagcctcattatggcttcagcaccagcagacatcgacaaaaccaaattctttaatcaactgttatttaaagcaattcctgtaggagtcattgccgctttaatcgctattttcgctttaaaatttgtaatgtga

SEQ ID NO: 3387 - DNA, 339 bp, Acinetobacter baumannii
actcatccaatctttcgatcatgtcttatattggtagataaaggtgtaattttaatgacgcaatcaactctttatcttttgcaagcttcttatcaccatactcctcgcattattgaagaacttgcaaagctatttcataaagatgatcaaattgtttttatgggtgactcaactgctcaactttcggtaaatatttgtcagcagtttggctcagtttcttgtttgtctcatgaaaaagatttaattgatgcagaaaccttggctcaggttaaggtattgaactatgatcagtttgcggatctggttttacaatttaatcgatgcatttctttgaaataa

SEQ ID NO: 3388 - DNA, 1422 bp, Acinetobacter baumannii
tgtcatgttttgatcagcactttgcctatgtcacacgcttcttcctgcttccagcaaaaccagttttttgtgttggtggagtacctcacttcactacatgaaatttatcctgtaagacatgagtttgcaggatatccggctgcaatgacattggcagatcgcgtacattcagatcatgatattgcgccacttgaagccagcaaaagctaccctgactcaatagagaaagtcttacacttttcaggtaaggcccgagacatacaagactttgagcaatttttagaacaagctcaaacagccaatattcaaaacttgttattgcttacaggtgataaacttaaagaacaccataatggtcgagatggacagcctcgtagtcgttacttagagtcagtaaacgccgtaatggctgccaagcaacatggtgggtttcgtattggggtggcttttaacccatttaaatatgttgaagctgagcgtgatgcacagtatttaaaactacataagaaaattaaagcaggcgctgactttatcattactcaattgggctatgacattgaagctttaaaacaagccaaagcatttttaaccaaaaataattattcgcagcaaatactggcttgtgttatgccactgactttgggccgagccaattttatggtgaagcataaagtcgcgggtattgtaatcaccccgcacatgctaaaagttttggcagacgaaaaacaggcagggcatacagaccgagtttatttgcgctgtgctttgcaaattttgatatgtaaacatttgggattttcaggtattcatttatctgcttgtcataagcctgaagaacaaatgctgcttgaaagctacgtcgagcaatacagacatctggagcttaatgttttagaagagctttggaattcactttggcaagtcacgacaagcaaagagtttactcctgaaattgctcgtttttcacgtcagccaacatctaaacaaatcattaaatatcgccaactacatgtgatgcatgaggccctgtttggatcaaaaatagctaaaggtgttggacggtttatttttaaagcgtctttttgggaaaacgctttgatcgccaaactcttactaaaaacagaagtactgagtaaacatagcctagtcggttgtgaaagctgtggtcagtgccgtttaggtgacaccttgtatatttgtcctgaaacatgtccaaaaggtttagccaacgggccttgtggtggtacaactttagaccgctgcgaatttggtgaccgtgaatgtattcattcggtcaaagcaagacttgcaaaagctgttgaacaaactgaaatattaaaagagaaattgattctaacggtgcctcttgaaactagaggaaccagttcttggaaaaactggtatttagcgactgaggcttaa

SEQ ID NO: 3389 - DNA, 2481 bp, Acinetobacter baumannii
ctggcccaaatgcttgaactattcgggttcagtatatgtggagtaggatctatgtctgagtcagattctaagtttcatatcttattcaaaatatggtgttttattttaggtttagctttattggctactggtattttttatatcgtgggcggtggaaagctagtatctctcggtggttcttggtatttccttatctcaggactgtttataaccatttcagcaattagtattttccgaaaaaaagcgctgggcgtctggatttttgcggctgtttttgttggtaccgtaatttggtcactcattgatgctggatgggaattttggccgttattctcgcgcttaatgtttcctgctggtctttttgctgccttgctatttactttgccttcaatccgacgttaccaatttcaaactagtttggcatcttcatcctatgcgataggtggattagttgttgtaggtatattgattgcgctctatcaaatgttccaaccgcatccaacagtagcaagctcaggtgaaaaactacctttagtaccagttgaccctgcaaaaaaacaggtgaattgggaaaattatggaaatgatgcaggtggtagtcgctttgttgctctcgatcaaattaaccgagataacgttcataaactaaaagaagcttggcgctttagaacaggtgattttacaacgggtagcggtaatggtgccgaagaccaaatgacgccactacaagttggaaataaagtcttgttatgtacgccacataacaacatttttgccatagatgctgactcgggcaaacagatctggaaagctgaggtaaactcaaaagccgatgcttgggaacgttgccgtggtgttgcatacttcgattcaactaaaccactggtgcaaccaactttagctggtgcaactccagtcactactgttgccaacaacacagcctgtccacgtcgtgtatataccaatacgccagatggccgtttaattgcagtcaatgcagataatggtcagcgctgtgcggactttggtgtaaatggaacggttgatctactcgaaggcttaggcggtgggactaaggctccacgttttgaagtgacttctgcaccaactattgccggaacaactattgtggtgggtagccgtattgcagacaacgtggcagcagatatgccgggtggtgtaatacgtggttatgacgtgattacgggtaaacttcgctgggcatttgacccgcgtaatccagatcctaactatgttcttaaaccgggtgaaatctataaacgtagttcggcaaactcttgggctgcaatgtcatatgatccacaaatgaatacagtgttcctaccgatgggtagttcatctgtcgacatttggggggggaaccgtaatccgttagatcacaaatacaatacttctgttttggcacttgatgcgacaacgggtaaagaaaagtgggtatatcaaactgttcataatgacttatgggactttgacttaccaatgcaaccaagtctagtcgactttccattaaaagatggtacgactaagccagctgttgtgattggaaccaaatcaggccaattcttcgttcttgaccgcgtaacaggtaaaccactgactaaagtaattgaacaaccagtgaaagcggcaaatattccgggtgagcaatacagtttaactcaaccacgctctgttgaaatgcctcaaattggtaatcagactttaaccgagtcagatatgtggggtgcaacgccgtttgatcagctcatgtgccgtattaactttaagtcaatgcgttacgaaggtttatttactgcaccaggtactgatgtttcattaagcttccctggttctttaggtggcatgaattggggtagtattgcttttgacccgacacatcgttacatgttcgtaaatgatatgcgtcttggtttatgggttcaactcattaaacaaacacctgaagatattaagattcaggcgagtggtggcgaaaaagtaaatacaggtatgggtgctgtaccaatgaaaggtacaccatataaagtgaataaaaaccgctttatgtctgctttaagtattccttgtcaaaaaccaccatttggtaccatgacggcaattgacatgaaaactcgtcaggttgcatggcaagtaccacttggtacagttgaggacactggaccacttggtattaagatgggcttgaaagcaccaattggtatgccaactattggtgggccaatggcaactcaaggtggcttagtcttctttgctgccactcaagattattacttgcgtgcttttgattcatctacaggtaaagagctgtggaagtcacgtatgccagtaggtagtcaaggtacaccaatcagctatgtttcacctaaaacaggtaaacaatatgtagtggttaccgcgggtggtgcacgacagtccccagaccatggtgattatgtgatcgcatatagtttagagaaataa

SEQ ID NO: 3390 - DNA, 1002 bp, Acinetobacter baumannii
aacatgcaaattattcaatttgaaaatcgtgcaaatcaacgtgccgtcgcgaaagtagaaggcaacatggcatatccggttaaagatattcaatcggttcgtgatttagcacttttagcaatccgcaataaagtttcactggaacaacaagttgaggcgttagggtttgagtccgaaacttatgattattcatctttattagcagatttaaaggtactgccgcctttagaccatccagattcaacgcattgtttaatttccggtacaggtttaacccatttaggttctgcatctgcacgcgacaaaatgcatcaacaaaatttaagtgatgacaactcggtgaccgacactatgcggatatttcaatgggggctacaaaaggggcgtccagcagaaggtcagatcggtgcgcaaccggaatggttttataaaggcgatggttcaattgtggtaagaccgggagctgaattacctttacccccatttgctgaagacggcggcgaagaacctgaaatcgcaggcctctatgttattggcgaagatttaaagccttaccgaatcgggtttgcgctaggcaatgaatattctgatcacgtaatggagcgtcgtaactatttatacctggctcattcaaaattacgtttttgtagttttggtccagctttacggacaggtgaattaccaaaacatttagtcggaaccagccgcttgcgtcgtgatggacaaatcatttgggaaaaagagtttttgtcgggtgaagacaatatgtgccatagcttggcaaatctggaatatcaccactttaagtatcgacaattcttaaaagcaggcgatgtacatatacattatttcggtacagcgactctatcttttgccgacggtattcaagcgcaagtcaacgatgagtttgaaattgaaatgaaagagttcggtcatccactcaaaaacaaacttgctcatatgcaacccgaattaccgatcggttcagttattactctctaa

SEQ ID NO: 3391 - DNA, 435 bp, Acinetobacter baumannii
ggactaaaaatgaaaaaaatcattaaaattttattattatctagtttgattttatctataccattatctgtagttgctaaaaatgttgagactaaagtaagctttttaaaaggttcttctcaaactacattaaccggaaagtttcaaggttatgatgatgtaagatatcgagtttttgcaaaaagtggacagattttaaaatttaatattaatagttatggtaatttagcttatattaatattttcgctccaggtcaaaagcctggtaaagataagccattattcgtgggttcgactgtaggtttttcaggtgaagtaacgctacctgttgatggtgattatattgttcaagtttatcaaatgaaaaaaagcgcgcaaagaaatagagcagtttcttttaatctagatctacaaatattagataataaaaaataa

SEQ ID NO: 3392 - DNA, 450 bp, Acinetobacter baumannii
gagcaaaaaatgactcaaaataaagttgaattagcagagaaattgtcaaaagaatctcatcaaggtcaaaagtatggtcctcatgattactttgattatcatattaaaggtgtggtcaattcattaattgagcaccgattttcagaagtctatattattaccgcccttctccacgatagcgttgaagatacacctcttaccctagccaaaatcgaaagcttattcggaaaagaagtccgtgatgccgttgatgcattaactaaacgagaaactgaaacacgcgaagaatatttaattcgttgtagttcaaatccgatcgctcgagtcgtaaaacttcatgacgcagcttttaatgcgcataactcacataaagaaagtaatcaatcacgtgtcgattattaccttcaaaccatgttaattgtttcaacggcgcaagatagattgggataa

SEQ ID NO: 3393 - DNA, 795 bp, Acinetobacter baumannii
atgagaaaaattttaggtatagcttctctcattatgtctacaggtgttgtacatgctgaacaattaaatgaacaagaacaaatttctccgtatagtgcgaatgtgacttttgcaagtcaatatatttcgcgtggttttcaacaaacttggggtaagcctacactacaaattggtttcgactatgcaaatccgaatgggctatttgtgggtacttgggcatccaatgtaagttctaactatctccgtgatgcttcagttgaatgggacttttatgcaggttatttaaaaaccatcgataaattctcaattggaatgtctgttttttattattattacccaggtgcaaaaagtacggctgaaacggggagtacaagctataactatggcgaaattgtgcctcaaattagctatggtcctttaagtctcaaatattttattacttataccccagattacgcaggttataactcaaatacgatgggtggaccggaaggtaaacgttcacgaggaacaacttatttagacctcaactttacacagccgatcaatgaaagttggacttttggtgcgcactatggctatgaaagaattaaaaatttctctgaagctaattttcaggatatgaaagttgaacttattaaagatttaggtgatggctggactacagggttagcttataccaaagcgtgggacaaagacggatactatagaaattatagtaatggtgaaccagatgcaccaatttcaaatccgattgattcgacctttacagtatctgtaaaaaaggtgttctaa

SEQ ID NO: 3394 - DNA, 297 bp, Acinetobacter baumannii
gcgatgaaaattggatttattggaggagccaatgatggcattgtaatcaatgctgccaatggtattgatacttataaacttgaatggcattacaaggctgagaagcattgtgaagaacagccatcattagggctaaatggccctgaatatgactattacaatttattaattttgagaaaaaataaagaggcaaaacttttctacgttttaactaccatgggcaaagaagatattgcggataagattaatgagtattgggagtattccacatctgtaggttatgactttgatgagtaa

SEQ ID NO: 3395 - DNA, 459 bp, Acinetobacter baumannii
aattcgaaaatgaatgtagatgcaatcgatctaaaaattttgaagtatttacaagacaatgcccgtttaagtaaccaagaacttgctgatcttgttaatctttcagcatctgcttgtcacagacgcgtcaaaattttagaaaccaacggaatcattgaaaaatatcaagccaaagttaattatgaaaaattaggtataaaaattgaggcgatagttgaaataaaacttgctcaactcaccgaaaatgaccacaacttttttttaagccaaatcaagaattttgatgaagtcatcaatgcctatatcattacaggtgaatctaattatgtactgcacgttgccactaaagatctaaactctttttctcattttgttattaatacactcaataaaattaaaggtgtggtaagcattaactcaaaaattatcttacagaaaattatacaaaagccgctgtag

SEQ ID NO: 3396 - DNA, 702 bp, Acinetobacter baumannii
ggtgagaaaatgtctaaacgcatattacatgtcgtgaccaatgtttcacgctataagaatgtcgatgaaccaacagggctgtggttaggcgaactcactcatgcttatgatgagtttgaaaagcaaggttatgtgcaagatatcgtcagcccaaatggtggaaaaactccaattgaaccaaaatcgcttgtgcctttagtggcagataaatctgttaaagaccgagaaaaagatcaagcttttattacgctgctggcaaatacttttaagccttccgatattaattgggaagattatgatgtgatctactatacgggtggtcacggtgtgatgtgggattttttagataaccctgaactgcaagaaatcaccaaaaatatttatgaaaaaggcggtattgtttcgagtgtttgtcatggctattgtggcttgctcaatgtcagactttccaatggcgaaagacttataaaaggcaaaaagttaacaggctttgcatggagtgaagaagttttggcaggggtggcaaaaaaagtgccatataatgccgaagagttagcgaaagaatatggtgctcgttatgaaaaggcttttattccttttgcaccgtatgtcgttcaagacggtaagttaattacggggcaaaacccgttttcagctaaaaagacagctttagcgataatagaagagctagaaaagtcataa

SEQ ID NO: 3397 - DNA, 1104 bp, Acinetobacter baumannii
ctcaggaaaatctttatgagtactctcgaagcccaagatcactccatgaccgagtcacccaagttaacaaagatgcaatatcttaagaaacactgggttatggttattgcatttattattgttctagtttccattttatggattttaaaagttatatttttaccttcttccgttgttaaaactgacgatgcgcgggtagacgtcgagtactcaaccattgctcccaaagtgtcaggtaatattgaagaaatttatattaaagatcaccaaaccgtaaaaaaaggccagcttttggcacggattgatgcacgtgattatcaggcggctttagctgaagctgaatctaattatgccaaagcacaagctgacttaaatgaagcaatgctggcagtagaaagacaaccaactgttattcgagaaacagaggcccagcttagaaaagtagaagccggcattaaactcactaaagataataccgcacgctatgaacaattacaggcacttggtgctgaatctagattgattacacaacaatcaaaaaccacattgaccgagcaatatgccgacttggacagcagtaaagaaaaagtcattgatgcgcagtatcagctcaaccaatataagattcaggttcaagctaaacaagcggctttgaaacaagcccaagctgcgcttgataaagcaaaactgaatctgagctatacagaaattcgagcgcctattgatggcatgattgggcagaagtctgcaaatgtgggcaactttgttggcgcaggtaatccactcatggtggttgtgcctttagatcaagtgtatgtagaagcaaacttccgtgaaattgagctaaaacaaattaaaatcggccagcctgtcactgtttatgtcgatgcttataacgttgagttaaaaggtgtggtagatagtttttcaccatcgactggtgcattcttctcgccaatttcagcaacaaatgcgacgggtaactttactaaaattgttcagcgtttacctttacgcatcaaactccttgagaaccaacctgatattaaattgttgcgtcctggtctatctgttgtggtttctgtggataccactaaaaaataa

SEQ ID NO: 3398 - DNA, 1341 bp, Acinetobacter baumannii
ggggatgaaatcatgaaagatatctcacaccgtgaagtttatgcactggttgatattaataattgctatgttagctgtgagcgtcttttcaaccctaaactcaatgataaacctgtagttgttttatctaataacgatggctgtgtggtctcacgtagtgaagaggcaaaacttttagggattaaaatgggcgtaccgtggttccaaattgaaaaagatgctttacaagcaggcgttcaagtctattcaagcaactacactttatatgccgagatgtcccgccgtttttttgctgttctcggtgagtttttctctccagatgatttagaagcctactctatagatgaatgctttattcatctcaccccttacctccaatctatcgatatctctgactactgcaacaaagtgagaaacactctcctaaaatggttaggcttaccttgttgcattggaattggatattcaaagacacaagcaaaacttgccaatcactatgctaagaaaattaaaagttttaaaggagtatgtaatttcatcaccttagatccattaattatggaagacctcatgcaacagacatcagtcaaagaggtatggggaatcggctatcaattagtcaaacagctacaaagttatgaggtgtacacatgcctagacttaacttttgccaatgaacaccatatggcaaaggcattttctgtggtcatggcacgcaccattcgtgagctaaaaggccaatcctgtattcaacttgatgatccagctattccaacgaaacggattttagcatcacgaagttttgctcaagctttatccagtattgagattattaaacaagcacttatctttcaccttaaccgggcacatcgccgtttaatgaaacaagaacaactttgtgcctgtgttcaagttatgctttatgaaaaaaccgacaaaccgccctataaaaaagtcacatctcaagcaattggtcttcattatgcaacagatgatttatgcatacttactaaagcagctatgcagcaaattgatgttttatataaagaaaataaaagttacataaaaattggagtattattttgtgctctacacgcacgtcagcaacatattgatgatttatggcagcctctggaacttattcatcaaagacaacaattgatggaaactttaggtacagtccgtaaacgctttggtaaccactatttacaagttggatatcactcacgtaatccatcttggcaaatgaaacaatgtcatcgctcaaaaaattatctaacacgctggaatgaaatgttaacgattgaagatgcttatacccccgttacacaaaatacatga

SEQ ID NO: 3399 - DNA, 213 bp, Acinetobacter baumannii
gttcaagaaattacatttttggggtttaaagctatttttgctgaggaattaatcaatcgaaacaaaaacttgccgaaaaaggcagagaagggttgcaactcttttaaaaatctctatactttgttttgcaatggtagccccgctggtggcttcgcaattgtactctgtgaaccccgccaggaccggaaggtagcaacggtagcagatctatga

SEQ ID NO: 3400 - DNA, 885 bp, Acinetobacter baumannii
ataaaggaaattaaagctatgcaacaacctctattgaaagatttttttgatgaaaataccaatacttttagctatgttgttgcagatttagcgactcgtcaatgcgcaattattgatagtgtgcttgactatgatgccgcgtcggccactacaaaaacgactaatgctgatctgattgtcgattatgtcttggcgcaaaactttaaagtccaatggattttagaaacccatgtacatgcggaccatatgactgctgcccaatatttaaaatctaaattgggcggtacaattgcgattagtcaaaaaatctcggtagtacaagaaacattttcggctatttataattttgattttaagaaattcaatgaaaatcagccttttgattatttatttgaagattatgaacatttcaaaataggggagatagatgcctataacattcctacaccagggcatacgccagcttgcttaagctatgtgattgctgatgccgtttttgtaggtgatactttatttatgcctgattatggttcggctagatgcgactttcctaaaggaagtgctgctgcactttatgattcggtacaaaaactttatacacttcccgacgatatgcgtatgtttctatgccatgactataagcctggaggccgtgacgaatatatctgtcaaacagatataaaaactcaaaagcaaagcaatatccatttaaatcgacgagtttccaaagaatcattcataaaaatgcgtcaagaaagagatgctactttggcaatgccaaaattaattctgccttcaattcaaattaatatgaacggtggaaattttccggaacctgaagcgaatggcatccgctatttaaaaatcccatttaattacttttag

SEQ ID NO: 3401 - DNA, 495 bp, Acinetobacter baumannii
tgccacttgataataataggtgatgtaatgagatttttagttcttgcaactttatccggtttggctttaatgggttgtgcttctgttcaacaagcacctaatacacaagaaaccattcgttatgcttctagtccatgtttcggcgcatgcccaatttactcagtagaagtaacacctacaggtttaattcgttttgaaggtaagcaatatacaaaagcaattggcgttaaagaaattcaaggtagcgtaaaagattatcaaaaacttgctgatgaattaaaaacttatcgtccgcaaacaggaacccaatctaaaactgcaggttgtcagcaaactgcgaccgatatgcctagctattacatcacctggattcaaccaaatggtacagaaacaaaattaagccattacacaggttgtatctctccagcaaataatagattaaataaagttatggaaaagttacctgaacaattaggcattaaagatctaatttaa

SEQ ID NO: 3402 - DNA, 465 bp, Acinetobacter baumannii
atcaaattgatagaaaggataatgatgtcaaaattgcgtgaagacgatgctgtagaaaccatgcgtgtcgacaaatggttgtgggcagcacgtttttttaaaacccgttctattgctaaagctgcaattgaagggggtaaagtacatcacaataatgaacgtgtaaaagtttctaaagaaattcgtgtcggtatggagctcgttgttcaacaaggtttcgataaaaaaacagttgttgttaaagcgctctccaatacccgaggaccggcccctgttgcacaacaactttatgaagaaacagaagtaagtattgcaagacgggagttgattgcttcccaacgaaaattgcataatctagcacgacctgaccatagaccaagcaagaaagatcggcgacaaatcaatcggtttaaacaggataatgatcgacattatgaagatcactggtcttataatgatgaataa

SEQ ID NO: 3403 - DNA, 1728 bp, Acinetobacter baumannii
gtgaatctgatgcaaactgctaaacatttattatttgtcactaatgatccgcaacagcaagtcaatactttaatcttggctcgtaaacttgctttagtcgcaacccaacacggctataaacatagtgtcatttcactcgatgagtttgaatcaagcgatcattttgatcatgtcattattattggacagcaacctaaaaatctaaatatttttggtcaaaacgctttatctttagtttctattgaagatattaaagatgatgcagacaaagcacttttaacggcacttgaacactcaaaaccagcaaatgagtgggaacaaaaacctaagcaagcttcaaataccgcaactcattttgttgccattactgcttgcccaactggagttgcccatacatttatggcagctgaagcgttacaacaaggtgcagaaagacttgggtatcaaatcgatgtagaaactcaaggttctgtaggtgcgaagaatattttatcacctcaagcgattactgatgccgatattgttattcttgctactgacattgaagtcaacactgaccgctttgtaggtaagcgtgtctatagatgtagcactggttttgctttaaaacaaaccgacaaggcttttgctgaggcaattgctaatgctcaggttttagaacaaggtaaacagcaagcaccaaccgaaaataaggataaaactgaaaaagttggtgtatataaacacttattaactggtgtttcttatatgctgcctatggttgttgcgggtggcttgctaattgcactttctttatgttttggcctaaatgcagcggaacaagctggtagtctgccagccatattaaaacagattggcgcagcagcatttaccctcatggtccccatgctgtcgggttatattgcatattccattgcagatcgccctggtcttgcacccggtttaatcggggggttattggcagcacagttacaagcaggatttttaggcggtattgtttctggcttccttgcaggttatatcgcgttatttattgcaaaaaaagttaagctcccaactagcttagagtcccttaagcccattttgattattccattattaggaacattatctgttgggttgattatgttctatgtggtaggtcaacctgtagcgcatatttttgagttaatgaaagatttcctcaacaacatgggcacaacaaatgctgtattaatgggaattattctggcaagtatgatgtgtattgatttgggcggaccaatcaataaagctgcttatgcttttacagtcggactacttaccaccaatacctatatgccaatggcagccacgatggcaggcggtatggttcctgcaattgggatggcaattgcaactttcctcgctagaaataaatttagtactggtgaaaaagatgcaggtaaagctgcatttgtgcttggtttatgctttatttcagaaggtgcaattccatttgcagcaaaagatccaatgcgcgttattccaacctgtattctaggtggcgcagtaactggtgcattagttgctttatttcactgtgagcttgtgactccacacggcggtgtatttgtactactgattccgaatgcaatcaatcatgcgtggttgtatcttgcagcaattgcggctggaagtatcgtaacgggagtaagttatgccatcattaaaaagaatcaagaagaaaaattattaacaaactcataa

SEQ ID NO: 3404 - DNA, 828 bp, Acinetobacter baumannii
agtattatgattaatacaacatataaactgatttcaaaattgaacctgaaaaacgcaacttatgggcaatattttgaaaaagagcaaatcgatactgaacgattaaaagtgatgtattccatttacgagcagtattatgaaaataccagattttctattttcgtagatgattttaaaaataaaagcggtgcgatcttaatttttgactcagaaacagatgagattgttggtttctcgacggtagttgtgcagcatttctacttaaacggtaaagattacaccgtgctctttagcggtgatacggtcattttgaaaaagttttggggcacgcgtacattgcaaagtaccatgctcaaactcatgatcaagcttcgaattaaatatccttttaacgaactttattggcttctcatttctaaaggctataagacttatctcttacttgccaataactattatgtgtattacccaaacattaaagatgaaaaccaacatctttcggaagttgttgaacattactgtgaaaaattctttggcgaatactacgacaaagaagccggcttactcaactttggtgatgactatcaaccattaaaaggcgaagtcgcaccgattactgccgaaatgagagaaaagaacccaaatattcatttctttgaacagaaaaatccgacttggagagccggtacagaactgccatgtattggtcgacttggttggaaagatattgcccgttttcctgtaaaactgatgactaaaccgacaagcaaaggaaaatttgaagcacagttaagccataaaacaaaacgtagagaggctatccaatga

SEQ ID NO: 3405 - DNA, 1041 bp, Acinetobacter baumannii
gtgcaaatgatgaaacaatatcactctgaaactgcgccaagccttctgcaagatcaatatgggcgtatcaagcgtaagttacgaatttctgtaactgatcgctgtaattttaagtgtgtatattgcatgcctgagcatccagaatggttaaataaacaagatttgcttagttttgaagcgctctttcaattttgtcattttatggtgcagcaaggtatcgaaagtattcgcattacgggtggtgaaccattaatgcgtcaaggtattgttcatttcattcgagatctacagtctttaaaaagtttaggtttaaaacgtatatcgatgactaccaatggtcattaccttgctaaacatgccaagcagctaaaagacgctggattagatgatttaaacattagtttagatagtttagatcctgttcagtttaaagagttgaccaagaaaaaattggagcctgttttagaggggatacaagctgcaaaagaagtaggattaccttttaaaattaactgcgtgttaatgaaagatagaaatgatgatcaaatcttacctatggtgaaatggtcaattgctcatcatattcctttgcgttttatcgagtttatgccgcttgatggtgatgcactttggtcaaataaagatgtggtaagtgaggctgaaattttacaggtattgcaaccgtattattcggtacaagtcatcgagcagcaacatgagccagcgcgtcaatatctaattaacggtagctatcatttaggaattatttccacaattacgcattcattttgccaccaatgtgaccgtatacggcttaccgcaaaaggcgaactatataactgtttatttgcgcctcaaggcttaaatattaagcctcagcttcaaacgctggtaagcaaacaacatactccggaatatggtgtgtatatccaaaatttaaagaatctggttcatccttatatctggcataaagccaaaggtttccatgccttacaacatcaacaaacccgtaaaatcagcatgcatatgcttgggggataa

SEQ ID NO: 3406 - DNA, 1167 bp, Acinetobacter baumannii
aaattggagatgaacatggcgttcagacaatttgaacgcacatctttacagctaagtatgggaaccctgcttagctgtttatgtgcgtcggtggcatatgccgacaccttagcccctgtaaaacctgcgagtgtagatgcatgtgttgcccttgcttcgaatgctgatcgcctagcttgttatgatgctgtgtttaaaccatcggccttaccagtagttcaagccgcagtagtaccagagcctgttaaaaaaattgataaacctgttgttcaacctgaaacatttaaagaaaaggttgtagataaggtaagtaatatcaaagtaattggtaaggcacctacacttgaacctactacgtctttactagatcaacgttgggagttgtctgaaaaaagcaaactgggtgtttggaatattcgtgcttatcaacctgtttacttgctaccagttttctggacgagcgataaaaatgagtttccaagcagtcccaacccaaataatacggtgacagaggcccaaaaccttaaatcaactgaaagtaaatttcagatttctttgaaaacgaaagcttgggaaaatatttttggcaacaatggtgacttgtgggtaggttatacccaatcttcacgttggcagacctttaatgctgaagagtctcgtccattccgtgaaacgaactatgagccagaagcaagtttaatgtttagaacaaactatgagttgcttggcttagatggtcggttgcttggggtaactttaaatcaccaatcaaatggacgttcagatcctttatctcgtagttggaaccgtgtcatctttaatgtgggtttagaacgcggtaactttgctttaatgcttcgtccatggatacgccttgaagaagacagcaaagatgataacaatccagatatggaagattacatcggtcgtggtgatttaactgctttttataaatggaagcaaaatgacttctcattaatgctacgtcactctttaaaaggtggtgatgattctcatggtgctgttcagtttgactgggctttcccgattagtggcaagctgcgtggacacttccaattatttaatggttatggtgaaagcttaattgactataaccatcgtgcaacttatgccggcttgggtgtttcactcatgaactggtactaa

SEQ ID NO: 3407 - DNA, 1194 bp, Acinetobacter baumannii
tatatggagatagtcatgaatattcgccaagtgtctgctatttgtctttcaatagcagctactcattttgtgtatgccgcttcaaatgttacaaatcctgtaaatgatttttcccaagcaaaaggaattattaaaaatcaatatattgttatattaaataaggatgcaggtccttctaaagatttcgcacaaaatattgctaaacaacatgctggtaaagttttacaaagctacgatactgttcttaaaggttttgcaatttatttacctgatacagcaggggcagcctttattgaagcgatgaaaaagaaccctcatgttctttcagtagaaagcgatacaatagtaaatattgatgcaactactcaaagtaatccagattggggactagatcgtatagaccagaaagctttaccattaaattcggcttattcttatttacagaccggttcaggtactacggcttatatcgtggatactggtatattgtctagtcaccaagagttttcaggacgtgtattaagtggttataccgcaatatctgatggcaatggtacaaccgactgtaatggacatgggacccatgttgctggaacagtaggtggtacgacctatggtgttgccaaaaatgtcaatttagttcctatccggattttggggtgtgatgggtcaggggcctcaagtaatgttattgctggtttagactggatattaaaaaatggtaaaaaacctgcagttgtaaatatgtctttaggtggggcaacaagttcttctttagatagtgcagtggaaaatttatataataatggttatgtcatggtcgtagccgctggcaattcaaatacagatgcatgtacatcttctccagcaagagtaagtaaggccattacagtggctgcgacagataataccgatactcgggcaagctattctaattatggaagctgtgttgatatttttgcaccgggtagccaaattaattcttcttggattggaaataatacagctaccaagattttaaatggtacttcaatggcaaccccacatgttgctggtgtagttgctgaaatgcttcaaagtacacctacggcttcacctcaaacgatctctaccaatcttttaaatcaagcgagcagtaacgtagtaaaaaacccttcaggtagcccaaaccgcttgttatataaatctccttaa

SEQ ID NO: 3408 - DNA, 2325 bp, Acinetobacter baumannii
atgaaaaggatgaaaccaatgcgtaaacaacgattattgaatgacatacaaaaaatactggcacttaacttatcaatcgctgcaagcttttggggactcaatactcaagcgtttgctcatggtggaaaggccgacatggtctcactttatcagaacatgagtgagcaaggcgctaaagttgttaaagatgactttaccaatacctatacaattaccaaaggctctatagtggtgagagccaagccaaactcaaatcaggttttagtgaatggcaaacctttaaaactcagtgtcccgttattaattaaagatggtaaacctgttattggaaaagatttttttaacgaagtcttccagtcggggttagatcaaacttttaaagttgaaaatacctttcacccgctcaatagcttaaattctgacgaaatcaaaaagacatttgatgtgattaaccgctcgaaatacgcctataaaaatatgcgttttgccgagttaaagcttaaagaacctgaaaaagccaaagtatgggattactttattaatcataaagattttaaagaagatcgtattgcctcatttattttattaaagggcaatcaagcgattgaaggtgaagttaatcttaatactcaacaagttacaaaatggaatgtacttaaagatactcacggtatggttttgcttgataattttgaagccgtacagcgcgtaattgagacgagtaaagaatatcaagacgcgttacgcaaacgcggcattaccgatgtgaagaaagtgatcgctactccgctaactgttggatattttggcggtaaagatggtctggataaacaactcaatatattaaaagtcgttgcttatctcgatgtcggcgatggtaactattgggcgcatcctattgagaacctagttgctgtagtcgatttagataaagaaaaaattatcaagattgaagaaggcgcaatcattcctgtgccgatggcaaatcgaccttatatttcgaataaacccgtagcaagtaagctaaaaccactcaatattactgaacctgagggtaagaactttagcattaccggtcaaaccatacattggggcaactggtgtttgcatgtggcgttagattctcgtgttggcttgcagctttcaactgtgacttataaagataagggcgtaaagcgtaaagtcatgtatgaagggaacttgggtggaatggtagttccatatggtgaccctgatattggatggtacttcaaatcttatttggattctggcgaatatggtatgggaacacttacctcatctattattccgggaacagatgcacccgacaatgcagttttacttgatgccgtgattgcagactataaaggccagccacaagtgattccaaatgccattgccgtgtttgaacgttatgcaggacctgaatataaacatcacgaaatttttggcaatcaggatgcgagtgaagcacgccgtgaacttgtcgtgcgctggattagtacagttggaaactacgattacatgtttgactgggtattttcccaaaatggtgtaattggaattaatgcgggtgcaacgggtattgaagctgttaaaggtgttaaagcacgcaccatgcatgacagtactgccaaagaagacaccaaatatggaactttaattgaccataatattgtgggtacaacgcatcagcacatctataacttccgcttagacatggacgtagatggggaaaataacagctttatgcatatggaccctgtagtgaaagccaatgacaaaggtggtgttcgtacaagttcaatgcaaattgacagtaaagtcattaccaatgagcaaaatgcagctgaaaagtttgatccatctaccattcgcttactcacgaatttcaataaggaaaataaattaggtaatccggtttcttaccagctcattccttttgcaggtggaacacaccctgtggcgaaaggagccaatttttctaaagatgaatggttatttaaacgtttgaactttatggataagcaaatttgggtgactcaatacaatccagacgaacgctatcctgaagggaaatattcaaaccgttcgactcatgatacagggttaggacagttcattggcaacaacgaaaatattgaaaataaagaccttgtggtgtggatgacaacaggcacaacccatgtggcacgtgctgaagaatggccaattatgccgacagaatgggtttataccctaatcaaaccttggaacttctttgacaacacaccgactttaaacttgggtgaagaagagcaaagcacgcagcacgaccatcactaa

SEQ ID NO: 3409 - DNA, 219 bp, Acinetobacter baumannii
acagaagttttggtttttgttgcttttggtgctgcagctacatttgaagatgtagacggggttgctgaagcagcgctcttactacgagggctacgtgcaggtgcagtcgttgaacgagtacgtgtcgtttttggtgtattagttgctgctttaggagtagtgctgttacgcttagccgtgttagaagccgactttgatgtatttgacactttttcctga

SEQ ID NO: 3410 - DNA, 2517 bp, Acinetobacter baumannii
atcgctcacttctacatcataatgaaagtaaggatatctaaattgaatatatctatgctgaactctcggcctcaccctacacgccctttaattaaatatggaacattacttttaggtgcgcttttagcgggttgtaattcctcatcaagtttagaccccacaccgacacaaaagcagatcacaattaagcgcgataaattcggtacaccacatgtatatgcaaatgatacctatggacttttttacggctatggatattcggtagcgactgatcgattattccagatggaaatgtcgaaacgtacaggacaaggtacagttgccgaagtgctcggccccgactatcttcaatatgatattgcaacacatagccgttttgacccagaaaatattaagcaacaactcgccgcgctctcaccagaagaccgagcaatttttgaaggttatgccgcaggttttaataagcgtgttaaagaggttttagcagatccagctcttatgcctaaagagttcacagatcatggttttaaaccatcaacatggcaaccagaagatattgctatggtttgggtgggcttaattttaaatcgcttcttttcagcaagttcggaagtatcaaatttagatttactcacgcaactgcaaaaagaaaaaggtcaagaagaaggccttaaagtctatcaacaattacgttggctagatgacccaagtgccccaactattattcaatctgcacaaaaaactcagcttttagcacatcaacaacaaatacttaaagacattagccctatttcaaacaaagcagccaaaacctatctagctcaagctcgcattgctttaggcaaaagtgtggtagacggcgtacctaccgccagtaatgcatgggtcttaaaaggtgataagactattgaaggccaagcagttttatataatggcccacagcaaggatggtatacaccagcaattacctacgctattggtttacatggtgctggctataatttgacaggtataactccagttggcttgcctgcaattttatttggaactaatggcaaaatcgcatggggttcgacggtaggttcactcgatactaacgatgtttatcaactcaccctaaacccaagtaattcaaaagaatatttatataaagggacatatattccatttgaacacaagcaagtaaaaataaaagttaagaatcaagctgaccatgttttagatgtttataagagtaaacaaggctttgtaagtacatgggatgaaaataaccatacggcgtatgcacaaaaacgtagctgggaaggtgtagaaattgaaaccttattaggatgggcaaatgcagccaaagcctcaaattgggatgagtttcttgctcaagccaaacgtgtcacggcctctatcacttggttctatgccgatactaaagataatatcggtgtggctgctttaggccgtttacctattcgccctgaaaaccagcatattcagcttccagctaaaggtgatggttcaatggagtggcaaggtttttatgacttctcacacaaccctaaagaatacaatccgcaaaaaggttatgtcacaagctggaataacaaagcctatgcaggtttacgctcagattcgtcaaacttttcttatgtagatcgggtgaatgaactaattgaacctttagaaagtaaagcaaaactgagccagcaagaaatttgggaaattaataaaactgctgcatggtccgatttaaatgcgcgttattttgttccttatatgattcaagctgcacaaagtcctaaggcaacaccgttagctaaaaaagtcgcgccattacttgccaattgggatcttaaattacgccctgatagtgaagctaaatattatcaaggtgcagcaccagtaattacacgtgcatggcttaatcaaatgattgaactggtactcaaacctaacctttcagaaaatatttataagcgttataccgatacgctttatccggtaaataatgatccacgaagtgcacagccagcgagtgcatcaaaattaatctggaatgcactgcaaggaaaacaggcaagcgttcctcagaatgttgatttcttaaaaggacaaacagcagatgaggtcgtattaaaagctttagaaaatgcactgactgaactttcaaatcaatatcactctaccgacccgaatgactggaaaattccggtcgcaaccatgggcttttccagcaaaaattcggtaggcattccttgggctgatccatcgcatgaacaaaagcttagtacttatggaaatacgggaagtgctacttttagagtggttttaaatccaaatcaagtcaccatgtgttcgattttggccccaggacaaagtggttttatcaatcaaaatggaaaacctgatgcccactttgcagatcagctctctttatttgaaagttataaatgtaaagatgatgcggtgagtcaaaaagaaatcgaccaatcaactcaacaaagcatcactttaaactactaa

SEQ ID NO: 3411 - DNA, 723 bp, Acinetobacter baumannii
aaactgcacttttcatacaaaattaccgatttttgttatcatgacaaaaatcggttttttattgggtttctcgtgttcggcataacagacttaacaacatatattattggtacattcctaattgtgttattgccaggacccaattctctttatgtgatgtctattgcttcacgctatggtattaaaaccggatatatgggtgcacttggtatttttacaggtgacttaattttaatgctctgtactgtacttggtgcagcttctttattaaaagcattcccttgggtttttatcgtactcaaactcgtcggcgcactttacttgtcttatttaggttttaagcttttacaaggcagcattcaacgctggaaattacggaatcaaccccaagcagaaatggctgatttacctgctttagataaagttcacccttataaaacagccttaagtattagtttactcaaccctaaagcgattttatttttcctgtctttctttgtgcagtttgttgaaccggattatgcctatccagctttaagctttttaattttagcggtgattttacaaattattagctttagttatttaactgcgcttattttctctggaattaaactttcaacttttttcaaacaaaaccataaaattgcagcaagcggaattttcttagttggcattttatttttcggatttggcttaaagctggcaacttcaacaatgtaa

SEQ ID NO: 3412 - DNA, 879 bp, Acinetobacter baumannii
ccaattaactttaaatctatggataagacttttgaatctttttggattacctgtaaagatggttatcagcttgcagctcaattttatcctgctcaagaaaagaaagctgaataccctatcctgatttgtccagcaacaggtataactaaaaacttttatcactctttcgcaacgtggttaagccaacaaggctatgatgtattgagttttgacttccgtggtattggcgaatccctacatggagctttaaaacaaagtaccgcaagtattaccgactggggaacacttgatattcctgctgcaattgatactttattaataaaaacgaaagtaaatcaagttattcttattggacatagtgctggcggacaactactaggagtcgtacctaactataataaagtcgcaaaagtaataacggttgcaggttcaactggacatattaaaggccttaaaggaaaaaccaaggttttagcgccagttatgtttaatcttatcttccctatttctaatcttgttaaaggtcatggagcaactcaattcattggtatgggagaaaacctacctaaaaaagttgctcaacaatggcgagagttttgtagccgtcctggatatgtaaaaaacgccataggcaagacaatttttcatgattttcattcagatattcaatgtccaattactgctatttgggctgatgatgatgagattgcaaccaaacgtaacgtacaagaattattaagtttatatccaaatgcaaataaaaaaatgattgagcttagcccaaaagatttaggctataaatcaattggccatatgctgttatttaaaaaatcacatcaaaaactttggtctattttagaacaagaaattaaacattga

SEQ ID NO: 3413 - DNA, 234 bp, Acinetobacter baumannii
gacgctaacttttcattctttgtagtggatgaaatgcttttagatgctactttttggttagattcgttacgcggtactgtattcgtattgtcagaagatacctcatacatagcccaacataatgtcactgcactaacagcaactatacctatttttttcataaatattcctatcgagttaagtgttaaatttttagaaagtagtgttaaagtaaaatttattattaatatttaa

SEQ ID NO: 3414 - DNA, 858 bp, Acinetobacter baumannii
aggtcaaactttctggctaagtgcagcaatcaaattttaaaagaattaatattttttcaaaggtacaaaattatggaaaattttcttaaagatcgaaaatatattgatctctccgttactttagagaataacccatatacagaccctcctcctttattgccaaaaattgaatatatggatcatcaagaaggttggcctgaaatggaagctatgtttcccggtttagagttaaaagatttacccggagaagaagcgtgggctgcagagcgtttaattattaccacgcatagtggaacacacatggatgcaccttggcattacagctctacaactgatggcggaaaacctgcttatggaatagatgagctacctttagattggtgttttcgaccaggtgtaaaacttgattttcgtaataaaccagatgggcatgtaatatcagcatctgaagtgcaagaagaattaagcagaattggatatacacttagtcctttagatattgtacttattaatacctcagctggggcttattttggacaacctgaatatttaggtaaaggttgtggaattggtcgtgaagcaactttatggatgctagaacaaggcgttcgagtagttggtacagatgcgtggagttgggatgctccctttaaatatacaaaagagagatttgccgaaacaaaagatgcttctattatttgggaaggacataaagctggtcgagatatcggttatggacaaatggaaaaattagcaaatctagaaaacctacctgactatggatttttagtatcatgttttccttataagattaaacatgcttccgcaggttttgtgcgtgctgttgctatcttataa

SEQ ID NO: 3415 - DNA, 420 bp, Acinetobacter baumannii
aattattttgtaatttattttcttaaattaataagcaaatatggcgcttatagtctaattctcctaaaatatatttttctcgattttttaaataatatgtcttaccagttagttgaattagagaacgcaaccgctaatattatttgcccgatttgtaagtttgccgttattgattggacacaagagcaatatgttcaaccttgtgaacatacagtatttattgcaatggacttaggatttgaatttgttgctgaccgttttgaagaagttatgaaacaaaacgtagatgagttacatgaagatccgaacatgaatatttttgatgcgataacgactacaccatataaaaatttaactattttaaaagcagaacttggtgtagatggactatttcgttatgtcggtataagtgattgttaa

SEQ ID NO: 3416 - DNA, 684 bp, Acinetobacter baumannii
ttgagtgatgtaatgagcctatatgcaacccaagatgaaaagaaacaagctgctgcgaaagctgctttaaaacacttacccaaaggtggcattttgggggtaggaactggaagtactgtaaatttcctgattgatttattgcctgaactacaattagaagcagcagtagcaagttctcaagcaacagcagatcgtcttaaaaaattaggcatagaagtggttgatatgaaccatgtgggtagccttgatgcttatgttgatggtgcagatgagattgatcgtcacatgcatatgattaaaggcggcggcgcagcattaactcgtgaaaaaattgtagcctcaattgctaaaaagtttgtatgtatcgttgatgattcgaaatgggttgatcaacttggtcgtgatttcccattacctgtagaagtgattccaatggcgcgttctgctgtagcgcgtaaattggtaagcttagggggtgatccggtttatcgtgaaggtgtggtaacagataacggaaatgttattttagatgtatttaatttgaacatcttaaatgcaattgatttggaaaagacaattaacaacattccgggtgttgtgactaacggtatttttgcgttaaatccagcaacgattgcaattgttgcaacaaatgatggtattgaagagcgtactgcacagtaa

SEQ ID NO: 3417 - DNA, 1080 bp, Acinetobacter baumannii
gtgagttgtgttatgacaaatgcgaacgattcaaactggataatttatggagcaaatggctacacgggcgagttaatcgctcgtgaagctgtacgccaaggtctaaaaccaactttggctggtcgtaacaaagctaaggttgaagcacttgctcaagagttggggcttggttataaggcttttgggctcgataacgtggatgcggtaagtgaacaactccaaggctttaaactggtcatgcactgtgcagggccattttccgcgacatcgaaacccatgatggaagcttgtataaaggcaggtgctcactatctagatattacgggcgaaatctcagtatttgagttggcacaatcacttaacagccaagctgaaagagccgatattgtgctttgtccaggtgttggttttgatgtgattccgacagattgcgttgccgctgcgctcaaagaggcactgccagatgcgacccatttggcgcttggttttgattcaaaaacagggctttcaccgggtactgcaaaaacaagtacagaaggtatggccgaaggcggcaaaattcgtaaagacggaaaaattaccactgttccgttagcacattatgtccggactattgattttggtgatggtaaaaaaagtgccatgagtgttccttggggagacgtatctacagcgttttatacaacgggtattccaaacattgaggtgtttgtacctgcatttcctaaaatgatttttggcgcgaaaatgctgaactatgtacgcccggtattaaaaatcaatgctgtgcagaagtttattaagtcacgtattgaaaaaacagttgtggggccaaatgaggagcttcgagcgaaagtacctacctatgtttggggtgaagcaagaaattcacgtggtgaaataaaaaccgcccgtatccaaacggaaaacgcttatagccttaccgtaaatgggtcactgacagtggtgaattatttactcaaaaataccattaagggtggtacatatacgcctgcaaaactgatgggttataaactagtgactgagctgccgggttcaggtccactggttattacttaa

SEQ ID NO: 3418 - DNA, 837 bp, Acinetobacter baumannii
gcttctatcgtacaaggatcagtaatgagtaaagatgaacggataatccagaatcaagacaacaaaaaaacgattcgtcatgaagattacattgctggcattggtaaaggcatggcgattttagatagctttagtagtaatcaacatcgtttaaatatttctatggcggctgaaaaaaccggccttacccgagcggcagcaagacgccatttattaactttagaatatttagggtatcttgagtcagatggccactattactatttaacccctaaagtactcaaattttcaggagcttatttaggtgcagctcagcttccgaaagtgtctcaacctttattaaatcttctaactaaccaaacctctctcatttattctgtgatggtacttgatggttatgaagccattacgattgcccgtagtgctgcccaccaacaaaccgaccgcgtaaatccatatggtttgcatttgggtaaccgcttacctgctcatgcaacctcggcgggtaaaattttactggcacatttaagccaagaagaacaattggactggctccaaaaatatccgcttcagcgtttaactaaatatacgcatgtcgaaaatgataaatttttagagttactcaaagaaattcgagaacaagattggtgttattcacgtgaagagcacgaattaggtgtccatgcgctcgccgtaccgatttatggacaagactttaaagtggttgctgctttaaacattgtttcaccaaccatgagaacaactgaagaatatttaattcaacatattttgccgctattgcaagagactgcgcgggatttaagacaagttctttaa

SEQ ID NO: 3419 - DNA, 930 bp, Acinetobacter baumannii
caacaagtcgtttgtgtgtatgaccccattggtaaatcgggagacgctttcgctttagccaaagattatgcacttgaagcaaaaaattggggagctgatctatctttaaaagcatatgttgatgaacgtatagctgctgaagatttgaaagttggaaaatgtgatggtgctattattagcggtttacgtggccgtcaatttaataaatatacaggttctttagatgcagttggtgcattaacaaatatgaaaacggcaattaatgcctataagctgttgtcctcacctatggccgcaaaaaacatggtggtaggcccttatgaaattgcaggtttaggcacaattggtcctgcctatttatttgtaaatgatagaagtataaatactctcgcgaaggctgccggtaaaaaaattggggtatttaaatacgatgaagcccagccaaagcttgttcaacatgtcggtggtcaggctgtatcggtagacgttaccaatgccggtgcaaaatttaataaccatgaaattgatattgtgcccgctcctattgtggcgtttaaaccttttgaactctacaaaggtttaggtgagaaaggagcaattgttcgtttccctctgactcaaatttcggcaaattttattatacgtaaagaccaattccctgcgggttttgggcaaaagtctcgaacttgggtagccagccaactcaatagaacatttggtattattgccaaatatgaaagtgatattccttcaaaatattggatggatattccgaaaaatgaacaattaaactatatgaaaatgatgcgcgaggctcgtatacagctaaccaaagcaggtatctacgacccaaaaatgatgaactttttgaaaaaagtaagatgtaaagaaaacccaagtaattttgaatgtgtattaaacgatgaatga

SEQ ID NO: 3420 - DNA, 816 bp, Acinetobacter baumannii
ttattgaacgtgttgaagcactttaaggagaaacaaatgccatcttttcaatctgccgatgcacaaattaactatcaaacttttggcgaaccgtcgtcccctgctctggtgttttccaattctttgggcaccaattatggtatgtggcaaaaacagtttaatgagttaaaagatcaattttttgtgatctgctatgacaatcgtggtcatggttcatcatctacgcctgacggtccatatactgtagagcaattaggtgaagatgttgtccgtttactggatcatctgaatattagcaaagctgctttttgtggaatttctatgggtggtttaacaggtcaatggctggcgattcactaccctaaccgttttagtcatgtggttgtggcaaatactgccgctaaaattggacaagaacaagcatggcttgaccgtgcaaaattagtacgtgagcaaggtttacaaccaatcgcagctacagcagcttcgagatggtttacagatccctttatccaaagtcatccttcaattgtcaacaacctgtgtaacgacttaagtgctggcagcgcaataggttatgccaattgttgtgaggctttggctaaagcggatgtccgtgagcaattaaaagacatcaaaattcctgtattggtggttgcaggaactcaagaccctataacaaccgttgcagatggcgagtttatgcagcagcgcattcctcaatcaaaacttacagaaatagatgcctctcatatttctaatgtcgagcaaccagaagcttttaataaaatcttaacggattttttagtgaactaa

SEQ ID NO: 3421 - DNA, 1884 bp, Acinetobacter baumannii
gagaatgacgtcatgataactaatcgacaaaatgtgcaaaataatactaatacatcacctcatccaattaccaaaaatacacttattgatcggtttagtcctatttactggagaatagacggcccacaaaccatgtcttttgccattacaaattatggaaatggatttgaagcatcttttagatcacgtatgacaaatgacttggtagggattagctgggattcttatgatacgaaagatcataaacttttagcatatgaaaccaaatatagttatgcaggggtagtttgggattttgatattgaattatcggcttctatgcccgtacttaataatccaagtttaacgccaactttaacggtgtactatcatgacaatggcgtagataaaattgcatatatcgtcttatttaattatgcaaataatccttcgtcgcgaacggcgcatattcatattaactgggatacagttaaagccggtttttctgctacagatagctttccggtaaccaatattcaacgtatctcattttcaggctttactagccactataacggccagtcagctacgcctttaagccagccggaagatggttatattcgtattaccaattcagtcgtgactggaacaaatgcaaagttaaatctgagtcgtgttgttgtaccccagcacaattatgggatctgtaccagctatgatgaccattatgacttgaacccgcagcgcctagtcaacaatatggtcgctttgggatatcagggattggtaaaccactattgtggaatgtcgcattatcctgaaatgacatggaaaagcgatattaataaatggcaaataccggatacgttggtaacaggtgaggccgtcgtcaacgcatgtacccgaaaatggcatgaaaaatatgcccaagctctacataatgcaaacatgcaacccatttttggggtaagttttgagatgtattcacttggagcaaatgagttttgggcacagcgtgactggaatagcaatttaggtaaaacaggttaccaaccaccgagttatttctttagcttaagtgatcaaaatgctttggcttatttgcacaaagtttttattgagttcacagatacaatggttgctggtggctgtaatgttaacatacaaattggtgaaccttggtggtggtataacacggacacgaatctaccttgtgtgtatgactatccaacaaaattagcctttaatgccgatacaggactatatgcgccagacctaggcacaatctatgaggctatgaataaaacaggtacgccgtatgatgagtttaaaacttggttaagaaataagttaggacagacctgtcaaaatattcgagcagccattaaagctaaatatgcaaatgctcaagtgtgtcctttaatatttttcccatccattcgttctccaatacaaaccctagcaacctatatcaactatccaagccagcactactcatatccaaattttgattacatcatgactgaagcttatgactggcttttagaagctaaattagatttagctcatcaagctgtttctcagataccaactcaagatttaggttatccggcaaataaagttgcatatttatctggatttgtaccagatgcatctattgcttatatctatggattcgacaaaaacaaaccttatcgaactccaagttggcagaggatttttggcgatatgaaaaataacgtatctcttggcctaatgaagcagtttatctgggcctatccgcaagtcatgttcgattcaattacaattgatacgacccaagccccaaatggcttctttgttgaaaatacactttactcaccaattagtgataacacaccgtatccaccagatatttacctttaa

SEQ ID NO: 3422 - DNA, 705 bp, Acinetobacter baumannii
agctggagcgttcgcaacatgaataaggtagtgctgtttgacatggatggaactttactagatttagcttttgatgactttatctggaacgaatgcttacctaaaagacattctgaaacacatcatctatctttaactgagagtcaagaaatattaaaccagttttatcgcagccataaacatacccttgcttggtactcatcaaacttctggacacaaacaactggtgtggatgttttaaagctccagcaagaatttcagcataaaattaaagcgaggtcaggatgcatggagctgctcagcgctttaaaagcacaagattatcaatgttggttagtcaccaatgctgactgtgagagcttaaaattaaaacttgataacgttcctatccaagatttttttgaagtcatcgtatctagcgaacaaattggttacgcaaaagaagacatccaattctggaaagagttgcaacgcttgcatcattttgcgccagaaagcactatttttttagatgacactcttcctgttttaaaaactgcagaaaaatttggtataagacacttgtttactatcttacagccctcaagtcttaagagtataagacagccacaagatttagggtataaagctctagatcagcttacagagctactgtctattttgaatcaaattgatagaaaggataatgatgtcaaaattgcgtga

SEQ ID NO: 3423 - DNA, 1377 bp, Acinetobacter baumannii
gccagaagctttctacactgctctcgaacgtgtaggtacaccgcgcgcagagattgtggagtgtgtgctatgagtaaaaatatttatgatgttgctgtaattggagcaggatgtgcaggtgtcgttgcagcacgggatttaagtagtgcaggtcataaggttattttattagaggcacgtgaccgtattggtggccgaacctatacaggtgaagcatttggccgacaagttgaatttggaggtgcttatgcacactggacgcaatcttatatctggagagaattacagcgctatagtattggattaaatcctcctacagaggttgataaagtagtctggtttgctgatggcaaattacacaccggtacacaagttgaatatgcaactcttattgaacccttattaacagctttctttaatgacgctcgtcaatggttccctcttccatatgatatctctgttattgataccagtgatattgaacgacaaacattaagagatcgtcttgatgccttaaatttatcaacttatgaacgtgacgttttagacggcttgttatcaacacttgttcactcttgggatgagcaaggaatcgcacagctcttattctgggcagctacctattttggaaactggggggcgttctttgaagtagcaggctcttggccaattgcaggtggcacacaaaaactagtaagagctattcataatgattcaagtgctgaattacggctttccacaccagttacaaacatagatgatcacggtgagcaagttgttattaccacgcaatctggcgaaaagatcatggcaaaaaaagcactggttgcccttcctttgaatgttatagctgacgtcaaaattacaccagacgtaaaaaaacctgttcaggacatgattgacgcaaagcaccccatgcagacagctaaattatgggtattggcacgtggtaaattcgaaccctttgttgcatttgccccagttgagcaaaacccgattaataccgttcgcgttgaatatgaacatggagatgactcaattttagtctgttttatttcagacgagtcaacaatagataccaatgatattgaagctgttcaaaaagctttacagatgtttaagcccgatattgaagtgcttgacgtcgtatcacataactggacaaaagatccttatgcacaagggacatgggtacactatcgtcctgggcatttgacggatgcggctccattcatgcgtaaacctcatgggaatatctatttcgcaggaggagatattgcaacaatgagcatgggcggtattgaaggtgctatagagtctggtattgaaactgctgcaagcatcacacatgcattagctcaaaaattagcaggatga

SEQ ID NO: 3424 - DNA, 207 bp, Acinetobacter baumannii
tacaagagcttaattttgcttaaattaaaattggctttcatgacaatccatcacagcatagccagtcagaaacgtctaagcaagcctgtactaaaaaaagaagaaaacctcctaagtgaagaggttttctatcagattacttctcttataaacagcttatgtttacttaaaggtaaatatctggtggatacggtgtgttatcactaa

SEQ ID NO: 3425 - DNA, 336 bp, Acinetobacter baumannii
aataatatagttaggctcatttttatgaatttagaattagatcaagatggtcatttagtcgactatacgatttggaatcccgaagtagcacaggaactcgccaaatctctcgatcttgaattaacagattggcattttgaagttttagctgcggttcgccaattttatcagcaatttgggcattctcctgcaacacgtcctttgattaagtttttgatgaaaaccgtcagtccagatattaataatgctgttttacagcaaaaatttaataccggtttagttgctcgtcatctcagtcgcttggcaggtattcctaaaccggcaaattgtttatag

SEQ ID NO: 3426 - DNA, 828 bp, Acinetobacter baumannii
gaaggaatagttttggcgacaccatatataactataggctgccctactactggcggtggtcaagtaatctcagggaatagtatgttcctgattgacggaattcccgttgcctgtgttggcgacaaagcaacttgcccaactcataaagtcgttgcgactattgtctccggtgatccaaacatgcagatcttcggcaaagccgctgctcgtgttaatgattcactctcttgtggttgcaaattactgcctcaacaaaacttagttgttcaagacaatggtggtgcagcatcatcgggtgcaaaatcctcatcagctccaatgtcacaaaaacagcagactactgatagttttagagaagaaaaatatgaaaactattacattgagcagtataaaactgatgtctacattagccataaggctgttcttttaggtgatgaaggtgtaacacctctggatggagctgtaagctattttctaaactacaaagttcaaggcaaggaactatttttaagtgtagttattaatgcagctccattaagccacaagggaactgtttacccttttgggaccgcaattgtttcacgggaaggtaaagagattgccagaaccaagttaaaaagtgatcaaggatattggccaacagataaaaataaggcccctttgggaagttgtactatcaagttgccagaaccaaatttacagctcgttgatgtagaacttgaattaggatataccgcagtaatttcggataccgtgggttctgtacatcccatgcctcctattaaaaaatataagttttccttaaactctgcggcgcgcaaggtgtaa

SEQ ID NO: 3427 - DNA, 885 bp, Acinetobacter baumannii
aaatatggcttttctacgttagtttgccatagagctattttatatcatgcctctataaacgtgaggaagatgatgatgctatatgagctatttttatttggactactgtcaggagtcaccacttggttatttggttttggcggcggatttgttgctgtacctttgctttatacagtcattattcaaaagtggagcaatgaaagtagtgtcggcatacatgctatgcaaatcgccgtagccacctcggcctttgtcatgctctgctcggcaagttttgcagtctttcggcactatcggtctggacatatagattggcaaaaaatccgctttttgtggggtggtattgcacttggtggaattgtcggtgcggtaatggcctcattgtttaatggtaattggcttcgctggatatttatgggctatgtgttcataaccattctagattgttattaccgaccagggtttatagtgacctcaaggcaaaagcaacactatggtcaaaacagtgaactcattaaagggggcattattggttgggttgcagcacttttaggtgtgggtggcagtgtaatgacggttcctttattacggcggcggggcagttctatggcagaggccgcggctattgcaaatattctcacgctgcctttgtctttaactgcaacgctgacctattgtgtgttgtcggtatggcaatctgaatgggcacctagtggatttatcggtctaatctggtttgaaactgctttattcttggttgcaggaacatggatcggactatatttttcagaaaaatttatttcaaaactgccggatttatggcgggcaaagttatatccgctacttttaataatagttctactcgtcatgttttttttaaattaa

SEQ ID NO: 3428 - DNA, 198 bp, Acinetobacter baumannii
tctacaccagttggtcgtattacaaaatgtggggcgttattactaacaaacatatcgagtcaaactcgcatagcctgtactaataaggagaagcaaatgtggtatttcgcatggattcttgggattttgatggcatgtttcgcgggtgtattgagcgctctttatatcgaacatcatcaaaatttagatgaggaataa

SEQ ID NO: 3429 - DNA, 543 bp, Acinetobacter baumannii
attacaggcttcttagtaagccagaggcacaatgacatgaatttgtatccaatacctgctgattttattaatgaaaaggtgaacctttcatggtgtgatatcaaatggggctatgaaaacaatcttctcacttcagaaataccaataaaaaaagcagagaatagtttattaacggaaaactatactaacactgaacttgagttgtcattccttatcccgagtgaatcaaatgacatcactccttttattaatgaactatgtcctaactttaaagaagatgaatatgagaacattagtgaaaaatggttatatgtaattcttagctggctttgggctaatcgtgaaagctttgaagatccattagatgaggtggaaaatatttatacagattttgattgtccagccgaaatggatagttttattaaatatatgcctcctactgatggatacgatccctcattgtattcttatgcagaaaatattaatcgcttaatgaagaattgggagagctacttacaaaagagtgctgaaaagtataagtga

SEQ ID NO: 3430 - DNA, 1161 bp, Acinetobacter baumannii
tggggaggctttatcatgattgaatatgaactcctaaaaatcatatggtgggtgttagttggagtcctactcattggatttgccctaaccgatggtttcgatatgggctcaatggcactcatgccttttgttggtaaaactgataacgaacgccgtgctgctattaatacaatcgcaccccactgggatggtaatcaggtctggtttatcactgctggtggtgcactatttgcagcttggccaatggtatactcggtcgcattttccggaatgtattgggccttattacttgtgctatttgccctgttcttacgtcctgtaggttttgactatcgttctaaacttgaaaatacccaatggcgcaactcttgggactggggactttgtattgggggtgccgtaccaacgcttgtttttggtgttgcctttggtaatttattcttaggtattccttttagtttagacagtacattacgctcggaatattcaggtagcttctttgctcttcttaacccatttgctttagtttgcggtattgtcagcctttctatgttgtgtgctcatggcggcgcttggcttatgctacgcacagacggtgccttgaaacaacgctctgctaaagcaactcaaattatggcagccatatttttagtttgtttccttgtaattggggcatggttgtacttcggtcaagtcccaggttatagctatgctgctgcagttgatccaaacgcagcacttaaccctttagccaaagaagtagtcacaaacaacaacccaggctggatgaataactacagcagctatccgattacaaaagtagctcctgtactggcaattttaggggcaattattgccttctttacagcatcaaaagccaaagcaggtttaagttttgctggcacaagcttaatgattgtaggtgcgattttaactgccggttttgcactcttcccatttttattgccatcgagtgttaatccaaactctagcttaacaatgtgggatgctgtatcaagtcatcgtactttaggggttatgactgttgctgcatgcatattcgttccgatcattttgatctacaccagttggtcgtattacaaaatgtggggcgttattactaacaaacatatcgagtcaaactcgcatagcctgtactaa

SEQ ID NO: 3431 - DNA, 189 bp, Acinetobacter baumannii
attcgccaagtattgctcaaatttgatagcagtctgattcctagctataaaaatgaagaagattttattttatggttagcagacttcattgatcggatcaccatagatacaagtaaaggagattatccaataaaaaagaatttagccaacctaagctctattgctgagaaattgatctatagacattaa

SEQ ID NO: 3432 - DNA, 1170 bp, Acinetobacter baumannii
aacctcaaagtaaattggagaaacaatatgacagggatcgtagatattgccattatcggtggtggcatagggggcatgtgcgcagccatccaacttaagaagcttggaaaaaatgtatctttaattgaaattaaagatacgcttaagcccataggggctggtattaccttaagtgcggcaacgcttcgcgcgcttaaagaagttggtgtcgtacaagagttatttaaagtatctggccaattttcacaattcgatatgtacacatcagatggtcataagattgccgaagcgcccattaagccagctattggtgcagaagatttagctgcaaatagtattggggtgatgcggtccaagtttgctgaagtattggaaaataaattacgtgagttaggcgtaaacgttattttgggtactactgtcgacaagttggaaaataacaaagattccgtcaaggttctatttaccaatgggcaggagcaacaatttgatttagtgatcggagctgatggcatacattcaaaaatacgccatctggtctttcctgaattacctgaaagtacttttacccaccaaggggcatggcgaattgtagtgccaaaatattttaataacttttcaatgctgatcggtaagacgcttaaagcttcttttagtcctattagtgattcacaaagctatatgtgcgtattagaccgtcatgaaagtgatgattttattgaacagcatctatggcctgaaaagttatctggtttattagctgaatttggtagcgttgttcaggaagtaaaagctgatatcgatcaaggaaaaattaaagcagaagatattctttatcgtccattacataccttacttgttgaagagtcttggcataaaggtcgtgttgttctattgggtgacgcagtgcattcaacgactccacatcttgcttcaggagcgggtcttgcaattgaaggagcgattcttttaagtgaagagttagcaaaagatcagcctttggaagatgcattaaatcattatcaagaacgacattttgatcgagcaaaaatggttattagtgtctcgactcgtctaggtgaaattgagatgagtaatggctcacctgttgagcatcgagagttggcaactaaagcatttgaagcattaacacagccgcttaaggcttaa

SEQ ID NO: 3433 - DNA, 1230 bp, Acinetobacter baumannii
aggacaaaagttagaatgaaaaacgcttatatcatcgatgccatccgtactccattcggccgttatgccggtggccttgcacctgtccgtgccgatgaccttggcgctgtgccgattaaagcgctcatgcagcgtaacccaaatgtagattgggaacaggtcgatgatgtgatctatggctgtgccaatcaagccggtgaagataaccgtaatgtcggccgtatgtcagcactacttgcaggtttaccatatcaagtgccagcaaccaccattaaccgtttgtgtggttcatcactcgatgccattgccattgctgcccgtgccattaaagcaggtgaagcaaatctagtaattgctggtggtgtggaaagtatgagccgtgcgccctatgtgatgggtaagtctgacagtgcctttggccgtagccagaagattgaagacaccaccatgggctggcgttttattaaccctaaacttaaagaattgtatggtgtagacaccatgccccagactgccgaaaacctcgctgaacagttcaacgtcaatcgtgcagatcaggaccagtttgccttggtgagccaacaacgcaccgcaagcgcgcaagccaaaggctttttttctaaagaaatcgtggcagttgaaatccctcagcgtaagggggatgctgttgtgattgataccgatgagcatcctcgtgcatcaaccacccttgaaggtttaagcaaacttaagcctgttgtgaaagcagatggcacagtcactgcgggtaatgcttcaggtattaatgatggcgcagcagcactgctgattgcttctgatgaggcagttcaatcttacaatctaaaaccacgtgccaagattattgcttcgacagctgtaggtgtagaaccacgcattatgggttttgctccagcaccagcgattaaaaaattacttaaacaagccaacctgactttagagcagatggatgtgattgagctgaacgaagcctttgctgcacaggctttggcagtgacccgtgatttaggtttgccagataattctgacaaggtaaatccaaacggtggtgccattgctttaggtcatccacttggtgcatcaggtgcacgcttagtcactacagccttaaaccagcttgaacagacaggtggtcgttatgccttgtgttcaatgtgtattggtgtaggccaaggcattgctttgattattgaacgtgttgaagcactttaa

SEQ ID NO: 3434 - DNA, 1671 bp, Acinetobacter baumannii
aatgaaagagttcggtcatccactcaaaaacaaacttgctcatatgcaacccgaattaccgatcggttcagttattactctctaaggaatataaaaatggtcattggacacaactttattggcggttcacgcagcgcacaaggtacaaccttattaaaaagtattcatgctacgactggtgaagctttgccttatgagtttcaccatgcaaccgagcaagagattaatcaggcttgtgaagccgccagtcaagcgtttaagacttaccgccataccacacctgaacagcgtgctgtttttttagaaaatattgccgatgagctcgatgctttgggtacagattttcttgaaatcgtgtcacaggaaaccgctttgccacttgcacgcttacaaggtgaacgtgcccgtaccagtgggcaaatgcgtttgtttgccaaagtattgcgccgtggtgattttttaggtgcccgtattgatactgctttacctgagcgccagcctttacctcgcccagacctgcgccagattaaaatcggtgttggtcctgttgcagtctttggagcaagtaactttcctttagcattctcaactgcgggcggtgacactgcttcggcactggcagcaggttgctctgtagtgatgaaagcccatagtggacacatggccacagcagactttgtagcgcaggcaattgagcgtgccgtagaaaaatcaaatatgccaaaaggtgtgtttaatatgatctacggtaatggtgtgggtgaaccactggttaagcatcctttaattcaggctgtgggttttacaggttcactgcgtggtggtcgtgctttatgtgatatggccgcagcccgaccacaaccgattccggtgtttgctgaaatgagtagtattaacccgatgctgatgttgcccaaagccttaaaaaaccgtggtgacaaaattgcacaggacttggcagattcagtagttttaggctgtggtcagttctgtaccaatccgggtttaattttaggtattaaatcagctgaatttagccagctcattagcaagctgactgaaattatgggggctaagcctgcacagactatgctcaatgccggcaccttaaaaagttataccgctggtcttgagcacttaaccgagcatcaaggtattgaacacttggcaggtcaaactcaacaaggtaatcaggcgcagccacaactgtttaaagctgatgttgagcttttactggcaggtgaccagcttttacaagaagaaatctttgggccaaccacagtcatcattgaagttgaagataaagcccaactcattcaggcactacaaagcatgaatggacaactgactgcgactttaattgctgatgaggctgacttaaccgagtttgcagatgtagttcctgtgctagaggaaaaagccggtcgattactcataaacggctacccaacaggtgttgatgtgtgtgatgcgatggtacacggcgggccatacccagccacttcagatgcacgaggcacctcagtcggaaccttggccattgaccgttacttgcgccctgtgtgttaccagaactatccacagagtttattgccagaagccttaaaagacagcaacccattgcagattttaagactggtcaatggtgagatgaccagagaagcgatctaa

SEQ ID NO: 3435 - DNA, 498 bp, Acinetobacter baumannii
aagggaagagtttatatggttgctcaaattcgtattggacaaggaatggatgtgcatgcctttgaagagggtaacttcgtaaccttagctggcgttcaaattccgcatacgcatggtttgaaggcacattctgatggcgatgtcgtgctacatgcattatgtgatgcattactaggtgctctagcacttggtgatattggtcagcattttccggatacagatccagaatttaaaggagcggatagccgtgttctacttaaacatgtttatcaattaatattagaccgaggttatcatttaaataatgctgatattacggtagcttgtgagcgtcctaaattagccaaatacaatttggaaatgcgtcaaagcattgcagatgttttaaatgtagatttaaatcaaattagtatcaaagcgaccacaaccgaaaaacttggatttactggtcgccaagaaggaattttagcaacagcgacggtgttaatatctcattaa

SEQ ID NO: 3436 - DNA, 1425 bp, Acinetobacter baumannii
tccaattcggtcaacctttattccgttatcgcgcgtaataccccggggacatctatgttgcaaaaagttttaattgcaaaccgtggtgaaatcgctttacgaattacccgggcttgcaaaacattaggaatcaaaactgttgggatctattcagatgccgataaagatttgatgcatttacgtttcgttgatgaagcagtatgtattggtccgggtgcaagtagtgacagctatttaaacatcccggcaattattactgctgcagaaattactggtgccgatgcaattcatccaggttatggcttcctttcggaaaatgccgagtttgctgaaattgtagaaagctcaggtttcacatttattggccctcgcccagaacatattcgtttaatgggtaacaaggtttctgcaattgttgcaatgaaaaaagctggcgtacctacggtacctggctgtgaccatgctgtaactatccacaatgccttggctgaagcgaaagaaatcggtttcccgcttattgttaaagcggcagctggtggcggtggtcgtggtatgcgtattgttgaacgtgtagatacactacttgagtcagttcaagcggctcaacgtgatgcagaaatgtggttcggcgatgataccgtatacatggaacgcttcttacaaaaacctcgccatgtcgaagttcaagttttgggtgatggtaatggccacgcgattcatttatatgaccgtgactgttcattacaacgtcgtcaccaaaaagtgttagaagaagctcctgctccaaatctaccggaacaagcacgtgctgatattttacaagcctgtgtccacgcatgtcagttaatgcaatatcgtggtgctggtacgtttgaattcttatttgaagatggtgaattcttcttcattgaaatgaatactcgtgttcaggttgagcaccctgtaactgaaatggtaactggggttgacattattgaacagcaattacgtattgcagctggtttaggcttagagcttcaacaagaagatattgaagttcgtggtcatgccattgaatgtcgtatcaatgccgaagatccaacaacattcttaccttcaccaggtaaaattgaaagtttctatgcaccaggtggtgcgggtattcgtttagattctcatatctatcctggatatagcattccgccatattacgattcaatgattgcaaaattgattgctcatggtaaagatcgtgaaacttcacttgcccgcatgcgtcaagcgttagatgaaatgattcttacaggaattaaaaccaatattcctttacataaagatcttattttgcaggataaaaacttctgttctcaagcaatggacatccattaccttgaaaaacacttattaaaacaagtggaagaagaaaagaaagctgaaactgcataa

SEQ ID NO: 3437 - DNA, 1068 bp, Acinetobacter baumannii
agtattgaggtttttgagatggatgagaataaaagcaaagcattacaagccgctttgagccaaattgagaagcaatttggtaaaaatacggttatgcgtcttggtgataacactgttcaagcagttgaagccgtatctacaggttctttaactttagacatcgcattggggattggtggtttaccaaaaggccgtattatcgaaatttatggtcctgaatcttctggtaaaaccacaatgacattgcaagcaattgctcaatgtcaaaaatctggtggtacatgtgccttcattgatgctgagcacgccctagaccctcaatatgcacgcaaacttggtgtagatattgataacctacttgtttcacaacccgacaatggtgagcaagcacttgaaattgctgacatgcttgtccgttcaggcgcaattgatttaatcgttgtggactcggtagctgcacttacacctaaagcagaaatcgaaggtgagatgggtgactctcatatgggtctacaagcgcgtcttatgagccaggcacttcgtaaaattacgggtaatgctaaacgttcaaactgtatggttatcttcattaaccagattcgtatgaaaattggtgttatgtttggtagcccagaaactaccactggtggtaacgctcttaaattctacgcttcagttcgtttagatattcgtcgtatcggtcaagtaaaagaaggcgatgaaattgttggttcagaaactaaagttaaagtcgttaagaacaaaatggctcctccgtttaaagaagctattttccaaattctatacggtaaaggtactaaccaactaggtgaacttgtagatttagcagtacaacaggatatcgtacagaaagctggtgcatggtattcatatcaaggcaataaaattggccaaggtaaaaacaatgtaattcgctattttgaagaaaatactcaaatagctgaagaaattgaacgtaatatccgtgaacaattgctgactacaggcacaaatggtgcagttcaaattgaagatgaagaagagccagatcttttattagaatcgtaa

SEQ ID NO: 3438 - DNA, 672 bp, Acinetobacter baumannii
ccgtcgttattaaattttatgcatgatccagtccttgagtcacatcatctcgtatgtgaaaaaacccaaacacgccgcggtatagagcgtcgtttagctctattgctaagcgcaaccgagctgtttttggaaaaaggatatgatgctgtctctcttgacgacatcgttaatcatgctggtggttcaaaaacctctatttataaatactttggtaataaagatggcttatttactgcaatctgcgattatcgccgtgaaatgttttttaaagatatctgtattgcatttcaaccagagcaaacttctttaaaagattatttaatccaaactctcatccgtttttataagcacattattcaacctgaacacattgcctttttacgtttggttattgaacaaactcaatgtaatgcaactttgagccaatacttatatgaaaaatgtgctctggatgtccaaaatacaattgctcaagccttactcatatctcatcaatcaggtgaaattacctgtacatctcctgatcattcctctcttatgtattttggaattttacgcgatattgaatggcgaatgattatgggaatgcctctcccacctaatgaaacagaagtcattgattatattaactattgtgttgatattttcttaaagggccatcataaagtctaa

SEQ ID NO: 3439 - DNA, 927 bp, Acinetobacter baumannii
aaaggtatattaatggaattaagacatctacgttattttgttaccgttgttgaagaacagagtctgacgaaagccgcagaaaagctttttattgctcagccacctttaacacgccaaatcaaaaaactagaagaagaattagggatcgatttattcgaaaaaggctctcgtccattaaaagtaacagaagcagggctgtttttttaccagcatgcggtgcaaattttgacgcacaccgctcaagctgcttcgatggctaaaaaaatgaagctggtcgagaatgttgttaaagttggttatgtgagttcgcttctttatgggcgattaccacaggtcatttatctatttagacaaaaaaatcctgatattcatgtcgagcttattgaatgtggtacacgagatcaggtggaagctttaaaactcggtaaaattgatttaggttttggccgattaccaattagtgatccagccattaagcgacttctacttcgaaaagaaaaattaaaactcgcaatccataaaaaacacccattaagtgatttccaagagtcaggaatttatttatctcaaattatcaatgagacaattttttcttatccaaccacacctaaaccaaatttttcgaccactattcaagctttatttaccaaattaggtcttgttccggccaagctgactgaagtacgagaaattcatatggcacttggcttagtggcatccggagagggtatttgtattattccggaaagcgcctgcgacattggaatgaagaatctaacttatttaaatatcttagacttagaagcctatagtcccatctctctatccatgcgcaacatggaccaaagttcctatattcctaaaatcttagattgtattgaagagatctatagtgaagaagaagtatccagaaatttgaatttataa

SEQ ID NO: 3440 - DNA, 1332 bp, Acinetobacter baumannii
aaggtagtatttaggtcgaaactctcaggtacaaatgacagatgggctgtactgatgaaatgttcttgcatttcagaggagtctgttatgccacatgttattgtgattggtgcaggaatcacaggggttacttcagcctatgaattatctcaattaggttaccaagtcacagtgattgatcgccatctttatccagccatggaaacatcatttgcaaatggagggcaattatctgcttgtaatgcagaagtctggaaccagaaagcgaccgttataaaaggttttaaatggatgaggcaaaaagatgctcctttattattgaatccttcctttagcctacataaatatagttggttggttgagtttttgtctcatattaaaaactatgaagccaatacaatagaaaccgttcgcttggcattgcttgcgcgtaagcgattgtttgacgtagctgaaaaagagcagcttcaatttgatctggagaaacgcggtattcttcatatgtatcatactaaggatgattatgacatcgccaagcgagttaatgatgtcctaaataaagggactttagaacgttactcggtttcacctgaggaaatgaaatcaatcgaaccttctttaacgggtgagtactttggtggctattacacaccaagcgatgcaaccggtgatatccataaatattcaacctctttagctgaaaagactaaacaatatggcgttcagtacaaattcggtttggaagttactgatattaagtgtcatacagataaagtggtactgaattgtcagccaagtgctgagcatccgcatctttcccaaacagacagctttcaattagaaggtgatgttttggtggtttgtggtggtgtaggaagttatcagttggctgatatgattggtgaacgtgtaaatgtttatccggtcaaaggttattcaattaccgtccaattaaaagatgaaaaaagtataaaaaatgcaccgtgggtgagtttgttggatgagagcgctaaaattgtaacgtctcgtttaggaccagatcgtttacgtgtagcaggtacggccgagtttaatggttataatcgagatattcgagccgaccgtattcaacctttggtaaattgggtaaaccgtaattttgacatttcaactgagcatgttgtgccttgggcgggtttaagaccaatgatgcctaatatgttaccagttgtgaaacagtctaaacagtctcgagttttctataatacgggacatggtcatctaggctggactttgtcagcagctacagctgttttggtgagtcaagacattcaacaaaagtatccagcataa

SEQ ID NO: 3441 - DNA, 1332 bp, Acinetobacter baumannii
aaaggattttttatgtctacagaatattctcaaccaagtgcgatagagcgcgaaacaatgcgcaaggtggcgtggcgattactgccttttttaacaatttgttatgtcatcgctattattgatcgtggcaatattggcatggcttcattacaaatgaatgaagatcttggattaacagctacagcctttggtttcgccagtagcttatttttctttgcatattttctatttgaagtacccagcaacttagccatgcaaaaatttggagcaaaagtatggattgcccgaattatggtgacgtggggagtaatttcatctgcaactgcatttgttgagaactccacctcattatatattatgcgctttttactaggcgcagctgaagcaggctttttccctggtgtaattttatatttaacctattggttacctgctaattatagagccagaatggtggcaatattcatggtagcaattccaggtgcaaactttctaggttcaccattatcaggatttttattatccctagatggctggatgggtatgcgtggatggcattggttatttattttagaaggtatccccgccgttttactgggtatcgcttgtttatttgttcttactgatcgaccagaacaagcaaaatggctcaatagtgagcaaaaatcttggttagttgaaagactacaatttgaacgccaacaaaaaactccaatcggtcatatttcactatggcaacttttaaagaataaatacatctggtctatgattattatttattctggtgcttctgctgcaggcagtacaatgagtgtttgggcaccgcaattaattaaatcattcggtttaagtaatgtagaaattggtttggtgaatgcaattccttatggtatagcttctattgccatgattctttggggccgcagctcagatcgtaaaaatgaacgcctttggcacacagcaatcgctctattgatgatctcatttggtttattaattgctttgttcacatcttcacttattggcacaatctttttacttagtatcgttttaattggtgcttattctgcaaaaggtccattctgggctttagcatcctcatggatgtcaccgactacaacagcggcaggcctagcagcaattggtgcatgtgccaatctgattggtggcggaatgatggtgaatatctatggcgcaatccatgatgcaacaggaagtcatgctatcgccttacttccacttgcagccttaaatctcgtgtcagctattatggttttcatcatgtctagaaaaaaagctgttttgtttacacaaccacaaagtacttcataa

SEQ ID NO: 3442 - DNA, 183 bp, Acinetobacter baumannii
gttgagtcttttaaatgtagtaatgcgtataacgcatttgtcttatgggtctttcaagctgtctttgttaataaagacagctttttttataatgtgcttaagtattttttagagtttggcttgattgtagcaatcgagattaatgcattgtgcactcagttctatgatttgatcaggggctaa

SEQ ID NO: 3443 - DNA, 741 bp, Acinetobacter baumannii
ttcaatacattaaaattgatatcaagatattgtaggaaaaacatggttaaaattaaacctcacccagcaacaagcggaaatgcatcggctgatcgccttttaactttgttaactgcttttagaataggtgataaatctttaaccctagcagaactcgcagaacgaacagaattaaataaagcaaccatcatgcgcttaatcgtttcgctagaagattttggttttgttaaccgtctttcggatggcagatatacgcttgccagcgaagttatgcgtttaaatacaatttatcaagatgcgttagacttagaaagacatgtaatgccttgtttacagcaacttgtagatgaaattggtgagacagcttctttttacgttaaacatggagcttatcgtctttgccaatatcgaataaactctacccatcgactgcgtgttcatgttcaaccgggcgaagttcgaccaatggatggagcagcatgcgctcaagcattgaaatcaacatatgaacaagttttagcaagaactgaacctttttattcaactggtgtaacagaaccccacgcagctggaatggcattgcctgtgtttgatgctcaaaatgaggtagtaggagccttactcatttcaggcccatcaagccgttttactgcggaagttgcaaaatctgtaggtgattttttcttcaaaattgcagatgacttaacgaaaagtttaggtggtaagagtattcgtaattaa

SEQ ID NO: 3444 - DNA, 858 bp, Acinetobacter baumannii
atgtcacaattaaaaccacaagaagttgtacgtttaggcgatatacaaatggcaaatcatttgccatttgtattatttggcggaatgaacgtactcgagtcaaaagatttagcttttgaaattgctgaaacttatattgatatttgtaaacgcctagatattccttatgtatttaaggcgagttttgataaagcaaaccgttctagtttgcattcattccgtggtcctggacttgaaaaaggtattgaatggttaggcgacattaaaaaacattttaatgtaccaattattaccgacgttcacgaaccatatcaggcagcgccagttgccgaagtcgctgatattatccagcttcctgctttcttaagccgtcaaactgatcttgttgaagcaatggcgaaaacccaagctattatcaacattaaaaaagcacagttcttggctcctcatgaaatgcgccatattttgcataaatgtttagaagcgggaaatgacaaacttattctttgtgagcgtggctcagcatttggctataacaatttagttgtagacatgcttggctttgacatcatgaaagaaatgaatgtacctgtattctttgacgtgactcatgctttacaaactccaggtggtcgttcggattcagctggtggtcgccgtgctcaaattacaacattggcacgtgctggtatggcaacaggtttagcaggattattcctagagtctcatccagatccagacaaagcgaaatgtgatggaccatctgcattgcgtttgtcacagcttgagccattcttggcacaactaaaagaattggatactttagttaaaggattcaaaaagttagatactcattga

SEQ ID NO: 3445 - DNA, 1002 bp, Acinetobacter baumannii
aactgcaaattttatgtcttaaagggctttgaaaaaagtttaaaaattagacttgaaatatattggctttgtgccactatatattcatcgaaggtcatcagacaaaaagaggatgatatggctatccagcttttagatgcggcaagaaacgaaattccagtgaaatttacgcagttttctggtggcgagcgtcatgttcaaattgatgagacaaccttaggttcactatatggcaatgtattggttcgtgcacacatggcctcaagtcacgatgtgatggactatttactacttgaaaatatattgctgactcagggtctaaccattgacctagaagttccgtattttccatatgcacgtcaggaccgtatttgtgcagtaggccaagcgttctcgcttgatgtgatgaccaagttactcaacatcaatgctgacaaaaaagcgggcaaacaaggcaaggtgactgtttgggactgccatagtgaagtaacaacagcattacttgctgccaatacttcttttagcgaagttgtaaatgtcagttcagtcgacatcatcgcaaagagtgaagcgctaagtacattgttaaaagatgaaaaaacagtgttggtttgcccagacaaaggcgcaaaagcgcgtacacaaatggtcgcagatgcttttaattctaagcgcaaacaaccaatcactattattcagtgcgataaaaaacgtgatccagtaactggcaaaattttaggtacacatgtacatgcgactgatttatcaggcctcacagcggtcattaccgatgatatttgcgacggcggtgcaacctttattggtattgccaaagaactccgtcgcctcaattgccataaggtcgttctatatgtgacccacggtatttttagtaaaggaatagaggtttttgatggactgcttgaccagctatttacctcggacagttttccacaacaaccatcagacaaaatttcagtaattgcttttgcagcagaataa

SEQ ID NO: 3446 - DNA, 1011 bp, Acinetobacter baumannii
atgagcaaattagaaaagactcaattgcaactcggctatattcctttacttgattgcatcgctttactttgggcaaagcagcaaggtttcttcgaagaagtcgatttagatgttaccttagtcaaagaagcatcatgggcaagtctacgcgaccgtttagcttttggtttattagatgctgcacattgtttatctgcaatgctccctgcagcagcaatgggtgcagatcaaattggtattgcactgcaaaccccgctcgttttaagtaaaaaccgtgcttttatcagcttaagccaaaaattaattcatcaactggctattaaagaaaatgataatgcacaaactaccgcccaaaaagttattcaatacattgaacaagatcatactctttctctagcccatgtatttaaacattcaatccatcattattgtttaagagaatggcttgctttggcagactctagaatagctcaaacgctcaaactcaaagcacttccgccaccgtatatggtcgaagctttagataaccatgtgattgatggtttttgtgtgggagagccttggaatactcaaggtgaacttttaggtttaagtaaaatcgtctgctcaagtcaagacattattcccaatgtggcagataaagttctcgcagtaactcaagaatgggctgaacaacatcctcacaccttagttgcccttacaacggcaattatgaaagctcaaaaagaattgagtaatttaaaagattttgcacctgtcttaaagttattggtcgagttcgggattgtccgatttcactgttctgaagaagtgcatgtcgataaatattatatgattcaaaatattgtaaagcacttggttaaagaaaatgcggctccacaacctgaagatttccattggttatttcagcaaatgcaaaaatgggaaaaacttcaattagcccctgatcaaatcatagaactgagtgcacaatgcattaatctcgattgctacaatcaagccaaactctaa

SEQ ID NO: 3447 - DNA, 1164 bp, Acinetobacter baumannii
atgtcaaaattaatacagcctatcagttttaaggctttgtttatatttactcctcttctgtttgtatcaataggttgtagtgaaacgctatattcccaaacaatcccatcagtaaagtcttcttcagaaaatatcgactatccagagatcgatacagcattaggagaaaagttacaaccgaatgaggaagtaatagctcatcaaataactcaagttattgagaagtcgattcgtgaacagtatacggcgggaaatgctttgcgtgatgcacaccctaaagcacatggatgtgttcgtgctgaatttcatgtacttaaaaatataccagctcaacttgcaaaaggtatttttattccagataaaaactatgaagcatggattcgtttttcgaatgcttctaatgatgcttctagagcagatattgaaaaagacgcacgtggaatggcaataaaaatcttaggtgtatcaggtcagaaaattttagaaaatgaaaaagaggccacaactcaagactttattatgattaatcaccccgtcttttttgtaaatgacgggcaaagatatctttcttttatgaacgatctaaatagccataatatgatcagaaagcttcatatgccgtttgctttaggttttaaaggtaccatgaatgctttaggtgcgcgtaattctaaaattgcaaatccattatatacacggtattggtctatggtgccctatcaattaggattaggtgttgaccgtcaagcggttaaatactccgtaagaaattgctctacagtgtctgcaactctacctgatcaccctagccataattttttacgagatgccttaaaagatacattgcaaaagcaagacgtgtgtatggaatttcttatacagccaagaacttcgactaaaatgttggttgaagatgcaatgttcgagtggaaagaaaatgaagcacctttttaccaagttgcgaccattcatattccaaagcaaagctttgatacccctgaacagaaccaattttgtgaaaatctctcttttacgccgtggcatgctttacctgagcataaaccgcttggcgcaataaatagaatgcgtaaaattatttatgaaaatataagcagagttagacacgatattaactcagctccccgacaagaacctaaaaactaa

SEQ ID NO: 3448 - DNA, 771 bp, Acinetobacter baumannii
ctcacaaaatttactccatttattactaccattaagaatttcaataaatttttagcggtagtaatacatcacgttacctcatgctctaaggtttctcacatgattgacaaaagtaagtcctcactaagcgaggttttatcgcagattaaagatggtgcaaccattctgattggtggttttggtaccgcaggacaacccgctgaactcattgacggtctgattgaacttggcgttaaggacctgaccattgtgagcaacaatgccggtaatagggattatggtctggctaaactgctcaaagccggttctattaaaaaagtgatttgctctttcccacgtcagtctgactcttatgtgtttgatgaactgtaccgtgccggaaaggttgaacttgaactggtaccgcaaggcaatctggcgtgccgtattcaggcagcaggtatgggccttggggcggtgtttaccccaactggctttggaacacttttagctgaaggcaaagaaacccgccatattgatggtaaagattacgtgcttgagtatccgatcaaggctgactttgccctgattaaagcctataagggcgaccgctggggcaatctggtttaccgtaaatctgcacgtaactttggcccgatcatggccatggctgctgatgtcaccattgcccaggtttgtgaagtggttgaactgggtggattagacccagaacacattatcaccccaggtatctttgtacagcatgttgtacaagtacagcccgcacagtaa

SEQ ID NO: 3449 - DNA, 528 bp, Acinetobacter baumannii
ataaattcttctggattaatgatgaaaaaattactaattacttctatggtagctttaacgatagggttaaatggctgtgcaagcatcattacaggttcttcacaaacacttacttttacaagtgtgcctgagtcagcaactattgagattaaaaatcgtaatggggtaaaagtccatacggggcaaacacctgctaccgttagcttaaaaaaaggtgccggttatttcaaaccagaaagttatcaagtatctttcagtaaacctggttatcaaactaaaaccgtagaagttacaggtactcttagtggctggtatttaggtaatattatttttggcggtttaattgggcttttaattgtggatccagctactggagcaatgtataagttggcaccaaaagatataaatacagtattagaagctcaaaatttagtaggagaagctaagcaaaagcccacgttaacagtgatgctggctcaagatattcctgagcaaatgatggcccgtgcagtacaaattaataaataa

SEQ ID NO: 3450 - DNA, 795 bp, Acinetobacter baumannii
atgagagcttctactgttacaattaaaactgaacaagatctagaaaaattaagagtttctgggcgtttggctgcacaagttttagaaatgataggggagtatgtcaagccaggtgtaacaactgaatatttagacaatatttgtaatgattacatcgtaaatactttaaaagttataccggctaatgtgggttatcatggattcacaaaaacaatatgtacttcagtcaatgaagtggtatgtcacggtatcccttctcaaaataaaattttaaaagatggcgatattattaatattgatgtagcaattattaaagacggctattttggtgatacgagccgtatgtattatgtcggtaacgtaaatccacatgctaaaaaattagttgaaactacttatgaagcaatggtcgctggtatacatgcagttaaaccaggggcgactttaggggatattggttacgctattcaatcggtcgctcatcgcgaaggatatagcattgttcgtgaatattgcgggcatggtattggtaaagtttatcatgaacaacctaatattctgcattatggacaacgcggccaaggtcttgttttgaaaaaagggatggtctttacaattgaacctatggttaatgcaggcaaacctcaggtaaaagagctaaatgacggctggaccgtaattactcaggatcattcattatctgctcaatgggaacacatggttgctgttacagatactggatttgaattattaacgccgtggcccgaaggtgtgggaaattatccagaaatttaa

SEQ ID NO: 3451 - DNA, 558 bp, Acinetobacter baumannii
attgattattcaacgttaggggcaaccgcaatgactgacaaagtgaatattgcagaaattatagaacggctagaacagttggaagcacacaatgccattcgtaactgcataaaccgttatatggaaatctgcgacgagctcaatgcaaatacagatctttatgagttgatgaatctttttgatcaagactgtatttgggaaggtattggcgataaatattccaaatcttttggtcgttatgattcttggcagtcgatttatgacatgttcaaacgctatacacaaaaagaatctcactttgttatgaatgcacactttgtaaattcagaacaaatttatgtaaatcaaaatgatgcaaatgcttcatggctgatgttgcaaacttcaacttttcaagatggccgtagtcatctgaatgcggcaaagctcaaggtgaagtttcagaagcaagcagatggaacatggaaaattaaacatttccaaacacagaatattttcagtcgtccggtatcgcattggcaaagtgaagccgagttgccggtaccttcccaggaatga

SEQ ID NO: 3452 - DNA, 288 bp, Acinetobacter baumannii
ctaaaacattcggttttagcgcaaccacaaggagggatggagatgttatcattacatttcaacaaacaagtcttcattaacactctgaacagcaaagattcagttgtttatggagtaacgacgcttgctcttatgctgactttactgtttcaaggtatgattaaagggaatctgaaacccgaatactttatgtatgccatggttgtttcttttgtattttgtgtatgggcctttgttgaccacaaaatgcgaaaattagctaaaagacgacttagtcaacagaaataa

SEQ ID NO: 3453 - DNA, 1077 bp, Acinetobacter baumannii
gcacttaattcaagttcttatttgcacattaggtttgttccaataaggaaaaataagatgactatttcaaatacaacagacttatcttctcccctaatgccatctcaacaacacaatggcaaatttagaaatacacgtccaaaccaacaccagccttcttttggcaaaacgcttcaactcatgtggaagtttctatttaacaaacctaaagacactgttccaaacaccgcaattcctgttttaagtttgtcaaaagaacaattattaagtgcgcctgaccggtctctatttcgtttgggccactcaaccattttgttaaaactgcaaaatgagttttggttaaccgaccctgttttttcggagcgtgcctcaccttttcaatggattggtccaaaacgttttcaccaaccaccgattagtattgcaaacttaccacccattaaaggcgtgattttgtcgcataaccactacgaccatctagactaccatgcggtcatggagcttaacgataaagttgagcatttcttaacaccacttggtgtaggcgacacccttattaaatggggaattccagcagaaaaggttcagcagctcgactggtgggataccacacatgtagatggactcgaactggtggctacccctgcccatcatttttcaggccgtggaatgggtgatagcaatgcgtcgctttgggcgtcgtgggtgattattgataacgacttacgtgtattttttagcggtgatacgggatattttgacggttttaaagagattggacatcgttacggtcctttcgatctgaccatgttagaaactggtgcttacgaccccgaatggcccgatgttcatatgcaaccagagcaaactttacaagcacatctcgatttaaaaggacgtcatttgttgcctatccataacggtactttcgacttggcgcttcatgcttgggacgacccttttgaacgtatcgtcgctttggctcaacaaaataatttagcgattagcacaccgcaaatgggacaaattttgaacttaaacgagccgaatgttgaaaattattggtggcgttcgtga

SEQ ID NO: 3454 - DNA, 714 bp, Acinetobacter baumannii
tgtgttggctccagtcaagccatgatgttttctttaaccccagaagagctcagtgtactgcaactttcttgtaaggtggcagcaagttgtcttgtggtcagtattattcctgcaatttgtgtgggatggtttttggcacgtaaagacttttggggtaagtcattcattgaaacattggtatttttacctttagtgctaccgccagtggttcctggctatttgcttttacaagtttttgggagccgcggcattattgggcaatatttggcgccactcggaattaattttgcatttaactggaaaggcgccgttcttgcttcggcagtgatgggttttccactattggtgcaatctattcgtctagcgattgaactggtcgatcagcgtttagaaatggcagcaaagacattaggagcttcatctttaggggcattttttcatgttactttgcctcttgccagcagtggcattttaattggtgctattttatgtttttgtcgcagtttaggagagtttggggccaccattacttttgtggggaatatttcaaatgaaacacggactttgcctctagccatgtatagcttaatgcaacaacccgatacagaagctgctattcaaaggcttattgttttatcgttaagtgtagcttttctggcattatggtttgcccagtggtttcatcgttatcaaaagaagcgtttagggcggtaa

SEQ ID NO: 3455 - DNA, 1416 bp, Acinetobacter baumannii
atgacctcatctaatttaaaacaatggaatgattttatagatggatgtatcgacttccgtcctaacgatggcgtgttccgtattgcacgcgacatgtttaccgagccagaactatttgacttggaaatggaatttatttttgaaaaggtttggatttacgcatgtcacgaaagtgaaattccaaacaatcatgatttcctaaccgttcaaattggccgccaaccgattattgtaagccgtgatggtaaaggcgaattacacgcgatggtcaatgcttgtgaacaccgcggtgcgaccttaacacgcgttgctaaaggcaatcaatctacatttacctgtccgttccacgcatggtgttataaatcagatggccgtttggttaaagtcaaagcgcctagcgaatattgtgaagattttgataaatcaagccgtggtttaaaacaaggccgtattgccagctatcgtggatttgtatttgtaagccttgatactcaagcaacagattcactagaagactttttgggcgatgcaaaactgttccttgatttaatggttaaccagtcgccaacaggtgaactcgaagtattacaaggtaagtcatcttatacctttgcaggtaactggaagctacaaaatgaaaatggtctagatggttatcatgtcagcactgttcactataactatgtctctacagttcaacaccgtcagcaagtcaatgcatcaaaaggtgccgaactcgacacacttgactatagcaagttgggtgcaggtgactcagaaactgacgatggctggtttagttttaagaatggccacagtgttttattcagtgacatgccaaatccgacagttcgtccaggctacagcacagttatgccatatatggttgaaaaatatggcgaaaaatatgctgaatgggcaatgcatcgtttaagaaatttgaacttgtaccctagtctattttttatggatcaaattagctcacagcttcgtattgttcgccctgtggcatggaataaaactgaagtcattagccaatgtattggtgttaaaggtgaatctactgaagcacgccgtaatcgtattcgccagtttgaagatttctttaacgtatcaggccttggtacaccagacgatttagttgaattccgtgaacagcaaaaaggttttcaggcacgacttgaacgttggagcgatatttcacgtggttgtcagtcttgggaatatggcgcgaccaaaaactcacaagatttaggcattcaacccgttattactggccgtgaatttacccatgaaggactctatgtaaaccagcatggacactggcaacgtctcatgctcgatggcttaaataaaaaagcgctgaaaatgcaggatattacttttgaaaacaatgccgtaatggatgaggtgtaa

SEQ ID NO: 3456 - DNA, 594 bp, Acinetobacter baumannii
tctttgaaatcaaagaagcattcaaagccatattcaaataggagagggcaaatgtcagtagataaatatattgaggaccttatcaagcgcgaaggtggttatgttaacaaccctaacgaccgtggcggcgcaactaattatgggataactgaagcagttgcacgggtaaacggttggaaaggcccaatgcgtgatctgcctttagatttagcaaagcagatttataaacaacaatattggattaatcctcgttttgaccaggttaatacattatcgcctttgatcgctgaagagttgcttgatactggtgttaactgcggtgtagcttttgcaaagcctttattacaacgagcattgaatctattgaataaccaaggtaaaggcggttggcccgatctagccgttgatggtatttatggttcagctacgttaggggctttaaaaatctttcttgccaaacgtggtaaagatggtgagaaggtaatgcttaaggtgctaaatattatgcagggccaacgttatattgaaatatgcgaacgcaatcccacgcaagagcaattcttttatggatggattagtaaccggatcgcataa

SEQ ID NO: 3457 - DNA, 510 bp, Acinetobacter baumannii
tcaataatgtctaaatttagtgatgagtattggatgcagcttgcttacgagcaagctgaattagcagccaagcagggggaaattcctgtaggagctgtaatcgtgagccaaaataagttaattggagctggttttaatgctccaattggtttatctgatcctacagctcatgcagaaattcaagctattcgtgcggcttgtgagtcattgaaaaattatcgtttacctgaagatgcgactttgtatgttacgcttgagccgtgcacaatgtgtgtgggagcattagtacatgcaagaattaaacatgtcgtatttggaacaacagaacctaaagctggctcactcgtgagtgcacgtcaattattagaaaatggttattacaaccataaatttacttttgagcatggatgtttacatgaaaaatgtgctcaacagttaagccttttttttaagcaaagacgtgaacaaaagaaacaagagaaacaacaaaaaacgtccttaaatgattaa

SEQ ID NO: 3458 - DNA, 384 bp, Acinetobacter baumannii
caggtttatccttcttctgtagctttactttttgagtggaatatggatatgaacttccaaacaatactttcatctttcaaaaatcaatctactggtacagatgcatttaagaatttaaaaagtgcctgtgaacaccatctcaaacattcatcacacctgaacgaaaaagctgtaatttatctcatttatgggtttgcccgtagttatgtcatcttatatgaagatgaagcggtaactaccgagttcgctcaagcttcgaaagaaatgttagtgaattatatgaatcgcttaaatgaagccttacgtactcaagatgaccatataatcttaaatactctaaatcaggtgagtaatgattatatgcaaggctcaagaatcttttaa

SEQ ID NO: 3459 - DNA, 345 bp, Acinetobacter baumannii
ataaatatgtttaaaacaaaaaaaacacttcaaatgttaaattttacacattgtagcaaaacaccctttactattttttatgttaagaataaaaaaatggagattagaatgtcaaagcgccatattttaaaagaagttaatgcgaaaagtatgtgtgggatggaaattgtagtagaacaaatttttgaaaatacattggagaaaaatttagcttcggctgaaatcgaacaaaactggttaccgctttccaagattgtgatttcagataaagttatcaatttagatcaagataacacctttgctcatcccagaacagggaaagtctttaaagttttaaattcttaa

SEQ ID NO: 3460 - DNA, 1149 bp, Acinetobacter baumannii
aatgatatgttaaatttaaaatcttctcatagtactgcatttactccgtcttccccagcagagcgctatgctgaggcattggcttcaggccagtttatggcagatgaggcacaagcacaggcagtgcaagaattagatcgtgtatggaaagaacttttaaatcgttataaggcttctaaaaaagctttccgtcgtttccgccgccaaacttctccaaaaggtgtatatatgtggggcggtgtaggacgtggcaaaacttggcttatggaccaattttatgagtctgtaccatttcgccgtaaaacacgtatgcattttcatcactttatgcaacatgttcataaagagttaaataaactttcgggtcaacgtaatccactcgatatcgtagctgatcaaatttataaagatgctgtcgttatttgtttcgatgagttttttgtctcgaacgtaactgatgcaatgattttgagtgacttattccaaaagttatttgttcgtggtgtaacactcattgcaacttcaaacattgcaccagacggtttatataaaaacgggattcaccgtgatcgttttattcctacaattgaaatggttaaaaagaactgtgtcgttttaaatgtagatgcaggggtggattaccgtttacgtgttttaaaacaagctcaattgtttaaatcaccattaggtaatgaagctcaaagctggatatcagagcgttatactgctttaactcatactcaaaccaattctcatgaaccgattgtgatcaataaccgtgttgttgaaacactagggcatacggaagatgttttatggtgtgagttttctgaactttgcttaaagccccgtagtccagcagactttattgaaattgccaatatttataatacggttttagtcagtaatgttcctcacttaacagacttcttgtctgaaggcacacgtcgttttatttatctagtcgatgaattttatgatcgtggagtgaaactacttttaacctctcaagatagtattattgatatctatcaaggcgagaaattggcttttgaaattgagcgtactcgttcacgtttattagaaatgcagtcagatgagtatttgcattctgaacatcgacatattgatgcgactaaaacttcttaa

SEQ ID NO: 3461 - DNA, 1131 bp, Acinetobacter baumannii
gaaagcatgtttcagtttatccaacagcaaaccgaattggttgatgttcttcaacaaatggatcaatgttcaacttatgggcttgatacagaatttattaaggttgataccctttggcctaaacttggagtatgtcaagtcaatgtcaacggaaatgtatatttattggatggagtgtctttagatttaagcaagttttggaaaaaaatctttcttgctcaacaaaatatttttcatgcatgtggtgaagatattgatttaatctatcactatgccgatgaacaaaacctattaaatgtttttgatactcaagttggattatcctttttgggacatggtttacaagtaagttatcaaggtgcattaaagctttgtttagagattgatattgaaaaggatcagactcgatcagactggttggcacgtcctttatctccgcaacagctatgctatgcggcaaatgatgttttataccttatgcaattggctaaccatattaaagatcagcttaaacaaaaagggctttatgagtatgttcttgaggattgtagtagcttaaccaaagaaattattagtgaaacaccaaccccattgttatatacagatgtgggcaattatcgtcattcacgtcgtcaattaatgcaattgcaaaatttaagtgagtggcgtgaagaggtagttagagcaactaaccagccacgtagttttatccttagaaactcgacgatgattgatttagtcgaaaaaaatccacgcaatagtttccaattatctcaagtaaaagatatccgtccgaatgttgtccgtgaatatggaaagattattcttgatcttttaaaagacttacctgttgaaggacactggccagctaaaattgctaaaccttttaaaattacatccaaagaaaccctaaataaaatggatgcattgattgctaaagcgatagaacaaacctctataccaaaagaagttttacttcgtaagaaatggttaaatgcgattcatcagcatgtgcttactaaaggtgatgaacaggatctcccagattatttattgggttggcgctatgagcttttaactaagccgcttattcagttatttaaagaagagaaagccagtcttttattttag

SEQ ID NO: 3462 - DNA, 2250 bp, Acinetobacter baumannii
atgcgtataccacagtttaactctcaagtcgctgaagccgacatgcctaacgtacaaatcagcggtggggttacacctggtcaagcagtggatatggtcggcaataaaatagatggttttgccaatctagctaatacggtcgccaataaatataaagaaatacaagatgagaacgaccgtgttcgcgtgattgacgcgcaaaacaaacttgccgagttgcgtttacatcttgaaaacaacgataccgatggctacatcaagaaaaaaggcgcagacgtggtcggctttgatgacggggaaggaggtaacttcgttgattactattctcgtgcatatcaaaacggggttggtgaaattgctaataaattaagcaatagccgtcagcgtacgatgtttcagcaaattgctgcacgcgatgcgcttcaatttaaaggtactttgcaaaattacttcgtacgtgaaaatgatgtttatcagcaaagtgtttactcatcttctgcagaacgttttatccgtgaaataaatgaaaatcctgccgacttcactaagattgacgaaagccgtgaaaatctaaaagcttcacttggcaaactaatgtcactcaatggtaaatcagctacagaagctgaaaacatgtacctaaagtcaatttcatctgcgcatttaaacaacctaaacgcctttattcaaaacggcgaattaaaagcagcagcaacttataaaaagaaatatggcgatgagatttcccttgctgatgattatgtgattaataaaagaatccatgaaaagcttgaagaacaacagatcgaacttttggttaataaggctacaactggaacccaagagtatagtaaccctgccttaaacgcaccgcctcaagcttcggcagcaattgctaaagagttaaaagcattatcccctgagcagatgaaaagcatccgatacaatgatcagcgtttggatgtttacactgtgcatgctgcaaaagaaaagggcatggagtgggcagcgccattattacttggcattcgcttagcaggtgagaaatctgataacagtgcagtttcacgtaggggtgctaaatctgttatgcaattcatgccacaaacttggggagaatacagcaaaggtggtaaaagagatattaacaatccggctgacactatcgatgccgctttagaattcgtagattggattagtaagaaatataaaactaaagacccaatggttattgcagcttactacaacggtggtggcaatgcggctacggcagtgttaaaaggacaacaaccgccaaaagccgaaactcaaaattatcttaaacgcattgataaatggttatctgatgatatggggccatatagcaaacagcccgcaaaaacacgtcaacaagcttatgatgaaatttggaacagtaacgtccctgtagagacaaaacaaaaagctttgtctttaactgaacgttattttaatggtcaggataaagttaaaaaagatcgtcaagaccaagaatatagcaatctttataatggaataatttcaggtaaattcgcctttgagcaaatacctgcgggtagtattacggctttagaaccaagtcaaattaatagtttgaaatcggtgagcaaagcaacttacaacaaagacattaaaacagacccgataacccttagtatgattacccttaatcaagaggaacttttcaaaggcaaaccacaatctgttctacatcaatttgctgataagttgtcgccaaaagattatgaagaagtcactaaaatgtatgcgaatgtgaatgctcttaaaggctctaaaaatgagaaaaagacattcattcttgacaataatactgtggctttggcagtcaagccgtatctaaatatcattgggataacaagcactactgataaaaggcagcttgagcactacaatgcagttaaaacagatttaatgcagacgttaaaagaagctgaagcaaaaaacggtgggaatttaacttgggaacaagtaaaccgagttgttttaaaaaacataaacaatcaggtaaaagttactacatcaagacctttctttgacgataaagttgagtacaaccgggtttactctcaagttaagagcaagggtgatattactgactcaatgaaaacaaaaattgataatatatttagaaagcagggtagaaacccaaacaatgttacggatgctgaatatattaacgcttattattcaattatgagaaggggttactaa

SEQ ID NO: 3463 - DNA, 1494 bp, Acinetobacter baumannii
ggaaattcacccatgaaacatactcttgaacaaaaacaagccattgatatggcaattgatggtgagtcttgcaaggtaactgcttatgcgggcgcaggaaaaacatcaacgcttaaattgataggtaatgctaaaagctatcaatctggcatgtacttggcgtttaacaaagcaattgctactgaagcacaaggtaaatttaacagcaacgttcgttgcaaaactttccatagtctcgcatttaattcggtaccgcgttggtttactaaaaaacttagcaatcgtcgcttaatgtcgaatcaaattgcatcacgtcatgaccttgagtcgtatcaagtgcctgtagccttaacaaagcaacgtggtgaagatgaccaaaaacgcttatttaacaataagcgcatggctacatctttaattaatgcagttggctatttctgccgatctaattattcagaaatccagttatcacaggtttacgctgctttacctgattggatggaagaaacacatcgtgcggaactagccaaaattcttttaccaaaggctaatgactattggcaggacatccttgacccattcggtgtaaaccgtttagagcatgaccactatttaaaatattgggcactcagtaaaccagtcatcaacacagattttattttgtttgatgaagcacaagatgctgacccaatcatgcttaatgtactaaataatcaaagcgctcaggtcatttatgttggtgacagacaccaacaaatctatgcatttcgtggtgcagtaaatgcaatgcaatcgcttgaaatacctgaaacacgactaagccagtcattccgttttggtcaagatattgcggacttagcaaacacaattttattcaatgtacttgatgaagaaattcctttgcgtggttttgaacaaattgaatcacaggtatgtgaagttcatgacagcgtagccgatgcaattattttccgcactaatgccgctgcgctttcacacatggttgagcttattcaattaggtcgtgaaccacgtcttgaggttgatacaggatctttaattaaaaatattgaagatgccaaaaaagttaaggcaggtgtacgcgttgctgatggaagtgcatttgaaggatttagcacttgggaagaagtacttgaatacagtcatgaagtttcaaacagcgacattaaaccacttgtgagcctgattgaaaaagtaggtgaaaacgcactcattgaagccttattaaaaagcagctcaaacgactatgactgtgttgtgacaaccgctcataaatcaaaaggccttgaatttaacaaggtcaaattaggcggtgactatttctataaagaagcagtttcagatggtgaaaagccattaacagcagatgaagcacgtttgttatatgtggccgcaacccgtgcaaaaaaacaactggatattaccgccctcaaccctcttttcaaaaacattaaatcgggagtcgcagcatga

SEQ ID NO: 3464 - DNA, 1371 bp, Acinetobacter baumannii
tattattttttaggggataatatgcaacaaaaacaattaaatacccctgatgattcagtggaacaagtcaccttctggcaagccttcttattttggctcaagcttggttttattagctttggggggccagctggacaaatcgctgtgatgcatcaggaactggttgaacaaaggcgctggatatcagaaaaaagatttttacatgcactgaactactgcatgttgttacccggacctgaagcgcagcagttagcaacctacattggttggcttatgcataaaactgtgggaggattggttgcaggtattctatttgtattgccctctttatttattttaattggattatcttgggtttatataaaatttggagatgtgcctgttattgcaggtattttttacgggataaagcctgccgtcactgcaattgtctttcatgcaacttaccgcataggcagtcgttcgcttaaaaataagtttttatgggtcgtcgcaattgcagcgttttttgccatttttgtcttaaagcttcctttcccgcttatcgttttatctgcaggtattgctggctatttagccagtaaaaagtacccagaactattttcctccgcgggtgggcataaagctagtcaaaaagattatggtccggcatatattgatgatgatactccgacaccagagcacgctaaattccattggtcacggttagccagacttatttttgtggcaatcgctttatggctattgccaattttagctttaggcgcatattttggatggcatcattcctatacccaaatggcttggtttttcactaaagctgcgctgcttacgtttgggggcgcttacgcggttttaccttatgtctatcaaggggctgtcaatcattttggatggctttcacctacacaaatgattgatggattggcacttggtgaaactacacccggtccactaattatggtcgttgcctttgttggttttttaggaggcgttaatcattcattacttggctctgagcatttattttttgctggagcactcggtgctgttattgtgacttggtttacctttctattttcatttgtctttatttttgcgggtgcaccgattattgaatctacacataacgaaattaaatttactgcacccctcactgcaattaccgcggctgtggtcggtgtcattttaaatttagcactattttttagttatcacgtgttatggccacagggtttttcaggccattttgatattgtcgcggccctcattactgtagctgcatttattgctttattccgatttaacattaacgtgctgtatgtcatttttgcttcggcactggttgggctcgcagtcactttcttttag

SEQ ID NO: 3465 - DNA, 1005 bp, Acinetobacter baumannii
gtggagcgaccgacgattagccctgaacatttacaggaagctgctgaaaatttatcaacaattcgagattttattcgttttggggtgtcagcattacgtcaatatgatgcacatttaggacaaggtactgaagattatttcgcagaaagctctgcattagttttacaaaccttatctcttgaatggtctgcagattcagagattttagatgcgaagcttttaccaagtgaaaaagcagaattcttaagcttgttggagcgccgtattaatgagcgtattccgacttcttatttattaaatttagcttatttctttaataagccattttatgtggatgagcgcgtacttattcctcgctcaccaattgcagagttaattgagcaacgttttgcgccctattgtttagatgaaaatggccaaatgcgtgaagcgcttaataacttaccagaaaataccaagcctaaaactccacaacgtattttagatatgtgtacaggttctggctgtattgcggtagctttagcttatgcttatccagatgcagaagtagatgcaacagacatctctaaagaagctttagaagtagcatcaattaacgttgaacatcacaataaacaataccaagttgcattacttgagtcggatttatttgaaaaaattccagctgaaaaccagtacgatttaattgtaagtaaccctccgtatgttgatgccgaagacatggctgacttgccggaagagtttttacatgaacctgaacttgcattagcagcaggtcaggatggtttagacttggttcgtaaaatgcttgctcaagcggcagattacttaacggaagatggtcttatagttattgaagtcggtaactctgaatgggctatgcgccaaaactttaatacagttgatttcaactggcttactttccaaaaaggtggttcaggtatttttgctttgactgctgaacaatgtcgtcgttatagaaaattatttgaagaacaagtttaa

SEQ ID NO: 3466 - DNA, 1770 bp, Acinetobacter baumannii
gtgagaaagcccatgattgatagtaaagcagtggttcaagcccataatttattcatgacttttaaagccgaaaataaaaattcagtagatattagtgcaattgttgatttgaatatgcaaattaaaaaaggagaacttaccgctttagtcggtccagatggtgcgggtaaaacaactttattaaggttaattgcaggattatataaagcgagttcaggttctcttcatgtgcttgggtttgatattgaaaaacatcctcaagttgtacaagaccgtattagttatatgccacaacgttttggactctatgaagacttaagtgtacaagagaatctaaatttatatgccgacttacacggcgttccaaaaaatgtacgtaaccaaagatttaaacgtttattggaaataacggatcttactcagtttactcaacgtctagcagggcaactttctggtggaatgaagcaaaagctaggattggcatgtactctagttcgttccccagagttactcttgcttgatgagcctagtgttggagtagaccctttatcacgacgggatttatggatcattattgaacaacttgttcaggaagaaaatttaagtgtaattataagtaccgcttatatggatgaagcagaaaagtgcgcttacgtgtatatcatgcacgaaggcaaaattttaagacaaggttcacctgagcaattaaaagcgttagtacatgagcaaacatggaaaataaaaccttcagagcagattaagactcggattgtacaagcccagttacttggaaattctggagagattattgatgcagtgccaagaggagagcaagtaaactttattagtcgccaaaaagaactatcaacagatatttttcctctggggctagtggcaaataggcgaccacctgaactcgaagatgtttttatgatgttgttacagcaaaatcaaaaacaacaaatctctatttctcagcaggcttttcgatccgaacaaaacaataattcgcaatcagaccaagcggtcattgtagttaaagatttagtcagaacttttggagattttactgctgttgccaatacgtcatttactgtacagcgtggagagatctttgggttacttgggccaaatggagctggtaaaaccacgacattccgcatgttatgtgggttactaccggcaagtagcggttacctagaagttgcaggtaaaaacttacggacggcccgtgctgaagcaagagctaaagtaggctacgtctctcaaaaatttgcactgtatagcaatttaactgtgttggaaaacttaaagttctttggtggagcctatggtttatcgggcaaaaaactagatcaacaaattgataaagctttacaacaatatgatttaaagccgcaaattaaaagcggtgatttacctggtggttataaacagcgcttatctatggcggctgcattattacatgaaccagaaattttatttttagacgaacctacgagtggaatagacccgcttgcacggcgtttattttggtacagcattggtaaactcgcaaatcaaggcattaccatcattattaccactcattttatggaggaagcagaatattgtgaccgcattgccatacaagatgcaggaaagttactagccctaggttctcctcaacaggtccgcgaattggcaagtaaagataaacatattgttgatatgaatgaggcttttattgcaattgtggaacaagcacgtgcattaaggcatgcgggttag

SEQ ID NO: 3467 - DNA, 249 bp, Acinetobacter baumannii
atcatggcttttatttttaaagaagtacagcaccgtactgtcgcacccgtcattatcgatgaagataaatgtattgctgataaaggatgcactgtctgtgtagatgtttgtccaatggatttattagcaatcgatccaacaactcaaaaagcttatatgcaatttgatgaatgttggtattgcatgccttgtgaaaaggactgcccaacagatgcagtcaaagtaaatatcccatacctactcaaataa

SEQ ID NO: 3468 - DNA, 198 bp, Acinetobacter baumannii
tttattaagtttatgttaaaagtaactgctgctttattaatattgggaagttttgcttgttatctcctttggggtaatgaagaaaaagctgaaactaaaagttcgcacatgcttaaagaagctgagcaatcaattaagaatgctgagttatctattcaaaaagctaaacaaaatatccctactgcatcgtatcaataa

SEQ ID NO: 3469 - DNA, 414 bp, Acinetobacter baumannii
gaaggggttactaagatgtataaaatattaattttattatcttttttggtatttagtttttcagttaatgcagctgtggaagatgatttaaaaacatcaactagaaaagctttaaataaaatcgacgcgcaaaaagaagactgctacaaaaaagccgaattttcagcaacagctaacggatgcttggaggattcttttaaacgtcaaaaggttattgtagatacgtttgttgatataaaagctagaaagcaagacccagaacagttgttacgtacttatgaagatcaggatgtttttaataaaagtataaaagcttgcgaactattgctaaaactttcgagtcctaatgataaatacttttatgtatataattgcaaattgaacgcccttaaacagtattttgagtatcagtaa

SEQ ID NO: 3470 - DNA, 255 bp, Acinetobacter baumannii
caaagtgagtttttaaccatgcttaaacctataattattttagttgctataggggcaattggtttggttggatacaaagtatttgcccaaaaggatgaaccgactcaaattaacgaaactgttctattgattaatgatgcaaataaatcagttgaagaagctgatcatacaatagaaaaagcgaatgcctcttttcagaaaattcctttaaatgaatataaacccgacaatagcaccctccaagcctcgcagtag

SEQ ID NO: 3471 - DNA, 234 bp, Acinetobacter baumannii
aaaaatgctactgaatccttgatgaataatctatttttgaacaattttccaaaaaagagatatttttttgatcattattttaaatttttcaaatttaatatccttctaaatgtttattttttacaaaagctttttttaatttatatattcattgagtcgtttttaaaaatatgtttttgtcttttaaaaagattttttgataatacgatattattcaaaaaatatttgaaataa

SEQ ID NO: 3472 - DNA, 414 bp, Acinetobacter baumannii
acagaatgtacaaacacaactcatcatagatcaactttttataaaattaatgaacgtttaaggggaacactaatgcaaccacaaatgggtggaattattcaggtcaatattccagatagagcaacattgcaagcaagttatatgggatatgtacaaggtgggggcttgtttgtaccatcgaagcaaaaagtgaagatgggtcaggaaatttttattttagctacgttaccagaacaatcacaaaaaattcctttaactggtaaagtagtttggatttcacataagcaaagtggatttaaaccgcaaggtttcgcaattcaattgagtggtgataaaggaatttactataaagctgaagctgagcggattttagctggtagtatgtctttagatcgcccaagttataccatgtaa

SEQ ID NO: 3473 - DNA, 294 bp, Acinetobacter baumannii
atggcgagtacgaagttaaagcggaaagtaaggaggggtgaaatgacagaagttaaatttgtttctatgcctgcatccgaattggctcaggtcatcgaaaaggcatgtgagaatgcagtaactaaagttttagcagcccaaggcgatgagctgcttaacattacgcaattatgtgaacgtataccgggcttatcctaccattcatttaagaagctagccaaagaacatagattcaaagatataaaaggccgttattcgcttacggctgtgaaagccgcgctgcaatctcactag

SEQ ID NO: 3474 - DNA, 951 bp, Acinetobacter baumannii
ggaattatcactatgctggcatatgttattcggcgtttatggcagatgattccgaccatgttgggagtagtgctgcttatttttatcttatttaattgggttggtggagatcctgcctatattctggcaggtaagatgtcaaatcctgaacagattgaaaatatccgtaaacagttaggggtcgatcaaccttattatgttcaactttggatttttattaagcaaattcttacttttgactatggcgcaagttggagcacaggtgaatccgtttcacaaattatcttaaccagattaggaccgtcgctcacacttttaattccactcaccattttacaaacagttatttcaattattttagcattggctgtagcggcggtacgtggctctctaactgatcgtatggtcatgatgttatgtaccatcggtatgtcgattagtattttggtttacattattgtttttcaatatgttctggcttatcaactgagctggtttccagtacagggatggagcgatagttttaccgacaatttatttaagttttccttactaccaattctaatcatgcttgtggtgagtattgcacctactttacgtttatatcgtagctttgtgcttgatgaagtaaatcaggattatgtgagaaccgcacgtgctaaaggtgtaggggaaagccgaattttaagtgtgcatgttctacgtaatgcctcaattccgattattactgatgtgatgtcaaatttaccggcattattgataggtgcatttttaattgaacgcttttttggtattcccggtattggtcgtgaagtgattattgctgtagagcgtagtgattttcctgtcatcaaagccattactgtatatattgcagctgcaaccatgatttttaatttgattgcggacttggtctacaaagtggttgatccacgtgtacagttgaagtag

SEQ ID NO: 3475 - DNA, 420 bp, Acinetobacter baumannii
acattaaggttcagtaagatgacgacaatatcaaaatcattattaaatggattaccgataaaaaaatctagggtacaagtttttgagattttaaatcagaacccacaaggcttaagcgcggtaagtatctatgcgcaaattaaaaatgaacataaaattacgttaggtaccatttatcgaattttatctgagtttgaaaaccgtaaaatcatcaaaagggtgtttttaggaaaaagtaaaagtatttataagcttagaaaagacaagatgagctgtaacctcatttcgctcaaaacctctgaagccttgaactttgaaaatgagaaagttaaagaattacttcatgaggttacggatattatttttgcaaacaccggagtcgacattagtagtgttgaactcaatctttatactgaataa

SEQ ID NO: 3476 - DNA, 702 bp, Acinetobacter baumannii
ttttttctaacttttagacataagaaagccccgaaattttggcgaaggacggggcgatctaaacaagcattacttcttcactgttattcaacagctaaagataacggggtcattatggaacagaacattatggttagtcaaatttcaaataatcatcgtaatctgattaaaggattaattcgaaaacaaaaagtaaagcgaattaaaaatgctttgcgaattcaacgcgaccaattaattgcggcaataaaagacgcatataaaaacagccctgctttaggttttggaacatgttttattggtgggattgttgttttagtggtgactatgagttttgcactagcgtctgcacatatggcctataagaatttaggcccacaacaaataagtattttttcacctatttacacagtagatgatttggatttaggcccttacaacgactgccacactgattgtcatgcatcaattcttaccagtgatatgcgctttcgcattgaagtcggctttgacttctcagggtatgacaacagcaatggatttaaccgagctacaggcatccaaattgaccgtttagagccaatcaatgtggttgatgaagaaggtgttgtaaatgcctatatcgaccgctttgagcttgtaaagatcaatgaagcgcttgaagaatcaattgaaactaaattagcaaagttgggtggctga

SEQ ID NO: 3477 - DNA, 2190 bp, Acinetobacter baumannii
aaagtagcaacttcaggaaagacaatgactgcacgtattcaaaaaggcaagttagcgattgctaaagaactttacgattttatcgaaaatgaagctttaccaggttctggtttagatagtgaaacttactggaagaactttgagcaagttgttgtcgaccttagtccaaagaataaagcattattggctaagcgtgatgaattacaagcaaaaattgatgaatggcaccgcaacaataaatttgaattaggtgcttacaaagcatttttaactgaaattggttatttattaccagaagttgaagacttccaaattactactgaaaacgtagatgaagaaattgcattgttagcaggcccacaattagtagtacctgtacgtaatgcacgttattgcttaaatgcagcaaatgcacgctggggttctttgtacgatgcactttacggcttcgatgtaatttcagaagaaggcggtgcagaaaaaggaaaaggatataaccctgtacgtggtgcgaaagttattgagtttgctaaaaacttcttaaatgaaattttcccgcttgcgcaaggctcacatgctgatgcaactaaatatgcaatcgagcagaataaactcgttgtgactttaaaagatggtactaaaactggcttagctcatgaagctcagtttgtgggtttcaatggtgaagaagcgaacccttcagaagttgttcttttgagtaatggcttacatgtcattattgaaattgatgcgaatagcccaattggccaaactgatttagcgggtgttaaagatctaacacttgaagctgcggttacaacaattcaggatcttgaagactctgtagcagctgttgatgcagaagaaaaggttgaaggttatcgtaactggttaggtttgatgaagggcactcttcaagaatctatcgaaaaaaatggtaaaacaattgttcgcgctttgaataaagaccgtgaaattaaaaatttgatcggtggcacaacgaaacttcatggtcgttcacttatgttacttcgtaacgtaggtcatttaatgacgaatccagcgatattagttgatggtgaagaaattttcgaaggtattatggatgcgttggtaacgccattgttatcaattgctgacatccgtagtgaaaacgaaaataaaaactctcgtaaagggtctatgtatattgttaaaccaaaaatgcatggccctgaagaagttgcttttgctgttgagttatttgagcgtgctgagcaagccttaggattaccagcgaagtctttaaaaatcggtattatggatgaagaacgccgtacatctgtaaacttgaaaaactgtattgctgctgctaaagatcgcacaatctttattaacactgggttcatggaccgtactggtgatgaaatccatacttctatggaagctgctccagttgttcgtaaagaagcggttaaaacacaaaaatggattgctgcttacgaaaaccgtaacgttgcaatcggtttgaaatgtggtttacaaggtaaagcacagattggtaaaggcatgtggccaaaaccagatagcatgaaagatatgttggcaactaaagctgctcatccaaatgctggtgcttcatgtgcttgggttccatcaccaactggtgctgtacttcatgcgatgcattaccatcaagtaaatgtaaaagcacgtcaagatcagttaaaagctgaagaaatgttgtcattagatgacttgttaactcctccatttgcaactgatacaaactggtcagcagaagaaattaataacgagctcgaaaataactgccaaggtattttaggttacgttgtgcgttgggttgacttaggtgtaggttgttcaaaagttcctgatattaacaacgtgggcttaatggaagaccgtgcaacattacgtatttcttctcaacatgttgccaactggttacgtcacggtatcgtgactcgtgaacaagttgaagaagtgcttaaacgcatggcaaaaattgttgatgaacaaaatgcgaatgatccattgtataaaccaatggcagctaactttgaaactaatattgctttccaagcagcttcagaccttatctttaaaggttgtgaacagccttctggttatactgagccattactacatgcggctcgtttaaaattaaaaggttatacaggtgactaa

SEQ ID NO: 3478 - DNA, 1038 bp, Acinetobacter baumannii; identical to SEQ ID NO: 1354

SEQ ID NO: 3479 - DNA, 285 bp, Acinetobacter baumannii
agtatgcaaaccagacctgatatccgtgtcgacactataaataagcaggttcactttatatggaccgatggctcaagcgtatgtctgagtcatcaaagtttaagggaaatttgcccatgtggcttttgccgagcgaagcggattaaacaaattaaaatagagcatcaaaatgttgaagtgacagctatgtttgatcaaggttatggtgcccaaatttgctttaatgatgggcatgataaagggattttcccgtgggcttttttaaaagaatttgctacaggataa

SEQ ID NO: 3480 - DNA, 1050 bp, Acinetobacter baumannii
acattagaaactcaacttgcagcccgttacgaagaatatagtgatttcggagatacgtttaatcctaaattcgcacttcgctgggaaccaattaaacaattaatgtttcgtacctcttatagcacaggatttagagcaccaactttatgggaagtaaatgctcctaactctataacaaatacttcagcttactataatgatcctgtactttgtccgaatggccctcctaaaaatccaggagatactcttccacctggtggtgttgccagccgtgattgcgaaacccaatttgaccgcaaaaatggaggaaataaagatcttgatcctgaggaatcaaaatcgtttacagctggtttggttctagaaccaattaagaatttagttctaactctagactactttaatattgaagttgaaaaccaaatagcagcgttacctgaaggtgatatttttaacaatccaacaaaatatgccgataagttcgtacgtaatccagatggaacacttaatcatatcattacaactcaagacaatatgggtgacttaaaaacttcaggagttgatgtaagtttaaactatataacgccaatgacagcaacaggtcgatttggttttggaattgatggaacttatgtcattaaatataaatatcaaaatgaaaaagatggagaatggattagtagtttaggagcatatgttggagatgctccaattattcgttggaaacatactgctaatttatattggaattaccaaaactggggtgtaaatttccaacaacaattcactcgtggttacgatgaccaaaattcaagttcttctgttgcggaaggttatcgtgatcataaagtaagcgactatacaatttataatatttcaggcacatacaaaggctttaaaaatctagaagttacagcaggtattaagaatatctttgatgaagatcctcctgcttcaaatgttggtgacaacttccaaatgggatatgacccacgttacgcagatcctttaggacgtacttactttgtacgaggtacatataagttctaa

SEQ ID NO: 3481 - DNA, 471 bp, Acinetobacter baumannii
actcctatgactcctgcatgtagactgttaaaaagtaacaaaatcgaattttctatccatgagtatgaacatgacgcaaatgctaaaagttttggcttagaagctgcggaaaaattaaaccttaatgtaaatgaggtgtttaaaacacttctggttaccgatgagaaaaattattttgttgcggttataccagttaaccatcaactcaatttaaaaaaagtagctacggcagtggggtgtaaaaaactacagatggcaaatcctaaagatgccgaacgtttaacagggtacttagtgggtggaattagtcctttaggccaaaagaaacgtttgaagacagtaattgatgcctctgcacaagagctcagcaaaatttatgtaagtggcggtaagagagggttagatattggtgtaaatcctaaagatttagcacaaatattaacggcgcaatttgtagacctacttgattaa

SEQ ID NO: 3482 - DNA, 1161 bp, Acinetobacter baumannii
tttagtatgacagaaggtgttggcctacctttatggttattagcggagttaacttatcgttgcccgctacaatgtccatattgctcaaaccctttagactacgcacagcataaaaatgaactgaccacgcaagagtggtttgatgtttttgatcaagcgcgtcaaatgggggcagtacaactcggtttttccggtggtgaacctttggtgcgtcaagatctggagcagcttgtggcgcatgcacaccaactaggcttctacaccaacctgattacctcaggcatgggacttaccgaacagcgtatttcgcatttaaagcaagctggcctagaccatattcaaatcagctttcaagcgagtgatccggtcgttaatgatgctttggcagggtcgaaacatgcttttgaacaaaagtatgaaatgtgccgacttgttaagaaatatgattatccgatggtcctcaattttgtaattcatcggcataacattgaccagatcgataaaattattgagctttgcctagaacttaatgcagatacagtcgagctagcaatttgtcagttttatggatgggcatttttaaaccgtcagggtttattaccgacacaagaacaactcatacgtgctgaacgtattaccaatgaatatcgggaaaagttaaaagcgcaaaatcatccttgcaaacttatttttgtagtgcctgattattacgaagaaagaccaaaagcctgtatgaatggctggggtaaaattttctttacagttgctccagatggtatggcgctgccttgtcacgcagcaagacaattaccgatttctttcccaaatgttcgtgaacaaagcctatcaaaaatctggtatgagtctaccggttttaaccacttccgtggtgatgcatggatgccagaaggatgccgtagttgcccagataaagatcgcgattttggtggctgtcgttgtcaagcttatatgttaacaggtgacgcaagtaatgcggatcctgtttgtggtaaatcgccgtatcatcaattcattgagcaggcacgtgccgagagcgaaattgattcctctctggaaaaattggtattccgtaatagccgaaattcaaagcaatttacggttcaacaaaacattccggttcaaaatattgtagatgattag

SEQ ID NO: 3483 - DNA, 276 bp, Acinetobacter baumannii
agaatgatgactactgccacaattattctagtgttggtcgcagcaaatattaatgccttgggaactttattgttggtcaaatttaaagttatcagccaaaaaaaagcattttcatattttacttggatattgttcatattttttataggcctttatttcaagttgtttggcgacaaggtagacattgatcgttctgaaatttggctcatctgtgtaatcggttacagcattgtatttggacctgaagattggggaatgtatgacgaaaacaactga

SEQ ID NO: 3484 - DNA, 729 bp, Acinetobacter baumannii
tctaggatgacattaatgcaattaactgagcaacagcaagacaaactcagtaaagttcaattagaagaaagctggaaaagatcattaactccatttttactgagtccttatatggatagtttaagagactttctgtttcaacaaaaacaggctcaaaaaaccatatatccaccgagtaaacaaatatttaatgctttaaatattacgccgttagatcatgtgaaagtcgttatattagggcaagatccatatcatggtccaaatcaggcaaatggcttaagtttctcggttcaaagaggggttgcattaccaccatctttacgtaatatttttcatgaactacatacagatttaggtgtgccggtttctcgtcatggtgatttaaccaaatgggctgagcaaggcgtacttttattaaacagtgtacttactgtagaagcagggcaacccacatcacatcaaaaacaaggttgggaagagtttactgacgcagtaattgatgttttgaatgaacaacgtgaacacattgtttttattttatggggtgcttatgcacaacgtaaaggacaacgtataaatagagaaaaacacttggttttgactgctgcacatccatcgccacttgcgactaatcgtggtggtttctttggatgtaaagtgttttccaaaacaaatcaatatttgaaacaacatggcattgagcccatagactggcaattggacgcatga

SEQ ID NO: 3485 - DNA, 963 bp, Acinetobacter baumannii
acaatggcgacctttcaaaaacgtaatggtagagtgacagctaccgttagaattaagccgcatccggctaagtcaaaaacatttgatactttgcgtgatgcaaagaaatgggcgcaagaaacagaagtaagattaaagaatgaaaagttagagattttcgaccatattatatttaaagatgccttaattgagtaccgtgatactgtctctattaataaacgtggctttgaaaaagaacgaagaaaaataaactttttactaaaagctatgtatgtagatcagccactcattcaagttaataaagacttcttaacagaatggcgtgagcaaagacttttaaatgttaaaggtgccacgattagacgtgagtttattttgctgtcagcttttttcacgtggtgcattgatgtcaagcgatggctatcggtaaaccctctacgtgaaattaagttcccttcagaatcaccgcatcgagaacgtgtaattagtgatgaagaaatagaaattttattacctttcttatctactgagatgcgctatatctttttaatcgctttacaaactggaatgagactttcagaaatttgcaatctgaaatgggaaaaaattagattgagtaaaagctatttaattttagaccttacaaaaaatggtcgtgctagggaagtgcctttaagctcccaagcggttgaaatctttaaatccattggcccaaaaaagcaagggtatgtatttagtataactagcgatgatgcaaccgatgaatttcgtgatgctaaattagaagcgggtttagaaggttttactttccatgacagtcgccatactgcagcaacaaaaattgctttaaaaatcccgttgcttgatctgtgtaaaatgtttgggtggagtaatccacggcgtgcgatgatttactacaatcccacatctagtgagattgcagcgcggctttcacagccgtaa

SEQ ID NO: 3486 - DNA, 540 bp, Acinetobacter baumannii
ttaatgtggacctcatttctaatgaatcattttgagttgttcaatttacctgtggcactcgatatcgatttggcaagcttgaaatcaaatttcttaagtttgcaacaacaatatcatccagataaagccgcagataaagatcaagcattgatcaaatcaagtgaaatcaatcaagcttttaaaacgctttctcaagttgatagccgcgctgcttatcttttagctcttaaaaagcaagatcatcatcttgatcaatctattagtgatttcgaatttctacaatccgctttagaacttcgtgaacaacttgatgaagcgacatcatctgaacatttacgtactttaagattagaagtacaacaatggattgatggtttggtccgtgaattcaaaattgattacagtgaagaagattgggcagaagcacgcgataccgtacgtaagttacgtttctttcaacgtgttttaaacgatattgataaagcagaagatcaactgttagatgatgaagacagttttgatttagacgacgatttttaa

SEQ ID NO: 3487 - DNA, 195 bp, Acinetobacter baumannii
cactcttttgccaaattcactcgaattgaattagtgatcatgactgatagtgaagttttaaccatccaaggggcgttaaaacttgctaaggtccgaattgatgtagtcggtgaaaattgccatccacgtaaaccgatatcaattaactgtcctgtttgttttaattgctcaaaccaaggtttaccttgtaaataa

SEQ ID NO: 3488 - DNA, 339 bp, Acinetobacter baumannii
atgagctttgcatcattattttgggctattgctgccatgatgcaagcatgcatgctcagccaatttggtcagaaaaagcttcaatatagctggcttaaaagtacatctagacgaattttatatggaacaaccatattatttttgcttagttcattgttttggaattgctcctttgaaggaagctctgtaggagtcttatcatggttttttgccataatcacaaccgctttcttttttcaaattattgttttttatttttttagaaaatattttattcctatttggttaatggtaatcgtcgttgcaattattttctcgattgttgagtgggtaccttaa

SEQ ID NO: 3489 - DNA, 357 bp, Acinetobacter baumannii
cttgttcttgcaaggtggtgcggcatgagcgacctagaaaccaaagctaaagattataagtccgagcgtgaccaggaactaaatgacctgcgctcaatcttggaaacggaacacggtaaacgttttctaatgcgcctgattaatagatcgaactatctacagccaacctatggcacaggcgcacatatgagtgattttgcatttatggaggggcgccgagagtttggcgtttacatcattggcgagattacacaagtagattccaacgcatggctagacatgcaaagagaccattttaaaaagactgaacagaaggtgaaccatgagcgaagtgacaacaactacgacagcaactga

SEQ ID NO: 3490 - DNA, 798 bp, Acinetobacter baumannii
ggaggatctgcaatgaatatagatttaaaaggaaaagtcgctgtggtgagtggcggtgcaacactgattggtaaagctgttgtacaagctttggtaagtgcaggtgctcatgtcgctatcttagatattgatgccaaaggcaaggcaattgcggaaagctttaaccatgacgtgatgtttattcaaaccgatttaaccagtgatgcagctattcaacaagctgtggcagatattcatcaacatttaggtgaagtgagttacttggtgaatttggcatgtacatatttagatgaaggttttaaatcttcacgtcaggactggttgcaagcactcgatcttaatttggtctctacagttgagctgagccgtgctttataccatgacctaaaaaagcagcaaggttcaatcgttaattttacttcaatctcggccaaagtggcacaaacaggacgctggttatatccggtttctaaggccgcgatacgtcaactcacacaaagcatggcaatggattttgctgccgatggtattcgtgtcaattcggtttctccgggttggacatggtctcgtgtcattgcagaagtcagtggcaataaccgtgaaaaagccgatagcgtggcagccgattatcacttgctaggccgattgggtcatcccgaagaagtcgccaatgttgttttgtttttattgtcacctgctgcgagctttgtcaccggagcagattatgcggtcgacggtggctattcagtaatgggccctgaaggatcacagcccgctattccacgtttagccgaatag

SEQ ID NO: 3491 - DNA, 1008 bp, Acinetobacter baumannii
aacgggtctgccattttaggagtttttatgaatacacaaattgaccgtgaaaaattcctagaaaaccgcaaaaaaggtattggcggttcagatgtggcagccattctaggtttcagcccttataaatcaccatatcaattatggcttgataaaacaggtcgtagcgagcagtcagaacaaaatgaatctgctcacttcggaaatttacttgaagatgtagttgctaaagagttttcacgccgatcaggtatgaaagtacagcgcgtaaaacaacagttatttttggaagatcacccgtgggcaatcggcaatattgaccgtgccgtgatcaatcctgaaatctcaggaaacgtacgctttaaagatggtgcattgactacagatcaattgcttgaatgcaaaacagctagtgaatacatgagcaagttattcggcgaacaagacactgaccagataccagactattacctaacacaatgtctttggtatctgatgattactggctgtcaagttattcatttagctgtgctaattggtggcaataagttccgtatgtatcgcatcgaacgcgatgaggaccttattaaatctattttcaaccaagtaaaagcattctggtttaaccatgttttagcagatgtaccaccagaaccaacttgttttgatgatgttttacatcgttggtctaaacacgtaattggtaaacaggtagaagcaacacgcgatcatttaaaactagctgaagaactaatcaaagttcaacaagctaaaaaggatgcggaagctcgcgaagaagctatcaagttagaaatcgctacttctatgcaagatgctgaaatgatgattagtcaaggtaaagctatctgcacctataaagcccaatcttcaacacgcattgataccaaagtgttgaaggaaaaagaacctgaactttttgaaaaatattgcagtactagcagtactcgagtttttcgcatcgcaaccaaatttaaagaatctctaatttaa

SEQ ID NO: 3492 - DNA, 1584 bp, Acinetobacter baumannii
tgtattgatgcatctcaaccgtgctcatcaagcaatgggagaggtgtcatgaacttagcacttttcccaaatgaattaatcattgataactttgcgggcggtggcggtaccagtactggccttgaagctgcatttggtcgtgctgttgatattgcaatcaatcatgacccaaaagctttagcaatgcaccgtgctaaccacccagacactaagcattattgcgagtcagtttgggatgtggacccaatagaagcaacacaaaatcagcctgttggtttagtttggctttcacctgattgtaaacactttagcaaagcaaaaggcggtaagcctgttgaaaagaaaattcgtggccttgcttggattgccttgcgttgggcagatttaacgcgtccgcgcgtaattatgcttgaaaacgttgaagaatttaaaacttggggccgtcttggtgaagatggcaaaccttgtccgaaacataagggcgaaacattccgtagttttgtgaaagccttacgctatcaaggttataacgttgaatggcgtgaacttaaagcatgtgattatggctctccaactacaagaaagcgtttctttttaattgctcgtcgtgacggtttgcctatcgtctggcctaaacaaacgcatggtgaccctgaatctaaagctgttttaactggaaaattaaaaccttggcgcaccgcagcagaatgtattgattggtcattgccttgtccaagtatttttacaagacaaaagccacttgctgaagctactttgcgtcgtattgcaatggggactatgcgttatgttatcgataaccctaagccatttattgtgaaatcgaaccacggtggggatacattccgtggtcaagcaattgaatcaccattacaggcaatgaccagtaaaaatggttatgcactggcaatgcctgttttgactgaatgtgctaatgcatcaagcccacgttgtatgcctgctaatgaaccactgagaacaatttgtgctggtgtgaaaggcgggcatcatgcacttgtttcggcatttcttgctaaaaattacactggtgtaattggtagtgatgctgataagccgattcatacaattacatcgaaagatcatcacagcattgtagctagtcacctggtcaaacttcgcaataataatatcggtcatcgtgttgatgaacctattcacactattacttcaagcggtgcacactttgctgaagttcgtgcattccttactgctttctatggaaatgaacgtgatggaaacagcattgataatccgctgcgcactattccaacaagagatagattcggtctagttactgttgaaggtcagacttatcagattggtgatattggctttcgtatgcttcaaccacatgagttattcaaggctcaaggttttcctgatgattacattttcagttatggaattgatgagcacgggaacactgtaaaactgactaaaacagaacaaacgcgcatggtcggtaactctgtttgccctcagctttctgaagcacttgtaagagctaatttctcacacgaaaagaaatatcagggggcagcatga

SEQ ID NO: 3493 - DNA, 309 bp, Acinetobacter baumannii
ccacagcccgcccagaccaacttattttcaaggagtgcaagagtggcaaactctgctcaagctaaaaaacgtgcgcgccaaaacgttaaagcgcgtaaacacaacgcaagcttgcgttctatggttcgtacttacatcaaacgtactttaagtgcaatcgctggtggtgattatgctgttgctacagaagcttacaaaaaagctgttcctgtaatcgaccgcatggctgataaaggcatcatccacaaaaataaagctgctcgtcataagagccgtttaaatgctcaagttaaagctttagctaactaa

SEQ ID NO: 3494 - DNA, 1704 bp, Acinetobacter baumannii
tccaagaccgctgactttatcaggtatatcatgaccgaatcttttgcagccctctttgaagaaagtgaattaaacctcaacgttgaaaagggtgcagtcatccaaggtgttgttgtaaacatcgatagtgactgggttactgttgacactggccttaaatctgaaggcattgttgaccgtgctgaatttttaaatgaacaacgtgaacttgaagttcaggttggcgatactgttgacgtagttgttgaagctcttgacaacggtatgggtcaaacagttttatcacgtgaaaaagctaaacgtgctgaaacttggactaaacttgaaaaaatctttgaagatggcgaaatcgttactggtgttatctctggtaaagttaaaggcggtttcactgttgacatcggtcctgttcgtgcgttcttaccaggctcattagttgacactcgtcctatccgtgacacaactcaccttgaaggtaaagagttagagtttaaagtaatcaagcttgatgctaaacgtaacaacgttgttgtatctcgtcgtgctgttatggaagctgaatcttctgctgaccgtgaagcattacttgctcaacttgaagaaggtcaaacagttacaggtactatcaaaaaccttactgattacggtgcattcgttgatcttggcggtattgatggtcttcttcatatcacagatatggcttggaagcgtatcaagcacccttcagaagttgttgaagttggtcaagaagttactgttaaagtacttaagtttgaccgtgaacgtaaccgcgtatctttaggccttaaacaattaggtgaagatccatggttagcgatcatgagccgttaccctaaaggttctatcgttaaagcacgtgttactaacttaactgactacggctgtttcgctgaaatcgctgaaggcgttgaaggtttagtacacgtttctgaaatggaccacactaacaaaaacatccacccatctaaagttgttcagatcggtgacgaagttgatgttatggttcttgaagttgacgaagaacgtcgtcgtatcagccttggtatcaaacaaactcgtgctaacccatgggaagagtttgctaagtctcatgagaaaggcgaaaaagtttcaggtacaatcaagtctatcactgactttggtatcttcattggtttaaatggcggtatcgacggtctagttcacttgtctgatatttcttggaacgaacaaggcgaagaagctatccgtcgttacaagaaaggtgacactgttgaagcagttatcttgtctgtagacgctgaaggtaaccgtatcagccttggtatcaagcaattgaacagcgatccgttcaatgatttcttagctgctaacgaacgtggtgctttagttaaaggtactgtaactgcagttgatgctcgtggcgcaactgttaagttagctgacgaagtagaagctactcttaaagcttctgaaatcaaccgtgaccgcgttgaagacgcaactaaattcttagaagttggtcaagaagttgaagcgaaaatcatcaacgttgaccgtaaatctcgctctatcaacttgtctatcaaagcgaaagacgaagctgaagagaaagaagcagttgctaacttgcgtacagcatcagcttctcaagacaatggccctaagactattggtgacttgatcaaagcacaaatgaagtaa

SEQ ID NO: 3495 - DNA, 942 bp, Acinetobacter baumannii
tgtggtatagcttttgcttcatataaattgcacgctgaaaaagcactgctgcattccaatcatctatacttgacgaattatacttttcataatctttatgtagcgctatattcttgggtatatatcgctgcaaaaaacgacaaaaaggtaaacataatggaaactgatacgaagataaaaaaattggctttagcctgttcagtcctcagcatcggattggtctttaatatctcagccaaggctgaatcagttactgtttatgcagcagcaagtttaacgaatgcaattaacgatttagaaaaaatttacgaaaaacagaataaagtagaagttaaaacttcgtatgcaggatcatcaaccttagctaaacaaattgaagctggagcaccagctgatatttttatttcagcagatacccagtggatggattatctacaaaacaaaaaacgagttgcagcaaatgaccgtataaatttattaggtaaccgtttggtgctaattaccccaaaagggcagtcattaaacataaaattagataaagccacagatcctaataaagtgtttacaggcaagatttgtacaggagataccaaaagtgtgcctgtaggcaaatatgctaaacaagcttttactaatttaggttggtggaatcgtattgagccaaagttagttgaaacagaagatgttcgagctgctttaaactttgttgcgcgtggtgaatgtcaggtcggtattgtctatgcaaccgatgctgcgattagtaaagacgtgaaggtagcaggcatatttccggaaaatacgcattcaccaattatttatcctgtagggataattaaaaagaactcaaactcagcaaagttctatcaatttttacaaagcaaccaagctaaagctgtctttaaaaaatatggctttagtgtgttggctccagtcaagccatga

SEQ ID NO: 3496 - DNA, 1665 bp, Acinetobacter baumannii
tcggttacagcattgtatttggacctgaagattggggaatgtatgacgaaaacaactgatgatgaaatccttgcattgcttgccgaaatggatgaatcagagattgagcaatatctattaacgctcaatgaagatgaacaggcagaaatagcaaaactacttgccgatgcacctatttggtttccattggaaggcccgcaaatggctgcgtatttatctcaagccgatgttattggctatggtggtgcagcaggtggcggtaaaacggatttaatcgttggttcattcttaacagtgcataaacgtagcttggttgtacgccgagagaaagcgcaaacagacggtatcgtacagcgttgtgaagaaattctaggccataagaatggctataactcacaaaaatcattctggaacttgggcaatggccgtttaatcgaatttggtggacttgataacttgggtgatgagaagcgttggcaaggtcgtgcccatgattttaaggcactcgatgaagctacagaaattcgtgagtcacaagcacgctttgtaatgggttggaatcgttcatcagacccaacaatcaaatcgaaatgtctaatgaccttcaacccaccaactacagcggaagggcgatgggtaattgattactttgcaccttggattaagaaggggcatccgaaccctgcaaagcctggtgaactccgttggttcgcgatggtaaaaggcaaggagcaggaagttgaaagtaataaaccatttgtacttattgatgatcaaattgtttatgacttcgacccgaaggattacaagcctgaacacattattaagcccaagtcacgcacgttcattcctgcacgtgtaacagataacaagtactacatggaaacaggctacatgagtactttacaagcattgcctgaacctttgaggtcacaaatgttatacggcgatttcggtgcgggtattgaagatgatccttggcaagttatcccgaccgcttgggtagaagctgcacaagcacgttggaaaccagaagatgaaatgcgccttatgtacaagggcgtgtttccaatggattcatacggcttagacgttgcacgtggcggtaaagacaacacaattggttatgcacgtcacggcttttggtacaacaaggcaaacgtattagagggcattcagtctaaagacgggcctgcaagtgcatcgtttgctgtgtcgcatgttcgtgaccatgcgcccattcatgtcgatgtgattggtgtaggtgcaagtacttacgatttcttaaagcaatcaggtattcatgtggtgcctgttgatgtgcgtaatgctgcaacttctttcgaccgctcagggcaacttagtttttacaacctacgttcacaactttggtggcaattccgcgaatctttagaccctgcatatggaagcacagttgctttacctcctgagcctgagcttttagccgacttaaccgcaccacgttggtcattacaaggcacaaacatcaaggtcgaatcaagggaagatatcgttaaacgtattggccgcagtcccgactatggctctgcaattatcaacgcgcaaattgatacgcctaaacgccacattatgcagacgatcaatgcatcagctgctagacgcgattacgacccttacgcgtag

SEQ ID NO: 3497 - DNA, 699 bp, Acinetobacter baumannii
ccgctgcaagccaaaaccagagcattgcttcaattatggccaataactttgatgacccgcgcgcctttgctccgtggtggtttgatgcagatcaagctcaggcattcttggcctcaaaaaccgcagcaaaagtcgcttaaggccaaaatatcaaagggagatttaaaaatggacacaattgaaactttagctttacaaacgattaatgccgaaaacccaagagaaattcgtaatttgcttggtcagtttgcaactggcgttaccgtgattaccactcgtggtaaagatggtcgaaaaataggaatgacagccaattccttttcatctctgtcgttagacccgccattaattttgtggagcctttcaaaaacggcgccaagtttgcctgattttgtagaagcagaatattttgccattcacatgttggcacaagagcatcatcagctttcggggcattttgctcgaggtgccgaagacaaatttgcaggcattgcccatcaacaatgcaatgctggcgttccaattttgactgatgcactcgcaaccttggtttgtcgcaatgtaaatcagtatgaaggcggagatcacctgatttttattggtcaaattgaacaataccaacagcgccaaggtgaaccattggtattccacgcaggaaagtatcgaattgccgctgagcatccagaattagcacattaa

SEQ ID NO: 3498 - DNA, 3480 bp, Acinetobacter baumannii
ctcataaaagccatatacatgtttcaacaagaaatctctcaattgaatttgcaacagctcaaggccggtgaaaagcgttgggtggggtcattattaggttcatcagcagctttattgcttaaagaaattgccactcagcattcttctttattggtattagttgctagaaacaaccaacatgttgctcaattagaaagtgaacttgagttttatggagttaagccgacaatttttccggattgggaaattttgccttatgaccgtttatctccccatcaagatattgtgtcagaacgtcttgctattttatctaatatgcctcagcaaggcgtattactgatttcagcaagtaccttggctcaacgggttgcaccttactcatgggtattgggagaacactttgatataaaagtgggtcaaaaatttgatttagaacaacaaaaattaaggttagttcaggcgggctaccacttagtagatacagtttatgaccatggtgagtttgctgtacgcggtagtattatggatatttttgcatctgggcaagaatctccgatccgcatagatttatttgacgatgaaattgattctttaaaattctttgaccctgaaactcaaagaacaacaaccacactaaaaagttttacggttttacccgcgaaagaattccctttaaaagaaggacgttcagtttttagagaccgttattctgagttttttcctactgccaatcctaagaaaaatccaatttatcaggacgttttagatggtatagcatcgcctggtattgaattttatttaccgctattttttgataaagaacaaatgcaaacacaaagtatgtttacaacatacttaccaaagaattgcattgtaattacaactaatgatattgacactgatttaacaaacttctggaaagaagttatgcgtcgttatgaagaccgacgccataatatggatcaacctattcttgctccagaagagttatttatttctccaaatcatttgttaagtgctttaaaccagtttccacgaatgcttgtaagcgcagaaactattgaagaaaaagctggtgcacttaatcttaaaactgaacaaccacccaagttgccagtcgatccgaaaaaagaaaaaccatttagtgccgtaaaaaaatatattgatgaagcaaatcatcccgttctattggttgcggaaagtgcaggacgtcgtgaaagcttaaaagatgcgttgcgttcaagtttaggcgagattccgaatgtagagaattttgagcaattccaaattagtcagttcgcaattgctattactaatgcacctttagatcgtggtttacttttaactgatcaattaacggttatttcagaaaatcagctttacgagcaccgagttgtacagcgtcgtcgcaagcgtcaacaggaagtttcagaagagtttctgatccgaagcttaactgagctaagcattggtgctcctgttgtacatatcgatcatggtgtggggcgttatgctggtttaattacactcgcgattgaaggacaagactatgagttcttacaactagattatgccgaagatgcaaaagtctatgttccagtaacgaacttgcatctaattagccgttatagtggtggcgacccggatttagcaccgttacataaaatcggtactgatgcgtggagtaaagctaagcgtaaagcattagagcaaattcatgacgttgcagctgagcttttacatattcaggcacgtcgtcagtcaaaacccggctttgcttttgaactggaccagtcgctctatatgcaatttgcgagtggctttgcgtatgaagaaacacttgatcaggctaatgcaattgaagccacactctatgatatgcagcaagcaaaaccaatggataggttggtgtgtggtgatgtgggttttggtaaaaccgaggtggccatgcgtgcagcatttgtagcggtacaaaatggcaaacaagttgctgttttagttcctacgactttactagctcaacaacattatgagtcttttaaagaccgttttgctgattggccagtacgtattgaagtactctcacgttttggttcaaacaaaacacatttgaaaaatattgaagacttggcaaatggtaaagtcgatattgtggtaggtacacataagcttctacaagagaatgttcagtttaaagatttaggtttaatggttgtagacgaggagcatcgctttggtgtgcgtgataaggagcgtatcaaagctttacgtgccgatgttgatatgttgacacttacagcaacgccaattcctcgtacgcttaatatggctttttcgggtatgcgtgatttgtcgattattgcgactccgccagcccgtcgattagcagtaaaaacctttgtgcaagagcatacagatgcttcaatcaaggaagcgattttgcgtgagttacttcgtggtggacaagtttatttcttacataatgaagtagagaccattgagcgagctgctgaaaatattcgtgtgcttgtacccgaagcacgtgtagcggtagcacatggacaaatgcgtgaacgcgaacttgagcaagttatgcagcagttctatcacaaagaatataatgtgctggtgtgctcaaccattattgagacaggtatcgatgttccaaatgctaatacaattttgattgaacgtgcggataaacttggtttagcgcaattacaccagttacgtggccgtgtaggtcgttcgcatcaccaagcatacgcgtatttattagtaccttcgattaaacacttaaaaggtgatgccgaaaaacgccttgatgcgattcaacgtgcttcgacattaggtgcaggctttatgctcgctacggaagatttggaaattcgtggagcaggcgaattgttaggcgagcaacaaagtggctcaatgcaggcgataggatatagcttgtatatggaaatgcttgagaaagcgactaaagcaattcaacagggtaaaaccccgaattttgatgctccattgtcgttaactgccgaaattaacttacatattcctgcacttattccagatgattacctaggtgatgttcatcagcgtctattattctataaacgtattagtaataccgatacacaggaaaaactagataacatccgtatggagcttattgaccgtttcggtattccaccgcagtcggttaagcacttatttagcgtgcatcaaatccgtttgaaagcagaacatttaagtattacgaaaattgatattaatactcaaggtggaaatattgagttttcaccagatacgccagttcaggccattagtattattcagttaatgcaaaaaaatccgacctattaccgtatggaaggcggacaacgtttgaaggtgatggtgcagcttgaagagtatgaaaaacgaattcaatttatcaatgatttattgcaaaaattgatgagtgaactacatgcctga

SEQ ID NO: 3499 - DNA, 1182 bp, Acinetobacter baumannii
atcgccttggcaaaccgaaaacttaaaataggcattgtagttggagaagtttctggagatacgctcggcgtaaaactcatgcgtagttttcgtgagcagggaatcgatgctgaatttgagggaatcggtggccctcaaatgattgcggaaggttttaacagttattacccaatggaaactctgtctgtgatgggcattgttgaggtattaaaagacttaaaaaaactattcgccgtacgtgatggcttaattaatcaatggactcagcatccagttgatatttttattggtattgatgcaccagactttaacctcagactttcgaaaagtatcaaagaaaagaatcttccaataaaaacagttcaatatgtgagtccatcagtttgggcatggcgtcaagggcgagtacatggcatcaaacaaagtatagatttagtactttgcttatttccttttgaaaaagttttttatgaacaatatgaagttccagcggcatttgtaggccatccattagctaaacaattaccgcttgagaaccctattcaaattgctaaacaagaattgggtgttgatgaaaatcaaaaacatattgctttgttgcctggtagccgcaaaggtgaagtagaaagacttcttcctatgctattgggggcagccaatattttgcatacaaaatatccagatattcagtttttaattccggcaattaatgatgcgcgcaaacagcagattgagcagggggttgaacaattagcaccgcagttaaaagcaaaaattcatattttagaaaatacggatagcgaatcgaaaattggtcgtatggtcatgaacgcgagtgacattattgccttagcatctggaacggcgacattagaagccatgctcatgcatagaccaatggtcactttctataaactgcattggttaacttatttaattgctaaattcttggtgaaaataccttattactctttgccaaatatcatcgcgggtaaaaaagtaattgaagagctgattcaggcagatgcaacacctgaaaatttagcggctgaaatagaaaaactaatgaatgttgaaaccgctcaaattcaagtaatgcaacatttaactatgcataaacagcttatttctggaaatacagaagatccggttcaagccattttgcaatatttgaatagctaa

SEQ ID NO: 3500 - DNA, 861 bp, Acinetobacter baumannii
ttttgcatggcttatcaaactttagaacagctgcagcagtctaaagccaagcttcacgaaactgtggtgcttgatgaaaatatgcaacttgcattttggtctaatcagcaagatcgtgtaagtgtctgtagcgatcaccacactttaagtctttatattcaagatggttatgaaagctatcaaaaaacacctgcgggctggaaaaatggtggtgggccgggacgtttttgcctattgcccgaacatcaggagtcaacttgggacatacgtggtgggcttaaatttgtccacttgtactacaccgaccaacatttgcgtgatgttgctgaaaaaatatgggacaaagagccgaatcaaattgaactaaacgaagttgtatttaatgatgatgaacggattcgggcgttatatcaattcttcttgttagattgcgattggcaagattcttcaaatcatttgcaaatgagtacaacggcaagtttattattgaatcacttaattcgaaaatatagtagtgttcaatggcaacagcctactatcaagggcggactggcaccccataaactcaaatatattcaggaatggattgaagatcatctagatcaggctctcactttgtctgatttggcgaatattgtgaatttaagcgaataccattttgctcatatgtttaaacagtccatgaatatggcgcctcaccaatatgtcatgcaaagacgcttaaccaaggctaaggggctaattcagtcatctcagctttctttgcaagatattgccttagtatgtgggtttagttcagcaagccatttaagtcatcgctttaaacaattttatggcatgagtccttcgcagttacgttaa

SEQ ID NO: 3501 - DNA, 966 bp, Acinetobacter baumannii
ttcataatggccgttagttacaaacaccaacagggtgtcgctttactgacaatacttattatggttgccttggctacaattttagcggcttctattgccaagcatcaaaataatactatggaaaatacagcctacttaatacgccaaaatcaatctttgctttatgcaaaaagtgcagaagcttttttttcagaattattaattcaagatgcaaataatgcaggtggagtagatcatttaaaagagacatgggcacaacctatgcctccgtttcctattgaagatggtttggtatccggacgtttgcttgatgagtctggtaaatttaatttaaataatctaactaatggggaaggcattgtaaatgaagatgctaaaagttggtttgaacgtttattggtacgtgtgggattaccagccgaattaagccaagctgtgattgattggcaagatccaaatgaagagccaactgggccaatgggggcagaaagtagttattatgaaggtttggatccaggttacatggctgcgaatactaaattccaccgtattgaagagttaaagctagtgagaggctttgatggaaaaaaatttgatctaatcgctccatatatttctgctttaccagaaaattcgaagttaaatattaatactgcttcgccattggttttagcaagtatggatgaaaaattagatataggagctattgaaaaagaattgcaaacacgtcaacaaaatttaaagttcttccaaaatgtagatgaattatggcaattgaatgctttttcagcggttgatagtcaaaagaaaaatcaagtaaatagccttattgatgttaaatccagcttctttcaagctcagattgaagttgttctaaataataggaagcgacagtttactagtgctttaatgagaaaagataaacaagtatatgtttattcaagaagcatggctccatttaactaa

SEQ ID NO: 3502 - DNA, 501 bp, Acinetobacter baumannii
ggcggcccggcggacgcgtttccttccagccccgtcggtgtaagacaataccgtgtagaaatgcttaaaagtggtattgaactgtatgagtttaaacctgttctagaacgacgacgtagaacatggtacgaaatcgtaacaggcagcgttataccagcaaaaggaaaaaataagtcgagcttgcatgccaagttttttgatgtagatggcaaagtctttatcggatcatttaactttgatccccgctctacctatttaaacaccgaagtaggtttggtgattgagtccagtcaattacaaactcagatttctgttatgttagatcaacatttacctcaagtagcctatcaacttaagctaaatagccaaggccaaattacttggctagattaccaagcaaacggacaagtcattgaatatgataaagacccgggaaccagccgttttcagagaacaatgattaaagctgtctcttatttgccaattgagtggatgatgtaa

SEQ ID NO: 3503 - DNA, 183 bp, Acinetobacter baumannii
atgttcagggctaatcgtcggtcgctccacttaggcgtctccaaaggcaaattttgcaaagtgactattctactgagtgaggtagtgcaaagcaacgctttgccttgtgaaccagtgttttacatatctatcttgaacagtcacgcctcaaaaacaaaatactttgttttaattaagaaataa

SEQ ID NO: 3504 - DNA, 717 bp, Acinetobacter baumannii
ctaaagcatttgcttcttcgtgagagttcaatgacagttcaaattattactattgatggtccgagtggttcgggtaaaggaacattagcggcgaaacttgctgcgtattatcaatttcatttacttgattcgggtgccttatatcgtttgttagggttgtcattacataaacatgatttattggaaaaattagatagccatttagatgagtgtgttaactatgctcgtcagcttaatattaagtttgaaacctcggcagagggaacattagttttcctcgatggggaagatgtaacccaaactatccgtacagagcgtgttggagaatatgcatctaaagttgcagcaataccagagctcagacaagcactctttgaacgccaaagagcatttgcacaaactccgggattagttgcagatggtcgagatatggcaacatcaattttcccggaagctaatgctaaaatttatttgactgcttcagctgagtcgcgtgctgagcgaagagtaaaacagttgcagggtatggggctagatgctaaaataaacgacattttagctaatatacaagcgcgtgacaaaagagatatggagcgagaagtagctcctctcaagccagccgcagacgcttatattattgatagttcggaattaacgatcgatcaagtatttaagttgatggttgattacgtcaatagccgtactgttagcaactaa

SEQ ID NO: 3505 - DNA, 924 bp, Acinetobacter baumannii
gatattaattttatgcatatttatattttaggttcagcagctggaggcggtttccctcagtggaactgtaattgtcctaattgccatggtgttcgtacaggtacgattaatgccaaagtgcggactcaatcttcaattgcaatttcagaaaacggcgtagactggattttattaaacgcatcaccagatatccgtcaacaattatttgattttaaagcggctcaaccagcgcgaaaattacgtgatactggtattactaatgttattttaatggatagccaacttgaccataccactggacttttaactttacgtgaaggctgtccaatgaatgtgtggtgtactgaaatggtctatcaagatctcacctcgggttttccggtattcaatatgctgaaacactggaatggtggtcttcaatatcatcaaattgatcctaaacaagcttttaaaattaatggtttcgacaatttagaatttttacccttaattattcaaagcgcggcgccgccatactcgccacatcgccatgacccgcatgagggcgacaatattgccttaatcatcaaagatcacaaaacacaaaaacagttgttttatgcgccagggcttggaaagattgacgatcaaatcatgcagattatgcaagattctgactgcgtcatgattgatggcacactatggacagatgatgaaatgcagcaaaccggtgtagggaaaaaaactggccgtgaaatggggcatttatacattagtggtgaaggcggttcgttatcttacttaaaccaactcagtacaccaaagaaagtgctaattcatattaataataccaatccgattttaaatgaagactctgctcaatttgctgaactaaaagcaaatggtgtagaagttgcctttgatggcatgcaaattgaactctaa

SEQ ID NO: 3506 - DNA, 1200 bp, Acinetobacter baumannii
agagagctttacatgaattttcagcgcatgactgaccttaatttagcaggtaaacgtgtccttattcgtgaagatttaaacgttcctgttaagaatggtgtgattaccagcgatgctcgtttacgtgccgcacttccaacaataaaagctgctttagaaaaaggcgctgctgtaatggtattttcacatttaggtcgtcctgtggaaggtgagccaaagcctgaacaatcacttgcaccagtggctgcatatttaactgaagcattaggtcaagaagttaaattatttactgattatttagatggtgttgaagttgaagcaggacaagttgttttgcttgaaaatgttcgttttaatcctggtgaaaagaaaaataatcctgaacttgcacaaaaatatgcagctctatgtgatgtgtttgtaatggatgcttttggtactgctcaccgtgcagaagcttctacagaaggtgtagcacgttttgcacctgttgcagcggcaggcccattattggctgctgaattagatgcacttggccgtgcaatgcaaacacctgaaaaaccaatggtggcaattgtcgctggttctaaagtttcaacaaaacttgatgtattaaattcattatctggtatttgtgaccaactgattgtgggcggtggtattgcaaatactttcttggcggctgctggttacaatgttggtaaatctttatatgaagctgacttggttgaaactgcaaaacaaattgctgctaaagtaagtgttccacttcctacagacgtagttgtagctgatgcttcacaaattaacttcgaagatttcttaggttctttggcagcagcgcaagcagtaattaagaaagttgaagatgtaacagcaaatgatatgattttggatgttggccctgaaacagctaaagcatttgcaaatatattaacaacttcaaaaacgattctttggaatggtcctgttggtgtatttgaagttgatcaatttggtgaaggtactaaagcactttctcttgcagttgcacaatctgatgcattctcaattgctggtggtggtgatactttagctgcgatcgataaatataatgtagctgatcaaattggttatatttcaacaggtggtggtgcattccttgaatttgttgaaggaaaaacattgccagcagttgccgttttacttgaacgtgcttaa

SEQ ID NO: 3507 - DNA, 204 bp, Acinetobacter baumannii
attttgatttacttatattttaacacctttgaccaatctataaaattaaataaatatttgaatatattaaactttagaacaagtattcattctatatacgctcatataccaacgattatttctcgactaccctcttttttgttatgcaaaaaatgcataattgctttaataaatgcattagaagtgaagcatttcgaattctaa

SEQ ID NO: 3508 - DNA, 705 bp, Acinetobacter baumannii
atatttgtttaccagattaattctaagttaggtcatatatttctaatttatattcttggggaagaaaatatgtgggaacttgtgaaagcgggcggctggttaatgctgcctttaattttgtgttcaattttaaccgtcgcaattattattgagcgttttgtacgtttaagacgttcacaagttttacctaaagtactaatgaatgatggcagtgcagatatttctgttgtcataacaaatttggaacaggatactaatgcgcaaagcacggcattgggcaatattctaaaagctggttttgagcatcaggaacatggcgaacaatttgctcgagcacaaatggaagctatggcttctcaagaaatctcttatttagaaaaaaatattaacttcttagggaccttaagtgctatagcgcctctactagggctgcttggaacagttgtgggaattattgagtcttttttggttattgattttggttcggcaggtagtcctagtttaatgattcccggtatttccaaggctttgatcacaacagcagttggtatgctcattgcaattcctgcacttatttcctatcgatattttcaaagagtagtgcaagattatattgctgagttagagcaacaatcgacgctatttcatgcctcattgttttacaaacgttcttcaatcatgcaagaacatcgccgcgttggttga

SEQ ID NO: 3509 - DNA, 528 bp, Acinetobacter baumannii
ctttgttattataagaatattttgtggttaaataacacttcgtctctctcatccgatcaggagcttagatcaatggataatgcaaacatagaaacacaagcagaagagcaaggagaaaaaaataaatcaaaatcaaaaagttctagaaaatctgcattagattttagaaagtatacgaaacaaatctggttggcaggtttgggtgctttttctcgtgccgaagaagaagggagtaaactatttgactcattagtcaaagtaggagaagagttagaatccaaaacaggtgatttagcagatacaactgttggtaaagtaaccgaaaaagcaaaagagtcagtttctgatacaaaagataaggtcgagaaaattttagatacgagtgtaaaccactctttaaatagaattggcttggtcactccgaaggatttacagcacattgaacaactcctagttcaactgcatataaaggtagatgctttaattgaagaaaatcagaaattgaaggcaaaattgaatgaaaagtaa

SEQ ID NO: 3510 - DNA, 1803 bp, Acinetobacter baumannii
aaaactaattacgtgggtatgaacttgaaattaaaattttttaagctcgtcattttaagtctggctattacatcagttccttgtgcttacgcaattacgccagcgcaaccaaacaaaattttgcatgttgcctatgaggccccagatgatggtttcgatatggtcaaaaccaccaatttctatagtgctagtattgctgaggcaatttttgagcctttactcaaatatgactatctagcgcgtccattacagttagtacccaatactgtagaaagcctgcccaaagtggaacaagacggtaaagtttatatatttaagattaagccgggtatctattttaccaatgatccagcttttaaaggtaaacgccgtgagttggtagctgaagactacgtctatacaattaaacgcattttagaccctaaaaatagagcgccttctgtttcttttattgatggtaagttacaaggtgccgatacagttgtagctcaagcaaagaaaactggaaaatttgattatgctgctccgattgctggagttaaagctcttgatcgatacactctacaatttactttgactcgccaagactttaattttccttatattcttgcctatattacttttggtgctgttgctaaagaggttgttgactattacggtgaccgtattggtatgcatcccgtaggtactggtccttatatgttaagtaaatatgtaccgagaagtaaggtcgagttagttgctaatcctgattatcgtggttttgtctggaattttaagtcaacaggaacaccttgggataaccaacttgttaaggaaatgtctggaaagaaaatgccacaagttggcaaggtggtggtcagtattattgaagaagagcagtcacgatggttagcttttcagtctggacaactagactttgataaactcacagcgaatgctgttcctcaagctttagatggaaatcagcttaaagcttcttttaagaagagaggaattaagcactatccaaataaggatcctgagattacctatactatgatgaatatgcgggatccagtgatcggtggttttagcccagaaaaaatagcgcttcgtagagcaattactctgtcatacaatcaaaaagaaagcatacaacaagcttataaaagtcaggctgttagatcacaaatgtttatacctgaaggtgtaaacggatataaccctaaatataaaagtagcgtaggatataatccgctgttagcaaataaactacttgattattatggttataaaaaagcggctgatggctatcggaccttaccaaatggtaaacctttaattttaaaaatcaatacagaaaatagctcagcatcggttattcattcagaactctggaaaaaaaatctagatgcgattggcattcgagctgactttaaggtaagtaactttgcagataacttaaaagccgctactcaatgtaaatatatgatctggagcggtgcatggattgctgactatcctgaaggagataattttgcacaattactatatggaccaaatgctgggcagggaaaccatgcttgttatcagtctaaaacctatgatgctctttatactcaggccattcatttaccacctcaacaacggctcccatattacgaaaaacttaaccgtcagatagaagctgataatccttggattattcatgtaacacgaattcgtaattggttagtacagcctcaagttcaggggtttaaagctcacccaatgatgaatacaaactggcaatatcttgatatgacccctattaaaaaataa

SEQ ID NO: 3511 - DNA, 930 bp, Acinetobacter baumannii
caatctatctattattatatgcagtccattagtctcattattcaaatttttcttgtattagcatttggttattttctaggtcctaaactctcactaaatattcggcattttatttttaaaatcctgccttatttttcttatattttactaaccagtgtagctttagaactaacactcgcccttgaccaaattgataacccttctactatacttccacctgctctattaattgcattaaccacttctcttggttctttttttacttgcttattcgcctatacaatttttgataaagaaagtgttaaagggaaaatttcacttcaactttttatgaatgcattaaaaaatattgccaaggcatttttagctttaacaataggcgtgattttaggaattcttcttacccaattacatacccatattccctttaatagttggtatttactattactttttatttttttaatcggaatcgaacttgcttttactcattttaatcgcacatggttaagctggaaaattcttattgtacctttggccgcctttataggctcgtgcttagctgggtttctcaactattccttacttggtcatgagtttacacttaatgaaatattagctttgggccaaggctatggttggtattcaatgtcaggtattttatttacacagctacattcagctgagttaggtgggattgccttgctcacagatctatttagagagatagttgcaattttactcatgtataccatgggttggcggtttccacgtccagcgatttcaagtgctggcgctacctcaatggatgtaacattagcaatggtaaaacagtcatgtggcacacattatgtaccacatgccatgatgagcggcttactcttaagtctactcgctccacttttaattactgtgtttttaaacttttaa

SEQ ID NO: 3512 - DNA, 513 bp, Acinetobacter baumannii
acctttacctatgaagctattggccctagaggtagaaatgacatgagacgaaataatattgagattcgcaagccaacagagcgcgatattcgtattcttgttgaaaatctacgacctgcggatcaagaagaactaaaagcatatttcagtgataactatcaatggattgtgaaaacatgtgttaaaggttcacgcgattcgtgggcagtcgttgttaatggcaaactgctatttatttgtggcgtgggcattacaagcctaattggtaaagtagggtgcccatggttgcttggtaccacgcacattagcaagtacccaatcgaatttattaagcagacacgcaatattctaaaagaaatgcttttagatcatgacctacttcgaaaccatgtttacatcaaaaacgatgcagcaattcgttttctaaaacacttaggttttaaattagatgctccagaagtgcacgggataaacggtgaatttttttatccgtttagtatggtggctgcatga

SEQ ID NO: 3513 - DNA, 453 bp, Acinetobacter baumannii
ttatgttactactattattcttatgcacaagaaggcacatttagggaaccaagtaatatgactgtaaccatacctcatgatatccagagttcagattgccaaagagttagtcaagtattggctagagttggagagaaatggagtatactcattgtaatgacacttgcatcacatcctcatcgcttttctgaaataaagagacgtatcaatggaatatcgcagcgtatgcttaccttatgtttgcgtggtttagaacgagatgggttggttaaacgtacggtttatcctgtagttccacctcatgttgaatatgaattaactccactgggccattcacttacagagcctgtaattgctttaggccaatgggctcagcagcatattgcagatattgatgcggcaagagctgcatttgatgcagctcaggagaaaccaattacattagacacttaa

SEQ ID NO: 3514 - DNA, 603 bp, Acinetobacter baumannii
gtcaaacactaccaatgcacatgcagaagtaatgtcccttttagaaaagccattattagcagaaacgttaatcaaaacacgcggcaaccaaaccaaggcagccgaattacttggtttaaaccgcggaacgttacgccaacgtttgaaagctcacaacattttaaaaacgaaggtgacagcatgacagacgcagaaattgaaagaagtaattttgaactatttgaactaagcaaaagaccttgtgctaaacgtgaaagcttatttgaaagatttgattcaaatggacttggcgaatcagaacaacattatgttggtaaatatgttgatagttacatgcaagagaaatgggagttgtgggaaaaagccaaagctcaggcggtgccagttactcatacacatagtgtgactttaacctgtgctgaattaaaagaagcttatgactttggcgcgccagatgaatcacaagaacaaatgactgacttagtcacaattggttggcatgaagatgggcacagtggtgccggctactatgcgtatatgaccgaatgtgaggatgaagggtctattaaattgggtgaaagcgaatcgggagctgagggatga

SEQ ID NO: 3515 - DNA, 1077 bp, Acinetobacter baumannii
atgattagctatgagaaaaccgatatgaaccatggcacatttcctgtttttgatggccataatgatgtactaacccgattgtggttaagtgatcataaaaatcctgctcaagcttttattcaagaaggtttagcaggacatctcgatttaaaacgttgccaacaagccggttttgttggtggtatgtttgctattttcttgccaccttttcattatgttaagcagcatcatcccaacaaactatttgaccaagacgcatccgacttcacgcaacagcaaattgaacacatttgtttggcacagctcgatttagcaaaacaacttgccgagtactctaacgacattcaaatttgcacaactgttcaagacatccagcactgcctaacacagcaaaagttagccattgtattgcatatggaaggtgctgaagcattacaacataatccagatttactcgatgtattttatgatgccgggcttcgtagcatcggtccactttggaatagaccaagtcgttttggacatggtttaaatgtcaagtttccgcattcacctgatactggagcaggtcttacaaacgaaggtaaagcttttataaagcgctgtgctgataaaaaaatggtgattgatgtttcccatatgaatgaacgagctttttgggatacagctaacattcttcagcaaccaattgtcgcaactcactcaaatgtgcatgctttatgtccacaagccagaaacttaacagataaccaacttaaagcaattaaggactctaaaggcatagtcgggttaaattttgatgtcgcattttttcgtaaagacgggcagcgtgatgcaaacacatccattgaggtacttttagaacatcttgaatatttaatagatcaaatgggagaaaatcatgtcggttttggttctgactttgatggagcactgattagtcatgaaattgaagatgtaaggggactacacctactgattgaagcaatgcaaaagcggcattactcaaatgagattatagaaaaaatttgtttttcgaattggttaaccgtgctcaatcgcatcctaggtaaataa

SEQ ID NO: 3516 - DNA, 960 bp, Acinetobacter baumannii
ggcgtatcatattgcacttggttaggttcgttagttcaaaggctttatatgattgttcgtgataaaagcaatgtatttaaactcttatttgcttggaaaggaacaattttgccgaaggttttgcctgcactgagttttgtggtacttatttcagcctgtgtggtctggctctcttattatcattggattcaaatacctaccgtacccgcgatcggatttaccatctttggtgtgattctttcgatttgtacgggctttcgaaataacgcatgttatgaccgatggtgggaaggtcgcaagctctggggggctttaattgccaatgccagacatattgttagagatagccatgttttatctaatgaacaacgtgaacatttaattcatcaggtcttaacttttagtaacttgttgcgtgatcgactgcgtcaacaaacagtcgaacccaccaaatttcttgagcatgcctatttaaataactcttcacttaattatttaaatgagcatattaatgcaccgcagtttgtactcgaaaatattcaaaaagatttagtcaaagctctaaaagacggcgaaattagtgacattatctatggcactctgacacgccatattgttgagctaggcaatattcaagcgggttgtgaccgaattgctggtacacctttaccctactcttattctgtacttttacatcgtgctgtttactgtttctgttttatattaccgtttagccttgaagcagctttaggtatttggacaccgcttattgtcggcttaatcgcttatatgtttttaggtttagatgccttaagtgctcaaattgaagaaccttttggtttgcaagaaaatgatttaccgcttgattcaattgtacgtttgattgagcgagaatctctaagctctttaggacagccattaccacccattattgaagcccaagacaacaatttactttaa

SEQ ID NO: 3517 - DNA, 417 bp, Acinetobacter baumannii
tacatggcatatgatgatcaaaatatcttcgcaaaaattttacgtggtgaacttccagcgataaaactctatgaagatgatcaagttctagcttttatggatattatgccccaagccgatggtcatgcattagttattccaaaaactcctgcagtaactttacttgatttacctcctgaagcggcagcttataccatccagatcgtgcaaaaaattgctaaggcaatggaaactgcattaaatttggatggaattgtgctcatgcagttatcaggagcagctgccggacaaactgtccctcatgttcattttcacctaattccgacaaatgttcaccaacttggcaaacatgcggcgcaattaggagaccaagataaaatcaaagctttggctgagaaaattaaaacagcactttga

SEQ ID NO: 3518 - DNA, 1257 bp, Acinetobacter baumannii
ctatatagatatatagaaaaaggaaatatgactatgaatgcaccagtaaatgttcagcaagaacttatgccagtgccagcgtctatgcgtgagatagatcgtaagcgctatttatggatgattagtccggctctacctgtaattggtttaggtattttagctggataccattttggtccacgcccattaaagaaagtatttgctttaggtggcccacttttattacacgttgtgattcctgcaattgatacaattattggtaaagatgcgcgtaatccaaccgatgaagaaattaaacttcttgagaaagatccatattattcgcgtttggtaaaaagttttattccattgcagtatgcggcaaatatttatgcatgttatttaacaagccgtaaagatacttcatttattgacaaaattttgcttggtatttcgatgggtgccattaatggtattgcaattaatacagcccatgaattaagccataaacatgatcgtatagaccatattttatctcatcttgctttagtgcctacaggttacaaccatttccgtattgagcatccatatggccatcataagcgtgcagctactcctgaagatccggcatcttcacgtatgggtgaaacattctatgaattttggccacgtactgttatcggttcttttaaatcagcaattgaaattgagaaaaatcgtttaaaacgtaaaggtaaagagttttggtcactcgataatgaattgctgcaaggctggggtatgagtgctgctttccatgcttctatggtaggaatttttggtaaaggtacgattccttatttagcaacacaagcattttacgggattagcctattcgaaattattaactatattgaacattatggcttattgcgtcagaaaaaagaaaatggccaatatgaacgtacaatgccagagcatagctggaataataacaatgtagtgaccaacttattcttatatcagttacagcgtcactcagatcatcatgcttatccaactcgtccattccaagcgttacgtcattttgatgaagcaccagagttgccaagtggctatgcaagtatgctgctaccagccatgattccttcatggtggtttaaaatgatggataagcgtgtatttgatcactacaaaggggatttaaataaagcaaatatttcaccaaaacgtcgtgcaaaaatcttcaaaaaatttggtgtagtcgataagtccttagaagctacacaggctgaataa

SEQ ID NO: 3519 - DNA, 294 bp, Acinetobacter baumannii
atgagtcatctaaaaaaacaagaaaattttaattttacctatagcaggatcttttttatctgtttagccgcttattgctacagttcatggctcagccttgttttagctaaatggttaccttttgctaaagcagagaatgtttatttttcggtatttatcagttttatcttttttattttttatattgtctttacgagttccattttatcaaaactatggttttggatgatcaatagcttaggcgtagcgttactagtgagctattggctattagctaaatggggagtggcttaa

SEQ ID NO: 3520 - DNA, 1302 bp, Acinetobacter baumannii
aaaaaatttcagatagaagataaagccataacaatgtcaggagttgacactatggctggtcaaaccattcaaattaaaacagcatctggaaagcagttcagtgcatatctagcgacgccagaaacaggaaaaggacctggagtggtgctttgtcaggaaatctttggggtgaatgcagcaatgcgggaaaaggcagattttcttgcagaagaaggctataccgttttagttcctgatctattttggcgtgtagcacctaatatagaactcggttatacaccagatgattttcaaaaagcttttgaactttatcagcaatatgacgaaaacctcggtgttgaagatattcaagccagcttagcttttttaaagacacgaccagaatgtgataccgctacaggcctcggcgtggttggctattgtttaggtggaaagctagcttatttggcaggctgtcgactttcggaagtggcatgtgccgtaggttattacggtgtaggcattgaaaaagcgttagatgagttagctaacgtaaaaggacgtttggttttacatattgcagaactggaccaatttacaccgccagatgcgagacaagcgattgtcgatgcagttaaccaatattcaaatgtacaagcttatgtttacgaagatgttgatcatgcctttgcacgaccaaaaagcaaccattaccacaaaccttcagcacgctttgctcacgagcgtacagtaacagcactacatgaaacgattggcccgaaatatgacttagttacactatgggaagaacatattcgtcatgagttcgatacacgtgacgtccccgcaactatggcaacaatggtcgcagaaccttatgtcaaccatattccaacgttaactggtggggtaggccaaagccagcttgctcgtttttatcagtatcactttgttcatcaaaacccgaaagatatgaagatcacttcgatctctcgtacggttggctcaacgcaagtggtagacgagttcattatgagctttacacatgacgctgaaattgactggttattaccgggtgtaaaaccaaccggtaaatacgtcgaaattccaatgttaggtgtaattcagttcagaggttcaaagctatgccatgagcatatttactgggaccaagcgtctgtactcgttcaaattggtttattagacccaacaggcttaccagttgcaggtgtagagaccgcgcgaaaacttcttgatgaagaccttccttccaatactttgatgccatcttggtcaagtagtgaaggcaagccagtcaattaa

SEQ ID NO: 3521 - DNA, 795 bp, Acinetobacter baumannii
tcgcccgttcacaggaactgtgcacataccggaggatttaatatgaatgcgatggtgaatcttttaaacggcttcaaattagctgaaggattttgcgaaatacaccaggtgcaaaaagtacaggcgggaccgcatcaaatttgcccaagttgtgcaatcaatcatgttcatgactcaaagcaaggtgaacaagcacgtgttgatcaaatggtacgtgacaaacactttggtggtgcaatgcttcctgaacgtcatgctcaatctgcatttgataactacaaaacacttactcatgcacaagcaaatacgcttactgaatgcatccagtatgcccaagcattacttgcaggtgataaatccaatttcatcatggttggttcaactggtacgggtaaaacccatctaggttgtgcaactgcaaaaacacttctcaaaaaaggcctgtacgttcgatacatcacaagtgaagagcttgcgcagcgtgtcatgaatgcatgggataaggacacaaaagatcaatcagaagcatctgtaatttatgagttcactacatacgacttattgatcttggatgaatacggtttgcatgaccgtggtaccagacttgaaattattcataaggttttgacagcacgttatgaccgcaaaaaaccaacgatgctcatttcaaatttttctatgaataagctcaaggcagatttgggcgaccgtctatggtcacgctttcagcatgatggcttacgtactgttgaatgcaattggtccgatgctcgtgtaggtggtgcctatgtctaa

SEQ ID NO: 3522 - DNA, 762 bp, Acinetobacter baumannii
aacatgactcaaacacctgaagctttaacgaccgaacaatttaaacaggctattattgataaaggtcagtattatcatatctatcacccatttcatgtgatgatgtatgaaggtaaagccactcaacaacaaattcaggcttgggttgcaaaccgctactactatcagatcaatattccgctcaaagatgccgcgatcatggcaaattgtcctgatcaacgtgtgcgacaggaatggattcagcgcatgattgaccaagatggtgaatatcctgatggcggtggacgagaagcatggttacggttagccgaagctgtaggcttgagtcgtgagcaagtgatttccgaagaattggttttgccgggtgtacgattcgccgtagatgcctatgtaaattttgcacgccgtgcgtcatggcgtgaggcagcaagcagttctttaactgagctatttgcgcctcaaattcatcagtctcgtcttgagtcatggccacagcattacccttggattgatgacaagggctatgaatatttccgctctcgtttaagtcaagcacgccgtgatgttgaacatggtttaactatcacgcttgattcatttactactcatgaacaacaacaaagaatgctggaaatattacagtttaaactggatattttatggagcattttggatgctttaacactggcatatgtacacaatgaagcaccgtatcatagcgtgactcaagaacgggtatggcacaaaggactatttaaatga

SEQ ID NO: 3523 - DNA, 2244 bp, Acinetobacter baumannii
aaatcggctcagcacttatttctagcgcttcaaattatgcacggtatggcaggtagttattcaatggaaagacgttcgttaaatcttcacttcatgacatgctctaaaacagcattggcttcatctattgcactcataacatctgtcgtctatgcaaatgaagcggaggtttcgcagctcccaaccattactgtgaacgctacacaaaatagtgatgcactatacacatcaaaaaaagtgagtttatctggttttcaaactggtgatgtaaagaaagtccctgcatctattaccaccattacatctgaacgtatagcagatcaacacgcaaaaacactgaccgatgtgattaaaaatgattcatccttaggcgatggttatgctgcaattggctactatccaaattttgtagcacgtggttttgcgcttgatttaggctcaagctatctcattaatggccataccatacgtggcgaacaaaatgtagctttagaaaataaagaacaagttgaaatcttaaaaggcatttctgcaattcaaagtggaatgtcgacaccaggtggtgtgattaactatgtaaccaaaagaccagccgatgttaaaaacattacagtcgatgcaaattcagaaggtggttatacactggcaacggatgtaggcggctttgttaatgatagttttggttatcgaatcaatttagcccatgaaagcatccatccaaatgttgatcacgcaaatggtaagcgtgagtttggttcagttgctttagactggaaaattaatgagcgttctaaactactgtttgacattgaagctcagcatcaaagccaacgttcagtacccggttatcagctgcttgatgggcaagaagtaccaacaaatgtagatcaagaccgtttattgggttatcagtcttggagtaaacctgttgtaaataacagtgtaaatacgagtttgaaatatcaatatgcatttaacgatcaatggaatggtagcttaagtgcatcgcaaagccgtgttgtgattgatgataatagtgctttcccatggggatgttatagcagcatttgtgaagttaccggtttgggcaatacttttgataaacacggaaattatgatatttacgattttcgtagtccagatgacacacgcattactaaccagtttgcggctgggttaaatggacaattcaacactggcaatattcagcatcaagtagctttcgaattacaacgtacttataaaaccttaaagcaccatacacctctgaatgtagcggtaggaacaggcaatatctatgaagatacggtggtcgactacagtccatcatcagaaagtccaggcgatcgttacaaagctctagagagtgatcagactgcacttactgtatctgaccgagttcaatttaatgatcaatggtcaactctactcggtggaaaactgattcaccttgatgagcaagcttataattcagatgggcagcaaagccgtgatacggatttaaacaaattcttgccacaattagcactcatgtatagtccaatttccacgactaatctttatgcttcatatgccaaaggattatcagatggtggtgaagctccgtggttcgctaataatgctctagaagttctatctcctaaaaactctgaacaatatgaagttggtgttaagcaacaaatacgcaatttcttagtaacagcagctatttttgatttaaaacaagacaatcaatacagtaaagtaaatgcagatagaacttttgattttgttgagcaaggcgaacaacacaatcaaggtattgagttaggtttaacaggtgccttaaccgatacactcgatgtaagttcaggtgttacctataccaaatctcgtctagttgatattgatactgacaactacaaaggccaccaaactcaaaatgtaccgaaagtacgtgccacagcccagttatcttataaagtaccgtcagttgaaggattaagattattgagtggtatgcaatacagtagcagtaaatatgcaaacaaagagggaacggcaaaagtaggtggttatagcgtctttaatattggtgctgcctataaaacaaattttgctgggcatgacacaacttttagattcaatattgataacttgtttaataagaaatattggcgtgatgtaggggcatttatgggagatgactatctgttcttaggtaatcctcgcacagctcaattttctacaacttttagcttttaa

SEQ ID NO: 3524 - DNA, 2280 bp, Acinetobacter baumannii
gcacgtaatcacatacgttcaaaacaagtactttttaagatgacaccttgttgtcttgccatatcggctatttttgcacagcaggcttatgcagaaaccgtaactcaaacggctgaggtaagcgaaaatgcaacacaaaaaccagtagcccaattgcaaaagattgtagtaactgcgactcgtacaccaaaaaatattgcagagattgcaggtacagttcaatctattgatcagaaacaaattatccagcaagctacggcgggtcgtaaagttgctgatattcttgctcaacttgtaccatctcttgcatcaagtagtggaacaacaagtaattatggtcagacaatgcgtggacgaaacgtattagtcatgatcgatggcgtttcgcaaacaggttctcgcgatgtttcccgtcaattaaatagtattagtcctggtatgattgaacgcattgaagtaatttcgggtgcgactagtatttatgggtcaggtgctactggcggtattattaatattattactaaaagagcagatacatctaaaccacttagctttgaaacaaaagtaggcattacatcttcagatacattccgtagtgacggcttagcttatgaagtcggacaatctgtctcatttaataaaggcaatatggatggtttcttaggagctaattttacaagtagagggtctcaatttgatggaaatggcgatagaatttccttaagcccttggcaaggtagtacgatggacactgatactatcgatgtaaatgggcgtttaaatttcaatttaaatgatactcagacattgagctttggtgcccagtactataaagataagcaggatactgactacggaccggattactcttatttaccgacaacctctaagagtaatgatgctacaacgccaacttataaggcaattaaaggtttaaagcttagtaatccattatttaccgagcgttatgctgttaattcacagtatcaaaatcaagactttttaggccaaatactaaatgttgaagcatattatagaaatgaaaaatcacgtttcttcccatatggcctatcaaataaatccgtgacttctgtaaaccagtctcaatcagaaattgaagtagctggattacgttcaactatgcaaaccgatcttaatatcgccaatcgggatatgaaaataacctatggccttgattatgattgggaaaaagataagcaatttgttgacattttggcgactcaatatccttatttagtatatacgccaacaggccaacgtaaaggttatggaccaaatactgaaattcaaaatattggggcatttgttcaaagcgattatgcagttacggataaattgaacttgcaagcaggtattcgttaccaatatattcaagcggataccgatgcttatattcctagccgagagacaacaatggttccggcaggatcaacacatgatgataagccgttatttaatttaggtgcagtttataaacttacagatgcacagcaggtatatgctaatttctctcagggctttagtttccctgacgtacaacgtatgttgcgcgatgtttctacttataccgtttcaacagcaaatctacagccaattacagtaaatagttatgaactaggttggcgtttgaatcaggatgatggcctaaatctgggattgactggtttttacaatacttcggataaaactgtccaattcaacaatcgtgcagcaaaggttgtagatacagatcaaagagtatacggggcggaagcaactattagttatccatttatggaaaattataaggtcggtggcactttaggatatacccgtggtcagtataaagacgtggcgaataaatggcatgaattaaactcatttacggttgctcctgtgaaaggaactctttttgctgaatgggataataatgaagggtatggtgttcgtgttcagatgcaagctattaaaggaacaaataaagcttataaagatgaccgtgaattagccgcatttgcaacaactcaagatgaagctttcagaaaagctgtagagaatgacgcaaatagtgctgcgcaaatcaaaggttataccactatggatgtattagcacatttcccggcttggaaaggtcgtgtagattttggtgtttataatgtgtggaaccgtcagtatcgaacagtatttgctcagcaagcagccgtctctaatgctaatccgttgttagcaatccctgcagaaggccgtacttatggtttaagttatacttttaactattaa

SEQ ID NO: 3525 - DNA, 765 bp, Acinetobacter baumannii
ccaaacaatcattttaaaaattgtttgtctacagtttcaggagtaactatgggcatgacttttacagacatagaaaataaatctgccaaacgcctaattggtattgctgcagtcatttttctgcatcttcttgttgcctatattctgatgtcaggtttagcaaacaatattcaaaaaccagcagaaaaacctgtggaattacaaattattcaggatattaagccacctcctccaccaaagccggaagagccgaaaccaaaggaaaaaccacctgagccaccaaaaatggtagaaaaagttgccaaggttcctgagccaccaaaagaagtagagaaagtagcaacaccagtacaaaaaacgacgccagtagctcaaacgactaaagtcgctactccggctcctgctgcacctagtactccttctccgagccctgttgctgcaccagctccagtggcagctgctgcaccagcacttaaacccgctggtgtaactcgtggtgtttcagaaggctctgcgggctgcgaaaaaccagaatatccacgcgaagcactcatgaacgaagagcaaggtacggtgcgtatacgtgttttagttgatacttccggcaaagtcattgatgccaaagtaaaaaaatcgagtggtagcaaaaccttagataaagcagcaactaaagcctacagcttatgtacgttcaaaccagcaatgaaagatggcgtacctcagcaagactggtatgaaattgaatatccattcgtaattgaataa

SEQ ID NO: 3526 - DNA, 234 bp, Acinetobacter baumannii
ggattaaatcacatgactaatttaacagaacataagtgcaaaaacaaatgtcctgagtttaaaggagagcagtgtaaccactgtttggttcaaccagtagaacagcgaaaaattgaagatatgggcgatgaccgtcacattgaaaatcatgtttctaaaaactgtcacgttacttcgtgtgatgtattgatgcatctcaaccgtgctcatcaagcaatgggagaggtgtcatga

SEQ ID NO: 3527 - DNA, 273 bp, Acinetobacter baumannii
gtactaaatcaccaattgtggaaaatagtgatgaatttaaaacttacctttgctgctttgttaattgtcccaatgatgttgactgcttgtgcgaaaaaagaagaggcgactcatgcaggccaagatgcggcatctacagctgttgctgacaaagtaactcctgaacaacaagctgcaatcgatgcgcttgataagccagttttagatgaaaagaatacagatgtagttgaaggtagtgtatctagcgagacggctgcttcagaaacgcattaa

SEQ ID NO: 3528 - DNA, 444 bp, Acinetobacter baumannii
tgggtagatcacaatatgaagtttaaacgttctcaggttgaagacattcatatcaatctaacacctatgattgactgtttattgttcattctagtgtttttattgttatctaccacttttaatcagccaagtcgcatcaatttaactttaccagatgcacaaggtgttccaccaaaacagtacgatcataaaattgaagtcgtggtagactctagcggacattacgccgtgaatggtcaggcgctatctaccaaagatgtggctgatttgagcactgcaattaagcaaattgctcaagagcgacgtgactttatgtttatcattgctgctgatgcaaaagcatcccatcaggatgttattcgtgttatggatgtagcaggacaactcggttttgttaacatcaatattagtaccaaagttccttctagaggtttttctgagtga

SEQ ID NO: 3529 - DNA, 222 bp, Acinetobacter baumannii
ataagttttttagctattaatttttatttatcacaaacttacaccgtaaaaataaaattaaaaaattttaattcatttcatacacttgcaaaacaaacctttaaccaacctttattaatttataatatttgctgtgcactatacgcattaataaattctttatttcttatttatagaaataaggttttttattataaccagtcaagttgcaaattaatttaa

SEQ ID NO: 3530 - DNA, 1743 bp, Acinetobacter baumannii
gaggaaatccaaatgtcagaacaagaaaaaaagaccccattacttcacattgaaaacttacgtgtaagctttaaaggtgaagataaacaatatatcgaaactgtgaaaggaatttcctttgatattccgaccaatacgactgtagctttggttggtgaatcaggtagtggtaagtctgttacttctttagcaactatgggtttattacctgtgggccaaagcaagattgatgagaaaagtaagattatttttgaaggtaaagacttgcttggcttatcgcgtacagagatgcgaaaaatctgtggtaaagatattgccatgatttttcaggaaccgatgtcatcattaaatccggtttttacggttggcaatcaaattgcagaagtgttgtgtttacatatgggtatgagccgaaaacaggcgcgacaacgtgttttagagttgcttaaagaggtcggtataccttcaccagaaacgaaaattgatgcttatcctaaccagctttcgggtggtcagcagcaacgtgtcatgattgcaatggcaattgcttgtgaacctaagctactgattgccgatgagccgactacggcacttgatgtcactattcaaaaacagattattgatttacttgaatcattgcgtcagcgccgtcaaatgtcgatgctttttattactcacgatttggctttggttggtgaaattgcagatcaaatgattgtgatgcgacatggtgaaattagagagcaaggtacggctgaacaagttttggaacagcctaaagatgtatatacccgagccttactttactgtcgtcctcaaatgtcacaacgaccttatcgtttgcctgtaacaagcgattttatgcgacaagaaaacaatatattggtagagcaaagctttgatgtttcagaaattcctgagcgtaaacgtggtttaaatggcgatgagcaaattattttagaagtaaaagatctgaaaaaaagtttttatagtcgtaagggactgtttggcaaagaagaatttcaggcggtaaaaggcgtttcttttaaattggctaaagggaaaacgcttggtttggtaggagagtcgggctccggtaaaacgactgtcgggttattgctcatgcgcttacatcaagcctctggggggcaggctttaattgaaggtaaagatattctttctttaactgaaaaagagtttgccaaatatcaaaggaagatccaaatcatctttcaaaatccatatgcttcactaaatccacgctttacgattgggcagatcttattggaacctatgcaaattcatggaattggtaaagatgatgcggaacgtaagcaaattgcgcttggtttacttgagagggtgaatctgcctgaacaagcttattatcgatatccgcatgagttctcgggcggtcaacgccaacgtattgcgattgcgcgctgcttaacgctaaagcctgaaatactaatttgtgatgaatctgtttcggcgttagatgtttcagttcaggcacaagtacttaatttattacaagacttacaagatgagtttgggcttagttatatttttatttcacatgacttgtcggttgtgaaatatatctctgatcaggttatggtcatgaatcatggtgaagttgttgaaatcgccaactcggatgagctctatgcacatccgcaacatgactacaccaaacgactattacaggccattccacaaggaattcagcacgtttcgtaa

SEQ ID NO: 3531 - DNA, 186 bp, Acinetobacter baumannii
atgtcagaccaagtattagtagttgctatcaaaaaaggtttttaccacggtattcgtgacgtaggcacagagttttatgtgcctgcggatttggtgaacccaaaagtaaaaacttggtttaagccagttgaggaaaagccgaaagcatcgggtcgaggcgcgacaggctcaacacaagctgaataa

SEQ ID NO: 3532 - DNA, 747 bp, Acinetobacter baumannii
gccgtgagccagctaccccaagatcccaaaaatcacaagcctctttacgatcagttaagggaactcatccttaacaaaattgtaaatggtgaatatgccgtgttgagtcaaattccatctgaaaacgagtttgctgaacagtttggtgtaagccgaatcacagttcgccaagcactcaaccaattacagttggaaggctatatttttaaggtgccaggtaaagggacctttgtaagtaagccaaaaacgttccagaacatttcaagtttgcaaggttttgcagaagcaatgtcatctgctggtcacgaaattttaaaccgtgtcatctcggccgagcttaagcaggtcccgatgcacgttgtacccaaattaaagttacctgttaaagccaatgtatacgaaattcaacgtgttcgtttactcaaccgtcaaccagtgtcttatgagttgacttatttgcctgaacatattggtttgaagcttaaagaaaaagcgattgatttacgtacaaccgatattttcaaggcattagaacaagagtgcgatatccctttgggacatgcagatttaagcattgatgccacggtggcggatgaagaattagcggctttgttacaagtcgaaatcggaactcctgtattacgggtcgaacgtttgactcatgacgcaaatggccaaccgattgactatgaatatctctatttctcgggcgataccttccagtaccgtttacgtattcatcgttaa

SEQ ID NO: 3533 - DNA, 1356 bp, Acinetobacter baumannii
gaaggaatacatatgaaaacgatagatgcaaacacgattatcaaccgtgagaaactatctccattacagtggatggtttttatcctaggattttttgtcttcttctgtgatggtctagacacaggaattattggttttgttgctcctgcattactggatgactggggaattaccaaacctcaacttgctcccgttttaagtgctgccttagtcggcatgtcaattggtgcaatcatttcgggacctttagccgataagtttggccgtaaaggcgttattgtttttaccagccttttgttttccatatttaccattttgtgtggctttgctaattcaacccaagacttaatgatttatcgctttattacaggtgttggtttaggggcagctatgccgaatatcagtactattgtctcagaatatatgcctgtaaaacgtaaagcattccttacaggtcttgctggctgtggatttatgctgggtatttcttgtggtggtgtgctgtcagcttatctattagaaagctatggctgggctaaagtgattattattggcggaagcattcccctaattttagtgattgctttgttgcttaaattacctgaatcaacgcaatatttgattacacgtcatcaacaagataaagcacagcgtatcttagagaatattcaaggctattctttccaaaagcctataaaacttgttttaactcaagcagaaactgcatcggatgaaaatccggttaaagtggttttaggaaaatacctgtggggttcaagcatgctttggctctgctgttttactagtcttttggtgttctatcttttaacaagctggatgccaacgattttaaaaacagcaggtttcagtacccaacagtttagtttaattgctgcgatcttcccttttggtggtgtaattggcgcaaccattatgggatggtacatggataaactgaacccaactacagtcattaaatattcatatctgattgctttcgtcctattcattattgcaggtttggtgagctcaaatattttcttattgggtcttactattttcttaattggtgcattactcgctggtgcacagtcttcattactgccacttgcagctatgttctatccagcagtatgccgcgcggttggagtttcatggatgcatggtatcggtcgtatcggtgcaattttaggcgctttctttggttcgctcattttcactttcaacctaagcttaagcggtattttctttattctagcaataccaaccttcatctcatttattgcacttagcctaaaagtaatttatgagaaatctaaacacaaacaagtgttaaagctcgaagaaagtctataa

SEQ ID NO: 3534 - DNA, 2553 bp, Acinetobacter baumannii
aatctaaaacaagctgagatttttgaagggttaagtgtagccacttataaactttttctctatgatgcgacaataattaattgtgaattagcatacttggttaatgagacaatgaagcatcagtttaaatttaatcctttagcgaccgctatttttacgctcttatgtagtggctccatacaatcaagttatgctgagtcagctggtgttgtctccaacatagacaataatcaacttaaggcgagtattaaggaagcctatccagggcaggaattctttcaacaatattatgttgataaatctgctcctgaggcgcaattgcgcaataataaatatttgagttcagcattctgccaaggaacttggattacaccaattaatcctgaaactaaagcattagatgcagataaagctacttcagttgtaacggctgattatgggcactacaaccctgccggcgactctgtgttggaaggaaacgtggtgatagatcaggaaggccgtacagttcgtgccgataaagtcaccatcgataaaactcaaacatttgcacatgcacaaggccgagtacagttagctcaaggcggcttactctctcaaagtgatgaaattgattacaatctaaagactcaaaccggaaatttagataatagtttttatatttctgaacaacaacatgcccatggtcatgctgggaagatcgagagaacctctccgaatgtaatggttctcaatgatgcgacttacacaacctgtccgccaggccagaaaccaggttggaaaattcaagccaacaaaattgagttgaaccaagaaactgggcgtggtgttacgcgcggaacaaaactatatgtaaaagatgttccagttctagcagttccctactttaacttcccgattgatgaccgccgtactacaggtatcctcaacccacaatttggtttctcaaacgatggtggtattgaactttcggttcctgtttatttaaaccttgcgcctaattacgatgcaacaattacgccacgttacttagcagatcgtggggcaatgttacaaggtgaattccgatatttgacggatgggtttggtgccggacagatttggggcggcattttgccatctgataaagaatatgatgataaagaccgtaaagatttccattttttacataattgggatatcaacgaccaatggtctaccaaccttgaatataactacgcatcagataaagactatttctctgatttagatagtagccctaactctaaaacagatcttaacttgcgtagagcttgggaacttaactatcagcatggtattccgggtttaaaagcacagcttaaagtcgaagatttccagacccttgacccagaagtaaaagacgtcaataaaccatacgcccgcttacctcaatttttattaaattatgtcactggtaatccactaggactacaatacgaatttaataacgatactgcttattttaagaaatcaattaacgatgattctgcacaagaaagtagcggtacgcgtatttataaccagtttgcaacacgttataactatcgaacaccagcagcctttgtaattcctgaggtttctgtacgttctattcaaaccttctatgacaaggacagtatcgcctctcaaggtttagatggcggttctgaaaacaaatcagtcgttgtgccacaatttacattggacactggattgaattttgaacgtgagggcaaatatttacaaacacttacaccacgcgccttctatgcctatgcgccatacaaaaatcaagatggctacccaaactttgactcaaccactgcgtcaattagttacgatcagttatttaacccttaccgcttctatggacatgaccgccttgaagacaataactttttatcgttaggtgtaagctatagtctttttgacacagtaggcttagagcgtttacgcgcaagtgtgggccaaagctattattttgaagatcgccgcgtcaccttgaaacaacaagatgaaattgatactgaacgcaatacaggtcctgttgttagcttatcaagccaacttaatcaaaacttcaccattgccgccaattcggcatggatgtcaaatggcgataatgcacagcgtgattttcaactttactatacaggcgataaaggaaatctctataatttaggctatttctaccgtaaagatattcctggtcgccaagatacatacgaccaagttgttgcatcgtttatacaaccaattaaagacaattggcgtattatggggcacgtacaatatgacatggacaatgatgttgcccgtgaattattactaggtgttaattatgaatcgtgttgctggggcatttctgtctatggccgctcatactataacgatctagacgatccaaaatctccagatgttagtgaaaagcgcgcgatcatggccgaaattacacttaaaggtttaggtggtttaaacaataaactcgcgtctttacttgaaaatcgcgttttaggttttaacaaaattaatcaatcttggacacaacgttaa

SEQ ID NO: 3535 - DNA, 237 bp, Acinetobacter baumannii
caggtgagacagatgaagagattgttacttgtattggctacaggatttggtttagatgggtgtgcatcgttaacacaaaaagcagatgaaaattatattactaaatcgcctgttactccggtcaatactgcctttaatgccactaaagtacttgaacatggaatttttactgagcaggatattgctgatatgcctgaacactcaagtataaattcccactataaaatatctttttaa

SEQ ID NO: 3536 - DNA, 1104 bp, Acinetobacter baumannii
ggagttggacatatggcagggaacagtattggacaactctttcgtgtgactacatgcggtgaatcgcatggggttggtttaatggcaattgttgatggagtgccaccaggccttgcattaaccgaagaagatttgcaaaaagatctggatcgccgtaagccgggaacctcgaaatttgcgacgcagcgtaaagagcctgatcaggttgaaatcatttctggtgtgtttgagggtaaaactactggtacgccaattggtttactcattcgcaatacagaccaaaaatcgaaagattatggaaatattgcacaaacttttagaccgggtcacgcagattacacttatacgcaaaagtatggtttccgcgactatcgtggcggtggccgttcaagtgctcgtgaaactgctatgcgtgttgcagctggtgctattgcgaagaaatatttagcagaaaaatttggtgttctgatccgcggtcatgtgactcaaattggtaatgaagttgctgaaaaactagattggaatgaagttccaaataatccatttttctgtggcgatgtagatgctgttcctcgttttgaagcattagttacatctttacgtgagcaaggtacaagttgcggtgctaagttagaaattttagccgaaaaagttcctgtaggttggggtgagcctgtttttgaccgtttagatgctgatattgcacatgcaatgatgagtattaatgcagttaaaggcgttgaaattggtgatggttttgctgtagcaggacagttcggacatgaaacacgtgacgaattggctagtcatggttttctagcaaatcatgctggtggtatcttgggtggtatttcaagtggccagaccattcgtgtggcgattgcactaaaaccaacagcaagtattactactccgggtaaaacgattaacttaaatcgtgaagatactgatgtgttaactaaaggccgtcatgacccgtgcgtaggcgttcgagcaactccaattgcggaagcaatgttagcaatagttctaatggatcatttcttacgccaccgtgctcaaaacgcggatgttgttcctccatttgcgccaattgaaccatag

SEQ ID NO: 3537 - DNA, 792 bp, Acinetobacter baumannii
acgtatttgcaccaagatttgctacaaggaggtgatttgatgtctctaagtgggaaacagcaacgctttgttgatgaatacctgatagatcgcaatggagcacaggcttatatcagagcaggctacaaggttaaaaatgaagatgtagctgctgtaatggcatctcgtctgttaaggattgataaggttaaggaagcaattgagaagggtgaaaaagagcttgcagaacgcaacaagatcactcaagacaaggtgctaaatcgcctttgggaaatggcaactgcggaccctaacgaactaatcagatatgtgcgtgttaattgccgctactgttggggcgtagatcactattaccaatggactaagggcgagtatcacaatgcttgttacaacgcattggtaaatcagaaacctaaacctgattgtgatggtggttttggctttaataaaaccagagcgccaaatcctgagtgccctgaatgccaaggtgaaggcaacggttatgtaactgttgcagatacaacacgtgtaagcgaacaagcaaaaatgctttatgcgggcattaaagaatctcaacacggtatagaaatcaaaatgaatgaccaagtggcggctttgattaaagccggtcaacacattggcatgttcaaggaacgtgtagagcacagtaacgaccctgaaaacccattaactgacaccaaagcatcaagcagaaaacttgctgcgcttgccaaacttaaaaaagcgaaggccaaggccgataaagcaaaggatacagacgatgaaaagtaa

SEQ ID NO: 3538 - DNA, 1026 bp, Acinetobacter baumannii
attttattgcaaatgaatacacaacgtgaacaattgatacatacatggcttacatctgttcttgaaaatgatcaatttcagatcgcttatttagcaggggatgcaagctttcgacgttatgctcgcatccagttacaaaataaaacgtatatgcttatggatgcgcctcctgaaaaagaagactgtgttccgtttgtgaccattgacgagttttttgcagggcatggggttcgagtacctcagatcgtcgcaaaagatttaaatcaaggttttctattgttagaagactttggtgatgtgctgctgtctacattgttaaacgatgaaacagttgatcaatattatgagcagagctttaaacagcttattcatttgcaatcgattaatggcgttgaacatttcccggtttattcttatgaaaagctcttatcggaaatgcagttattaacagattggatgttaccgtcactcgatatccatccaacagctgagcaaaagaaaactattgacgatgcatttgatttcttggctcaggcagcattagctcaaccgcaagttattgtacatcgtgattttcatagccgtaatttaatgaaaattgctaatgaagaagaattgggagtaatcgatttccaagacgcggttattggtgctgatacgtatgatttgatctcgattacacgtgatgcatatgtgcagtggaatgctgagcgtgtttatcaatggtttaaagtgttctatgagcttttaccagcatctgctaaacaaaaccgaagctttgaccaatttaaacgtgatgctgatttaatggcaattcaacgccatatcaaaattttaggtatttttgtccgtttgtttgagcgagatggtaagtctggttatttgaaggatttaccacgagtcatgtggtatttacttgaagagagccgtggctatcatgagcttgatgacttcatggcgtttattcacagttcggtaatgcctaaatttattgaaaaatatggcccttatgaggttgcagcataa

SEQ ID NO: 3539 - DNA, 522 bp, Acinetobacter baumannii
ttcatgttgcaattgattttaggtggtgcccgttctggtaaaagccgattggctgaacaaacggccatatctatgcaattagctgtcacttatgtggctacggcacaagcgcttgatccagaaatgcaaagccggattgtccatcatcaaaatcagcgtcctgctcactggtctttggttgaagaaccattatttttagcaaaaactctgcaagaaattgatcgaccgaaccaaattattctggtggattgtttaacactttggctaaccaatttgttacttttagaagatcaaaacattcaacaatttgagtgtgagcagctgttaagagttttacccacacttcagtcagaaattattttagtaagtaatgaaacgggtttaggcgttgtgccactaggtgaaattagccgccgttttgtcgatgaagcaggaaggctacatcaggctttaggacaaattgcagataaagttgtgttttgtgtggctggttttccaatgattttaaaaggtgagaaataa

SEQ ID NO: 3540 - DNA, 312 bp, Acinetobacter baumannii
tttgaaatgcactgtgatatttatagatcgagcaaaaaagatgaaatgtacatttatattgctcgtccaaactatcctgatgaaacggagcaagccgatccgtttgaaaaagttccagaagctgttttacaagcctttggccgtgcaacgtttgtcatgcatttagaattggctccaacacgtaaattagcgcgtgtaaatgttttacatgttctagactcattacaaacaaaaggcttctttattcagatgccgccagaagggttaattaacccaaatgcagttgaaccagagggcttacgtggtgcgtga

SEQ ID NO: 3541 - DNA, 1851 bp, Acinetobacter baumannii
ctcatgacgcaaatggccaaccgattgactatgaatatctctatttctcgggcgataccttccagtaccgtttacgtattcatcgttaatagctcagataaaaataaggattttacaatggaaactaaatatcttgagttcgatattgtggtgattggtggtggaactgctggaccaatggctgcgattaaagccaaacaagaaaacccgaatttaaaagtcttgctcattgaaaaagcgaatgtaaagcgcagtggagcaatttcaatgggaatggacgggctgaataatgctgtcattccgggctatgcaacacctgagcagtacaccaaagaaattaccattgccaatgatggagtagttaaccaaaccactgtatatgcatatgcaaagcatagtttcacaaccattcaacagctcgaccaatggggcattaagtttgaaaaagatgagacaggtgagtttgctgtaaaaaaagtacatcacatgggggcatatgttttaccaatgcctgaaggtcatgacgttaaaaaagttttataccgtcagttaaaacgcgctcaagtcaaaattaataatcggattgtcaccacaaagcttctaaaaaatgagcaaggtgcaatcaatggtgtacttggctttgactgtcgtagtggtgacttttatgtcattaaaacgaaagctgctattttatgttgtggtgctgcagggcgtttaggtttgccagcttctggctatttgatgggcacttatgaaaacccaaccaatgcaggtgacggctatgcaatggcataccatgcaggtgctgagcttgccaatttagaatgtttccagattaatccactgattaaagactataacggtccagcttgtgcctatgtgaccggacctttaggaggttataccgccaacagtaaaggtgaacgtttcattgaatgtgactactggagtggtcaaatgatgtgggagttttaccaagaattggaaagtggtaatggtcctgtttatttaaaagtagatcatctggccgaagaaacgattcaaactattgaagagattctacataccaatgagcgcccaagccgtggtcgtttccatgagggccgaggaaccaattaccgtcaagatatggtggaaatgcatatttcagaaattggtttctgtagcggacacagtgcttctggcgtatgggtcaatgaaaaagccgagacttcggttaagggattatatagcgctggcgatatggcggctgtacctcataactatatgcttggtgcatttacctatggttggtttgcgggtgtaaatgccgcgcaatatgtgaatgcaattgaagatagcgaattaaaccaaagcgaaatagaagtagaaaaagctcgaatatttgcaccactgaattgctcagaaggtttacctccagaacaagtggaatataagctgcgccgttttgtaaatgactatttgcagccccctaaaactcgccaaaaaatggaaattgggctcaagcgctttgaagaaatcaaacaagatattaagcgaatttctgccagaaacccacatgagctgatgcgtgccgctgaagtttcttttattcgagattgtgcggaaatggcagctagagcttcactgtttagagaggaaagccgctggggactgtaccactatagagcagatttccctcaaaaaaataactcggattggttctgtcacgcgcatttgaaaaaagatgaatacgggaacatggtcagtttcaaaaagccaatcgagccttatgtggttccgattaatcaagatgaagctgtgtcgtatgaccgtttacgcattcaaaaagatgttgctctagcagactaa

SEQ ID NO: 3542 - DNA, 189 bp, Acinetobacter baumannii
ttatccgagcaaagaggattgaaaattcgcgtagtttttctagcattccaatctattaaaaaaacaaaaataacctctcctatttctttttatatcttttctccctcttcactaatttttatggcaaataataagaacttaagcgttactggctgtaatataagcaaaacatcagataccaaactttaa

SEQ ID NO: 3543 - DNA, 609 bp, Acinetobacter baumannii
tcgatttggcacatgttaattcgtaagttatttaagtttgaaaatgcacacgttgtacgtaactgtacatcggatcgttgtaagcgatccattcatgggcatagttataaagtcgagttattacttaaagcttcgaaattagatcatggacaaatggtatatgattttgggctgttaaaaggcgtaattaaggaccttttcgatagctttgatcatgcgatttgtttctgggaaaaagatgatccacaatatattgatgcttgtaagacttttagcgcgcgttggatctctttaccagtttcgccatctgctgagcaattttctcgaatcttcttctatttagctcagcaagtattacaatctactgttacccaaaatggggaaggtgatgttgaagtctattcagtgattgttcatgaaaccgatacaggttatgcccaaagttttcttgaagatattcaaaatgaacaaatggggctgttaaaccttgagggaattattttttcagaacaagtccaatccgaatgggctgatccagatatgtatgaaaatttaaaacaagggattaagtttcataatccgcatgttaacttacaagtagaagtgtaa

SEQ ID NO: 3544 - DNA, 660 bp, Acinetobacter baumannii
gcacggaggcagtataaaatggcttggtcacgtaatgaaatggcacaacgtgctgcaaaagaacttgaagatggtttttatgtcaatttaggtattggcttacctacccttgtcgccaattatattcctgaaaatattaatgtttggcttcaatctgaaaatggcctattaggtattggtgaattcccgactgaagaaactgtcgacgccgatttaattaatgccggcaaacaaacggttactgctcgtcctggtgcagcctttttctcaagctcagaatcttttgccatgattcgtggtggtcatgtcaacattgcaattttaggtgcaatggaagtttctgaaaaaggagacttagcgaactggatgattccgggtaaaaaagtcaaaggtatgggcggtgcaatggatttggttgttggtgtccaaaaagttgttgttcttatggaacactgtgcaaaagacggtacaccaaaaatcgtgaaaaactgtagtttgcctttaacaggtaaaggtgttgttcaccgcgtaattacagacttaggcgtaatggatattacgccacaaggtgtagagctcattgaacttgctaaagacgtaacgctcgaacaaattcaagctgctacaggtgtcgagttttataaaaccttagtcgcgtaa

SEQ ID NO: 3545 - DNA, 1071 bp, Acinetobacter baumannii
attgaatttaaactatgtaaatttgaatttaataagaaggccaaaaagatgaataaaaaagtgattgccggcattttagttgttatagctgtagttgccatcggcttttgggtatggggatataataataaaaaacaattagataataatgtattaactttatatggaaatgtggatatccgccaagtttcacttgcatttgaacaatctggccgtattcagaaacttttagttcaagagggcgataaagttcaagttggtcaagtactggcgacccttaataccaatgcattacaaattcaggcaaagcaagctcaagcacaacttaaagctcaacaagaggcaattgttaaacaagaggttggagctcgccctgaagaaatcacccaagcaaaagctcaacttgcgtctgcccaagctgagcttgataaaaccaataaaaacttgcaacgcttacaaattttggtaagcagtacggatggtcgagcaattagccaacaagagctcgattatgccaaaagcaatcaacatagtgctgatgcagcggtccgtgaaagacaagccaatttagaattattaattaaaggtgcacgaaaagaagatcgtgaagcgacgagagcacagtatgaagtgactaaggctaatttagatttaattaactataaccttactcaagcagaactaaggtctcctgtaaatgcagtggtacgagctcggttgcaagaagttggcgacatgacaactgctcaaaaggccgtttatacattagccttgaccaatccaaaatggattcgtgtgtatgtaaatgaacaagatttaagttcaattaaaatggggagcacggctcaaatcattcgtgatgcttatccgaatcagcctatgaatggaaaaattggctatatatcttcagtggctgagttcacacctaaaacagtacagacagaagagattagaacaacacttgtttacgaagttcgggtgtatgtacatgatccgaatgatcaattaaaaatgggtcaacctgtgacagtaaaagtcccacttgctttaagtgagaaagcccatgattga

SEQ ID NO: 3546 - DNA, 222 bp, Acinetobacter baumannii
ctcattattaaagtggataatatcatgaaaaaaaacatttttttagctttagttctgggcttagttgggtgctcaacagctccagttgttccgaatacagcgaaaccgatacctaatgagagagtgtacaatcagaactatttaaagaaacagactcctgaacaagcaaaagttactttttcacgagataaaggtttttctaggatctggttgtactcatga

SEQ ID NO: 3547 - DNA, 909 bp, Acinetobacter baumannii
caagaaattaaaaaatattggagatatatgatgaaaaaatcaactcaaccactagtacatttcgcttctgcaagtttaatcgcagcttgctcgttacttccattaagctcagttttcgcagaagaaacgagcaatgctcctgtggcaacagcaactactgaagctacttcaaatacaactactccaactccaccaccacagcctgcaacaagtgaaactgttaaaaatccatatggtctagaagccctttggcgtgaaggtgacttagtcgctaagtctaccttatttattttagtactcatgtcgattgggacttggtacatcatcatctctaaattattacaacaaggtaaagtcaaacgccaaggtaaagaagctgaaaaacatttctgggaggcaacttcgcttgataatgctgcagaaggtttagaacaaagtagcgcataccgttttattgcagaaaaaggcattaactcgactaaatcacacggcggctctctacttgaacgcattgactttaatacttgggtgagcatttcaatacaacgtgcgattgaaaaagtacaaaaccatttaggcggcggtctcgcttttttagcaacagttggctctacagcacctttcgtaggtcttttcggaacagtatggggaatctatcacgctttaactgcaatcgggatttcaggtcaggcatctattgataaagttgcaggcccagttggtgaagctctcattatgaccgctattggtcttgcggtcgcagtacctgctgtactgggttacaactggttgactcgtcgtaataaagcagtgatggaaaatgttcgttcatttggttcagatctacatgcagttttattaagcggagaaattaataccaacaattcaattaatcgcagcattaaataa

SEQ ID NO: 3548 - DNA, 996 bp, Acinetobacter baumannii
gtaagcgttaatttaatgaatcagaatgtgacttctaaggtttatccgtggcaacagacaatgtgggaaacgttaacaacacgttttcctaatattgggcatggtttattattttatggtaaacaaggttgtggtaaacatgcttttgctaagcatttcttagcgtgggtactttgtttaaataaacaacctcaaggtgcttgtggtgaatgtagtagctgtcaatggttaaaatcagatacgcatccaaactatgttcatatcacgacagatgaagaaaataaaaaacagaatgcaaaaattaaaatagaaaaaattcgagatttattgccatttgtacaacaaactggtgagggatggcgtgttgttgttattgagccagctgaagctttaaatcttgcgtcatcaaatgcactgctaaaaaccttagaagagccaggtgaacgcgtcgttttaatcttgttggccgatcattatttgaaattaccggcaaccattcgaagtcgcttacagcattttgctttagaccgtatttcatatacagaagccacatcttatctaaatgaacatttagcggaaacagcatcagtaccagctgaattattgctaggtctttctaatgatatgccgttgcaagcggttgaaattgcgactagtgattggtttgctaaaagacagtcttttttagaagactggactaaagttgtaaatcaaaaaaatatgcctttattttattcggctaaatggcaaaaagaactcagctttagtgattttatgatgcttcttgaatacttgttaggggatttaatttgtgtcaagctcaatcaaccacagaaaaatattgatttacagttcgatcaattagcgcaaaactataatttagaaagcttattcagtctttatgaggaattacagcattctaaaagattagttgaacagaatgtacaaacacaactcatcatagatcaactttttataaaattaatgaacgtttaa

SEQ ID NO: 3549 - DNA, 960 bp, Acinetobacter baumannii
agaatctctaatttaaggaaacttaccatgaatgcattagtacaaaacacaggctttttaactccaactacattagctgaagcaatgcaggttgcagatttattggctaactctgaaattgttcctaaggactaccagaaaaaaccaggcaacattttagtcgcaatgcagtggggcgctgaaattggcttgcaaccacttcaagcaatgcaaaacatcgcggtaattaatggacgcccttctctttggggtgatgctgtacttgctcttgttcgtagctcaggtttgcttgaacagtttgaagaaactcaaacagaagatatggcgacttgtaccgttaaacgtaaaggccaaaaagctgtaactaaaactttcactaaagaagatgctaaacgcgcaggtttattaagcaaacaaggtccttggacacaatatccaaaacgcatgatgcaaatgcgtgcacgtggatgggcattgcgtgatgagttcacagatattctaaaaggctttggtgtagctgaggaagagcgtgacaaagaaattgatgtaacacctgagccatcgaagcttccaaaacatcaaggtactgcgggtttaaaagctcaattagccgaacgtgaagaacagcaagataaagtagttgaattaaaagtctcttttgatgttgaaaaatgcatcgaagatattggcaaggttgaaaacctagctgatttaaaatcacttggctcaaccattccttctgatcttggtgaaccggcacagacggatattaaaaacgcttacgcaaatcagaaattctatcttcagcttttagatgatttggaagttgcaaactcaattgaagcaataaattcaattatggaaaagcaatttgagccaaacacatcattcttaactgatgcacagattgattctgtcagtgcattgtttgaaagaaaaacggctgaattaaccgcataa

SEQ ID NO: 3550 - DNA, 381 bp, Acinetobacter baumannii
atgaaatctaaaggctttaccctcttagaagttatggttgctttggcaatctttgcagtcgcagctgtcgctttaactaaagtggcaatgcagtacacgcagtccacttcaaatgcaattttgcgaaccaaagctcaatttgtagcaatgaatgaagttgctatgatggagattaatcaagaatggttgcaaggaacccagagtaagcaagtaacttcccaaggtgaaacttggcaaattgataagtcagctcaatctactattagcccgaatgttcaaaaaattgatttacaagtgagtttgtatgatccggataaaggaaaagtacaaaatggcattacacatatggtcttttttaattatccagtgaaagcaaaataa

SEQ ID NO: 3551 - DNA, 231 bp, Acinetobacter baumannii
ttcccacctaaagcttgcttagccaaaacttctacaatgttgcttaaatttgtcatgagtaactcttatgtatggtttatacatgagcatacgcgtttttttgttaagacagcaaaaatcaaattgttaaattttgaaagagattgcaaggtcttttaccaacggaatttattccaattttccggatttgcccaaaattttgaattaaaccagtctggtacatgcttatag

SEQ ID NO: 3552 - DNA, 639 bp, Acinetobacter baumannii
aaactatataaagagagtaattgcgtgaagatggaccgtcaagctcagttccgagcaagagaagcattaatatttcaagttgcggaacagttgttgttagaaaatggcgaagccggaatgacacttgatgtgctggctgctgagcttgatttggcaaaaggtactttgtacaagcactttcaaagtaaagatgaattgtacatgttattaattattcgtaatgagcgcatgttactggaaatggttcaagatactgaaaaggcttttccagaacatttagctttctttatgttgcatcatttgcaccatccggaaagaacagtgctgtttcaccaaattgaagaaaagctttcaattactgcccaaggtgtgcaccatctttttaatgaactctaccaagtgagaaagcaacgcttacgtattattattcgtatgactgatcactatttagagtcaatccagagtcatatgactacacgagattacttggcttcaatttggtcactcactcatggagctgctgcaattctgaattcaagcttttatcaacgttatttgggttcaagagatactttgcgagtagcatacattgaccaggcattagccttacccaaacaagcagttgagcagtacgcttaa

SEQ ID NO: 3553 - DNA, 1161 bp, Acinetobacter baumannii
tattttcataattatttcatggtatattcagtacacaaaacaacctttagtatgatcgaaccagtgacagcaatgactacacattcaaattccgtttctaagccagatatcgacgacgttaatattaaaagcattcaaactcttgtaacaccaaatgagcttaagtcagaacttccgttatctgatgttgcttcgcaaactgttctaaaaggccgcgaaactattcgtaatattttagatggttcagataaacgtttatttgtcgttattggtccttgctctattcatgatccaaaagctgctcacgaatatgctgatcgcctaaaagcgctaagcgaaaaggttaaagatactttatatctggttatgcgtgtatattttgaaaaaccacgtactacaattggctggaaaggcttaattaatgatccggatatgaatgactcatttaacatcgaaaaaggtttacgtattggtcgtaaacttttgcttgagttaaatgaaaaaggcttaccttgtgcaacagaagcacttgaccctaactctccacagtactatcaagacttaatttcttggtctgcgattggtgcacgtacaaccgaaagccaaactcaccgcgaaatgtcttctggtctatcatcaccggtaggttttaaaaatggtacagacggcggtttaactgtcgcaaccaatgccatgcagtctgttaaatatggccatagtttcttaggcttaaatgaagacggtcaggtttcaatcattaatacaaaaggtaacccttacgcacatgtggtattgcgtggcggtaatggtaaaccaaactacgatgctggctctgttgcagaagcagaaaacgctttagcgaaagcaaaagtgagcaacaaaattatgattgatgcaagccacgctaactcgaataaagacccgtacttacagccgcttgttcttaaaaacattactgaacagattttagacggcaataagtcaattgtaggtattatggttgaaagccatctaaaaggcggccgccaagatattcctgacaatctttgtgaccttgaatatggtaaatcagtaactgatggttgtattgactgggaaactactgaaaagacattgcttgaaatgcatgaagctttaaaagaagttttaccaaaccgctaa

SEQ ID NO: 3554 - DNA, 852 bp, Acinetobacter baumannii
ggaaatcataaaatgtcaattacacaaggccatgtgcgtattcaaaatctatcgctacatttagggcaagttaaaaatcgttttcaggcactagatcgggttaatttcgaaatacaaccgggcgagtttatatgtctacttggcccatctggttgcggtaaatctacattattaggtgctttggcagggcacttaccgattagttctgggactttaacggtcgataatgaatctatcctcgaaccgcatccagacagaggtttggtgttccagcaacataccttatttccatggaaaagtgtgcttgaaaatattgcttttggtctgaaaatgaaaggcatcgccaaacaaaagcgtattgaacaagctaagaaaatggttgatctggtcgggcttaaaggtttcgaacataaatttccagccgaactttctggtggcatgcagcaacgagttgaaattgcgagagtgctgattaatcaacctcgcattttattaatggatgagccttttggtgctttagatgctcaaactcgtttaaaaatgcaaatgctattactcgaaatttggcaagaaatccaaacgtcggttttatttattacccacgatattgatgaggcactttttttagctgatcgagtattgattatgagccatagaccagggcgaattattgaagaaattccgcttaagtttgaacgtccaagagacgttgagcttgtaacaagtagtgaatttacagccattaaaaagcattgcatccagactttaaaagaagctactcaacaagaagagttaagccgtttaaatccattagggcttggaaagaaatcacaaattaaggaatacgaatga

SEQ ID NO: 3555 - DNA, 1560 bp, Acinetobacter baumannii
gttatgcataaaggtatacgtcaatctatggcatggctgcactcgtggactggtttaatttttggatggctcatatttgctattttttttatgggaagtttgtcttattaccgccatgaaattaatttgtggatgcaaccaccccttgcacaatttgaaataaaacaagatgtggcaattaaaacggcatatcaatacttacaagaacacgcttcagatgctaaatcttggtatttaactgttgctacacctgaaagtccggtaaatacgatgtattgggaaaaaccagatggtagttatggaaatgcaaccctcgatgcaaacactggtcaagaattaaaactttctgcgactgaaggcggtgactttttctaccgtttccattatcaactttttggtgtcccgatattaattgggcggttggtcgtatctttagcagcttttattatgttgattgcgttaatctcaggcattattactcataaaaaaatcttcaccgatttttttaccttgcgtacctttaaatcgcagcgctcatggttagattttcataatgtttcatctgttattgcactgcccttctttttaacagttacttttactggcttggctattttcttctatttatatttaccttggggaatgcaaaaactctatccagagaatccatatcaatatttcaatgatatacgtacaaacacagtcacagaaagtacaacaccgcatcctgcacagaatttaccagttgaaaagctattagctcaacttaaacagcgttggggaaatcaaactttagcaactatgagtgttaaaaatccaaatacgaatcaggctcaaattacgtttattcagcaagaagaccattctattacccgtaatcaagcccaaatcacattagatgctacaaatgctaaagtcttgggtgatacacgtaatcatagtcctattgccacactttatgcaggagtatatggcctccatatggcaacttttgctcagcctctacttcgtttaggattgtttttctctggcattttaggctgtgtaatgattgcctctggcttgttgctttggagccttaaacgccaacttcaaaataaaaatagtaagtttcatttcgggcactatttagtttaccgtttaaatgttgctacctttgtaggtttgccttgtgcaactcttgcttatttgtatgcgaatcgattgtttactgtcacggcccccactgttaattatgaaatttatagtttcttcttcgtgtggctcataagctttattattgcgctcatcactaaaaaacaatatttatggcaaactcagctaggtatttttattctgcttagtattgcactccctgtcttgaatataagttatttactaaaaaacaattatattcaaaattttagtagttattgggattttgcacgtatagatatatttttctggttatttgcagctttagccttttttatatttcttaaaattaagcctattcaatataaagcttcagataaaattcaaaaaaagctgagtaagttaaatattgaggtgaattcatga

SEQ ID NO: 3556 - DNA, 831 bp, Acinetobacter baumannii
ttgatgaataaaattattcttggattaatggtagtaccacttgtattgagtggatgcataaaaaaagcagaggaaaaaccaacagaaaaaacggaaaaaacctctactataaaagcaactgaacagcccccaaaagaagaaaatataattcctgctatgctagtacgtaattttcttgtgaagtttcaacaacccaaaatttgtgctccaaatccagatgttgatggaattgtatgtacctctaaagaagcgattacacttaaaagtaatattgaatggattgatcaagtaatcgataaggaaatccgtaaagattatgcagatgctcttacacctccttcagaaaagcaaaagcaactaaatcaaacccaagctgaagggtttaataactggtcacagagtgtggtttatcgctttaatggacagtttggccaatatgtgcaaatttcgaaagtaagttcagaatattctggcggggctcatggtataacaacttttgaagattatatttttgacttaaaaagtaaaaaacgcattgaattaaaagatattgttatcaatggaaagatgaatgcgcttaaagaagaattgtggaaacaatacggatattggtgtcaagaaaaagatatgcagccttatattagtaaagaagactttaaagtaagtgaaaatttctatattaatcaatcaggcgggattacatttgattttcagctttacgaattggctccatatgccgcaggtcctgtgagtttagaactctatgatacagatcaactgataaaatcagattttttaccgccaatgcctactttaaaaactgaagtgtag

SEQ ID NO: 3557 - DNA, 261 bp, Acinetobacter baumannii
tattcgctcaagacaaaactcatagagaacatgccatttcaaagtttaccaaactggttccaacttggcgccttcttactggcaataaatgccggaatgattaatgtattagggcttatcacccttttacatcaatcggtgtcgcatatgactggtaatgtcagtatgctagccatgagtttggtaaactggcaatttgaacacatcatatatttagtactagttatattatgttatgtatgtgggcgaattcaaacatga

SEQ ID NO: 3558 - DNA, 1107 bp, Acinetobacter baumannii
aacttttgcaacataggtaaatacaggagtgagccaaaagggataaatatgaaccaagccaactcccacgaactcaatggacgtcattttcaaaatgagccgatctttactgatcataatttggtgttcgatcaccacgatttaagcgaaacctgccgaaatgtaggccaaatttttaaaccgcatgatcttaaaatctctcatcagaagcgagatttcagtgcaactatgcaccatgttaaaacaggcgcattgtctattagtcgcttggaatatggcgcagatgtcattattgaaccagatcatctggataacttttacttaattcagattccaactcagggctatgcagagatcgagtttggttcgcaaaagttcatttcttattctcaagttgcttctcttatttctcctcagcaatctttacgtatgcgctggcatgcaaactcaccacagctcattctaaaagtgtcaaaggatgattttacgtaccattgccgtcaacacattgccgattcagaaaataacttactcatttttgacccaaaattagatttttctacccaaggtggagcctattttttgcagctggttagaacattgatggatgctttagcatgcgagcaacaccctctccatcatcctttagcctttaaacagtttgagtcaaatttatttaatgcactgatttatggtcagcccaataatgcattacataaaattgatcaatataaagaaaaaacggtatctccttatttcgtgaagcgcacagaagcatatattaaagaacacttgcatgagccgcttaatgtcgagattttagctgaacatgcaggcgtgagcgtaagaactctatttactggttttaaaaattatttgggaaccaccccaatgtcttatttaaaagaattacgttttgaacaagcccatttagagctcatgcacaatgaaaatctatctgtcactgacgttgcatttaaatggggatttacccatttaggccgtttttcacaagagtacaaacgccgttatggtgagttaccttcgtctactcgccgatctggtcaaaatgaaggctcaggcttaattacttcaattttttcttaa

SEQ ID NO: 3559 - DNA, 966 bp, Acinetobacter baumannii
cttggatgcaaattaaatgcttacatgatcaatcagctatatgagcagtatagtactatggccttaagcgcttggggctttactgatttgccttcttatacagataaatatgatcctaatgagaaagatatagtgataaagacaaataattggttgaatgatgaggcagcagaggaaaaaactcagcaaggtcttactgcctttgtagctcttgatgacgcattcatgagtattgcatcacggatttatttaattagaaatgccaaggaaacgattgatctacaatactacatttggaccaatgattttgtggggaaccttattttacatgagctgctcaaggcagcggatcgtggcatcaaagttcgcttattaattgatgatcaaaacggtataaagcttgatggcatattaagaagccttttacagcataccaactttgaaattagattatttaatccttataaatttcgttacttacgtatcttcgattatctcttccgatttaaaaaagtaaatcatcggatgcacaataagctcattattgcagatgcatcgattgcagtaacaggcggtagaaatattagtagtgaatattttgaagcaagtagtaagtttcaatttacagatatggatatcttattttacgggcatgcagtgcgccatgcccaagctgtatttactgatttttgggaaagtaccttaagtgtaaatgcaactgagattatcggaacttgtgctgagcatcatttaaaagctttaagagagcactatgaacaactccaccacgaagaccatagcctcactgaagataagctttacgatgcgcagagttatttaaaagagcttttagagcataaccctattcaatggtctaaggcccattttgttgctgactctccgaagaaaatactgggcactgcaactgaacatgaaattctttatggcgactctatgtcttcttaa

SEQ ID NO: 3560 - DNA, 198 bp, Acinetobacter baumannii
aagatcttaaaagaaaatatggaggtctatgctatgtctcgtggcgacaaatcatcttatacggcaaaacaaaaacgtcaggcgaaacatattgttgagagtgaagtagatagaggtcattctcaagaagaagctgaacgtattgcatggtctaccgtcaataaacaagatggcggcggcaagaaaaaatcacattaa

SEQ ID NO: 3561 - DNA, 579 bp, Acinetobacter baumannii
acagttctaaacagggtaaatcctatgagatcaattgttgatctttgcaatttagccctgtcgcatctcgcgcagggctatgttgtaaatgaactaaccgaaccgacaaagcatgcaagattgtgtaataccttttacccaatttgccgtagagagcttttggacaacgaacatcaatggacgtttgccgttaagcgcgttcgcttgaatgtcgatgcaggttatgagtttggcacggcttatgttttgccaagtgataaggtccgtatatttcagcttgaatcaggcagccgattctatgtagaaggcaatcttctattcacagaagataccgcaccaatcttacgctatgttcacgatgtgaaagacttggcgttaatgcccgattctttcaagaccgctctatcttatttgttggccgcacgaatagcaggccctttgacgcagaacgagcaaaaacaaatatccatgatgcagctttatgaaattgaaaagaacaaagcaattttcattgatctgcaacaacatcgaattgaagcacggcctgagcatacaggctcaatgtttgaggcacgataa

SEQ ID NO: 3562 - DNA, 2679 bp, Acinetobacter baumannii
gcttacctaaaattggctgtagagattacagccttttttattggtgggcaaaatatgacagttccagtttccgaccgtttaagccaactttacgttggaaacggcacaaatacacgtttcgattttacattccgtatttttcaacaagaagatgcaacaggcgttgctgtacggaaaaaaggtacaacagattttgaaacaattgaccctgcgacttacacagttaccataaatcccgatgatatgggcggatatattacatttaataccccaccgaccgttggtacctatttttatatcgcgggtgcatctcctcttgatcagctcttagatatcacaaactatgataatttttatcctgatgctattgaacgcgcacttgataaacttaccgccttgcttcaagagtggggaacgaaattagacctcgagaaacaagccagaattttagcggatattcactacgattcattagcaatggagcgcgaagaaaatcttgaaaatcgtttgattagttatattaatgctgttgttgggattactaatccaaatatttttgacggtatttctgaccgtatgattattactaaagatggccgtacgcagcgagaatttaacgataccttgccgtattggacggacgattacgccaactttaaacaacaaacatttttgcgcgaagaacaaattttagaacatgttaagcaagaagatgcgtcattagatcaaaaaattaatgctgaaaatattagagcaattcaagcagaacaggtacttgacggtaaaattgcagcaataggtgggggcgcatctcacgggtatacctcctacactgaaatggttgcagatgctgcaaacattcctgcaaattctgttgttactgttgggggagatcctgactccacgaaagacggcgattatatttataatggaacaacattttctaaatcgccttatgatccattaacacagtcaaaaaactatacaaacagctttagttcattaacaaaaaactcaactgtggtttatccgttcatttcgagaaaacgaaataatgttaatgaaagcgcggttccagtaactcatgaagcctttttaaagccttacattctaagtgttcgcgtaatgaatgcgaataaggaccattattaccgtgttcaacaaatcagtaatccagatcacgctacagcagcaaatcgttggatttttgaaatattagcccgcggtaactttgaaacagccgaaacgcgcatttcgacaatcacggcggttcttccgattgtaaaaaactcaggcatacgagatttcttggtcgaatatggcgatgtaaaaattggtatcacattagacaccaacaaatgcccaacgtttgatttttattcagtcgcatctacggataactcgtacacatatatatttgatccgagtttgtattcttatgcagcagtagggtcttccgatttagcagcacttagcacacgtattgacggatttattaagcctatgcaacttaaaaatttacttaatgatttgcgtaacccaatccagtctgtccaaataaaattgattggtgactcaattacttatggactaggagctactgataatggcagtggtggtggggttctcggtgtccacggaccggctacaacaaaaacgtgggcaaaccttttgcgtaattatcttggtacagcattttgtacaagcccacgctatggtgatgatacgattgtacagactggagaagcttatttcacaagtgatggtactagtgttttaagtgcagaattgtccaattttacttttaaaaacagtgctacaggtaaagaatttacagttgcagaaatgcaagcgttagtaggatcaattgctagttcacctgtaggtacttttattgacttgagaagccctgcgttaacttcagtaattgcgcctactgacatggaatttttgtttaacgggaatgagttcacaattaatcatgcaaggctaggcaatggaagtgcaacagagtcatttattgatgtttatgtagatgatgttctgcactctagctttaatgtatacacagcatccacgcccgattttctgggagcttatacagtaagtgggcttgctgatggtcagaaaaagatacgtattgcaaaccgattaaccaacacaacaatctatgcccgtttagtttcaattactgcaacacgcaagatttctgtaattaatgagggggtttctggctggaatactggaagctggttatctggtgacaacatatctaataagatcagcattaaagataactacgttattatgatgctcggaactaatgaccgtcatacaacacagaaaattggtacgttcaaaaacaactatcttcaattacttgaccgtatcggcgctaagaatagtaaggctcaaattattgttatggccccgccagctgtaacacaaagtgaagatccgagcacaggtcgtttattccgaattgcagatttaaactatgcaattagtcaaattgcacaactacgatcaatctctatgattaatttgtttgaggcaacatctaagttaaaagctcaaggaattgagtttctactgcctccaccagatcaattacaccctaatgattacggttatggagttatcgccgagtacattatcaatcagattttgaacgcataa

SEQ ID NO: 3563 - DNA, 339 bp, Acinetobacter baumannii
tatttactaaatgatattttagtggagttacccatggtcgatgttggcaaaactcagctaaagcaatttcttaaaccgcttactaaggctgaaagaattgcatttgcagagaaatgcggaacaacgctcggaaatttaaaccaaatcatttacagcaagacttcttgtggcgcggcattggcaattgcaattgaccgtgaaagtaaaggttcagtgcgttgtgatgatctctgtccaagtgctgattatgaatatgttcgtaaacaaaatgaggagttaaaggaaaagaaatgcacatccaagaaatttcgaatgatcccaatagcaacaaattgttag

SEQ ID NO: 3564 - DNA, 1221 bp, Acinetobacter baumannii
tttaggctaaaggcaaatttagcaaatacaccaataagagatattaagatgagttcaattgttatagtttcaggtagccgtactgcaatgggtggttttcagggtagtttatcttctctaactgctccagaacttggcgctgctgtcatccgtgaatcgatccaacgtgcaggtgttaagcctgaacaagtagatgaagtgattttcggttgcgtactcagtgcaggtattggtcaaggccctgctcgtcaagccatgcgtaaagctggcgtgcctgatcatgtcggagctgtgaccattaataaactttgcggctctgcaatgaaagcggtcttaatggcatcagataccttaaaagcaggcagtgccaatattattgtggctggcggcatggaatctatgacgaatgcaccttatattttgcctaaagctcgcggtggttatcgtatgggacacggcgaaattaaggatcatatgtttttagatggcctcgaagatgcagaaactggtcgtttaatgggttcttttgctcaagacatggcaaataccaaaggctttacccgtgagcaaatggatgactttgcaatttcttcacttaaaaaagcgcaaactgcgattatggaaggttatttcaaagaagagattgttcctgttgaagtaaaaacccgtaaaggtgttgaagttattgatcaagatgagcaaccattaaaagcaaatcttgagaaaattccaactttacgccctgcttttagcaaggacggcacaattacagccgctaactcaagctcaatttctgatggtgctgctgcattagtacttaccactgaagaatatgctcaaagccatggtttaaatactttagcaaaaattgtggcaacttcgactcattctcagcatccaagcgaatttaccattgctccaattagtgcaattcagaaagtacttgagcgtgctggttggtctgttgatgaagtagatgcttgggaaattaatgaggcttttgcgatggtggcaatggcaccaattcatgagctaggaattgatgaagcaaaagtaaacgtccatggtggtgcatgtgcattaggccatccaattggtgctacaggttcaagaattatcctttctcttatttatgcattaaaacgcttaggtaaaaagaaaggtgttgctgccctatgtattggtggtggtgaagcaacagccgttgcgattgaaatttaa

SEQ ID NO: 3565 - DNA, 378 bp, Acinetobacter baumannii
aggttcataaaaatgtctgaagaacaaatcgaaaaacagattcaagcaaaaggactaaatgccccgcgcataacacctgatcagcttgattcaaaaatcaagaatgtttactaccattcaccactagcaaatgctgatcctaaacaagctatggatgaaaagacataccaagcattgcgttgtttaaccttttgcacaatcgttttagagaatggctttaccgttactggtgaaagcgcatgtgtagcccctgaaaactttgatccgttcatcggccaagaagtagcgtataaaaacgcccgtgaaaaaatttggcagttagaaggatacttgttgaaggaaaaactttatcaagctgatttagataaacagttctaa

SEQ ID NO: 3566 - DNA, 612 bp, Acinetobacter baumannii
gcggaaataaaattggctaaatttaggattgatttgctcagacatggagaaagccagtatagccataccttacgtggccatttagatgatgagttaacagcaaaaggttggcagcaaatgcaggcaaccattgagcaagttacagaccagacatgggatgtcattgtaagctcttcattaaaacgttgtgcttgttttgccgagcaactggccaaaacagcagaactccctttacttgtaaatcatgacttaaaagaaatgtattttggtgaatgggaaggcgtctcaactcagcaaatttatgaaacctcacccgaattattggcaaacttttggcaaaaaccaagtcaatattgtccaccttgcgcagaaacattaaaccagtttcaaacaagggttcttaaaggttttcagaatttgctggagcagatgcaaaagcaaaacttacagcatgctttagttattactcatggaggtgtgattaagctattggcttgtttagccagacaacagcctctagatgacttacttaaaatgccggcagagcttggaaaattatattcactcgaattttctgaaacagatggtcaagtaacttttaagttaagatag

SEQ ID NO: 3567 - DNA, 519 bp, Acinetobacter baumannii
gggagaataaaagtgtcgacagtaccatttgtgacatgtgatttattagatgacaatccggaaaaagatttgcaagtagtcacgccctcaatggacggtaagttctttaaaagctatggtgcacgtcaaacttttggcggacaagttgtgactgtaaagtgttttgaagataactcgcgtgtaaaagagttgctggctacagatggtacagggaaggtattggttgtggatggtggtgcttcaatgcgctgtgcacttatgggagatatgattgctgaatcggcagttaaaaataactggaatggtgtggttatttatggctgtgtacgtgatgttgatgcacttgcaagcttagatttaggtgtacatgcattggctgcaattccgcaaaaaagtaaccgtaagggcattggtgaagtaaatattcctttgtattttggtggagtcacaattcaatctggtgattttatctatgcagataataatggaattgtgattgctaaagaaaaactagtctag

SEQ ID NO: 3568 - DNA, 900 bp, Acinetobacter baumannii
gtggcgataaagatgtctggtgcttttgaatttatcttggcaggtatgttagttggcttctgtgtaggtattacaggagttggtggtggatcattaatgacaccaattttaattggtctttttaggattgaaccgcatatcgcaattggtactgatttactttacgccgcgatctctaagttctgtggatcgatggttcacgcaaaaaaacttaatatcgtctggccgattgttttatggctagcggtcggtagtattcctgcatcttttggtactgcgtgggtacttgagcattatttaagtcagtcaactcattataaagctgtactaaccatggtattaggttttatgttgaccttaactggtgtttctatcattttccgtactcggattgaaaagttctttaataaattccgaaataaagagaatactcaaactgaaaatgagcaattcgctgttcaaaataaacgcacctatattgtgattatgggtattattttgggcgtattcgtaacactatcatcagtcggcgctggtgcctttggaattatggcacttgtaatcatgttccctaacttaccaatgattcgtattattggttccgatgtcgtacacgctgtactcttaaccctagtcgcaggtcttgggcatatgagtgccggtaatgtcgactttgtgctgcttatgtggttgttggtaggttctattccggcaattattattggcacattaattagctcacgtatgccggaacgtttaatccgtaaaattttgggtattacactatttgctcttggtgttaactttatggtccacccagtcaaagccaaaccaaaagcagctgtggtacaacaacaagcagtagttgctgaaaaaacaggcaactcgaccgaaagatag

SEQ ID NO: 3569 - DNA, 570 bp, Acinetobacter baumannii
aatatgtcaaaaaaagatgacattattaccactgctttaagactttttaattcatatagttataattctataggggtagatcgtatcatcagtgaatctggtgtagcgaaaatgacattttataaatactttccttcaaaagagaaacttattgaagagtgtttattattaagaaactcacttttacaaaattctcttactgcagcaatctctaaagaagacgaaaccaacccactagctcgtattaaagccatctttttatggtattcagattggtttaatagtgaagactttaatggttgcatgttccaaaaagccttagaagaagtattaaaacaatacccgtcaacacatcaaccagcaactttatacaaaatctggttaacacaattaatgcaagatcttcttattcaatatgaaattgaagagtctcgacctttggcattgcttttagtcaatattttagagggtatgaccattcaagctcaagttgagcatggttcagtaaaaattgatgactattggaagcgtgtagagaaactcattgaatttgaaaaaattgcacattaa

SEQ ID NO: 3570 - DNA, 222 bp, Acinetobacter baumannii
ctgacaccaaagcatcaagcagaaaacttgctgcgcttgccaaacttaaaaaagcgaaggccaaggccgataaagcaaaggatacagacgatgaaaagtaaacctaaatcaattcttatgttctggttcttagtagctgttgcgattgttgtattaggttcagatgtttacagaattgtagtgcttaaacagcatccttattcaactgtaaaaggggaatga

SEQ ID NO: 3571 - DNA, 207 bp, Acinetobacter baumannii; identical to SEQ ID NO: 3220

SEQ ID NO: 3572 - DNA, 1734 bp, Acinetobacter baumannii
cgacaacaaaaagggatcaagtccacgatgaaaaaaaaatacaatgttcgatctcaggcaacccccaagattggcaaaacaattcttaaattaagcacccttagtttaagcatgatgtgtcttaccatggcacaagcagcagaaactgaacaatcaagtaccgatgaaaaaccaacaaaagtcgtaaaagttgccgttacaggttcttcaattaaaggggttgcggcacaaagtgcttcccccattactgtggtgaaagttgatgaaattttaaaacaaggggtgacaacaaccgaagaagccttagcaaaaatcagtgcaaatcaatcaagttttgttactgcgcaaaatgtaggcgctagcggaactgtaggttcagcagcagatctccgaggaattggtgccaataaaaccttaatcttacttaatggtcgtcgtttagctgctaatgcttatgatagtggtgtcactaatttaaatattattccactcgccatgttagatcgcattgaggtcttacgagatggagcatcagcaatttatggtacagatgcgattggtggtgtaatcaacttcattactaaaaaacaatttactggtttaaacatcagtggaggtttgacacaaccagagcaaaatgggggggatacacaagatgtaagtgtatttggtggttatggtgatcttgatgaaaatggcttcaatatctttggtgtcgttgattatcgacatggcaacgatgttatggctaaagatcgtaaagttagtaaacgcggaggattattaccagagttaggtattacaaaaggtagcagtggtagttttcctgctaacttttatgacacaaaaactggaaccgaaggaaacccatatgcagcaactggatgcgggaataacccgctcgtgtacgctcaaggtggattctgccgttataacagtcaagcagtgattggaattgttccaaaaactgaagatatctcagcattggggcgtgctacttttaagctaaatgacaatataaatgctgtagcagaatatgtttacgcacgtaatgaaattactacttctgtcgctccggacgttttcttcgatttaacattgaatccagatagtaaatattatccaggtaatggaattacacctgctatgaataaagtcagtggcccacttgaactttatattcgttctcaagctggtaatcgtgttagttctagtattaatgagtcacatcgaatattcggtggtttagaaggcgaagcttatggttgggatatcaataccggtattacttatgctcatagcgaagcagaagaccggctaaacagtggatatcttaactacaaaaaaactcaagaagctttaaataatgggattttaaacccttttggtccacaagcaccagaagatgcgggtttatgggatacactgggcgtaactggtacttatttaaaagcagatgttgattcaactactgttgatttcactgctagtcgacctatatttacattaccagcaggtgacgttggttttgcaataggagctagctatcgccatgatgaatggacctcaaacgtggtgtctgaagtggctagtcaagcaccaagtacaggggttgatcctgatgaacctaccaataaaggaaaaagagatattaaagcagtctttactgaactgcatattccattaacattaaacattagaaactcaacttgcagcccgttacgaagaatatag

SEQ ID NO: 3573 - DNA, 402 bp, Acinetobacter baumannii
aataatgaaaacattagattggtggcaaaaatgaacgaccctttaacaattaaatccttaccttggtttatcaagatttgggcggcggtgatgggcggcatttttgcgctcatgttaagtggcgatattgatgttgaaggaaagataaaaatcaacatcggtgtgattatcaaattcgcaattagcgtttctattagcttatacggcggttcagcatttattgaatatcaagattgggggcattactcacatatgacccaagggtttgtcatgctgatttttgcagtattcgggatgttgcttattggtatttggtatcaggcaattcaattactgaaaggtaaaaccattagtgaattgatctttgaaatcaaagaagcattcaaagccatattcaaatag

SEQ ID NO: 3574 - DNA, 1002 bp, Acinetobacter baumannii
ctaggtgaaaaggatatgatatcactcagccaacagatggaactcaatcattattcacgcaaagctgaatttgcgcagaatctgatgtccacaatttgtggtgaacaccgtctagacacaatttacaaagataatctcgatttccactatgacggaatgcgtttgcccaataaaaaaatggcaatcggtacaatcagttatggtgcaaacgtcgctatcaacatttcaaatttaaaagcttatagcattagtttacctatacaggggcgacaagctctcaacattcgtggtgcacattatcaatctgatgaaaacagaggcctaattgtttcaaataatgatcaacaagatctgattatcgataaagactgtagaaaatttcaggtggttattcctgagcgaagtatgcagattgtccttgcagatttactgaataaacctatagaaacgcctatcatttttaaccctgaaatgcacttagactctgagcaactgattggagcgtggtggaagaatattcagaattttttacagctaaaatcgcaatatagcaatttttatggtttgcagatgttatctgaagactatgaaaattttgtaattaaagccttactattatctcaagaaaacaactactctaaagctttaaagtcactctcacatcaagatgagccagcttatattcgaaaggttcgtaattttattattgaacatgctcacgaagaaatctgtgcagaagacttgcagcgtttggctggggtttcaaaatcaaaattgtatgatgaatttcaacaatactacggcaccagcccaatgtcgtatttgaaaaaatatcgtcttcaacaaatttacaaaatcttgagcactacaggagcagataaaaaggtttctatttcaaagcttgcgtatgactggggttttaaccatttaagccgtttttctcaagaatatcgtgaagaatttggagaaaacccaagtgagaccaaaggcaaaattttctga

SEQ ID NO: 3575 - DNA, 201 bp, Acinetobacter baumannii
aagtcattgaaagctaaaatatttacagtttggttacttcgcggtgctggtgtgcttgaatcattgtcatcgttatcattacagcctaccaataaggccattgccagacataaagatgttgtcttaaatagtatgtttaaagtcgtcatttttttatcaattgatgaattaagatgcataaaaaatacgcatagagtatga

SEQ ID NO: 3576 - DNA, 771 bp, Acinetobacter baumannii
gccatgttgaatcaacatgagataaatttaaaacagtatcaaaataaatctttaagttatttgaatagcaccgctcactctgaaggggtcgagtttgataaattcattaaagaaattgatgaatatccaaatgccgttgttttagatttaggttgcggtggtggtcatgtagcttataacgttgctcgccatgcagatctggtttttgcttatgatttatctcatgaaatgctcgatacagtgtcaaaagctgccaatgctcgaaaaataaaaaatatttttgtacagcaaggtattgctgaagatatgccttttactgatgaacaatttgatgtaatcattagtcgttattctgcccatcattggcagcatgtcccaacagcaatgaaagaaataaatcgtgtattaaagccaaatggcactgttatttttgttgatattattagctcaagtttccctattttagatacatttttacagactatagaagtgattcgagaccctagtcatgtaagaaattacagtattaaagactgggttcactttattgaagatgctggttttgaattaacaattttagaaaaacaaaccctcaaactagattttgatagttgggtacagcgcatgaagacacctgaagatcaaataaaaacccttaggtatctccaagaaaatgcagcagatgttgttaaaaagtattttaatattcaaaaagatggaagttttgaaagtaaggtcgggtactttgtatttaaaaaactatccttctag

SEQ ID NO: 3577 - DNA, 561 bp, Acinetobacter baumannii
gtcgatatgaaatcgaatctaccatttcaaccacaaaaaggctttaccctcatagaagtgatggtagtcattgtgattatgacaattatgacttctctggttgtattaaatataggtggcgtcgaccaaaaaaaggcaatgcaggcgagagagttatttttactcgatttgcagaaaattaataaagaatcgctcgatcaatcacgtgtattggctttagaaactcatggtgagacagatgtctcaccattttcttatgaactttatgaatatcacgatcaaagcactttacaagtacaagatataaaaaaccgttggcagaaatatactgagtttaaaacacggcaacttcctgcccatgtttctttttcagtacaacccttggatgaccagaattattctaaagctaaaaatacagatttgattggaggacaaacgcctcaactcatctggtttggcaatggagaagctaaaaccgttaaaatacaattttatttagaacaaaaaccgattggttcggaaatacaaatagatcacttgggtaaaataaatgaaatctaa

SEQ ID NO: 3578 - DNA, 1092 bp, Acinetobacter baumannii
aacaagatgaaacgcttaaagtcccttgtctcagaacaaagtcaaatcaagcacctctctacccgactatttcgtcctcaaacattagtattgtcacaaagcactccgtttgaagtgattggtgaattcaatcaaacccgcgttcgttattatgcagctacagaaaagagctttagagaaccattagtatttgtggcacctttagctattaatatggcgatttatgatttatatccatatcgttctcttatcaaatacttccaaaatgcaggttttgacgtataccttgtcgattgggggcgtttaggctttaaagatagacatcttaactttttatcgtttattgaagattttattcctaaagctatagagcttgttcgcacacattcaggcagtgatcaaatttctctacacggatggagtatggctggcatattcgttactttatatacagcgcataatcatccgaattatgtcaaaaaccttatagttttaggtagcccaatcgatagctatgcttctggttatattggaaaactctaccgaaccataaacaacactattgcccgcaataaaaagcttcaggaacgtatttactcaggtttaccgaagcgtttgattcatactccgggcattttaaattctttaggctttaaaattcttgaccctaaaggctggttcgatggtcatattcaattacttaagaaccttaatgaccttcagttcgtacaagaacatgccacattaagcagttttttaaaaaatatgattgattatccgggaggtattaatcaggacatgttatttaatgtttggctgcaaaatccattaagacaaggttctattcagttaaaagataaaaaaatcgaattaaaaaatatcgactgttcactcttagttggagctggtcgtagtgatcaattagtgacggcagatgcagctcagccattaagtcagttaaccagtagccaagatgttacatttactcttattcctggcggtcatttaggtctaatgtcaagccaagcaagtgcgcaggaattctggccaaagttagcaacatggctgagtgagcgttcaacaaaaatctaa

SEQ ID NO: 3579 - DNA, 1884 bp, Acinetobacter baumannii
acagtacagaatcgaccaattaaagaaataggattaataaaaatgggacaattacatccagttttatcaaatacacatgtgattcaaaatgctttacaggcttggcaacatccaaattcggatcaggcaaaatatgttgagcaacgtgttattaagcaattacttcaagctttaatttttgaagatattattcattcagaatatgatggaaaaaattttattatagaagtacaaaatagtcagcgccaaaccattcgttatgtcgctgcagggcaaagacaatatagttacaaactggtacgccttgcccgtaatcaggatgtatttcgtcaagatgaaaacggtcattatcagattgctactttaaatttagttattgatgaaattcttagaaccataaccgatgcagcaaaagttgaagattttatttttgaattaaaacgaacatttattcatgatttacagtctcaagcatgttttgatcactatgctttgccggcaattcaatatccatatgatattttagaatcatatttaatggatggtcatccatatcatccgtgttacaagtcacgtgtaggttttagtttacaagacaatgtacgctatggtgtggagttcgcccaaccaatcgccttggtctggttggctgtgcatcaggacattgttgcaaaaaaacattcagaagatatagagccagatttattttttaaggagcaattgaattcacaagaccaagagctattcctgcaacatctctcagatcgtgatttgaaggctgatgaatatatttggattccggttcatccttggcaatgggaaaaccatttaatttctatttttgctgaagaaattctaaatggcaaaattgtttatttagggcaaagtcaggatcgctatctagcccaacaatctctacgcactatgactaacttgcagcatccggaaaagccttatatcaaactgtcgatgagtctaactaatacatcaagctcacgtgttctggctaaacatacagtaatgaatgggccaattattacagactggttgcaacgcttaattaaacagagcaaaaccgcccaagagcttgattttgctgtattacgtgaagtgtatggtttaagcgtggattttactaaattgccaaaatcacatgctcaacaggcctatggcacaattggatgtctatggcgtgagagtgtgcatcaatatttacgtgaaggtgaagatgcaataccgttaaatggcgtgagtcatatccaaaaagatgggcaagcattaattgcaccatggttacagcaatatggtgttgaatcatggacacgtcaacttttgaaagttgtgattactcctttgattcatttactttttgcggagggaattgcaactgaatcacatggccaaaatattattcttgtacataaacaaggttggccaacgcgagttcttttaaaggacttccatgatggtgtgcgctatagtccagcatatttagcacaccctgaattggctcctgaactcgatcagttgccgcctgagcatgcaaaaaccaacagtatgtcatttattttgacagatgatttaaatggtattcgtgattttagctgtgcctgtctgttttttgtggctttaaccgatattgcaatatttttaaatcaaaactttgatcttccagaaaaaaaattctggcaatgggctgcggaagtcatccaaaattaccaacagcaacatccagagcatgcttcacgttaccaattatttgatgtttttgccgaaaaattgcgcattgagtcattaactaaacggcgtttatttggtgatcgtagtatacaaattaaatttgtcgataacccgttagctccttttaaattgcaggtgaagtga

SEQ ID NO: 3580 - DNA, 423 bp, Acinetobacter baumannii
tttaaggagaatttaaccatggcattagttgataaattactacagttctccgataagcaagctattgcggcgggtgctagtactttcactttggacacagtgcataaatctgttggtacagcgggtttacctatctgccttcaagggcatgtagttggacctgcaaacgctaccgttacagtgacacttgaagaaagtgcggacggaacaacttttacagcggcagccgcgtcaaaagcgtttaaagctgctgaactgaacaaaggtacgttcttttacgtaaacagtgcgacaaaacgttttatccgtttgtcttatgcggttgccaatgcgcctactggatctatttcggcttggttgggcaatgaagcggatatccgtacaaactatgacgctgtaagcggcgcaactgtaccagtttaa

SEQ ID NO: 3581 - DNA, 330 bp, Acinetobacter baumannii
aatattgggaataaaccttatattgagtacaggttcatacctttaactgaggaaaagctcatgaataaattaatggttgcggtattcgctggaatggtgacccttgccggtttcagtgctcaagctgcaacacctgagcaagaatgtcaaaaattgcaagatgattacaatttgatttatgcgtcaaaaggcttttgttttaaagaccaagatgctaaagaaaaatatggtaatgaaaactgtcatacgactaagccaaaattctctgataaagagcagcaacgtctagacgcaatcaaagagcgtcaaaaagaattgaaatgtaaatag

SEQ ID NO: 3582 - DNA, 1437 bp, Acinetobacter baumannii
gttatgcttgattttattggaattggactggggccgtttaatttaagtctggctagtctgttacatgataaaagcgagctgcaatatcgcttttttgatcagcgtgagaaatttgactggcatgctggtatgcaattgcctaatgcgatgttacaagttccttttatggctgatttggttagtatggttgagccaaccagcccttttagttttttaaattatttaaaacaccatcaacgtttatataaattctattttagagaaaatttgtatataccgcgtcaggaatataatcattattgtcaatgggttgtagaacaacttaaccatattgagtttagtagccatgtgctggatattaaaccgattaaaggtggatttgatgtggaggtagtgtgtaatgggcaccaccaacattatcgtactcgacaattggtattgggagtgggtacaactccacatttaccagaaagcttacaacagatttactcaaaatcaggaacctgcctgcattcatcagaatatttacagtacagctcccagaagttatcaggaaatgtagttttaattggttctggacagtccgcagcagagatttttttagatctatttgatcgtcagtatatgaatggtcgaactacaccagactttcatctttattggttaacccgttctgctggtttctttccaatggaaaatacaccattcggtttagaacattttagtccggattacatgcattacttttacaatttaccatcaggtttaaaggcagagttaccagcgcaacaagcaaatttatataaaggtattagcagtaaaacgatacgtgatatttatgagcgtttatatcatcgtagtatcggtggaatgcctacagatgttacgttggctggacatcatcaactgcaatatgcagagctcttagaaaaccagaaaacaaagttgtgttttgaacaccgtcagcaaaataagaattatattctggaggctgattgtgttattgcagcaacgggttatcgttatccaaaccctaagtttctacaaaatttacaatctttaatcatacgagatcaggccgaccattggcaggtgggttcaaactttaaagtcaattatcaaggtgaaggatctatatttattcaaaatatggaagtttatcaccacggcgtaggtacgcctgatttaggcttaggagcatatagggcagccacaattgcgaatcaattggttggtgaagagttattcaaacttgatcattctcagtcattccaacaatttggagtgaatgcatcagcgcaaaaagaagtttctgttcgcaatattgcagcctcaaaaataaccgagttttcaagacccttaaataaatcagggccaatgcatcattctgctttgggagcgtatgcacgaagtaaattatctgagcatattgaataa

SEQ ID NO: 3583 - DNA, 303 bp, Acinetobacter baumannii
atgactactgaagctcttaataagtctgatttgattgaacgcattgcgctaaaaaatccacacttggctgaaccattggtggaagaagcggttaagattatgattgaccaaatgatcgaagctctttcgtctgacaatcgtattgaaatccgtggttttggtagctttgcattacaccaccgtgaacctagagttggtcgtaaccctaaaacaggtaagtcagtagatgttgcagcgaaggctgttccacattttaaaccaggtaaagcacttcgtgatgcagtgaatgaatctggaaaataa

SEQ ID NO: 3584 - DNA, 2175 bp, Acinetobacter baumannii
ataaaacatgatcaaaaaagaggtaaaaacgtgcttatttttcatggaaaacctgttcatggagctatcttcgatatggatgggacaatgtttgatactgaacggttgcggtttcaaacattgcaacaggcatctcaagaactcattgggcaggagttttcacacgaatatttaatgcaatgtttggggttaagtgcgactacagcggaaaagcttgcacaacgtttatacggagtagatgttccatataaggaaattcgaaaacgtgccgatgagatggaactagaacatattcgaaaacatggcgtacctattaaaaaaggtttggttcaagttctagagcgtttaagaaaatctggtttaagaatggctgtggctacttcaagccgtagagcaattgccgaagaatatttaattaatgcaaatgtttataaattttttgatgtcattacttgtggggatgaagtagaacaagggaagccacatccagaaatctttttaaaagcggctagtcaacttcatttagacgctaaccagtgtcttatgtttgaagattcggaaaatggtttaacttcagcacatacatcgaaaggtttaacgattttattaaaagatattaaagaaccaaatgatgaaatgctggaaaaagcgcatttttattatgaccagatgtacgaatttttaatcgaccttgaccaatttattcctgttatggatacgccagagatacaggaaccttttcctcaaagtctgaatcagcttactgttggaatacatggtttcggtgctattggcggtggttatatagcgcagatcttgtcgcattgggatggttatacgaaaccaaaacgtataattgcgtcaacacgaaatagtcttttccgcgaagctgtaaatgcgtttggaacctatagtattcgctatgggcaattttcttatgatgaacgtattgaaaatatgaccattgttgattctgacaatgagcaacaaatgttagagatgtatactcattcaagtttgattgcattatgtttgcctgagcaagcgatcgaagctgaatcaaagataattgcaaaagggttatatgcgcgttttaattcgcaacttgaaacatgtatagaaccgttaacctttctaattattttaaataaggttggtgcgaaatatttggttatgaagcatcttaaagaagctctactagagttaaccaacgatgaagatgtaaccgagcatattttaaaagagcattacttttgcgacaccgtagttaatcgcatggtttcaaaactttctaatcagaatttatatcgtcaacttcgtattaagcataattttcttgaacagcatttagaagatgtggagcaagaagaccaaatcgaaattgaagattgtaataaactaactccagatcaactaaatcaggcttctatctatgttgataacatgcgccgtaatttccagccgggacatatcttacaaagcatggatttaatcttgttccatagcgaaagtgatatgccaatctatgtagagaaaggcagtcctttacttgaaaagttgcgtcaggtggtattggttgaccaaattactgatattcaactcattaaaaatcgtttatggaatggtgtacatgcgatgcttgcttggtatgcatctttaatgggttatgaatctattggtgttgccatgggtgatcatttagttaaagcatttgcagagaacttaattgcagaagtgaagcagggacttgctattgtattacctaattatgcaaaagatctggatcgaatgtcacaaagttttctagactcatgtgaatatgcatttaaagatccttgtcaacgcgtagctagagatccactacgcaaactcaatcataatgaacgtgtcatggcatcaattgctatgaatatttgtcatgatttgccttataaaaatttattaaaaggtgctgctttaggttatgcctatgcgattcaatttttagaaattgaagagactaaagctgttgaacatctgcagcagcaaattcagaacctagacttgagtacaactcaaagaagacagcttgaagctgagttggttcaacttatccaatatttgttttctgaacaaggtaaacaacctttggataagttgaacaataccaaaactacatcaaatcaatatgtttga

SEQ ID NO: 3585 - DNA, 1293 bp, Acinetobacter baumannii
aacgattgtgaaacatataaaatggcaaagctaaattttgagtcagaacaggatttttatattttatttgagcagcttaaagctctattcccaaatgcgattttgtttttagcggacacatctactcaagcaattcactataaatttaatacagacgatatttctgtagagaacatggcagcgcttactcaagaccatcacaatcaatatcttgagatcaatactcctaaaatgagaaagcgatttatctatcaagaacatgatatttacctcacagagcatcgaattatcgggaaattgcatattctacagcccgttagcatagagaatgatatcgctgatcaagtagagctaacagaacaattacaagagttaagcaagatctttaatagctgttcaccagaaatgactcgtatgttttcaattattcaaagagtggcaattactgagtttccagtgcttgtccgcggcgaatctggtagcggtaaagaacttgtggcaaaagcaattcatgattatagccaacgtaaaaataagatttttgtggcgattaactgtgcagctttaaattctaatattttagaaagtgaactctttgggcatgtgaaaggtgcttttacgggagcaattcgcgaccataaaggcgtgtttgaacgtgccgcaggcggaacgctgtttctggatgaaattgccgagattcctttagagcttcaagctaaattattacgggtgttagaaacaggtgaatttacgccagttggtggtgaaaaaccgattcaagccaatgtccgaattattacagcaacacataaagctttacgcgaagaggctaaggctgggcgtttccgtcatgatctactctaccgtctacgcgtaattccaattttcataccaccactcagagagagaaaagtcgatattcctcttattgtcgatcagattttaaaagagagctcaacccaactcgatacaatgcctcgacatgtcaatcaaaaagcgatgcaagttttattgaattatgactggccaggaaatgttcgtgagcttaaaaacactctgctttatgctttaaccatggcaaatggtaaagatgaaattgaagtcgaagacttacccaatgagctattaaatgcagaggattacgttaaattacccgagacaaatgcagagcttagtccagaaaatgtgcaagccgctttagaaaaatataaccataacctgaatatggtcgcgaatatttttggaattagccgcactactctttggcgatacagacaaaaacataagctttag

SEQ ID NO: 3586 - DNA, 723 bp, Acinetobacter baumannii
ttatccagtgaaagcaaaataatgataaaaaataaatatattcacatccgaagctttgctgctcgccttgcagcacgatcgagcagtgctcgattaactcgcgcctcaggatttactttggttgaattgttagtcgcgatcgctatctttgcggttttatctttattggggtggaaaattttcgattacttgctcaaagttcgtgatcgtaatgccgaacatgaagtgcatttatttgaattacaagatgcttatcaacaaattcttcgtgatactttgcagattatccctttatccgcaaaccaaggtgggcaacttcatccagctttagaaatcgataatcaaattttacgttttagtaaagctggggtaacagatcctttaaaacaaggcttatcaccatttgaacgaattgaatatcgttatgatgcagatcaaaaaaaactatatcgtcttaaatatacaaatttaaatacttcgaacagagagcaacctttatcgagtactttgttaagtcaagtcgaccaatatcagattatggttttgactccgcaagaagtcacaaaatggcccgaggttaatattgatccaacgaaacctaatgagttaaaaaaattaccgaaagggataaaaatccaacttacagtcgctggtgtaaattatgaatggatttatagcttaaatcagggtgacttatcgctttcacaggaaggtaattcataa

SEQ ID NO: 3587 - DNA, 216 bp, Acinetobacter baumannii
gggatgagtgaaaaagcatttaaagacttaaaaattcgcttccatttggctattggtgtggctaatggcgatcgtgaggactttgggaaattatcggattggatcgaagaagaaaactggaaaatgatggatgaggaagagcagaaagatactctttcagaaattgcagaggaatgggcgcagcagtatttagatttaggagcgacagtcgaatga

SEQ ID NO: 3588 - DNA, 1152 bp, Acinetobacter baumannii
aggaacttcgatatggatatgtcaaaacaattattattgccttctacagacaaccttccgtctttctttagaccggaaacaatttctgaaaccccttgtttaggaaaaaagccgtcactcgatctagatgcggctcctatatttgatctagatcaggaatggcaacattccttatttggtcgttcaatccaagagtgccatagaaatttgatgcatattgctgaagatgcagatatggcaattggggtgactgaccctcacggtactttactctggacatggagtagtacacctatgcgttcatctgctgagcaagtccattttgttgaaggtggacaatggtcaacccaagcagttggtcaaaatgcaattggtcttgccctaaatacacattctgcaagctgtgtttattcacatgaaaaccagatgaacagtgttagagactgggtatgttatgcagccccgatcactgacgcaaatacaggccagttttatggcattatgaacttatcaactaaatatcaaaagcataactcacttggaattttagctgttgaacgttgcgccgatattgtaaaacaagccattcaacttcatcaaaagaacattttatatattaaggcgctaggcacgcctaaggttcaatacaatcaacatagcttaacactcacgcagcgccaaatcgaaattttatgcattcttgctttatgtccggaaggcataaacctagaagagcttcactatgccttatatggcgatcgaccagtgagtaccactacactaaaagctgagctctcacagcttcgaaacctgattcccgatgtgatcgagtcacgaccatatagacttaactgtgaaattcaatgtgactttctcatggctgagcaagcactaaacttaggttttactgcaaccactttaacactgtatagaggtagttttttagccaagtcagaaagtccgtttttgtgtgcttggagagattgctttgacgcccgcttgagtcatgttatctatcaaattgatgatgtagaccaactattacgtgtggttagccgtgttcccgaccgtgttgatgccgttgaacgcttacttgaacttctgcccgaagaaacaccgtatcgggcaaagctcttaaaattgctcgaataa

SEQ ID NO: 3589 - DNA, 414 bp, Acinetobacter baumannii
gctgaccccgaggtttggagaagcgaaatggcttatagcgaaaaggtaattgatcattacgaaaacccacgtaatgttggtgttttagacaaaaactctgagaatgttggtacaggcatggtgggtgcacctgcatgtggcgacgtaatgcgtttacagattcaagtaaatgacaacggtgtaatcgaagaagcacgtttcaagacttatggttgcggttctgcaattgcatcaagttcacttgtaacagaatggttaaaaggcaagacacttgatgaagctcaagcaatcaaaaacattgatattgcaactgagctagctcttccgccagtaaaagttcactgttctgtattagctgaagatgcaattaaagctgcgattgaagattatcgtagtaaaaaatcaaaagcttaa

SEQ ID NO: 3590 - DNA, 669 bp, Acinetobacter baumannii
accatgagcgaagtgacaacaactacgacagcaactgatgcggcaactacagctaccactactgatgcacctgctgcaactaccactgaaacaggtgggggcaatcccgctacaactcaggttgagacaacacctactacaaccacgactacagataatgctgaaaacactgaaaccaagcctgaagttcttttagggggcgaacagccacctgctgaacaaccgattcagtacactgaattcacaatgcctgaaggatactcaatgaatcctgatgattcaaaagttcttcaagagttagggcaacagttcaaaatgccacaagaagctgtgcaaaagcttgtggatttaggcgttcaaatgcagcaacgccaagtacaagagcagcaaaaaacgattctttcatggcttgatgcagctaaggccgataaggagtacggcggtgaaaaccttgaaaaaaacctgttgacagcgcaacgcgccttcagcttaccacggggcgatgaaatctctaagattctctatatgagcggacttggtaaccatcctgcagtaattggctttatgaccgaagtaggtaaattgttggaacccgacaatatgacccatggtcgtgggacaaatacagcgaatgtggcaccagcggccgtatggtatgacaaatcataa

SEQ ID NO: 3591 - DNA, 912 bp, Acinetobacter baumannii
aagggaatagataagatgaatttagaagtccgttgggtagaggatctcctcacattagaacgtgaacgttcaatctcaaaagcagcagagaaaagatttattagccagtctgcatttactcgaagaattcaacaaattgaagaaatgattggtgctgaagtcattattaggaacaacaaaaacaacatcgaatttacagacattggtcgaattttattagtgatgtctaaaaatattgaaaaacaggtagaggagaccgcaaaactaattaaaaatagtaaaaatgaaactgaatcgaccattcgtttctgcgttgttcattctttagcctctggatttttaactacttttttaaagaaatttcctacacttattcgtgatttaaaaattgaaattgtcgcaacgaatagtggagaaggcctgtctttgttaaaagaaggtgcttgtgactttatgatttgctatgcagataaaagcaatattagaaaggttggggatgatattttaagtggtatcaaaattgctgaaacggttattgtaccggtctctgcaactgaacccgaccatagcccgaaacatacaatacaaagtaactttgctctgctagcgtatagtaaacacgcgtacttaagaaaattggtagatcaactgattgaaggtaagcttatatataaaacgttatatgaaacagataatgccaccaatttaaaagagctggttttacaaggtctaggggttgcttggattccaaaaattaatgttgaagaagaccttgcagccggaaaattagtcattttagaccaacaagaatattgccttgctcaagatatttacatcttcaaaaataatttgagtgataataagtcggtacagaaaatatggaatggttttaaaggtcagcaagatctataa

SEQ ID NO: 3592 - DNA, 1227 bp, Acinetobacter baumannii
gatcaatcagaggatatttccatgaatttacaaaatccaaaaaaattcaaaataatgattgatcaggcacatgatgttgcgatcaatgtattacgccctatttcccgtaaatacgataaagcagaacatgcttatccgaaagagctggatatgcttgcttcactcattgatggcatgaatgaaggtggtgaaggaattaatgcaggtgctgccggtgcaggaaaacgtggtgaaactgataatgaaggagtccgtaatggaaccaacatgtcaacagcgttaggcatcattgaaatgtgttatggcgatactgggctattactcagcatgccacgtcaaggtttaggaaactctgcaattaccgcggtcgcaaatgatgagcagcttgaacgttttaagggtacttgggcagctatggccattaccgagccaggttgcggttctgattctgctgcgatccgtactacggcaactaaagatggcaatgactatattttaaatggtgaaaagattttcgtaacttctggtgaacgtgcggactcggtagttgtatgggctacacttgaccaaaaacttggacgcgcagcaatcaaatcatttgtggtgcctaagggtacacccggaatgaaggttgaacgacttgaacataagttaggtatcaaagcttctgatacagccgttattagttttactgactgtcgtgttccagctgaaaacttgctcggtaatcctgaaattgatgttgcaaaaggttttgccggtgtaatggaaacctttgataatacgcgtccattagtcgcagcaatggcaattggctgtgccaaggcttctttagagcgtattaaagaaatttttaaagaccagttagaccccaattactcgactccatatttgcaaacttccaaccttgctgcacaaatttaccgaatggaagccgaatgggaagctgcacggttacttatgctgaaagccacctggatggcagacaacaaaaaaccaaactcaaaagaagcttccatcgctaaagcaaaagcaggtcgtgtaggcaatgaaatcactttgaagtgtgtcgagttagcagcaagtgttggctataacgaagatgaactacttgagaagtgggcacgtgattcaaaaattcttgatatttttgaaggtactcaacaaatccagcaacttattattgctcgacgtgagcttggaaaatcttcaagtgaactaaaatag

SEQ ID NO: 3593 - DNA, 396 bp, Acinetobacter baumannii
ggaagagcagaaagatactctttcagaaattgcagaggaatgggcgcagcagtatttagatttaggagcgacagtcgaatgagtattttagataaaaactatatcgtcactatgccagacgaaagcaaatgggctgtaccagttcgcataattgctgagagtcgcgctaaatactatgcgggtgttgatgaagtatctttcgaagaaagcctaaatgatgacaccgtccctctcttcgaatctgacgattatgaaattcatgattgggctgcaaataatatgaattggagagatgttaaagatcatgccatccaaattgaacgcccaagcttagattatgaagatggctgggtaaatggcgagtacgaagttaaagcggaaagtaaggaggggtga

SEQ ID NO: 3594 - DNA, 438 bp, Acinetobacter baumannii
tcaggagcagacattatgggtatgagtgttggttctgaagatgatgaagaaatgattggaacgattaacacgacacctctcgtagatgtcatgttggttttacttattatttttcttattactattccggtagttacgcatacagttccggtgaaactaccagaagaaaaaaatactccgtacgcgaccacgcctgaaaatattcaactttcagttaataagaaaggcgatattttctggaacgagagttatgtaccgaataaagaaatattgttagcaaaattacaagctgtggcacaaaaaagaccgcagccggaggtacatattcgaggagatcagcttacccattttgaagcgatagatcaggtcattagtacgaccaaacaagctggtattggcaaaattgcctttgttactacccctccagcttccccgtaa

SEQ ID NO: 3595 - DNA, 1728 bp, Acinetobacter baumannii
gtgaatcaagattttaaggtttatttgcgtctcatatcctatttaaaaccttattggggcgtggccttattagttcttatcgggttcggtatgaactcagcaacggaggtttctgttgctaagctcattaaatttattattgatgcaattcaaaatgcgagtagagcggatctggattggttccctttattaatcattttattggtattcttccgtggccttggcctatttatgggggggtactatacggctgtgatctcgcgtagtttggtttttagtattcgccaagaagtttatgcaaaacttctaagactgccggctcaatattatctcgataactcttcgggtcatattactgccaaaattatgtataacgtcgagcaacttacagctgcttcatctgaatcattaaaaaccattgttcgagatggcatgattacgttggggttgttaggttatttgttctataccaattggcgtttaacaatttgtattatggtgttcttacctgtaattgggattttggtgcgtaaagcttcaaaaagaatgcgcaaactctcgatgcaagttcaggacactatgggtgatgttaaccatgtagtgcaagaaagtattaatggtaatgcagttgttaaaagtttcgctggtgaagagtcagaacaagagcgtttctataagtcatcggaagaaaacttaaaacgtggtttaaaaatggtgattgtgcaaaacctaaatagtcctgttgttcaagtggtaatggcttgtgcaatggctctaattgtatggttagcattaagaccacaaattttagggaatacaactgctggtgagtttgttgcctatattacggcagcagggttactttcaaagcctgttaaaaacttgacagatgtgaatgaaaagttacagcggggtttagcagctgcacactcagtttttgaattattagatttacctgaagagcaaaatagtggtgaacttaaaccgcagttgcagggtgcaattcgttttgaccatgttgtacttaactatgctgacggtacgcaagcgattaaagacttttctttagatattcgtccaggcgaaactgttgcattggtagggcgctctggtgctggtaaaacttctttagtgaacatgttggtacgtttccaagaagtctcaagtggtcaaatttatttagatgatttgccaatacgtgatattgagctttcaagtttgcgtacacaaattgcaatggtaaatcagcaagttgttttgtttaaccgaactgtacgtgaaaacattgcttatggtcagttacataatgcaagtgatgaagacgtaatagctgcagcaaaggctgcttatgcccacgactttattatgaacttaccaaatggctacgatactgttttgggtgctcaaggtctaaatttatcgggtggtcaacgtcaacgtattgcaattgctcgtgcaattttgaaaaatgccccaattctcattttggatgaggcgacaagtgcgcttgataatgaatctgaacactttattcaacaagcatttgatgaggctatgcaagatcgtacaacgattgtgattgctcaccgtctatcaaccattgaaaatgcggatcgtattgttgtgatggatcgcggacaaattgttgaacaaggtacccatcaagaattacttgctaagcacggtgcttattatcaattacatcagcgtaattttgaggaccattaa

SEQ ID NO: 3596 - DNA, 1893 bp, Acinetobacter baumannii
ttttttaaagatcattctatttcgattcagtttcaattttcatcaaatattcatactctatgcgtattttttatgcatcttaattcatcaattgataaaaaaatgacgactttaaacatactatttaagacaacatctttatgtctggcaatggccttattggtaggctgtaatgataacgatgacaatgattcaagcacaccagcaccgcgaagtaaccaaactgtaaatattttagctttcaatgactttcatggaaatttagaaccacctaaacgttacgttgaagcagcgaatccaaatgatgcatctcaaactgtacgtattcctgtcggtggtgtgagttattttgcagatgcaattaagaaacttaaagctcaaaatcccaataatgctgttgtgtcagcaggtgacttaattagtgcctccccacttacttcttcattatttctagatgaacctactattgaagtcatgaatgatattcaaattgactttaatgcagttggaaatcatgagtttgaccgtggtacagatgaattgcgtcgtttacaaaatggcggttgtcaacaatataccagcactgccccatgccaaattaataaaaactttagcggcgcaaaattcaatttccttgcagctaacgtggcaatgaaaaatgatacaagtaaaacgatttttcctgcctataaagtcaaaacttatggcgggattcctgtagcttttattggtttaacactcaaagcgactccaagtattgtttcagcggcgggtattaaggatgttgaattccgtgatgaagcagatacggtaaatgcgttaattcctgaactccaaaaacaaggtattgaagccattgtcgtcgttgtccatgaaggtgcagcgccaagtacgaaactcaatcaaaaaacatgtgatggcttaagtgggccaattttaggtattttagatcggttaaatccagcagttgatattgttgtttcggggcatacacatcagtcttatatttgtgattatgcaaccaagaatccggctaaaccgtttttactaacctcagctggccaatacggcacgcttattaccgatattaaggtggagttggatggtaaaactggcgatatcattaaaaaggatgctaaacaaattccggttcaaagtgaggcctatacttcgggtacaaccactgtaagtctgacagacctctatcaaaaatttagtaaaacgccaagtatcgaagcgattttagataaataccgtcaagcagtaaccacaatttctggacgtgttgttggaacttctactgccgttgtgagccgtacacaagtcgaaagtggtgaaagcccactaggtgatatgattgctgatgcacagcaagctgccgctcttcaagcaagtaatcaaggttcggattttacgttaatgaacccgggcggtgtacgtgctgacctactgattaacagcaataaccagattacgtttggtgatatttttgcagttcaacctttcggtaactcgattgtgactttgagcttaaccggtaaacagattagagatgtgcttgaacagcaatggtctggtgcaaatgcaaattcgcctagaattttacagccgtctaaagagttgagttaccaatatgcggcaaatacttctgtttcaccgcgagcaaataacatcatggttgctggttcaccattagttgacactaaagtataccgtgtgacggtaaatagtttcttggcagatggtggtgacaactttacggtattaaaagaaggccaaaaccgtgtcggtggtggtcaagatattgatgcgcttgaaaactatgttgcacaaaactctaaagattcaccgttaattattccggctacgactcgtattaaagtcattaaataa

SEQ ID NO: 3597 - DNA, 285 bp, Acinetobacter baumannii
atgaataaagaacaatttgatgtaaatcttgtgcctacctggcgccaaggttatcgctttcaatttgagcctgctcaaaatggctttgtcattttatatcctgaaggcatgatcaaattaaatgaaagtgcaggggccattggacagtatattgatgggacaaataatgtttctacaattattgcccagctcaagcaacaatttggtgatgtagccgaaattgacaacgatgttattgattacatgttagttgcccagcaacaacactggattgatttagtatga

SEQ ID NO: 3598 - DNA, 312 bp, Acinetobacter baumannii
agtatgaaagatggactccaaattgaagaaatgaaaaatgcggcggattcagtcgtaggaacattaaaatctttagctaacactgaccgtttattcattttatgtcacttagcccatgaggagttaaatgtctctcaaattgaagagaaaacacaaatcacccaacccaccctttcacaacaattgatgatgctacgtaaaagtgatgtcgtttcaacacgacgtgatggcaagcaaatcttctattcgatcaaggatgataagatgcattcaattttaaatatgctttaccagttatactgcatagaataa

SEQ ID NO: 3599 - DNA, 1332 bp, Acinetobacter baumannii
tcaatcttggacacaacgttaatgaagacaaaacatcttaaacagttttttaaagcgacgacccttgctgtattaatatcttcatcaatgcatagttttgcccaacctactgatgaagttgtggcaattgtggacaatagcgtaattttaaaaagtgaccttgaacaaggaatggctgaagcagctcacgaattgcaagcacaaaaaaaagaagttccacctcaacaatacttacaatttcaagtattagaccaactcatcttacgtcaagcacaacttgaacaagttaaaaaatatggcatcaaacctgatgagaaaagtctaaatgaggctgtacttaaagttgcaagtcaatcaggtagcaaaagcctagaagcctttcaacaaaaattagatgcgattgcacctggaacttatgaaaacttacgtagccgtattgctgaagatttagcaattaatcgtctgcgtcaacagcaagttatgtctcgtattaaaatcagtgatcaagatgtagataacttcttgaagtcaccacaaggacaagctgctttaggtaatcaagcccatgtgattcatatgcgaatttccggagacaaccctcaagaagttcaaaatgtagcaaaagaagttcgttcacaacttgctcaaaacaatgatttaaacgctcttaaaaagctttcaaccgcgactgtaaaagttgaaggtgcagatatgggattccgtcctctttctgacataccggctgaacttgctgctcgtattacccccttgcaagatggtcaaacaactgacttaatctctgtacgcgatggtgtacatgttctaaaacttttagaacgtaaacaaaatgaacagaaagcattagtaccgcaatatcaaacacgccatattcttattcaaccttccgaagtggtaagccctgaaaatgcgaaacaaataattgatagcatttacaagcgattaaaagcgggtgaagatttcgctactcttgctgcaacttattcaaacgatacaggttcagcacgtgatggcggcagtctaggttgggttacgccaggtatgatggttcctgagtttgataaaaaaatgcaggaaattcctgtaggtgaaattagtgaacctttccaaactcaattcggctggcatatcttacaagtgacagacaaacgcgaaaaagatatgacgcatgaatatcaagagcgtatggcacgtcaaattttaggtgaacgtcaatttaacactgaaattgatagctggttacgtgaagtccgtgcaaatgcttatgtagaaattaaagatccaagcctcgacaaaaagaacttacaaaaataa

SEQ ID NO: 3600 - DNA, 1257 bp, Acinetobacter baumannii
aaaattatggagaatattatgcgccgtattgcaattgttggagcaggacagtctggtttacagcttggtttaggcttattagatacaggctatgacgtgaccatgatcaccaaccgaactgccgatgaaatccgtcaaggtaaagtcatgtcaagccagtgtatgtttcataccgctttacaaactgaacgtgacttgggactaaatttctgggaagaacaatgtccagccgtagaaggcattgggctagctttagtgaaccctgaaaatggtggtaaagcatttgaatggagcgctcgtcttgagcgctacgctcaatcggtcgatcaacgcgtcaaaatgccatattggatggaagaatttgaacgccgtggcggtcgattggtaattcaggatgttggaatagaagagttagaacaactcgcaaacgactacgagcttgtattactcgccgctggtaaaggtgaggttgttaagcaatttgaacgtgatgatgtacgtagtgtttttgataaaccgcagcgcgctttggctttgacctacgtcaaaaacatgaagccaatttcaccttattcacgtgtgacttttaacattattcccgaagttggtgaatacttttcatttccggcactaaccatcaatgggccttgcgacattatggtatttgaaggtattccaaatgggccaatggactgttggcaagatgtgaaaacaccagaacagcacctgcaatgtagtctggacttactcaagaaatttgtgccttgggaatatgaacgctgcgcaaatgttgaattaactgatgctggtggttatttggcagggcgtttcccgccgacggtacgtaagcccgttttaaccttaccgtctggcaagcaaatttttggtatggcagatgccttagtggtcaatgatccaattaccggtcaaggctcaaacaatgcggctaagtgtagcaagatctattttgatgccattttagccaatgataatcaaagctttagtgaacaatggatggttcaaacttttgaacgctattgggcttatgcagaacaagtcgtggcttggaccaatagcttgttattaccaccagagcctcatgtcgttgaactcctagccgctgcaagccaaaaccagagcattgcttcaattatggccaataactttgatgacccgcgcgcctttgctccgtggtggtttgatgcagatcaagctcaggcattcttggcctcaaaaaccgcagcaaaagtcgcttaa

SEQ ID NO: 3601 - DNA, 612 bp, Acinetobacter baumannii
aagaaatcggaaaatttaaagatgaatcaaattgatacttataaagcacttgttacagcatataaagaaatagcaacctctactattggtcatgtacttgatcagggatatattcctcaggtattccccttaagacctgaagataaggtggtggggattgtacgtacagttcggattgaatcgatcaatgcgagtggtttaagacaagtcttgatgagttgtcaaccaaatgaagttctcgttattgatgcaagatatgatctacaacgtgcttgctggggagagcaaaggagcgtagctgctatacactgtggtctggctggggttgtggtcttaggtgctattacagatcggcaggctttacttaaactcaaacttcctatatttgctcatacaaccagttgtttaaccactcgtaatgaaggggaaagtctcgttgaaatagatgccaagattcatattaatcataccattgtacaaactggagatctgattgtaggggatgcagatggaatatttataataaaaatggatgtggcacagcaatatttaaaagaatttcaaaggcttgagcaaaatgaacaaaataagaaaaatgaattctttttataa

SEQ ID NO: 3602 - DNA, 915 bp, Acinetobacter baumannii
gtccaagcggagacaattttgtttgatctagatagtagattattaaatattttttatcatatttatcggttcaaaagtgtttcaatggctgcagatgctattggtttgacacagccgagcgttagtaatggtctaaacaaaatccgccaacattttaatgatcctttgtttattcgagtcggtaatgaaatgattccgactgaactggcaaagcaaatttttccactcattagcgaagttattgataaggttgaaagcattaataattttaatgtgaactttgatccgttgacctcagatcagttgtttacgatcgcgatgactgatgtatctcatttggttttgttgccgcaactaaccaattatttaaaagaaaaagcacctttgattcgtttaaatattaggcctattacaccagaaactagctatcaaatggcaaacggcgaaattgatctagccataggttttttaccgcagttagaagaaggtttttatcagcagaagttttttcgtcaacattatgttgtaattagctcaaaaagccatccacgtttagacccaaataatttcactttagaggattatatgcgtgaatctcacatcgatattgatgcgggtattgggcattatcacatcaaaaatgagctacaaaataaagggctggatcgaaatattttaattcgcttaccaagttatttaggagtgggattggtcgttcaggaaacagatgctattgccactgtgccatattatttaagtcaggttttattggttagagagaacttacagattttaccggcaccgcttgattttccaacttatgatgttaagcaacattggcatatgtcttgtcaccacaagagtagccataaatggttccgtcaaacatgttatgagctatttaaaactgcttaa

SEQ ID NO: 3603 - DNA, 1485 bp, Acinetobacter baumannii
aatgtggaggatagggtgcaattagagaggtttatagatcgggaacctaagcagtttgcatattttcatcgtttgatgggatattcaattctgtcattaattttagtgatctatgcctttacctcaccaaatactaattatcaaatctatattcctcctttttttctttttttgctttttgtcagttctaaactagaacactggttgcagtaccagtttgataagaaaactcaaaaaagtgtttttttcgcaatagatgcgattgtagtggctgttactctggcaggagtgcaccttaatctcgttccaacatttattgcactttttgcattgttttactcagcaattaatagtcgtatttcctttgcagttatttgtttaacgagtctgcttggggcgattattttttatttaagtacatttttcctatttggttttcatccatatttcgaagccacaagccaagaattaacagtaattaccttacttggtttggtaatgtttatcactatcggaaattattaccaacaccgctgggttaaaaaaattagtcagcaacgtcagcattattatgaccagatgacacgttatattgcttttgctaatcagttaagccgctatgctccattacaattatggcagtcgattatgcgtggggaagctgaagcaaaaatcgaatataaacgaaaaaaaatgactgtattcttttctgatattcaggggttcaccgaactatcagaaactttaattcctgatgacttagctttcttgcttaacgattatttaagtcatatgactgaaattgcaaagcaatatgaagcaacagtcgataaatttatgggagatgcgattctcatattttttggagatccaaattcacaaggggttgagcaagatgccaaatcctgtgtagaaatggcaattgctatgcgtcagcaaatgaagttgttgcgcgaacgatggaagaaaatgggatattcggccttacatatccgtatgggtattagtacaggttattgccacgtagggaattatggtgcaacccatcgtatggcttatacgattgtaggtcgcgacgtaaatttagcggcacgtttacagtatgctgctgaaattgatgaaatactcatttctgatgatacttatcaattaatcaaaagtgattttctatgtgcgcctaagaccccaatttatttaaagggtattcaaggggcagtaaaaacatggcaagtcatggaaaaatacacaggaaataaatcagaccatcaacaatggtttgattatgaatataaaggtttccatttagttttaaatttagaagaagtacaaaactacgaataccctgagttggttgaagtgcttgaaaaaatgattcagcgcattaaagttcaacaaactttggttaatactcaaggtgttgctcagcttagacttgaggatgaagttaagcctataaatatcgatgaagaacaagatcaggtataa

SEQ ID NO: 3604 - DNA, 1863 bp, Acinetobacter baumannii
ctcatggcacttttgcaaattgctgaaccgggtcaatccagtgccccacaccaacatcgcattgcgattggtattgacctaggaacaacacactcattagttgcgacagtgttatcaggcaaacctaaagtactcaatgatgttcaaaatagaagattacttccttctatcgttcattatggggacaatacaactcattatggtgaagaagctaaaccgtttatcattgcagatccaaaaaatacaattgtttctgttaaacgatttatgggccgttcaaaggcagatattaaatttcaacacccttatgagttagtaggctcagaaaatgaaatgcctgcttttgaaacccgtgctggacgcaaaacaccagtagaaatctcagctgaaattttaaaacaattaaaagatcgcgctgaagacagcttacaaaatcctgttaatggagcagtaattaccgttcctgcatatttcgatgaagctcagcgtcaagcaactcgcgatgcagctcaacttgcaggtttaaatgtattacgtttattaaatgagcctacagctgccgctgtagcttatggattagatcaagaaagtaatttagcgaccgaccgtaattatgtaatttatgacttgggtggcggtacttttgacgtatctatcttacgtttttcacaaggcgtattcgaagttttagcgactggtggtcacactgctttaggtggtgatgacttagaccgtctaatcgtaaaatgggctaaaaaacaacttaatattgatgtattaagcgatgaagattatgccgtatttattgtggcagcacgtcaagctaaagaacaattatcaactcaagattcagttgaattaaagttactcgaagcaactctcacactagatcgccctacatttgaaagcattattcaagtagcattagacaaaacgattagtgtttgtaagcgtgtactgcgtgatgcaaaactcgagttaaccgatattcaaaatgttgttttggtaggtggttctactcgctcttatgctgttcaaaaagcagtacgggaagtttttgcccaagaacctctttgcacgatcaacccagatgaagtggtggcaattggcgcttctattacagccaaccagttaatcggtaatagccaagatggctctcttcttttagatgtaactcctctttctcttggtctagagactatgggaggactcgttgagcgtctgatatctcgtaatacagcgattcctgttgcacgtcgtcaagagttcaccacctatcaagatggccaaactgctatgttaattcatgtagttcagggcgaacgtgatttagttgaacattgccgttcattaggtagatttgtacttcatggcattccaccaatgactgcaggccaagctcgtattgaagtcactttccaagttgatgcagatggcttactcaccgtttctgctcgtgaagcaacttctggcgtgcaagctcatatcgatatcaaaccatcttatggtttatctgaggcagatacggaacgcttattaattgaaggtttccaacatgccgaagaggacaaaaatcttcgtcatttaaaagaaactaaagttgaagcagaacgtgagcttgaggctcttgagcaagcattaaaagtagatgcagatttacttgatgaaaagcagcttgaagcactcaactctgctaaggaatcattaaaagctcagcttgaaggcagtgatattcaagcaattgagcaagcagttcaacaacttaaagtacatagtgatgcttttgcagcactacggatgaatcgacatattgaccatgccttaaaaggcacgaagctcgatgattggtcaaaatcaaattaa

SEQ ID NO: 3605 - DNA, 786 bp, Acinetobacter baumannii
atgacaaaacttttagacggtaaggtcgcttttattacaggttctgcaagtggtatcggtctagagattgctaagaaatttgctcaagaaggtgccaaagttgttatttctgatatgaatgccgaaaagtgccaagaaacggcgagctcacttaaagagcgaggttttgatgcattatctgcaccatgtgatgtgactgatgaagatgcttataaacaagccattgagctgactcaaaagacctttggtacagttgatatcttaattaataatgctggtttccagcatgttgcgcctattgaagagtttccaattgctgtttttcaaaagttagttcaagtcatgttaacgggggcatttattggaattaaacatgtttttccaattatgaaagctcaaaaatatggccgtattattaatatggcttcaattaatggcttgattggtttcgctggaaaggcaggttataacagtgctaaacacggggtaattggcctaacaaaagttgcagctttggaatgtgcacgtgatggtattacggtaaatgctttatgtccggggtatgtagatacaccattggtccgtggtcaaattgcagatttggctaaaacccgtaatgtgagtttagacagcgcacttgaagatgtaattttggcaatggttcctcaaaagcgtttactctctgttgaagaaattgctgactatacgattttccttgcgagtagcaaagcaggtggggtaacaggccaagctgtcgtgatggatggcggttatacggcccaataa

SEQ ID NO: 3606 - DNA, 612 bp, Acinetobacter baumannii
gcgatgaaactacttcaaattgacacaagtattttaggtgagcagtctgttagccgccaactcacctcatctgttattcgtcagctcagcacagcttatccagatgcagaaattattcatcacgattttgctttagagccaattcctcatttgtctgatgctgagtttttagcatggcaaggtgttgaacctaataatgaaatagcgcaacaacgtgttgcaagaaacacccaatatttggatgagttcttatcgtcagatatcgttgtaattggcgcacctatgtataactttagcttcccatcacagttaaaagcgtggcttgaccgtctatctgttgctggtaaaacattccgttacacggaaaacggtcctcaaggtttagtagaagggaaacgtgtcattattgcttcttcgcgtggtggtgtgtattcagaaggttcaccagccgaagctttagactatcaagaaacttatatcaaagcgtttttcaattttattggggtgactgatatcacttttgtgcgcgccgaaggaatcgctttcggaccagaggcacgtcaagctgccttagataatgcagcagcgcaaattgcccagttagcgggttaa

SEQ ID NO: 3607 - DNA, 1584 bp, Acinetobacter baumannii
tcacacatctggcttatgaatattttatttaaaacaactgtgcttgcagcatcattattgctcgcggcttgtaataacaatgatgatcaagaagctcaaactgcaccatctacaaacccatcaaaatattatcaaacgaaaacgccttaccaacctcaacaagacttaaaaagctatgaacaagcgccgactgggttccagccagtttttacagagttagtggcacgtcacggttcgagaggtttatcaagtctgaaatatgatttagcactttataatttatggaaacaggcgaaagctgaaaatgccttaacgccactaggtgagcaattaggtgcagatttagaagcaatgatgaaagctaatattttgttaggttatggtgttgaagggatccgtcaatacggttatggaaatgaaaccatgactggtattttagaacaccgcggtattgccgatcgattattacagcgcttaccaactcttttaaatgctcaggcgtctatattggtacaaagttctggagtagaccgtgcggtagatagtgctaaatttttcactgctgaactcattaaacaacaaccccaactgaaagataaaattgttccattgtcttataccaatttatcgagtgaaagcgtgccaagtattgaagatggtggcgttgatcgttttaaactttattttcatagcttgaatgcagacgaagacttagctcaaccactgagtgttagccaacaaaaaatttatgatgcaagtcaggcttatcaagattttgaagaaaataataaagatttagctcaaaagttagatgagttaacaaaaaatactcaggctgaaaaaactgcccaaatggtactcagcccgatttttaaagctaacttcattaaaaagctcggtaccactggttatagctttagcaataccggatcatttacagtaacttcgccgaaaggtgagcaaattacagaaaaaggtaaggggaaaaatacaattgccagcgcagttgatgcagcggcttatatttatgaactctattcaatttctggtggtatgaaagatgagttaaaaggtattgattttgataaatatatgcctttggaagccgcaaaattttatgctgaatttaatgacgccaatgatttttacgaaaaaggcccaagctttacagaatcaaataaagtcaccagtgaaatcgctcaaggacttaaacaggatctgttccaacaagttgacgccgtagtgaataaagctcaaccttacaaagcagttttacggtttgcccatgctgaaattattattcctctggcaactagcttagatttgcataatatgatgcagccgttaccactacgccagacttataattactcgacaagcgcatggcgtggtgaagtagtttcacctatggcggcaaatgtacaatgggatatttaccaaaataaccaaggctctactttggtaaaaatgctttataacgaaaaagaaactttatttaaacctgcatgtaattatgcacgttatacaccaaccagtttttactatgactacatcaaattgaaacagtgctatcaaatgcaatag

SEQ ID NO: 3608 - DNA, 300 bp, Acinetobacter baumannii
acgaatcactggttggcaaggtcgaacaaatcaagaacaacgcgatgcgggaatgttgatttggggaatgtgggtttaggagaaatgtttatgccagtacttgcgtttctacctgagttcatcgtgaaagacaaagtcaaacgcgattcaacaccaaaggtcacagaatcagacgtaaaaaacattagaactttacgtgaaggtggcctgtcttatcgtcaactagcagataagtacgatatttctcatgagatgtgtagacgtatttgcaccaagatttgctacaaggaggtgatttga

SEQ ID NO: 3609 - DNA, 684 bp, Acinetobacter baumannii
tatggtggctgcatgatgggcggaggaggtggcggcggccaaatgggcggtggcaatctgtatcaagcaattgctactgctgccgttaaaggtgccacaacatatttaaaattaaaagcgcttaaacagtccttagagcagcaagcagatattgcaggagaaaatgcaactcttgcagatatacaagcgcgcgatgctattgatgacgggcgcaacagtgttacggattatcaacgtaatctttcaggcttcaagtcaagccaaatcaatgcgcttgctgaaaacggcattgatgttacacaaggttcagcgattgatattttagcttcaactgaaatgatggcccaaaacgatattgataccttgaagtataatgccgccatgaagtcttgggggcatcgtgttcaagaaaccaatttcatcaatcagaaaaactctcttttggcgcaagccaaatcagtgcgcccgcgcctaaatgctgaactagcagcaatagaccaatttgcatcttcaatgatgggtggtggcggaggaagcccaatgcaaggcggcgagtctctaacaatgacgcaacctgtaaacggttcgtataacgcgaatagcaatttttcaatgtctctttacggtaaagaacaaggggcatcttggcaaaactacaactggaattggatgggggctgcttaa

SEQ ID NO: 3610 - DNA, 1149 bp, Acinetobacter baumannii
gcccatagactggcaattggacgcatgatgaactctcccaatgtaaatagctatcatccggatttggtagttgaagaagcgaaaaatggttggcgtattgtacgtttgaatcgacctaaatcattacacgctttagatgaatcaatcgtaacggctctattacgagtatttgaagacttccgtgatgatgagcaagtaaaagcaatttggttggactcgactacaccaaaagcattttgtgcgggtggagatgtacgcaaattacgtcagctggtaattaatcaggaagtagaaaccgcaaataaatttttccagcaagaatatgctttggatttattgttacataactatgctaaaccagttgttgtttggggcgaaggatatgtaatgggtggtggtttaggcttgtttatggctgcacctttccgtttggttacaccatattcacgtttggctatgcctgaaattaatattggtttataccctgatgttggagcaagccgtttccttgctgaccgtgggcaaattggtttatttactggtttgacaggttctattatgacggctgctggggcatatagcattggttgggcgacgcatatttgtgaagcacaacgtgataatgttctgcagaaagtactcaatattaattgggctcactatccggcaggtgatttccgtgcgatcgatgatactttaaatagtttacatcgcccggttgcagcagggccattacaaaattcgttagacgttatacatagtgtttgccgtggttcaagctttgaacaagactatcaagcgatcgtcagcttgcgagatgcaagcagtgactggttgcgtcaagcgagtgaaaacttacaaaagggctcgcctagtacggcagcaattacttggttgttatggcaatggggtaaacaagttcattcttgggatgaagtttttgatttagaagcgcaaatctctgaatggaaaattcgccatcctgactttgtggaaggcgtacgtgctcgtttagtcgataaagatttatcgccagaatggaaagcatgtgaagaccttacattacgaggtattttggccgatgatccaccgatcacgacgattgatagctggaatgcattacttagacaatatggtgtagtgtcataa

SEQ ID NO: 3611 - DNA, 297 bp, Acinetobacter baumannii
agaaacagactcctgaacaagcaaaagttactttttcacgagataaaggtttttctaggatctggttgtactcatgatatgtatgtaaataacgaaaaagtattttcaattcgctcaaacgaaatagctacaatttatcttgagcctaaatattatatctttagattagaaactggtgggggaatgtgcccaaatattgccacttctcaagaaacagaagtcaaaccaggggcagagatagaatatcgaattttacttccatctgactttaatttaagactaactcgaatgaaataa

SEQ ID NO: 3612 - DNA, 1149 bp, Acinetobacter baumannii
agattcggactatataacaggtcaatctattttaacggacggcggaatagtctatcgctaaaacaacatcctgatttgagggagataataatgaaagcagcgcgtttttatgacagaggtgatattcgtattgaagatattcctgaaccagaagtcactcccggcactgtaggcattaaggtagcttggtgtggaatctgtggtacagatttgcacgaatttatggaaggaccaatttttattccaccttgtggacatccgcatcctatttcaggtgaatctgcaccgattaccatgggacatgaattttcaggtgtggtttatgccgtaggtgaaggtgttgatgatattgaaattggtcagcatgtcgtcgtagagccttatattgtggcggatgatgtaccgactggaccgggcgataattatcatctttccaaaaatatgaactttattggtttaggtggccgtggcggtggtttgtcggagaaaattgcggttaaacgccgttgggtacacccaatttccaataaaattccgctagatcaggcagccttaattgaacctttatcggttggtcatcatgctttcgtacgtagtggtgcaaaagctggtgatactgcactggttggcggtgcggggccaattggtttattgctttcggcaattttaaaagcgaaaggtcttaaggtcatcattaccgaactaagtgcaaaacgtaaagaaaaagccaaagagtcgggagtcgcagattatattttagacccgtcagaagttgatgttgtttctgaggtcatgaaaattaccaatggcgatggtgtcgatgttgcgtttgaatgtagtagcgttaacaaggtgttagatactttggtcgcggcagtgaaaccaacaggcgttatagttattgtttcgatttggagccatccagcatcaattaatgtgcacagtgtggtaatgaaagagcttgatgtacgcggcacaattgcctatgtaaatgaccatcaggagactattaaactggttgaagaaggtaaaataaatcttgaaccttttattacgcagcgcattcaacttgatgatttgatttcacaaggttttgaaaccttaattcataacaatgagtcagccgttaagattattgtacatccctaa

SEQ ID NO: 3613 - DNA, 240 bp, Acinetobacter baumannii
agagacaaatgcatgagaatgaagtttattgcatatgaccctaactctggtgaaaaactcagcttgaaagagcatattcatcacatggataaatacacaacttatgttttttttagtgatgaaaaagacaatatggttttcaatccacagaaaaaacagatatttgaaatcagtcaatatacttctaatatgatggttgaaatttcaagaaagttatactacttgattggtgaatattag

SEQ ID NO: 3614 - DNA, 795 bp, Acinetobacter baumannii
ataaaggaatgcataatggtgaatcatcaaattaaagtactgcaagcattagcgtctgcaattgctgaaggtggtagaggtgttacaggtacagcatttcctaaacagcctgttagagctcttaaactttatgaatttgagggttcaccattttgtcgccgcgttcgtgaagtgattacacttttaaatttggatgtcgaaatttatccatgcccgaaaggtggattaaaatatcgctccatagttaaagaaattggcggtaaattacagtttcctttttttattgatgaaaatacaggtgacaaattatacgaatcacaagatattattcatcatttatttaaatactatggtaagacaggccaaactcctgataagttttcaaattatccaaaaatgccatatctggcgtttgccggaacattattaaatggtgctcgtggggtctggattaataaaaaaatagtaaatagagctgcgcctaagcataaacttgaactatggagctttgaagcaagtccgtattcaagagtagtaagaagtgtattaagtgagcttgagctaccttacattttacatagtgttgccaaagaaagatggcaagatatggggcctgcgattcttcggttaaaaccgggcaaatatgaacctttaaaagagggaaagcgagaaaaattgttgccgctcatgcaaggtaaaatgcaagtgccttatttagtggacccaaatacaggtgttaaaatgtttgaatctgcggaaattgtaaagtacctaaaaaaacaatatggcagttaa

SEQ ID NO: 3615 - DNA, 192 bp, Acinetobacter baumannii
ttgaagaggtgcaaaatgttaaagtcaattttagtattaggaacaggtattgcgattggcatgtgtatgtacaagaaaaagcaaaagaacagtaagagcttctctactgatagtgataccgactcattgattagtaaggataataataagagtaaagatgacaattcactcgataatgctgtccaggtttaa

SEQ ID NO: 3616 - DNA, 1524 bp, Acinetobacter baumannii
atgaattttcgtcaaattcaggcaatactacatagttggtttggaattattgttctttgggttatctttttcattttttttacgggctctattgcttattttcggacggaaattaatgtttgggcacagccagaagcaatcagccatattcaaacaatcccttctgcacaacattctgcgcaaactgcgtttaactatctcaatcaacatgcaccaaatgccaaaagatggcgagttacagtagccaatgagcggatgcctgtgaacctacttcaatggcaggataaagaggggaaacatcaagagctacaaaaccctaataccggtgagctattggggcctgtacggaagactttgggtggagatttctttttcaaactacattacacgctttatcctttgccaagcacgttcggtagtttagttgtagcagttgttgccttaattctattaattagtttaatcactggtgtgattacgcataagaaaattattaaagagttttttacctttagggcttttaaaggacagcgttctttattagatcttcatcacataacaggagttatcacttttcctttttatttggtgatggcctttactggactgttgattttattttatctagttttaccgtggggattatcggaacaatatggtaaagctggtataccaaagttctataatgaaatgcagtttaccgaggtggcaaaacctcgagaaccttccttaacagaagcgatgcaaccttttaatcaattcatggcacaaatgcctaagcgaacagaatctggagctattttagataaatttgaagttcaaaagcctaatacagcagatggcgtgattacatttgactataactataaaaatattattaccttaaatactcctcaatatatttttgcaacaaatacggctgaacgactcaatcagccacgaaatttaagtgcaatagcacaattaggttcatcaagttatgggattcatttaggttactttgcttctatctggatgcgttttattttggcttgtttaggaataataggatgtgtcatgttggttgcaggcgcattactatggcaaaaaaagcgcatcaaagaacaaaagaaatttggatatagattagtacagcatttgaatttttttactttcttagggctgccttttgcctcagccttttatttaatggttggtcggattatacctgcttcatttgagccgagggaactatacgaggtttcagcattttatatagcatggctattaagcttattgattagctttagctgctcaataaggaagggaataatcatcatgctatatattacggctgctgttttattgcttattccagttattagtgtcgttctggtgccagaagcctctttattaaatagtttaaagtctgtgcattggtctcttgccggtgttgatctggcgctcatactgctcgggctattctatttagtagtattacgcttctaccaaaccaaatttattacgttaggagaggctaaatga

SEQ ID NO: 3617 - DNA, 747 bp, Acinetobacter baumannii
aggcactttcgagtgcctttttatttggtttatagaataaatacttataaaataagagatgtaaaagtacagtattttattcctgctatgtgtgccaactttaagcctttaactcttgcccaattgcagcaacttcagttgcctgtggtcggctttagctatgccgatgaggtttatccgagtgggacaatgccattattattcaaatcaccgcaaggttttgaatggcgtgaagtcatgttcggtttggttcctaaatgggcagaagatacgaatatagcaaaacatacttataacgcccgtcatgaaacgattttccaaaaaccgagttttcaagaagctgctcttaaatgtaagttcggtgtgatacccgtcacggagttttatgagagtaaatatataaatgataaacctgagcggtggggcgtacgccgtaaagatgggcaggctttttttatcgcagcaatctatgaaatttgcaaaatgaatgaaacgattgtccgttctgcgagtatgttaaccatggatgcgattgatcatcccatgatgaaagacttccatgaaccgggtgatgttaaaagatcagtcattgtgattccacatgaccgcttagatgaatggttaagtttagaaacaccagatatttcaagctttattgaaggttttcctgttgaggagtttgaatgtttacatgttcctaaagagaagattataaaacctacacctcaattaagtatgtttgaataa

SEQ ID NO: 3618 - DNA, 489 bp, Acinetobacter baumannii
catgtgtatcgaatcatgcgccttacaactcgcggtcgctacgcagtgactgctctacttgatttagctttgcagccaactgaacaaacgatcacgctcgccgaaattgccgcacgtcaatctatttcagttgcttatttagagcagttgttcgcaaaacttaagcgtcatgggttagtttctagtgttcgcggtgcaaatggtggttatcatttggctcgaaacgctgatgaaattactgtgttagaaatcattgaagccgtaaatgaaaccgttgatgcaacgcgttgtgaccataaaggcaactgccaaaatggtgcaatgtgtcttactcacgatttatggcaagaactctctcatcatattgccgactatttagctaaaatcactcttgccaacctcattagccgagacaacgttcaaactgttgcattacgccaaaatgtaactggcacagattcagctcttttatcgggtacaggtatttga

SEQ ID NO: 3619 - DNA, 252 bp, Acinetobacter baumannii
atcgggagtcgcagcatgaatacatcagccgtagttgtttcattagatcaaattagagctgtgcttgagtcaaacactaccaatgcacatgcagaagtaatgtcccttttagaaaagccattattagcagaaacgttaatcaaaacacgcggcaaccaaaccaaggcagccgaattacttggtttaaaccgcggaacgttacgccaacgtttgaaagctcacaacattttaaaaacgaaggtgacagcatga

SEQ ID NO: 3620 - DNA, 1386 bp, Acinetobacter baumannii
gattctattttcatgtcaaatcagaacgataagcttaagagtttaaaaacttcttccatggatcgacgcttatcaatcgcgaaagcttctttactggcaggaacacgttgggctactgcaagtgcctcttccctcttttctagtgaagaagaaaaagagaagaagcgtaaaaaggcaatgagcgagcaagctaattatcttgtttctgaaattggcaaactaaaaggttctattgtcaagattggccaaatgatggcgctttatggtgaacattttttacctgaagaaattactcaagctttaaataccttaaataaccaaactgttgctttagactggccagcaattaaacctcatttacaagaacaattaggttctaagttaaatgatctaacaattgatcatgagcctattggtacggcctctctggcacaagttcatcgcgcaacacgtaagtcagacggtttagagttagttttaaaaattcaataccctggtgttgcgaatgcaattgactccgatatgagcctgtttaaaaacatgcttaagcttacacgtatggttcctcaaactcgtgagtttgatcagtggttcgatgaagtacgtgaaatgatgcatcgtgaagtcaattatcacgtagaggcagccaccacacgtcgctttgctgagcgtttaaaagatgatgagcgctatatcgtccctacaattgtagatgaatactgtaccgatcaagtcttatgtatgacctttgaacgtggcgtgcctatcaatagtccagtcatgctttcccttcctcaagaacgccgcaatcagctcggtgaagcttcactagagattgcagttcgtgagatttttgaatggggcgaaatgcaaactgaccctaactttggtaactaccttgttcgtttaggtaatggccaagatattcaggataaaattgtactattagactttggtgcgatccgtcagttcgatgaacatttactctcagttgcgcgtaatcttatacaagcgggttatcagcatgataaacatgcgatggttcaagcaatgactggatatgagtttttcgatgcaatgcctgaaagtattaaacccggcatggccgatgtctttttacttgcgacagaagcattcagtacccctgcaaataatccagatatgccagctgggctgatggatgaacatgaacgttatgactggaaaaagagccagttacatagtcgtgttatgcagcaagcaagcaaatcaatggcgtctcgatatttctcggttcctccaaaagaatttatgtttattagccgtaagtttattggtgcatatacatttatgactgttattgatgccaaaacaaatgtacgacgtatgattcgtaactttgcttaa

SEQ ID NO: 3621 - DNA, 387 bp, Acinetobacter baumannii
acgcgattacgacccttacgcgtagtgtcaacaggaaacagggccatgagcatttgtcaaaagcataatgttatgaatgacaacctcacttggagttttcacatgtgcagtagcaattttacggaccttttatttggcggtaatagcgtgattgataagacagcaaagcttttcggcatggatgcaaagaaggcagatattcaagcaccaccaaagccaccagtacgacaggactctaagtcaccagatgcatcagcaactatcgaccgtgttcaaaacgcacagaactctatgtcgggcggcattgcaaacaccttgtacacagatgcaacaggtgttgatgacgagaatttgcgtttaggcaagaaaactttactaggcggctaa

SEQ ID NO: 3622 - DNA, 1149 bp, Acinetobacter baumannii
ctaggcatacgccatttaaaaataccttttggagaaatctcaatgaagaaattgcttctcgctgccgcagttgcaactttgagcgtaaacgcggtgcaagcagcgccaactttgtacggcaaactaaacgtttccattaaccaagttgacaacaaaaatttcgatggtaaaagtgacgttaccgaagttaactcaaactcttctcgtattggggtaaaaggcgaagagaagttgactgataagctatctgctgtttatttagctgaatgggcaatttctactgacggttctggttcagatactgaccttagcgcccgtaaccgttttattggtttaaaaactgaaggcgtcggtacgttaaaagtaggtaaatatgactcttacttcaaaacctctgctggtagcaaccaagacatctttaacgatgacacacgtttagatattacaaatattatgtacggtgaaaaccgtttagataacgtagttggttttgaattagaccctaaattattagctggtttaacattcaatatcatggctcaaactggtgaaagcacttctgatagtaaaaaaggcgaaactggtaaagacagcaaaaatgatagcttcgattcagtttcgacttctctaggttatgaaaataaagacttaggtttagcaatcgctgctgctggtgacttcggtatcaaaggtaaatatgctgcttacggtttgaaagatgtttatacagacgcttaccgtgtaactggttcttatgacattgctaaatctggttttgtagtaggtgctttatggcaacatgctgaacctactgatgacttgactgcatatggtcaaacatataaatcagatggttcaatcgataaagctggtaaagcttaccgtggtttagaagaagaagcatacgcagtaactgctgcttataaaattcctaacactaaacttaaagtaaaagcagaatatgcttctgctgaaacacaagtaagtggtcaggcagatcgtaaaattgacttgtatggtttaggtcttgattatcaaatcaataaacaagctcgtttctacggtatcgttgctcaacaaaaacgtgactggttgaatgacgacgacaaacaaactgttgtaggtactggtattgaatataacttctaa

SEQ ID NO: 3623 - DNA, 1446 bp, Acinetobacter baumannii
tttggaatacgtaacatgagacaaaataaattgatcaataaaaaactattactcagtagcttaattggtgccatggtactcggcactttggggtgcggcagtaaaacagaaactgtgcgtgtcgccattggtacacaagacacgaccattaactgtgcaacaggtgggttgctgattcgtgaattgaatttattaccaaaatatttacccaaagatagtgaatacaagaatgttaaatatgacattcaatggaaaaattttacctctggtgcaccacttaccagtgagatggtggctgggcgtctagatttgggagcaatggctgactttcctgctgtgaataatttagcggcatttaaaaaagctggaaaagaaagcatatttttagcgcctttgtcaggcagtattaatggtagcggtaatgcgattgttgttccaattgactcaaaagtcacttcacttaaagagctaaaggggcagactatttctgtaccttttgcctcaactgctcacggactattattgcgagcaattcaagctgaaggttggcaacttgataaagatattaaagtgattgctcaggcgccagaagtggcggggcctgcattaaaaagtcataagattgctgcgcatgctgacttcgtaccatttggagagttatttgcttaccaaggttttgctaaaaaaatctatgatggttcacaagcaaaatcacctacatttcatggttcgcttgccagcaaggattatgcacagcagcatccagaagtcataaaagcttatttacaggcaactattgaagcgaatcgcctgattcaagaacaacctgaaaaatatagtgaatttattgctgaaaaaacaggtattcctgccgaagttgtttatctatttcatggtccattagggctgcaaactcgtgacttaacgtggaaacctgaatatcgaaaagcgactcaaattgcgatagacaccttaaaagttctaggcaaaaacgacggtacgcttgatgtaaataaatttattgatgatcaatatattaaagatgcatttcaggcatctggacttaattacagccagcaattggctgactatgcaaaatcacctttggttgccaatgacgctttaacggggcaacccatcaaaacatttgatcaggtgactcaaatttgggtaaagggtgaagaaaaagttcgtagctatgaaacgcctgagcatgctttttctgatttaaagaaaatacaagcagctggaaaaacggtgcgtgttgtttatagccaagatcatcagtccgacattaagttacttgccaatctggcatggtatgccacagataaagcaggacaaattcaggcctttttattaaaagatgatgctgaaaaatgggctaaacaacagggcggaaaagtatatgactttaaagctattcagcttgtaacacagagctga

SEQ ID NO: 3624 - DNA, 408 bp, Acinetobacter baumannii
tttctcacacgaaaagaaatatcagggggcagcatgacagtgatgatcacccttgaaccaagccgttacattaagcgtaaaggctttggcagtgaaaactgcaaggcaataaaacaatcagttccttttgttgaagcacgtcgtggtgaatacacacatcgagttcgccatgtaacgcttattaccactttccaaaataagtcgcattttgccgttcattgttggtgcggcatgaccatgtgtgtcggtggcactgggaaaggaacagggattttacttgatacaccaagcgctaatcgtcctatgtgcgctacctgtgaaggtagggtaattggtgcgggcttgattggttcacgtgaaatatctggccgccaagttatgtatcgagcaagtgaggtgcggtcatga

SEQ ID NO: 3625 - DNA, 1068 bp, Acinetobacter baumannii
ttccgttttagacttctatcacgtttaaggggaatgaaaatgggacattcagttgcacttaactttgccgatggcaaaacctttttcatttcggtaaataacgacgaattgttgcttgatgcagcagttcgtcaaggaattaacctgccgttagactgccgcgaaggtgtttgtggtacctgtcagggacaatgtgaaactggtatttatgaacaagaatatgtcgatgaagatgcattaagtgaacgtgatttggctgagcgtaaaatgttagcttgccaaacaagagtgaaatccgatgcagctttttatttcgatcatgattctgctatttgcaatgctggtgataccttaaaaattgaaaccaaagtgactgcggttgagctggtttctgaaacgacagcaatcttacatcttgatgcaagcagtcataccgaacaactccagtttttaccgggtcaatatgctcgtttgcaaataccggatactgaagactggcgttcttattcttttgcaaatagaccaaatgcgaccaatcaattgcaatttctcattcgtctcttaccagacggtgtgatgagtaattacttacgtgaccgttgtcaggttggacaaagcctacttattgaagcaccgcttggtagtttctatttacgtgaagtagagcgaccactggtttttgtggcaggtggaactggtttatcagctttcttgggaatgcttgataacttggttgatcagcctaactcacctgcagttcagttgtactacggcgtaaatagtgaaaccgacttgtgtgaacaacagcgtttacaggcctatgcagaacagctacccaactttagctatcacccgattgtgactaaggcaacggaaacttggcaaggtaaagccggttatatccatgagcacttaaataaagatcaactggccgagcaagcttttgatatgtatttatgtggcccaccgccaatgattgaagccgttaaaaattggttagatgaacaagctttgcaaaactaccgtatctacagcgagaaatttttacagagcaatacctcacgctaa

SEQ ID NO: 3626 - DNA, 657 bp, Acinetobacter baumannii
attttacttagatgttatctgtttatgcatccgttttttcaagagttacaacagggtagtcaaaaattaggtttatcgcttagcgaagaagctttgacattattgttgaagtatcaagatgctttggtactttggaacaaagcttataatctaacagcgattcgtgatccgaaagaaatgttagttaagcatttgttagatagcctaagtattttgaaagatttgccagcaggtcgtttgctcgatgtaggtacaggtggtggcatgccaggcatgatcattgctttatgtcagccagaacgctcttgtgtattgcttgattcaaatggtaagaaaattcgttttttgaaacagtttattgctgaccttaagcttaaaaacgtaatagctgtgcaaacgcgtgttgaaaatcaagatacaattgatgaacttggccaatttgatgtaataacaagtcgtgcatttgcatcattaacagattttgttgaggctgcgcgtccatatttacatgagcagagtataattgccgcgatgaaaggactgattccagttgaagaaatggaagagcttaagcaggaattttcatgtaaagtgattgaactgcatgtaccgagacttgatgaacaacgtcatttacttttacttcaacgaatttaa

SEQ ID NO: 3627 - DNA, 960 bp, Acinetobacter baumannii
agcattcctagatacttaagcttggtaatcgaggatgaagttatgaatattttactctatgttgcggtggtgttgatttggggaacaacatggattggaattgccgttcaaagccattatgcaacacccgttgtcgcaattttatggcgttttgctatttcagccttattactttgggtggttttactattttcaggaaagttacagcgaattgctttaaaagatcacttgttttgtatgctgcaaggcctttgcgtttttggtctaaactttatttgtttttatactgcggttaaatatgtaaatagcggtttagagtctgtcattttttcgatggccgttttctttaatgccattaatgcgcttatcttttttaagcagaaaccttccccaaactttgcaccagctgcacttttgggcctaagtggtattgttttactgttttggcatgacctgattaatagccagtttaatgcgcagctattaatgggtattgggctatgtgcaataggcacttacggcttttctttagggaacatgattagtgttagacaccaaaaacgtggactaaatatcttttcaacaaactgttatgccatgacttacggcgcattggtgatgttaattctggcattatttacaggacaagatttaatgccgccgatgaatttcccatttttaagctcggtactatacttagctgtatttggcacggttattgggttctctgcttatttttctctggtcgggcgaattggcgcagccaaagcagcctatagcacgttgctctttcctttagttgctctaacagtttctactttctttgaaggatatgagtggactttaaatgctgtatttggaattttactcatcttacttggcaactacttaatgtttagtaagtttgaaattggaaagaagttatttagcagtcaaaaaaattgtgagaagcaggcataa

SEQ ID NO: 3628 - DNA, 1326 bp, Acinetobacter baumannii
aaagttcctagtttttgtctacaaagtgatggaagaaatatgacatatactcaggaagaaaaacgtagcaggatacgtgggattgtaggcgcagcctctggtaatttagtcgaatggtttgatttttatatttatgcagtatttgctgcttactttactcaagctttaaccgcgccagatatggatagcacaaccaagtctatttatgtttggggggtgtttgcagcaagcttctttatgcgtccgattggaagctggctatttggtcgtattgcagatcgacatggccgaaagaagtcgatgatcatatcaatctgtttgatggctttaagctcctttttatttgcagctttgcctacttatgatcaagtcggtttatttgccccttttctattgctccttgttcgtttacttcaaggcttatcagtgggtggtgaatatggcgccgttgcgacttatatgagtgaattaggcttaaaaggtcagcgtggtttttactcatctttccaatatgtcactctctctggtggtcaattgcttgcaagcttactgggcgttattttgttgacgttcttaagtgaacaacaattacatgatggcggttggcgtattccatttgttattggtggtatcgcagcaatcttatctttgcttgcacgtagtcgtttagaagaaacgctttctcatcaagacagcgaacgaaaagagtctggtagcttaagagaactctttaaaaagcactggaaaacctttttattggtggttggatacacttctgctggttcattaacgttttatgtagagactgtttattcaaaaacctatttaaccaacttagggatggatggaaaaaccgttggttatatcatgacctttgccctatttgtctatatgtgtgctcaacctgtatttggtgcaatttcagaccgtattgggcgacgctcttcaatgttggcatttagcttattgtccgccatttttatttatcccgtcatggtgatcggaatgcgtgcctatatagattctccgatcatcattaccttgctactcatctttatgatgatgttactcagcttctatacttctattagtggattggtaaaagctgaaatgttcccacctcatgtgcgagctttaggcgtaggtttttcgtatgcagtaggtaatgcgctgtttggtggttctgcaccttcagttgccttacagttcaaagctgccggaattgaaaataccttctttatatatgtcattgtcatgctgattatctgtttcttatgtagccttgcgcttcctaaaaaaccagattatttagaacatgatcattaa

SEQ ID NO: 3629 - DNA, 780 bp, Acinetobacter baumannii
acatgctatagtggcaaaatattgagaaaagatgacaagataaaaatggcactcgatttattgcctaaaagcatgtttgaagcaattgatttattgcctgatgcttcgacccctgtaaccctttttacacgtcactccttaagagagctggtagatgggcaaggcttggcaggatacgacctccagcttacaccgcaaggacgtgagcttgctcaggaatggggtagctatttaattaaaaacacggatcgtgtaattcaacattgcatttctagcccaattcaacgttgtgtagacactgctgcacttatgattgaaggagcagatggagtgagccctgagccgaatacacatacaattgaaatagttgaacaaggtttgttggttgaacctggtagctttgtactggatattcagcaggcggcgccttatttccgtaaacaaggggcacttggttttattaatagctttgtgaacaatgccttaccgggtatgaaacatccaattactggcgtattagatgtattagagctgatctatcaaactcatcctaaaacaaaaagtggtctaagtttagctgtaagtcacgacacaattattgcagcgattgttgcggtaatttcaggcaataaccaaatacaaaaagcagattggcctgccatgatggaagggctgtttgtatggtttgaaggtgatgaatttccaaattgtaaattaaagtggatttggagaggcaaaacttacgagttagatgtttctgagttccataaagtacagtaa

SEQ ID NO: 3630 - DNA, 1800 bp, Acinetobacter baumannii
ataggatgtagtcagatgcaagaacttgccaaccgattggcgatacaaaatttcgtcaacgcttatatgcaagagactggcaaaggatatttactttcttttgaccaacaaagttcaactcaacaagcgtttagctctggtttgacgctgttaactcttcctcttccttctatacaagcagaatgttctgtacctttatcttatgtaagtcgtgtaggacgccatcgtctcgctgctttaccgaaaatgtgtattgatggtcaatggcaaaaaatcagtgcaggaaccattgttagtcttttacttgaagagttggttattgaatctcaattcaaattagatgctgcttcattgttagaaaaatggatacaaagccgggacgcgctactacaattcttaaaacaacgccataatgatttcgatgatttagtaaaggctggacagaattttattgaaagtgaacaggcattaattttgggtcatagtatgcacccagcgcctaaaagccggaatggttttgttcatgaagattggttgaagttttcacctgaacatgctggaaaaactcagttacattattggcttgttcatcagaattatattgctgaaggttgtgcaactgagcagccaatttcagatcaagttaaagacgcaatccgttggtatttgtccgaaagcgatttaaacctgttaaagactcatgttgaatttaaattattgccactacatccttggcaagctcgttatttacaaggtaaaccttggtttgagcaattaaaacaaacaggacagttaattgatatcggtttacgtggatggcaattttcaccgactacatcaattcggaccttagcaagttttaacgccccttggatggttaaaacttcactatcagtcatgatcactaattcaattcgagtgaatttggcaaaagagtgtcatcgtggcgaaatttcttatcgtttatggcacagtgaattaggtaaaaaaatattaaaacaatgcccaacactgaaagcagttaatgatccagcctggatagctctgcaaatagacggcgagattattaacgagacaatttgtattttccgtgatcaaccatttgcagtacagcaacaagtcacttgtattgcatctttatgtcaagaccatccaaataaagagttaaatcgttttaatgctttatttgaccaaattgctcagaaaaatcaacaaacgaattttaaagaaattgctttggattggtttgatcatttcttgaagattggcttggctccgttaatgtatgtttatcataaatacggtatggcttttgaatcgcatcaacaaaatgtattgcttgagctagaagatggtttaccgaaaaatctctggttacgtgacaaccaaggcttttattatattgaagaatttgcaactgaaattgtagaagcattaccagatttactagaaaaagctcatgcggttggtcctaaagattttgtggatgaacgctttagttattatttctttggcaacactttatttggtttgattaatgcaattggagcaactggctatatctctgaagatgaactgttaatccatttgcaacaaaatttacttcaattattagagcaatatccagatagcacattattacagggtttattgtttaacgattctttaccgtataaaggcaatttacttacacgtttacatgaattagatgagcttattgctccattagaacatcagtctgtgtatgtgcagctaccaaatccactgtacgttgaacagaaggatgtgagttatgcttga

SEQ ID NO: 3631 - DNA, 1425 bp, Acinetobacter baumannii
ttttggtgtaggagaacccgcatgtcaaaagctcaatttgatttaattgtgattggcgcgggaccgggtgggtatgtggctgcaattcgtgcagcccagctcgggttaaaaaccgcaattgtagaagagcgacatttaggcggaatttgtctaaattggggctgtattccaaccaaagctttgcttgcaggggcagagctcgcaacccagtttaaacatgctggacagtttggttttcaggtatcccaactcgattttgatattcaaaagcttgtgcaacatagccgacaagtgtcagctcaattagtacaaggcatcgattacttgttgaaaaagaatcaggtcactgtttttagtggtcgcgctcaacttacagcgaaagaaaaaattgaagtgaccgatgctcaaggtaatagtcaggctttgagtgcaccacatatcattttggcaactggagctaaagcccgacatgttcctcaacttcctgtcgatggaacatatgtctggagctataaagaagcgcttgttccagagcagttaccaaaaagtttactggttgtaggttcaggtgcaattggtagtgagtttgccagtctttatcaagatttaggatgtcaggtgacccttattgatttggctaaacaaattttaccgaccgaagatgcagaagttgctcaatttgttagaaaacaatttgaacaaaaaggtatgaaagtcttaaccgatgctgtcgttcaaagtattcagattgaaaatgagcaagtccactgtgtggttgaaacggcaaatgatgttcaaacgcttgtttttgattgcgtgctttcggcaattggtgtacagccgaataccacagggctaggactagaacgtttaggtgtagaactcaatccacaaggttttgtggcaattgatgattattgtaaaaccaacgtagcagggctttatgccattggtgatgttgctggagcaccttgtctcgctcataaagcaagccatgaagccataatatgtgtcgagaaaatcgctggtgtggcaaacgtccattcactcgaccgtagccagatacctggttgtatttttacacatccacaagtggcgagtattggtttaacagaaaatgcagcaaaagctaagaatctacctatacgtattggtaagttttctttaactgcaaatggtaaagctttagcaattggagatgcgtcaggtttcattaaaacggtggtacatgcagaaacgggtgaattacttggtgcacatatggtaggtcatgaagtgaccgaacatatccaaggatttgccattgcgaaatatctagaagcaactgatgaaagtttagctcaagtgattttcccgcatccaacattatcagaagccatgcatgaatccattttggcttcaatgcaacgagcgattcatatgtag

SEQ ID NO: 3632 - DNA, 858 bp, Acinetobacter baumannii
cgaatgagtagtttagtccaaacaaaacctaaaaaccaaagtacatttttgattaaattttttcagcaattgaggttatatccagcgcatttaaaaaactatgccattgcttttacatctatagctttctggatagtcatttggcaaggacttgctcagtttaaaataaatttaggcattgtgaactttagcaatgtacccacacctttagatgttattcatgcactgtggactttctttcaactcagcactgcatttgaacatgttgaatctagtgtttttcgcgtagtagttggttttgtgctcgcggctttaattggtgtaggtattggtttgttagcaggacgttatcaaaaacttgctgcatttctaatgccgccattagaagtattacgtccaattccagcagttgcatggattcctttagcgattctgatttttccatcatcagaagcgtctatgatttttattacctttatcggggctttatttccaattttattaaacactgtacatggtgttggtgcagttgacccaagactcgttgcgtcagcgaaaagcttaggtgcttctgatctagctatcatttatgaagtcattattccgggggcattaccgaacattattacgggtttatctattggaatggggacttgttggttctgtttagtgactgccgaaatgatttcgggtcaacacggaattggatacttcacatgggaatctttcaccttgcaaaactatagcaatattgtggttggcatggtgctgataggagcgttaggtatgtttagcagtacattggtacgtgtgattggaaaccgatttaccccatggtatcaactaaggaaatcataa

SEQ ID NO: 3633 - DNA, 1215 bp, Acinetobacter baumannii
tacatgaccagtaaaggcgaacatttaatgaaccagtctgatgatttagaataccaacttgatactttagccattcgtaccggacacactcgtagttttgaaggtgaacatggcgaaccaatttttttgacttcatcttttgtatatgaaaatgctgctgaagcagctgcaaaattttctggtcaggttcaaggaaatatctattctcgttttactaatccgactgtatcgatgttcgaaaaacgtttagcggctttagatggggctgaacgtgccgtggctacaagctcaggtatgggagcaattctatcgattgcgatggcgtatctaaaagcaggtgatcatgttatttgctcaagagcagttttcggttctattgtcgctttatttgaaaaatatattgccaaatttggtgtagatatcacatttgtggatctacgcgatttagatgcatggaaaaatgcagtacgtccagaaactaaactattatttgttgagtcaccgtctaatccattagctgaaatcgcagatatccaagcgcttgcagatattgcgcatgcaaatggcgcattacttgctgttgacaatagtttctgtacacctgttttacagcaaccgttaaagttgggtgcagatctcgtgatttactctgcgactaaatatttagatggccaaggccgtgcgttaggtggtgcagtggtaggtaaccatcaactcctagaagaagtttttagcgtagtgcgtactttagggccatctatgagtccgtttaatgcatggattttcttaaaaggattagaaactttacgtttacgtatgaaagcgcactgtgaaaatgctcaaaaacttgccgagtggttgtctacccatgaaaaagtagaaaaggtctattatggcgggcttccaactcatgaaggtcatgaacttgcagcaaaacagcaaaatggctttggcgggattgtttcttttgtagttaaaggtgagcgtgaaggcgcatggaaggttattgataacaccaaatttatttctatcacgggtaatttaggtgatgtgaaatcaacaattacgcatcctgctacaaccacacacggcaaactttctgctgaagcaaaacaagctgctggtattgaagaaggcttaatccgcgtttcggttggcttagaagatattaacgatattattggtgatatctcacgtggattagatttgatctaa

SEQ ID NO: 3634 - DNA, 717 bp, Acinetobacter baumannii
gaaaacaacagaatgaataaagtttatgccaacgcagaggcagcactgaaagatgtaattgcagacaatcaaacacttgctgttggtggttttggtttgtgtggaattccggaaaaactaattgttgcagttaagcaaagtggtgtgactggtctcacatgtatttcgaataacgcaggtgtagatgatttcggtttaggtatattgcttcaaaccaaacagatcaaaaaaatgatctcttcttatgtgggtgaaaataaagaattcgagcgccaatatttaaatggtgaattagaagttgaactaaccccacaaggcaccttagctgaaaagttacgtgctggaggtgctggaattccagcattttacacacaaactggtgtaggtacactcattgctgaaggtaaagaagaacgtatttttaacggcaaaaattacattttagaagaatctttaacagccgatgtagcgcttgttaaagcatataaggcagacacggcaggtaatttagtatttcgtaaaactgctcagaattttaatcccgaatgtgcaatggctggaaaaattacaattgcagaagttgaacaggtggttgaaattggtgaattggatccggatgaaatccatttaccaggtatatatgtgaaccgcattgtattaaatgcatcacctgaaaaacgtattgagcataaaactttaagcacggaggcagtataa

SEQ ID NO: 3635 - DNA, 249 bp, Acinetobacter baumannii
ggactgaacaggctaaagccaatttttttatcttcgtatcagtttccattatgtttacctttttgtcgttttttgcagcgatatatacccaagaatatagcgctacataaagattatgaaaagtataattcgtcaagtatagatgattggaatgcagcagtgctttttcagcgtgcaatttatatgaagcaaaagctataccacattaaaaaattcagtcgctatgaaagtttttatttaacgttttaa

SEQ ID NO: 3636 - DNA, 222 bp, Acinetobacter baumannii
atattatgcagggccaacgttatattgaaatatgcgaacgcaatcccacgcaagagcaattcttttatggatggattagtaaccggatcgcataaagtgattttgtgtaagagaaccaagctagcaacttttattactctactgtgcattctgttttcagggtgcacggcgcattcaatcaataacaatattcaagtatcattatgcgtaaaagcaatttga

SEQ ID NO: 3637 - DNA, 6567 bp, Acinetobacter baumannii
cagcatttaagattacaaataactgtagtcttaagtgcttttattatgtctgatcaaaatacaaatctgacaattggtcaattattcgaattaaaccaaggcaagaacccaacgcaaattgcggatacagaagcccgtgcgcgtaaggctgcacgttcgttgggcttagactataacaagatgacagaaacgcctgaacagatcgtttctgtagctgacgagatcaacacgcaaaaacgtgtgaatgacgttgtcgcaagtgatcccgtactaggtaaatacgcacttaatcctaatcaagctgctgtatctttagatgactttgaaaatctaaaagacattagcgataaagtatcgttattgggttcgagtttgaataaaccgtatgaacctgtttcataccaagacatacaaaatgttttgtctaaaggtacgtcaccagaacaaaaaaagagactgaaagaactaggtatttacgaagaccctcaaaagcaggtcaagccgaatgtaaaccctaatttattggatacgctaagcacatctttagtgcctcaaacatcagatcaagttttcaaagaacattacgaccgcatcaagaaaacaacgggcgtaatggctgctgaacggtttaaaaaatactatgaaaaccaagtctattggatggagcacacagcgactgctgaacctaccagtccacaagaacaaggcaatcgatatgtaaatgcggctattcgtgctgttgcggctattggtcagacagaaggcgcagtaattagcgcaacaactggaaacgatagccttcttaacttggcaacacgagtaaaaaataaagctgccccatcacaagaaatgacgcaagcgctttaccaagcacaacttgcggcacaaacaaatgatgcaggcgtattgggcgcagcacaagaactggttagcaatgctgatgcaggtttagtgggtgagtttttaattgaacaagcaccccccgcattagttgggtattatgcaggcgcgggggcaggtggagttttaacaaattcacttatcagaaataccgctaaatatgcccctatggtgatgaacttagaaaaggcggctaagttagtacgcggagtaacaaccgcaggtaatgcggcacaaggcgcattaggtgcaggcacggccgatgctctggtgtcatatgggcagaacatggcagaagcccgtgagaagtttttaacccgccaagaacagattgattatgcagctgcaaagacatggggttcagccaaatactcagcgttgggcggtgcattaatgcctgtaacttttggcggtcctttgcgtactgttggtggtcaagcggttattcaatccgctgcgggcatgtattccgttaaaggtgcggccgatgctgttggtgaaaaagccgatccagtcgaaatggctttagaaggtttgttagaagttgcgactgctgcgcctgaagtagcaattacatctgcggccaaagttaaaaaccaacgtacagcacaatttgcattagaccaattgcgacaagatcaacagcaagacgctgttcgttcaagtacgtttgcagctgtacttaacaaccttattgaccgcaacaaagaaagcaagacagcacaacgtgatgactctgcaagccaagcatttatcaaacaggcagttgaagaacatggcgcggttgaagaagtttatatagatggtcagaccttcaaccagttattacgtgatcgtaatattgagccgaccgatttatttgaacgtgcgccaagtctgcaagatcagttgggcacagccgaaacatttaatggcactgtacagataccagtaaatgaatttgtttctgcaatgtcagttgttgagcgtccaacagattttgttgagaacgttcgttcaagcccggacatgccaacttatcgcgaagcccaagagaaccttgcaaaaacaacggaacaaatgcagcaagaagccggtacatatatggctgagcaagcccgttttgaaagtgctgaagatgcaaaagagttggtagcaacagaagtacaaaaccaattggctaaagtcggaacatttacggctaaatacaatcgtgcagcaggtgaattaacttcagctttctactcaacgttaggcgataaacttgggatttcagcaaaagaagcttttgaccgttacccaattcgtattactgatgattctgttcaatcagaagctaaggcacctgaaagcgttgataacgatgtaacacttattcagacgcaacaaccaaaaacagaaccaaaaggccaaaggtaccaacaaagtaaaggtggcacacgcggctcaattactttcagcattggtcaagatggctcaacaattgtattaagcaaaaatgctgatttctcaacctttgtgcatgagcttgggcatcatttcttagaaatgaatatgcaactcgccctaagtcctgatgcgcccgcacaagtccgcgcggatatggaaacggtaatgaagtgggcttcaccagaaacaactgatctgggcgaatgggattttttcaccgatgcagaaaaaacagaagtacatgaaaaatttgcagaaacttttgaacagtatgtttttacgggtaaagcaccgagcgcggcattaaagcaagttttcaaccgattcagacaattcatgattgccgtgtacaggaacattgaaaagtttatgggcatcaatgaccgcgcagaattaaacgctgatatcacaggcgtaatggatcgtatgcttgcatcatcaagtgcaattgctgaagcacaagctgcatcaaatcttgaaatgctaattcatcaagatgatgcaatgcgccttggtatttcgccaaaagattatgacgaaatgcgccaagatcatgaaattgctacagaattatctataaataccttagagcaaaaatcactgcgcaatatggtttggtaccaaaagcaaaagtctaagtatctgaaaacattgcaaaaagaagctgataaaaagcgcgctgccgttcgcgaagatatggcaaaagaaattgcacaagaacccgtatatcaggctatggcatttctacgtcaaccgcttgaccaagttgctaagcgtgactcaaccaaggttgagcctgaacgcgacaacctatttgaagcgattgctaaattcggcgggcttaatgccaatgaagtagaaagcacttggggcattgatgatgctgctaaaaccaaatcaggcgttggaaataaacctgtcgtacgttcttcaaagtcaaaagtaaaaggcctgtcaattgaatcgatggctgagaagcttagtgaagaagggtatttaactttagatgaacacggcaaatttgatacccgtgaacttgaagataaatttgcggaacagttgcgcggcgttaatcaatattcaaatcaagttgaccctgaattgttagattattcacaggacatggatttgctgcaacgctatgcagaaggtcgcacaaccaaaggcaagttatcactagattggattgaagccaagtacggacgagacagcgatatttaccaaagcatttctaaaggcgcttatggttttgcacagcgtggaggtgaaaaccccgatgtcgttgctgagatgttcggttatgaaagtggtgacgcattgattcgggacctgcttaattcaccgagtcctaagcaaaaaattgatgagctcaccgatgcgcgtatggctgttcaatattctgaatttttcgatcagcaaagcattatagaagcagtcgaagccgcattacacaatgatgttcgtgcgcgcatgctttcagctgaaatggctgcactaaacggtttacttggccgcaagtctgctttgaatgaagctgcaaagacagttgctcaagacattgtgcaacgtcaaaaaattaaagatattcgaccacatgtacgtgcacaagatgatgctcgtttagggcgtatggcaaatgaagcatttagaaagggcgaaacggtagaagctgcacgccataagcgcaatcagttagttcaattctatgcaaccaaatacagttatgatgcaaaagaccagactcaaaaacatcttgatttagtcaaaaaggtttttggaaataacgagaagttatctaaaaaccgtgactttgatttcgtgaccgctgcccgcggcattttgggcaaatatgatcttggccgcgaatcaacaaattatgagcatcaactagaattgattcgtaaatatgacccgaccacatatgccgaaatacagaacataggtgcattgcctgaaaaccaaaactatcgcgaattaacgcttgaacagttcaatgcagttatggctgcggtcgaaacactttggcatcgatctaaagaaaataagatttggcatacaactaatgaagcctttgagcgtgaacaggtccgtgaagaactaattcagcaaacaggcggtaagaaaagcgttgagaagattcagcaaacattattgggtagagataagaccgcagaacttaaagctaagttcatggaattaggcgcttcagcaaaacgtgtcgaccaggtagtaacttggttagacggtggtgcaaatggcaaattccgtacatatctaattaatcctatgcaagatgccttggctaaatatcgtattgagaaagccaagatgcttaaagacgtggtcgatatttttgaaggatttggcaaactcgataattcaaaaattgctgcacctgaacttaataactttactttcgtgggcaagcaatctttgctccatgcgattttgcatacaggtaatttaagcaacaaagagcgtcttgttttaggttatggttggggtgcgcgtttagaagatggttcggtcgatttcagcgcatgggatcaattctttagccggatggttaaagagggtgtgattaccaaaaaagatatggataacatccaaaaactctggaatctttttgacaaatacaaagagcaagcacaaatcactcataaaaaaattaatggtcgctattttgacgaattaccacgtacacctattagtacgccatttggtgagtatgaaggcggttatgtgcctgctgcttacgaccgcattcgctcaaatgagcaagaccgcattcaagataaaaacttagctgaaaataatttagctgcgttagatatcgcaacgactggcgcgaactttaccaagtcacgtgcagatcgttaccacgatcaacttgagctagatatgtctcggttaccaagtcatcttgataaagaattgcgctatatccatcttgaattacagattcgacaaatcggacgtttattgctgaacaaagattttagaaatgagattgagcgcgtattgccatttggggttaaacaagtctttaacccttggttgaaagcaatcgcaaatcagaccgttgatgaaagctcaggcgttagtttgctagataatattttccgcacacttcgccgcaatacgggtatcgcgattatggcgggtaacttaaaaaatgctgttgagcagttcacaggctttacacaagttgctgttgcagtaccgccgaaacaattgctaaaagctcaggcccattattttgcttcagttgctacccgtgaagacatggctaataacattatggaaatgtccgacttcatgaaaacccgtttcgaccgtgcagcggatgaataccgttatgcggtggatgaaattgtttttcaaaagggcgcaattcaaacagtgaaagatttcaccatgaagcacgcgtatgtattgcagacaacgatacaaagaccaatggaaatgatctcttggcaagcagcatttaaccattacacagaacaaggcatgactcaatatgacgctgttcacgcagccgatgcggtgattcgtcaatatatgacggatatgtcaccagagggaatatcgaatcttgaacgtggtacacctgctaaacgaatgtttttgatgttttacaactggttcaatatggtttggaacacatcaatgtcagaagctaagttagcgttagaggcaagcaacggttcatgggtgcaagcatcgccacgcttggcgtatgtggcgttaatgatgatctccattccttcgatgctgtctgagttgcttggggttatcttcgcaggcggtctaaaagatgaggatgatgacgataacaagtgggatgacttatctgcaaaacttgcgctttcacaattaaaaatgttggcggcttttgtaccgtatgcaggtaatgtggtaaatgctgcaattagcaatacggacgataccattgtgaacgaccgctacacagcgtcaccagtattcagtatgggtgagagcgggctttctctgattcaacatgcaagacgtgctttggatgaagataaggaagttaaccaaggtaaagcttcaaaagatttaatgaatacagcgacccttgttacaggcattccgtttgctgtacttggtaaaccttctggttattggcttgatgtagctcaaggcaagaaagatgcaccagacagtatttacgatgcaacacgcggtacgataacagggaaacatgcaccggaatga

SEQ ID NO: 3638 - DNA, 1023 bp, Acinetobacter baumannii
ggaccattaagtatgtcattagcccggctgatccaaaatgcatggaataagcaatcaagttggttgatagttttacgtcctttgtcttgcttgtatcgtgctgggtttttactaaatcgtggtttttatagttcaggctttaaaaaagtttataccgcacctgtgccggtcatggtaattggcaatattacggtggggggaagtggaaaaactccattattaatagagctggtcaattatctaaagcagcataatgtaaaggtaggggtaattagtagaggctatggtggagctggcccttttcctatgttggtaacatcggccagtcaagcagctgaagcaggagatgaacctgctttgattgtacagtcaactggcgtacctatggcagtaggacccaatagacaagtagcaatcgagttattattagcatcgactaaactagatttaattattagtgatgatgggttgcaacattgggcattaggtcgccaaatagaatggatcgtacttgatcaaaatcgtggccttggaaatagaaagttattaccagagggatatttacgtgaacctgtggaacgtttaaaaactagtacggtaattgagcatactttcacaccaacaactacattgcatatgcatcttgatgcaggccagccttacttattgaatccttcttcggcaactgaattatcattcaatattcaaaataattaccatgcagtagtcggtattggttttcctcagcgcttttaccaaacacttaaaggtttaggggtgaaacaatttcaagagcatgcttttcgtgatcatcatgattacagtattgatgaccttctatttaatgatgaccaacctatcattacaactgaaaaagatgcagttaagttgttaccattacttgaaaagcatccagaatttaaacgacctatttgggtcgtgccagttaaagctgttttgtctacagagtgctatcaggttttaaatcaacaattgcaaaagcttgatattcaaatatcttag

SEQ ID NO: 3639 - DNA, 1434 bp, Acinetobacter baumannii
ctaattcgaagtttaatgatgaacgctgatattactacccgtattgagaaggatcttattggtcatcgagaaatcaacaatgaccattattacggagttcaaacattacgtgctttagaaaatttcaacttaacaaatagcaaagttggaaatttccctaatttaattaaagcattagctatggttaaactagcttgtgctgaagcaaactataatcttaaaaacttagatcaaactaaatttgaagcgattgaatacagctgtaatcagcttattcgtggtaatttccatgaccagttcccaatcgacatgatgcaaggcggtgctggcacttcaaccaatatgaatgcaaatgaagtattggcaaacgttgctttagaatatatgggccattctaaaggtcaatatcaatacttgcatccaaataacgacattaatatgtcgcagtcaacaaatgacgtataccctactgcaattcgtttaggtttattacttagcctagatgagttaaatcttccatttaacaatttgattcttagcttcttgaataaatctcaagagtttgcacacattttaaaaatgggtcgtactcagttacaagacgctgtgcctatgacattaggtcaagagtttggtgcttttgcggtaactctacaaaaagaccttgagcaaattaatacgcttattccaaatgttttagcttatatgaatcttggcggtacagcgattggtacgggaattaccactgaatatagttaccgtgaactcgcgattcaagcacttggaaaaatctctggtaagaaaattaagtcagctccagatttgattgaagccacttctgatatgggtgactttgttcttttatctggtttattaaaacgtactgcaactaaactttcaaaaattgccaatgacttgcgtttactttcaagtggtccacgtactggcattaatgaaattaacttagaagcacgtcaaccaggtagctcgattatgccgggtaaagtaaacccagttattcctgaagcaatgaaccttgcttgcttccagattattgcaaatgatttggctgtaacgttagctgctgaagctggtcaattacagttaaatgcaatggaaccacttattgcattcaaactgtttgaatcgatggacttgcttggtaaagcaatggcaatgttccaaactaagtgtattgatacgattacggcgaaccctgaacactgtaaagctttggttgaaaattcaattggtattgtgactgcacttaacccatacctaggttatgaaactacaactcgtattgctaaaactgcaaacgaaactgggcaaagcgtattggctttagttcaaaatgaaggtttattatcagcacaagtgcttgatgatatcttgtcgattaataatatggttaaaccaaaaatgtcggcttaa

SEQ ID NO: 3640 - DNA, 387 bp, Acinetobacter baumannii
caaaatggaagactaaatatgatgttatatggatatcacttctcaacaattgaaaataactgggaagacttaactccattaaatgagtttttacaaacatttgcagatgatgatggtgatgtctcccaaagagataaagaatcgcttaaagaaattattgctaaatccgatacagctttggccttagctaaagaaatgggttgggatggtagctatacaggctgtccttatttattttggttaccaagtaaaaatacgcaatcttttgaatatggatttgtttttaaacaaacctcagataactcaacttttgtaatctcaccaattgaattggcttatctggcgcaagatgagcaggtacaaactttaagtaagaatattgattaa

SEQ ID NO: 3641 - DNA, 1578 bp, Acinetobacter baumannii
agcgtattgagcaagctgtgcgaaaaacattggaggcttaggatgagcgaaattaaaacgctggagatcccgaaatggggattatccatggaagaaggcacgatcgcccaatggttgattaaagagggtgatagctttaataagggcgatgaaatttgtgaaattgaaaccacaaaaatcgtcaatgtgttagaagcgccttttgctggaacgctccgtaaaattttagcgaaagatggtgatactttacctgttggtggtcttattgccgtatgtgctgatagtgaagtttctgatgcagaaattgaaaggtttatcacatcactaggtggttcagcagctcaagcacctgaagcaccttcggagcaaagtaaggcggaaacatctgcacctgttgctgaaaaagcagaacaaccacagactgtagcagctagtgcgccagttcctgcaaaggtagcgaaagatgactacgctgtaccagagtcattacaaggctatcaaacatctgatgagttgtttgcaacgccgcatgccttgaagcttgcagaaaaacacaatgtaaacttggcaaaagtcacaggttctggtcgtgaaggacgtattagtgttcaagacatccagaaggctgtacaggctgctggtggtcagtggcctgatattaagcagcaaactcaagctaaagtgtttaaatctacggccgatgatagccaagttttagcaacgcctgtagcacgccgtttagcaaaacaatggggcattaacctaaatgattgccgtgtttcaggtactcgtggccgtgtctgtaaagaagatgttgaggcagtttactatcgtaacaatccaacgtcggtaaatgaacaatctgtgcaatatgcagctcaaccacaatcgacaattacgactgtggcgatgaatgggatgcgtaaagcgattgcttcacggttacaggctgcaaaacgtaacgcaccgcatttccgcttagtggttgatctcaacgtagaggctttgcaaaaactacgtaagcagattaatgagactgttccacaagtgaaactttctattaatgacatgctaattaaggcagctgccgccgcgctgattaaagtacctgaggtgaatgttcaatttgatgaggcgactcaatcaattttacagttctctcaagcggatatttcggtggccgtagcgattccaaacggtttaattacacccattgtaaaagcagcgaatcagaagtctttagcacaaatttccgatgacatgcgtgatttggcaacgcgtgctaagactggcaagttacaacctgacgagtttcagggaggcagctttagcatttcaaatttaggaatgttaggcattaaacagttcgatgccattattaacccaccgcaaggtgcaattatggcattaggtgcttcggaatctcgcgctgttgtcgaaaatggcaatttagtggttcgtgagattgtcacagcgacgttgtcatgcgatcaccgagttattgatggcgcagttggggcgaaattcttggccagctttaagcagtttgttgaaaaccctgctttaattttggtgtag

SEQ ID NO: 3642 - DNA, 654 bp, Acinetobacter baumannii
acttttatgagtgaaacgcaacaaagacaaaaacatccacgtctgttgctgaatattgttctaattattttagaaacttttttctcatttattctcacccacgatggtgttcttcgcttgcaagcgaaaaagtttatcgccaataaaataacaatccgtattaatagctatttgccatttttcgatttctatgtgcagtttacggaaaaaggattgctatttgatattcactcatatgaccgtcggattgatttagaaattaatagtactctcgttgaccttatcaaaatttttgttttttcaaatcaacgtagcctgaataacatgcgaattgatggggatgcagagactaaaaaagaactcatagatttaatttcgcatctcactttacctaagcttctagcagactggaagcagtggttcaacgcaccagatgatgaagccgaagcactagcctctcgcaaaaaaattgctccattacttgaaaaaatcgaccaacaacgctcagaaataaattcgttgcatgtcgaaattaaacagtatcaaaaccgaattgcacgtttacaacagcgccaacggaatattaacttgtgctttggtataattagcctaatatttattgtttatttcatatataatttgtgggtagcttaa

SEQ ID NO: 3643 - DNA, 891 bp, Acinetobacter baumannii
ggtggtatgagcaaccaagacgtagatatttggatgccaatttatattggcgacatgcttgctaagaccactcgaatgaccaccgagcaaatcggtgcgtcatttttactcatgatggactattggcgtaacggtgcaataccagatgacaacaacgttattgcaagcgtaattcgttcaaatttgagtaaagcgaaggctttaaaaactatcttgataaattcaaatttatttgaagtaaaagacagtgaattatcttcaaaatatttggatgatttaaagtctcaagctgaaagtaataagtcttcaaagtcagagcgtgcaaagaaagcagcggaagcacgatggaataaagagcaagactctagcaacactaatgcatctaatgagcatcaatctagcaatgctaatgcatatgcacaagcaatgcataagcatgattcaagcaatgctcaaggtatgcttgagacatgcccttcatcgtcaccttcatctatatatatacatacacaatcagaaacgccgaattccctcgatgaggacctgagtttgtggaagccttcacttcatgaaattaactcatggagacaaagagcagggctacctaaaacgactcaggaagagtttgacaccttcatgattaccttcctaccgcattacgcacctgaaatacgttcaggtcgtctcattgaaaacaagatttacgcgaaatacatccagtgggtgaaagacgatgctttgaaagcaaatcggcttgctaaagcgaaacccgctgcaaaaacaaattcggctaacgattcaagaaacgtcaatgacgcttggaaagacgagcctaaatcagatgatcgcccgttcacaggaactgtgcacataccggaggatttaatatga

SEQ ID NO: 3644 - DNA, 885 bp, Acinetobacter baumannii
aaatcaatgagcgaacttaacaatattgctgaaaccaattacaagcttggtcaaacaagcctgcaaaatgtcactcaatcaacaggtgtgttgccttttgttgtagtgccaaatggtagtgaagttcatgaatttgaagcattactacaacgccctcttactttaacgcaaagcgttaatttacatacagcaaaggactttattgcgtatgtctctcgttatgcggataagaactctttagtgtttgttgatgtattgaaaggcaaatttaaagctgtgctcgattatcacgaagtcgagaaagaaactaatacgggttcagtacttgcgccacgacatggcaaacatgcagcacattttattgctgaaaaaacgcctgaatttcaaaaagttgaaggcaactcaggccgtaagttctcacaaactgaatttgctttgtttttagaagatgtaatgccttacatcaatcaaccagacgcagcagttttgtatgaaatcgtacaaacattaaatgcaaaaacgaatgttgattttaaatcaggcatccgtaccgataacggccaagttcaattgacctacaacgaaacaattgaagcgcgtgccggtactgcgggtaatctcactattcctgaacaaatcgttgtcggtatccaagtacatcgtggcggcaatcactatgccctgcctgcgcgtttccgctatcgcattaaagaaggcacgattgtgttctggtacgacttagatcaactagaaaaagcaatcgaaaaatcaatggaagacaccgtcgaatatattcgtgacggtaaaaccattactaaagatgatcaagaaattgaattagcaggcctgcctaactatgtgcagattctggaaggttcagtttaa

SEQ ID NO: 3645 - DNA, 1437 bp, Acinetobacter baumannii
ataagaatgagaaggattttttcagctatggaaaaacagcaaggaatttttgaaagatttgctcttcggattagtgactggtctgaaaaatggtttcctgattcatatatttttgctctgcttggcgtcattattgtctctattgccgccttgggtattggtgctccaatccatgatgtagcgacctcatttggtaatggcttctggagtcttattccctttaccctgcaaatgactatgctcattattgtaggttatgtcgtttctgtatctaagcccgtaaaattcctgatccaaaaaatggcgcgtattccaagttctggacgtggtgctattgttttggtggcaaccgttagtttattaatttcactagtcaattgggcaataagtacgattcttactgcacttttagtgattgcattagcaaaacgtaaagagctgaatatggattatcgtgctgctgcggcagccgcaatcattggtatgggtgcaacttgggctcttggaattagttcatcagcagcacagcttcaggcaaataaaaccagtttacctgagtcaatttataacctgactggtgttattccatttaccgaaacgattttcctttggcaatcaattgcaatgaccattattttagtgattgtttcaatcgctattgcatattggtctgccccaaaaggcaatagcgttaaaaccattgatagttttgatgtgcaatttgaagaagaaaaaacaaatgaagcaaaatctactcgtccaggtgactggttagaaaattcgcctatcttaacgattattgtggtggttttaggcttaatctggatgttttttgaattttcaaaaagcaatcccatcattgccatttcaagtctcaacacctacaacttcgtgtttttaatgcttgggttagctttacatggcacaccacggaactttttaaatgctgttgcaaaagcagttccggcagtatcgggaatcttaatccaatttccactttatggaagtatcgcctttattatgacgcaagctttaaatagccaagacttatcgctgtcacattatattgccgagtttttcgtttcaatcgcttcaaaagaaacctttgcaattgtgatgggaatttactctgcggtacttggattttttgtaccttcaggtggtggaaaatggattattgaagccccatatgttatgcaagcagcaaatgatttaaaggttcatttaggctggtctgtacaaatttataatgcagccgaagctttaccaaacttaatcaatccattctttatgcttccaatgttaggcattttaaaactaaaagcaaaagatgtgattggttttacagtaacgcagctcgttgtgcattttcctttagttttattcttgctgtggttctttggtagaacgctcagctatacccctccaactttttaa

SEQ ID NO: 3646 - DNA, 1224 bp, Acinetobacter baumannii
tttaaaaagagggataatatgcaacatcaaattaatggtattgctttaccaaatgaacaaggattttttggtgagtatggaggtcagtttattcctccgcatttaaaagaagcaatggatgaaattaatgttgcttatgaagaaattcgccatacaccagaatttcaaaatgaattagcagacctctttgcaaattatgtcggccgtccaagtcctttatttcatgcaaaacgcctttcagaacagttaggtggcgcgcaaatttatttaaaacgtgaagacttaaatcataccggtgcccataaaattaatcactgtttaggtgaggctctacttgctaaatatatgggcaaaaagaaagttatcgccgagactggtgcgggtcaacatggggttgctttagcaactgcttgtgctctagtgggtattccatgtgagatccacatgggtcaagttgatattgaaaaagaacatccaaatgtggtcaaaatgaaaattttgggcgctcatttggtgtcagtaactcgcggtacagcaaccttaaaagatgcggttgatagcgcgtttgaagaatatttaaaagatcctaaaaattttatttatgcgattggttctgtggttggtccacatccatttcctaaaatggttcgagattttcaatcaattattggtaaggaaattaaagagcagacgcatcaacgatttggtaaaaacccagattatgttgtcgcatgtgtcggtggcggttcaaatgcaatcggtgcatttacagcttttttaaacgattcagatgtgaaacttgtaggagttgaacctgctgggcatgggctagatacaaatatgcattcggcaaccctaacattaggtaaaccgagccaaattcatggtatggcatgttatgttcttgaaaatgaggctggtgaacctttacctgtgcattctatcgcttcaggattggactatcctggtgttgggccacaacatagtttcttaaaagatttaggccgtgtggaatatagcactgcaactgaccaagaatgtttagatgcgtttatgaccttatcacgagttgaaggtattgttcctgcgcttgaaagctcacatgctgtcgcatgggcaatacgtgaagcgccaaaactgccgaaagaaaccatgatcgtggtgaatctgtcgggtcgtggcgataaagattctgattatgtggcagaaaaacttaagctttaa

SEQ ID NO: 3647 - DNA, 852 bp, Acinetobacter baumannii
atccattttggcttcaatgcaacgagcgattcatatgtagaaattctacatttacaggagttgaacatggttaagggattaaaaaataaagtcgctttagtgactggggcagcccaaggcattggccgtgggattgccctgcgcttggcgcaagaaggggcacatattgcattagttgatatgaaacaagatcgactgaacgatgtgcagcaggaaattcaggctttaggtgtaaatgcgagtacatttattgccgatgtcagtgaccgcgagcacgtgtatgctgctataaatcatgctgagcagacacttggtgggtttgatgtcatgattaataacgctggaattgcacaagttcaagcgattgctgatatcacaccagatgaattccaaaaaattgttgatattaatattggtggagtgctgtggggaatacaggctgctgctgcaaaatttaaacaacgcgaacataaaggtaaaatcattaatgcttgctcaattgcaggccacgacgggtttgctttactcggtatttactcggcaaccaaatttgcggtacgagcacttacccaagctgcggcaaaagaatatgccagtcacggtattacggtaaatggatattgtcctggaattgtcggaacggacatgtggattgaaattgataaacgttttgctgaaattaccggtgctgcaattggtgaaacttataaaaagtatgtggaaggcattgctttaggtagagcccaaacaccagacgatgtagccgcattagttgcttttctagcaagtgaagattcggactatataacaggtcaatctattttaacggacggcggaatagtctatcgctaa

SEQ ID NO: 3648 - DNA, 261 bp, Acinetobacter baumannii
ccaaattacggagtttttcgcatgaaatatttagtcattaaaaaactaggtcacggtttctatttaggtaaaggcaatgttcgacaaggaggtaaagaatttatcgttataaaaagcgataaagaattgctcgtaggtgctgaaagttataaatacgatgcttcaaacaatcaattattgtgggaaggtatccaaaacctagggcaagaagtggtcggttttgctgatactgaagaggaagctttagacttagctttctaa

SEQ ID NO: 3649 - DNA, 306 bp, Acinetobacter baumannii
aaacccttaggtatctccaagaaaatgcagcagatgttgttaaaaagtattttaatattcaaaaagatggaagttttgaaagtaaggtcgggtactttgtatttaaaaaactatccttctagtgagtctaagcttggatttgtgttcatagagaaaatgttagataaaagccctcatatagagggcttttttatgcctaaatttagatttttgttgaacgctcactcagccatgttgctaactttggccagaattcctgcgcacttgcttggcttgacattagacctaaatgaccgccaggaataa

SEQ ID NO: 3650 - DNA, 351 bp, Acinetobacter baumannii
ggagttaaaggaaaagaaatgcacatccaagaaatttcgaatgatcccaatagcaacaaattgttagttggtaagttgctcgaaaatatgagtactcgcgtacctgtagaagtaaagcaactaatagatgacatagcgaattcaaatggaagtgatcgcgctaagtggatgagagaggccatagatttaaagctcaaagttgacttgggaatatcatcaacagaagagcttgttgaaacaaggaatacaacgaaatcaagcgaatacagaaatgtattcagaaatttaagagcttttttgcacgcattaaaaaagcccgacgttgcgggtcgagcttttcgcgttcattaa

SEQ ID NO: 3651 - DNA, 906 bp, Acinetobacter baumannii
gctataattttaagctgtaactcatttgtatcagatcataatttgaacttttatatccatttgctattgataagaatgataattatttgcaattatatttatagatttctttataatataaattggagtattcacatgcgctctaccatcgtggtcacaggtgctgcaagagggataggagcggctatcgccaagcaactactagatcaggggtatcatgttattggtattgactgtcaaaaaaatcctgaacaatgggatatcagtaaaacaatgacgtcagatcaatcttcacaatggcaaggcatctcacaagacattacccatcaacaagaaacacaaactttaatttcagagctgttagaaaaatacgaaattacggggttagtaaatgcagcaggagtattaattatgcgctccatgcttgaagcaaaaacggaagattgggaaacactttttgcggtcaatgtcatggcgcctatcgcgatcagccaacaagttgctaaacatttttgtgcaaaaaggcggggtagcattgtcactattagttcaaatagtgcgcgtatgccacgtatgcaacttggtatgtacgccaccactaaggctgcactaagtcatttttgtcgcaatctggcacttgaaatcgccccttatcaagtcaggctgaatatcgtttcacctggatctactctcactcaaatgcagcaacaactctggacagataatacacctccacctgcagtaattgatggtgatttgagccagtaccgaacaggtattcccttacggaaactcgcgcaaccagatgatattgccaataccgtgagctttttactttcggaccgagcggcccaaattactatgcaagaaatagtggtagatggaggagctacacttggggtttaa

SEQ ID NO: 3652 - DNA, 258 bp, Acinetobacter baumannii
aggcttttcttcatctatcatgtgaaccatccttttttaagctatgtgatttcatgctcaaataaatatcggatatattcaacagtgaacacacatcatttatgtaaagaatacttaaaaattattaaaatatataaaaagttaaatagtgttattcaaaatattttaaaaactcttctaactcaggtaaatgtgcaaagtttttatgagcatcccctaacacaacccaatcatgttttgactctatacaaaaattaa

SEQ ID NO: 3653 - DNA, 867 bp, Acinetobacter baumannii
agcttatttatgtttataacaacaactcgccccaatgatgctttaattgaacagctactaccaatcttggaagaagctagccaaatcttattacaagaatatcaaaattattcggctggatatgaatttacgattcaagaaaaacatgacgattcaccagtaacgcaagcagatttaaaggtaaatcgttttttattaaagcatcttgcagaaattacacctgagttaccggttttatcggaagaaagtgactatagcgctcgccatgcttggtcttcttgctggatgctagatccacttgatggtacgaaagagtttatacatgagcgagatgagttcacgataaacttgagtttgattgaagggcgtgaaacgattttttcggtgattgttgtgccatgtgagcaagttgtttatttaggttatttaaaagatttaccttttaaatatagctttagccaacaacaatggtatcaatatcaaaaaacaccttattcaaaacaagctcctgtacaaattggtttaagtcatagtagtaaaaatccgaaatatcagaaattcattgaacctattgaaaggattcgtaccgtaattcgacgtgaagcaggtagcgcttataagttttgtatgatgttagaaggagagatcgatatttatcctagatttcatccgacatcagaatgggatactagctcaggtcaaggattattagaaagtataggtggcggtttactcactctaacaggtaaaccctttgaatataaccagcgtgataccgtattaaatgggggctttatcgcatttcgtgatcaggaaagcaaaaaaatagcatttgaagctttagcccaatcaggtgttttggattga

SEQ ID NO: 3654 - DNA, 1002 bp, Acinetobacter baumannii
tctattcttatagctcactataattttattaaaataatgattgatcacgtaaacatggatgcactaagtaaattttttgatgatatccacttaaataagtctgaatatatttatataaaagcacaaggtgaatgggcttttaaaacacaagatcaatctgctttactggcttatatcgttttaacgggttctgtatatatccaattaaatgtgtcagagaaaataacagcaagagctggagatattattttaattccttctggaaaagcgcatcatgctacagactcaaaagctactgcaagtaaacttgtagatccagtcgatattactccattatttaatggacatcgccacgatccaattgagttaggctcatcaacagctgaaaataccctattactctgcttgcgctgtcaagtcgatacttatatggcagggccacttattaatgcattaccctctattatgcatattcaacatgagaaccaggccactcctcctgaatggttgcaaataggtctctactttttagcggtcgaaacacaaaaaatccaaccaggccatgacaaaattattgatcacttagtcagtattcttttaatagaatgtattcgtgatcatattcaacaaatgtcagatcaacaaaattggttaggtgccctcacacatcctgaattaagtaatgctttatccgcaattcatagtcaacctgaaataagctggactgttgaatcattagctgaacaatgctgcatgtcacgatctaagtttgccaatctttttaatagtattattggtgaaccacctcttacttatttacagcattatcgcttccgcttagctagccaatatctacgcacaagtaatttatcaatacaacaaatttcaaataaagtgggctattcttccgaaaccgcatttagtcaggcatttaaaagagtatttgatttatcacctaaacaatatagacaaaattatattggtactaatctcgatgaataa

SEQ ID NO: 3655 - DNA, 2166 bp, Acinetobacter baumannii
atgagaattatttacattatctttaatcttatgaatatcccacctcgaccatttaagttgtctgtaatcgcctgcgcgatttgttatgccaatctcacctatgcccaagatgcacaggtacaagctttgcaaacgattcaagtcaaagcatcaaatgcagagcagtcttctgaacagaccaaggcatataatgttaaaaactcaagtagtgcaaccaagcttaatattgaggctaaggaaacaccccaaaccattaatgtcgttactcgtcagcaaattgaagattttggccttaccagtactcgtgatgttttaagaaatacccctggtgtaacagtctctaatcaagaaactgagcgaaccacttatatggctcgtggttttgagatttcaaatatcttgacggatggcgtaggctttcctctttcaggttataactataataatacgaatcctgatacttacttttatgatcgtgtagaagtagttaaaggagctgactcgttaactaatgcctttggcgatccgagtgcaaccatcaataatattcgaaaacgtccaacccaagaatttcaagcaagcggtggtgtaagttacggttcatgggatacgcagcgctatgaagctgacgtatctggctcaattctaccaagtggaaaagtacgtggccgtattatgggctatgaacaaactggtgattcttacctagaccgatattctgcggaaaaaaacggctttgctggtattgttgaagccgatttaacagatagtactttacttaccgccggttatagccaagaacaaaataaacctaatgcaaacaactggggtgcactacctttattagatgccaacggtaaacaaatttcctatgaccgctcatataatccaaaccctgattgggcacattgggataatgagacacaaaatgcttttgttgaattaaagcaaaaacttaatgaccaatggaatgctaaactgacttacaactatcttgatacgaagcataatagccgtcttctctattactatggttatccaaaatctgatgggtccggtgtttctctaacgccttggggtggacaagaacatcaagaaaaacatgctgtagattttaatctcgaagggacctataagctatttaaccgagaacatgaagcaactctaggctacagctatgtacgtaatcatcaacaagataaacaatctacaggaacgattaacgatagtaacgttataaagtcaactactaccgattgggcaagttggacaccgcaatctataacttggtcagatttcacagaagcggctaactataaacaaaatattaactcaatttatgccgcgacacgtttacatcttaatgaagatttaaaacttttacttggtgcaaactatgttcaagctgagagtaaaggcgaaagttatagctcaccaatgtcatatagtgaaagtaaagtttctccatatgttggactaacctataactttacacctgaatatacgggttatatgagttacacctcaattttccgtcctcaaactggtattgataaagacaccaatcaggctttaaaacctattgagggtaaaagctatgaaatgggtgtaaaaagctcatggctagatgaccgcttaacaggaacactttcagtatttaaaactgaacaaaataattaccctttacgtaactcggatggaaatccacttaatcgaaaagtaccaacgagtgatctagaatcgcaaggtgtagaagtcggtctatcaggtcaaattactgataacgtaaatctttctttcggctacgctcaatttagtattaaagatactaaaaatggtggcgaagcaagaacatacaatccaaaccagacacttaacttgctaactacctatactccgccagttttacctaagcttaaagttggtgcaggtttacagtggcaagatgggataaagttatatgactcaaatgtaaacggtacgatcaaacaagatgcatatgctttagtcaatttaatggcaagctatgaagtcaatgatcatattacgcttcaagcaaatggtaataatatttttgacaagaaatatttaaatagtttcccagatgggcaggctttttatggtgccccagccaactatacagttgctgtaaagtttaaatattaa

SEQ ID NO: 3656 - DNA, 384 bp, Acinetobacter baumannii
gtgaatgttatgccaactaagaacacttcattcagtcaaaccctagcaaaccttcaacgtggcgacacgatcgaagaattagacgcacttttgactgaggccctccaagcttcaaacgacacaggcaaagtatcaaaaattactgttactttgactattaagcctaatggtcgtggtacctacaaaattcaggacgatatcaagtccactcttccaaaattcgacaaagaaccaaccgttctatttacggatggtgaccaacaactcgtgcgtgaagacccacgccaacagaaattgaatcttgagcacattgacgcgggcacacctgctgagctcaagcaaattccaactgaaaataaaccaacaattaagtctttaagttaa

SEQ ID NO: 3657 - DNA, 1128 bp, Acinetobacter baumannii
gataaagttatgtggcagcaattaatcacgtggctgaaacaattaagttttttagtcaaaaaagaattcttaaccatttttagtgatcctacaaatagggctattctatttgtacccgccctgatgcaagcacttttatttggctatgcggctacttatgacgttaaccatgtagattatgcaattttagatcagagcaatgggcagatttcacatgagctgatctcgaagctcgatggctctggtatttttaagcgtgttgcaacactggaatataccgaacaaatcaaacaggtcattgataaccgtcaggcattgctcataattgcgatccctaatgatttcgagagtaaattaaacaataaccaaagcgctcctatacaggtcattgttgatggtagaaattcatctacagctatggtcgcagggtcatatctaaataaaattattggtcagttcaatcagcaaaagtttaattcagctttaccgattagccttgaaacaagaacatggtacaacccaaatcaggagtctcgttggagcttaatgcctgcattaattgcagcattaagtatgatgcagacattacttttatctgctttatcagttgcgcgtgaacgtgagcagggtacgtttgatcaattattagtgacaccttatacgccattacaaattatgattggtaaggctttgccgccgatttttgtaggtttgatgcaatcgaccattattttattgattattttgttctggtttaaaattccaatgaatggctctattggactgctttattttggattattcagctttaacgtggctgtagttggtgtgggcttatcaatttcagctttatcattaaatatgcaacaagccatgctttttacatttttattgattatgcctttaatgttactttcaggtttactgacacctgtagaaaacatgccaaaagcattacaagtagcaacttatgcaaatccattaagatttggaattaacttagtacagcgggtttatttggaaggtgcaagctttgcacaagtcaaattgaactttttaccaatgattgtgctgggaatagtaactttacctttagcagcttggttatttagaaatagattatcttaa

SEQ ID NO: 3658 - DNA, 1449 bp, Acinetobacter baumannii
tatctattctttagggagaaagaatatatgtgggaattatttgtaattctactttcgcttgggctgttgatgtatacagcttacaagggcttttctgtcattctcatggcaccaatttgtgccttacttgcagttttactcattaatccagccaatgttttaccgttttattcgggtgtttttatgcccaaaatggtgaactttattaaagattactttcttgtgtttttgctgggggcaattttcggtaaagtcgttgaaatgtcaggaattgctgagtctattgctcgaaccatagtgagatggattggggcaaaaaaagcaattttaacggttgtattactaggtgcaattttaacctatagcggtgttagtttatttgttgctgtatttgcaatttatccctttgcaaaccagctttttagacaagcgaatattccaaaacgtttaattccgggaaccatcgcgctgggtgcatttacatttaccatggatgcattgcctggtacaccacaaattcaaaacgtaattccgaccactttctttggcaccaatatttatgccgcaccatttctaggaattattggtgctatttttgttctatgcatggggttggcttacttagaatggcgtcgccgagctgctgcaaaagctggcgaaggcttctcgggttttggcgtaaacaatacgccatctcaagaaattgaagccgatatcaacttgcaaaataatggaagtacggctcgccagtttttagcgtttgtaccacttattcttgttgcggtaatgaacaaatatttgtctaaagcaatcaaagagtggtatccaaatggttttgattttgccgcagttggattagcggattacaccgtagatgttgcgaaaactggtgcgatctgggcagtaggccttgcacttattgtcgggattatttctgcaattttatttgattatcagcgtgtagtgacaaatttcaaagagggcattaatgccagtattggtggctcacttttagcagtgatgaataccgcatctgagtatggtttcggtgcaattattgcgtcattaccaggctttgccatgattagccatgcaatgagcagtaccttcacaaatccactagtcaatggggctgtgaccacaaccgttttagcaggtattacgggttcagcttctggtggtatgagtatcgctttaagtgcgatggctgaacaatataacgccgcgattttagctgctggtattccaccagaagtcatgcaccgtgtagttgcgatggcgtcaggtggtatggatacgttaccgcataatggtgctgttatcactttactcgctgttacaggtttaacgcataaacagtcgtataaagatatttttgcagtcacggtaattaaaacgttagcggtatttgtggtcattacggtctttaccgtaacaggtattgtttaa

SEQ ID NO: 3659 - DNA, 1002 bp, Acinetobacter baumannii
aatggaattttatatatggacttaaaaaggcaaatagagacaggtattaagttaagaggaatagataaagtttctcgtattcctattaaaattttacctaccgaagaactacctaaaaaacctgaatggattcgagcaaaaataactgatttcgaagaaattcaacgtatcaaaaatttattacgccaacaaaagctacatagtgtttgcgaagaggccgcatgtccaaatctacctgaatgttttggtggtggtacggcaacatttatgattatgggagatatttgtacaagacgttgccctttctgcgatgtagcacatggtcgtccaatgcctttagatgaaaatgaacctaaaaatctagctgagacggtcgctaacctaaacttaaaatatgtagtcattacctctgtagaccgtgatgatctacacgatggtggcgcagcacattttgtgaagtgtattgaagaaatcagaaaccgttgtccagatacgctaattgaaattttagttccggactttcgtggccgtttagaaacagcactctctacattaagcttatcaccacccgatgtatttaatcataatattgagacagtaccgcgtttatataaagcaatgcgtcccggttctgactatcagcattcattaaatttattaaaacgttttaaaaaatactgtcctgatatcaaaactaaatgcggtctaatggtagggctaggagaaattgaagctgaggttattgctctactcaacgatttaaaagatcatgatgtagatttagtgactattggacaatatttacagccctctaaatcacatgcccctattcaccggtttgtgaatttacaagaatttgaaagatacactcagcatggtcagcgtttaggctttaaaaatatctggagtgcgccgatggtccgttctagctattttgccgatcggcaatatttcggagaacctgccccaaagccattttcaagagaggatgttttgtcatag

SEQ ID NO: 3660 - DNA, 1920 bp, Acinetobacter baumannii
gatttatctatgaatgcacttcagcccgtttatcaagtaatggaccaaggaatcttacaggattttatcaatagccttctggttgaaacgattattcctgaacattttatttttgattttgcgactgcccaaactgcgctaaatcaacatggcaaaaatcttcaagaagtatttaaaaacacgtctgaacaagtttcttttgtgctattacacgaagagagtcggcaaggcttggtcatgtttgcggtacaaaaaggtattactcaagcctggaagcttgctaatggaacagaagtttttctattggaacgcacaaatgatcatgttcagatcaatgtgattgggataatagaactttttgagtttattcaagcgataggtctttttaatcagtgtagcactgataaagttcaagccttttatgagcagctgcaaaaatgtttaaagcaatatcatttattacaacaacatcgggtaaatgcacatgatttgttgaatcaaagctcggcacatagattccgcattttagagcaatatgcaggttatcgggaccgcccatatcatcctttagccaaattaaaagaaggtctcagtcagcaagagtatatgcaatattgtccggaattcgctcaagaattatctattcattgggtggctgtacataaagataaaatgatgtttggtgaaggggtagaaaatatttttaaacaacagccaagcgaaatttttattcctcgtgctgagcgatatcaattaaaacaggaaatgtttcaacgtgggttaaatgaaacccacattgcaatgccaattcatccttggcaatttgagcatttatttcctaagttctatgcggatgatattgccgacggcgtttgtcatcctttgaattttatttctaaaggaatgtatgccagtgcgtctatgcgtagcctcttatcaaaaaatgttttagaagaaagtctaaaattaccgataggaattaaagctcttggttcattaagatttttgcctattgtgaaaatgattaatggtgaaaaaaatcagaaattattacagcaagccaaggcaaaagatgctgtcttaaaactaaaattatggctttgtgaagaaacacaatggtggtcatatttacccgagaagcaaaatgaccggacagcagacaatgagtggttatttgtagagaaacctacccatttggcagctcagcgccgtcatattccagctgaattattgcaagaaccttatcaacttataccaatggcaagtcttggacatacaattacgggtcagcctgccatttttgattatattttgcagcttcaacacaaggacataaactccaagcagatacttatcgagtttgagaaactgtgtacatgtttctttgatgtaaatttgcgattattccgcttagggcttatgggtgaaattcatgggcaaaacatatgtcttgtgttgaaaaatggcgaatttgatggattgatgttccgtgatcatgattcattacgtatttatttaccttgggtagagcaaagcggattgaaagatcctaattatttgagtccccatgattttagaaatacgctttatcatgaatcggtagaggctctgttattttatattcaaactttaggtattcaggttaatctagggtgtattgttgataatttagcgagtcattatcaaattgaagttaaggatctatggtctgtacttgctcatgcgttacagcaagttattcaaaatctaaacttccagccagagattttgacccagctccaacatttactatttgaagtgcctgaatggccatataagcagttacttcgacctttgctagaacaagatacacggattggtagtatgccatcgggaattgggaaaacccgaaacccactttggtatgccttaaattgttag

SEQ ID NO: 3661 - DNA, 360 bp, Acinetobacter baumannii
actaagtctatgaaagaacaaaacttaaaattacaaattagaattcttttagagcaaaatattgcatttggtccgggtaaggcggacttacttgaagcaattgcgagaactggttcaatctcacaagctgcaaaatctatgaatatgagctaccgccgtgcatggcagttggtcgacaccatgaatcagtgctttgaaacagctttagtggaaacacaaacgggcggaacacatggtggtggggcagccgttacagctttgggccagaaagtcttacagcattaccgccaaatggaaatcaatgctcgacaagccttagaacatgattatcaaatcatgagtagctatttaaaacgttaa

SEQ ID NO: 3662 - DNA, 699 bp, Acinetobacter baumannii
atcatgttctttaagcagttttttgagcaggaaagttcgacttatacatatatgcttgggtgtgaagaaacacgagaggctgttttaattgacccagtcgcatcagatattgagatttatgcaaaagaattagagcagcatcaatttacgctcatctataccttagacactcatgttcatgcagaccatattaccgctgcaaatttacttcgtgaacgtttccattgcaaatcggttttacaccgaaactcagaagtaagttgcggagatattttaattactgatggttgcatgcttaaagttggcaacctcagtattgaagcgcgttacacaccaggtcataccaatgcttgtacgagttacctagttggaaacatgattttcactggtgatgcattattaattgacggctgtggtcgaactgacttccagcaaggtaatgcaggtacactttatgacagtattcataagcaacttttcagcctacctgacgacactattgtatatccggggcacgattataaaggtcgtctatcttcaacgattggttatgaacgcttaaataactcacgtctgggtcagaatcgttcacgtgaagattttattaaattaatgaataacctaaatctgccatatccaaaacaaatcgataaagcactacctgcaaatcaggcttgcggctcaacttcacaatcataa

SEQ ID NO: 3663 - DNA, 438 bp, Acinetobacter baumannii
gtggtgcctatgtctaaaatcattatcggtattgaccctgatttagaaaaatcgggcgtagcagttttaggccaatcgcattttgaattaaaaaatctcaactttgctgaggttgttgaattattcaaggcagagcaggacttaatcaaaaaggttgtgattgaagcaggttggctaaacaaaaaagcaaattttagaagcggtgctaacaaatccattgctgttaatgagcagatttcaagacgtgtgggtgaaaaccatgctacaggcaagctgcttgttcagatggctaaacatatgggtttggcagttatcgaagtaaaacccactaaagccaaaatcaattcagaagattttaaacgaatcactggttggcaaggtcgaacaaatcaagaacaacgcgatgcgggaatgttgatttggggaatgtgggtttag

SEQ ID NO: 3664 - DNA, 669 bp, Acinetobacter baumannii
aaaatgactataagtacgaaaaaagcaattgtagtaggtgctacaggactcgttggtttagcgcttgttgaacaacttgagcaaacaccagaatttgaggccattaccgttgtagtaagaaaagaatcacaactacttaatacatataagaaagttactcagctcgttatagacgattttttattgctcaatgatgaagatgtgaatggtcatactcatgcatttagttgcttaggtacaactttaaaaatagcgggctcaaaacaaggcttttatgcagttgattatgagataaatgctcactttgcagacttaatccaagataaacatattcattttttaattgttagtgcacttggggcaaatgctaattcgccaattttctacaataaagtaaaaggcgaattagaagattatattcaaagtttaggaatcgaaaaattatctatttttagaccttctctactgattggtaagcgtagcgatgtacgttttattgaagatttaggacaaagtctatttaaacttattgaaaataaatggactaagcctttcaaatataaaccagttacagcagagcaattggctcataccatggtcgtagcggcactaacgcaaattgaagcttttaaacgatatgataatctcagcatacaacaaactcgataa

SEQ ID NO: 3665 - DNA, 1212 bp, Acinetobacter baumannii
ggcctttatatgcttgaattcttttctcgattaagcttagtcactaaaattattatcgccattattttagggataggcgtcgcactattatttccaaccgttacgccgtacttaagcttgtttggtgaactatttattaaagcattaaaatcggttgctcctattttagtctttgtactggttctctcatctattgccaacttccaagtcggtcatagtgcaaatttacgcccagtattactactctatgtagtaggtatgttattagctgcttttagtgctgtgatcgctagcttatcttttcctagcaccctttatctcaacactgtttctcataataatttgcaagcgcctggtagcctcgctgatatattaaaaaatctgcttttaagttttattgcaaaccctgttcaagcaatcagtgaagcgaactttattggtattcttgcgtgggcaattggtctcggcttagcaatgcgccatagctcggatacgaccaaacaagtaatgcaggatgtttcacatgctgtaagcgctattattcataaagtcattgcgtttgcacctgttggtattttcggtctagttgcagtaacttttgcagatgctggactagcaacacttgaaagttatgcacaattacttgctgttctattaggaacaatgctgtttgttgctctagtgattaacccaattctggtaggtttaacaattcgcggtaatccctacccattagtatttaaatgcttaaaagaaagtggtatcacagcgttctttacacgcagctcagcagctaatattcctgtaaaccttgatttagctgaacgtttaggcgtaaatccttcaactgcgagcgtttcaattcctttaggtgctactgttaacatggctggtgcagcagttacgattactgtacttactttagcaactgtgcatacgttaggaattcatgttgatttggcaacaatgattattttatctgttgtagctacaatatcagcatgtggtgcatctggtgttgcaggtggttccctacttctaattccagtcgcatgtagcttatttggtatttcatcagaaattgcaatgcaagttgttgcagtaggtatgattattagtgtattacaagattcaacagaaacggcgcttaactcatctaccgatgttttatttacagccgcagttgatattcgctcaagacaaaactcatag

SEQ ID NO: 3666 - DNA, 435 bp, Acinetobacter baumannii
gtacgttatatgattaacatcggttcttgtttatgccataaagtaaaattctctgtaccttgtgaaatcaaaacggtttatcactgccattgcagcttatgccgaaaacaaacaggtactggagcgaatgccgctactttagtaaaagaaaatcagtttaattggttgatgggtaaggaatatgtggctacctataaaaaagaaactggttttacttcatcattttgtaatagatgtggttcgcctgtccctaataaaattaatggtacaaactatatgtggataccgttggggcttctcgaacaaccgtttaaaccagatttaaaacttaatttttgtatagagtcaaaacatgattgggttgtgttaggggatgctcataaaaactttgcacatttacctgagttagaagagtttttaaaatattttgaataa

SEQ ID NO: 3667 - DNA, 801 bp, Acinetobacter baumannii
gcttttaatatgttattacttgtcgttgaaggcattgtgattggctttttacttggtcttaccggtgcgggtggtggcattcttgctgtacccgcgcttatgaccagtcaaggctggagcgtggcgcaagctgcgccaattgggttattggcggttgcgctatctactctcataggaaccattgaaggcttatttaaaaagattgttcgttatcgtgctgcgatctggattgccttaattggtgctcctatggcacatatcggcattttaatagctaacacgatttcacctatttggctcatgttaatgtttagcttggtcatgtttactgtaggctatcgacttatcagtaaccgtgtttcggattttcataacccgccgtgtcaggtcaacccaagtacgggacgctttatctggaattttaaaactggtggtgtgcttgcaagcatcgggattattgctgggcttttaactggtatgctaggggttggaggcggctttgtaattgtacccgcgcttagaaaagtcacaaatttggatatgcatagcattgttgcaacctcacttatgattattttcctgattagtggcatgagtattgtgatgcatattgcagagggctttcactatccagtcgccattactagtgcgttcgcgctcgcatgtgcattcggtatgttattaggacgccgagctattcggtttattccgtctgcaattgtacaaaaggtctttgctttaatggtttttgctgtcgcaatttatatggttattaagattgttaatctaacaaatatctga

SEQ ID NO: 3668 - DNA, 408 bp, Acinetobacter baumannii
tcatctaatattttatccattatgtctattcatccagatccacaaatcaatcgtttaaatgttttaggtgaacccttagcaagctgttgttttgaccctattactggttacttccggaatggtttttgccatacagccgtaacagatcttggtcaacatacggtgtgcgcccaaatgacttctgagtttttaaatttttcacaaaaagtcggaaacgatctgatcactcctctacctgaagcaggcttccctggcctacaaccgggagacttttggtgcatttgtgtaactcgttgggtagaagcttatcaagctgctggtcaagcaccccctgttaaacttcatgcttgtcatcaagctgtactgagctatgttccattagatgtattaatggaatttgcagtgtaa

SEQ ID NO: 3669 - DNA, 348 bp, Acinetobacter baumannii
gtgatcaatatgccacgtattaaagtacttcctcacgctcaattttgcccagaaggagcagaatttgaggttgaacaaaatgcaaatctttgccaaagtttgctcaacaaaggaatcaaaattgaacatgcttgtgatatgtcttgcgcatgcacaacttgtcatgtgatcgttcgtaaaggctttgatagcttagaagaaatgaatgatgttgaagccgatcttctagaccgtgcttggggattggaacctgactcacgtctttcatgtcaggtgaaagttgtagatgaagatcttgaaattgagattccgaaatacacaattaaccacgcttcggaaaatcactaa

SEQ ID NO: 3670 - DNA, 1665 bp, Acinetobacter baumannii
ggtggcaatatggaacttaaacgagttaatcaagaattttatgttgctgaccagattactgctgacgatatcgcaaaaattgcagaccaaggaataaaaactctgatatgtaaccgtccagatggagaaggtgcagaccaacccaatgtgattgaaattgaagaagcagctcagcgacatagcctaaacgtaatctatcagcccgttatcagtggcaaaattactgatcaacaagttaccgagtttaagcagctttatcagaatgctcagaagcccgttttagcatattgtcgctctggtatgcgtgcaatcagtttgtgggctttggctgaagttgctccacaagatgcagcactgttagttgagtcgggtaataagcttgggtttaacttaaaaggcttagtgccacgtattttaaaacgtgatcatgaaccagccacaattccttgttatagcgttgtgattgttggcgctggggcagcaggaatttctgtagcgtctagtcttttatctcgtgaacctcatttagatattgtcattattgatcccgcagatacacattattatcaaccgggctggaccatggttggtggcggtattttcaaaccacaagtaaccgcacgctcaatgacaagtgtgataccttcaaaagtaaaatggatgaaagctgcggttgctggattcgacccagagcataatcaggttattttggaaggatgccaacctattcaatataaagctttggtcgtgtgtcctggtttaaaactcaattggcatggcattgaaggcttagttgaaaccttaggtaaaaatggggtgacgtctaactatcgttatgatttagcgccgtatacatgggaactggtgcaacagctaaacggtggaaaggcaatctttacccagccacctatgccgattaaatgtgccggtgctcctcaaaaagcaatgtacctttcagcggactactggttaaagcaaggcaaacttaaagatatctctatccatttttataacactggtgctgttttatttggtgtgaaggaatatgtacctgcactaatgcaatacgttgaaaaatatggcactgaacttcattttaaccatcaacttgtcaaagtggacgggtctgcaaagaaagcatggttcaaagtggtgaatgatgaaaatgcagcattggtcgaaacagatttcgatatgttgcatgttgttccaccgcaacaagcgcctgattttattcgtgcaagtactcttactgatgaagccggctgggtgagtgtgaatcctcaaaccctacaacacacacagcacgccaatatttttgctttaggtgatgtgatgaatgcgcctaatgccaaaactgctgctgctgcacgggcacaagctccgatcgttgcggttaatgttatagcccagctcaaaggtgagcaaaacttctgcgagtacaacggctatggctcatgtccactcacagtagagcgtggaaaaatcgttctggctgagtttggctacggcggcaaattacttccaagttttccaaaatgggtaattgatgggcaaaaaccttctcgtttggcttggctgcttaaagagcagattttaccgccgatttactggcaaggcatgctcaagggccgcgagtggatggtcaaacctgagcgaggataa

SEQ ID NO: 3671 - DNA, 1455 bp, Acinetobacter baumannii
acagaggatatgtgtatggaacgctcttctgtgtccgcagctcaaccttatgagcaaagtttacaacgctacgtacttctgacggttatgcttggtacaggtacggttagtttaaataacagtagtttcaaccctgcaatacctcatttaatgtcctattttcaggtaggtgaggtatgggcaagttgggtagttgttgcctttttattagcaatgagtatcagtttgcctttagctggattcctaagccagcgttttggtaagcggtcaatttatttaattgccttattgggatttgctttggcttctacagcaggtggtttatttaatcagtttgaatcggtgttgattgctagagctctgcaaggcttttgtagcggattaatgattccattatctcttggactaattttttcagttacaccaagtgaacaacggggaagtacaacaggattatggggtgccatgatcatgctaaccttagcagttgggcctatgctcggagcactggttttggtatggcttaattggaaggccttattttttataaatttacctgttgcttgtctagcattaattttaggctatgtttttctacctaaagagcaaggggacaataagcaagagtttgactgggcaggcttcttttttctcggttcaagcatagttttattacttgggacactgagccaaatccatcaaattcaggacttatttcaacctctatatggtgcgcttttagttctaagtgtactgctttttataagatttatttttgtacaaaagaataagtctatgccattaatcgagccagctttgtttgctacgaagggttttcgctacagcttagtcatttgtgtggcacaaacagtaggcttatttattggcatgttgctcattccactatggatacagctccttctaaagttaagcccgctttggactggttttgcgctaatgagcagtgcagtagttaccggtatttgtagtcaacctgccggaaaatatctagatcgttacggtgctgcaaaaatcatgtctcttggactaatgattactgtggcttcttttcttttgcttgcttgggcacctatacaaaatgtctggttcattgtgttttgtatgatattacatggcttaggaatgggactttcttatatgccatcgactacggcaggtttgaacagcttacgccagcagcaacagcatctagttactcaagcggccgctctaaataatttattccgacgtatttttgcagcagtggcagtcgttattgccgcgttatatcttcagctaagacaacaatcattgccgttaaatactcaagcaatatttacatcatttcacactatgcaggaaatctttgtgtgttgtgcaattcttatactttgcactttgcctttcgcatggcgttttcctgaacagtacagaatcgaccaattaaagaaatag

SEQ ID NO: 3672 - DNA, 480 bp, Acinetobacter baumannii
tgtgatagtattagccattattgtttattgtcatttataaaagatatgtttagtttgcatccacaacttgctcaagatactttttttgtaggcgatttcccgctttcaacatgtcgtttaatgaatgatatgcaatttccttggttgattttagtaccacgcgtaccaggaatcacggaactatacgaattgagtcaagctgaccaagaacagtttctacgtgaatcaagctggttatctagccagttatctcgcgttttccgtgctgataaaatgaatgtagcagctttaggtaatatggtgcctcaattgcatttccatcatgttgtccgctatcaaaatgatgtagcttggccgaaacctgtatggggtacaccagctgtgccatatacaagtgatgttttagctcatatgcgtcagactcttatgcttgctctacgtggccaaggtgatatgccttttgattggcgcatggattaa

SEQ ID NO: 3673 - DNA, 804 bp, Acinetobacter baumannii
ataaaaagtattagggttaccatggctcaaattattgcgattgcaaaccaaaagggtggtgttggtaaaacaacgactgcagtaaatcttgcagcgtcactagctgtattgaaaaaacgtgtgctacttgtcgatatagattcgcaaggtaatgctacgatggggtctggtattcaaaagaatgatctactttactcaattacggatgtgttattgggtgaagtgccaatcgaaacagcaattcaaaaagctgaggttggatataaagttttgggttcaaaccgtgaactttctggtgtcgagcttgccattgcagagcaagaaggtcgtgagttcattttaaagaatgctttgaatgaaatccgggactcattcgattacattattgttgattgtgcgcctagcttaagtttaattaccgtgaatgctttagctgcagtagatggtgtaattattccaatgcaatgcgaatactatgcattagaaggtttggcagatttaactcaaacaatcgatcgtattcaaaaagcgttaaatccagatttggaaattattggtgttttacgcaccatgtatgatgcgcgtaatgccttaactcgtgatgtatcagctgagttagagcaatattttggtaagaaactctacgacacggtgattccacgtaatgttcgtttggctgaagctccagcacatggtttgccagtgatttattttgaaaaaagttcgaaaggtgcagttgcatacttaaatcttgcggctgagatgttaaagaaaagtaaagtgaagaaaggaagtaaagtatga

SEQ ID NO: 3674 - DNA, 492 bp, Acinetobacter baumannii
actcacatctttcaattaagggttgcagttatggctgaacaaaatgtcatcacttctatgctagacgatttatcaaacgaacagcctattcatactgcactttgtattggccagaaaattgaccagaataacgcaattcaatggcactattttaccgtaactgagctgttaagtctgccttttactcagcgttatgatttgggttttgtattgtttgatactgatgaaatgcaggacatcagcgatgtgcagaaatcacaattattagtaaagctaagagatttattagcaaaacgaattgttgtcgtgagcaaacgcagtgatgaacagcttctgcgttctttaggttttacccaacttattgataagacttcacatgatagtgattttgctttatggcaatttaatattttgacctataagcatgtaccagactggtttaattcaaaattttgggcaaatccggaaaattggaataaattccgttggtaa

SEQ ID NO: 3675 - DNA, 453 bp, Acinetobacter baumannii
ggaactttcatgcgtaatgtaattactatacaaaaagaatttaatgctcctcttggtgatgtctttaacctgctttctaaacatgcagcttacaacactgcgtttgctccactacaagttgtgcgtgttaaagattcagcagatcctgaaagacctgatggagtgggttctgttcgtcgtatggggtttggcgtgattaaaccacttaaagaagaaatcacgcatctcgaagaaaacaaacgtattgaatataaactgattgataatcctctagtgaaacaccatttaggtcgaatcgagttctcagaaattactccttatattactttagttacgtatcgtatcgaattaaccgcaaaagctcctgttgtaagtaaattaattcttgcacagctaaaactagcgattacactaggcttttcgagattagctaaagcatttgcttcttcgtga

SEQ ID NO: 3676 - DNA, 600 bp, Acinetobacter baumannii
gagttactcatgacaaatttaagcaacattgtagaagttttggctaagcaagctttaggtgggaatcagcaagcgtcaggtcaaggtggtttaggtggaatgttaggttctgtattaggacaaatgggtggtaacacttcatctggtgcccaaggtggtcttggtggagtattgggttctgtattaggacaagtcactggtaataacaacacacctcaaactggtggtggtgtacaaagtttattaattgcagtggtacctttaatcttaggttgggttcagcaacaaggtggtttacaagctgctcttgagaaattaaaaggcgctggcttaggtagccaagttcaaagttgggttgatccaaaccaaagtaatagtgaagttccgacccagcaattacaaagtctgtttaatccagcagacattgaacaagttgctcagcaagctcaagcaccaaaagaacaagtttatggtgcaattgcttctgtcttacctcaggtcattgattctttaacacctcaaggtgagagtacagatcatcaagaagctaaccaagatattcaaaatgtgatgaatcttgtaagtggtttcttaaaataa

SEQ ID NO: 3677 - DNA, 390 bp, Acinetobacter baumannii
ataaaactcataagtggggtgcctatgcgttatattctaattgcattactcattattgtatttggctattctttagcacttgttttgcagaacccaacagaacttcctgttgatttattatttactcaagttcctgcaatgcgtttaggtttattattgttgcttaccttggcgcttggaattgtggttgggcttttattaggtgtacaagttttccgagttttccaaaaaagctgggaaatcaaacgtctccgcaaagatattgatcatttgagaaaagaacaaattcaaagtgctcaattggcggcagcagaagcagctgcaaatgtaagacatgaaaaaactgttgtagatatttatccgcaagataaaaactctactcctttataa

SEQ ID NO: 3678 - DNA, 1833 bp, Acinetobacter baumannii
ataaagatcatcatgaccgaaaatttaaaacaaaagcttaagcactgtagtgtcggcctattctttgccggaatggctttaacgggttctatatctatttttgcgaaaagcccagccgatccaaataaagttttgcgttatgtattcccaacagctgaaacaggcttcgacccagcttatgtacatgacttatattcagcgcatgtactcacatctatatttgaaactttatatacctatgattatttggcaagaccagcaaaattaatcccacacgtggctacggctatgccagaagtgagtgcagatggtctgacttataccattcacattaagaagggtatttactttacggccgacccagcgtttaaaggtaaacctagagagttaacagcttacgattatgcatattcttttaagcggttattagacccaaatttacgctcacccaatagttggttattggaagataaaattgaaggtatgaatgctttagtcaaagcagccaataaatccggaaaatttaattacgatcaaaatgtaagtggtttacaaacacctgataagtacactttggtgattcggttagtaaaaccagactataactttcctttattactggcccatgatccgacaggtgcggtggcacgcgaagtcatcgagaaatataaagataaagccggttttgttatggggcatccggtaggaaccggaccttatatgctcagtaagtggatacctgcctcacgtattgttttaaaagcaaatcctgaatatcgaggttttacctggaactttaatgccagtagccccggggatgaagcaattgtaaagcgccttaaaggtaaacaaatgcctcaaatcggcacaattgatattcaggtcatggaagaaaaccagtcacgatggttagcattccagcgtggtgaggtagatatcattcagcttgaagggcaattagtttcaaaagcgattaaagacggtaaattaagacctgagctcgcaaaagaaggcgtgcaattatctcgtattgttgatccagaaattagttatatctattggaatctcaaagatcccgttgttggaggaatgagtaaagaaaaaattgccttacgccgtgctattgcgatgtcccgttcaatagatcaagagattaaattggtaaggaatagtgatgcagaacgtcttcatttcccagttccacctggtgtagtgggatatgacccacagtatagaagcagtacgccatattcagtaaaagcagccaatctgctgttggatcgatatcactacaaaaaagatgcttctggttggcgtacacaaccaaacggcaagccgctcgtggtcgaatataaagcgcgcaatgacagtattggccaacaaagtgctgaactttggaagaaaaacttcgatagcttacatattcgcatggtgtataagccaatgcttttttcagacttacttcgatcacagaaacaatgtgagggaatgtttggttcttctgcatggatcgctgattatccagatggggataattttatgcagaatttttatggcccaaatacccatatgactaactggtcttgtggttcgataccagagtttgatgagttgtaccgccagtctcaacaagtgaagccaggcccagaaagagatgcgttatatcgaaaaatgacgcgcttgttagaggtttatatgcctgtgcaaatgtcttatgcacgctatcgcaatatgttggcccaaccacgaattattggatataagaagcatccgattttacatgctgaatggatgtacttcgatattgatacaaatacgaaatctaatcattaa

SEQ ID NO: 3679 - DNA, 837 bp, Acinetobacter baumannii
ggtgcggtcatgagtttaaaacaccctcttattcgatatcacggcggtaagtttcgaatggctgaatggattattcgtcattttccaactcatgaaacttatgttgaaccttttggtggtggtgcttctgtattacttcaaaaagcgccaagccgtgttgaagtctataacgatcttgatagtgatgtagtcaatttttttgaagtgctacgtgatcagcagcttgctgaacaacttgcaattcaaattgagcatacaccttattcacgtacagagtttttaaatgctcgagctgacgcaacagacaaagttgagcgagcacgtcgcttagttgtccgcgctcaaatgggttttggtagtgcaggagcgactaaaggtaatacaggctttcgattagacacagctcgaggtggtagtgacatcgttaccatttggcagcgtcaacctgaacttgtacttcaagctgctgcacgtttaaagaaagttcttatcgaaaatagagatgccattaaggtcattcaagatcatgacagagcagagactctattttttgtagaccctccatatgtgatggatacacggtcaattggctgtaacgcttatcgatatgaaatgtcgaatgatgaccatgaaaacctaatttctgttctaaaaaatgtaaaaggcaaggtcattctttgcggttttgagcatccaatttatgaagcattgaattggaaaaaaattactaaaactgttgcagcttccggacaatctggctccgttccaagagaggaggttctatggattaacccccaagctgaaaaacagaatgatttgtttagtgaggtggtatga

SEQ ID NO: 3680 - DNA, 453 bp, Acinetobacter baumannii
atgcgacccatcgaaataataaaagtagtaaacagctttttatcttttacttgctctgccttcattattggttttttcttttactcttttgttggcaccgaaagctactataaatataaggatatcgtagatttttataatctttttgtttttctaattaatctgatactgctgataattgtatttaaatacggtaatcttttatcagaacgtacatttgattttttagagaatgaaaaaatagaagggctaaaatcaggcaactatattgggctgttgcttttaagtgtttttaatattttattattcaatcctattttttctttttcagaatattttgataaaggaggagacaatttaaatgtcgcttatttggcaatgagttgttctctttttttaggtgctgttttactgtacacatctaggcaacaaatcaaaaaattacatgaatag

SEQ ID NO: 3681 - DNA, 1173 bp, Acinetobacter baumannii
gttattaccatgacagaagctttaaccgttttaggcggtattactgctgaacagtttttaacagagtattggcagaaaaaaccattacttgtacgtaatgctatgcctgaaattgtgggtatgttagagccgaatgatgtaaaagaactcgctttagaagaccatgtaactgctcgtcttatccgtcaaaaagataaaaatccaaatgaatggcatgtaaaatcgtctcccttaactaaaggtgattttcaaaaactaccaaagttatggacacttttggttcaagcagtagaccattattcatttgatatagctgaattgtggaagaaatttccttttattccgcaatggcgccgtgatgacattatggtctcttatgccccaaaaggtggttcagtaggaaaacattttgacttttatgatgtttttcttgttcaaggatatggtcatcgacgctggcaactcggccaaatgtgtgatgcaagcactgaatttgtacctaatcaacctttaaagttgctaccagaaatagatgttcattttgatgaagtattagctcctggcgacttattatatgttccacctggattatcacattatggcgttgccgaagatgattgtttaactttctcctttggtttccgtatgcctaatatttcaggcatgatcgatagaattagcgatcaatttgctactgatgaattacttcaaaatcctgttgtcgatattacccgtaagaatcctcctcaaattggggaaataaacacggaagagttggcttatttaagagatttagtgctagctcaattgaaaaattcaacagtacttgatgctgccctcatgtcgtacatgagcgagcctaaatatccagacaatattccagaaccagatgaaatagaggtggaagacctaaatgctattttgtcagatggctatgagctgctactcgaacctgcttcgcgtctactttatacagaacaaaatggcgttttaaagttttggggtaatggagatgaattaccgattgtggaatcttttgccacccaactcaaatcgattgccgatgggaaaagcattcctttcaatagtgagcttaacaatacagatattttagaaaacattgttcaattattgaataattcaattcttatgttgttacctcctgcagagtaa

SEQ ID NO: 3682 - DNA, 255 bp, Acinetobacter baumannii
tttgttaccattataaacgttggagttttcatgattcatttaactgaaaatgctgcgactcatattagcaattaccttaaaaatcgaggtaagggtgaaggcattcgcgttggtgtgaaaacttctggttgttctgggttggcttatgttctcgaatttgtagatgatatcgatgaacatgatcaaattttcgaacaattcggcgttaaggtttttgtagatcctaaaagcttagtttacttagacggcttataa

SEQ ID NO: 3683 - DNA, 501 bp, Acinetobacter baumannii
ggtgtaaccatgtcacaagaactacattttgctgtatctcagtttttgtacaaaaaggcagagctttgtgatgcttatgactgggatgcctacctagagctttacgatgaagatagtgaatatcatattccacagtggattgatgaccataattatgttcaagatccaaatcagggcttgtcttatatttattatgcggaccgtacaggccttgaagaccgtgtattccgtattcgtaccggaaaagcagcctctgcaacgccattaccacgtactttgcacagcataaacaacatccgagttaaaacattggatgatggattaattgaagcaaaagttgcatggcaaacgctttataaccgtcaaggtttagaaggctgtttttacggacacgctacttatcttttacgccaaacagcagatagtttccgtattcgtcgtcagcacagcattttgctgaatgacaaaattgattccgttttagacttctatcacgtttaa

SEQ ID NO: 3684 - DNA, 861 bp, Acinetobacter baumannii
ggtctctacatgtctgctgatacccaacattttaccggtacagatcaatatatcgcgactgatagtcttaaacttgctgtaaaagcagctcgtgctttgcaaaagcctttattggttaaaggtgagccgggtacaggtaagactttacttgccgagcaagtggcagaaagtcttggtttaaaactcattacttggcacatcaagtcaacgactaaggcacagcaaggcttatatgaatacgatgctgtgtctcgtttgcgtgatagccaacttggtgatgatcgtgtttatgatattaagaactatattaagcccggtaaattgtgggaagctttcaccagtgaagagcgctgtgtgcttttaattgatgaaattgataaggcagacattgaatttccaaatgacctgttacatgaactagataaaatgtctttttatgtttatgaaacaggcgaaacaattacggctactcaacgtccaatcgtaattattacttcaaataatgaaaaagaattaccagatgctttcttgcgtcgctgtttcttccattacattgagttcccagatgaagcaacgatgcgcgaaattatctcggtacatttcccgaatatctctgcaactttggtaaatgaagcgcttcaagttttcttcaagctccgtgaaattcctaacttgaagaaaccaccatctacatctgaactgatcgattggttgagtctgcttatggcagatgatatgcctgaagatgtactacgtaatcgagatacatccaaagctattccacctttgtatggcgcactcattaaaaacgaacaagatgtgcaactgcttgaacgtttggctttcatgtcgcgacgttaa

SEQ ID NO: 3685 - DNA, 1701 bp, Acinetobacter baumannii
gcggctaacatgactgaagacgatatcagagcgctgaaaaaacggtttgatgcagtttggcaaaatcgtgtcaatgatatggacgaccattgtgccgaattagcattacacgttttgcctgttgctattaaaacgattaagaaccaagaaaagcatgaccgatctgcatggtccaaaattgttgataacacaggtaaagattcgcttaagactcttgcggcgggcatggtatcgggcacatgttcaccgagtcgcaagtggtttacattgcaggccgccgatgaagcattgcaaaaagatattgaagtaaaacaatggcttaaagctgttgaggatgcttgctatgttgcttttgcaaagagcaatgtatatcgggcggtacatcatatctatacgcaagaaggggcttttggaatcggtgcggcattagctcctgatcatgggccaaattcaaaagctcaaccaatggacgttatcccaatgacgttcggcgagttcgcaataactacggatgagttcaataaacccaatggcattttccgcaagttcaaactaaccacactcaatatggttaagcagtttggactagaaaacgtttctgatgctattaaaagcgcattcgaaaataagaactttgaacaagagtttgaagttcaccatgcagtttatgaacgagtagatgcaaaaggatatggccctaaaaacatgccttatgcatcgatctactacgaaccaagtgcaacaaacaagttactacgtgaaagcggcatgatgagctttcaggttatttgcggccgttggacagtatcaagtagcgatgtgtacggtgaaggtccagcaagtgattgtattggagacttacgcgcactacagaaagggcatcagcaaattgctgtaggcgtggactaccaagttcgaccacctttgcttttacctgattacttaaaaggccatgagcgcgagacattaccaaatggcattgcgttctatcaagcgtcaccgacaagccaagttgcacaagttcaagcaatgttgaatgtgcagttcgatttgaacggcgttatggcacagattgcacaatgccaagagcgtgttaaacgcgcatttcatactgatttgttcttgatgctcgatgcttttgataaaggaaaaatgaccgctaccgaagtgtacgagcgtaaatctgaaaagatgctcatgcttggtccggttgttgaacgtcagatcgatgaactactacgtccacttgttgaaatctgtgtgcaacgtgtgctttcacggaataagtaccttcaacaaattgcacctgaagctattcaaaacgccgatgttgaaatcaatttcgtatcgattcttgcccttgcgcaaaaagcttcaggttctgccgtccttgagcgtgccttagcgatggttggacaagtcgcacagattgacccgcaagtgctagataaattcgatacagataaatttatcgatgagtacatggatattaacggcgtatcgcctaacgtattcagaccaaaacgaataattgaccaaatccgtagcgaccgtgcagcacaacagcaaattgcacaacagcaagctttagaagctcaacaagcccaaactcaaaacacaaatgccaatacggtgaaaacggttagtgatactgacgctgaaactgtatctgacttgttcttgcaaggtggtgcggcatga

SEQ ID NO: 3686 - DNA, 702 bp, Acinetobacter baumannii
ggttgcagcataatgaaagcaatgattttagctgctggcttgggcaatcgtatgcgtccactcacactatatacaccaaagcctctgcttgaggtagggggtaagccacttattgtgtggcatattgaaaaacttaagaaaatcggtgtgaccgaaatagtcatcaattctgcgtggttagcagacaaactcatcagtagcttgggagatggctctcaatttggtgtggatatccgttggacacgagaagaagaagggctggaaacagctggcggaattattaatgctttgccactgcttggaacagatcctttcattctggtgaatggagatgtatggactacaatggattttgaagctctacgccatattaagttaaatgatgatttggcacatcttgtattagttgataatcctaaacagcatcccgaaggcgactttacattattaaatggacgcgcttttgcgtttgatcaagatgtgaagggcgagaacctcacgtttagtggtgtatctgttatccatcctaagctttttgatgggttggaagccggtaaacgtcctttagccccactgttgaagcaagccatgcacaatcaaaaaatatctggtgaaaagcttaaaggtgcatgggtggatgtgggaacgcctgagcgtttaatggagctagatttgcaaattcgtgaaggcttctacgattaa

SEQ ID NO: 3687 - DNA, 891 bp, Acinetobacter baumannii
agtatgagcatcaaaaaacgcggattggcgaaaggtcgtggtttagatgcattacttggttcaattcaaaaagaaaaattacaactagaagctcaagcgcttgatcatggtcagttaaagcaaattgacgtgaagttgttgaaacgaggtgaatatcaaccacgtcgttttatccatgagcatgatttgcaagagttggcatcctctattgaaaaacatggggtaatgcagccaattgttattcgtcctgtagatgatgaagctcatccttacgaaattattgcaggtgagcgtcgttggcgcgcagctcaaattgctggcttaacggaaatccctgcaattgttcgtgatttaaatgatcaggttgctattgctttagcacttattgaaaatattcaacgtcaagatttaaacccgattgatcaagcgttggcgctacaacgattccatgatgaattcggtttaagccatcaagaaattgctgatacagtcggtaaagcaagaacaacggtaagtaatttattacgtctgttgagcttggctgatgacattaaagaatttatgcagcaaggccagcttgatatggggcatgctcgtgccatcttaactttaaagggcaaagaacaacttgaagttgcaaaaattgtaattgagaaaggattatctgttcgtcagactgagcagttagtgcgcgattggaacgagcctaaacaggaaaaggaaaaagctcctgttgcaccagacattgagcaactaactcagaaattatcagaacgttttggtgccaatgttaaaattgatcataaccagaaaggtaaaggtaagcttgttattcactatcattcactcgatgagttagatggtattttgaatatttgtttaccagattaa

SEQ ID NO: 3688 - DNA, 828 bp, Acinetobacter baumannii
aatacgagcatgaaaactgaatacttaagacgcattaacttgcgcaaagcgatagacacgatacggcttagagataagttgaaatcagatgcagctttttgtgatcaatttggattaacaccaagtcatatttcccagatgattcgtgggaaaggtagctttggtgaaaaagttgcacgcgacttagaaagccaaattggtttagcagagtattatcttgatcaaaatcatagttttccgatggatgatgattttcttgaaaaagtttttggtaaagaatataaagaaataaagttaaacgagacttcaaatcaaagtgatagtaataactctatagaacttatgatctatgaagatggtgatccggtacctgatggatatacagctattgattactatgatgatgtttttgtaagtgcaggaaatggatatttgaatttaatgcagccaagcgctaaaaaattctttgttccgacatatttaatgcgtgaatgtaatgttcaaccttcaacagctaaagttgttaaagtccgtggggatagcatgtttccagtgctacaggatggacaacctatttcagttgatatgtcagcaaagagaattattgacggtgaaatttacgctttccaagttggtgatgaaacaaaaattaagtatttatctgtatggaatgatgaaggaaaaggtggctttaaggctacatctgcgaaccaggataaaaaccgatatccagatgaatattactcccctgcaagaattgcttctgaaggggttgaaataattgggcaatattggatgaagttggataccaaaaaaattaaaagataa

SEQ ID NO: 3689 - DNA, 1242 bp, Acinetobacter baumannii
agagcattaattatgaagttgcaaggttccaatatattgggacaggaacaaatagatttattaaccacacgcggattaaatttcgtatggtttccaaagcaacttgaaacgatatatcgttttcaatatcaaaatggtgcagcctatgagtttcgctatagagcacctattattttaatattatatttatttttaagctttggtatataccaagttttaccaaccgaacaagttttatcctggttaagctattattcttgggtaggcataattgttttaatcgcctggattttatcatttattaaaaaattaaatcagtggtttgattattatgtcggaattggttcttccgctgccgttgccataacatttatcttaattaacgttttagaaaatggccaagataatgtactttttcatgcagcaatgatgtatgccattgtgattatttatggtgcggtaggcatgcgtttttatactgccattattgcaggatgggtcggcggtcttattggtattttggtaagtacctatttgaacggagacatagactggaccttcttgaaccgtacatatacgtttagtagtttcttaggcatgacccttgcctatgctacggaccgtcagcaccgtgaaaactatttacaaaactgtatgattgagcttaaccgtattgaactcatgcaacaagctcaacaactgtcactgctttctcaacaagatgctttaaccgggcttgctaaccgacgttatcttgatgaaacacttgataatgaatggcgacgcgcattacgccatgagactcctcttactattatgatggttgatatagacttctttaaaccatataacgatagcttaggccatctcaagggtgatcagtgtttaaaagatattgcgactgcaatttcctcaattgctgctcgtagtggcgatttggtagcccgttatggcggtgaagaattcttacttctattcccaatgacaaatgcacaacaagccaaaattcaggccgaaagattaatgaatgcaattaagaaaattgctattgttcatccatgtagtagtgtttcaccatacgtaactattagtgttggcgtggcgaccacaattccacgtttaaatgattcaatttctgcttttgttagtcgtgctgatcatgcgctctatcaggcaaaaacaaatggccgcaatcaatatcaaattgctttgaatgaagaacaaattgtagatctaacttaa

SEQ ID NO: 3690 - DNA, 294 bp, Acinetobacter baumannii
aaactactaataattagagatataaatatgacgaataattttaatgctgaacaggcaagaaaaaatgcgaaagacgtaaaaatagatcaagcactattgttagaaaaaattttatctggaaccgaggaaatctcgaaagaaggtaagcgacgggcagtttttcaatttccaatagatgctttgcatcctgaacatatcacacaggtagaggaagagttaaaaatacgatgttttaatgtttcaaccaatattgagcaatctggtacaacagtcaatattgaagtcagtttctaa

SEQ ID NO: 3691 - DNA, 1305 bp, Acinetobacter baumannii
gacaccataatcatgacaaatatgatcaataaagcccaagggttgggtttatcgctgatcacaaaactagctggaagcgatgtacttgatcaactcaaactacgtaaatttcttgaaaggtctctttaccaaggttcaaaagctggttttagagcattaagtcagactcagaaagcatttaaacctaagcaaattccccaacaacgcctgcctcaacagaagaaaaacctatttgatttaagcctaactgaagaacaacaaatgacttcagaggcaatgtctcaatttgctcaagaagttttattgggattagctcatgatgctgatcagacagctcaatttccagaaagcctttggcaatatgtagaagatttaggattaaactattacgctcttccagaagcactaggtggtgtcgccgctgaacaaaatattgtaagtaacttattgattgctgaaaaactagctgaaggtgattttagtcttacagcagggctcttaagtacgtttagtgttattaatgccattacacgttggggttctactgaagttcagtcaatgtatttaccttgctttgcagaagactccgatattaccgccactttcgctgtacaagaagctactccagcatttaacccttatgttttaaaaacaaaagcttctcttgaaaatgatcaatattttatagagggcgaaaaaacattggtcattttaggagatttggctgatgtgttcttggtgagtgcagactttaatggcaagccggatgtatttgtagtacaagctggcgataccatttctattaaaagtactcctgctatgggtctcaaagcagcagagacagctacattaaaattcagtcatacacctgctctacgactaggtgcaacagattttgattacaccgcctttttagatttaggcaacttaatgtggtgtgcaatggctgtaggaacctgtgaagcagtaaaagcctactgtattaaatatgccaatgagcgaactgctttcggagaaccaatttcacatcgtcaaagtgtcgcattcatgatcgcagatatggcaattgaaattgatgctatgcgcatgctaattctaaatgccgcaagtcttgccgaagcaggtaaacctttccatcgtgaagcatatttagctcgtcttctttgcgcagaaaaatccatgaaaataggaacagatggcgtacaaattttaggtggtcatgggtttacaaaagaacaccctgttgaacgttggtatcgtgatttacgcgcaaccgcaattttacattctggcctacatgcttaa

SEQ ID NO: 3692 - DNA, 996 bp, Acinetobacter baumannii
tttttaataatcaagataataaaggaaaaggatatgcaattaacggaagagcaattactcacagcatataaacgcatgcgtgatattcgtgaatttgaagatcgacttcatgaagaaaataccaatggtgatattccaggctttattcacttatatagcggagaagaagctgtagcagtcgggatttgcgaaaacttaaccgacaaagactatatcacttcaacacaccgtggacatggacactgtattgcaaaaggctgtgatattcacgctatgatgctggaaattttcggtaaagatgacggactatgccgtggaaaaggcggttctatgcatattgccgatttagataaaggtatgctcggtgccaacgggattgtgggtggtgggccccctttagcaattggtgcagcgttgacagcgaaaactttaaagactggtggcgtcggactgtcttttacaggtgatggtggttcaaaccaaggccttacttttgaagcgatgaacatggctgttgttcttaaacttcctgtgattttcgtttttgaaaataacggttttggtgagggaactggtcatgattacgctgtaggaagcaaagacattgctggtcgtgcagcaggctttggtttaccggcagttaaagttgacggtacagacttctttgccgtctatgaagccgctcaaactgccattgaacgtgcacgtcgtggtgaaggtccaagcgtgattgaaaccattacaaaccgtttttatggccacttcgaaggtgatcctggcttgattcgttctaaagaagaagtcgagttcatcaaagaaaataaagatcctttgaaaattttccgagaaaaagtcaaaggcaaaattgatgaagccaaactagacgagattgatgcagcttcaaaggcaaatgttgatgatgccgttgctaaagcccgtgctgcggcatatccgaaaccagaacaactccttactgacgtctatgtctcttactaa

SEQ ID NO: 3693 - DNA, 552 bp, Acinetobacter baumannii
acagcatccttattcaactgtaaaaggggaatgatgatgcgtgaacaatttgaaagcttgcctgaaattaaagaaatactaggcagtctacatccaacaatcatttggtttggtgctgacagcaaataccacacaagtttttcaggctttgacaatgcagtaattcgcctaaacggtgcatgggatatttacaaaagatgcttaggtcgaacaatgacgcatgtacaaaatgaaattacaaagcacctaaaagatcagtcaagcaaggtacacaacacttcatgcacttatcaatttgaacttgcatttcatcgcctgcaagacacgcctgagctacgcaagatttattggtctgctttaggtcaattgcaatttgattctaatgatcaggttatcccaccagagcttgaagagtgcccatgttgtaagcaaccgatcattcgcaaaatcggcactgagacggcaggctatgagacctatgacataggcattgatgaaagcggcaatagatatatacgccatccacattgtgaatgggagcctgaagaatga

SEQ ID NO: 3694 - DNA, 354 bp, Acinetobacter baumannii
ccaatcccaattttggggttggctttcttttttattttttatgtgtcagtaaatatgtccagaactttaaatcttccgatgttatatcgcataaaagttttctatcgattcttaattgttttcggtatgggttatgcctgtatggcgtacttaagtcttggactaactgaaattttccatttgaacttaggcaagccagaagctatctatttggcggcctttatttctattttgttttatgtatttttcgtgattgttggtttctgcatccaatcattattgcgactgaccattttatcaatcgcactatttgcccttttctttattgtgacacggacggtaggttatgcataa

SEQ ID NO: 3695 - DNA, 288 bp, Acinetobacter baumannii
gaggatgttttattcatgaataaatcagaattaatcgatgcaattgctgaaaaagggggagtatctaagactgatgcaggcaaggcactcgatgcgacaattgcgtcaattactgaagcacttaaaaaaggtgacacagtaactttagttggttttggtactttcagtgttaaagaacgtgctgcacgtactggtcgtaaccctaaaactggtgaagagcttcaaattaaagcaacaaaagtacctagctttaaagctggtaaaggtcttaaagattcagttgcttaa

SEQ ID NO: 3696 - DNA, 423 bp, Acinetobacter baumannii
ttaacccaaatgcagttgaaccagagggcttacgtggtgcgtgaagatcaagctggaattttaaatcaattactttcttctcttgatgcaattcctgaagagattattgctttaacagcttatggcgttggcgctattattgccttatggtgctggtggcgtttaatgcgccgcttacctaccactttgggcgcaataagctggttagttgtttttgctattttggtgacaccgactgtttcggaagggcctaatgcatctgtagcgccagctatttttggactactatttggtgttttaactaaagacagtcctttaatctggtcaaatttatccttaattctgtttgtaatcggtctaggtttggttattggctattgttggtcaaaatatataacaaacaaaagcatgcgttccatctaa

SEQ ID NO: 3697 - DNA, 204 bp, Acinetobacter baumannii
gtttttaaaatgacgcaagtgatgatcaaggcgtatgatttcgcaaatacaaaagaagttgatcttttggctgatattgataagggcggtaatatccttaaagtttatgactataatggcaatgaattaagcataaacatggatggtaccgtgacttttaatcgaaagcgttgggaacttcctgttaaagtagatttaaaataa

SEQ ID NO: 3698 - DNA, 633 bp, Acinetobacter baumannii
ggcggtaaaattatgttgattgattgccgttttgagctacaaatgggtcagtttcatagtgaacctaatttccagtcagatgcttctgttattgggctatttggagcctctgggtcaggtaaaacgtccattttacatgccattgcagggctgaacacaccgcatagtggactcattaagatacagggccaaacatggtttgattcagatcaaaaaattaatttgagtacacaaaagcggcatgttggattggtttttcaagatgctcagctttttccgcataaaacagtcaagcaaaatttattatttggtcttaagcatctatcccaacaagaacgtcactttgaagcagattacattattgaattattaaagttagagcatttattacaacgtatgcctatcaaactttctggtggagaaaagcagcgcgtggcactaggtcgagcattattatattcgcctaagctgttactgcttgatgagccattatcagcattagatgcgaaccataaagctgaaattattcctttttttcagaaagtaaaagaagaaataaaaattccgatgatttatgtgagtcatgatattcaagagattaaacaactgaccgaaacaatgtgggttttataa

SEQ ID NO: 3699 - DNA, 1065 bp, Acinetobacter baumannii
gaaataaaaatgaactggtggttagaatccgtacagcaacctaatttagatgcaaaacaacaagctgagcaacatcaactccaacttaccaaacctacaggtgccttaggcgatctagagcaaattgcaattacacttgccagtttacagtcaaatgcacatccacaagttagccatccatggatcacaatttttgcaggtgatcatggtgtagttgaagaaaatatctctgcatatccccaagctgttacccgtcaaatgttgcaaaacttcacaactggcggtgcggcaattagtgtcattgctaaatatcatcaagctcatttgcaagtgattgactgcggtacagcaggcgaagcatacgaatatgcaggtgttgaacgtcattgtattcgtgccggcacagcaaattttgccaaacaagctgcaatgaatgctgacgagtgccgtgctgccttagagttagggaaaaaaagtgtagatactgctaaagcgaatggagcagatatttatattgcgggtgaaatggggattggaaatacctgttctgcctctgctttagcatgccttttattaaatgatactgccgagcaattgactggagtaggtacaggaattggtgctgatcagttaagacataaaattgaagtaattgaaaaagcaattgaacttcatcacaaacatgtcattggtgatgtcttcaaaacactttgtgctgtaggtggtttggaaattgcggcaattgtcggtgcttatatccgctgtgcgcaagtgggtttacctgtgattgtagacggttttattagttctgtagccgctttatgtgctgtgcggatgaatcctcaagtgcgtgattggatgttgtttggtcatcaatcggctgaatatggacatcgccgtattttacaagaactcaatgctgagccgattttaaatatgaatttgcgtttgggtgaaggtagtggtgctggcactgctttggcattggttaaaatggcttgcgctttacataaccaaatggctaccttcgctcaagcggctgtaagcggaaataaaattggctaa

SEQ ID NO: 3700 - DNA, 2034 bp, Acinetobacter baumannii
atgaaaaaaattggagatacgatgaaaaataatacactgaaaatgactacattatgtatgttgaccataggtataagtcaatttgcatcggctgaagtgacgcgtgcgacattaccattactcaaagcagagcaactcccagcatggtgcgattctaatttaaaaaaaaatcagcaagagatttctagttttgaaaaaacgcctgttaaaaacgatgctgccgctgctccgatattagccaagtgggataaaatttttgctcatcttgaagatttttcgggacccataggtctatatagtaatgtagacccagatgcgaaattacgtaaggcagcagaagactgtgaaatcaaaattaatcagtttcatactgatatatttcaaaattcaaaattatataacgtcattaagaataccaaagcgactgatccgattgaccagaaataccgtcaagatattctggatcaatttgaagacacaggggttcagttagaaccaacaaaacgcgcaagaatgaaggctattctggatgagttgactaaacttgaacaagaatataaccgtaatattcgtgataacccggaaaaacttgaatttactcctgaagagatgaaaggcttaccggaaagttatatttcggggttaaagaaaaatacgaaaggaaattatctattaggttttgagtatccggagtatcgccccttcatggagctagcggataatgatgatgccagaaaaaaataccagattgcctttacacgacgtgggactgaacaaaatttaaaactactcaaacaggcaatagatttacgttatgaacttgcacagttatttggaaaagcaagttatgcagattgggctttaaaagaccgaatggcaaaaacaccagaggctgtaaacaagttcttggcagaagtacaaaaaacggtagcaccacttgaacgtaaagaagtagaagaacttcgcgcctttaaagcacaaaccttaaaaacgccgttagacaaaaccgagataacgcgttggagtgaagcttactggagcgaaaaacttcgtaagagtaaatatcaaattgatcaggaaaagcttcgtgattattttccaactttagccgcacaaaaatggttatttgctatttcatctgatctttacggtattgattttaaacctgtcaaagttaaagcatggcaggatgaagttgaatattacgatgtagttgataaaaagacaggaaaactccttggtggcttatatatggataaattcccccgtgaagggaaatacggccatgcagcagtttggggagtatatggtggcagcactttaaccaaccgattaccgatttcagtattggtgaccaactttaaccgtaaaggtttaaatagtgatgagcttgaaacttttgtacatgagttcggtcatgctttacatggcatcttatcaaatacccgctataccagtcagtccggaacttctgtagagcgtgattttgtagaagcaccttctcaaatgtatgaagagtgggcacgccgtaaagaaaccttatctaaagtggccgattattgtgatccagcttgtccacgtgttgacgatgaattaattgcccgtttaaaagcagtacataattatggccgaggcttgcgttatgcccgtcagacgctttatgcacaatatgacatggcacttcatacggcagatgccttaaaagtaaaacctttagaaacttggcaaaaaatggaagctgctacagccttaggatatgtgccaacaactgaattccccgggcaattcgggcatttaatgggtggttatcaggcaggttattacggttatatgtggtctgaggttttagcgctagacatgctttctgcttatggtgacaacctgaacaacccacaagtgggacaacgttatcgtcagacgattttatcgcagggtagccaaaaaccggcagctgaattggttaaagatttccttggtcgtgatcctgacaataaagcattctttaacgaaattaccggacaacgggttaaataa

SEQ ID NO: 3701 - DNA, 771 bp, Acinetobacter baumannii
gaagaaaaaatgaaacatatcgtcattccagcacgcttctcaagttcgcgtttgccaggtaagccattgttacttattcatgatcgtcctatgattttacgagtggtggatcaagcaaaaaaagttgaaggtttcgatgacctatgtgtagcaaccgacgatgaacgtatcgctgaaatatgtcgtgcagagggcgttgatgttgttttaacaagtgcagaccatccatcgggaacagatcgtttaagtgaagttgcccgtattaaaggatgggataccgatgacattattgtaaacgtacaaggcgatgagccattactgccagcccagcttgttcaacaagttgcaaagcttttggttgataagccaaactgttcaatgtctacattatgtgagcctattcatgcgttggatgaatttcagcgtgatagtatcgtaaaagtagtcatgtctaaacaaaatgaagcattatattttagccgtgcaacgatcccttatgatcgagatggcgctaagcgagacgaaccaactttacatactcaagcatttcgtcatttaggtttatatgcttatcgtgtgagcttattacaagaatatgttacatgggaaatgggtaaacttgaaaagctcgagagtcttgagcaattgcgtgttttagaaaatggacaccgtattgctattgctgtagcagaagcgaatttaccaccaggtgttgacactcaagcagatcttgatcgcttaaataatatgcctgttgagtcttttgagtaa

SEQ ID NO: 3702 - DNA, 219 bp, Acinetobacter baumannii
actttgaaaatgagaaagttaaagaattacttcatgaggttacggatattatttttgcaaacaccggagtcgacattagtagtgttgaactcaatctttatactgaataaaaatcttttaaactgttataaaaataaaggacagcttcatactgtcctttatgcattcttaaatgagttatttaatgactttaatacgagtcgtagccggaataattaa

SEQ ID NO: 3703 - DNA, 657 bp, Acinetobacter baumannii
aaaaggaaaataccaatgagtattccaaagattgcaagttacagcatgccccaagcgcacgaatttactccaaacaaaacaaattggtcactacataccagtcgtgctgttttattggttcatgatatgcagcaatattttttagatttctatgatctaacccaagaacctattccagaactaattcaaaacaccaaggcattaattgatgctgctcgccagtctaatattcccgttgtctatacagcacaacctggcaaccaatcacctgaatatcggcagttattaaccgacttttggggacctggtttaaaggatgagccaagcatcacacagatttttccgaaaatttcacctcaaaaaaatgatacggtgcttactaagtggagatatagtgtttttaaattttctccgctcgaacaactcatgcgagactctggtcgcgatcaactcattatctgtggtgtatatgcacatattggttgtctaatgagtgctgcggaagcatttatgctaaacatacagccatttttatgtggtgatgcgctggctgactttagcagagaagagcacgatatggcattaaaatatgccagtacacgatgtgctcaagtcatgacaacacaacaagtaatccaagcatggatacaagaataa

SEQ ID NO: 3704 - DNA, 1014 bp, Acinetobacter baumannii
gaaagtgaaatgaagcgaattaatgtagcaatttgtggttttggacggattgggcaacaaattgcagagcttcttttaaatcgatcgacatactataaacaaaaatatcaaattgatgcccgtttagtgggtgtctgcaactcatcatcaggtttaattaaccaagatggtttacaagcttcaaagtggctagataaaacacaatatcaagcaggcctaacagagcaaaagtttttagaacaggttcaagcagatgtcattattgagactggaccaagtgactatgtgacaggtggaaaaggcctattttatttaaattatgctttaacacataacatgaatgtgattgcggtatctaaaggtgctttagtcgtagaaggtaaaaaactaattaacttggcacatcagcacaataaaaaactattttttagcggtgccactgctgcagctttaccgacggttgatttgtttgaatataacttagctggctgccaaattttagaaatagaaggtgtctttaccggaaccacgaattttattttaaatgatatgttgcaacacgaatgcgcatttgcagaatctcttgaaaaagctcaaacaaaagggattgcagaacctgacagctctttcgatgtagatggatgggatactgctgccaaaattacgatactagccaatactgttttgggggctgatgtaaaaattcaagatattccaagacaaggaattagtcacgttacggccgatcatattcgtgattggaaaaaagaaaatgtaattcctcgtctggttggttttattcatattaagaatcagcaaattcaaacaggtgttgaattaaggttagtcccagcaaatcatccgtttgctcatctgcaaggttctaataaatgtattcgggtgttaacgcaagaaatgggggaatttgttgtcactggaggggcatctgcgccattagccacagcagccgcggctttaaaagattttgagttgatgctaaaaacgggctactaa

SEQ ID NO: 3705 - DNA, 891 bp, Acinetobacter baumannii
aggaaagaaatgacgcttaaacaactaaaagcttttttggcccttgcgcgtacactcaactatgccaatgcttctttagagttacatctcagccaatctgctttaagtctcaccatcaaaagcttagaagaagagttaggcggtaaactgtttaaccgtaatacacgccgagttgagcttactcaagaaggcaaatcactcattccatatgcaaaaaaattactcgccaattgggatgaaatggaaaacgatgttaaacaacgctttaaactcaatcgtggaaccttaagtattgcatctatgccctttgtgacccatgcaattttgccagaggtgattcatcaatttttagcagtccatcccaatcttaatttttcaattcacgatattccaaatgagaccattatagaaaaagtacaagacggtatttttgagcttggtatttgttttgaacctgatctcaccgaaggtttagagtttaaaccgttgtttgaagaagacttcttagctctattacctaagagtcacccactcgctcaatcatcttctattacatggcatgagctttgttcaaatccatttgtaaccttgcaaaaaccctcaattgttcgatatttagttgagcaaaattgtttgcgaaataatataacgctcgatttaaaagttgaatgccaccaaatttcatctctttcaagtttcgttgcttatggaattggggtaagtgcaattccaaggcattttgctaaacacattgataaagaacataacgtactgattgatttaaaagatgaagccattcataaaacagtaggaattgtttataaaaagaactttgaaatttcaaatatttctgctcaatttattgaggcactggttcaatataaattttaa

SEQ ID NO: 3706 - DNA, 1008 bp, Acinetobacter baumannii
ggaatacgaatgagtttttattatcaagctttagatgatatcgatgaatataatcaggaatttcttgcgccgctcaatcatgcagatgaaaagatccgctttgttgctttaatgaatattggtgatgaagaaaatccggatttacttccgtggctgcatgcagcactacaacacgactcttcagctttagttcgtgaagaagcggcaaaaaaactagaaagctgggaagactcaaccagtttgcaagtattggcgcaagccttatttgatgctgatctgaatgtgagacaagctgccagccagagtttaagtgaagtcaaaaatccggcatcgacccagatactggcaccgtatttaaagcatacggatacttttgctcttggggcaattctgcgtgctttaaaacctttacgaccacagcaattatttgaagagatatctgctttggtacaccacgaagatgcatttgtacgccgtgaggcagtcagtgcattaagttggttacaacaagaccaagcaattacgatattggcaaaaattgccgaaacagatacagatgatgaggtccgccgtattgcaacaggtggtttggcttatagtcagagtatatccgcagaggtcatccaagcacttcaacactctttaacttcggaaagttggcaactaagagtggaagctgctcttacgattggaaaattacgtattgttcagctcgaagctcctttaattcatgctgtatcagatttgtattggcaagtacgtattgcagcagtacggagcttgggactacttaaatcacatctggcagttgctcatttgactgataactttaagcatgaaattagtaatttacgtaaagaagtcgctttagcactcggtgaaattggtacagcagaagctcagaagctattggaacaacatcaaaatgatccagatcctgaagtacgaaaagcgattcgtattggattaaatcaaattggtgaggtgaagtatgcaaaccagacctga

SEQ ID NO: 3707 - DNA, 1074 bp, Acinetobacter baumannii
caaggtagaataagccgcactacctgggaggatattatggcactcatttcaatgcgccagctcttggatcacgctgcggaacataactacggcgtaccagcatttaacgtaaataacttagaacaaatgcgtgcaattatgcttgccgcagatgctaccaattcacctgtaattgttcaggcatctgctggagctcgcaaatatgcaggcgctccattcttacgccatcttattttggctgcaattgaagaatggccacacattccagtggtaatgcaccaagaccatggtacaagccctgatgtatgccaacgttctattcaacttggttttagctcagtgatgatggacggttcattaggcgctgatggtaaaactcctacaacttacgattacaacgtagatgtaactcgtcaagtggtagcaatggctcatgcttgtggtgtatctgttgaaggtgagatcggttgcttaggtagccttgaaacaggtatggctggagaagaagacggtgtgggtgcagaaggtgtacttgaccattctcagcttttaacctctgttgaagaagcaaaacaattcgttgctgatacaaatgttgatgctttagcaattgctgtaggtacttcacacggtgcttataaatttacacgtccacctacaggggatattttagcaattgaccgtattaaagaaattcatgcggcattgccaaatactcaccttgtaatgcacggttcaagctctgtaccacaagaatggttaaaagtaattaacgagtttggtggtaatattggtgagacttatggtgtaccagttgaacagcttgtagaagcgattaaacatggtgtacgtaaaatcaatatcgatactgacttacgtttagcttcaacaggtgcaattcgtcgtttcatggcggaaaacccagctgaatttgacccacgtaagtatttcgctaaaactgtcgattcaatgaaacaaatttgtatcgatcgttatgaagctttcggtacagctggtaatgctgacaagattcgcccaatttctttagagaaaatggttgatcgttataaataa

SEQ ID NO: 3708 - DNA, 1023 bp, Acinetobacter baumannii
gcatccagaattagcacattaattcaccacaatcacgatcaatccggtcgtgatttttttataggaaataagaagatgaaaagcactttaattaaacatggatttttagcaggaacattgttgggtttgccgttggttacacatgcctatgatttaccgaccgtaaacttaggtatgaccagctttctcgacggtggattacccgcagggcccggctggtatgctcaaacctacttccaaaattacgatagcaataaactggtcgatgccaatggacaaaaattaggtttgcctaaaacagatttaaattatcaagtgctggttgagcagattagttatttatcgaatgtccgagtaaaagataaagccagtctaggcataaattttctggttccttttgtcagtaaaatggacatggatgatggcttgaataatgctgccattaaggcccaaagcggctttggggacattatgatcggaccttttattcagttcgatccagtcatgggtgcacaaggaccgaagtttgtacatcgttttgagtttcagatgaatttacctactggcgaatatgaccagcaaaaagatattaaccccagtaataacgctgtttcatttgatccttattgggctgccacatattggtttaatcccaaatggaccgcttcaacacgcatccattatctctataactttaaaaatgatgacccaagctatgcgtttgctggagcaaatgatatgcaagctgggcaagcaattcatgcaaacttcgcaacagattatgccattaccgaacaattccgtttaggactaaatggctattggttaaaacaagtgacagatacagaagtcgatggtgagaaagtcaaaggtcgacgtgaacaagtttgggctattggcccaggcgccatgtatagtttttctaaaaatgatcacttggttgcaaatgcttattttgagcaagatgctgaaaaccgcccagagggaacacgactacaagttcgctatgttcatcatttctaa

SEQ ID NO: 3709 - DNA, 2085 bp, Acinetobacter baumannii
gagtcaagaatgacatcattgcccactttagctagctcaaaccagcacaatttagaaacgtatattaatagagaactctctttattagagtttcataaacgagtgcttgctcaagccaaagatatagaacacccattactggaacgtttgaattttttaattattttttcacgtaatctagatgagttttttgaaattcgtgtggcaagtttaatccagaaaattagcttgatgagtcaggcaaccggaccagaaggtttaccgttagtagaagtattaaagcaaatttcaaaaaatgctcatgaggcggttgaagagcaatataaaatcttaaactatactttgttaccgcaactccaaggctatggcgttcattttattcagcacggcgatatattagaaaagcataaagaatggattaaagagtatttttttaaagaagtacaacctgtagttacgccaatcagtctagacccagcacatccatttccaaggctggtcaataaaagtctaaacttcattgtaactttagaaggtaaagacgcttttggacgtcaaattgatttagctattgtgccggcaccgcgttcgttaccaaggcttgttaaaattccagaacatatttctggcggtgcagagcattacattctgctctcggccattatccatcaacatatttcggatttatttccgggtatgaaagcgacgggctgtcatcaatttcgtgtaactcgaaatgccgatttaaccgtttctgaagatgtagaagatttggctgctgctttaaaaggtgaattatcttcacgccgttttggccaagcagttcgtttggaagtagcaaaaaaatgtcctgaagaaattgctaactatttattagagcaattcgatttagatgcagaacatctttactacgtcgatggccctgttaatttagcccgttttatctcaaactttgatttaccagagttgcgctataaaccatatcaacaagttttgcctcagcttttatacactaaaaaaccgatttttgatgtgttaaaagcaggagatgttctacttcatcatccatttgattcttttgcacctgttatcaagttccttcgggaagctgcacaagatccaaatgttttagcaattaaacaaaccttataccgtagtggtgccaactccgaaatcgtacaactactcgcagaagctgcgcgtaatggtaaagaagtaaccgcggttattgagttgcgggcacgttttgatgaagaatcaaatattgaagtcgctaacgttttgcaagaagctggcgcagtcgtggtgtatggcattgttggctataaaactcacgctaaaatgattttagtggtccgccgtgaacaagaaaaaatcaaaagatatgtgcatttaggtacaggcaactatcatgcagtgaatgccaaaatctataccgattttggtttgctgaccaatgatgcggaaatttgtgaagacgtccataaaattttccaagaactgaccggtatgggcaaaatggcaaaacttaaaaaactttttcatgcgccatttaccttacattctcagctgttagaacttattgaacaagaaattaaaaatagccttgctggtaaaaaagcacacatcatcattaaagtgaatgcgcttactgaaccacagctcatcagcgcgctttataaaacatcacaagctggtgtaaaaattgatttaattattcgttcaatttgctgcttgagaccacaagttgcaggactttcagagaatattcgagtacgttcaatcgttggtcgttatttggagcatacgcgggtttactatttttataatgatggtgatacaaaagtttattgtgcaagtgcagactggatggaacgtaatttgttctctcgtattgaaacctgcttcccaattgaaaataaaaaattaaagaaacaagtcattgaagatggtctaaataactatttaaaagacaatcgtcaagcatgggaattacaggctgatggaacatgggtgcaatgtcatcctaagccggaagaagaactttatattgcacagcaacacttgatgaacttagctgggtaa

SEQ ID NO: 3710 - DNA, 1881 bp, Acinetobacter baumannii
aatattggaatacttatggaatcgtttcgtacagtcattaagggttggctcggcaaagtccttttagttttgtttttgacccctttagcgcttgtaggtattgaaggatattttaataggggaaacaaggcagatgtcgcaaaaactgtaaatggacaggacatatcaaaaaaagaccttgaaactttaacgcaaaggtataaagaacaatatttagctgctgtaaagggcgatgaaagtttacttaatttaccggtaattcaagccaaagctcttgatatattggtatcccgtaatttgctcattcaacaagctgaaaaattaggtatttctttaagcgatgctcaaatcgagcaaatgttagctcagcagccaagtttgcaagaaaatggccagttttcacaaaaattatatgaaaattatttgcgttcgattggtatgacaagcgaaggcttaatcgctagcttacgtcaagatcacgctttaaaaatgttgacttcaacttttgcagattattctttagtgagtaaagttgatttaatgcaaattgcgaatttgcaaactgaacagcgtacattgcatttggctagtattaagttagacccttataaagctggtttaactgtatcgaaccaagaggctactgattactacaacaaacatcagaatgagtttaaacagcctgcttctgttgatgtagattatgttgttttatctccgtctttaatggctaagccagctccagccacagatgccgagcttaaacaagcttatgcaaagttcgtagaaactcagcaaaaagatgctaaacgcatagtgaaacatatccttattacgacagacgctcgtgatgatgcggcagctcaaaaacttgctaaagatgtatatgcaaaaattcagggtggactttcatttgctcaagcagcagctcagttctctgaagatccaacttctaaaacgaaaggtggattagttgaagcatatgcacctggtgttttctctgatgcatttgataaaactgttttaagcttgaaaaatggtcaaatttctcagccagtaaaaacacaatatggctatcatattattgaagcggagactcaggcgaaccaaattccttcatttgaagctgagaaaccacgtttaattgcagaagtcgaaaagaataaagttgcatctgtttattcagataccgtaaatagtttgaatgaaacgattgttggtaatgattctttagatgctgttgtacagcaggttaaaggtacaaaaatcgaatcattaaatggtgtaactttagctactcaaaatccatatttaagtgatcctaacgtaaaaattaaattgtttaatgatgatgtaaaaaatggcgatcgtaatgcttcatctaatattcaattagcgaacggagatactgtttgggttaaagtacgtgactatcatgcggctggtgttaaaccacttgcccaagcaatgaatgaagtaaaagctaaagtaattgatgagaaagcacgtaaagcagctcaagcgaaaatcgctacaatgctgacagaattcaaaactcagccagctgaacaagttgtcgcgaaaaataaagttgcttttgaatcagcgggtgtatttactcgttcacaaggtttaaaacgtgcaattgagcgtgcagcatttagtgttcctgcgccaaaaccaggtatgtggtctgtaactaccgcgaacttaccaaatgagttagtggttgtggctgtttctaatgtaaattcagctgctgttaacgctatgcctgctgatcagttgcaacaattaaaacagctttaccgccaatctcgtggtcaacagatacttgaagattacagcgaatacttaaagtcacacgctaaaatcaaataa

SEQ ID NO: 3711 - DNA, 978 bp, Acinetobacter baumannii
attactaccttaaattaccaaaataaggcctgttttatggaatgtatgagaattcagcctgtaacgagtcatcctggagaaaatgctttatttattgtattaggattagctcaaggtgattctgttgtagaaaaagtaaaagattttgttggtaaattctcagcgttaaccagaagtttgtctaaccgttatcctgaaactaaatttaatgccatattaggttttagctcaaacgcgtgggatattttatttccacagcaagcaaagcctcaagaattagaaacatttcaagaaatcaaaggcccaaaatacacagccgtttcaacacccggggatttattctttcatattcgtgctgatcgacaagctttatgttatgagttaggaagtatcatcaatgaacagttaggtaaagtaacttacccaattgatgaagtgcatggttttcgatatttcgatgggcgtgcgattattggctttgtagatggaacagaaaatcctgaacctgtaattgctgcacaatgggcattagtgggtaacgaagatcctgactttattgggggaagttatgcatttatccaaaaatatacccatgatatggaaaaatggcgtgcattaagtgatgatgaacaagaaaaagttatcgggcgtaaaaagttcaacgatattgagcttgatgatgaggagaaacctttaacagcacataatgtagtaagtaaagcgcatgatgcagaaggcaatgaactaaaaattatgcgtgcaaatatgcctttttcgaatccatccaaaaatgaatatggtactttttttattggttactcacgtaaatttagtacgacacgtcaaatgcttgaaaatatgttcttaggaaatgagcaaggtaatcttgatcgattacttgactttagtactgcccaaacaggcactctatttttcgtaccgacagtagattttctagatggcttgggtgacgagtag

SEQ ID NO: 3712 - DNA, 1146 bp, Acinetobacter baumannii
acgagattgatgcagcttcaaaggcaaatgttgatgatgccgttgctaaagcccgtgctgcggcatatccgaaaccagaacaactccttactgacgtctatgtctcttactaaaggaatagtaaagatgccaaataaaagttttcgtaatgcaattaaagaagccattgaatcagaaatgcgccgtgatccaaccgtatttgttgttggtgaagatgtccgcggtgggcacggcggtaaaaacactgaagaaaaccaattagaaggtttcggtggtgtattgggcgtaaccaaaggtttatggacagaatttggttcggaacgtgttattgataccccaattaccgagtctgcaattattggtatggctgctggtgctgcagcaacaggtttacgtcctgttgccgatttaatgtttatggatttctatggcgtgtgtcatgacatgctctataaccaagccgctaaattccgttatatgtttggcggaaaagcaaaagcacccatggttgtacgtggcatgattggcgcaggtttctctgcggcagctcagcattctcagtcaccgtataacgtatttgccgcggttccgggcttaaaagttgtggttccatctagcccatatgatgtgaaagggctattaattcaggctattcgtgatgatgaccctgtagtgttctgtgaacataaaatgctttatgacattaaaggcgaagttccagatgatgcatataccattccttttggtgtagcaaattacacccgtgaagggacagacgtgaccattattgcattaggcctgatggtacaccgtgccaatgaagtagcagataaactagcaaaagatggtatttcagttgaagtggtcgaccctcgaacaatttcacctctggatgaagaaggaattttagagtctgttgcatcgactggacgtgtggttattgtggatgaatcagcagcacgctgtggctttggtcatgatgtggctgcactgatcgcgcaaaaaggtttccactatttgaaagcacctgttgaactcgtaacgccaccacatacgcctgttccattctctccagttttagaaaaagaatggattccaagtgtagagcgtattgagcaagctgtgcgaaaaacattggaggcttag

SEQ ID NO: 3713 - DNA, 594 bp, Acinetobacter baumannii
ttttttatgataattgagatagaaacccatccactgcaaccgtttttgccagaaaatgcccgtttattaatgttgggaagttttccaccgccacgtaataaatggaagatggacttttactatccgaactttcaaaacgatatgtggagaatttttggtttaatcttttttcaagataaaacttattttttaagtgagaaccaaaaaagctttaacgaagaagctatccgcagctttctgattgagacaggcattgctatttttgatacggcgtatcaaattaaacgcctaaagggcaatgcttcagataagtttcttgaaattgtcactccgacagacttagcggttttattgaaacagattcctcaatgtcacactattatgactacgggcgataaagccacagataccttaatctcagttttacctgagaacacggaaaaacccttaattgggacatctacatcaacttattttgcagaccgcgatattaatttatatcgattaccgtcatcttctagagcatatccattagctcttgagaaaaaagcagaagcctatcagaaattctttaaggaaatcggtttcttgtaa

SEQ ID NO: 3714 - DNA, 708 bp, Acinetobacter baumannii
ttttatgtgatggaagaaagtctcttgagtatcattgttgcgttggacgctaaaagccaatatgacgctttaaaaattgttgaacaacttgatcctactttatgtcgcgtaaaagtaggtaaagagctttttactcatgaaggcccatctgttgtaaaaaaacttcaagaagaaaatttcgaagttttcctagatttaaaattccatgatattccaaatacgacggctcaagctgtatgtgctgccgcagacttaggtgtatggatggttaacgtacatgcatcaggtggccgtaaaatgatggaaacctgtgtggagcgtttaaaagcaggtaattatcaaacacaattaattgcggtaacagttttaacttctatgggccgtgaagatttaaaagatatcgggttagatattgaacctgtagaacaagttaaaagattggcgaaacttactaaagaaagtggtttagatggtgtagtttgttctgctcaagaagctaaaattcttcgtgagttaatcggacacgatttctctttagttactccgggaatacgtcctgagggtagtaatgcagatgaccaaaaacgtattgtaactccgaaacaggcaatgcttgatgggtctacacatttagttattggtcgtccgattactaaagcagaaaatccaactgaaatgttgaaatcaattcttacttcaattgcttaa

SEQ ID NO: 3715 - DNA, 192 bp, Acinetobacter baumannii
caaaatgccttggaattgcacttaccccaattccataagcaacgaaacttgaaagagatgaaatttggtggcattcaacttttaaatcgagcgttatattatttcgcaaacaattttgctcaactaaatatcgaacaattgagggtttttgcaaggttacaaatggatttgaacaaagctcatgccatgtaa

SEQ ID NO: 3716 - DNA, 1023 bp, Acinetobacter baumannii
atgcctacgattgtacaaacaaacccaacattagccgacgttgcccataacattggtaagaactctaaagttggggcgattatcgaagtactcaacaaacgtcaagacttacttgacgatgctgtagtacttgaagcaaacagcggtacccacaataaaactagcgttcgctcaggtttaccaaaaggtacatggcgtaaattgaactatggtgtgcaacctgaaaaaacatcacgtgttcaagtctctgatagtactggtcaattaacttcatattcagaagttgataaaaccttgtacgaccttcaaggcgaaaataaaaaacaatggcgctctgaagaagatgcaggcttcttagagggtatgtcacaagaggtaatggaaaacattatctatggtgatgttgcaggtgatgtatctacctttaacggtttagcaacgcgttacaaccatcttattgaccctgaaacaggcgtagcacctgcaaacgctgtaaacattctggatgcaggcggtacaggcactgacaatacgtcaatttacattgtgcagtgggggcgtgaaaaaactcacttgttctatccgcaaggtacgcaagcgggtcttgatattcaggacaaaggacaacaaacggtacttgatgcgcaaggcggccgttatgaagcaatgcgaacatacttccaatgggacgtgggcttatctgtacgtgactggcgctcggttgttcgtatcgcaaacattgatgtttcggacctttcaaaagacgcatctactggtgcaaatcttattgatttattggacgaagcactttctctcttaccacttgcaggttcagcacgtacagcaatctacatgaaccgtactgttaaacaagcgcttaaaggccaagtcaatcactttaaaaatgtgcgcttgactcttgaagacttccgtaaagacggtagccgtaaaattcaagcatgggatggtgagccgattcgcatctgtgaagtcattcttaacactgaagcccgtgtagtttaa

SEQ ID NO: 3717 - DNA, 780 bp, Acinetobacter baumannii
tatctgacgatgaatacgtcttttaaaatacaggcagagaagtgcgcaactctgcctatattgcaacagcgtctgaaattaaatgttcaaatactacctgaaagttcaacaaccttagattgtctgttgaatgatgatgtatgtcgacaggtgttacaggattttgcaacacgtattcatgctaaaaatctaacttgtgcgacctcattatttgtcaaatattggtgtacaagttggattttaccttttttatattgccatgcggccgttttgccatttgtaaaatgggctagttctgcattagttatagacttgccggaacaatggtattgggataggactttacagttaaaccaagcaagttttcattcttttcagattatacatttgcaagagtttaatgacttgatagaacaacttaatctgttatttaagcagttagcgaaaataggtcgcgtaccttatatattactctgggaaaatttaactgttcgagtagtacagttttatcattcttttacaaagcaaaatctaaatctggatatacagtctcggttagaacagcaaaaacaattctttaagtcaaaaactgccgaaagtttttatttaactgaaaatccatttatgcgtttatggaatggatggcatccagaatttaatacttttatgagacaaaaatgctgtttctattttcagctcgaagaggctgagcagaccttatgccgtaattgtcccttacgtttaaaagaaatcggaaaatttaaagatgaatcaaattga

SEQ ID NO: 3718 - DNA, 1260 bp, Acinetobacter baumannii
ctggcacagattcagctcttttatcgggtacaggtatttgatatgaaacgtccaatttatcttgattacgcagcaaccactccagtagatccgcaagttgcagaacgtatgatggagtgtttaactttcgacggtacctttggtaatgctgcatctcgttcccacgcttatggctggcaggcagaagaaaaagttgaatatgcacgtgagcaagtcgcaaacttaattaaagctgacccacgtgaaatcgtttggacttctggtgcaactgaatcagacaaccttgctcttaaaggtgttgctcaattctatgcatctaaaggcaaacatatcattacaagtaaaattgaacataaagctgttctagatccttgccgtgaattggaagaacaaggttttgaaatcacttatttagagccagaaccacaaacaggtttaattactcctgaaatggttaaagctgcccttcgcccagatactattcttgtttctcttatgatggtaaacaatgaaattggtacagttacagatgtagcagcgatcggtgaattaacacgtgcaaataaaacgtttttccatgtagatgcagcacaagcagctggtaaagtcgatatcgacttatctactatgaaaattgacctaatgagtttctctgctcataaaatttatggtccaaaaggtatcggcgcattatatgtacgtcgtagcccacgtgttcgtctaaaagcacaaattcatggcggtggacatgaacgtggtatgcgttctggtactttagcgactcaccaaattgttggtatgggtgaagcttttgaacttgcaggcaaaacaatgcatgcagaacaagaacgtattcgtaaacttcgtgacaaactttggaacggtttacaagaccttgaacaagtattcttaaatggccacccaactcaaaacgttgctaactatttaaacgtcagcttcaactttgttgaaggtgaatctttaatgatgtcgcttaaagacgctgctgtatcaagtggttctgcttgtacttctgctactttagagccttcatatgttcttcgcgcattaggtttatctgatgagctagcacacagctcaattcgctttagttttggtaaatacacgactgaagaagatattgaccacgtgcttacaattaccaaagccgctgttgagaaattacgtgaactttctccgctttgggatatgtacaaagaaggtatcgatctttctacagttgaatgggcagaacactaa

SEQ ID NO: 3719 - DNA, 366 bp, Acinetobacter baumannii
tgtgatgagatgtttaaaaaattaacccaactttttcaaggttcgaaagagacaccagaacaaatttatttacaagagaatcagctcagttttgattcagagcgtggtccagttattaaaaatgtcgtgattaatgaaaagtggtcagagcaccttgaatatttttcaaatcgtaaattacagaattttgataacttacctaagctatttcaaattacaccacaaattaatgaaaagattgatttagagattgcaacgcaacgatatgtggaaaggttaggtaatacacaagaaaagttacttgagcttaaagcaatcatacaggtattaaaccaatattatgtgatgtttttacgagacaaataa

SEQ ID NO: 3720 - DNA, 687 bp, Acinetobacter baumannii
aagatatacttttatgatgaaataaaattaggtttaaacatgtccagatctagacgaagtgatggtgacttaacaaagactaaaattattgaggcagcaggacccttaatcgcccaatatggttttgcaaaaacagcaaacaaaacaattgccaaagtagcaaatgtcgatttagcagcaattaattatcactttgatggtcgagatgggctataccaagcagtattaatggaagctcatgcccattacctagatgaacaatacttactagaacttgttgaaagtatttactctcccgaagaaaaattgagtttattacttgaaactttattacataagttgacggaaaaagatgtttggcatggcaaagtttttattcgcgaactgttttcaccgtctgagcatttattaagttttattgaattaactggaatgagaaaattttttcttattcgaaagttgattagtcaagtggcgaacttagatgaaaatgatccggccgttttaccttgtattttaagcgtgatgaccccttgcatgatgcttattattgctgggcctaatgctcaagcacctgagccacttaaaaatattgctcagatgcccttacatgatttagttgaacactttaaaaaattttcattagctggattaaaagcaattagccaatcaaatcttaaaaattag

SEQ ID NO: 3721 - DNA, 1191 bp, Acinetobacter baumannii
cccatgtttgtgcggttattttacaccttacgaaaatatggtgttccagtcacgactcgtgaactgattgacttaaattgtgcagtaagcgaagggctagtttttgccaatcaagaagatttctatcaacttgctaaaaccattttagttaaagatgaacttttttttgataagttcgatcgtgccatgaaagattactttgatggcatagaaacctttgatattgatgagttactcaagcaagtccataaacttccaaaagactggttcgacttagaacttctagaaaagcatttaacaccagagcaaagagctgaacttcaaaaagcaggttctttagaagaactgatgaaaatgctagaagagcgtttacgtgaacagcataaaaaacatcaaggtggtaaccgtatggttggcacgggtggaacttcaccttttggtgcttttggtgaccatccggaaggcgtcagaattggtgggccgggccgtaaacgttcagcggttaaagtttgggaacagcgtaaataccaaaatctagatgatgaccaagttcttggtacccgccaaatgcaaattgctttacgacgtttacgtaaatttgcaagacaaggtgctgccgaagagttagacgttgacggtacaatccgtgaaacggccaagcagggtattcttgacgttcaaatggtgccagagcgtcgaaatcgaatcaaagtgctcatgttgtttgatgtaggcggttcgatggatgcacacattgcccaatgtgaaaagttatttagcgcagctaaaacagaatttaaaacgcttgaatacttttattttcataactgtctttatgactatgtttggaaagataattaccgaagaacagcgacccgcatgaatacgtgggatttgtttcatacttacggacgtgactatcgtgtaattgtcgtaggtgatgccagtatggcaccgtatgagctgaaatcggtaggtggctcggttgaatatatgaatgatgaaacaggtgaggtttggttgcgtcgcctacgtcaacattttgataaaatagcatggttaaaccctgaaactgaagggtattggcattacactcaaactattggttggattaaagagatttttgaaaaccacatgtatccaatgactctaaaaggcattgaggacttaacgcgttacctttctcgataa

SEQ ID NO: 3722 - DNA, 660 bp, Acinetobacter baumannii
attaaaactgtgctgttgaaaccctccacactcatggtgccaacaccaatacaggattatcctgaatggcaccttgggcgtcaaaattacgcattgtggtatctagaaattaatgatcagaaattagttcattatctagatcaattgcgcgcgcatttttcagaatttctagtagaacctaatcaccgtcaatatcatgtcacgctgtttatatgtggattcttgacccatgaaaataaagttcatggtgatgattttagttttactgaatttgagcagcataagaaagttctaaaacaagaaaattttgcaccattccaattaaaaattggttcagttgatagctttagtagtgctttatttgtagaagtccaagacaccgaaaatatcttatctcacatacggcaaaaattaggcacagtttctaatgaaattgccgctttagattactgtccgcacattacattgggtttgtataagaaagactatagtagtaatttgattttacaaaaaatttctcaattacctgtacaatacacacaggctgaatttgatcttaaagttgagcatttaatctttggctattatcaagcccaaactttacaaggtcagctgtatccgtatgagcatttgtttttaggtgattcatgttgcaattga

SEQ ID NO: 3723 - DNA, 894 bp, Acinetobacter baumannii
ttgaaagatgtgagtttaaactttatggaattacaaggcatttgccataaaatgcatgcaggcctaaaagatgctagtgtaactgatcaacagacaaccaaggcaaatgttgaatacaaatttgtattagaccgttcagaaattgatcttccttttaatttaggacaagaactagaaatcgaatggacaggtaatatttattgcacctcttgtggtgctaaaacaccaaagtcttattcgcaaggccattgctttaaatgttttaaaacgaaagcggaatgtgacctttgcattatgaaacctgaaacatgccactaccatttgggtacatgtcgtgaagatgactttgcccacagcgtatgtttccagcctcatattgtctatttagcaaattcaagtgctttaaaagtaggtattactcgcgttagccatatgcctggtcgttggttagatcaaggggcaactcaagccttacctattttaaaagttggttcacgtcgtttatccggtcagcttgaaaccatgttcggttccttaattgcggataagacagattggcgtaaacttctcaaaggcgaagctgagcctctaaatttgattgaacaacgtgatcagttaattgaagaattcgctcctaaaattcaaactattcgtgaagaatttagccaaaatcttgaatttaacgaaacggttgaattactagaaaatgaattgccacgtgagtttgtttacccagttgaacaatatcctgaaaaaattaagtctttaaacttagataaaacaccaaaaattcgtggagtattgcaaggtattaagggccaatatttaatttttgatattggtgttattaatatccgtaaatatacaggttacgagctgattgtacgtgcataa

SEQ ID NO: 3724 - DNA, 663 bp, Acinetobacter baumannii
acttcatgcttgtcatcaagctgtactgagctatgttccattagatgtattaatggaatttgcagtgtaatgaaacaacccaaaattattttggcatcaagcagtcagacacgtaaagatttaatgaatcgtttaggaatcgaatatatctgtattagcccagatattgacgagagtccttgtggtgaaacgcatgccgatgatttagcaaaaagactggcatttactaaagcacaggtaattgcacaaaaaaatcctgaagcaattgtaattggttcagatcaagttgcatggcgagagcatgctcctcataattttattggcaaacccttaacaattgaaaatgccaaagctcaattagcagcaaactctggccgaacagtcttttttagtactgctttaagtgtacagtgccttgaaagaagttttgaacatacgcttgttgagcattatcaagttaagtttcgcaatttaagcgcgcctgaaatcgaaagatacgtcgacttagatctgcccttacaatgcgcaggaagttttaagtgtgaaagtctcggcattagtttatttgaaaaaatgataggccaagaccaaaccacgctgatgggtttacccatgattcagctttgtcagattttaagacaactcaatcttcaaattccttaa

SEQ ID NO: 3725 - DNA, 375 bp, Acinetobacter baumannii
atgaaaaacgtcattattttaacttctatattgttattaagtgggtgcacaattaattctaagttattatcaccagcaaaaagtgatgatgacaaaattattgtagaagcagaaaagtacaagcaacaatatcaaaaaaagatctttaaaatttggaatgttccgccttcttcagtgggaatgagtgctagcgttaaagtctttttaagtgatactggtgagattgagcaaattatttttctagataaagaagaccaaaagtttaagtcgagtattgaaaaggcgatatggcgtgcaagtccctttgttttaccttctaatccggaagttagaaaacaagtaagaaagtttaatattaaatttactgcaaagtaa

SEQ ID NO: 3726 - DNA, 186 bp, Acinetobacter baumannii
tgtatattttttatacaaataaatttgaaacttttcgccaacatcaaaaaattttccaaatggaaaatttatttttatatcaaaaaagctaaagcatcatactcaagcataataaaatcaatatttatcaatattttgcataaactaaaaaaagaaaaatatatagttggcacttgctttgcttaa

SEQ ID NO: 3727 - DNA, 1560 bp, Acinetobacter baumannii
aaaacgttagtcttgcctgcaatcctctttaccgcatatgcagggtttccaatgctaaacgcaaaacaacatgctattcaaaaaactaaaatcgcaattattggtgctggattcggtggccttgccatggctattcgtctgttacaaagccaacaatcagatttttttattttagaaaaatctaatgatgtcggtggaacttggcgtgaaaaccgctatccaggagctgcgtgtgatgttcaatcacatatgtactctttgtcttttgcacctaaaactgactggtcaaaacgttatgcagaagctcctgaaattttcgattatatccaagatataaccgatcaatatcaaattaaaaactactgtaagtttaaccatgaggttactcatgtacagtatgatgaagtgcgccatgtatggtcactagattttgcaaaccaaccttctctcgaagcacaatttgtagtttttgcatcaggtccgctacatattccacaaatccctcatattcaaggtattgaaaagttcaagggtaaagtttttcactcttcccaatgggaacatgactacagtctaaaaggtaaatcagttgcttccattggtactggtggtagtgcaattcaatatattccagaaatcgcaaaagacgttaagcaattatatgtattccaacgtacagcagcttgggttatcccacgagatgagcgtaaatactctaatttgagcaaagctctatttaaaaaatcaaacttatatcgacaaattcatcgcagccgcctttattggagtaatgaatctcgcgttgttcctatagttcagccgcaaatcatgaaatatgggcaaaaattagctgaggcatttatacggttccaagttaaagataaagatttagccaagaaacttacaccagactttgtgatgggctgtaaacgcattcttatttcaaataaatacttccctacttttaaccgtaaaaatgttgaattagtgactgagggtattcaagaaattaaagagaacagtattattacaaaggatggaaaagaaagaccaattgactgtttaatctatggaactggttttgttaccgatccacgtatttatttaaaacattttacatgtattggtcgcaatcaaattgaattgaaacaggcttggaaaaacggtgcagaaagttattatggaattatgaccaagaattttcctaacctatttcaactggtcgggccaaataccgttttaggtcataattcgattatatttatgattgagtcacaagttaattatattttacagcttattgatctagttgaaaaatctggacagcacgctatagaaattaaaccggaagttcaggattccttcaatgaaagaatacaaacacaacttcaaggtactgtatggcaagctggcggatgtagcagctggtatcaagctgccgatggaaagaacttttctttatggccaacttatacatggaaatattggctagacactcgtaaagttaatcctaaagattatttgttattaaataaatgctcacagagctatgcagcataa

SEQ ID NO: 3728 - DNA, 606 bp, Acinetobacter baumannii
ggaaaatcagtgtttagtgatagatttgaacaactcgttcaagctttacgtattttgcctagcgttggaccgaagtcggcccaacgtatggctttacatcttttgatgaaaaatcgtgaaggtgcatttgctttagcacatgctctacatgaagcatcaagttatattcatgaatgtagtgtttgccactctttaacagagcatgaaatttgtgatatttgcgcttcaacagaaagagatgatcaattgctttgtgtagttgagtctccggcagatgttatggcaatcgagcaaagtggtagttttcgtggcaaataccatgtgttgggtggacacctttctccattagatggaatcgggccagaagaaataggcattccttatctaatccaacgtttaagccaaggtacgatcgaagaagtcattttggcaactaatgctactgtggaaggtcaggcgacagcgcattatttggttgaagcgacgaagcatttacctattcacatgacacgtattgctcaaggcgtaccacaaggtggcgagcttgaatatgtggatagtcataccttaagtcaggctgttcataaccgtatgcgtatgaaataa

SEQ ID NO: 3729 - DNA, 783 bp, Acinetobacter baumannii
gaaagaacagtgtttgttgatacccattgccatttaacaatgttagatttaacgccttataacggtgatttagatctagcacttgctgctgcgcgagcagaaggtgtttctaagtttatggcaatttcagttgaccttgatgattatattgctttagctgaaatcgcaaagcgtcatgaagatgtggggtatacggtaggcgtacatccgtgtgaggatgttgatactatggctcgagcaacgactgagtatttgactgaattggctcaatcagaaaaggtgtgggctttaggtgaaacaggtttagactattaccacagcactgactttattaatgagcaaaaagattgttttgctcgtcatattcaagcctctaaaaatgttaaaaaaccagtagttgttcatacacgttcagcaaaacatgatacggtggatattattcgagctgaacaatctacacatggtattttgcactgttttactgaggactgggaaacagcaaaagctgtattggactgtggttactatatttccttttcaggaattgtttcatttaaaaatgctcaagatctacgagatgtagccaagcaagttcctttagatcggcttttgattgagacagatagcccttatttggctcccgtaccatatcgtggtaaaacgaatgaaccaaaatatgtaccttatgtagcgaaagcactaagtgaggtatatgataagccagttgaggaaattgcaagaatcacctcgcagaattttgaaaatttacttaaagcgatttaa

SEQ ID NO: 3730 - DNA, 348 bp, Acinetobacter baumannii
agatacggagttaggtttatgaatatcaatatgctcatgcagcaagcgcagcgcatgcaaaaagatatggaatcaaatataaaaaaggctaaagaagagcttgctcaaactgaagtacatgctgaagcgggtggtggtttagttaaagtaacaatgactggccgttatatcgtaaaacgtatcgaaattaatccagaattacttcaagacgaaccagacatgattgaagacttaatcgcagctgcggtaaatgatgctgtgcgtcaagctgaagtagtttctgaagaaaaaatgcaaaaagctaactcaggtatgggtttacctcctggtttagcaggcatgttctaa

SEQ ID NO: 3731 - DNA, 216 bp, Acinetobacter baumannii
aaaaggatggttcacatgatagatgaagaaaagcctttaaattttgaagatgatgatgagcctcttgattttgaagatgaagaattcatagacgataaaaaagaggacgaaatgtataactcgattactaaggatggctctagtgtcgatcctgctgatgatgggacacgacatattcgtcctgaagacggcgatccgattgaaattgatgagtaa

SEQ ID NO: 3732 - DNA, 357 bp, Acinetobacter baumannii
caaagttgggtggctgatatgaaaactcactctcaacctatggacctaagagactactttgccacagctgcgatgcaaggaatggtagcaaccatttctaatcagtttgaattagatcgtttgcgtgaatgggcaaaacaaaatggccaaacattgagtcaatttattgctagtgactcatacaagcaagcagatgcaatgatttatgagcgtgaaaaagggactgtggaaagtatagatgcgatcaaacaaaagctaattgaggctattggacgtaagcattccagtctacatccaaatatgtatatgactgtcgatcatcttatttttcaacttgaaacgggtctgccattttag

SEQ ID NO: 3733 - DNA, 1155 bp, Acinetobacter baumannii
agtaggtgggttatgctgagtgttttaccaaaaagaaagttagaaacccagaccgctcctgcttcagcggggctatggcgacttgccatgcgtcgccttcgggccgataaaattgcaatggcatcgctcattgttgtgttgttctatttgatcgtattaatactatctctaacgggtgtgattgcatctgattggaataaagaagttgctgtcagttatgcgcctcctacatttataggtgcagataagacaacggaagctttgaaaagtacagccgctgtagatgaggaattaccggaaaatccagtcgatcccttaaaagatgtaattcaccaactcaaggctgaaatcaaacaagaaaagagctctggaagtgcaattgattattatggtgtagttgatccattagctgatgatatgaaagcaattgatcagcaactcggtggacatttacttgatcagcaaagtgaactaaaaagtaccctaatttttggtgctgacaaatgggggcaagacgtccttaaaaaaaccattaaaggcgctgaaacttcaattattgtagggcttgtctctgccttactggcagtcacattaggaacgcttttaggggcaatttcaggttattttggtggttgggtcgatgatattctcaactggttttataatatttttacttccattccatatttattattagttcttgcgattgctgctgtactacaacaaaagggcattttatctattgttctgattttaggcttaacgggctggacaggtgtctatcggttaattcgtgctgaatatatgaaacatacggcacgcgaatatgtacttgcagctaaagccattggtgtcgggcattttcgccgtatgtttattcatatttttcctaacgtcagccatattgcattggtccaaatgtctattttggtggtttcttttattaaatcggaagtgattttaagtttcttagggttcggtgtgccagtaggtgtagtgtcttggggcagtatgttaaatgaagcacaaagtgaacttcttttaggtaagtggtggcagcttgtcgcagcctctgtcgcaatggctgttttggttacggcattttcaatgtttactgatgcgctacgcgatgcattagacccgaaactaaaataa

SEQ ID NO: 3734 - DNA, 1149 bp, Acinetobacter baumannii
ggcatgcgggttaggagacctacaatgagctttgcattttggagtcgcttgaaagccttagttcggaaagaaactaaacagcttcttcgtgacaaaagcagtctcggaattggcctagttttgcctgttatcttaattttactgtttggttatggactttcttttgacttgaaccaagcacgagttggtgttgtcgttgatcagtcctcgccgcaggtcaatcaggtcttagctggcttaaatggatcgcgatatttaaccagtctagaatttcataatttgcctgaagcagaacaggccattcgaaatggcaaaattgatgcgattttgcatttgccttccgattttgcaaatcaggcccaacaaggtaacgcaaaggttcaattactattaaatggtagatcgaccaccatagcaactgctttagaggggtatgtcgcgggtgctttggctaccgcgccatcaatacaaattgatcgtagccccatattagcatctgcaagcgccgttaaaattgaacaaagaatatggtttaacgaatctggtaatagtacttggtttttagtgccgggtttaatggtactcattttaactttaattggcgcatttttaacgggtctgcttattgcgcgtgaaagggaaaggggaacattagaagccttatttgtcacgccagtacgaccatttgaaattgtgttggcaaaactcattccgtacgttgttgtcggcatgattgatatcgttatttgtattgttgctgcacattttatttttgaagtacctatgcgcggttcattattctcaattttatttgcttcattactatatttaatcgtttcattattacttggtttaactatatctggctttgcccaaagtcagtttcaggcgagtcaaattgctttgttggcaagttttatgccagcgctgatgctttccggatttgtttttgatacacgcaatttgcctttggttgtgcaaattattagccagttacttccagcgacgcattttatggttttaattaaaactttatttatgggaggtgatgattggaagctatggtttaaagagtgcggtattttattgggatatatcgttgttttgatatgtgctgtgaacttttcactgaaaaaacggttgagataa

SEQ ID NO: 3735 - DNA, 510 bp, Acinetobacter baumannii
atcaggtcattagtacgaccaaacaagctggtattggcaaaattgcctttgttactacccctccagcttccccgtaatgattttaaggagaattttatgggtatgaatgttggctcaaataatgaagacgatgtaatgctagaggtgaacatgacaccgcttattgatgtcatgctggtactcattattatgtttattattactatacctgcaccaaacaatgcgattaatattaatttgccaaatggcacaccgccaccaacaaatgaaaagccacctgaaatcattgatgtaagaattgatgcagcaggcaaagtattttggaataaccaacaggtttctgaccgcaaggcactagagactttatttcaaggtgttgtcgccaaaaaagatcaagaccaaatcaaacttaaaccagaccaaatggctgaatataaaaatgtagcgatggtcatggctacggcgcagcgtttaggtgtaactaaaattgggattgtgagtagcaattaa

SEQ ID NO: 3736 - DNA, 564 bp, Acinetobacter baumannii
ctaactcaattacgtcaggttcagtatcctcaagatataccactattacaccgctggatgcatgagccacacgttattcctcagtggcaattaaataaaagcgaaatagaactcaaagtttattttgaaaaaatgctagctgatgatcatcaacgtttaatgattgtaggaatcaatggtcaagacgtggggtatgccgaaatttatgaagggaagcgtgatcgcctagctcgttattataaaggtgaagacaatgatttaggttggcatttactatttggggagaaatctgcttttggtcaaggatttttgcgtccaacgattcgtttattgaatttctatatttttgaaaattccccaacaaatagaattgtaggagaacctgatcatacagtgaagccttatgcggctgtagtagaagacatgtgctatgaagagcagggcttaattccaatgccggaaaaaacggcaatgttgtattactgtttccgtgaaaagttctatgacagattttttgagttataccaggcatcgcaacaaaaattacagcaaaaagcgagttaa

SEQ ID NO: 3737 - DNA, 1086 bp, Acinetobacter baumannii
attcggcaattaattttatcacttctttatagtaaaacatttcagtctagggaaattgataaaagaatgaaacgatcggcacttggtttaatctatttaattcaaggaatgcgcaatgcgggcattgatgtcgactcacgtttggcagatataggtattaaagtagattccttggacccaagctcaacaattcatgacagtttggaatgggatatacagcaaattattagtgagaatgttgacccagagaaaggattatttattggacaacattacgcattggcaggttatggtcctttactcatgttacttgtgaccagccatgatatacaaacagccttagaaaaaggcatacagtatcaaaagcttacgcatttatttggtactttgagcttacaagaaactgaaaaccacatcattttgaactatttaccggtcgatttaaaaacagaaatcggtttactccgtgcccaatgcgaaatttcgggcacttataagtttattcaggatatttataccatgatgggcttaaaaatgcctgatatgcgtatagatttaccatttccggaaccctctgatccagatacctttgctcaatattacgcatattatggagatgatctacattttaattctacacatgcagcatttagcctaagtaagaatatgctggaaataaaaattccttcagcagatattattactcatcgtatctatgaggctaaatgtatcaaagaaatagaaagattaaatgaacaagatcatcaaataccgcctattattcaatatgtgcaagattatttagagctacaacaaggaattatcccgagcatggcggaaaccgcttttgctttgaaaatgcctgaaaggacattaaggcatcaattgcagcagcttaatacgagttataaacaaattcgtgaacagattattaagaataaggcgcttaaacttatggaatataaagagtattcaatagaagttattgcagaagcacttggttattctgaacctgccgcttttaatcatgcatttaaaagatggtttggacagagtcctcggcaatatggaaaagagttttactga

SEQ ID NO: 3738 - DNA, 399 bp, Acinetobacter baumannii
gaaaaaaaattgatatggattaaatttatcttgtatcctcttggtatgtttgtactgtggcaagctatttttataattatgcaactctctttaacatctctaaatatgtcacaagtctttgtaggtataatttcattgatcataaattgcgggatgcaaattcttattgattataaaatccctcatctagcaccgaaatataaatttgtagtgagtgctacttacgtcatcctcttcacctttttattggcaacctattcaacaactgttttattagaaggcttgaaagttgctcctcaagcaatttggctaggttatttgtttttccatgtaattggcgtgtttatatatttttctaataatagagacgagttttgttgggacaatttattaaagtaa

SEQ ID NO: 3739 - DNA, 768 bp, Acinetobacter baumannii
ataggaaaattagcaatgactgctctaaatcaatatggaatgagtttagaaattacgccgcataatggatggtctcagcggttttgggaggatcttttaccagtgaaggagcgggtgagtaagcatccgttttttactgaaatggccaatgggggattgagcctagaaagtttccgttatgctttacttaatttctatccattagtagcgcatttcccgtcatatatggccggtgcgttagctaaagtaactgcttttgcagaacctggcgttactgaaacaagagattggttaattcaaaatattaaggtcgaagagcgccatttacagtggtatcgggattgggcgaaaggttttgggttaacggtagaacaactcgatagtgttcgtccgccagcttcgatgaatgcggtgaatcattttctttggaatatgagtcaccgtggcaacttggctgaatgtctggctgcgactaatttggcaattgaatgggcgacaggtgactggtctattcaagtctataaaggcatacacgcttatacggatcatccggaagttaccattgataagcgttctttagcctggttacgtgcacatgctcattatgatgatttacatccttatgaagccatggagctgattaaacgtttatgtaatgaacgacctgattggcagcaaaaagcatttcatgcggcagaagaagggctgcggtattatgaattagctttagacgattgttatagagtacagcttcaagcctctgcttga

SEQ ID NO: 3740 - DNA, 843 bp, Acinetobacter baumannii
ttttttgaattctttaatgggaatagggattgctattcccatttttatttcttcataattcaatttgtttttagatatagatcagttagagacttggatatgacacctttttggatagcattgcaatttttaactgttctgcctattgagctaaaaacaataccaacggcgcaacaaaatggtcgagctattctgttttatcctctagttggtctgattattgggggcatactttttcttgttacctgtatttttgttaaattacccgctcttttacttgcggcaatcgtactcgctttatggatctggctaacgggtggattgcatttagatgggctagcagatactgccgatgcgtgggtaggtggttttggagataaactacgtactttacaaatcatgaaggatccaagttgtggtccaattggagtcctcagcttagttatcatatgtttgctcaaatttgcactagtttatgtgttgattgaacagcatcaatctttatttttaatatgcattcctatccttgggcgtgtggtgccatctattttgtttttaactacaccatatgtccgtgaaaaaggcttaggccgttctttgacagaccatttacccaaaactgcttcatggataataactgggttcgttctgctattacctttgtattgggggtggcaagggcttattgccatcattggttttttaatcagtcttgtttatttaagacatgtgtttataaaaaggattggcggtattacaggggataccgtcggtgcagcgattgaaataggtgaaactgtactgatgtttacttttgtcgtaagttatttttatttagtttga

SEQ ID NO: 3741 - DNA, 315 bp, Acinetobacter baumannii
actggcgaatttatgagttacaaacacaataatctgatggcaatgcgtcaccgtttttgggatgagtcttcagatcatgtattaaatgaaaagcaatttttacagcagaccttaatcgaacaaggcatttttaataatgcgacttttgatgatgttaagtactttttctatacactgcctagcatcgttattgtaaaggctcatgcgcttggttttatgcatgattccgtcaagcaaatggttattcaacatattcaagctaatcgtatgcatttaatgcaaaaggctgaattgaaaattcagtttaaaatgtaa

SEQ ID NO: 3742 - DNA, 2016 bp, Acinetobacter baumannii
atgcaatattcgtttaatggtggcgtaatttcaccagatatgttcggccgcattgatcaggcgaaataccagactggtgttgccaaatgcaaaaacttttatgtcgaactttttggcggccttgtctatcgtgcaggcttccgctacgtacaccattaccctaaatcaatgggtaaaatgcgtttaattcgttttgtctttagtgaagaacaggccgttgttttggctattcgtgcaggtgctgtaaatttctttgctgatggcgggatgcttttagacgataacgatcaacctttagaagtagcattgccttatgctgagcagcatttaatgcagctccgttatgcacaatctgcggatgttatcaccatcactcatccggactacccaccacgtaaaatcattcgtaagggcgcaactgaatggacgactgagatagtcacggtcgggtatggcttggctcaaccgcaaaacttgaatggtaccgttaaaaaggtaaatgaaaacggctacattgaacgtgaatacgtatatcaagttactgctgtaaacgatgaaaatgaatcccaagcatctgcaaaatcgcctgttttaaaaaacgatctaacattatcgggcaatgaaaatattctgacatgggatgcagtgctgggcgcgacccgttacaacgtattcaagttgcgttcaggattagctagttacattggggaaacaacagaattaagttttactgatgattacatcgaaactaacggcgcaattacaccacctttaatccgcaatcctttcgagttttacccaatggctgttgcatatcacggtcagcgaaaagtttacggtgggggttataaatcccctcaatggctacgaatgtcacgtacagcaaccgatgataattttgggtatcacatccctttacaagatacggactctatccaaattcgctttgctgcacgagacggtaacggcgttcgtcaccttgtgcccatgagtgacttactcattctaacaagtggcgcactttggaaaatgtcagctgatggggctgtaactgctgcaagtgttaatgtgaataagcaatacagtacaggtgcaaatgatgtaacgcctgttgaagttgacggtgctgctgtatttgcttctgatcagacagggcatgtgcatgaagtgtcactagcaagtggttataacgcttcgttttatcaaacgatcgatttatcaattatgtgcccgcatctctttgatgggcataaaattgtagattgtgcattgctacgcaaccctttgaatattatatattttgttcgtgatgacggcgtcttgctttcgctaacatatgagccgcaacaacaggtttgggcttgggcagaacatcatactgacggtaaatttctttcattagcagaaatacctgaagataaccaatctgttttatatgcatttgttgaacgaaatggcttttacacaattgagcgaatgcttacaaggcagccgctagatatgcaagataagtgttacctagacagtagcattcaatataagggcaaccccacatcaactttaaccggcttagattggttggaaggtcaaacggtatctgtatttgctgatggtggagttaagccaaatgttaaagttgaaaacggcacaatcaaattaccccgtgaattgtcaaatatttgggtgggcttagggtatgaagcagaaatgcaaacattgccaatttttcaagagcaaagaagccctgttaaacctaaagtggtgaataaagcatttttacgtgttttagattctcaaaacattttggtcggcgctaaccaagatattgaagaccgtacgccaatcgatgagtttaaaccgcgtagcaacgaacgctatggcagccctcttaaattgtattcaggtttggtagaggtaccagttgacagcacttacgaaagagacattcaaattactgtaaaacatgataaacctttacctatgaagctattggccctagaggtagaaatgacatga

SEQ ID NO: 3743 - DNA, 1359 bp, Acinetobacter baumannii
agagtaccttttgtgtcgaatgtcacgtcgtttcggtctgaattaaaacaactcttccatttaatgttacctattttaattacgcagtttgctcaagcagggttcgggttaattgataccattatggctgggcatttatctgccgcagacttagccgctattgcggtaggtgtaggcttatggattccagtcatgctcttgttcagtggcataatgattgcaaccacaccattagttgccgaagcaaaaggcgctagaaatacagagcaaattccagtgattgtccgccaatcattatgggttgcagtaattctaggagtattggcaatgctcattttgcagcttatgccatttttcttacatgtgtttggcgtaccagaaagtttacagcctaaagccagtttattcttacatgcaattggtttgggtatgcccgctgtaaccatgtatgcagcgttacgaggctattccgaagcattaggccatccccgccctgtcacggtcattagcttactagccttattggttttaatcccgcttaacatgatttttatgtatggcttaggaccaatacctgctttgggtagcgcaggctgtggttttgcaacatccattttacagtggctgatgctcattacgttagcaggctatatttataaggcttcggcttatcgaaacacatctatttttagcagattcgataaaattaacctgacttgggttaaaagaattttacagcttggtctgccaattggtttagctgtgttttttgaagtgagtatttttagtacaggggcattggtccttagccctctaggagaagtctttattgccgcacaccaagtagcgatttcagtcacttcggtactgtttatgattccactttctcttgccattgctttaaccattcgcgtagggacgtattatggcgaaaagaactgggcttccatgtaccaagtacaaaaaattggtctaagcacagcagtattttttgctctattgaccatgtcttttattgctttaggccgtgaacaaattgtctcggtttatactcaagatataaatgttgtgccggttgccatgtatttgctctggtttgcaatggcatatcaattaatggatgctctacaagtcagcgctgccggctgtttaagaggtatgcaagatactcaggcaccgatgtggatcaccttaatggcgtattgggtaattgcttttccaatcggtctttatttagcgcgttataccgattggggcgtagctggtgtgtggttaggtttaattattggtttaagtattgcctgtgttttattgctctcacgactctatttgaataccaaacgtttaagtcaaacctaa

SEQ ID NO: 3744 - DNA, 393 bp, Acinetobacter baumannii
aggggtggttctatgtattatcctttactttcaattgctttaggctcagttctaggggcgtggttgcgttggtttttaggtttaaaactcaacccgatttatccgcaaattccgttgggtactgttactgttaatttggtcggtggctttattattggttttgcgatggcttattttgctcatagtgatttgaacccgaattataagctttttgtgattaccggtttttgtggtgctttaactactttttcaacgttctcgattgagatcgtcaccttattgcaaagtggtaagtggggaatggcgatgtcggcgatttctattcattcaattgggtctttaatttatacgtgtttggggttggcgacttattattgggtagcgggacattga

SEQ ID NO: 3745 - DNA, 702 bp, Acinetobacter baumannii
tctactttctcgattcacatatttcgtataaagtggctgttacagatagatacaatattgaagtatgtgtctttgtctgttaaaagatgcgtgaagactaaattggcggtgtttatgaccacagggcgaatcctgaatatcccaaatatcctaactttggcgcgtattgcgcttattcctgtatttttggtgattgcatattggccgcctgcaataggtattggtgagcacgtaggaagtatgacacgtcatattatcttgacggctattttcgtgctggctgccgtaaccgactggtttgatggctatttagcacgaactttaaaccagacttcagcatttggccgtttcctagacccggttgcagataaacttatggtcgcagctgcacttattgttttagtgcagtggaaaccgacaattgcgatggctttcgctgcaattgttattatttcacgggaaattactgtgtctgctttacgtgagtggatggcagaacttggcgcgcggaccagtgtagccgtatcaacagtcggtaaatataaaactgcatttcaaatgattgcgattagtgtattcctgttgaattggcagcctttagaagtattggcctatgctttgttatataccgccgttattctgactttatggtcaatgtttatttatttaaaagctgcatggccatacttaaagcagccataa

SEQ ID NO: 3746 - DNA, 1755 bp, Acinetobacter baumannii
acgttgcctttcacacgatacttgacgcaaccgtgctacgagataaggagttttctcatgatgttggctgaccctagcaaaaaataccgccgtatgtaccagcgagtcgatttaccagatcgccaatggccaaataatgaaattacaaaagcgccaatctggatgagcacggatttacgtgatggtaaccaagcaatttttgaaccgatgaacatggaacaaaagttcaaaatgttcaaaatgcttgtaaaaatcggttttaaacatattgaaatcggcttcccttctgcgtctcaaattgacttcgattttactcgtatgttgatcgaagaaaatcatattcctgatgacgtatacattgaagtattggttcaggcacgtgaccatttaattgagcgtactttcgaagctttagcaggtgctaagcgcgcaattgtgcatatttataactctaactctccaaccttccgtcaaaaagtgttgaatgtagatgtaaatggtgcaaaacagttggcggtgaatgcagctcaaaaagtgaaagaatatgctgcgcaatatcctgaaactgactggattttccagtacagtccagaatgcttctctgcaactgaattagaagtagcaaaagaagtctgtgatgcggttacagaaatttgggatgcacgtccagatcataaagttattttgaacttacctgcgactgtcgaagtttcaacaccaaatgtttatgcagaccaaatcgaatggatgcatcgtaatttggcacgtcgtgatggcgtcattatttctgttcactgtcacaatgaccgtggctgtggtattgctgcatcagaacttgccattatggcaggtgccgaccgtgtggaaggctgcgtatttggtaacggcgaacgtaccggtaacgttgacgttgcagcaattgcattgaacatgtacacccaaggtgtagcgccagaattagatttctctaatattaatgaagtcattgcaacggttgaagaatgtactggtttacctgtacatcctcgtcatccatatgcaggtgacttggtatttactgcattctctggttcgcatcaggatgcaatcaaaaaaggctttgaatatcagaaaaacgaagaaatctgggatatgccttacttaccaatcgacccgaaagatttgggccgcgactatgatgctgtcattcgtgtgaatagtcagtctggtaaaggcggtatcgcttacttattagaatcaaactataacgttgtattgcctcgtcgtttacaaatcgaatttagtcaagttgttcaacaatatactgatgagaatggtacagagattagcgctaaacaaatctggaccttatttaaagacacgtatgttgaagtgaaaaaccaccattacacggtcaaaaactataagttatctgacattaatggtactcaaattattgaacttgagattgatgttgaaggtgaaactcaacaattacgtggcgaaggtaatggtcctatctctgcattcttaaatgcacttcaattaccaattgatgtattgaactacgaagaacgcagtattagttcaggtgcaaatgccaaagcattaaccttaattgaacttcaagtgaaaggtacaggcagaggctcatttggtgcaggggttcacgacaacacagtcacttcatctattgaagctattattgcatgtaccaaccgtttgattgatcaaggtgttttaagtacagatcaggttgttgccgccgctgtttaa

SEQ ID NO: 3747 - DNA, 333 bp, Acinetobacter baumannii
ggtatgcactcttttgtacttgttgtacatattattttagcagtactgatgattgcattaattttagtgcaacatggtaaaggcgcagatgcaggtgcctcttttggtggaggtggcgcagcaacagtatttggtgcgtctggttcaggtaacttcttgactcgcgtgactgcaattttgacagctttattctttgtgaccagtttgactctggctgtttttgccaagaagcaaacgactgaagcatatagtttgaaaactgtacaaacgactgcgccagctcagaccacatcgcctgaaacttcaccaaatgcaccaaaaaccggccaataa

SEQ ID NO: 3748 - DNA, 3702 bp, Acinetobacter baumannii
ggcatgaactcaagagtacaggtgtcttatcaacctattattgatattgaatttagtggactgcatttaattgaggcttcggcgggtaccggaaaaacctatacactgtcgagtttaatggtccgtatttttcttgagaaatatttaccgggccaagtcattgcaacaacattcacccgtgctgctgcggctgagttaaaaagccggattcgtgcgcgtttgatcgaaacccaccgttatttagatgccaagcggagcttgactgaaaaagagatccttttgcaggccgagcaagaaactgacttattactgcaacatattctcaagcattttgcgacacgtattgcctatgcctgtgagcgtttaaagctcgttatcgatcagttagatgagctatttgtcggaacacttgatagctttagccaaaagctattacgtgagtttgcctttgaaagtggcaaaattgaacgtgctcaaattactgatgatgctaaaacctatagccgccaactgattcacgatgtactccgtgaatggatacagtctcagcctcaaaccgtgattgatgcgttgtatctggcaggagagttaaagagtgtcgacagttttgtcaaactggtcgaagactcactaaattttagttcggctcattttaagcttcccgaaaaacctacgattcagtttgaacaacttgctcagcttaaacagttggcaacagaaattgatattagccttttagagccgtattacttgcttgatggcgagcactataaacatgtaaacggcacaatatttcgtaacggggcttttaataagttatttagtgaatgtttgccacagttattacaaattttaaagcaaagtgacagcattttagtttttgatggatctttagcagcacaacgagaactcgtttttaagtttttaggccaacttgccgatcagaaagtttttaaaaaatgtcccgccgaaatttccgatggattctatcaacatccttgtattcagcagattcagcagctatttggtgtgctgaaaaactacgctgagcagttcgatcagcttcatatttatttaaaagcttatttgtgtgtagaagttaaaaaacgtttaccacaagttttacaaaataagggtgagacgactttttctcagcaaattcgcactttgtcagaagctttaaagggcgagcaggggcaacgttttgccgtatttgtgcaggctcgataccccttaattttggttgatgagtttcaagacaccaaccaagaccaagatgacatgctcgccagcatttggcgtcatccagaacgttaccaaaaaggttgcatgattatggtgggtgaccgtaagcaggcaatttacggtttccgtggtggggatatgctcactttcttgaatgcctacaaagatattcaggcaaagcatggtcgcgaatataaattaattcataaccaccgttcagtcgctgacttggttgaagtggttgatgcgttatttcaaaggcaaatcgactttggtgaacaggttcaatatgacccgattcgggcagggactcgacctcatccggttttaattgatcaaaaccagcctaatccgcatcctttacgttggctcatgctaaaagacaaggaaacagaagcacagcaagtcgcgtggaaaatacgtgatttactcaatcagtcacatgcaggacaactttattttcaaaaagatgctcagactcaaatcttaaatgaagatgatattgcggtcttgtcgcgtaatcatgatggtcttgataaagttcaatttgaattagaacgtttaggaatacgagttaatcggccatcaaaacgaagtgtttttgattgcacaattgctcaggatgttggagccttactcactgcgattcttcatccttacgatgaggccaaagtgaaacgagctttgattagccgtttatttgctatggaccttaaacagctgttgcaactcgaacaaacggccgaaggtttaagccagtttatgacgggttttgatactattcgggaattgtggtcagctcagggctttttagtagcatggcagcaatgtttaaaccaatttggcatttggaaaaatctggttgctgtccagagtaaagataatgagcgggttgtggtgaacttgcgtcatttgaccgaaattttgagccaacatagcgagaaatatcagggcgcgcaaaatctctatcactggtatctcaagcaattacaatcaccgcttgatcgtgaatgggagttagagcgtaggttgtcgagtgaagctggcgtacagctcatgaccattcaccagtcaaaaggtcttgagtttaaaattgtctttttgctcggggccgacaagccatttcgggaaaataacaaaacacttaacttctcgacccaagatataacggttccggagtcggctcaaaccctaacacaacgtgttgttgcgattgccgataaaacatatttaaacgaaatcgagctgaagcagcatgaagaacgggctttggcggaacaaaaccgtctatggtacgttgctttaacccgggcaagtcatcgtgtttatgcgctcttacaagatacggatggcaagtctgtttcaggtttggcattttggaaaaacagagcggaaccattccagcaccattgttgtaccgatgaaataattttggagcaaccacctgctgcaagacatttaaatcaacacatcaatattattgagatacaggcacagcattttcctgatcagcgcttttattcaagaggcaaaaccagttttagttatctggcacagcatttaagacataaagtaggtacagatttactcgcgagtcagagccatgaagctgttttagccgaagatgaactcgatcaggttatttctgttgagacgcccgcagcacagccaattaactggatcaaaagtaattttccgagagggacgctcgcaggtaatttcttacatgaaatttttgagcatattgattttcaatgttcagatgagtgggtaagtgaaatacgtcgtcgttttaaaaatgactacagtagtttgtggcaagatttattaatcaaataccaagaaagctttcccgaagaacaagaagcggaatattcgctttatcacgctgtggccgaatggttgcaagagattctaagcacgccgttatatcaaggctttcgcctaaatcagttacagccagagcactatttatcagagtgtcctttttatttggcactgtcagatcgtgtactagccatgaaacgtattcagcagctgtttgctgaatatggtatggaaatgcctgagttattagaggcacgttctgcacgctatttaaatggttcgatagacttggtttattttgatggacagcgttatcacattgctgactataagagtaactacttgggtgaaaaccttgctgattacagtgtagaaagtattgcacaaagtatgtctttagccagctattggctacaagcaggcctgtatttggttgcattacatcgttatttaaaagtcaaaatgcagaattatgatattgaacaacacttaggtggggcgacttatctttacttgcgcggtatgaacggcgaagctgagcagggttattattattggcagccaagtacagaatttgttctacgactcgatgctattttagggtactttgctgaggataaaattgcataa

SEQ ID NO: 3749 - DNA, 261 bp, Acinetobacter baumannii
tacttaagctctgccgagtcaccatttgcaaagcagctcgctgatgaggatcagttaataagtctaaatgctcttcacatgaaacaggttgaattggttgttgctttaatcggcgaatttgctcagctagacgttgctctaggttccaatatcggtataatgccaacccctgcccgtcgtggacacaaggggcaacttgagactttgcttgttcagcagatatcaccagttggccaagtgtttctatttgctctgggctaa

SEQ ID NO: 3750 - DNA, 561 bp, Acinetobacter baumannii
ttaagtagattatcgggtaaaagagctatgaaacgttggtacattattcatgcctattctggttatgaaaaacaagtgatgcgttcacttaaagaacgaatccagcgtagcgctgttgccgatagctttggtgatgtccttgttcctaccgaagaagtggtagaaatgaaggatggtaagaagcgtaaatctgagcgtaaattctttcctggctatgtgttagttgaaatggaaatgaatgacgatacttggcacattgttaaagagtgtccaaaagtattaggttttattggtggtacacctgaaaaacctgcgccaatcactcaacgtgaagcagatgcgattcttgcgcgtgtacgtaatactggtgaagccccacgtcctaagacgatgtttgagccaggtgaagaattacttgttattgacggtccattcacagactttaaaggtgtggtggaagaggttcaatacgataagtcacgtttaacgttgacgattaacgtgtttaatcgaccaactcaggttgaactcgaatttcgccaagtcgaaaaaacgatttaa

SEQ ID NO: 3751 - DNA, 1443 bp, Acinetobacter baumannii
ataaaaagattagagcagtggaccatgagtgaacaacaaccaaaatttgaaatacgagacgaagaacagctttcagttgatttaattgaagcacaatatgctttaaaagaaagccgaggaaaacccaatgccaaaagcacactcattttaatgagtggtatcgagttagctggaaaaggggaagcggttaaacagcttcgtgagtggctagatccaagatatctgcgggtaaaagcagatgcaccacgtgtgctgacagactctgaagcattctggcagtcctattcagcatttattccgactgaaggccaaattgtggtgatgtttggcaactggtatagcgatttgttggttacggcaactcatgtgtcagaacctttggatgatgcgcgttttgatgcctatgttgaaaatatgcgggcgtttgagcaggacctaaaaaataactatgtcgatgtcattaaggtttggtttgatctttcgtggaaatcactccaaaaacggttagataaaatagacccatctgaacagcattggcataagcttcacggcctagactggcgtaataaaaaacaatatgacactttgcaaaagttacgccgtcgctttaccgacgattggtacattattgatggggaagatgaaaaacagcgcgatcaattttttgctcagtatcttttacaacatatgcgtcaattgcctgaacatgaaactgaagtcaaaggtaaatggcagcaggcaaaaattcccgagagtttattaaaacctgctcaggaaaaaatggataaagccgaatataaaaaagagctcgacaaactcagtaaaaaaattgccgataccatgcgctttgataaacgtaatgtggtgattgcatttgaagggatggatgctgcgggtaaagggggggccatcaagcgaattgttaaaaacttagacccgcgtgaatatgatattcactgtattggggcgcctgaacgtttcgaagcaagacacccgtatttgtggcgtttttggaatcgtattaatgaagctgaaaaaattaccatttttgaccgtacctggtatggtcgtgtgctggtcgagcgtgttgaaggatttgcttcacctatcgaatggcaaagggcatatgacgaaatcaatcgctttgaaaaagacttatttgatagccaaacaattgtggtaaaaatttggctagcaattagtaaagatgagcaagagcaacgttttaaagccagagaagagacaccgcacaaacgctttaaaattactgccgaagattggcgtaaccgtgataagtgggatgattatttaaaggcagccgcagatatgtttgagcgaaccagtaccgaatatgcgccttggtatattgtcgcaacagacgataaatacactgcacgcttagaagtgttaagagctattttaaaacagctgagagcagattaa

SEQ ID NO: 3752 - DNA, 525 bp, Acinetobacter baumannii
atgaaattatcaaataaatcccaagcattgtatgacatgattgctccagcagtggaggcatgtggtgtcgacctttggggaattgaattccttccacaaggtaagcgttcattattgcgtatttatatcgatagaccggttgatgaaaatgctgaaccagtgattaatgaagatggtgaagtagagcaaggccgcggtattggtgtagaagattgtgttcgtgttacacaacaggtcggcgcaatgctggatgtccatgatccgatttcaggtgaatatgcattagaagtttcttcaccaggttgggatcgcccattttttcaactcgaacagttgcaaggctacattggacaacaggttgctttgcgtttgattgctgcagtagaaaatcgtcgtaaatttcaagcaaaactccttgctgtagaccttgaaaatgaagagattcaggttgaagttgaaggaaagcatgtgcttgatatcgacagcaacaatatcgataaagcaaacttgatctatcaagattaa

SEQ ID NO: 3753 - DNA, 1083 bp, Acinetobacter baumannii
ttgctgcaatcaatcacatatcagatattgaatgagaaaatcatggctcaacaaagactgtcatttttagatcgtaaccttacgctatggattttcattgcgatgggggtggggattgcgataggtgtcttcttacctcaagcttctgttactttagacaaaatgagtgtggattctgtcaatattccaattgcgattggtttgattctgatgatgtatccaccgttagccaaagtggactatgcagctctaccacaagtatttaaagacaaaagaacattaactttgtctttagtacagaactggattattgctcctgtattaatgtttgcattagcaattatttttttgcatagctatccagagtatatgactggactaatcctgatcggattagctcgttgtattgcaatggttttagtttggaatggtttagcctgcggcgataaccaatatgtagcagcattggttgcattcaatagtatctttcagattttgttctttagtacttatgcttggttatttcttaccttcttaccaccttattttggtattgctgggcaagtaatcaatgtggatttttggacgattacccacgcggtattgatttacttgggtattcctttttttcttggtttcttgacccgtttgatcttagtcaacgccaaaggcttagagtggtaccaaaatgtctttttaccgaagatcagtccattaagtctattggcattactgtttactattgttgctatgtttagtctcaaaggtggagatgtagtgagtctgcctttggatgtaattcgaattgcgattccattaacaatttactttatcgtaatgttcttcattagtttctttatgagtaagtggatgggtaatgactacccaaaaactacagcaatttcatttactgctgcgggtaataattttgagttagcactggctgtagccattgcaacctttggtttagcatcgcctgtggcatttactacagtcattgggccattagttgaagtaccagttttgattgctttggtcagtgtctctttatggctaagaaaaaagtattttgaatcggtgtaa

SEQ ID NO: 3754 - DNA, 1173 bp, Acinetobacter baumannii
atggctactttaaatccacgtgacgttgtgattgttgatggcgttcgttctgccatgggcaaatctaaaaacggtatgttccgtaatgtacgtgccgacagtttatctgctgaacttgtacgtgcgctcgttgcccgtaaccagtttgatgtaaatgaagttgaagacctgatttggggctgtgtaaaccagaccctagaacaaggtatgaacattggccgtaacatcggtttattggctggcttgcctaaaactgtggctggtcaaacagttaaccgtctttgtggttcttctatgcaagcgatccacactgcggctgcacaaattgcaacaaaccaaggtgatatcttcattattggtggtgtagagcacatgggccacgtaggtatgatgcacggcatcgaccttaaccctgaagcatctaaacactacgctaaagcatctaacatgatgggcttaactgctgaaatgttaggtcgcatgaacggcattacccgtgaagaacaagatgcgttcggtgttgaatctcaccgtcgtgcttgggctgcaactcaagaaggccgtttcaaaaatgaaatcattggtgttgaaggccacgatgcaaatggctttaaaatcctttgcgacatcgatgaagtgattcgtccagatgcaaaccttgaagcgttcaaagcattaaaacctgtatttgaccctaaaggtggttcagtaacagcagcaacatcttctgctctttctgatggcgcttctgcaatgttgcttatgtctgctgaacgtgcacaagcattaggtttaaaaccacgtgccgtgatccgttctatggcggttgctggttgtgatgcagcaatcatgggttatggtccagttccagcaactcaaaaagcgcttaaacgtgctggcttatcaattgctgatatccagactgttgagttaaatgaagcatttgctgcacagggcttgtctgttcttaaaggcttaggtctgtatgacaaacaagacatcgtgaacttaaatggtggtgcaatcgctcttggtcacccactaggttgttcaggtgctcgtatcaccactacgttgttaaacgtaatggaacaacaagatactcaaatcggtcttgcaacgatgtgtatcggccttggtcaaggtatcgcaacagtgatcgaacgtgtttaa

SEQ ID NO: 3755 - DNA, 1722 bp, Acinetobacter baumannii
aaggagtttttagtgccgcatgacgtagatttaattattttacttgctgttggtttcggcgttgccctgttttttggctatattgccgcccgactacgacttccccctcttattggctatctcattgccggaattattattagtcctaatactcctggtgttgaagcagatattcatcttgcaaaccaacttgctgaactcggtgtaatgttcctcatgtttggcgttggtatgcatttttccttaaatgatcttttacttgttcgccgcattgccttgccaggtgcaatcttacagattgctgttgcaactttactgggtattggcgtttcaatgttatggggctggagctttggctccgcactcgtttttggcttaagcctgtcatgtgcgagtacagttgtattattaaaagctttgggagaccgtggtcttctagattctgtaaacggcaaaattgctgtgggctggctattagttgaagatttagtcatggtacttgttttagtacttcttccagctacagctgttttactgggcggaaaagccccagcaggcgcagaaggtaacatctggctaacacttggaatcaccctattaaaggttattggctttatcgcctttatgctgattgtcggtaagcgcgttgtgcctattattatgcagtttgttgctcgcttaggttcaagagagctatttacgcttactgtagtcgctgctgctgtatcgattgcctatggttcttatgccatctttggagtttcaatggcattaggggcattctttgccggaatggtcgttaaagaatcagatttcagccatcgcgcggaagaagaaacgctaccactacgtgaaattttctcgattttatttttcgtttcagtagggatgttgtttgatccacatattcttattgaacgtccactacatatcttggctgttatcgcgattattatggtgggtaaaacacttgctgcaatggccttggttttattcttccgctatccaatcaatactgctttaacagtcggggccagccttgctcaaattggtgagttttcatttattttggctacccttggtgtctctttaggtctattaacgttagaagctcaaaacctgattttagcaggcgcattattctcaattacactgaactctttcatcttctcggcaattgagccggtacaacgttggattcgtgaacgctctcatttagcacgacttcttgaacgtagtggcgacccattagccatgctgccagatgaagtcgatcaatcttatctacgcgatcaagtggtgattgtagggtatggtggcgttggacgacgtattactgaaaatttaattaatcaaaatattaaagtcgtaattgcagaagagaatcgtgaaatcgtagaaaaactacgtcaggcaaacattgcggctgtaagtggtgtagcaaccgaacctggcgttttaattcaagcacatatcatgcacgcacgactcttggtaatttcacctatggatattttagatattcatcggattgtagatattgcgaagcaattgaatcctcaaattcaggttttaatttgtgcagaaagtaaagaagaagccgcagtgattagagacgaacacattggtgaagtattctatgcgaaagaagaaatggctaagaatatgagccatcatattttaaatcaaattgaacttgcgcatcagtccacacatcattaa

SEQ ID NO: 3756 - DNA, 1947 bp, Acinetobacter baumannii
tcatttaagtcctcatttgagattttggaaaacattatggcctatattactttaagggatgtccaacttgcttttggcggacctgccctgctcgatggcgcgaacttcaacctagaacgtggcgaacgagtctgtttaattggtcgtaatggtgaaggtaagtctactttacttaaactcattgagggaagcctactaccagattctggtgaagtttctgtccaaaatggtttaactgtttctatgttagctcaggatgttccaatgtcatcgggcaaagttgcagatattgtagcagaaggtgcaggagaagccgctgccgtacttaaagcctatcatgaagcaagtgatgcctgtgtacttggtgacatggaagcttgcgatcgtatgggatctttacagcataaacttgaccaacttgatggatgggcattagaaaataaggtcaacacgattttaggtaaaatggagttagatccgaatgcagatctagccgacctatcaggtggtcgtaaacgtcgcgttttactcgcccgcgccctacttacccaaccagatgtgttattactcgatgagccaactaaccacttagatgttgaaagtattgagtggcttgagaaattcctgcttgatcaaaataatttaaccttactctttatttcgcatgaccgttcttttgtagaccgccttgcaactcgtattgtggaattggatcgcggcatattacgcagctatgaaggaaactattctcgttatcttgacctaaaagctcagcagcttgaagctgaagaaaaacaaaatgccttgtttgaaaagaaacttgccgaagaagaagcatggattcgtcaaggtattaaagcacgtcgtacacgtaatgaaggtcgtgttcgtgcccttaaagcattacgagaagagtcaaaagctcgccgtttccaacaaggcaaagtcaatatgggcgttcaagaagcacagcgctcaggcaaacttgtatttgatattgaacacttaagcgtaagctacgatggacaaaccctcattagagatttctctgccattgttatgcgcggtgaccgcattggtttggtcggtgataacggtgtaggaaagactactttaattaaagcgatcttaggcgaagttcagcacgaaggtgttgtcaaaacaggaactcagcttgaaattgcttacttcgaccaattacgtaatcagcttgaccttgaaaagtcggtttctgaaaacgtttctgaaggttcagatttcgttgatgtaaatggtcaacgtcgccatattctcagttacttacaagacttcctattctctccggaacgagctcgtacaccggtaaaagcactttctggtggtgagcgtaatcgtgtcctgttagcaaaactattgctcaagccatcgaacctgattgtaatggatgagccaacgaatgacttagatatggtcacacttgagctacttgaggagatgttgtctgaatataaaggtactttgcttctaattagccatgaccgtgcttttatggacaacgttgtaacatcaacttgggtatttgatggcaaaggcggtattgcagaatatatcggtggttatcaggactatttaattcagcgtccaaatgagagagtcgttgaccaaaaaggcgatgtaaaaaaagctcaggctaaagcagaagctgaaaaaaatgcagctcaaacgaacgtaaaaaaggtcaaattaagctacaaagaccaacgcgaactggaacaacttcctgcggaaattgaaaaattggaaaccgagcaagccgagctttctgacaaacttgcggatggttcatggtttgtcacagatgcagatgctgcaaccaaagcaagccagcgtctagcagaaattgaagagttactccttgaaaagttagagcgttgggatgaacttgagcaaatgagtaaaggcaattaa

SEQ ID NO: 3757 - DNA, 486 bp, Acinetobacter baumannii
tcatggaagtccaatatgggtcatgttgattacgatagcacattgatcgtcggctcttttattgcggctggcgctatttgctatattgtgatttccatggagcagttaatatttaagcaaacttataaaaagattgagccgtttattctattactcaatggattattactcgcagcagcgattagtattgtccatattgtcggcatgcatgcttaccatttatttgaagcagcttcttcgaacgttcctttaattacactggcttttggaattagtgctgtactttcaagtgtcgcaatttggctgacttctcgttttacacttcctatatttagactcattttaagctcaatcattatgggaattgggatttctgcttcttattatgtgagtatgttaggctggaatattgatatttataagaaagactatacctcttttcttattttattttctgttttaattgccatgaggggtcgggactag

SEQ ID NO: 3758 - DNA, 864 bp, Acinetobacter baumannii
tacattgagtctttaggaaagatcatgcaagaggaaccgagtccgtcgtggggaatgcgaggcttacgaaagtggttaggtacagcgccagaaacccgagatgaattattaaaactagtccaaaattcacgtcgttttttagaacctgatactgttgccatgcttgaaggtgttcttgaccttcctgctacaaaaattcgtgaagtcatgacgccacgaacagcaatgatcagtatgcaagaagatgatcagttacttgatattcttcacgtattggttgagtctgctcactcacgttttccagttttctcagctgaccaacctgataatgttgttggtattttactggcaaaagatttactaccatttttgactgaaccaaatactaaattagatattggctcgctcatgcgtcagccattatttgtgcctgaaagtgcacgttcagatcaagttcttcgtatgcttaagcatacccagacccatatcgcgattgtgattgatgaatatggatcaacagcgggactggttacgcttgaagatattcttgaagagatcgttggtgaaattgaagacgaacatgatactgcggatgaagatgcacagtacattgttccagataacgaccatacaatagcgaatgcatggatggtgcaggcacttacaccaattgaacacttcaacactgttttagatgctgatttttctgacgatgaagtagaaactgtcggcggtttattgcttcaagaaattggtttagttagtgatttacaaggtcagactgttgagcttggaaattggttatttacgattgttgaagcagatgcccgcactattcatctgattcgagctgtacgtcaatga

SEQ ID NO: 3759 - DNA, 4224 bp, Acinetobacter baumannii
gcgaggcttcccgacacacggagaaaaaaattgaaagacttgctcgatatcatgcgtaagaaaacggactcagatggtcatgcgccagttgagttcgaccgtatccgtattggtcttgcgtcaccagaaatgattaagtcatggtctcatggtgaagttaaaaaacctgagacaatcaactatcgtacgttcaaaccagaacgtgatggtttgttctgtgccaaaatctttggtccagtaaaagattacgaatgcttgtgtggtaaatacaagcgtatgaaatacaaaggcgtcatttgtgaaaaatgtggcgttgaagtaactacagcaaaagttcgtcgtgaacgtatgggtcacattgagcttgcttctccagttgcacatatctggttcttaaaatcgttaccatcccgtatcggtttattacttgatatgacacttcgtgatatcgaacgtgtattgtatttcgaatcatacgttgttactgatcctggtatgacaccatttgaaaagtatcaacttcttaatgatgaagaatactttactgctctagaagagcacggcgacgaatttgttgcaaaaatgggtgcagaagcagttcaagacttgttgaaagacatcgaccttgaagctgaaatttcacgtttacgtgaagaaattcctcaaacaacttctgaaacgaagttgaaaaaagcgtctaagcgcttgaaattgatggaagcattcaaagactcaaacaacaagccagaatggatggtaatgaacgtacttccggtacttccaccagatttacgtccattagttccacttgaaggtggtcgtttcgcgacttctgacttgaacgatttatatcgtcgtgtaattaaccgtaacaaccgtttgaagcgtcttcttgaccttgcagcgccggacatcatcgtacgtaacgaaaaacgtatgttacaagagtctgtagatgcgttgcttgataacggtcgtcgtggtcgtgcaattactggttctaacaaacgcccattaaaatctttggcagacatgatcaaaggtaaacaaggtcgtttccgtcagaacttgttaggtaagcgtgttgactactctggtcgttcggtaattactgtaggtcctactttacgtcttcaccaatgtggtcttccgaagaaaatggcacttgaattattcaagccattcattttcgcgaaattacaagcttcaggtcaggcaacaaccattaaagctgcgaagaaaatggttgagcgtgagactccggaagtttgggacgttcttgcatctgtaattcgtcaacatccagtaatgttgaaccgtgcgccaacacttcaccgtttaggtcttcaagcatttgaacctattcttattgaaggtaaggcaatccgtcttcacccactcgtctgtgctgcgttcaacgccgacttcgacggtgaccaaatggcggtacacgttccattgacacttgaagcacagttagaagctcgtgcattgatgatgtcaacaaacaacatcttgtcaccagcaaacggtgagccaatcatcgttccttctcaggacgttgtcttgggtctttactacatcactcgtgatgcagtaaacgcgaaaggtgaaggcatggtgtttgcggatactcacgaagtaaaccgtgcacttgcaactggtcaagttgcgatccatgctcgtgttaaagtacgtgtgcatcaaacggttatcaatgaaaatggtgagcgtgaacagcaaactattattgttgatacaacaccaggtcgttgcttactttgggaagttgttccagaaggtttaagctttgacatgatcaaccttgagatgactaaaaagaacatctctaagttaatcaactcttgctaccgtaaacttggtttgaaagatacagttatcttcgctgaccaattaatgtacttgggcttccgtcaagcgactcgttcaggtgtatctgtaggtatggaagacatgttaattccacctacgaaacacacaattattgacaaagcggaaacagaagttcgtgaaatcgaacaacagttcgaacaaggtttcgtaactgctggtgaacgttataacaaagttgtcgatatttgggcgcgtacaaacgaccaagttgctaaagcaatgatggataacttgtcttatacacttgtgaaaaacaaacaaggtgaagacgagaagcaaaaatcattcaacagtatctatatgatgtctgactctggtgcccgtggtagtgcggctcagattcgtcagcttgcaggtatgcgtggtttgatggcaaaaccggatggctcgattattgagactccaattaaagcgaacttccgtgaaggtttgacagtactccagtacttcatttcaacacacggtgcgcgtaaaggtttggccgatactgcattgaaaactgcgaactctggttacttgactcgtcgtcttgtagacgtagcacaagacttagtaattactgagccagattgtggtacaagtggtggtctagtgatgactccattcattcaaggtggtgatgtcatcgagccattacgtgaccgcgtattaggtcgtgtaactgctgaagatgtacgtcgtgcatctgatgatgaagttgtattacctcgtggtacgttaattgacgagaaaatcgcagctcagcttgaagaggctggtgtcgatgaagttaaagtacgttctgtaatcgcatgtgaatcaacattcggtgtatgtgcgaaatgttatggtcgtgaccttgctcgtggtcacttggtaaacccaggtgagtcagtaggtgtaatggctgcacaatcaatcggtgaaccaggtacacagttaacaatgcgtacgttccacgtgggtggtgctgcaagccgaacttctgctgcaaacagtgttcaagtacgtaacaaaggtactgtacgtttccataacgtaaaaactgtacagcatgcgaaaggccacttggtttcagtttcacgttcaggtgaaattggtattgccgatgagttaggtcgtgagcgtgaacgctacaaacttccttacggtgcgagcatcttgttgaaagatggtgagcttgttgaggctggcggtatcgttgcgacatgggatccgcatacgcatccattggtaacagaagttgctggtaaagcacgtttcagccaaattgctgatggtgtaactgcaacatctaaaactgatgatgcaactggtatgacaactgttgaaatcttgcctgtaacagcacgtcctgcttctggtaaagatttacgtccagcaatcgtattagatacaactgatggcggtgaacagttctacttcttaccacaaaacacaattgtgactgttcgcgacggcgaaacaattggtgtgggtgacgttatcggtcgtgtaccacaagaatcttcacgtactcgtgatattaccggtggtcttccgcgtgttgctgacttgttcgaagcacgtaagccgaaagaacatgcgatcttggcagaagtgtctggtatcgtaagcttcggtaaagagaccaaaggtaagaaccgtttagtgattactccagatgacggttctgaaatttacgaagagttgattccaaaatggcgtcaaatcaacgtgtttgaaggtgaacatgtgaaccgtggtgaaaccatttctgatggtccacaaaatccacatgacatcttacgcttgaaaggtgaagttgctttaactaactacatcgtgaacgaagttcaagacgtttaccgtctccaaggtgtaaaaatcaacgataagcacattgaagttatcgtacgtcaaatgttgcgtaaagttgatatcatcgatggtggtgatacaagcttcatcaaaggtgaacaagtggattacatccgtgttgttcaagagaaccaagctgtcttggctcagaacaagttccctgcgaagtttgaacgtcaattgatgggtattacgaaagcatcgctttctactgactcattcatctctgctgcatcgttccaggaaacaactcgtgtgttaactgaagcggctgtaacaggtaaagaagatgatttacgtggcttgaaagaaaacgttgtagtgggtcgcttgattccagctggtactggtcttgcataccacttagagcgtcgtcgtcaagaagcggaagcagcagaacatgctcttcacaatgacttcagcgaagtagaccaagcatttagccaagctttaaactcagaacaattctaa

SEQ ID NO: 3760 - DNA, 381 bp, Acinetobacter baumannii
agattatctcctcctatagtgatagcacttttttctaaaaattggagccgtaccatgtctgcgactattgtaaatacaactgatgataacttccaagcagatgttctagatgctgaaacacctgtacttgttgacttttgggcaggttggtgtgcaccttgtaaagcaattgcacctgttcttgaagatttatcaagtgaatatgcgggtaaagtaaaaatcgttaaagttgacgtgacttcttgtgaagagacggcagtgaaatacaatatccgtaatattcctgctctattacttttcaaaaatggtgaagtagtagctcagcaaatcggcgctgtgcctcgttctaaactcgttagcttcattgacgaaaacgtttaa

SEQ ID NO: 3761 - DNA, 1158 bp, Acinetobacter baumannii
atagaaaatccggcaaaaaaacgagtgctaaatcaagcaaaagttcgcgtgaaaaaacaaaaaccaaggtcattgaggaaaatactcctgctatccctcaaagcaatcctgtacctgaagctttacgacacaatattccaacagctcattcaagaaaaacagttttcagcagctgaagctcaagtcaatcaggcgctaaaaaaagataatactcaacatgaactgtatttattacttcttgaaattcatattgctcagaaagatgaatttgcaattcaacagttgattagccatattcgtagcttaggtttaaatgaaatagcagctcaagcagaaactcgacaaaaagaatatgaatcatccagacaacctgatgctattgatttccctcaagctcaaacatatgaagaaccgaaaaacacagatacaacggctcagttcgatgaattaacaacaagttcttccgaggcttcttttaatgacttaaagaaagactatacccctgtaaaacaagaacctgctgttgaaattgaacctttagagtttaacttttcattcgaacagacttcggctacggaaaataccaaccaaccggcacaacaacctgaattatcatccactcaagaaacaaatgagctggccgatttagagttttcttttgacttggcccctctgcatgaaactgaggaaaaatctcaagcagtagaggtaaaagcagaccaagaaaatagcatcaatgcattagattttaaccttgacttaaatccttcaagtccagagacgaaatctgttgaacaagctccatcattagatgaaattaagctcatagaacaaaccccattagaagcgacttctatcgcacctcttgagttttcattagatgagcctgccttagttacagcgccagagattgaaattcaaaataatgaggtagtaaacgaaagggttactcaaacccaaatagaggatccgcttttagaagcttttccagaattaaaacaaataaatgaaaatgaactcgatttaaaattagctgaacaatacattaagtttggagcgaaccaagcagcgcgtaatttactacagagtgatgagcaaaaattcaacacagaacaacaacaacatgcgaaaaacctacttaatcgcatagcttcttag

SEQ ID NO: 3762 - DNA, 348 bp, Acinetobacter baumannii
cctttactgttaccaacaacaacaataccttcagctgcttcaacaccagagcttaagcccaatttactaacttttttctcccaaagacgttgtttaccacggtatgcagcaacttcacctttaggatcaagggtaaaaacaacaccttcgctagcgtcaagttgtaaacgtaatggatctgccttattcgtagaagaaacactgcgtgaaaacacgggcaccaaactcttatttgactcagtcaatttcggtagtggatttggttttgcttcttttactttgttgctagaacatccgaccaatacagccgatgcgattgcaattgccaaaggcagtttgaatttctga

SEQ ID NO: 3763 - DNA, 810 bp, Acinetobacter baumannii
gggcagactttgagtactccgaagttgaagatcatgttatgtatgggggttgctgttgcacttttgacaagtggttgtcagacttcgcaaacggttaaaaaggacccggaaaaagcagtaaaagtgcgtacgcagcttgctgccgaatacattcgttctggtgacttggattctgcaaagcgttctcttgaccaagcgttaagtgtcgatagtcgtgatgcaacggcaaatatgatgatgggtattttattgcaacaagaaggcagtaaacccaatttagaaaaagcagaacattactttaagcgtgcaatttcatctgaaccagacaatgctcaggcacgtaataattatggtacgtatttgtaccaaatggagcgttataatgatgctattgagcaatttcgtattgctggtgcaacattaggctatgatcaacgttaccaggccttagaaaatctggggcgaatttatttaaaactaggcgatattgcgagtgctgaaaaaacattcaaacaagcacttcttgctaaccgcgactcttacatttcaatgttagagttagcagaaattttttatttgcagcagcagattccggctgctacacaaatgtatgaacaatatgttcgtacagtggggcagaaaaatcagggtgcacgcgcactttggattggtttaagagtggctcgagccaatgcggataaaatgggaatgcaagttttagtaaaccagttacgtgctttattcccggaaagtccagaatatcaacgttatttgcaattacagtatagtactgaggccgtatggaaataa

SEQ ID NO: 3764 - DNA, 1818 bp, Acinetobacter baumannii
gccgtgatgtttgattttttatctttttggcaagctaatacaccaattttcagtatcctcatcccggcatttactggttttatcttattgcttctaggtaaccctggcgctggtgcattaaaagaagattggcgacaaccttggcgccgtggcattagtttgatctcagcaatagctgggttaatcactgctgttagttatctgcttgttgcaaacactggccaaattacggtttatcagttgagcgagtggtcagctccctttggtattgtgctggtactcgaccgcctttcagcttttatgctagttttaacttatgccttagcagttccggttttatggtatgccagtgaaaactgggatacgagaggtcgctatttccacgccatattccattttcttttaatggggctatgtggcgcatttctcacaggcgacttatttaacctgttcgttttctttgaaatcttgctcatggcatcctacgtccttttattacatggacaaggaaaaccgagatttcagcttggtgtgcattacgtcattatcaaccttttagcctctgccctgttcttaattggtcttggcatgatctatggcagtgtaggtagcctcaatatggctgacgtttcacgtttgctaccgactttagatgcagatcaacataaattagcagttgcaggtgccttactattatttgtcgtgtttggtattaaagcggccatgctaccagttggtttttggctaccaaaaacttatgccgtggcaagtacacctgtcgcagcaatttttaccattatgaccaaagtggggatctatgccattttgcgtgtcaatggaactgtatttaatgatgtactcagccaagaaatctttaaaagctggttgcttccaattggtttagtgacttctttatatggcgtgattggcgcaattggtgcagatcgcctcagacgttttgttggctttatggtgctgtcttcaattggtactttattgattgcaattgccatgtcaaacacgcaagcgtggtctggagcattattctatttagtccacagtacattgattggtgcagcattttacctgttctgtggctggatgacttcacagcgcggtgattttaaagaccatttaaagattgcaccaagaattaaacaagaaaaagcagccatgctgacttatttcctgattgccatgatgctcgcaggcttaccaccttttagtggcttctttgggaaagtatttattttgcaggctactgttgaaactgcatatcaaggctgggttattggtattgttcttttggtgagtttattaagcattattgcattaacacgtgtcggctttattttattctggcgtgcatcaccaccagaagaagacccgatcaatcctgcttatattatttatcgtgctttacctgaaaaagcaccgccacgtaacgatacagtcatctatatcttgcttgccggtttagtggcttatgtagcatttgcttcacctgtattgcactacaccacaaataccgctcagcaaattcaagatcatgccctgtatcagcaatctattcttaaaactgatcaaaatggcgaagttattagtgttcagccatatgactcaacttatttaccagaaacaaaatatggtggtgaagttgaagatcataatgcctatcttattcctgacattatttcaaaagatactttcaacggtgagcatatttctgaatataaacaccgccaaattcagcagcaagaaaaattgcaaaccccaaccattgctgatgaaagtcaactgaaacctatggagccataa

SEQ ID NO: 3765 - DNA, 1029 bp, Acinetobacter baumannii
aatgcagtgttttattatatttttaaatttgttgctttgagagttactatgtcactggaagccctgaccacagaagcgcttgctgccattgcagcagctcaagaccttgttgcacttgatcaggtgcgtgtgcaatttacagggaaaaaaagccagcttgcagaacaatcgaaagcattagggaaaatggaccctgaagaacgtaaagtacaaggtgctgcgattcatgctgttcgagaaacaattaataacgctttaactgagcgtcaaacagcattacaacaagctgcactggcgcaaaaattagcaagtgaaaccattgatattactttgccaggccgtggacagcgcgttggtacagttcatcctgttactcaagtgcaagaacgtatttgtcagttctttactaaagctggctttacggttgctacaggaccagaagttgaagatgactatcataacttcgaagcattaaatattcctgggcaccatcctgcacgtgctatgcatgatactttctatttcgatgcaaaccatttgttgcgtacgcatacttctggtgtgcaaattcgtactatggaaacaagccagccaccaattcgtattgtatgtccgggccgtgtataccgctgcgactcagaccaaacgcattcgccaatgttccatcaaattgaaggtttgtacgttgctgagaacaccagctttgctgaattaaaaggtttattgattaacctactgaatgaattttttgagaaagatttaaaagtacgtttccgtccatcatatttcccattcacagagcctagtgcggaagtggatatcatggatgagcgtggacgttggttagaagtattaggctgtggcatggtacatccaaatgtattgcgtgctgcggggattgatcctgataaatacaaaggctttgcttttggtttaggggtagaacgttttgcaatgttgcgttatggcattaatgacttgcgtatgttctatcaaaatgatgtgcgtttcttacgccaatttgcctaa

SEQ ID NO: 3766 - DNA, 1602 bp, Acinetobacter baumannii
agcagatgcccgcactattcatctgattcgagctgtacgtcaatgagagcatactttgaaaagctgttagattcttcgcaacaacaaaaacagcttcctttaatttttccattgctcattgctttattttcaggtgccgtgttcagttttgcactggcaccttattattggtggtggctggcaattttgtctcctgccctactctatgcgacattgcataaccgctcagccaaacaagcatttgcaattggctggagttatggttttggtttatggtttgtaggggctttctggctctatacgtcgatccatgtatatggcgataccaatgcttttctaagcgtatgtatgattgctgttatggcccttgtaatgggcttatttacagcatttcagacatggatttatcgacgcttctttcctgaaacaccgctgactttcgcccctctctggattatttttgagtgggctaaaacttgggtatttaccggtttcccttggctatttgtaggttatgcttttactgaacgtttactcgatggttatgcgccgctatttggtatttatgcaatttcctttgtagtaattgtattggcatgtgctttagttgaagttctacgtaagcgtattttctgggttatccctgctgccctgttagttttaggtgcatggggagcatcatatattcagtttgtacaacctaaagcggctaaaccgcttagcgtttcgctcattcaaggtaacattccacaagatttaaaatggctaaccgaatatcaagttagaacattagaaatttatgctggtttgactcaatctgaatggggccgtgacctcattgtatggcctgagtcttcaattccactcttccaaaccgacattgaaccgtttttggatgcaatggatgcacaagctaaaaagaaccataccgcttgggtaactggcataccttattgggatgtagcgaaatcgcatcaagtcggcagtccactgtattacaacagtattatggcttctggtagcgattcaagcggtctgtataaaaagcagcgccttgttccttttggtgaatatattccgctgtcaggtttgctttcttgggttttaccagccatgcaaaatgatattagcatgagcggttttacacgtggtgagagtgatcagaaaccacttttaattaaagggcacgcacttgcggctgcaatttgttatgaagtggcatatccgaacctgacacgtcgtaatgcagaagacagcgactttttggtgactgtatctaacgatgcttggtttaccggaacagctggcccatggcaacatttacaaatggtgcagatgcgtgcgaaagaaaatggtcgctggtttattcgtgcaactaacacaggtgtaacagcgtttattgatcaaaatggtcatatcaccgaacaagcaccgattgataaagagtttgtcttgagaggcgatttaccagccatgcaaggtcaaactctctataaccgtctaggtgattatccaattttaggatttgcagtattactgctggttttaggttggatctatcgtccacgtaaagtagacgtgtcttacaaatcacgtcgctaa

SEQ ID NO: 3767 - DNA, 1143 bp, Acinetobacter baumannii
gaaataagcccagtctgtttaacagattgggcttttgattttgtttatgacaataaagaaggggggagcgatactttgtctcaattacaagctgaagtagatgtagtcattattggtggtggacaagcagctcttgctacagcttattttttaaaacgtaagaaaattccatttgtgattttagatgaccaaaatcaggcaggtggtgcatggttacatgcttgggagtctttacgtcttttttctccaaatacttggagttcgttgtcgggctggatgatgccaaaaactgaacaaacttatccaacgcggaatgaggtgattcaatacttatctgcatacgaacaacgctatcaatttcctgtcattcgacctatacatgttgatcatattgagaaaaaaaatgactgcttagatgtatatgcgggtgataaatattggcgagcaaaggcggttgtcagtgctacaggtacatggagtcagccttatattccacattacgaaggattagaaagatttaaaggaatacaaacccattcagcacattatgttaatccagaaccttttattaataaaaaggttctagtgataggaggaggtaactctggtgctcaaattcttgctgaagtctcagaagttgcagacactatttggatcacagtaactcctcctcaatttttatcggatgatgttgatgggcgtgttttattccttcgagcaacagaacgtttgaaggcacaacaggagggacgaatagttgatcaacccattggtggtctaggggatattgtcatgattgacagtgtcaaagatgcacgtgaacgtggggtattacatagcagagaaccctttaaagcatttaaagaacattcggttgtttgggaggatggttcaacacaattggtcgatgctgtgatttggtgtacaggtttcaaagcttccctaaatcacttaaggagtcttagagtgatagaacctaatcagactgttgctgtcaatgatggacgttcaataaaaataaacaatctttggctagttggttatggtgaatggacaggcatggcatcggcaacattaatcggagtttctagaacagccaaagcagtagtcgatgaaatagctgtttacttagctatagattaa

SEQ ID NO: 3768 - DNA, 735 bp, Acinetobacter baumannii
ctatcacaacctgactggcggtattgttgctgttcaccgcggtttcaaactgtaagggatagcgatatgtggtcgattttggcactcggtgcagtcgaacgtatcattcatcatctgatcgatctggatgcattaacccgcattcagctcaatcagctacagggcaaaatgttgcgtgttatcatcgatagcccgcaactttctgttgatgtattctttgaccaagaaaaagtacgtcttgaacctaccgttacagggcacagtgaaaagccatctatttttgagcagcgcccttttgatccacaatttaaaatttctgaagccactgcaactttgcatgtcaaagatgtggttgaactgatcaaattattattaagcgatccagaccagattggtaatatcccgcttcaaggtgattatcacctcttgcaggatattcaaaaaattatgcagcaagctgaacctgatttagctgcgcatctatcaaaatgggttggtcctcaactcgctcacgaaatcggtaagattcaacttgcaccaaaacatttaaagcgctctcttcaaagtcatctattttttgctgaagatgccttaaaagaagacagcggtttatttgccccacgttgggaaatggacgatttaaatcaggctacgcgtaagcttaatcaagacattgatcgtctagaagctaaattgcagcagctcaatgcacaactacaacccactcaagactag

SEQ ID NO: 3769 - DNA, 246 bp, Acinetobacter baumannii
atgactaaaccaccatatcatgatgatcaagcgtcattttccgcacccattgaagatttgcaagtgcgaattgcatttttagatgatttagttgaggaattaaatcagcaactcgcgattcaaactttagaaatagctgatttaaaaaaacaaatgcaattactttatcaacgtgtggaatctgcagatttatcagaaggtgttgcaccttttgatccattaacgaataaaccaccgcattactaa

SEQ ID NO: 3770 - DNA, 567 bp, Acinetobacter baumannii
ctagataaaccctattgtaataggcaggaaatagaggaaaaaacaatgcaacaggcattatttggcggcggctgtttttggtgcgtcgaagccgtatttttacaaatacgtggtgtagaaaaagtaacaagtggttatgctggtgggcatacaactcacccaacttatgagcaagtatgtcaaggtgacactcagcatgctgaagtggttcttatcgactttgatgaacaacaagttacatattctcagttacttgatgtgttctttgcaacgcatgatccaacgactttaaaccgccaaggtaatgatattggtactcaataccgctctgttatttactattttaatgaagagcaaaagcaggcagcagaacacaccattcagacattaaaagatgacgatcttgatattgtgactgaattatctcctgctcctacattctatccagcagaagactatcatcaaaattactatgaaaagaacccttcacaaggttactgcaactttgcaatcccacctaaactgttaaagttacatagtaaattccaacatctcatgaaaaattaa

SEQ ID NO: 3771 - DNA, 1359 bp, Acinetobacter baumannii
acttttcgacctctcgccatgccaaaaataaagccaattaaactcgtaattattgtcgtctgtatcgccattattgctgtcttagcttggaaattcttaaagcctaaacaacagcaacctcaatatattacagcagaggtaactcgtggggatattgagaataatgtacttgcaaccggtacacttgatgcaaccaagcttattagtgtgggtgctcaggtatctggtcaggttaaaaagatgtatgtgcagcttggtgatcaagtaaaacaaggtcaacttattgcacaaattgactcgaccacccaagaaaacagtttaaaaacatctgatgctaatattaaaaatttagaggcacagcgtcttcagcaaatcgcttctttaaacgagaaacaactcgaatatcgtcgtcaacaacaaatgtatgctcaagatgcaacacctcgtgcagatttagagtcggctgaagctgcttataaaacagctcaggcacaagttaaagcattagatgcacaaattgagtctgcaaaaataacgcgttcaacagcacaaaccaatattggctatacacgtattgttgcgccaactgatggtacggttgttgcgattgtgactgaagaaggtcaaacggtaaacgcaaaccaaagcgctccaactatcgtcaaaattgcaaaacttcaaaatatgacgattaaagcacaggtgagtgaagccgatattatgaaagtggaaaaaggtcagcaggtctatttcacgaccttaggtgatgaaaccaagcgctatgcaaccttacgtcaaattgaacctgctccagattcgatctctagtgaatcaaacagcaccacaagttcaacaaccagctcagccgtttactacaacgctttatttgatgttccaaatacggacggcaaattgcgtattgatatgactgcacaagtttatatcgtattaaattcagcaaaaaatgccttactggttccatcttctgcgttaagtagcaaacaattttctggccaaagaaaacaacaaggtcaatcagcagataaagcaagttctactccaagtgcagaacgcaagcatcaaggtaacggcgcccgtttagaacgcttaaatttaactcctgaacaaaaacagcttattgaacaaggcaaagcaactctgagtgtagttcgtgttttacaagcagatggtacgactaaaccaacacaaattttggtaggtattaataaccgtgtaaatgcgcaagtacttgccggattaaaacaaggtgaccaagttgtaattgccgatagttcagaaaactctgcagcttctgcaaacagtggtaataaccgccgccgtggcccaatgggaatgtaa

SEQ ID NO: 3772 - DNA, 1689 bp, Acinetobacter baumannii
tttggcgcgttggatgcgtttatgctcacacatttaactttaattaattttgcattagctgatcatttagctattgatatagaacaaggatttaatgttctaacaggtgagacaggtgcaggaaaatcattattactggatgcactatctgcctgcttaggggaacgtacagatacaaattatgtccgctatggttcggacaaagcggatgtaaccgcagtttttacttatcaggacaatagccctgaagcaaaatggttaaaagaacatgaactagatgatgattcaggagaaattcatttacgtcgggttatttttgcaactggccgtagcaaagcatgggtaaatggccgtccaagtagtctctctgagcttaaagaattaggtcgcttattggttcagttgtatagccagcacagccaacaacagctacttgaaccgccttatccaaagcattggctagaccgttatagtaatttttacgccgaagcaaatgatgttcgtgaagcatatagtacatggcagcgtaatatccgccagcatcaggctgcgctcgatgctcaagcgacccgtcttcaacgtattgcgaccttagagttacaaattgaagagcttgaggaagtcattcaaaccgattacaaagaaatcgagcaagagttcgatcgccttagtcatcatgaacatatcatgcaagactgtagctatagtctaaatgcacttgatgaagctgaacaaaacattactcaagaaatgtcgtcgatcattcgccgtctagagtctcatgcggggcgtagtgagcagctttccgaaatttataattcgttattaaatgcgcaaagtgaaattgatgatgccacatcaaatttacgtcaatttattgaccgtcagagtttcgatcctgaacggatggaagaactgaactccaagctagaggttttccatcgacttgctcgtaaataccgtactcaaccagaaacacttaaagaagagtacgaaacttggcaaagtgagcttgagcaattacatcagttagaagaccctgaaactctggctgaacaagtagaaaagtcacatcaagaatttttagaaaaagcccagcatttagacaatattcgtcgtgaagctgctgccccacttgcaaaacaattaactgaacaggttaaacctttagcgctacctgaggcccactttgagtttaagtttgaaccattagaacaaccaaatgcagaaggtttaagttttattcaacttttatttactgccaataaaggcatacctcctcaaccattggcacgtgtagcatctggtggtgagctttctcgtattgcactcgttatgcaagtcatgaatgctgaaaagaccgaagcagaagttttggtatttgacgagattgatgtcggaattagtggtggtacagctgaagtggttggtcgtttattggccgacttggctcagcatgtccaacttctatgtattacccaccaagcacaggtggctgcacaatccgatcaacatttgttagtcaaaaaacaacaaactgatccggcaagtagtactattgtacaacttgatgaaaatcaaattatttccgagctagcacgcatgtcaggaggtgttgaaattaatgaaacaaccttgcagcatgctaaacaattacgtcaacttaaatttcaggcttcttcaacttaa

SEQ ID NO: 3773 - DNA, 450 bp, Acinetobacter baumannii
tctggggcgttcaaggaatcgcttttatggcgcttgctgcttttattttttcacctcaatcgttatttaataaataggctcatttttatgttggcttattggtataacgcaccgcgtcacatcaaactcatctttattattgtcgtttgtgctgcaatttatgcagccaatcaggtacagcctttatcgccgacttacactgttcttagcctcgtgttaggttttgggcttcatttcgggcaatatttacaaacaaaaattccagagcacagttcacataaacttaagctccagtttctgcttagaatttaccctctcattattgttgctattataatgtggttactgccccctcaacacaattggattgcaacaatacaagctttaggctttgtactggttggattttttcttgtttcgatttatcaaaatcgggccaaacgtttttaa

SEQ ID NO: 3774 - DNA, 1395 bp, Acinetobacter baumannii
ttaggtgagcctatgaaacttgaatctatccaatttaaacatattgctctgtttcatgacctaaaaatacagtttcaatatgacaaacaaccgattactttaattttaggcgagcaagcaactggcaaaagtatgctactcaagcatatttatcatgctttaacgtggtttcctgcgcgccttaaagatgcacgcaccccaggcattgtcatgccagatcaggacattagccattctcgtttgcaatctaaaatagaagtcagcatccagattccaccggaatttggacaactccctgaaaccgcttcaacccagcaaaccgacacatccctttgtagctggaagctgttcaagaccttaaattcaagtggtgtagggattagtcaagttgaaactcagcagctcgatcaaaccattaccctttatcatcaagtcacaagaaaagacccacttcaaggtcttcccttactcgcttattatccgtcagagcgatttgttaacgatataaatttactgaataaaaatttaccgggtattacccagtctatttctgcttatgacattagcttcattccgtttaccaccttcgcccgcttttttgagtggttacgtgaaattagcgatattgaaaatgcacaagcggctcatgttgtgcagcgaattatttcaaaacaatccaattcacaagatcaggaagaaattttacgtcagctacaacttgaattggcaggacatcctaaacagcttccttcacctaatttgtacgcattaaaatcggcattaaagattatttttcctgagcttgaagacttttatttgcaatatcacccaaaacttcaacttatggcacattacaagggtgaagtcttggcctttcaacaactttccaataccactaaaacatggattgcactcgtaggcgatgtggttcgcaggctttgtttgctcaatccgttgagcttagacccttgtcttgaaggtgaaggcgttttgttaattgaccagatcgattcacaactagatgcagcacattgctcagaaattttaaatcgtcttcatcgcgcattcccacgcttacaaattattgtgaccggaagccgtgaggaattgcttgaacatgcagctgtatatcaatgttttaaattagagcatggaaaaataagtccacttgatttaagtacgactcagcagcaactcgaacatctttatacgttattacaacgagatgaagcgttaacgccgcatatagatcccctaccgcttgataccgagccagcaacaactcaaattgatagtttgtaccaacaaatccaaaatctaaatgaacagcaaaaaaatgaattattacgtatgattcatgcaggagacacctcggaagaaacctcctctctttaa

SEQ ID NO: 3775 - DNA, 285 bp, Acinetobacter baumannii
tatgactggccacagatttgctgttggctaaatcaatggagttacaccatgtctaaggtttgccaagttaccggcaagcgtccagtcgttggtaacaacgtctcacacgccaacaacaaaaccaagcgccggttcgagccgaacctgcaccaccaccgtttctggttagaaagcgaaaaacgttttgtactttttcgtttaaccactaaaggtatgtgtattattgacaaattgggtatcgaaaaggttgttgcagaccttcgtgctcaaggtcaaaagatctaa

SEQ ID NO: 3776 - DNA, 768 bp, Acinetobacter baumannii
tgttttaagtttatttattataaaaagagagcatttatgcaaagtaataacccgatactgacacgcgttgaaacggtcagtgactatagtcaaccgatgaccgtgcaaggtgcgattcaaaaatctgttatgttgaccatcattgctgctgcagtgggtgtcgctttatttttctatgcagcctttactgcaaatattggtattgcttatgcggcttcaattgtgggtgcaattggcggcttggttttagctttaattacgacttttaaaccaacgactgcaccaactttagcaattccttatgctttatttgaaggggctttcttaggtggtatttcttttactttccagttgaaatatccgggcgttcctcttcaagctttattggcaactttcgtcacgactttggtgatgtttggtctatataagtttcaaatcatacgcgcaactgaaaagttcaaatcagttgtgatctctgcatctttggcgatctttattgtatttatcgtgcagatggtgatgcgtttagcgtttggctcaagcattccttatatttttgaaagcaactggttaggtattggttttgctgcttttgttgcagtgattgcttcactgaacctaattttagattttgatttgatcgaaactaatgcagcatatcgtgcaccaaaattcatggaatggttgtgtggtattgccttacttgcaactttagtatggatgtatatttcgttcttacgtttgcttggtttattgtctgacgactaa

SEQ ID NO: 3777 - DNA, 210 bp, Acinetobacter baumannii
ctattctttacaaatctaaaattacaattaattttaataaagttatcgattttccaaacagttaagtttaatcaaataattaggaccattttgcaactaaaagtgattaaaactttcacatttccttcacaattctatcggcaaatccaattaacacaaactgtacatataaataagaattattattattcgcataacgtttatatttaa

SEQ ID NO: 3778 - DNA, 819 bp, Acinetobacter baumannii
tcacaaattactgccaatctagacttaaaaacactaaaacaagtcatcataggaacaatcatcatgacaactcatagcctcaaagataaagttgtattgattactggcggtgctaaaaacctaggcggactcattagtcgtaaatttgcagaacagggtgcaaaactcgcaattcattataatagtctggaaactcaggcagatgcagagcagaccttagcagatattaaagcattgggtgcagatgcaattctaattcaggcagatctaactcatattgaaaatattgaaaaactgtttatagatacgaaacaacattttggtggtatcgatattgcgattaataccgtcggaaaagtccttaaaaaaccgtttttagaaaccaccgaacaagagtttgatagcatgagtgatatcaactcaaaaattgcctatttctttattcaatcggcaggtcgacatttaaataacggcggaaaaatctgttcaatcgtaacttctcttcttgctgcttacacagggttctattcaacctatgaaggtttaaaagcacctgttgagcattacacccgcgctgcatcgaaagaatttggagatcgccaaatttctgtgactgctgttgcaccgggaccaatggacacaccattcttttatggtcaagagtctgccgaagcagtcgcttaccataaatcagcttcagctttaggtggacttactaaaattgaagatattgagccattagtccgtttcttagtcaccgacggctggtggattacaggtcagacgattttcgcaaatggtggttataccacccgctaa

SEQ ID NO: 3779 - DNA, 1695 bp, Acinetobacter baumannii
aacctgattacaggggcgagttcgggaatatataaaagacatacaaataataaggtattaagaagaatgaatcagttaaataatttacagcataaatttccagtagtggacggtattcctgaaagtgtacgtttgccatctcaaattcatcagcgtgtctcactcgtggatggtgagttgaagttatgggctggtgcaaccaagaaaacattatctccgatctggatacagcagcctgacggtagcctacagcaagttgaacttggtagttacccagtcatgggcgaaaaagaaagcgatgaagcattagaagcagcggtacgagcttataacaatggtcgtggcgaatggccaatgatgaaggttagtgagcgtattgcatgtatgcaaaatttcattcagcgcatggtagagcaacgagatttgattattaagctgatcatgtgggaaattggcaagagcttggccgattcagagaaagaatttgatcgtactattacctacatgcgtcaaaccattgatgccctgaaagatctagataatgctaactcccgctttgtaattgctgaaggcaccattggtcaaattcgtcgtactccattaggtgttgtgttatgtatgggaccatacaactacccgctgaacgaaaccttcgcaaccctgataccggctatgctgatgggtaatactattatttttaaaccacctcaatttggaactttactatttgaaccattgttagaggcatttcgtgattcatttccaaaaggggtgatcaataccatttatgcaccaggttctctagtggtgccgcatttgctggcatctgggcaaattaatgtactggcactgattggttccagtaaagtggccgatcacttgaaaaaacagcatccaaaatctcaccgtctgcgtgcgattctggggttggatgcaaagaatgcagccatcattttgccagatgctgatttggacctgacagtgaaagagtgtctgttgggtgcattgtcattcaatggtcagcgttgtacagctttaaaaatgctcatggtgcaccgttcgatagccgatgagtttgttaaccgtttaacgactgagctggctaaactgaaagtaggtatgccgtgggaaaaaggtgtatctattacgccgctaccaggcatgcaccgtacagcctacatgactgaagtgattgaagatgcggtggcaaaaggagcaaaagtggttaatccggaaggtggtgaattctgcaaaaccatgttctatccagccgtagtttatccagtgactgaggggatgagactgtatcgcgaagaacagtttggaccagtggtaccagttgctgtttatgatgatattgaaactgtattggattatgtcactacctctgatcatggtcagcaggtgagtatttttggtagtgacccagcgcaaattggccatttggtcgatacacttgtacatcaagtttgtcgtgtaaatatcaactgtcagtgtcaacgtggtcctgatgtattcccatttggtggtcgtaaagattctgcagaaggtacactttctgtgcatgatgcgcttcgtgcattctcgatccgctctatgattgcggctaaacagactgatgacagtaaaggtatgctggcttctatggtgtctgagcactattcgaaatttgtgaataccgactttattttctaa

SEQ ID NO: 3780 - DNA, 1137 bp, Acinetobacter baumannii
taccatgagttgagcgatacaatgatagagaacccaattaaacgtcgaccaacacgtaaaatccgtgttggttcggtctatgtcggtggcgatgcacctattagtgtgcaaagtatgacaaataccgaaacttgcgatgttgacgcaactgtggctcagattgagcgttgtgttgatgcaggtgcagatattatgcgtgtttcagtgccttctatggaagctgctgaagcctttggtgcaatccgtaagcgtgtttcagttccattagtagctgatatccattttgaccatagaattgctttggcagttgcagattatggtgcggactgcttgcgtattaacccgggcaatatcggttcagaccagaaagttcgtgaagttgtggctgcggcacgtcatcacggtatttctatgcgtattggcgtgaatgcgggttctctagaaaaagatttacagaaaaaatatggcgagcctacagggcaggcacttcttgagtcagctttacgtcatattgatattttagaccgtcttgacttccatgagtttaaagtcagtgtaaaagcatcaaatgtgtttttaaccatggatgcttatcgtttactctctcaacaaattgataatccattacaccttggagtgactgaagctggtatttaccgtacaggtactgtgaaatcagcgattgctcttggtgggttattgatggaaggcattggcgatacgatgcgtatttcgcttgctgctgaacctgaagatgaaatcaagatcggttttgatatcttaaaatcgcttggcctacgttctaacggtatcaactttattgcttgtccaagttgttctcgccaagaatttaacgtgattcaggtgatgcaggctttagaagagcgtttagaagatatccgtacaccaatggacgtttcggttattggctgtaaggtaaatggcccaggtgaagcaaaagaagcagatatcggggttgttggggctgcgcctcgttcattggtttatcgtaatggtgagaaaagccatttaattgataccaatcaattggttgatgaaatcgaaactatggttcgtcaacgtgttcaagagcttgaagaagctaaatctaaagaaattattcgtagttcatcatga

SEQ ID NO: 3781 - DNA, 2337 bp, Acinetobacter baumannii
aaacatgagttacatatccaggagaatggtatggtcacagtacgtgaacagttacctgaacaactaactgagttgtcagaggaaacgactgtagagcatgccgccgaaacacaagtcggtttagcctcatggttggatcgggttcgtgaaatattagatggggcagagcttaaacaactcgaagaggttgcgcatttaaccctacaaaaagagttagattcaacggttaatcatcgttccaatacatttgctacgggtgttggaatggctgatattctggcgcatttacatgtagatgaagatactttatctgctgcaatgctttatcgtagtgttcgtgaggacattactgatatagaagaagtaaagcgaaagtttggtgagcaagtttataaccttgtcaaaggtactttggcaatgggtaagctttcagagcttattgaaaaaaataaacgactagaagaccattttaataacaaccaacgggaacatttaagcggcatttataaaatgctgatttcagtgaccgaagatgttcgtgtcgttttaattaagttagctgaacgtacttactctttacgtgagttggcaaactcatcacgtgaacgtcaagagcgtgtggcgcgtgaaattttaactatttattcgccattagcgcatcgccttggtattgcacagctgaagtgggaactcgaagacttagcgtttcgttatttggcgccagaccgttataaagagattgcttcattactcaatgaaaaacgtcttgagcgtgaacattatatccagttcgtgatagaccgtttaaaaagtgaattggcggcgcatggtattgaagctgaaattacaggtcgagcaaaacacatttattcgatttatcgaaaaatgaaaagcaaaaacctaagtttcgatcagctttatgatattcgtgctttacgtgtattggtgaatagcgtacctgagtgttatcactcattaggtattgttcatcagatttggcgtcatatcccacatcagttcgatgactatattactaacccgaaagccaatggttatcgctcattacatactgctgttattgctgagaataaatctttagaggtacaaatccgtactcatgagatgcatgacgaagcagagttaggggtatgttcgcactttaactataaagaaggttcaaagaataccgaccactcttttaaccaccgtttgcattcgcttcgtgctgttttggaacattaccaagaacgtaatgaaacaacagtacatcaaaatgaagatgagacggaaggttttgatcagcttcaagactttgaaggttttgaaaagatttatgtctttagccgtgatggtgatattaaagaactaccacgtggctcaacagttttagactttgcttaccatgtgcatacagaggttggaaacaagtgttatgcagcgcgtgttaaccagcgctatgtaccattaacctatacgctaaaaacaggtgagcaggttgagattttaaccaaaaaagatcgtgagcctaaccgtgactggttggtgaactctttaggttatatcaagacagctcgtgctcgtgacaaattacgtcattggttcagacagcaagaccgtagtaagaaccttgaagttggtcgtgagttactaaacaaagaattgtctcgattggcgattcaccctaagagtattgatctcaacgattactcgtcacattttaatgtgaaaacaggggatgatattttggttagtctggtcagcggcgatattagtttgcatgccctgattaatcagattaatcgtcaaatgcatctggatcaggatgagcctgaactggtacttaaaccaacattaaacccacgtgccagccatactctgtctgcgcatggcatcttaattgatggtttagacaatgttgagctacatattgcgcagtgttgccaaccagttcatggtgaatcaattgccggttatatcacgttgaaccgtggggtaagtattcataaagtcttgtgttctgattatcaacgcatgatcaagcaagagccagaacgtgctgttgaagcggattgggagatgcagccaactcgtggtcaaagtgttcaaattgtagttgaggcttatgatcgtcgtggcttactcaaagatttaactcaagtgattttctctgaccagattaatattcgtcaggtgaacacaatttctgaggcagatggtattgctaatatgaagttgctcattgaggtgaaaggcttggctcagctttcacgtttgttagctcgtttagagcaacaaccggggattattagcgcacgacgcatgattcaaggtgtttaa

SEQ ID NO: 3782 - DNA, 990 bp, Acinetobacter baumannii
aaaaggactaccatatcttctatgtattttattaaaccgacacgctctatccctttcgtagagcaagctctggaagcattaccagacttacaagtcattcacatagatgatctcgatttatacgacccaacaattatcgcaattgctgatgtacaagatttcctaacttataaatggcgtttacctacaatcgtgattgcttttgagcatgaaggtagtgctttagctcaagcatgggaagctggtgctcttgcaggatgggtatggaaccagttacctaatgatctaaataaagctttaacaagaattgatgcacaatataaacgtaatcaggatagccgtgatttaccttcggcagcagaattacaaaaacgtttattgccaaatcctattgatttattaaattatgaggttgaaacttttttccaaccttctgcctatttatcaggcgactggtacgactactggaagctcaatgataaagaggttttattttatctcgccgatgtatcggggcatggtgtaacaagtagcttattaacttcttggatggcagcctttcatggtcgctccaaaacaccacgacagttaatcaaaaagttaaatgggatgctagttcaagagaatattgaaaaacatattacaattgtggtcggcattctaaatcttgaaactcatagtcttcgctggtctagtgcaggtcattaccctcctccaattatttttgaacctaatcaacctccaaaaattttaaccaccagcagctttcccttagggttaactgatgagttagaagttgaagaacatgtatgtacattaaatcgtcatgcacgtttcattatttgctcagatggagcactagaaccatttgatggcggcttgaatgatcagtttcaacaattagttcaacatttgcaaaatcaatcattccaagcccctgatcacgttgctgatgacattgccatctttagtctttgtcgaatgaattaa

SEQ ID NO: 3783 - DNA, 1647 bp, Acinetobacter baumannii
aacatggagttgtttcacatggttagtgcctataacgaattaccacgcacacccgcaaactttgttgcgttatcccctctgcgctatttagagcgcgcagcttatatctacccagaccaagcttctattattcatggcaaccgtcagatttcatggaaacaaacttatcagcgctgccgtcaatttgcatctcagcttcaacaattaggcataactaaaaacgataccgtttcagttttattgccaaatgtaccagcaatgattgaagcccattttgctgtccctatggcaggtgccgttcttaatacactaaacacccgtttagatgctaaaaccatcgcttttatgctagagcatgctgagacgaaagtgcttttggttgaccccgagtttgttaatttagcccgagaagccctatcactcattccaaaccaacatatcattgtgattgatgtagctgatgaagaatatgaaggtgaaaatcaatttcttggttcgtttgaatatgaagaatggatagctcaaggcgatgctaatttcgaatggcatttaccgcaagatgagtgggatgcaattagtttaaattacacatcaggaacaacgggtaatcctaaaggagtggtttatcaccaccgaggtgcttatttaaatgcagctagtaatattttagcttgcggtatgaaacctcgagctgtttatttatggacacttcctctttttcactgcaatggttggtgctttgcgtggagtattgcagcaagtggcggaaccaatatttgtttacgcaaagttgaccccgaactggtgatgcagcttattgctaaacataaagttgattacttctgtggcgctccaatcgtcttatccatgattattaatctaccgaaagaaaagcagccaatcatagaacattatgttgaagttatggtggcaggtgctgctccacctgtcgctgtaattgaaggtatgcgaaatattgggattaatgtcaaccatgtgtatggtttaaccgaaacctatggaccatctgcgctttgtgcttctcaagcaggatggagcgatctctcaattaccgagcaagcacaactgcattctcgtcagggcgtgccttatccacttcaagatagcatgcgagtactagaccctgaaacgatgcagccagttccaaatgacggtgaaaccatgggagaaatcatgttccgtggcaatattgtcatgaaaggatatttaaaaaatccaaaggcaactgaggaagcttttgcaggtggctggttccacacgggtgacctagctgtttgccatccagatggttatgcaaaaattactgatcgctctaaagatattattatttcaggtggagaaaatatttcatctttagaagtcgaagacgttttatataagcatccagcagttttaacagccgctgttgtggcaaaacctgacgaacgttggcaagaagtaccatgtgcattcattgaattaaaaactggggctagtgccacgcctgaagaaattattgagcactgtcaaaaagaactggcgcgctttaaagttcctaaagatgtggtgattactgaaattccaaaaacttcaacaggtaaattgcaaaaattcatcttgcgtgaatgggcaaaagaacgtgcttaa

SEQ ID NO: 3784 - DNA, 1107 bp, Acinetobacter baumannii
cagtttttcaccgtattgatgaagtttatccatcatgaaaaatgtattaggcaacaaaaagataaaacgtataaaataatagcatcgtcaatgagatcaattattatggcgcttaatcagatttggaaacaacaacttacacttgtgacctatggtaacgaatacctacgtcagaatttaagttttagccaatggcgacaacatcatatttttgaccagcatagttttcaatttcgtgacttaatttcacaacatttacttgctcaacatttccaagtttggttagaagcactcaaaaaacaagggacgactcaaatctctcttcacctatctactattttaaatgaagagcaaaacccgaatagtaatgtcgaacttttaccttatgctcattttattgtaagtcatcaaaacaataagaaaatcgcatggatctttggacatgagcttgccgaatggtacagcagcgataacgagtttgagccgcctctgactcaacgcagcgatttacgcttagagactttctggcgttttgaattgaatgaaaaattatctaagaaagttgaagctgacttaaaagcacctcaatgggatgaaatcgcaaactttatggaaactgagttatttcgaagtaagtatgcagcaggttttgaagaaccagaatttcagaaaaaatattttgatgggtcaacacatcaaatttcggtagagcatcaaccaactcttgctcttattcctgaaagctacccagcagattgtgcacatcaactcctctaccgcactcaggccttatcagattatttagagcagaaaaaacgcaccgcaaatgatcctttaggggaagacttagaccaagaacaaattattaacttaagaaactttacccacaaaactgacgacctatttgcaaaacttattgtgaaagcagcaaatcactatcaaacagctcaattaaaacctattgagaaaccttctccttttgatgcaacgaatgagtccgcagctcatttaaaagtacctcatcacaaagctggaggaacaggggtaatcaagcttattgttctgacaataattatttgtgctttagcctattattttggtctttaa

SEQ ID NO: 3785 - DNA, 861 bp, Acinetobacter baumannii
gctaattacactgtaagcagaaccaattacagagatgaaatcatgaagtctatagatgaaataaaagctcaagaggtatgtgtagctattctattagataaaaaagctactaatacgcaagccaagatacttcctagtgaaaatataatcattgataggttacttgagcgtaaagttgagttacaacatgcttatagtgagttgtattcaaaactagggaaatatcatcaagccctcacaaattttttagatttgttagtaggaattacttcaatgcatagtccagaggaagtaataaagtctagggctgctcagaaaaaattgaatgagattaatcagcaaatttctattaaagctcatgaattagcagctctcctagaaactagatccgagttaataaatacttctggctttatgacagatacccattatcacattggtaatgtaattcgtgaagcatctcagaataatccgtattttagaacatctttgctagataaattaaagcaactccaaggtcagtttgatcttaaatattggcctcggttagatgatgtaatgaaagttatcgctgaagatgcaagaatggccgtacctattgctattgattctattactgaagtggcaacaataggtgagagagcttccttagttgattattttagagctttatttgaagctattgaatgtaatcgtcagaaagaatatggtttcttacctaatgactttaagttaacagataatacaattgctaccttagcgaattgcgccttagctttagagccaaaagaaatgattgatggcctatatgtgaaaaattttagaagtcgtgagcgcaaacgcataggtagtgactcctaa

SEQ ID NO: 3786 - DNA, 933 bp, Acinetobacter baumannii
tttggtttaactattcggaaaatacgaacaattaaaatggatcggttgcagcaattttatatttttacagaagtcgctaaacgacaaagctttagtgaagtagcaaatcagcttgatctacctcgctcgacagtgacgagtgccattcaacagttagaaactcactatggagtacgcttatttcatcgtactacccgtaaagtcagtcttactcaagatggccaacgaatattgccagaatgccaaaacctgttgtttgattatgaacaattagaacagttgatccagacacaaaaacagcattaccgtggcacattaaaaatttcgatgcctagccggattgtgcatcaagtgattattcctgaactgcctgatttttatcatcgttatccggatattcatttgcagctcaatagttctgatgacctgactgacttaattgaaaagggaattgactgtgttgttcgggtaggagagctagataacagcagtttaattgcaagatttattggtcatttggtgatggtgaattgtgccagcacgcaatatttacaagattatggtattcctgagcagttaaatgatcttgaacagcataaattaattaattacgcaggagctgtaggagaaaagcagggagaatttatatatcaaggtggaactgtgatgatggatagtgctttaagtgtgaacaataccgaggcctatatcgccgccgcttgtgcaggtttgggaattattcaacttccttattatgatgttcaggataaaattgaacaggggattttagttgaggtgctgagtgcttacagtgcaccatcgcttccacttaatattttgtatcccaacaggagttatattccaaagcgactagaagtttttatgaattgggtgggggaagttttaaatcgcaaatgtatcgtcatcttttag

SEQ ID NO: 3787 - DNA, 582 bp, Acinetobacter baumannii
gataagacaactatgggtgcaaattctgcgctaatttttggaattttaattaacgtcgcgattttattggtctttttccgttttttaatgcaattggcggcagtaagtccttataatcctgtggttttatcgacagtaaaggcgactaagattgttgatatttttggccgaatttttccaacggtcgcaaaaggccgattcaatctggcagcgttggttcttttaattattttatatttactgaaaattttcggtgtaatgtatctttcgggttccatgcccaatagtccggttcatttagtgattctgacttttgtgaccatgattcaggatttgattcgtttctgccgttacttaatttttgcaacaatcattttgagttgggtcgttatgtttactcaatctcgttcaccttatattgaggtgattcaagatttagctgaaccgttactcgccccattccgtcgtttgttgcctaatatggggatgattgacttatctccaattctggcatttttggcactctatattgccgagattttaatgaatgaagtcgctaaagttttattaactgggctttaa

SEQ ID NO: 3788 - DNA, 1326 bp, Acinetobacter baumannii
aaagaacaaacaatgaaaacacctcattttgccattattggtgcaggcacggcaggtttagccactgcgattttgctcgcccgtgaaggcaaccacgttactatttttgaacatgttgatgagttatctccagtaggtgcaggtttactgctacaacctgcgggcttagccgtatttgagcacttaggtgtgctcgacaaagccctaaccttaggtgcgaaagtcacaggcttagaaggacaacttccagacaagcgtcttttagttaacagtcactatcgcgaagcatcaacaaatctttatggtctaggtatacaccgagccactttatgtcacgttctcactcaaaaacttagcgaatattcaagccagattacttggtgcatgaatcattccgttgaaagttttgtagaacataacgatgaagttcggatatttggcagtcatcaaaatcaaaagtttgatgcttgctttgatggcctactcattgccaatggtgctcgtagtcaattacgccctaaagcatgggtaaaggttgacaaagcttatccttggggggctgcgtggagtatcgtgcccgagtgccaagttctcgattctgaaattctgcatcaattttatgatcgctcgaaaattatgatgggaattcttcctacgggagcgattccaaccgaacctcaacagcgcctttcaagtgttttttggagcttacctacgccacaattacaaagctttttgcaagatgagcaggctaaacaagcttggttaaagcaagtctcagaacgttggcccaaagttgcagattggctcaaagaaattttgtataacagtcaaactcagcccaaatggctatctgcaaactatcgtgatgtcgtcatgactcaatttggtcaaggtcgaattggagtaattggagatgcagctcatgcgatgagtccacagttgggtcaaggggccaatatggcattattagatgcttgggctttttctcaatcattgcaacatgctcaaaaaaaccagaatattgattggtccctgctctggcagcattatcaccagcttcgcggttcatctactcagttttatcaattccttagtcgcttactaacaccactttatcaatctgacgattggtgggcgggaggtttaagagatttagttttcccttggatgtatcaaattccttattttcgaaaagaaatggccatcacaatttcaggtttaaagacagggccattccgccatcttgaatatgatcaagtagctcaattacctaaagaaaacagtacgtttcatttaaaaagtgaatctctgactgatttttaa

SEQ ID NO: 3789 - DNA, 1113 bp, Acinetobacter baumannii
aggcaaaaaacaatgaaagtgatgcaacttctcccagaactcaatagcggtggcgtagaacgcggcacactggaaattgcacgtgcactggttgcacaaggtcatcagtctctggttgtgtctaatggcgggcgtttggtctcacaacttgaagctgaaggttccacacacttaacgttacctatccataaaaagtctttatcaagcctatggcaaattcgaccattacgtcagcttattgaagagtaccaaccagacattgtacatgtgcgctctcgcgtacctgcatggctaacccacttcgctttaagaaaaataccagcgaataaacgccctcacctcattagcacggtacatggtttctattcagttaatcgttatagtgcgattatgactcaagctgaaaaagtcattgctgtttctgacagtgtggttaagtacatcacagatcattataaaaactgtccaccacaagatattgtccgtatttatcgaggcattgaccctgctgcttttccgcataactatcaaccttcagcacagtggtttaaccaagtctttaacgactttcccgaactcgagaataaatttttactttgcctacctggccgtattactcgtttaaaaggacatgaaagtttaattgaactgatgcagcaacttcattcgcaatatcctcaactgcatgctgttgttgtgggtggggctgatgtaaaaaaacaagcctatttaagtgagttgcaaaacaccattcaaagcaaaggacttgcagataaaattacctttgtaggacatcgctcagatatacgcgaatggctcgcttttagcgatatagtgctctctctatctaatcaagcagaaacattcggtagaacagcattagaagcgctctctgtcggtacgccgatcattggctggaaccgtggaggtgttgccgagattttatctcatgtgtacccgcagggtcttgttgaagcagaaaatgaaaaagctttattagaaatagtaaagcatcatattgaacaaccgcaaacagtcgctcctgtgacaatgtttagtttaaaagatatgtgtgaccaaacccttgagctatatcaaagtgtattgaaataa

SEQ ID NO: 3790 - DNA, 852 bp, Acinetobacter baumannii
ttcatgaaaacagaaaccactatacaaggcttagctgcttctttaaatcctgctagagctgcacgtaaaatcattggttttgtcccaacgatgggaaatctacatgaaggccacctcactcttgttcgtgaagcgaaaaagttatgtgatgttgtggttgtgagtatcttcgtgaacccaacacagtttggtccgggtgaagattttgataattatccgcgtacgttagagcaggatagtcgtttacttgcagatgttggctgtgacattatttttgcaccatcagttgaacaaatgtacggtacacaacctcgcttaactaacattagcgtcagtcaaattacggatgatttatgtggaagctcacgtccggggcattttgatggcgtggcactggttgtcaccaaactctttaatattgtgcaaccgaattatgctttctttggtcaaaaagactaccagcaattagcagtgattcgccagtttgtacaggatttgaatattccgttagaagttattggcgtaccaattgttcgtgcagaagacggtttggcactgagttcaagaaatggttacttgactcctgaacagcgtcaggttgcaccagtcatttatcaaggtttaaaacaagccgaagagcaattacaccaaggtaaagatttacaacaagtcttggcagatttgaaaacactgttgacagacaatggttttgttgtggattatgtggaggctcgtcaacctaatttgttagctgcttctcaatttgatcgtgatattgtgttgtttgtcgcggcaaaattaggtggaacgcgcttaattgataatctacaagttgcctttacacctcaataa

SEQ ID NO: 3791 - DNA, 1344 bp, Acinetobacter baumannii
aattatagaacagcaagattgcggatctttacaatgaaaaaaacattaagcttaccgaaagcaccaatagggatgatcaaccgccataaaaaaattaatcctgctgaaatgaataaaattttaaatcagcattttaatgcatttaaacaggctgctgcacaaggtgattatgtcaaagcatatcaacatgtaaaaaaagcagtaagtctggttcccggacatcccggagcattgtctgatttagcttataccgagctacggttacgccgttatgacgatgcatatcaacattatatgcaagccattaaagcaagtggttctaacgttaatacaaatctatacgatggattgaccgaagtttgtcatcatttaaataaaaaagaagagaagattaaatttgggcgtttagccatttcaaccaaaaaagaactcacaaagaatgagcctactttaaatatacccactcataaacccgttccctttagcccaaatccacaagaaaatattattgctttttctctatttggagcaaatcctcggtactgtgaaacgtccattttaaatactaagttagctcaagaaatctatcctgaatggacgtgtcgattctatgtggatgagagcgttcccgaacttgtacaacagaggttacaagcaaatggtgcacaagtcgtacatgtcagccccactcaaaaacagttatcaggtttattttggcgctttttagttatggatgatccggtggttaaacggtttttagtacgtgatgccgactctatcgtgtcttatcgtgagaaagccgctgttgatgcttggctcaaaagcgatcaatggttccatttaatgagagatagctattctcatactgaattaattttggcgggtatgtggggcggttgcacaggtatttttcataatattgaagcacatatcagggattatgttgccactgggaggtatctggacaatcgagtcatagatcaacattacctgcgttattgtatttggccgactttaaaacaaagtgtgcttgtacatgatagccagcaatttgatgaaaatagtgccgattttccggtttatgatctaacttcaatgcaaaatgaccaagacaattttcatgtagggatggataatggttcaccagtcgttacaactgcggttaatcatccaacggcagaaaaagtttactggattttattcgatgaaaatcacgatgaagtttgcagatatgatgcaattgtgtcgaagagtcgaaatattgaagtgaatttaccccacgcttttgctaaaaaaattcagttacagcagtggaaattacaagtctatccgtatgaaaactga

SEQ ID NO: 3792 - DNA, 564 bp, Acinetobacter baumannii
aataggagaacaaccatgaaatttaagaatgcaaaaataaaaatactcgatctcgatttacgaggctgcttatatctcaataatttctctcattcacagcgtgtggcattattcttcaaaattattagccgtgctggtgacggacctttttggtacctcatgttggcgattgtatggggaatgcagggcattacctatagcttgcaaattatctatttgctacttggtggttcagttggaacagcaatttataaattcttaaaacataaaaccacgcgtccacgtccttaccaagtacatcaggtgattgttctcggtgaaagaccactcgatcactttagttttccatcaggtcatacgttacatgctgtcatggtgacaattgtgttggggtatatccaacctgtgttgcttgcagcgatgttgccgttcatggtgcttgtgttgtctcgtatggtacttggacttcactatccgagtgatgtgattgtgggcgcacttattggtgcagcagtagcaagtctgattatttttgtcgcgccattattgggcattgctttataa

SEQ ID NO: 3793 - DNA, 513 bp, Acinetobacter baumannii
aaaaaattgactattatggctattttaaaaaaacttcagaacattccttcaatttccaaattcttatttaaccattacccaccttaccgtggagctggaattcatattgaagtcatgaatttagaactctgtcatgttcgggtaaaaatgccacttacttggaaaaatcaaaatctggtaggcactcactttggcggaagcctttattcaatggttgaccccttttatatgttgattcttatgcatcatctcggatcaaaatatattgtttgggataaagcatctgaaattaattttttatcacctggccgaagtaccgtttatgctgacattcgcgttgatttagcagaaattgaacaaattcgtgaacttgccgaaaactatgctcctgttcttagaacatatcatttaaatattttcgatgaatcaggtgtgagaattgctgaagtccaaaagacactttatatccgacgtaaaaaagcaaaaccttctactaataaaataagcgcctga

SEQ ID NO: 3794 - DNA, 2235 bp, Acinetobacter baumannii
gcctctatgaccataacgccaaagcctgattcagttgtttatcgtgtgcgtgttgccgtacctgtgcatctgtacgacacttttgactatacactcaccaaagcacaatatgaacgggctcaagtaggttcacgcgtcgcaatttcatttggacggcaaaacctgattggtatcattactgaaaaagttgacccacaagaatcatttacaggtcactttcagcttaaggccatttctgaacttttagatgatgagcctattttagatgaacaagttttaaatttattgacatggtcagcacaatattaccaatttccgattggcgaggtgatgcagactgctttacctgcgttattgcgtcagggcaaacccatggatgttttatttcatctatggaaaatcattccatgtgacaatgccgaagctttactaaaacgttcaatcaaacagcaagatgcttatcaaattttaaaattacatcctgccggaaccactgaaaatattctcaatttaagtggtgtagaaactgcaacacttaaagcactgcaaaagaaaggtctcatagactgtacgcttgagcctcatgactttagcccagcccctgtgcaattggcgcaaatgccactcacgctcaatgaagaccaaaagaaggccacccagcatgtccttaatgcacagcatcaatatcaagcgtttttgttggatggtttaaccggaagtggtaaaactgaagtttatttgcacatcatgcatgaagtgctaaagcaaggtaagcaagtactggtgttagttcccgaaattggtttaacccctcaaaccatttcgcgctttaagtctcgttttaactgcgacattgctttattacattcggggttaaatgactctaaacgcctacaagcatggcaacaagcacagactggaaaggcctctattattttaggaacacgttcagccatttatactccgctgccacgtttgggcctgatcattttagatgaagaacatgacctttcttataaacaacaagaaggtttccgttaccatgcgcgtgatgtcgcgctttatcgaggacatttacaaggctgtcctgttcttttaggttcggcaactccaagcattgacagttatcacttagtcgaaactggcaagttaactgcacttcagctgaaccagcgtgcaggccatgcgcttttaccaaaaatgcatttgattgatcttaaaattgtcaaaaaacagcatggtattagtcagcctttaatcgaacagattaaaaataccctagcaagaaaagaacaggttttaatttttttaaaccgacgtggttatgcacctgttctggtctgtgaaagttgtggttggcaagcgaattgtccgcattgtgatgcgcattttacgttacacactcagccttattcttacttacattgccaccactgtggcacagttcatcgcttgccagaccactgccctgagtgtcagcaaaagagcctcaaaactttaggtgctggcacagccaaggttgaagagcatttacaagaattatttccagatcatgatgtgattcgggtcgatcgtgacagcaccagccgagtcggtagctggcaaaaaatttatgatcgcattcagcaaaataaaccttcgattttgctcggtacgcaaatgttggcaaaaggtcaccattttccgcatgtgaccttggttgctattttagacattgatgcaggcttactgagtgtcgatattcgagcgccagagcgtactgctcaattgattgtacaagtggctggtcgtgcaggtcgtggagaacataaaggtcatgtttatttacaaaccttaaggccagatcatcctttactcaccacactcatcgaaaaagattatcgggcagtcgcgaaacaaacattggctgagcgtaaagttgccttactgccgccttatcgctatgccgtacttatacgcgctgaatcgaaagatcgcgactataccttgcattttttaaatgaagctgccgagcaacttcgccaaatagcaggtgatattgttgatatctgggggccaattccagcaccaatggaacgtaaagcgggacgttaccgcgcacatatggtgattttgtctgctgatcgcgctcgtctgcatttttacttaagacaatggtgggctcagttggtccatgcgccaagacagcatcaactcagactctcaattgatgttgacccgcaagaatttagttag

SEQ ID NO: 3795 - DNA, 1023 bp, Acinetobacter baumannii
tttttaatgactattaataaaaccattgaaactattaaatctccaagaatcagtgtagccccaatgatggactggactacaaaggactaccgattctttgcacggttgtttaacccaaatgttgtgctttatacagaaatggtgactacgggcgcgattctatttggcgatgcaaaacgccatttggactataacgctcaagaacacccgatcgtattacaacttggcggttcaaacccacaagagcttgccacttgcacaaaaatggctgaagactggggttacgatgaagtcaacctcaatgtaggctgcccaagtgaccgtgtacagaacaataaaatcggtgcatgtttaatggcagaaccagacttggtcgctggatgtattcacagcatgcaaaaagccgtcaatattccggtaacggttaagcaccgtatcggtattgatgacatgcagtcttacgaagaaatgctgcattttgtagatacggtagcagcaacaggttgtacccactttgttgtacatgcccgtattgcgatattgaaaggtttgtctccgaaagaaaaccgagaagtaccaccgctacgctatgaagatgtttaccgtttaaagcaagaacgcccacatctgactattgaaattaatggcggtattaaaacttttgccgaaactcaagctcatttacagcacgttgacggcgtcatgattggccgtgaagcctatcacaacccttacttacttgctgagctcggccaactttggaacctagaagcgccagatcgtttcgatattatggaacaaatgctaccgtatattgaacaacgtctagctgaaggtgcaccactctctatcattacgcgtcatattttaggtttattccaaaatttaccgggcgctcgcaaatggcgacaagccctaagtggtggaaatgcaaaaactttaactgatgtcgagaatgcaattcataatatgcaagctgccattatccgtactgaagagtatttaaaggaacaccaattttaa

SEQ ID NO: 3796 - DNA, 2784 bp, Acinetobacter baumannii
cattgccagacatgggaggataacccaatggctaagtatagcaatatcaatagttttaatgctttacagacgctaacagtaggttccagcaattatcagatttttagcttaacccaagccgagaaaaagctaggtgacattgccaaactgccgaaatcattaaaagtactgttggaaaacttattacggtttgaagatcagcacagtgttaaaacagaacacatttatgctttagctgagtggctaaaaacccgtacctcagatcaagaaattcaatatcgacctgcacgggttttaatgcaagattttaccggcgttccggcagtcgttgacttagccgcaatgcgcgctgcaatggctgaagcggggggcaaccctgaaaaaattaatccgttatcacctgtagatctggttattgaccactctgtgatggtagaccattttgccgatgatcaggcttttgaagaaaacgttcaaattgagatgcagcgaaatggcgagcgatatcaatttttgcgttggggacaatctgcatttaataactttagtgtcgtgccaccgggtaccggtatttgccatcaggtcaatttagaatatttggctcaagcagtatggctaggtgaagacaacggacagacctttgctttccctgataccttagtgggtacagactcacataccaccatgattaatggtctaggggtattaggttggggagttgggggtattgaagcagaagctgccatgttgggtcagcctatctctatgctcattcctgaggtgatcggttttaaactgactggcaaattacaagaagggattacggcaactgacttggtgctgaccattactcaaatgcttcgccaaaaaggtgtggtaggtaaatttgtagaattctatggagatggcttagccgacttaccacttgctgaccgtgcgaccattgccaatatggcacctgaatatggtgcaacttgtggtttcttcccaattgatgaagtgactttgggttatttgaaattaacaggtcgtcaaagtgaccgtattgcattggttgaagcatatagcaaggcgcaaggcttatggcgtaatccgggtgatgaacctgtttttacagatactttaagtttagatatgagtacggttcaggcaagtttggcaggtccaaaacgccctcaagaccgtgtgcttttatcggaagtacctaaaacctttaatgcgctcatggagttaacccttaagccagccaaagaagcgaaagaacgtttagaaaatgaaggcggtggcggtacggctgtagaagcgaccaaagccaatattcagcatgaaagcccatcttgtgtaattgaagggcaagaatatccattaaatcatggcgatgtcgtgatttcagcgattacttcatgtaccaatacttctaacccaagtgtaatgttggcagccggtttacttgctaaaaaagcaattgaaaagggtttgcagcgtaaaccgtgggtaaaaagttcacttgcgcctggttctaaagtcgtgaccgactatttattggcggctgggcttacgccgtatttagatgagttgggctataacttggttggttatggttgtacaacgtgtattggtaactcaggtcctttacctgaaccaattgaagatgcgattcagtgtcatgatctaaacgtggcatctgtactttcgggtaaccgtaactttgaagggcgtgtgcatccattagttaaaaccaactggcttgcctcaccaccacttgtggttgcctatggtttagttgggaatatccgtaccgatttaacgactcaaccaatcgggcaaggtaaagatgggcaacctgtttacttaaaagatatctggccaagtcaggcagaaattgatgccgtcttacaaaaagtaaataccgacatgttccacaaagaatatgctgcggtgtttgatggtgatgaaagctggcaagcgattcagattccaaaaagtaaaacttacgaatgggctgatgactcgacttatattcgccatccgccgttctttgaaggtattggtgagccaccaaaaccaatcaagaatattgaacaggcacgtattttggcagtgcttggtgactcggtaacaaccgaccatatttcaccagcgggtaatatcaaaaaagacagtccagctggccgctatttacaagagcaaggtgttgagccaaaagacttcaactcttatggttcacgacgtggtaaccatgaagtcatgatgcgaggcacctttgccaacattcgtattaagaacgaaatgctcggcggtgaagaaggcggtaataccattcatgtgccaagtggtgagaagcttgctatttatgatgcggcaatgcgttaccaacaagaacatacaccacttgtgattattgctggtaaagaatacggaacaggttcttcacgtgactgggctgccaaaggaactaacttgttaggtgtaaaagctgtcattgctgaaagttttgaacgtattcaccgttcaaacttggtgggtatgggcgtgttgccactccagtttgttgatggccaaaccagacagtccctcaacttaacgggtcatgaagtcatttcgattcgtggtttatcggatggtattcagcctcatgaaattcttgaagttgatgtgaaaggaccaaatggagtagctagtcattttaatgtgttatgtcgaattgatacgttaaatgaggttgagtactttaaggcaggtggtattttgcattatgtacttcggaatttgattgcttcataa

SEQ ID NO: 3797 - DNA, 1269 bp, Acinetobacter baumannii
gaaatagagacaataaaacttatgaccagtctaaattcgtcctatgggcgctctcaagcggttcctttatctgtattcgagcagtcgaaagacgcacatattattcgttctgatgaagaggcaatagagattgccaagcaacttgctcaagagttcgccacagaagcatcagatcgagatagagagcgccgtttacccttaaatgaaattcaacagttctcacaaagtggcctgtgggccattacagtacctaagcaatttggtggggcgcaagtcaagtaccgaactttagcggaagtgatcaaaacaattgcgagtgttgatccttctcttgctcaattgcctcaaaaccacttggcttttattgaacatttaagactagatgcgaaacctgaacagcaacaattcttctttaacttggtgttaagaggaattcggtttgggaatgcattttccgaaaaacacagtaagacagtagcagacctcactaccacattacgaaagaccgagcatggttatgaaattaatggcaagaaattctttgcaacgggtgccttgctcgcacattggattccaattgttgctgtaaatgaactagggcaaccttatgctgcacttgtgccacgtgaaacatctggggtcaatattattaatgactggtctggttttggacaacgtaccacggctagcggtacggtagagctgaatcaggttccagtacgtgaagaatatttagtcccgatttaccaagcatttgagcgcccaacaccagcaggtgctatttctcagtttattcaggctgcggtcgatgccggtattgcacgtggtgcaattgaagaaacgattcaatatgttaaaaaccatagccgtgcatggattgattcaggtctagaaaaagccagtgatgacccttacaccattgcaaatattggtgacctaaaaatcaaactgcgtgcagcagaagcggtattggatttggctggagatgcaattgatcaggccattgccaacaccaccgaagaacatgtaaaccaagccactctattggttgccgaggcaaaagtactcaccacagaaattgctattttggcagccaataaactttttgagttatcgggtacgcgttctactttatctgaactcaaccttgaccgtcactggcgcaatgcccgtacccacactttgcatgaccctgtgcgttggaaatatcacattgttggtaactattatctcaatggggttcagccacctcgtcatgcatggagctaa

SEQ ID NO: 3798 - DNA, 696 bp, Acinetobacter baumannii
aaggtgtttgccgtgattcatcatatccccaatgttttaagcaaagagcaagttgccgagtttcgtaagctcatggaagaagccaattgggtaggtggaaaagtgactgctggcaccttgtctgcttcggtgaaaagaaatcagcaactctcagaacaagacccccttacccatcatttaagtgatatcgtcatcaaagcaatttggcaaaatcctttgtttcaggccgcggccctgcctcacaaaattattccaccgctttttaatcgttatgatgaacatgaaagttttggttttcatgtagacaactcaattcgccttattcgtggtacagcggaacaaattcgtacagatctatcatgtacattatttttaagtgagccagatgaatatgaaggtggtgatctggttattgaagatacctatggttatcacgaagttaaattacctgctggtgacgtagttctctacccatctaccagtctacatgaagtgagtagtattacagcaggtactcgttttgcttcctttttctgggttcaaagtttagtacgtgacgatagtaaacggcatcttttatttagtttagatgaaagtattcgtgaactccgtaaatcacatggtgatagctattctgaagtcatgaaattaactaatatttatcacaacctaatccgtatgtggtcagagctataa

SEQ ID NO: 3799 - DNA, 729 bp, Acinetobacter baumannii
agcaccgttgccagaagacatgacccagttattagaggctttgagagtagcaaaatgagtctgaaaaccgaattagtgatttttgactgggatggtactttatataattctgttggtcagattgttgcaagtttacagcatgcggcagaagagcataagttaactctgactgatgaagccgcaaagagtattatcggtttaggtttgccggaagtgatgcagaccttatttccagaagtacctgatttgcatgattcgattttaaaagcatatggcgatcactatattgccaactcgacaaatgatgcatggtttgaaggtatttctgaactacttcatgacttaaaagctcaaggtttaaaacttgcagttgcgacgggtaaaaaccgtcgtggattagaccgtgtgattgcaaaaacacagagtactcatctgtttgatgttactcgagcagccaatgaaacccgttcaaaaccagacccgctcatgttaaaagaaatcttgactgtaactggagtaagtgtcgaacaggcagttatgattggtgatagtagttatgaccttgaaatggctcagcgtttaggtatgcctcgtattggggtgggctatggagtgcactcggtcgaagttctacaacagttccaacctttaaccattgctaaagatgtacctgagctgcacaactttttaagagagtatgcaaagttatctactgtagacgtagcgtaa

SEQ ID NO: 3800 - DNA, 393 bp, Acinetobacter baumannii
ttttattatttcgtcaaaagaggttttattatgttgaaatttatgaaaattgtggctcttgttgcaactgttgctgcgttaagtgcatgtagcaaaaatgaggcatcagagcaaaagaaatcggaagcaccgatggagcagatgagtaaagagtcatctacagttgcaacagctcaagctgttggtgtgattactgctattgatacgaaagaaaatattctaacactcgaccatgaagcaattcctgcaattaaatggcctgcaatgaccatgggctttaaagttgcagatccagcattattgaatggtttaactgtaggggaaaaggttgacttcgaattaaaaatagagggtgagagtcagattattgttgctgtgaaaaaaagctcataa

SEQ ID NO: 3801 - DNA, 324 bp, Acinetobacter baumannii
agatattattttcttttcagctttctttccgcaatttgtttctatttcacctcatctagatttaagtctaactattcttacgctgacatggatagttttagactttttaacgctatctctagtctatatatttttccgccgcctctcgaacagccatttatacccgaagatcctcggtttatgtggtctattactgttagttattgccgtttacggtttatatcagacattcatttaaacaatgagaggatagccctcacctctctatgtctcttttattttgctcgccctatttcgcacgagaacaactcttatacaatctag

SEQ ID NO: 3802 - DNA, 696 bp, Acinetobacter baumannii
accgcttatgctggtgttaatggcaagcatcgtactggttattgtaattgcggttatgctgccaatcgtaaatatgaacaatatgatttaataactttgatattagagataatgatgaaagtaaaaaatattcaaagcgaaacagcgatgaaacaacatagtgaatctgtggtttcaaatcagtttgaaccaacgtgccattccgagtatagctctgtatcagatgtttgctcttcaagttctttcggacttgcgacacgttcgagccgtgctcgaatgaaacgtgcctcaggctttacccttattgaagttatggtcgtgattgtaatcttaggcgtgttggctgctttaatcgtaccgaatgtcatgggccgtagtgaaaaagctaaaattgatacgactcaaattactttgaaaggggtagcgggtgccttagatcaatacaagctcgataatgggcatttcccaaccatgcaagaaggtggtttagatgcgcttattaatcaacctgctacagcaaaaaactggatgccgggtggttatgtgaaaggtggttatcctaaagacagctggaaaaatgatatccaatatgtcgtacctggaaaagacggccatccttttgatctatattcatttggcgcagatggtaaagaaggtggtgaaggtaacgatgccgatatttattatcagccttaa

SEQ ID NO: 3803 - DNA, 702 bp, Acinetobacter baumannii
ggttttaatgctagctttgaattatggatggtccggattaataaaatgaatagtaaacatgtggacatttatataggaaaactcaatgattttttaaatcgaaaacaacatgattttcccgactttcgtacatttaatgagtataaaaaacagcaaatacaacatattaaaaataaactgattgctcaaaagctagagatagcaccaactgatttagtatttgcaaaacatgagtatggcaaaccttacttactggaccatgccctgcattttaatcattcccatagccaacaatattatgctttagcgctgagtgagcgaattaaagatattggtatagatgttgaagagcttgatcgtaaagtacgtctggatagtctggcacaacatgcttttcatcctgatgaatatgcaacgtggcaaagtctagaacaagatagagaatattggtttaaagtctggaccactaaagaagctgttttaaaagcatcgggtctgggtatacgtttagatttaaataccttaaacacccaagcacatcctacaaatcatggcggattatgttcgcatgaccttattgggacatttgcctaccaaaactttgtgttcggtaatatgatcttaacagtcgcatggcgttcagaacaatcatgccgtggattccagtttccttctattcagattcattcacttgaccgttaa

SEQ ID NO: 3804 - DNA, 1278 bp, Acinetobacter baumannii
ttaaaaaatgctatgcaagattcaattgaacaatatatgcaaaaagttgggcaacaagcacgtgatgcttcacgcgtcttaacaagtgcttctacctcacttaaaaatcatgcactctctgctatttatactgcattggaaaacaaccaagcagctatcttggcggcgaatcaaatcgacatggaaaaaggccgtagcaaccagctcgacagcgccttacttgatcgtcttgagcttacgcccgcacgttttaaagggatgttgcaaggtttaaaagatgtgatcgcgcttgttgatccaattggggaaattacggatcttgcatatcgccccacaggcattcaaattgggaaaatgcgtgtacctctaggtgtcgttggtatgatttacgaatcacgtccaaatgtcacacttgaagctgcatctttagcaattaaatcgggcaatgccattattttacgtggtggctcagaagcacttgagtcaaataaagcaatcgcagaagcggtgaagcatggcttaaaagttgctggtttacctgagcactcagtacaagtgattgaaacttctgaccgtgcagcggttggtcacctcattactatggctgagtatgtagatgttattgttccacgtggtggtaaaagcttaattgagcgtgtaaccaacgaagctcgtattcctgtgattaagcatcttgatggtaactgtcatgtgtttgtagaagcacaagcggacttacaaaaagcgttaccaattaccttgaatgctaaaacacatcgttacggcgtttgtaatgcaatggaaactctgctcgttgatgaaaaaattgcagaagttttcttaccacacattgctgagctttatgctgaaaaacaagttgagttacgtggttgcccagaaacacgtcgtattttaggaagctctgtaaaacctgcgacagaagaagattggtataccgaatatttaggaccgattcttgcagttaaagtggtgagcggtattgatgaagcaattgaccatatcaacaaatatggttcgcatcataccgatgccattgtgacagagaactatactttggcacgtcagttcttggctcgcgtagattcaagctccgtcgtagttaatgcatcaactcgttttgccgatggctttgaatatggtttaggtgctgaaattggtatctcaacagataagattcatgcacgcggccctgttggcttagaaggtttaacttctcaaaaatggattgtgttaggtgacggtcaaattcgtcaataa

SEQ ID NO: 3805 - DNA, 282 bp, Acinetobacter baumannii
aaattctatttgttcgagtttgttatgtcagaacaacctatttcacctactgtacaacttaatacgcgtggtttacgttgtccggaacctgtcatgatgctgcatcaggcgattcgcaaagcaaaatcaggagatgttgttgaagtgttggcgactgacccttcgacttcttgggatatccctaagttttgtatgcatttgggacatgaactcctattaaaagaagaagttctagatgagcagaaccataaagaataccgttatctggtacagaaagggtaa

SEQ ID NO: 3806 - DNA, 615 bp, Acinetobacter baumannii
agtcgctatttatcgagtgagtgcactatgaaaaagacattatttagcacactaattgcaggactgctaagtatgcaggctcatgcagattatatcgcccagccacaatcggttgcgagccaggctgcgcgcttctccacaatggggattcatgaccttcaaaaagcagctcaagcgggtcaagctggcgcacaattttatcttggaacacgttaccaatacggtaaagatgtagcaaaagacgataaacaagcttttacttggttcaaagctgctgctgaccaaggcctttcacctgcgcaattaaatgttggccgtatgtacgccgatggtattggcgttaagaaagatgagtctatggctcgtaagtatttcgaaaaagcggcaagtaacggcgataaccgtgcaagctataacctcgcgatgatggaagagcaaaagaaaaactacgtaggtgcttaccagtggtatgagctttcaactcgtgatggcatgctcgacaataaagtgattagcttatctgaaggtaaaaagacagctcttgctgcaaacttaactcaagagcaaatccgtatggcacgcgaccgcgcggataaatggattcaagcacaataa

SEQ ID NO: 3807 - DNA, 1086 bp, Acinetobacter baumannii
caaaatgtagcaaatcattgcaaaattcgcttattgtttttcaatcaaaattcaaatggaaccaatatgattggcgcgttgatgctggacatagccggcacagaacttactcaagaagatattgaactattacaagctccgcaagtcggtggcatgattttatttgcacgaaatattgaatcaccacaacaagtccgtgctttaaccgaccatatgcgccaagttcgcccagatattttgattgctgtcgaccaagaaggtggtcgcgttcaacgtctaaaatctggctttacattattgccagccatgggccgttttggcgagctctatatcactcaacctcaaaaagcacttgaattagctgaacagtgcggctggttaatggcaactgaagttttggctgtggggatcgattttagttttgcgccagttttagatctgaatgcaattagcgatgtaattggtgaccgtggtttctctaaaaatatcgaagatatcgctccacttgctggtgcatttatgcgcggtatgaaaaaagccggcatggcaaataccggtaagcacttccctggtcacggatcggtaaaagctgactcacatgtcgcagctgcaatcgatagccgtagctatgacgaaatttataaccatgacatgcaaagctttatcaagcttatgcctgagctagatgcgctcatgccggcacatgtaatttacgatcaggttgacccaaatccggcaggtttctcacctttctggattcaagaagtccttcgtaatcgcttgaaatttaatggcgtacttttctccgatgacttaagcatgcaagctgcttgtgtcgctgggggtgcagacgcgcgtattcaagcagctctggcagcaggctgtgatatggggctagtgtgtaatgaccgtagtgcagcatgtactgcactcgatggtattgcacacttagagctaccaaatcaagagcgtttagaacgtatgcgtggtcgaattccacaaatccaagttggtgaaactttatcgcttggaaatgactggcaagctgtcaaaacagccattgaagaatttaaaaattcgatttaa

SEQ ID NO: 3808 - DNA, 369 bp, Acinetobacter baumannii
gctgcaccagcactaccaccgagtgctccacctgcagcagcaccagcgtcaccaccaatcactgcaccccctaagattgccccaacacctgcaccaatcgcactattacgtactgttttactgctagagcctttagcattagcggcaacaccagcaccaagcgctgctcctaaacctgcaccaatattaccgcctatatgtttacctacggcaccacctgcaccaccaccgatagctgccgaaccaatacgtttgctttctgggctagcattttggcaacctacaaatagagtagttgacattaaaccaacacctgcaatcatcatcatttttttcattaaagctactcctctactcagttgcgcctag

SEQ ID NO: 3809 - DNA, 441 bp, Acinetobacter baumannii
aactgcacagcaaagttatgttggaggtcaagcttaatggcttttcaattgggtgaagaccacgatagtggcatgaatgagatgaatctcattccgctaatcgacattatgttggtgttaatgatcatctttttggtcacagcaacagttgccaacccatcgattccattaacgcttcctaaaacaactgctgaaattattgatccaccaccaaaagcaattacgattagtatcaatgcaaatggtgaagtggcttgggatactcaagtaattagccttgatgagcttcaaaaacgcttccaagaagcaggtcaaggtgcggttaaaccgacagttcaacttcgcgctgataaagagtcgaagtacgatactgttgctcaggtaatgtctcgcgccagtgaagccggactgagcgatattgcctttgtaagtgaaaactaa

SEQ ID NO: 3810 - DNA, 834 bp, Acinetobacter baumannii
gatcaaggagcagcaatgctgacctatcctaatatcgatccggtcgcaatacatctaggacctcttcaagtccattggtatggactcatgtatttattggcatttttatgtgcttgggggcttgcttcctaccgtgccaaacagcgtgatggctggacatcggacatggtttccgatctggtgttttacggcgccttaggtgttgtactcggcggacgtatcggctatgtgcttttctatgagtttgataaattccttgaaaacccaatctggttattccaagtctggacaggtggtatgagcttccacggcggcttcttaggcgtcatgatcgcaatgctattctggtgtaaaaaatatcaaaaaacatggttccagacactcgactttgttgccccttgtgtaccgacaggcttaatgttcggacgtattggtaactttattggcggagagttatatggtcgtgcggtcacagatccgaattatccattcggaatgattttcccaaccgatccattacatctggttcgtcacccttctcaaatctaccaagcgctttgcgaaggactattactctttattattttgtggtggtttagctcaaaaccacgcccacgtatggctgtatctgccctatttttaatgggttatggtgttgcacgctttgtgatggaattcttccgtcagccggatgccgaccaaggtttcatcttgtttggctggatgaccaaaggacaaatcctcaccgttccaatgctactgataggcctttggatgatgtggtatgcctaccaaaagaaaatttatgactggggccctcaaaagaacagttaa

SEQ ID NO: 3811 - DNA, 963 bp, Acinetobacter baumannii
aacattatggccaaaaattattatgaagaattaggggttaaacgagaagcctcagctgatgaaattaaaaaagcgtatcggaaattagctcgtaaatatcatcccgacatcagcaaagaaaaagatgcagaagaaaagatgcaggcaattaatattgcctacgacaccctaagcaacccagagaaaaaagctgaatacgaccaaatgttagaccacccacaaggttttaatggttttggtcaaggggcagctcaaggtggtttcgatggtgccagattttatcgtcaaggttttacaggcggtgagcaagcagactttagtggctttgaagacttatttggacgctttggtgcaggcttcggcggtggacaacagcaatatcaaagacaacaacgtagttatcgaggtgaagaccagcatgccagcatagaggtcgatcttgatattgcttaccatggatcaacacaacacatcaccctgcaaattccaaccattaatgcctatggtgagccagaggtacaacgaaaaaccttacaggtaaaaatacctaaaggcatgaaagaaggacagcaaattcgcctaagtggacaaggacaaagtggtattaatggtggtgccaacggcgatctttatatcgagattcaatataaagatacagatcgtgtgcatgtcgaaggcagtgatgtatatttgactgtagatgtagcaccatgggaagccgcattagggcaaggcattgaagtaaaaacgcctgcgggacctttacacgtcaatttacctaaaaatgcaaaacaaggacaacagctacgtttaaaagacaaagggataccaaataaaacgccaggccatctttatttaattttaaatattgtattcccaccggcgcattctgaaaaagaaaaagaagcctatcagcaattggcagaagcctttgcttcattcgaacctcgttcatctcattag

SEQ ID NO: 3812 - DNA, 780 bp, Acinetobacter baumannii
gacatcatggcaatttcaagttttggcaaaattttaaccgtactggatttattttccgtttcacgaccagtgattaatgtcgatattatttgcgaagaacttggcttgtctaaaccgaccagctaccgttatctgaaagaactcgtatcagccgacttattaaaacgtattaatggtacttctggcgattacactttaggctcaaaaatagcagttcttgactatgtatctagaacaaccgacccattggtccaaatcagcacgccatttatgcgaaatattgtagagcgtactgaactttgctgtttactcacctatttaaatgatgactactgcattgatattcatcatgagatttttaaagatactgagttactttcatatggtcgaggctgcccacgcccaatttatgttggggcctcaccaaaaacgatggtttcacatttaagcaaacaacgcatgcatgactactatgaacgttttcaacatgagctgtctgaatcaggttttgctgtagacgaacctagctttattcaacgtatgcgtaaaataaaaaaacaaggcttctatttctcgcaaggcgagattgaccccaatgtttcagggcttgctgtacccgttcgtttttcgagtaaagaagtgcctttggctttaacgttagtcgcatcaaagaaccgctttgattttttaaatattgaaaagttgattgaaattttgcaagaaaacgcggcattgattgagcagcgctttatggaactttcagagaagggcgagatctaa

SEQ ID NO: 3813 - DNA, 1182 bp, Acinetobacter baumannii
gcgcccaattttggaaacacaggtggaagagtcttaatgaatcagaaattcaaactgcctttggcaattgcaatcgcatcggctgtattggtcggatgttctagcaacaaagtaaaagaagcaaaaccaaatccactaccgaaattgactgagtcaaataagagtttggtgcccgtgttttcacgcagtgtttcttctacgaataaggcagatccattacgtttacaacttgacgctagcgaaggtgttgtttttacccttgatcctaaaggtgaagttgctgcataccgtggtaaacaacgtctttgggagaaaaaagttagtaaattgggcttaagctctggtgttgaagcagctgaaggtattgttgttgttggtaacagtaaaggtcagttatttgctttagatcaggcaaccggtgaacaaaaatggactgcacaattatctggtgctttattaagtccttctttagttcagtctggccgcgtgattacaattgcaaatgacggtactgtatttgcacacgatgtatcatcaggacaacaagtttgggcatacaaattgccaaatgttcagttcagtttacgtggtcagccatcgccagtgagtcttgaccctcgtactgttttaattgcttctgcgaatgcatatgtttatgcgattgatacaattagtggtattccgcgcttccaacgccgtgttgcagtaagtgaagggcgttcagatattcagcgtttaattgacattgatggtgatccggttgttgcgggtcaactcatggtaacaactagtttccaaggccaagtaactgttactgatcttgcttctcaacgtgtggtttggagtgaagattcaagtagcaccaagcgtccagaagtttatgataataaagtgtttgtttcgtcaactgatggcaagcttacggcttatgacttaacaacaggcgaacagctttggcaaaatgatagtctcttaaaccgtcatttaagtaatcctgtcgtcttgggatcggaccttattgttggtgatttggatggtgttttacacctaatcgacccgacaacaggtaagttgattggtcgttctaaaacaagtggtgaggtcaatacattacgtgtgattgagaatcagctctatgtttcgacccgaaaaggcgatttaagtatttggcagaatcgttaa

SEQ ID NO: 3814 - DNA, 996 bp, Acinetobacter baumannii
ctgcttttttatgcctgcaaaaagatgaaaaaaatagctttattttatatgggtggtacttttggttgcattggtgaacctttagctcctatgccttatgaccaattcctacctcaacttgagaaagtgattcccccacacttaacagttgattgctttgctgcgcccaatattgtcgatagcagtgcatgtacagcacctgactggttacgcctaattcaacgcatacaacaactacaactagaaggctatcagcattttgttgtgattcatggtacagatacgctcagttatgcagctgcgactttagctcgctttttagggcaaagctgtcatattgtgattactggtagccaatacccgttactcaatattcaaggtgataacacccgtgaatttactgatgcaatcgaaaacttatatcttgcattagagcaggttatcgcacttccggttggtgcttatctcgctttccaccatcaagtatttcacgcacaaactgcattaaaaacgcataccactgaacttgatgcattttcagggttaagtagtaacgttgagtttacgcctcagcagaatgaattgatcgtaaaagatgctcaaattgaaaaagctgcttcctttcagattttaaactggatgatgcaaccgattgcaacacagcatttagtacaacaattacgtcatttactgcctgccccaccacactttttagtgttgcaaggtttcggtacaggtaatatcgccgtaaacgatgaatttttggcaacattagacgaactctattctcgtggatgtgtaccaattttggcgacacaagtcacttttgggggtattgaccaacgttatgcaattagtgcttgggccaaaactgcaaaaattgtcattaatgatgcccatagccatgcagatctctatgcaaaagcacttcaaatctatttaaaatacccaaccccagaacaatggttgaaccattggaatgaaaatctgcattaa

SEQ ID NO: 3815 - DNA, 747 bp, Acinetobacter baumannii
ttgaaaaatttacaaaataaactgaaacatctggaaaaggacaatcacatgagcttaagtgatgaagaacaattcgacagcttaaagtcgttcgccaaaaaatatggttctgccatgattagcgggattctcattgcattgattgcctttttcgggtgggaatattggcaaaaaagaaaccttgcaacgagtcagacagaaactgcaaaggtacagcagttaatggatgaagcgaatgcaacagccgataatccaaatgctttagcttcaataacagcttcggcagataagattgtaaaagacgatattgattcagttcaggcgatacaaactcaatttgtattggcaaaacttgcatatgaaaaacaagattatgctgctgctgaaaaagctttgaaaaaagttgagaattcaaaagtaaaagatgaaggactgattcaggttgtaaaattgcgtttagcagatgcacaattggcgcaaaacaaatatgatgaagctctaaaaaccttgtctggtgatgtcgatccggcatttaaagcaacagtagaagagttacgcggtgatatctttgttgctaagaaagatattgattctgctaaaaaagcatatcaagctgcatgggattcgttactggaacgtaaacaagagcgacaaattttacaaattaaactcgaaagtgttggcgttttagttgaagatccacagattgagcgcccaattttggaaacacaggtggaagagtcttaa

SEQ ID NO: 3816 - DNA, 2889 bp, Acinetobacter baumannii
aatgaaaatttcacctttaggcttcggtctaaattatatatggatacgagtgtgctaccgataattatcttattaccgttaatattaggcaccacccttgtttcattgcttcaacggttttcacgtggagtaacggctttaggggcgatcggagtcagtttaaccagttttggtttattactgactcaggctaaaactgtgcttggtggtgcaagcattcaacaaagttgggattggttaccacaattaggaattaatctgagctttagacttgatgctcttggtttattattttctcttcttattaccggtatcggtacactcatttatatttatgcctattattatttaggccctaaaaattcattaagtaaattatatttattactcatgctgtttatggcagcaatgctcggtatttctctttctaacaatttaattattttattagtcttttgggaacttaccagtatttcatccttcctattagtcggttactggagtcattacgaagctgctcaacgtggctcgcgtatggcacttaccattacaggtatgggtggactcgccatgctaggtggatttgtcttattaggacaaatcacaggaacctacgaaattaatgatattgtcggaatgaaagacctcattcaaagtcactatctgtttgttccgacgcttttgcttattttactgggtgcatttactaaaagtgctcagttcccgttccatttttggttacccaatgcaatggcagcgcccactcccgtgtcggcctatttgcactctgccaccatggtaaaagctgggattttcttattagctcgtcttgcacctattttcattggcgctgcgctttatcacaacattgtcacgtttgtcggcctatttacactttgtatggccgcatgcttcgcaatttttaaagaagatctaaaagggctactagcctattctacaattagtcatttaggtcttatcgtttgcctgcttggtattggttcacctttagctgttgctgcggcaattttccatattattaaccacgcaacctttaaagctgccctgtttatgattgccgggatcattgaccatgaaacaggtacacgtgaccttagaaagttaagtgggatttggcaactattaccgtttaccgcaacactgactatgattacagcggcatccatggcaggtgttcctctcactaatggctttatttctaaggaaatgttctttaccgagctattagcgagcctttcaggatcaactgttatctttgccagtattattgcgacgcttgctggtatttttgcagtcagctattcaattcgcttagtacacggcgtattttttgatggccccgtaggaaaacaagttccaaataaaaatgcccatgagccacctatcggcatgcgagcaccagctatattgcttgcgacattatgtattttggtcggtattttccctgctctactggtcgagcctctagttaacagtgtgacacgtgcaagtcttatgcaacctgattttgcaggtactcatcttgcaatttggcatggatttaatgcgccattaatcatgagtattattgctctggttggcggtacgcttttctattttgccctagcaaaagatggcatgattcgtaagatcgaccttgacccacgtttagggcgcttacaaggccgtattttatttgacttattcttaaagcatttattattaacaagccgaaaaattaaacaaaaaaccgaaaatggttctttgcaaagttacctgttcttaatcattgcttttagcatcgtcatggttactctgcctttgttcaatcagggccttaccacaggtacacgtgagctgactcacgcaccatggattgcagtagttctttggctgaccttattctcaggttgctggatgatgctttggttccaccatgaacgtatcaaggctgtacttattagcggtgcaattggtcttgtggttaccatggtatttgtcaccatgtcggcacctgacttagcactcactcaaattacggtagatgtagttacgactgttctgttgttgatgagcttatcgttactccctcaacttacgccatatgaatctcgtcgctcaagacgttggagagatgctgcgttagcaattattggcggtttaggaattggttggattacatggcttattttaacgcgtgatcataattcgatttcatggttctttgctcagcaatccttaccacttggcggcggttcaaacattgtaaatgttattttggtggacttccgtggctttgatacctttggtgaaattacagtactaggcattgctgcgattggtgcgctatgtctcatggatggcatgcgcgtacatggcaccaccatgacacaaggcctcacctaccgctttaacccatctccgctcatgttccgtattacggcctcttgggtattacctttagcattggtcgtaagtgtctatatctttatgcgtggacacaactacccgggtggtggctttattgcaggtctaattacctcaatggcactgattattcagtacattgctttaggtcaagatcaagcagaacaaatgttaaaagcccaatccggtcgtctttacgaaatctggattggctccggattaacaattgcaggccttactggcattgccgcatggttctgggcacgtccattcttaaccagtgcgcacgtctatgttgaattaccagttttaggtaagttgcatctggcttcagcagcaagctttgatctgggtgtgtatatcaccgtagtaggcgctaccatgctactcatttctgtattaggggactctcgccactcgagtatgtctggtcctgtacctcatggggagaaatcatcatga

SEQ ID NO: 3817 - DNA, 360 bp, Acinetobacter baumannii
ttattactttacttaatcagagaaaataccatgaacccaatcaaacttatcgcttgtggagttttaagtctttcactcagttctattgcttttgctaaaactgagcagattacacttaaagccaatgtctattacggcgaagagtcagttgtatttccaaccactaaaggcgaagtcattttaaatagctacgctatgccagctaaagtcgttccacaagttaaaccttttaagaaggggcaatgtttagaaatcaaatcaaaatatggtttctttaaagacactggagatggtcaatatattgaaagtatccaaccttgtagcaagaaaggtttagcgactccaaaagtaactcgttaa

SEQ ID NO: 3818 - DNA, 1632 bp, Acinetobacter baumannii
gtaagactttatatgattccgcacgtttcacgtttactcgaactttggcgtattgcagcgcactatagactcgatacgttgttccctgcggatgaattacctgttaaagctaagcatgcattgaacattataaaaatgcatccggcagcatggtctagtcgtgaacgtaaaaatcctttaaagcttaaagaagctttagaagatatggggccgcttgcaattaagcttggacaactcctgtcaacccgccgtgatttgattccacctgaaatactcgcccaactagttttgcttcaagatcaggtcaaaccttttgatggagaagttgccaaacaacgtattcaagattctttaaaagcagacgtaaatacactatttgctcgctttgatgaccaaccccttgctgctgcctcaattgcacaagttcatacagcggcactacatgatggacgtgaagttgttgttaaagttactcgtccagacattcgtagccaaattttacaagactttgaaattctggcttggctaggcaccaccttagaaagtcgtcttgaagctgcccgtgcattacatttatctgaaattattcaagactaccgccaaatcattttaaatgagctggacttgagtattgaggcagataacacccgtcgtatgcgccattacttcactggttcaaccatgatgtatgtgccagaagtctacatggacaccaaagatgtcatggtggctgagcgtattactggtgtccctatttcagatacggcaacctttgaccgtttaggtatggaccgcgcacaacttgcagaaaaagggttaactattttctttacgcaagtattccgcgataactttttccatgccgacatgcaccctggtaatgtctttgtagaaaccatcaacccaagcaatccacgctttattgcactggactgtgcaattatgggtgagctttctaagcacgaccaaatgacggttgcccgcatgttgcttgctgtcatgaacagcaactttatgcagctcattcaaattgtgcatcaagctggctggattccaccgggtacagatcaagacgcgttagcacgtgaaatgcgccgcactgttgggccaatggtgtctaaaccaatggatcaacttgattttgcgggtatcttaattcaagtgatggatattgcccgtcgcttccatttagagattccgccacaactcatgctactactcaaaactttagtgcatgtagaaggcctaggtacggacctttatccgcagctcgacatctggaaattggcaaaaccaattttgacagaatgggtcaaatctaatatgaacccagtcaaaaatgtaaaagagcttggtcagcaattacctgatctgcttttaggcgctcaagatttcccaagtttaattattgatagcttaaatggtttaaaaaatcagtctgcttggcaagaccgtcagttgcgtgaaattcaacagcttcgtttacaaatggaacaccaacaacgtcgtagctggatgtttggcagtactatgctgattttgctaactattgcgattattagcccttggtttgtatctattattttgattgtgttgagcagcttattggcgctttggcgtgtattgaaataa

SEQ ID NO: 3819 - DNA, 426 bp, Acinetobacter baumannii
acttattcttatatttacagactaataataattgctcaaaacttaaggaagaagagtatgaaaaaaatagtttttgcctttttgtgtttcggaataaccacggtctatgctgataactgtgatagtgctcgtaatacttatgatgatatttactgtaccaataaaatctatgcgagtgctgatgcagacctgaataagaattatcaggcattaagagcgaaattaaatacagcacaaagaaatacgcttaagaagtcgcagcttgcttggatacgccaacgtgatgctgaatgtacagattctaatagaaatagcgtagacgtgcagtgtcgtttacagacaacgcaagaaagaaaccattggctgcaagaaagattgcgtgaatgccaaacggtgggatgtaaaaccagtcgattaagtgaataa

SEQ ID NO: 3820 - DNA, 855 bp, Acinetobacter baumannii
agccggacttattacgttctgcaaactcctgtagaggataccatcatgattagtctaagtgacttaagaaaatttaaagccgaaggacgtaagttctcttgcctaacttgttacgatgcaagtatggcaaaagcaatggaacttgctgaaattgatacgatcttaattggtgattctcttggaatggcaattcaggggcgtgactcaactttacctgtaactgttgaagacatggcctatcatacagcggcagtccgtcgcggtaatcagcatgctttaattatgactgacttaccatttatgagttatgccactttaaacgatgctttgcagaatgcgaaaacagttatgcaagctggtgcccaaatgatcaaaatcgaaggtggtgcatggctaagtgaaactgtccaagtgttaacacgtaatggtgtgcctgtatgtgtacatttaggtttaaccccgcagtctgtacatgtatttggtggctacaagttacaagctagaacgcgcgaagcagccgatcagcttattgccgattgtacagcggtggttgaagcgggcgcggcagttttattacttgaatgcgttccggcacaattaggtcaagaaattgccgaattgttcccaaatactcctgtgatcggtattggggcaggtaatgcgactgatggccaggtattggttgtacaagacatgttaggtctaacgtttggtcgagttgcgcgttttgtacgtaactttatgaaagaacaatctggtgaaacagcgattttagatgcttttaaagcttttcatgctgctgtacaagatcagtcgttcccagctaaagaacacactttccaagttgagctgtaa

SEQ ID NO: 3821 - DNA, 306 bp, Acinetobacter baumannii
gtgttatgttataacatttctttaatcaaaaataatttaggacaatctctcatgcgtaaagatattcatcctgcttaccaacaagtgttatttcatgacaccaatgcagacgtatacttcttaattggtagtactattcagacgaaacaaaccaaagaatatcaaggacaagtctatccttatgtgactcttgatatttcaagtgcttcacatcctttctatacaggtgaagtacgtaaagcaagtaatgaagggcgtgttgcaagctttaacaaacgcttcgctcgctttaatcgtaagagttaa

SEQ ID NO: 3822 - DNA, 1302 bp, Acinetobacter baumannii
accacactctactctttcctaattctgacccttatgaacttaactgaactcaagaaaaaaccaatcggcgaactaattaaaattgctgaatttatgggccttgaaggtatggctcgtaaccgaaagcaagatattatctttgccatcttgaaacgccatgcgatgaatggcgaagaaatttttggtgacggcgttcttgaaattctctctgatggttttggttttttgcgctctgccgcaggttcgtatttagctggtccggatgatatttatgtgagtccttcacaaatccgacgctttaacttgcgtacaggtgacaccatcacaggtaccattcgtccaccaaaagaaggtgagcgttattttgctttgctcaaagttaatcaaattaactatgacacaccagaaaattcacgtaataaaatcttatttgaaaacttaactccacttttcccgaccgaacaactggttatggaacttggtaatggtacaacagaagacttgaccgcgcgtgtagtcgatttagttgcaccaatcggtaaaggtcaacgttctattattgtcgctccgccaaaagcgggtaaaacaatgttacttcaaaacattgctcaatctattgtgagaaacaatccggaagttttccttatcgttttattaattgatgagcgcccagaagaagtaactgagatggagcgtaccgtacgcggtgaagtcgttgcgtcaacatttgatgaagcaccagcacgtcacgtacaagttgcagaaatggtcattgaaaaagcaaaacgtcttgttgagcacaaaaaggacgtcgtgattttacttgactccattacacgtttagcccgtgcatacaacaccgtaattccttcatcaggtaaagtattaactggtggtgtggatgcacatgctttagaacgtccaaaacgtttcttcggtgctgctcgtaatatcgaagaaggcggttctttaacaatcatctctactgctcttattgagactggcagtaaaatggatgatgtaatttacgaagagtttaaaggtacaggtaaccaagaaattacacttgatcgccgtattgctgaaaaacgcgtcttccctgccatgaatattaagaaatctggcacacgtcgtgaagaacgtttaatggatgaagataaattacgtaaagtttggattctccgcaaacttcttcaccctatggatgagttggcggctatggagttcttacttgatcgtatgaaagaaaccaaaacaaatgatgatttctttgatcagatgaaacgtaaagcttcaacataa

SEQ ID NO: 3823 - DNA, 381 bp, Acinetobacter baumannii
ggtccaccctattttatgaacttagctaaagtttccgagctcacaaaagtaagcccacgtatgctgcggtattatgaaaatttagggcttatacagcctcatcgagcgagtaataactatcgaagttatacgcaaaaagatattgaaaatattaagaaaattaaaatattaaatgacgcaggtatgaacctgaaagacattcatgttttattgccatgttttgatttagatgaacgggtatttacgctgtgtccagtggttcaagaaaaactacaaacagaacttaagcatgtgtccgatcagttaaacaaactgcaaacttctcaaagtttattacaatctttcttggcaaaaggaaaagctgagagcaccaatatttaa

SEQ ID NO: 3824 - DNA, 285 bp, Acinetobacter baumannii
tcagcatactataaaatacgcgcttccttacctgcaggtcgattttgcaatggtgcaatcgtgccgaacaggtgcccaaaagaggttactatggctaagttaaaaactcgccgtggtgcagctaaacgcttcaaagcgactgcaaacggttttaagcgcaaacaagcattcaagcgccacattttgaccaaaaaatctgctaagcgtatccgtcaattgcgcggctgtgtaatggttcacgtaagtgacgttgcttcagttcgtcgtatgtgcccatacatctaa

SEQ ID NO: 3825 - DNA, 1260 bp, Acinetobacter baumannii
ataagacactatttaaaaaataaggataatctaatggctgtcaaaaaggcacaaatgatgccgacttttgcttatgaaggggttgaccgtaagggcgtaaaaatcaaaggagaacttccggctaaaagcatggctttagccaaagtgaccttacgcaaacaaggggtgactgttcgaaatatacgtgaaaaacgtaaaaatattcttgaaggtttattcaagaaaaaagtcaccacactcgatattacgatttttactcgacaattggcgaccatgatgaaagctggtgtaccactcgtacaaggctttgaaattgtagctgaaggtttagaaaacccggccatgcgtgaggttgtactcggtattaaaggtgaagtcgaaggtggtagtacttttgcctcagctttaagaaaatatcctcaacattttgataacttgttttgttcacttgttgagtctggtgaacaatcaggcgcactcgaaacgatgctggaccgcgttgcaatttacaaagaaaaaagtgaattgctcaagcaaaaaatcaagaaagcaatgaaatacccagcaacagttattgtagtagccattgtggtgaccattattttgatggttaaagtagttcccgttttccaagatttatttgcgtcttttggagcagatttacctgcatttacgcaaatggttgtgaatatgtcgaaatggatgcaggaatactggttcattatgattattgcgattggcgcagtcattgctgcctttctggaagcaaaaaaacgcagtaaaaagtttcgtgatggcttagataaactggtgcttaagttacctatttttggggacttggtttataaagcaattattgcccgctatagccgcacgcttgctacaacatttgccgcaggtgttccacttattgatgcattagaatcgactgctggcgcaaccaataacgtgatttatgaaaaagctgtgatgaaaattcgtgaagatgtcgcaacgggtcaacagcttcagtttgctatgcgggtctctaatcgttttccatctatggctatacaaatggttgcaattggtgaagaatcgggtgcactagacagcatgctcgataaagttgccacttattatgaaaatgaagtggataatgccgttgatggtttaacctctatgatggaacctttaattatggcaattttaggggtgctcgtaggcggtctggtaattgctatgtatcttccaattttccaaatgggctcagttgtataa

SEQ ID NO: 3826 - DNA, 657 bp, Acinetobacter baumannii
ccagaggttcttatgctgcaagtcaaaattgttccagttactgcttttgctcaaaattgttctttagtttgggacagtgaaacaaaagaagcagttttgattgatgcaggcggtgacgctgctgttttgaagaaagaagtagaagccttaggtttaaaagtaaaggcgctatggctgactcatgggcatttagaccacgcaggggcggtgggtgagctcgcacaagaatggagtgttcctgttgttggtccgcataaagaagatcagttctggctagatatgattcaggaagtttcagcacgttatggttttccaattccacagccagtaaaagttgatcaatggcttgaaggcggtgaagtgctaaaactcggtgaagatgagtttgaagtgcgttttgcaccaggacatacaccaggtcatgtcatgttctataataaaaatcatggtttactctggactggcgatgtcctgtttaaaggctcaataggcagaacagactttccacgtggtaaccatgagcaactcattgaatcgattcaacgtgaatgctttagcttgccagatgaaactcagtttatttcgggtcatggaccaatgagcaccattggctatgaaaaacaatttaacccgtttgtcgcaggtaaggcgggttaa

SEQ ID NO: 3827 - DNA, 291 bp, Acinetobacter baumannii
ctaagaggctatttcacaatgggtgtatttcagttaaataccgctgactacctattcatgaaatatcgatctatgactgtcgaattaatgagtgtagtacaagactattatcctcatttaagtaaggcagaggctctgagaaaggcaaatcatcaagaatttcctttctcagtctttaaaatagattcaagcaaacgtgcaccttttctagtacacattaaagacttggctgatattttagataaaaagtattctgaagcttctaaagattttgctacgtttcatcaatga

SEQ ID NO: 3828 - DNA, 321 bp, Acinetobacter baumannii
cacgctttatattgcaaatatttattttttaaggggaaagtaatgttatatgtgattccgtttatcatattactcgtggtcgccgttattttaaaaaaacgcgagaatagtcaaaaacaagaggccacttccccaaaaaatataaatagaaaatccggcaaaaaaacgagtgctaaatcaagcaaaagttcgcgtgaaaaaacaaaaaccaaggtcattgaggaaaatactcctgctatccctcaaagcaatcctgtacctgaagctttacgacacaatattccaacagctcattcaagaaaaacagttttcagcagctga

SEQ ID NO: 3829 - DNA, 1647 bp, Acinetobacter baumannii
gaaagactatacctcttttcttattttattttctgttttaattgccatgaggggtcgggactagctttcttgctggcctataaattaaaagaaagtgaacgtcaccgtataagtttaaaattagcctttgcagtgatgatgaccctaagtattatggggatgcactatacggcacttatttcgacaaatattactgataagtttgtaagccaatatcaggctgagcatgacttgctgttatttacaattattttagttacctgtctggtgctggtcgcgagttttattgttgccgtgctggaacaacgactgaaccagcgaaatctagaactgcgcaaagccaataaagaattagccaacctctctattcaagataacttaactaaattaccaaaccgactttatttagtggattacgccgaagtcctcctgtcagatcaccgttataaagaccaaaaaattgcttttctctatattgatttagatcgttttaaatcggtaaatgatgcgtttggacaccacattggtgatcaactgcttatacaaatggccaatcggttacattggcaactcaatgaaaaatgtaaattgcttagaattggtggggatgagtttttactcattgctgaaaacactgatactgaagaggcaatgcaacttgctgaaaaagtattacatcttattcaagacagttaccaaatttccggtaaagaaattaatatttcagcaagtctaggtatcgcactgttccctgaacatgggcaaaatgttcaagacctgctgatgaatgccgatgctgccatgctgatgtctaaagagcagggccgcaatacttataccgtctttagttattctacccatcaacaagaaacaagaagtcagtcaaaactgatcaatgatttatacaaagcagtcgaagaaaaacaatttgttctctactaccagccaaaatttaataccaatcttgagatttgtggggtagaagcactcattcgctggaaccatccatctttaggtatgctgacaccgcatatgtttattggtggcgcggaaaagacaggtttaattattccaatgggatattgggcgcttgagcaagcttgccaacaaattcaggaatgggaacgtagcaatacgcagttttatccaatcgcagtcaatttatcggccttgcagttcgaaaataaaaagctctttagtactctcgaaggtttgttaaaaaaataccaaattcagcctcatcacctcattattgaaattactgaatcaaccgcaatgcggcatatcgacttaagcattcgtgcttgtgaacgactgcgcgatatgggtattcgggtggcaattgatgactttggaacagggcactcaagcttcttatatttaaaagatttaccagttgatgaacttaaaattgaccgtggttttattgtcgatttaaaaccgggctcaaaagaagaagtcattttagaaagtattattcatttggcgaaaaagttaggtttaaccgtaacagccgaaggggtggaaacacagcaacaagttgagattttaacgcgcttgggctgtcagcagttccaaggttatttgttgggtatgcctgtaaatgtagggcaactgattcagtcgcaaggagctcattttgtttaa

SEQ ID NO: 3830 - DNA, 732 bp, Acinetobacter baumannii
agcgccgtatatcctctatttcaaggtaatgatatgaatatgataaagaacagcactaactcaactaaaaagataccaccgttatattggttgttaactgtagtcatgatggcggtgttaattgcaggcggtattttatttaatcaacatcaaaaacgacaaactgaacttcagttagcacaactcgctttagaacaatctaaggtacaaaatcaatctgccacaacacaagcagcatcggaacccgttgaatcaggtttcaccggaattgaaagtatggtggaaaacccggaatcagaatctactcattcacaagctgaagatgaagtggttgcgggggcaatagccgcagtggatcaggcaaaagcacaagatacaagtctaggcaatctcagttcagaagttgatgctgagtaccatgaaggaaaaaccttaagttcgaacacctctcgctatggcttaaagccaatcaaatctgctccagctgatttaaagtcaaccatcccgaatattgatcaaatgttagcgtcacaccttatgaatgtatggggccgctcaagtccagatcaggtgagtaaacgagttgaaggatggagccagcaaggtaataccatgacctatcgtactgcatgggactctgaccgttaccaatgtacttggtatgtggtgagttgggataagaacagcaatcaagtccttcacgaaggataccagccatgctttggtcactaa

SEQ ID NO: 3831 - DNA, 1389 bp, Acinetobacter baumannii
tctgatgatttttttatcattcatagagttttctatggatgttctgcacgcgcgcgtgtacatctttttagagctagaaatatggacttttataaagaaaaactgtctcgaaaatgggggggattgtcaattgctgtggcttgcttctctttgacctatggtcatgcttatgcccagccactgaccttggatacagctttgaatctcgctgagcaatatgcacctaccctaagagcaaatagcgcccagattgaaggggccgagaatgtagtttcagcttcaggtattttacccaaccctaaattatttgtaggtttagataattaccctgtatccggcgatgccgcatggtcagtcacacgcgaaggtatgactatgcaaaaaattggcgtgatgcaagattttccaaatcgtgccaaaagacaagctgaggtcgatttagcaaaagctgaactaggttcggccaatgctcaaactgagattctgcgtattgagttacgtcagaaagtcgcatctgcttggcttaagcgcttttatcttgaacgtaaattagcactatacgatgaactgttttcagagaatcgattactttctcaaattactcaaacacaggtcatctctggtcgtacaatcattgccgatgcacttgatccaagacaagaagccacggtattgcttgaccagaaggatgatttacttcgtgatttaaataaagccaagttggagttgcatcggttagtcagtgcagaacctactgaaaatctctctcaaattgaaaccttacctgaccaagcaccatctatctaccttgatagatcaaagctatatcatcatttgcatcaacatcctgaattaaaagcatttcaggcagaaaagcaaactgctgaagcaaaactgaagcaagctcaggctttacagaaaccagattggggtattgaacttgcttatcagcatcgagcacccgaatttggcgatatgatcggggtgcaactaacaacagagcttcctgtgttttcaaaaagacgtagtagtccactcattcgggcagctttagccgaacaaaacaggattactgccgatcaagaagtccaataccgtgaccatctcactatgctagatgatgggttatccgatcttgatgcacttgatcagcaaattagacgtgcgatgcaaacaagtattccactcgctaaacaaaaagtgggtttacagttggcaagctatcaagcaggtaaaagtaatttatctaatgttattgctgctcgacaagctcttttagaacagcgtttgcgtctcattgatctccaacagcaacaggctgtgactaaagcccaactttattatgcctttgaagaaccgaccttaaaccatgttgaggggcagccataa

SEQ ID NO: 3832 - DNA, 456 bp, Acinetobacter baumannii
cggcgtttgtacccagaggtatttaaaatggctaagaagattgacggctatatcaagctgcaagttccagctggtaaagcaaatccatctccaccgattggtcctgcactaggtcaacgtggtgtaaacatcatggcattctgtaaagaattcaatgctgctacacaaaaagttgaaccaggtcttccaatccctgtagtgattactgtgtacaacgacaagtcgttcacatttatcatgaaaactcctccagcttctattcttcttaagaaagctgctggtatccaaaagggttcatctgtacctaacaaaactaaagttggtaagttgactcgtgctcaattagaagaaatcgcgactactaaagaaccagacttaactggtgctgacttagacgcgcgtgttcgtaccatcgctggttctgcacgttctatgggcttggaagtggagctataa

SEQ ID NO: 3833 - DNA, 1494 bp, Acinetobacter baumannii
ttggtgtcgtattcggcttcttacctgccaagaatgcagcaaaacttgaccctgttgcagcactatcacgagaataaggaaaattgcatgtctttttctatgactaaacttagcgcagcacttctcctcactagttctcttgtgggatgtgccgctgtagtaaaaacaccttaccaagcaccagctgtacaagttccaggcagttttcagtacgataaggctaaagctaaaacagcatcggttgagcaatattctgaccgttggtggacattgtttggagatgcacagctcaaccaactcgtaactaatgttttagagcgcaatagtgatttggctgttgcgggaatcacactccagcaagcacgcttgcaagctgatttaaccgcgaataaacaaggcttacggaccagctctagtgtttctacagggcattctttcgacttaaattcgggagatgacagtgcgaaaggtttatcaatgagtgctggggtgagctatgaacttgatttgtttggcaagcttgctcgtcaaactgaagcaagtaaatgggaagccttagcaaccgaacaagatcttcaagctactggtcaaagtctgattgccactactgcgaaactctactggcaacttggttatttaaatgaacggtatgcaactgcacagcaaagcttagccacttcacaaaagctttatcagttagttcatactcagtataaagcaggtgcagtttcaggattagaccttacgcaagccgagcagtctgttcaaagccaaaaagcaagtttaagccagattgagcaacagcttgttgaaacgcgtacagccattgctgtgttattgcatgagccagtacagcaactcaatattcaagagccacagcgtttaccacgtacagcgctgcctgctattggtgcgggtttaccagcggatattttgtcacgtcgcccagacttgcaagcagctgagcttcgcttgagaaaagcactagcaactaaagatgcaactaaagcaagctactacccgtcaattagcttaaccagtagtttaggttcaagcagcacatcgttaacggagttattacgtaaccctgcccttacgcttggagcgagtttaagcttaccgtttttgcaatataacgatatgaaaaaagatatcgcgattagcaacctagattatgaaaaagcgattattcaatatcgccaaacgctttatcaggcttttgctgatgtagaaaacgcgttatcaagccgcacagaactcgacaaacaagtagcgttacaagagcgtaatgtcgaacttgcagaaaaaactgaacgtttaactgaagtccgctaccgttatggcgctgttgcgttaaaaacacttcttgatgcacagcaaactacacgtactgcgcgcttgagtcttgttgaaaccaaacaaagccaatacaacgcttatgtcacccttatgcaggcattaggcggttcacctgtaaaagaactgccgcaataa

SEQ ID NO: 3834 - DNA, 462 bp, Acinetobacter baumannii
agtttaaatcttaaaataaaggagccactcatggcaattgaacgtactttgtctatcgtaaagccagatgctgtgtctaaaaaccacatcggtgaaatttttgctcgtttcgaaaaagcgggtttaaaaattgttgcgactaaaatgaaacacctttctcaagctgatgctgaaggtttctatgcagagcacaaagaacgcggtttctttggtgacttagttgcattcatgacttctggtccagttgttgtatctgttcttgaaggtgaaaacgcagttcttgctcaccgtgaaatcttaggtgctacaaaccctaaagaagcggctcctggtactatccgtgctgatttcgctgtaagcatcgatgaaaatgctgctcacggttctgactcagttgcttctgcagagcgtgaaattgcttacttctttgctgacaacgagatctgcccacgcactcgttaa

SEQ ID NO: 3835 - DNA, 270 bp, Acinetobacter baumannii
atctcaaatctagatattaacttttttactttattttcaatgcattattatatttttatgattaagaaagattatcaattcggattattgttttatcttattaaccgaatcgataatctctcttacattttaattaaggctgataataaatatcggcatcgttaccttcaccaccttctttaccatctgcgccaaatgaatatagatcaaaaggatggccgtcttttccaggtacgacatattggatatcatttttccagctgtctttag

SEQ ID NO: 3836 - DNA, 1842 bp, Acinetobacter baumannii
agattgtttcaaatgaacagtaaaaatattgcacttattggtaacccaaattgtgggaaaacatctctctttaatactttaacaggcactcgtcaaaaagtagctaattatgctggtgttactgttgagcggaaagaaggtttctttaaactaccttctggtgaatcagttcgagttttagatttgcccggcacatacagcttaaagcctacgagtctagatgaagaggtaacaagggctgtatgcttaggtgagcttgagggtgaggttctacctgatatatatgtatgtgtggttgatgccactaatttacatttacatttaagtcttgtgcttgaaataagggcattgaatcgaccaatgcttcttgttttaaatatgatggatgaggtcaaaaagcgtggtatttcgatagatattaataagctatcagaattgttgggtatccctgttattgaggctgttgccgttaaaactaaaggcgtgcaagaactactaaatcaattagatcaaaaaaatctatttgtcactccttatcattctgatctgaatcattttgatcagattaaaaatattactaaacaggtaattttaaaaaatgataacggtgatgcaagaacagctttcttggataaaattttcttacatcctgtacttggtttagtcatcctaacgcttaccatgtttgtcatgttccaagccgtttttatctgggcacaaccttttatctcattaattgaaaatgcaattgcttggttaggagatacaattggcccgcttattactcatccattacttagaagtcttattgttgatggggtaatcgctggatcgggtagtgttttggcttatatgccgcagatccttatcttattcttctttattttaattttagaagaatcaggttatttgccacgagcagcattccttttggataaattaatgtccaaagctggtttaagtggacgttcctttattccactattatctagttttgcctgtgctattcctggtgtcatggcaacacgaagcattagttcggaaagagatcgtttagcaaccattatgattgcgccattaatgacttgttctgcaagattacctgtttatgctttgctaattgcggcattcattccaaacaaattagtttatggttggttgagcctacaaggtttagttctttttggactatatatggctggaattgtttcagcattatgtgtttctttatttttgaaactagttagaaaagataaaacagaaagtatttttatctttgagttgcctacttatcgattgccagatattcgaaacgttgcattaggactttatgatcgagctacgatctttctaaaaagagttggtggtattatcgtagcattatctatattgctttgggtgttggttacgttccctcaaccacctgagcatgccacgatgcctgctatcaactatagtttagctggacaacttggacacattattcagcctatatttgcacctattggctttacttgggaaatctgtatcgcattaattcctgctatggctgcaagggaagttgtcattgctgctttaggtgtaatttatgctatgtctggagatgaagatactgtaactcaaacattgttgagtcaaatctctggtcctgatggttgggggctagctacagggatgtcattattagtttggtacattttcgcaccacattgtcttgcaacattagcgaccattcgtcgtgaaactagtagctggaaacagcctgttattatggcgacttacttatttgggcttgcgtatttctttgccttcattacatatcagcttattagtagactttaa

SEQ ID NO: 3837 - DNA, 1380 bp, Acinetobacter baumannii
aagatgactcataaactgtttaatgcgatcagtttccgtattgcactcatcttctcattatctaccattattatcttaatgattatggggctggtcattcatcagcttgttatgcatcattttgaaactcaggaccgcactcagctagaagggaaaattcagcttttagaaaatttactggaacagaatccgaaaaataccgaagaactaaagatatatttaaaagatgctttagttggtcatcatgacctaattgtccagattgaacgtccaactggtcaaatcatttttagttcagcacccgccgttataaagccccagacattagtaaaatctaaacatactccttggatagaatggaaaatccaaagtaaaacataccgcggcttagtttataaaaagtcatttgataaaaatatgagcattccaactgctcagattattgttggaatcgatacatctgaacatcaacattttttaaacgactttagacgacaattgttatatatcggagttgtgggcacaatttgtttaatgtttctaggttggtttgctgcatggaggggcttacgtccagttcaaaaaatggcaaaagttgcagaaggcatttcagctcagcatctatctgaacgattagcagtcgataatacccccactgaactaaaatcattagccatagcctttaacgatatgttagatcggctagaaactgctgtagaaaaactctcagatttctcatctgatctggcccatgaaattagaacaccaattaataatttaatgactcaaactcaagtgtgtttgtctcgtagtcgggatattaatacttatcaagaagtcctcttttctaatctggaagaatttgaacgtttggcccgaatggtttcagatatgttatttcttgcaaaagcagaacatggcctacacttaccaaacctgcaacaggtcaacctggtacaagaaatttctgctttatttgacttctatgatgctatcgctgctgaaaagggaatgtttctagaacagagtggacaaggatacgtaaaaggcgatccgtcaatgttacgtcgtgctctgagtaatttactatcaaatgcgatcaaatatggtaaacctgattcagtaattaagattaactgccaacaaaatattgataccactatatttacaatcgaaaatgaaagctctccaataacacctgagcagctgaatcgattatttgatcgtttttaccgcacggatgcatccagacaaagagttgaggaaggcacaggtttaggtttagccattaccaagtcaattcttgatgtacatggcgcaatgattcaagctgactatagcaacagccgtatagtttttaaaataacttttaaaaattaa

SEQ ID NO: 3838 - DNA, 1278 bp, Acinetobacter baumannii
gcaaattatcaacatacgatatttcaaatgcagaaacatgatgcattcgctgccctgcgctatagagatttctcaattgtcaccattaatcaattttgcttaacattagcaattttgattcaagaaattattgttgcctattcactttatcaaattaccaaagaccctttaactttaggtttaattggactagcagaagccattccatttattgccctatcgctttggggtggttattttgctgataaatttaataaacaggtcatcatgaaaatctgtttatttttctcagtacctcttcctttagttttatggttactgttccatctgcatgggttgggtcatatcagtgtaaatttcctttcttggggcatttatgcggttatttttggtttgggcaccatacgtggtttttacaacccttctgctacatccctaaaaccatttttaattccacgtgagctttatgcaaatggtgcaacatggacaaccattggttggcagagtggtgtaattattgggccaatgctcggtgggttcatgctcgcttatttaggcagagaaaccagtctttttagtgttgccggtctacttagtatctgctttattctcattaatttattacataaacgtagctttcctaaaattgaaactgccaatgttatagaaagcttaggcgatggctttcgctttatttggaaaaccaaaatagttctttgggcgatttctttagaccttgcctctgttttatttggtggtgtaatcgctctactccctatttttgccgaagatattttaaaagtcggtcctgaaggcttgggttacttgcgtgcggctccttctattggtgcactcattactatgattgctttaactcgttttccgccaactcagcacgcatggcgtaatatgctacttgcagttgcagggtttggtgtatttacaatccttttcgcgttctcgaacaacatgtggttatcactatttgcgttggcgatgacgggtgcttgcgacagtatttcggtggtagttagacaaaccattttgcaaatattcccaccagaaaatatgcgtggtcgcgtagcggctgtaaatggaatgtttgtctcatcaagtaatgagctgggtgcatttgaatcaggcttggctgccaaatatttgggaactattgcagcgactatttttggtggttgtatgactcttgcagtagtaaccttctgttggctaaaaaccaatgatctttttaaagtcgatattactaaaagctcagaagattag

SEQ ID NO: 3839 - DNA, 1152 bp, Acinetobacter baumannii
aaaacaaatcatcttaaaagagtaatttcaatgatttatatcgaagtactggcagtagtggtgatttggttaagcttctggtcacttattcctcgtgatgagtggtggtttcgaggtgcagattttccaagattacaaattctgtttattggcttaattgctttaattggtatgttgttttggccgaccgaatgggacgtatggcgtgagcttttgcttgcggtactcattgcagcgattgcctaccaacttaaaatggttttaccgtatacgctgttttggaaaaaacaggttaaaaaggttaaacagcatcagctagatcctaaaaaacagatttcactgatagtttctaatgtgctcaccccgaatgataaatatcatttattacttgagcatgtacggacgttaaaacctgatttattgcttactttagagagcgatacaacttgggaaaatgctttaaaagagatcgagaaagattatccataccgtgtgcccgtaccattagataatttatatggcatgcatttatatagccggttaccgcttaaaaatactgaggttaaattcattttaagtaatgaaataccttctattcataccacggtaattttgcgatctggcatgcctgttcagctctactgtttacatcctaagccacctagcccaactgaagcaaaagattcaacactgcgtgacgctgagcttttaattgtcggagatcaaattaaagatcttgatgaaagttgtattgtgatgggggatttaaacgacgtagcgtggtcacgaacaacccgtttatttcaacgtattagtgggctactcgatccacgagtggggcggcattttattaatacttttcatgcggactatcctttattgcgctggtcacttgaccatatctttcatagtacagacttcggtttagtaaaaatgcagcgtttatctcatattggatcagaccattttcctgtctatgtcgttttacaaacaggtcgaatatttgaagaaattcacgaggaactagaacaaactcaagccgatgaagaagaagctcaagccgcgatacaacgaggtattgctaaagctgaaaaagaagaaaaaatcgtgactgatgaaattgcacagccttataaagagaaaaatatataa

SEQ ID NO: 3840 - DNA, 639 bp, Acinetobacter baumannii
actaggaatcacgataaacaaggagcaataagaatgagtcttaaactttatactaacaatgaatcgcgtggtgtcgttatagactggcttttggttgaacttggtgtggaatgtgaacgtattgaagtagcataccgaaccgagatgaaatcaccagaatatttaaagcttaacccgtttgggaaagtgcctgtattggtagatggcgatgtcgttatttatgaattaggtgcaatttgtgcatatctggcagacaaatttagtgacaaaggtttggcacctgctttagatgatccgaaacgtggtttgtactatcgttggctttttatgatggcgggtccttgggaagctgctggtgtcgataaagctttaggaatagaaatcgcacctgagcaaaaaatgtttgtgggttatggtgattataacgatgcttatcaagctttagttcaaggactgagtgaagcaaatccgtatgtatgtggtgaacaatttaccgctgcagatgtaagtgttggagccatgctattatggcaattaaaaatgaaaacgattgaatcgcacccagctattacacgttatgttgaaacgatcaaacagcgcgaaggcttaaaacaaagcagtatgggccaactgttgtaa

SEQ ID NO: 3841 - DNA, 3636 bp, Acinetobacter baumannii
atgggtatccatgttattcaaagtcaacgtattgatgtgttgttgcagggcgtactggcatctacgtcccagccgtcaacgcatccattacaggttttgaaagcccagcatttcattgtgccaagtcctgccatcgagcagtggctgatacaaaaacttgcagaacagcaaggaatgagcgccaattaccagttccaccaacgtgtgcgcgggtttcagtggtatgcctatcaacaggtcctcacggcgcataaggaacaggttcgtaaagccaatattccacgcttgatttttaaatggcgtgtacatcaagccttacaggaatttattcagcctgatgttatgagcatagatagctctcatccactgcattctattgttcaacgtatttatgacagcgcagatcggcttgaacaaggtattgagaagcagctaaaaaaacaaaaaatgttgtattgggttgccgagcaggttgccgatttatttagtaactacatggtctatcggggacagtgccagcgtggttgtgaaaatacctgtacttgtccaaataactggttagcagcatggggacaagggcgatcactcgatatcgaaaagtatattgcccataaagataaagaaatttctgcttttactttacagcaaacccaagagttagagcgttggcagcgctggttatggcagcagcattttcatgatgattttatgcaaatgcagcaaattgatgagttgttttggcaagagttagagcatcctgagcgccagaagaaagcactgtctcgtttgccggagcaaattgtcatttttactttactggatttaccgcccagccagcttcagtttttacgtcgtttagggcaatacattgatgttttgattttgcactataacccttcgcaagaatattgggccgatagtgtcgacccactctggaaacagcgctatgacttaggggtaaaagagcgttttatagcaaagaacccccaagcgaccgatgcggaaattgccgatttctttaataaatttacgcttaattttaatgctgaggcgcgtgagtcaagacatccactgttaaccagattgggcaaacaagcccgcgaccacttctcattactctcaaacttatctacaggtgaagagggtaagtgggtggatgcttttgtcgatgattttcctgaaagtttacttggcaaagttcagtcagatattttgcacttggtggaaccccaagccaagcaatatgaacttgcccctaacgatgactcaattcagattcatgtctgccactcgacattacggcaacttgaagtattgaaagaacaattgattggctggttggcaaaaccgcacgaacagccgcgtcgtccaaatgatattttggttttagttcctaatttggcagaagtagagcctttaatacgaagtgtttttcctgctacagcgactgagcaaggcgtgcatttgcctgtcaaaatagcaggaattgcctcactcgatgcacttaatgcatggcgtgccgtgattgggcgtattcaccttatgcaaggacgatttagctttgatgagtttgctgactggcttggcttacacgcgactcaacagcgttatgcacttgaatatgctcaagtagagcgaattttaactttacttgctgatgcagggtttaaacgtggacttgatgcagagcatctgaaacgtagtttatgtgacggcgatgatgattatcgatatagctttaaatttgctttagagcggttagcgctcggcatagcaattcccgaacatgctacatttaatcaggtgctgagttacgctaaggttcaaccgggcgattttgagcttattggtacgctcattcagatttatcaagatttaaatgaacgccgtgactggctcattatgcatgagcagaaaaaaagtcatacggtggaatactggctgcaaatactctcgcaagatattgtcgagtttgagcaggccggtgtggctgctttaaaaactgcgcgggaaattgtaaaaaaacaagagcgtatgttaacgctcgcaagctactatgccgagacagaaacaggcaccttacgtaaaatcaccttgcctttgccttatattctggatgagattcagcgaactttagaaaatcaaacggctcaagctgaaccgactggacagattacctttgcccagattggacaaattcgtccgttgccttatcgtttaattgtgatgttgaaccttgatgcagggcagtttccaaatcgagacacccatgtgccatttgatttgatggatgccttacgtcaacaattaggtgatcgttcccgtcttgaggatgaccaaggcgctttcttagatgccctacttttagctcaagaaaacttatggctgttttataacggctttgatgtcaatgacggtgaggtgagagatccttctagtattcttcaagagttccgtgagcatcttgcacttattgtaaagccagaaccaaatgcacccgatcgagaagtgattgaaggtattgaaatcccgactcaattaaaacagctctatcacttacattatttacagccgtttgacccgaaaggttttatggctgagaaccgctatattcgttatcaagatcactggtttaacgtggcgatgcaaattcagcaagcttccggtgttcttaagccttgggcaaatatatcttatcctttagaaatacctgacatgttggttttagacagccatcagtggatacaggatgtgactttccccgcacgtttatatttaaaaactttaggcgtagaaaacttaggaaatgtaagcgtattagatcagaatgaacctttgcttttagatggtttgggccgttataccattcgacattttttacagcaaaacgaacagcaggcacagcctgaagttctacttgatcagttgcctgtaggcaaagttcaatacagtgcatggcaacagggcatttttgaacaggaatgtttgcttgagcgccttcatcattacgcgccagccgtgacacaaacgactcagcgtgtgtggcgaattgccaaacagctacatatgaatattactgtgccaaaatctgaaactcaggattgggtcagcatggaagcatcaagtgctcgggcaaaaagacgtgcaaaagtctggttagagtacctgctttggttggcctatttaaatgaaggaagtgcaggaactgaaagacgccgtattgtggtttttagtgaccaaactgtcatctgtaaaggtattagttcggagcaagctcggcagtatttacaaccgtggtttaaaatctggcgttatgctcaacagcagccgctcgtgttaccagcagctttattattaaaaccacttgaaaaagctaaggcatatcagtgggaaacaacaaatccgacagaaaaaataaaactcgatgagaagagctatgcggagctgttaaaatactggaatgaaacagggtcatttaccgctatcgatatgacacaaaatgaagcgtgcaagttacatcaagattggcgtttcattttgcaagaacaagatgcacaagcattacttcaacatgcttgtgatgagtttgcctatgacctgtatcatccggtttttcaatttcaacattcggagtaa

SEQ ID NO: 3842 - DNA, 486 bp, Acinetobacter baumannii
catcgcatccatattaaggaaaaaacaatgagcgaagaacaacaagttcaaccacaattagctttagagcgtatttatacaaaagatatttcttttgaggttccaggggcacaagttttcactaaacaatggcaacctgaacttaacatcaatctttcttctgctgctgaaaagattgacccaactcactttgaagtatctttaaaagttgtggttcaagccaataacgacaatgaaacagcgttcatcgtagatgtaactcaatctggtattttcttaatcgataatatcgaagaagaccgtttaccttacattttgggtgcatactgcccgaacattttgttcccgttcttacgtgaagcggtaaacgacctagtaacaaaaggtagcttcccacagttacttcttactccaatcaactttgatgcagagttcgaagcaaacatgcaacgtgctcaagctgctgctgttgaaggtcaagcttaa

SEQ ID NO: 3843 - DNA, 186 bp, Acinetobacter baumannii
cttacctgtcttgaacgaatcaagtattacagtaagaacctgaccggatggatgaaaccatcaaaacgccatatcagtgtattacatcagccagcaaaaggttgggtaaatatcacggaccggagggcttttttgggctttcacatgaacgttcggtcatgtcaaatccagaactttatagcttga

SEQ ID NO: 3844 - DNA, 1869 bp, Acinetobacter baumannii
cgactcagccaattggctagatcatggtttaaaactatactagcccaaacgataaaaggcacaatagcatatttgcgcctatggattaaaacactcacggcagcaccggatgatctgacattacggttgccacctttaagtattgaggagtcctacatggaacacatcgaacgtgaatcgatggagtttgacgttgtcatcgtaggtgcaggacctgcaggtctatctgctgcgattaagatccgtcaattagcgattgaaaataacttacccgatctttcagtttgtgtagttgaaaaaggctctgaagtaggtgcgcatatcttatctggtgctgtacttgaaccgcgtgctattaatgaacttttcccgaactggaaagaagaaggtgcgcctcttaatgtacctgtaactgaagacaagacattcttcttgctttcagaaactacttctaaagaagcacctcactggatggttcctaaaaccatgcacaatgacgggaactatgttatctcgctaggtaacgttgttcgctggttaggtcaaaaagctgaagaattagaagtttctatcttccctggctttgctgcatctgaagtgctttaccatgaagacggtactgtaaaaggtattcaaacgggtgacatgggtattggtaaagatggcgagcctacacataactttactccgggttatgaacttcacgctaaatacactctctttgctgaaggctgccgtggccacttaggtaaacgcctaattgcaaaatataatcttgataaagatgcagatccacaacattacgggatcgggattaaagaactttgggaaattgacccagcaaaacataaaccgggtctagtgatgcacggtgctggttggccattgtctgaaactggttcttctggtggttggtggttataccacgctgaaaacaaccaagtgactttgggtatgattgtggacttgtcttatgaaaatccacacatgtacccattcatggaaatgcagcgctggaaaactcacccactcatcaaacagtatttagaaggtggtaaacgtatttcttacggcgcacgtgctgtagtgaaaggcggtttcaactctttacctaaattgactttcccgggtggttgcttaattggtgatgatgcaggtttcttaaactttgcgaaaatcaaaggctcacacactgccatgaaatcaggcatgttatgtggtgaagctgtatttgaagcaattgctgccggagttgaaaaaggtggtgatcttgcggttgctcgtgtaaccgaaggcgaagatttattcgttaaagaattaacttcttacacagacaaatttaacaacagctggttaaaagaagagctttataacgctcgtaactttggccctgcaatgcataagtttgggcaatggattggtggtgcatttaactttattgaccaaaacgtctttaaagtgccattcactttacatgacttgaaacaagacttcgctgtattgaaaactgttgatgcaacgagcttcaagccaacctatccaaaaccagatggcaaactgacatttgaccgtttatcttctgtgtttatctcaaacactgtacacgaagaaaaccagccagctcacttgaagcttactgatccttcaattccagtgaacgtaaacttaccaaaatgggatgagcctgctcagcgctattgtcctgctggtgtttacgaaatcatggaaaatgatgacggctctaaacgcttccagattaacgcagcgaactgtgttcactgtaagacctgtgatattaaagacccatctcaaaatattacttgggtaacacctgagggcggtggtggtccgaattaccctaacatgtaa

SEQ ID NO: 3845 - DNA, 867 bp, Acinetobacter baumannii
aaggacagccatgccatgaagcgtatacttatcgtgacaggacagtctggttcaggaaaatcttcagctcttcaagtattagaagatttgggctactactgtattgataatttacctttggcattgctgcctgaaattgtggcaaagctagatcatgaaaataatcttgagcagcttgctttaggggtggatgtacgaagtactcgggcagatatgcaagagttcgaccatgtttttgagcaattacaaaaacatggtacggttgatgtgatttatctgacgacacaagatcaagatttgattgcacgatttagtgcttcacgtcgtccacatccgttagcaaatcgtttcaaaagccttttacagtgtattcatgaagaaaagcagttgctgattccaattcagtttcgtgccactgttcacattgataccacagataaaagtgttcacgatttaaaacatatcttgctatcaaaactaggacagtcagataatctgattgttatattgcagtcatttggttataaacatggcattcctttagatgccgactatgtttttgacgtacggcatttaccaaatccgcattgggatttagaattacgccgcttttctggtttagacgagccagttaaacaatttttagaagcaagtccacaagcaaatgaaatgtttgaggacattctccacttcttaaaaaaatggctgccggcatttgctgaagggcatcgtcactatatgacgatttcaataggttgcacaggcggccagcatcgttcagtttatatggtagatagactaaaacaagcacttgaggcagaatggtctgttcaggtcttacacagagaaatgaagcactggtcatga

SEQ ID NO: 3846 - DNA, 417 bp, Acinetobacter baumannii
  unsure (70): Identity of nucleotide sequences at the above locations are unknown.
tcaattttacacaccattcaatatccatttggagttattctcatggctttaactaacgaagaaatcttanatgcagttgcggcagacactgttcttgaacttgttgaattaatttctgctttcgaagagaaattcaacgtatctgcagctgctgtagctgttgctgctccagctggtggcgctgctgctgctgctgctgaagaacaatctgaattcaacgttgagttgacttctttcggtgctaacaaagtagctgtaattaaagctgttcgtgaagcaactggtcttggtcttaaagaagctaaagacttagttgaaggcgctcctcaagttcttaaagaaggcgtttctaaagaagaaggcgaagaacttaagaagaaacttgaagaagctggtgctacagttacacttaagtaa

SEQ ID NO: 3847 - DNA, 2841 bp, Acinetobacter baumannii
tatgccctacagagagatcaatctgatgtagctatgtctaatttcaataaaaccttatcgaaacgcttacgtctgaatcatgcatatgggcaattaattgctcttatttttgtgcccattatgattttaacgtgtgttggggcttttctggttttaactgaaacatcacgttctgcaaagcaacaacaattgcatcatgcctcagcgattttggcacgctacaatcaaattgctaaagatctctacacattagtagaactacaaccagacgaatatgatcatgctcaacatattatgcaaagtatgtttagcgagaaaaatctaaagcgtgctgctttaattgatagtaatggtcagacttatttaagtatcggttatcgagataatcgttactggcctaacttcacacaaaaaaataacttttttggtcctatatcttataaccataataatatctatggagtccgtatcattgataccgtagggaagccccctgtctggctcttgattgaaatggacaatcaaccacttgaattagcgcgatatcgcattttgattgctttagtcattactggcctgatgactttattattacttttgctctgtctgaacttttattctcgccgctggattgcacccatgtatgaaatacgtatgcaattacagcgtctcaatgcagacactttagaccaacacatcgtgattaacagttccggtgagttaagattactccagcgcgatatcgcaaacgtggtgaaacgcttacactttagttttttagagttaaaagaacataccgagcaaacagaagaagacttacgcagaactttagatactttagaagttcaaaacattacttaccgtcaagcacgcgaccaagccatttcatctaatcaggcaaaatcggttttccttgccaatatcagtcatgaacttcgtacaccgcttaatagtattgatggctttattcatttattacttcgccaacaaaatttaagtaacgaacagaacctttatttacaaactattcgcaagtcctctgcccatttattagcattaattaatgatgtattagatttctcaaaaattgatgcaggtaaactggaacttgaaacagcaccttttgacttagaagaagctgtatttgatgtcatggatatgttgtcacctttggctgcacaaaagcatattgccatggctttttattatgcagacaacattcctcaacaggtgattggtgatgctttacgctttaagcaaattttgaccaatttgatttccaatgccatcaagttcacgccagatggtgaaattattgttcgtgtgcgtatggaacatgatgacatcggtcagtgcttgcttcattttagtgttcaggacagtggtattggtttaagcggtacagaccgtaaaaaactatttgagtcgttttcgcaaggcgatgcatctgttacccgccaatttggtggtacaggcttaggtctggcaatttctaaacaattggttcatctcatgcatggccaaattggctttgaagataaccaagaacgtgccccaacagaaaaaggttcaacattctggtttactgcacagtttgctgtagatgaagaacatgagattgaacatcctcacttcgaacatttacaagtggtgtcttatttagctcaccctgcaacagccagtgttttgcgctactatcttgaaaattatcaagtaccacatatcgaaactcaatcgattctggacttgtttagccgcttaaaacatctcgaccagaaagacaatacatggctcattgttgaccatagtggtgatactgaagctctactcaaagaaattcgtagccgctatcaaggtaacttagcagtttacggctatcaaatgacgcttgagccaaacatgctcaccgaatatcgcgctcgcccactttatcaaccattaagccgcagtggcctcattcaattattaagtgaccaacctatctttgaagaggaacaacaagactttaatggacagggtttacatattttggcggtcgatgaccatttacctaacttaattgttttagaagcattattaggtgagttaaatgtcaaaactactaaggctttaagtggacaagaagcgctgaatattattcaagaaagaattgatcagaagcttaaaccatttgatttggtatttatggacattcaaatgccggttatgtcgggcattgataccacacgtgcgatccgatctttagaatccactttagatggggaaatgcaacttccaattatcgctctaacagcccacgcgcttgcagatgaaaagcaaaagcttcttaaagttggtatgaatgactatgtcaccaaaccaattcaaatggagcagatcattcaaattttaacgcaatggacgaaaaacaacttcactgcgcaaaatctagctaaagatcatcatgtggttgcagaagcgttagatccagaaattttaaattggcagcaaagtttacaactggcagcaaacaaagaagatttagctcaagatcttctcaaaatgttggtagatagcttcccaaccgagctagaagaaatgcaacaactcattgagcttgaagactttcctcagcttgagcatgtactacaccgtctctatggcgcaacacgctatgtaggcacaccaaaacttcaacaagtgacgggtgactttgaacaatttatttctacgctacgcaaagaacgccgtagagctgacgatggcttcattgaagaagtcatgagacgtttcgatgaattaggtctcgtcattaaagaagttgagagtgcagctcatcaaattttagtcataccagattaa

SEQ ID NO: 3848 - DNA, 1278 bp, Acinetobacter baumannii
tgcatcacacaattaatgccttttgatcaggaagttaggaaaactatttttatatcaggacttgggtatttcaacgtggctacatcagtattagttattaattgcggttcttcatctattaaatacgcactggtttcagagcgtcgtgaagatcgtatttacggtttagcagaaaacttaggggcagctgatgctcgtattaaagggattaccgtcggtggagaaccgctagagctttcaattccttatgctgaccacgccaaagctttagaaactttacttgcacgtcttgcaaactataaacctcaagcaatcggtcaccgtgtcgtacatggtggaagccttaccaaagctgaactactcacccctgaaattgtagaacgtattcgtgcagccactccgcttgcaccgcttcataatcctgctcacttaatcgggattgaagcaacgatgcgcctattccctgaattacctcaagttgccgtatttgacaccgcatttcatcaaactatgcctgcgcatgcataccgttatgcaatccctaagtttttatatacagaacataatgttcgtcgctatggtttccacggtacaagccatgcttatgtgtctgaccgcggcagtgaactggcaggaaaattccaaaaaggcggttggttaacagcacacttgggcaatggtagctcgacttgtgcagtgtggaatggacaaagtgttgatacttctatgggccttactccacttgaaggtgttgtaatgggaacacgtagtggtgatgtcgatccaagcttacacagcttccttgctaaaaatcttggctgggacttagcaaaaattgataaagttttaaataacgaaagtggattactcggcctatcacagctctctaacgatatgcgtacagtgattgaagctgctgaaaatggcaatgaagatgcttgcctcgcgattgaagtatttagctatcgccttgcaaaatcacttgctgccctaagctgtggtttaccaagtattgatggcttgatctttacaggcggtattggtgagaactctgcttatattcgtgaaaaaactctagcttatttacctcatttcggtttacagctcgataaagaccagaacaacaatttaaaacgtggtatagaaggccgtattgatagcggtacaggtccacaaatctgggtgattccaaccgatgaagaaggccgtattgccaaagaaactcgtcaggttgtagaggtttcacaaaatacatctcctgaagttagccttgcttaa

SEQ ID NO: 3849 - DNA, 1029 bp, Acinetobacter baumannii
cggagaacacaaatgcaaattttttacgataaagactgtgacttatcaatcatccaaagcaagaaagttgcgattattggttacggttctcaaggtcatgctcatgcacttaaccttaaagactcaggtgtagacgtaactgtaggtttacgtgctggttcagcttcttggaagaaagctgaaaacgctggtcttaaagttgctgaagtcccagcagcagttaagcaagctgacctcgtaatgattttgactccagatgaattccaatcacaactttaccgtgacgtgattgagccaaacatcaaagaaggcgcgactttagcatttgctcatggtttctctgttctatataaccaagttgttccacgtaaagacttagacgtaatcatggttgcgcctaaagctcctggtcacactgtacgttcagaattccaacgtggttcaggtgttcctgacctaatcgcaattcaccaagacgcttctggtaatgcacgtaacgttgcgctttcttacgcttctggcgtaggtggtggccgtacaggtattatcgaaacttcattccgtgaagaaactgaaactgacttattcggtgagcaagcagttctttgtggtggtgcagttgaacttgtgaaaatgggcttcgaaactttggttgaagctggttatgcaccagaaatggcttacttcgaatgcttacacgaacttaagttaatcgttgacttgatgttcgaaggcggtatcgctgacatgaactactcagtttctaacaacgctgagtacggtgaatacgtaactggtcctgaagtaatcaatgaacagtctcgtgaagcaatgcgtaatgcattaaaacgtattcaatctggtgaatacgcgaagatgttcatccaagaaggtgcgttgaactacccatctatgacagctcgtcgtcgtcaaaatgctgcacacggtattgaacaaactggtgctaaattacgtgcgatgatgccttggattcaagcgaacaagatcgtagacaaagagaaaaactaa

SEQ ID NO: 3850 - DNA, 225 bp, Acinetobacter baumannii
cagattaaacagataggagccgctatgggcttacgttggacagatacgattgatattgccattgaattgtcagaagcacatccagaagttgatccgcaatggattcgttttaccgatttacatgcatgggtttgtgcgttaccagactttagtgatgacccaaataaatcaaccgaaggattgctagaagccatccagatggcttggttggatgaagttcgctaa

SEQ ID NO: 3851 - DNA, 555 bp, Acinetobacter baumannii
gtgaccaaacaatatatgactcaccgttgtctgattgccccgccagaaatggcagatgacttttttgcaaatacagtaatttatcttgcccgtcatgacgaagaaggtgcccaaggtattattatcaatcgccctgccggtatccaaattaaagagttactcaatgatttagacattgatgcagacaatgtaaatccgcatgaggttttacaaggtggtcctttacgccctgaggcgggctttgttcttcatacaggccaaccaacatggcactcttctattgctgtgggtgagaatgtctgtattactaccagtaaagatattctcgatgcgattgcgcataacgaaggtgttggccgctaccaaatcgcccttggttatgcgagttggggtaaaaaccagctagaagatgaaatcgctcgtggtgactggcttatctgtgatgccgacatggatctgatttttaacttgccgtacgatgatcgttgggatgcagcctataaaaaaattggtgtagatcgtacatggctggcttctgaaatcggacacgcttaa

SEQ ID NO: 3852 - DNA, 186 bp, Acinetobacter baumannii
ataaaggaacaaaataaaggtactcagcggagtggcgatcaacgctcacaactaacaaccaaattaaacttaaacaccacaccggaatttgatgtaacagtgttgttttatgagccttatacgcccaaagcgaataaaccacaggaacaaaagccaaagcgacaattggcatttttgggaaaatag

SEQ ID NO: 3853 - DNA, 1101 bp, Acinetobacter baumannii
tttattagacagaccgtattgtctatttttttatctttagataaactttatgttataaaaatgttcaataaagtatgcattatgttaaaaaataaatttatgattttggccatccttccttttatgttgagtgcatgtggaggtggaggggcaagtgatagtaattcagcgaataacaatcaatctagtacatcccaagatactatcgcagatggtacccgttattattttatggattacaatcctgatcaaatagatgagttagatgaaaaaatagatgagctaaatattgcttattttgaaatatttaataagaaatcaacagatagttcttctaatcaagttttaggtgagtatttgctcacagagaagaaactctactcccctactgataaagcgattaatgtgatgaattttaattcattgacagattggagattagacctcattggagatgttaaagaggattggaaatttcaaagagttgatctgtctaataaaaatatgttcgatactgttttgccgggctatcgagcagtaggttttccagtggtagataagagtacggctaaaggacgtttatttcttaatacttacggacaaaataaatttcctgaaggaagtagttgttatcgattaatttcaaaaaaatctaatcaagagacatttgtatttaatgtagatcaaaatcacgaaattaatcaaagttttgaagattttgatgctgaaaatggcccgtatcttaattatttaaatcaaacgaatccatttggctttacttataaagcagttaaaggaacatggcaaaatattccttggactacaatttatgatactagtctaggttttgcggaaaatgacggtgttgcagtgcaatatcaaggcaaaacatatgccgcagattatacaagtaatattggttggacggctgagcaagagattaaacactgggaaatatacttgaaaaatatcgacaaccccgaacgtatgcgggttgctcagttaagaattgcacaattgaagtcaggttgttatagctataatgaaactgctgcaaatgcgcttgctgctttgtctgcattagattggaaaccatattaa

SEQ ID NO: 3854 - DNA, 1482 bp, Acinetobacter baumannii
cgtaggagacagcgtcttttgcaaaccttgcgagcgtcaaaatgtggtttgtccacagcccaacttccttcttcgattttagatgtgatcgatagtctgactaaagcaggctatgaagcttatattgttgggggtggtgtccgtgatttaatgctaggactcaatcctaaagatttcgatgcagtcaccaatgcaacaccttctcaaattaaagaagtttttggccgtcgatgccgaattattggccgtcgatttgaattggcacatgtctattcaggacgtgagctaatcgaagttgccactttccgtgctcctcctaaaaaagcggtgaccagtgcttcgggcatgattttacgtgacaacaactggggaaccatcgaacaggactttgctcgacgcgatttttctatcaatactctgtactaccagccgcgtaagggtattgtgctcgatttctgtaaagcaattgatgatgtcaaaagtaagactttacgtttattgggcgatcctgtgcaacgttttgaagaagatccggtgcgtatgcttcggacattacgttttgcagctaagctcaactttaaaattgatccggcaattctcgacatttttgatgttgagatgacgcaattacttcgtgatgtttcaccacaccgtttatatgatgagtctcaaaagcttttcacaatggggcatttggcacgcgtattaccaatgttgattgactttggcgtgtggaaacagctttttgctgatattcgtccggatctcactccatttattcaacgtgcagcaaaaaatactgatcaacgtattcaggtgggtaaaacgattaatccggcatttttctatgcggttttattgtggcagccatttttagagcgttgtgatttttatttatcaaaaggcgttgttccggccgaagcacgtgctcaagcaggtttggatgttttaaaacgtcaagcaacacgcacagttattcctcgttttgccgaaacttttattcgtgaagtttgggaaatgcaaacccgtttgcttaatccaaaaccacagcaaattgaagcattggcaagccatgctcgtttccgcgctgggtttgacttcttattacttcgtgaaaagtcaggtgatgacacaacacagggaatgggaagctggtgggaagcttaccaagaaatgtcaaacgacgaaaaagaaactgcgattagccaatataatcgtcagaaggcgaaaagtcgtcgtaaggttgctgctgaacctgttgaaagcaataaagttgatacggaaattgagcctttggttgatgttccagagcctcgaagccgtcgtggtaaaaaagagcgtgcacgacaagagcattcctatgaccgtgttattgaaaaatcttccgcagcacaaacgaatgtgatgagtgatcatccaattttaaagcgcaagcgggtacaacgtgatttgagccaagttatttttgggccgacacaatga

SEQ ID NO: 3855 - DNA, 186 bp, Acinetobacter baumannii
gcatatttgcaaaccaccaaacttactatttcatggtctatagatgaaaacgaattacttgtttgcccagcctactcaagcaagacatcatctcgaactcctgatgctgcgcctcgcgcgcgtataaatttttgtctgtattttagatcagaccttttcaaattccctttaatttttctgtattag

SEQ ID NO: 3856 - DNA, 192 bp, Acinetobacter baumannii
atgaacctgcatgacggagtcctgtcaattaggttggcattctgggatgaactttcagttggagttacttttctttcgggaaaagtaaccaaaaccattgtcatacgcaaaacctgttcactttctgcatctatcaaatatattgaagcaatcaatatccttcagcagatgagcaggttgcgtatgacttaa

SEQ ID NO: 3857 - DNA, 1497 bp, Acinetobacter baumannii
attgtgatgcaaatattgaaacaaatacaagttccatatagttttgccaagcgtcatggtgttttatttcgttatgacggtgatcaagtttttattgttagacgtcaaaatacagaaaaaattgcattgcaggaagcaagacgaattttggggaaacctgcacactatcaattatgcactgaacaagaatttaatagtctattaagtaccagttatgcaggggatacaggcgaatctcaacaagtagctgcgggcttagaagaccatccggatttattaagccttgcagatcaggtgcctgaaacagaagacttaatggatcaagaggatgacgcgcctattgttcgtctaatcaatgcacttctctctgaggcaattcgtgttggagcttcagatatccatattgaagcctttgagaaaaagctatcggttcgtttacgggtagatggacaattgcgtgagattgtacaaccgcgccgtgaactagccccgttacttgtttcgcgtattaaagttatggcgaaactcgatattgccgaaaagcgtgtaccgcaagatgggcgtatttctttacgtcttgctggtcgtgaagtcgatgtccgtgtttcaactttgccttcttctcatggtgaaagggtggtcatgcgtttactcgataaacaagcgggccgccttaatatgactcatctaggtttaatggcaaatgactatgaacgtttaactcagttagtacatcgtccgcacggtattattttagtcacagggcctactggttcagggaaaacgacaactttatatgctgccttatctgatctaaatgacaatacccgtaacatcttaaccgccgaagatccaattgaatatcagcttgaaggtatcggccaaactcaagtgaataccaaagtagatatgacttttgctcgagctttaaaagcaatgttacgtcaagatccagatgtggtgatggtgggggagattcgtgatctggaaactgctgaaattgcagttcaagcatctttaacaggtcatttggttttatcgacgctacataccaataccgctattggtgcagtgactcgacttaaagatatggggattgaacctttcctgctttcaagctctttaattggggtggttgcgcagcgtttggttcgtactttatgtccacattgtatgacatggcgtgaagccgatacttttgagaagcaagtttttcagcatatttcccatgaaccaagtttaaagttaccagaggctcaagggtgtgatcagtgttctcatttagggtttaatggccgtacagcgatttatgaaattgtacctattgatgaacctatgcgccgtctcattcatggtaatgcagctgaatttgaattagaaaaccatgctcgtcagtattctggttctattcgcgatgatggtttacgtaaggtgctctcaggtaaaactacacttgaagaagtgcttcgtgtaaccaatgaagcaagtgaagcataa

SEQ ID NO: 3858 - DNA, 507 bp, Acinetobacter baumannii
aggggagcgcatttaatgagacacattatttctgtactcgttgaaaacgaagctggtgcgctttctcgtttggtgggcttattcagtcaacgtaactacaacattgaaacacttaatgttgcaccaaccgaagatccgacattatcgcgtttgacgttaacgacttatggcgatgaccataagatcgaacaaattacgaaacagctcaacaagcttgttgaggtggtaaaagtagttgatttatcagaaggttcacacattgagcgtgaactcatgctaatcaaagtaaaagcattaggtgcttcacgtgctgaaattaaacgcactgcggatattttccgtgcgcaaattgtagacgtgacaccaacgacctataccattcaaatagcagggacaactgaaaaattagatggttttatcgatgcgcttgcagaaaacaccattcttgaagtcgttcgttcaggtgtatcaggtatcgcccgtggcgaaaaagttttagccatttaa

SEQ ID NO: 3859 - DNA, 303 bp, Acinetobacter baumannii
tgtgaaaagcaaatcggaggacaacgcatgaccatcctaccttatgctcttggcattagcttgattgctatcacaatctctatgttgctttgcctttttcgaatggtgatggggccatctattgtcgaccgcctactagcgcttgataccctatttttaaatgcgacctgtctcattattgttttaggcatttattggacaaccacctctttattcgaaggggcgttgttagtcgctatgctagggtttgtttcaacggctgctttagctcgttattttacaaccggtcatgtaatcgattag

SEQ ID NO: 3860 - DNA, 507 bp, Acinetobacter baumannii
tcttgggagcaagttatgaactttctaaaacaatcagcctttattgctgtatttgcttttatgggtttaccaactgttcaagcagaagaagtggctactttacctacaattcgcgttatggccgaatctgagctacgtgaagaagtaggctttgttccatttcaagaagataaaaaagtccgtcaggctctacaacatcgtgagtataaaattcataacgatatacagaatgctttagtccctgaaggtatgacgacagtagactatcaacctgtcatggcacagccagacttgtctcagctttctccttttttacgagaatatattctagctgtagcgggtggaatccaatcttctgacccaaccaatggtctttttgaaatgttaaagccgctcaacattaaccgaactaatgtagatgcttatcgtgaaggtacgatgaaagtaaatttagatgatattttgagattacagcagcaaatacaagatggtttaaaaggccgataa

SEQ ID NO: 3861 - DNA, 1035 bp, Acinetobacter baumannii
actgaaaggcatttacacatgtcgtttgaacaaaaaccgaaagttactgtcattttagcgaatttaggcacaccggatgaggcaactgtcccagcggtgcgccgttttttaaagcagtttttatctgatccacgtgtaattgaaattccaaaattcatttggcggattatcttaaatctgtttgttttgccttttcgcccaaaaagagtagcgcatgcctatgcttcggtatggtctaccgattcgcccatgcgtgaaattgtatttgagcaaactcaacgtgtgcaggcttatttagagcgtgaaaataaacagtttgacttaactgtgttgcccgccatgacttatggtaatccgggtattgatgcagttttagaaaagttagcagctcatccacaagagcatgtcattttattgcctttatttcctcagtattctgccacatcgacagcaccgttatatgacgcatttgctaagtggattcctactcagcgaaatttgccaggcttgaccattattaaagactactaccagcacccaatgtttattcaagcactggcagaaagtgttttagcttatcaagcacagcatggtaagcctgaaaaactattgatgtcttttcatggtattccgcagccttatgcagacaaaggtgatccttatgcagaccgttgtcgcattactgctaagttagtcgctgaagctttgcatttaaaagatgatgaatgggctattagtttccaatcacgttttggaaaacaagaatgggtgaaaccttatactgaccagcttttacaagattgggcgaagcaaggcgttaagtctgttcaggttttaagtcccgctttctctgctgactgtttagaaacacttgaagagctcgctatacaaaacgctgagttgtttcaagaggcaggtggcggaagctatgcttacattcctgctttaaatagcgatcaagctcatattgatttgcttgcaggtttagttcaggctaatcttgatgcccttacccataccttagcccaccgttaa

SEQ ID NO: 3862 - DNA, 630 bp, Acinetobacter baumannii
agaacatttaaaatcgacatcactggaggcaagctaatgcgtattgatcaacaactggcagaaaagtggattaaacccggctctagcgtactcgatttagggtgtggtgacggtgaattactcgctcatatgagccaaaagcatcaaattcgtgcttatggtttagaaattgatcaagaaaagattgcaattgccgtcagtcgcgggttaaatattattcaacaagatttgaatctcggtttgagccgttttgccgaccagtcttttgactatgtggttatggcacaggctttgcaagccgtagatgcacccgatgttttattaagagacatggtgcgtgtgggtaaacaggccattatcacttttccaaactttgcgcattggaagactcgctcttttctagcattaaaaggaatgatgcctgtatcggatgctctaccatatatgtggtataacactcccaacattcatttatgtacgtttaaagatttcgaagcactatgtgcggaaaatcaaatacaaattattaatcgactcgccgtcaatggaaaccagcagggaagcctgttaagcaaacatgttccgaatttgtttggtgaagtcgctatttatcgagtgagtgcactatga

SEQ ID NO: 3863 - DNA, 858 bp, Acinetobacter baumannii
agtctgtttaacaactcggtagaggaattttacgtcttgtttgaaaataatgaatatcagcctcacccccagaattctttaaaatggtggggtgaacagcactttgaaattaaccagtccaaagcatggcaattcggttcaatgctctttcgtttaacacgcggcataaaagaatggcgtatcgaatattatcgcccgactctccaagatgataatgagcaagattggcacatcataacggatgcaaattttggttttccacattctgtgcaagtcgaacgttatatgtttcggaaaactaatccgaactttctactcatgccacgtttggcggaccgatcagtggtaattaaaccagttgatccaatctacattccagcgggtcaacgtgggacactttatattagtacccctctatggattgcaggtttagttgaaagtcagcatgaacctttatttgagattcctgtaattcaacccaaagatacatggtttggtcctaatgcccagcaaggtgaaatttgttatgcaacctctgttgatggtcgtaccgatttaaatctattaaccccacgtgcttttcgtgcagttacgccgatcgattttcataataccagtaatcatcaattacgctttgatcgtatgaatgtaccggttaccgccctaccactattttatagtgaaagtacgggacgcttatggacatcacaaatcaaagtctactatgaaggctctgaccgcccagcccgtattcgtattgaaaaccgcactccccctctggcaggtgaagtgacttatgttcaccccccacgttcaccgggtggtgcgctatttaatatgtttgattcattcttttaa

SEQ ID NO: 3864 - DNA, 465 bp, Acinetobacter baumannii
cctcaacttaagttgaggttggatactcatctaaattttattaaacggttgagttccatgaacaaagaaatttttaaaatcataaatccttctactttatatgacccaacacctaacgcttatagtcatgtcgctgtagtaagcaattttaacaatattattcatattgcaggtcaaggtggcgaagaccaacaaggtcaattaagttctcatttcagcgaacaagtcctacaagcatttgaaaatattaactatgcgttagtagctgccaatgcagaacttacggatatcgccgttttaagaattctagttgttgaccattcggtagaaaaacatgagattttgattaaaattatgaaggatttatggaaaaattatccttttccagcctgcacactcattcctgtgccgcgtcttgcactaaaacatatgctcattgaagtcgaagcaacggcatacacttaa

SEQ ID NO: 3865 - DNA, 1842 bp, Acinetobacter baumannii
atgtcattcctactgcaagcaactatttttcttggagcatctctgattttagtccctttgggcaaacgcctagggattgcaacagttttaggttatttatttacgggcatacttcttggcccgagtgtattaaatattgcccatgaccctgaggccattatggagttggctgaatttggggtcattttacttatgttcctgattggtctagagctccgcccacaacgtttgtgggaaatgcgtgactctatatttgtgatgggaagtttacaagtcgtgattacgggcataattctcatgctcacagtattgctactatttcaacaacacctcgctgccagctttgtgattggttttgcgcttgcgctgtcttctacggcctttgtattacagcttctgactgagaaacaacagctcaatactacctatggtcagcaatcgttttcaattttgcttttccaagacattgcagcaattccattacttgcggtaattcctcttctggcaggaaccgaatctacccatcatggtattgcttattttgcagccatcatcgcgacgtttaccggcttgttcctatttagccgttatgtcatgcgcccatttttccgttttgtcgccaagagtggtgcgactgaactgattacggctgtagggttatttattattcttgccgttgtgttactgatggacactttaggtattagcacaacattaggtgcttttcttaccggagtccttttagccgactcagaattccgtcatgagcttgaagcgagtattgcaccgtttaaagggctcttacttggcttattctttatgaccgtaggtatgacgacacaattgtcgttactgattgaaatgccttggctcattattggtggagcaatcggcctactcgtcatcaaaaccctcgttttaactgccattgcccgctataaaaagtacagttggaacaatagcttgttactcgggacttgcttggctcaaggcggtgaattcgcttttgtaattttgagcctagcaaaaagtgaaaagattttaacggatgccttattagagcctgtcacgttgattgtgaccttatcaatggtccttaccccagtgatttactggattatggcctgtaagatcattcccctttttcataaagaattgccacctgaatatgatgagattcctcagcaagataatccaattatcattgccggttttgggcgctttggacaaattattgcgcgtattgcccgcttacagcacttaggatttactgccatcgataacaaccttcatcaagtggactttgttcgacgttacggcggtaagctctattatggtgatgtcacccagcctgacttactccgctcagcagggattgaaaaagcgaaagtatttattttagcaattgatgatgtcgaagattctatgaatgtcgcacgtcatcttagattgaactatccaaacctaaaattactggctcgtgcccgtgaccgccaccatgtgcacctattaagagacttaggtgttgaacatatttggcgtgaaacctatttatcatcattaggtatggcttatcgtgctttacgcgaactcggtatttccgatgaacaagcttataacaatatcgaaatctttcgggattatgatgagaaattactcatacagcagcaaagtatttataccgatgaacaaaaggtttttgaaacccatcgtaatgctctggcagaacttgaacacctatttgaaagcgatgctcaacaagccatatcgaagcacgacgttaacttaaagcgtcatttacaaccaaatcgtatcgacattacacgagatcacgaagaataa

SEQ ID NO: 3866 - DNA, 201 bp, Acinetobacter baumannii
cactttctccttggaataatgttatctaggcactgcctaaataaaggtcttcaaccagagatatactcattgttgaagcactcattttttatatttagtatgactggcaaccgccagtcacagcatcacaaaaaatctaaagcacctaaaagatactttagatttttaaaccacaattactttcgtaaaactcacaactga

SEQ ID NO: 3867 - DNA, 900 bp, Acinetobacter baumannii
cttaactataagaaaaactttttattgagaatgattatgtcaaaaaaatttgaagactttaataatccaagagaaaaagcattgcaggggatgaaagatagtattcccgcttcacaatgggaagaaaacttacagtttctcaaacaattaaggaataaaattgcgcaattgccagtaagtaaacaccctgcaattgaaatattaaataacggttatcttgataaacaaaccctgactcgtattcatttagaatatcgtcatgccattgttcagatttttaccgatgctttattaaaggcgcagtttatgacaaaacaattggagccaaagcttcactcgggcgctaaaatgtttccacgggtgttgttgagcttaaatatattagatgaatttggttttcgaccgggtttagataaagataattattatttaggcaaccctgaatatgcacattatccattatatgaagatttgctaaatgactatggtttgactgaggctgaccgccgtaattataaaccttcaaaaattgcagatcaggtgagaacatttttagaagcttcttacgatagttatattaatgtggtggcattattggcggtggcagaagaagaagttattctttttagcccaccattgcgacaagcaaccaagtttgtaaatatcgatgttgagggtggtggttattaccatgtacatggcgtttcaacagatgaaacagctgaagcagctgatgatgaccatcaagatgacctttggtttgcgttggctcaagccattaccaaagatgactatgaaagcttgactcaactatgtcttgattattgtgcactgtggactgagttttgggatgcacaaattgctgatgtccaatttattgaagaaaagaaattggcataa

SEQ ID NO: 3868 - DNA, 1767 bp, Acinetobacter baumannii
caaaagtataatttttcatataccaattataaacacattaacataggcaggcagatgtcagcattacatacatctccaaaatttacggggttttttcgacgtttagtcgaagaaaagcatgtgtcggcagcgaccatgcaaactgcattagatgcagcgaaaagagctaagcaggacacagtcgcatatttaattgaagaggttcatctctccccttcgttattggctgaaacaatttctgctgagtttgctgaaccatatttcgatctggatgtttatgacacctctcagattcctaaagatctggtcgatcagaaactgattttaaaacatcgaattttgccgctcattcaaagagggcaaattttatatgttgcgaccagtaatccaagcaatatcgaagcgattgatgcaattcgttttaatagtaaattgctggttgagcctgtaattgtggagcaccataaactcgaaaaagttttaggccagcattttgcagaagaaagcagctttgacttcaatgatgaagagtttgatctcgatgttaatcttgatggtcctaccgctcaagaagatgaagaagaagctcctcaaggcgatgaagccccgattgttaaatatattaataagttattaattgatgccattcgtatgggtgcttcagacttacattttgaaccgtacgaaaaatcctatcgggtgcgctatcgtgtcgatggtgtgttacgtcaaattgccaatccccctctacagcttgcaaaccgcttggcatcacgcttaaaagtaatgtctcaaatggacatttctgaaaaacgcgtcccacaagatggtcgtatcaagctcaagctgtcaaaaagcaaagcgattgattttcgtgtgaactccctcccgactttgtttggtgaaaagttagttctacgtattcttgacccatcaagcgcaatgctaggaattgatgcactaggatatgaagaagatcaaaaagctttgtttatggaggcattagataaacctcaaggcatgcttttaattaccggaccaacaggttctggtaaaaccgtatcgttatatacaggtttaaatattttaaatactgaaagctccaatatttctactgccgaagacccggtagaaattaaccttgaagggattaatcaagttaacgtaaaccccaaggtagggcttacttttgcggccgcacttaaatcatttttacgacaagaccctgacattattatggtgggtgagattcgtgacttggaaacagcagaaattgcgattaaggcggctcaaaccggccacatggtgatgtcaacactacatactaatagtgctccggaaacattgacccgtctacgtaatatgggggttccttcttttaatattgcaacatcagtaaacctagttattgcacagcgtttagcacgtcgtctttgttctcaatgcaaaatacctgctgatattcctaaacaaagcttattagaaatgggctttaccgaacaagatttagcgcacccagattttcgggtttttcagcccgtaggttgctctgaatgtcgtgaaggctataaaggccgtgtcggtatttatgaggtaatgaaagttacacctgaaatttccaagattattatggaagatggcaacgctttagaaatcgcagctgcttctgaaaaattggggtttaataatctacgtcgttcaggtttaaaaaaggtgatgcaaggggtgacctctttacaagaagtcaaccgtgtcaccagtgaataa

SEQ ID NO: 3869 - DNA, 819 bp, Acinetobacter baumannii
agcaataataaacggagtttgtgtatgggtcgtcttgccgttaacttatccatgatttttaccgaagttcctttaattgaacgctttgcattagcccatgcagagggctttgaacatgtagaaattcaattcccatacgagcttgccatttctgatattcaagaccaacttgaacgttacaacctaaatttatgtttaattaacgttcctgctggtgaccttatgcaaggtggaaatggcttagcaggtataccgggtcaagaggctgcatttcgtgaggcattacagttagcgattcgctatgccacagcattaaaagtacctcgtgttaatattttggcaggtaagcaacctcaagactctgacttacttccttgccttaagacacttgcaagcaacttaaaattagcctgtgatttactgacagaacacgatattgaacctgtatttgaaatgattaatggcacagatatgccacgctttttggtacagaacattgctcaagcccaagaaatgctagaagcagtcaatcaccctgccttaaaaatgcaatacgactgttaccatatggcaatgatgggtgaagacgtacttgaagggttacaagaaaatattcaccagattggccatattcagtttgcagattgtccgggacgccatgaacccgatacagctcaaataccgtatgagcaaattttttcatggattaaacaaagtgcttatgagggctatattgcggcagaatataaacctaaaaatggctcaaatcagtcatttacatggaaaaagaaatatttttccgatgatgtaaatatataa

SEQ ID NO: 3870 - DNA, 942 bp, Acinetobacter baumannii
aatatcaataatcaatatgctagcagcttgctggcatattgctatcactggggtgaaaatatgattcctgaagcttggatgtatgcaacgtggctgattaaagtcgttttatatttaggaatagcatttattgttggtggtgcctttagctattttctactgggtcgttatgtagaaatcaagcaagctatcctaaagtacattactattggtgcaggggtaggctttatttcaagtgctttaagcttcttcgttcttataggaagtttttccaatacaggtttttctggaatgtggaatagcaactacattaatatcttaataaatactcctactgggcatgtccatatcatccgttcaattagttttgcacttttactattatttatgatcgtaaagcttggtaaagggactatccagatttctaaagtagaagggacaatttttaccatcctgctcatccccatagtttttagtttttcacaactaggccatgttacaaatttacctttattcgctcaattcttattatcaatacatatactagtaatgtccttatggatgggatcacttttccctctatggagaacaactaaaaaaattacaggtattccattaaaagatcgcatgcacctatttggaagaatcgcagcatttgttgtaggaatactactcgcttgcggtgcgagtattgctctgttactcattaaagatttcaatactctactaaatactccttatgggcatggttttattattaagatcgtatttgttctaagcgttttattattagctgcctttaacaaatggtattttactcctcgcttacaagacccgaaatttgccaaacagttgggttatgctattttatttgaaatgtcattaggcctaatgatccttttaacgactggatatattacaactgtagtgggaattgattaa

SEQ ID NO: 3871 - DNA, 441 bp, Acinetobacter baumannii
gcgatcaataataataggacttatgagaacatgtctcagacatcaccagtttatcaaggaagttgtttatgtcagggtatccgctatgaaattaaaggcgatatcggtgatattattcagtgtcactgccaacgctgtcggaaagccaatggaacagcatttgccacgaatgctcctatcaacagtgcagattttaaaattacgcaaggtgaagaccttgttaaaaaatttgctgtgaatggtgtgtaccgttggttttgtagcgaatgtggttcaccgcttattagctcgcgtgatgcccagcctgaactgtatcgtttaagaattgggacactagatacaccattagatcaaaagccgacaatgcatatttttgctgcttcaaaagcagagtgggaaagcatttgtgacgatttaccgcaatacgatgaacgtccatga

SEQ ID NO: 3872 - DNA, 183 bp, Acinetobacter baumannii
atacgcaataatgaacgcttaccttgtggaaggaattcaattccccaaaggtcgacaccacatgcctccactgctggagcaatcatgtcatacaatgcttgggatttatttgataatttcatttactctcgtcattctcgtgcgattcaatcggttgttttaaccgacacagacttactatag

SEQ ID NO: 3873 - DNA, 186 bp, Acinetobacter baumannii
tttccaaataactctttcaattgctgtatagacatatacttcctccatgtttcaacatggtggcaaagcacccttgcactttgcatctctcgtcttatttatataggcgcactggaattaaatttcaagcgctcagatagtttaattttagaactcgaccatttcgttacgaaaaccatcaattaa

SEQ ID NO: 3874 - DNA, 447 bp, Acinetobacter baumannii
tttaggaataaaaagatgtcattagaaaaagttgtgtatcgtgcaaaagccaaagcaacaggtggccgtgatggtcgtgcaacttcatcagacggtgtattagacgtacaacttggtgtacctaaagaaatgggcggcgctggtggtgctgtaactaacccagaacaattatttgcagctggttattcagcatgctttttaggtgctttaaaatttgttgcaaatcgcgataaattcaatattagcaaagatgcgtatgttgaaggtgaagtcggtattggtccaattccaacaggttttagtattgaagttactttaaatgtttatttaatcggtatggaccgtgaagaagctgaaaagttagttgcagcagctcatatcgtttgtccatattcaaatgcaactcgtaacaatattgatgtgacatttaatattgtgactgaataa

SEQ ID NO: 3875 - DNA, 726 bp, Acinetobacter baumannii
ccaaacagtaaaaatatatttaagataacagcaaggagagttaacaagatggttggactatttcagcatttaggacgtagtgtacaaaaccgccctcacttctttattgctttaatttttggagtggttgttgcaagtttattggcatggctcacttcatggaaatggtctaccattttattagcaagctggaatggctcaatcagtttatatttactccatgtctggaaactgatgagaagtgccgaccattcacaaatgcaacagcaagccaaaaaacaggacgaaagtaaatgggtcattatgctcattgttttattggccatcacaatgagtctagttgcaattttggtacaactttcccagctcccttctgggcattatgaaaagttaggacatgtagcgttagctttactcaccattatttcagcatggcttttcatgcataccgttttcgctttgcattatgcccatgacttttatatggctctatccagaaatgaagagaatggtggattagacttcccgggtaccgaacatccgacctaccctgacttcttatattttagctatattattggcacctcagcacaaaccgccgatgtttcaattaccaacaaacatatgcgtcttttaaacttatttcatgctgtattatcttttggcttcaacacgaccattttagcgatttgtattaacgttgctgctggctttcttaccaactaa

SEQ ID NO: 3876 - DNA, 993 bp, Acinetobacter baumannii
gaggacagtaacatgactaagtacgcatcagatgctttaattgcagctacacattcgtcatgcagcattcaacctatttgggcttacgatctgattggttctgagaagtcagcaaaagctcttgggggatcaaaaactacgagcatgtttgcaaaacaaaagtctcaaaatagtaatcaggcattatctctcagtaaacctgttgagttgattaggtcagtatatccattagtgacaggctcccctgtcactaatgggatgttatctgttcggctaaagccagagaatgaattgtttattcagtttattaaacagatagggcctatgctcaatggtgggatttactgtaacgatcagtacttttcgtatcaaattatgggctatcaatatacgctcatcacgagacagttcaatgagaagttaatggcgtggaatgcagagcaagttcgcactgaagagttatttgatttaacaatgaaggctctatacaagaactatgcaggcttcgagatacatgagctatatctgccaatactatttacgctttcgacgaatgcaacaacgtattctaaacagcaatatttagatcagcagaagaaagagatgattgcccttttcattaatgaaggcggtaataatgatgttgttgcggtattttcaaaatgggaacttacgccccaaggacaattagcactcagactagtgttcttactagaacgtcagtttataaatgatcctgttggttggtctgatgagaatgctttcacagccttacatggtaatttggagagcctttttaattgcaaagcatatcctgtatctatgccattaaatgggtttatgcaaaccaatcgttttttaaaaaacgatccaaagtgtaaagaccttattaagttgctcaaaacgtatctggttggcaccgatacaatccttcgaatctgggatacacagtccagttttgatgtgttgttttccaagtttacaaccaactag

SEQ ID NO: 3877 - DNA, 435 bp, Acinetobacter baumannii
atagtgagtaattgtcaggaaaatataccctatatgaatttagaaccatcgcccagcgtgtctaattctcacgatttcgcaatgaacacctcaaataaagacgtacaagcttgtcttaaagtcgtccatgacgctttagttgatgtaaaagcaaaagatattctacagttagatgttagttctattagcaatgttgctgatgctattgtcatcgcgagtggtacttctactcgtcacgtcaaagcacttgctgacaatgttgcagaagaagctcgaaaagctggtttccgcccgattggcgttgaaggcgaacgagatgccgaatggatcttaatcgatcttggctttgttgtagtacatgtgatgctaccaactgcccgcaaattctatgatttagaaagcttatggcgtactgctccagagtcggtcgcataa

SEQ ID NO: 3878 - DNA, 243 bp, Acinetobacter baumannii
ccattaggtaaatttaaggatgattcagtgtttcggttaaagtgtcttggtggtccactgtatggacaagaatattctcatgctcaggatgagtttatttttaaagacaaacagacaggaaagcagacgcgttatcgaaagcaggctttaaacttcaccccaccccaagagttctttatagcagagtcaatttctacaaccgtagcctacaatcttgcattgcaattaatgaaacgctattga

SEQ ID NO: 3879 - DNA, 1080 bp, Acinetobacter baumannii
aaaaaactcaacctcacgaagttgagattttattcattatatttgcatgatgatgcctgtaaaaatagacaaaatctgtcatcatgcagaacttattccgtttcacttgagtttgagtctaggagagacaatatgtctaacgaaaaccaaaagccaacatctccaactgagcaggcacaaagttcagacaaagttagcccattcctaagctcacctttaccgcaaggtacacctcaagggcaacaacaatctttacagcaaaccttaacagatacacctgttagcggttctgtaccgaaatacaatttaccacgtggtgcaggcaacactggcaacgttggtgaaacaacacactttggttattcaacagttcgaactgaagataaagcacaaaaagttgctgaagttttccactcagttgcaagcaaatatgaccttatgaatgacttgatgtcatttggtattcaccgtttatggaaacgctttgcaattaacatgtctggtgttcgccgtggtcaacatgtgttagacattgcgggtggtacaggcgacttagcaaaagtatttagccgtgaagttggtccacaaggtcatgtggtactttcagacattaacgaatctatgctcaatgtaggtcgtgaccgtctaattgatgcaggctgcaccaatgtcgattttgtacttgccaatgctgaaactttagaaccatttgcagacaacagctttgaccttgttaccattagctttggcttacgcaacgtgacagataaagacgcagcgcttgcttctatgttccgtgtgcttaagccaggtggtcgtttacttgttcttgagttttctaaaccagtatttgagccattctcaaaactttatgacctctactcattcactgctttaccgattatgggtaaattggttgcgaatgactcagaaagttataagtacttggctgaatcaattcgtatgcacccagaccaacgtaccttaaaaggtatgatggaaaatgctggcttccagaactgtgactatcacaacctgactggcggtattgttgctgttcaccgcggtttcaaactgtaa

SEQ ID NO: 3880 - DNA, 2223 bp, Acinetobacter baumannii
aatcgactcaacaaatatacacacaaaagttacggatttattatgaccactgcttctaaccacccaacacgtcgcgatattttaaaatggtttacggggatcccttttcttccattaggtgcgatggctacggcagcaacgttagcaggttgtaacgatagcgataacgactcatctattgtcactccgtcaaagccaattaactttaagaatgcaacgttcacttcaatgccagctccttcaacggtagcagatattgccacaacagcatgtgcatcaaaacttgctatttcatgggaagacggcagcaaaacagaataccaactcgcttacaaaccattcttcttaacaggtacagaagtgcctgatggtaaaggaggaaaagtcatcgcgggtggttattacgatattaataataagccaattattgataaatcagttgcaggtaaagaacgtcaattcttctctgactgcccagatggtagttctctcattagtttcaaacaagcaacaggcaaagatttcacagatgctgacaaaaaagcattaggtgtaaccggtaacccagtgttccatgtggtccaatttgaatatctatcaaaagaccaaaatggtggtgatacttacggtaaattatcatctccgattgctgtcttaactttagatcaagatccaaagacaggtcacttaactttaattaaataccataacgttgatacttcaagtgcacatggactatggattacttgtggtgcaagtttatctccatggggaactcatctttctagtgaagaatacgaaccagatgcttttgaccaaaaattaggtcaatcactttcaacacttaaagccttcagtaaaaatatatatggcgatgaaaacattgccaatccatataactatggccacttgccagaaattaccgtaaatgcagatggtactggtcgcgttacaaagcactattgtttaggtcgtatttcacacgaacttgtacaggttttccctgataaccgcactgtgttaatgggcgatgactataccaacggcggcctatttatgttcgttgcagataaggagaaagatttatctgcaggtacactctacgttgcaaaatatacaacagtacttagtgatacaacgactggtcagatttcttggatcagacttggtcatgcaacaagtgccgagattgaaaacctcatcaagagcggcattaaaggaactgatatttttgagtcagttctacaaattgctaaatatccaagcgatgcaacaacagcagagaaagaggctattgatgcgggcgacaaaggtactcctgaacaacaagctttagccaaagctgcaaaagagcgtttaaaactacaacaagctgcccaaaaagcagaattagaagctcaaggttttaaatttacttatttaagtaaaactggtgtatatctcaagcttaaagataatagcgacagaactaaacttgcagcggctttccttgaaacacaccgttatgctgcttacatgggcgcttcaatggcattgaccaaaaatgaaggcacaacagtaaatattgcagataaaaaagcttattcggctttagctaatattgtcgattcaatggttgaaggtggtagcggttatcttgctgagcacaacgttaaattcccgaaaatcactgctggtggtattttggagcacacattaactggtggtcagaaagacagctcaaatgttgcaatcaatagtgagtgggtacctagccaatctaaccttctcattaaaggtaaagatattagctttgacagcttagggaacactgctgacccagagcaaattgctagccctgataacttgaagttctcagaaaaacttcgcactttatttatcggtgaagactctggtaaccacttaaataacttcttatgggcttataacgttgataccaaacagctcatccgtattttatctacaccggcaggtgctgaatcgacgggtctacatgcagtcgacgaggtaaacggttggacttacatcatgagtaacttccaacatccaggtgacgaatggaaccgtttctacaaagaaaaagatggtgttcgtactggtattagcgcagatttactcgctcaaattgatactgcaattaatacaaattacagtaataaatttgcagcagcagttggctatatcactgccgacccaattgcaccatctgttgtgaagaaatga

SEQ ID NO: 3881 - DNA, 417 bp, Acinetobacter baumannii
gggaaggtcaaaatgcaaattacaatggaaattattgtttcgatctttctggttttcggtgctttttttatgttagtcggatctatcggtatggtacgtctacccgatttattcatgcgactacatgcacctaccaagtcgagtacattaggcttaggtagctttttaattgcttcaatgatcttttttgcttttcaaggccgatttggctttgccgagttacttattacactgttggcttttattactgcacctgtatcagccaacttaattgctcaagccgcgctacatttacgtttacgctcgttgagtggtgaagttcctgaggcaattgaacgccccctcccttgggatcggtataaaattgggcaacgtttttcacaaaacaaaccacccatggaacctcctcaggaataa

SEQ ID NO: 3882 - DNA, 198 bp, Acinetobacter baumannii
gcatcgcccaatgaaactgattcagctcatcaagtacgagaaatgctttcatttaatctctcccattcattgaataaagtgctttttatttattatgcaaagcttttatttaaatatatagcttattttctcttatattttaactttcttgtaactattaaatatgggaataattcttattttaaatctcaaatctag

SEQ ID NO: 3883 - DNA, 381 bp, Acinetobacter baumannii
ttaaagcccaaaggagtgagtacggtcatgaataaaaaaattggtttaatatctactgtcatattatcaacagttatgttcaccggctgtcaaaatatgagtccgtctgaccagcgtattggtgcagcagcaggtggtgcattgggcggtggtcttggtaaccatgttggtggtggtatcggtgcaggcttaggtgctgcggtaggtgcaggtgtgggttctaatactcaaggtggcagtaaacaaactacaaccaagagtgcgattggtgcaggtattggttcggtcgttggtaaagcaatcataggtggtgatacaggtgctgcaattggtggcgcaatcggcggcggtgctggtgctgcgattgaagaaaagaaataa

SEQ ID NO: 3884 - DNA, 1215 bp, Acinetobacter baumannii
aattgctgttttgattctgtaacgcttgcagttgtgagcacttttgatacactcaactccccctttaacaattttaacgcaccgaggcaaaatgacatgaaagtaggtctggtcggttggcgcgggatggtcggttccgtccttatgcaacgtatggttgaagagaatgattttgctcatattgagccattctacttctctaccagtaatgcaggtggtgaagctccttcatttggtggtaagactgccccagcacttatggaagctacagacattaccagtctgaagcaaatggatgtcattattacctgtcaaggtggtgactacacgtctgaagttttcccaaagttaaaagcaactggttgggatggctactggattgatgcggcatctactttacgtatgactgatgatgcaatcatcgttcttgatccggttaaccttaatgtaattaaagacggcttagcgaaaggtactaaaactttcgttggtggtaactgtacagtatcactcatgttgatgggtgttggcgcacttttccaaaataatttggttgagtggatgactgcgatgacttatcaagcggcatcaggcgctggcgcacaaaacatgcgtgagttgttaacaggtatgggttatttatataacaataccaagactttgttagatgatcctaaatctgcaattcttgatattgaccgtcaagttgccgagttacaacgcggtgagggtttcccttctgcgaactttggtgtgccacttgctggttcattaattccttatattgataaacagcttgaaagcggtcaatcaaaagaagagtggaaaggacaagttgagaccaacaagatcttaggtaactctcaaatcgttcctatcgatggtcactgtgttcgtatcggtgcaatgcgttgccactctcaagcattaaccatcaaattgaaaaaagatgttccgcttgatgagatcgaagatatgattcgtaactcaaaccagtgggctaaagttgtaccaaatacacgtgaagcatcaatgactgatcttacacctgttgctgtaactggtaccctaactgtacctgtaggtcgtttacgtaaactcaatatgggtaaagagtacctcggcgcattcacagtaggcgatcagttactttggggtgctgctgagcctctacgtcgtatgttacgtattttagtagaatacaaaagctcataa

SEQ ID NO: 3885 - DNA, 288 bp, Acinetobacter baumannii
aagcaaaccaaaagcttaaggagaattgttatggcagcaaatgtcattgtttactcaacttctgtatgcccgtactgcgttcgcgcgaaacaattacttgagcgtaaaggtgttgcttacaaagaagtaaatctttctgttgaagcgccagaagtacgtgctgaattaatgcaacgtacaaatcatcgtactgttccacaaatttttattaatgatcagtttatcggtggttttgaccaactttatgctttagagcgtgaaggtaaactcgacgaattattggcttaa

SEQ ID NO: 3886 - DNA, 225 bp, Acinetobacter baumannii
gctatggccaataaagaggaactcattgagttcgaaggcgttgtcaccgaaacgcttcctaatacgatgttccgtgtacgtcttgaaaacggtcacgaagttattgcacacatttctggtaaaatgcgtaaacactatattcgtattcttactggcgacagtgtgaaagtcgaaatgactccatatgacttaaccaaaggtcgtattacgtaccgtgctcgctaa

SEQ ID NO: 3887 - DNA, 879 bp, Acinetobacter baumannii
agatcacacaaaaacaataaatcgagttcaggacgaatgacacaacacctttcaaaacaccgccacatctcttttacagcccactatacgggttatatctggtatcaaatggggatctcacatgaagcacttgccactagcaaaggaaaatcactggcatatttagttcacccattagaatcttgggcagagaaatatgtgggcggcagtatgcgcacaacgcttaaacagcgccataccatgcttgatcatgatttagagaagttaattcaagaaaattctgatttacaagttcttgaaatcgcttgtggtttatcaccacgtggctggtggtttaggcagcattatccttccattagctatcgagagcttgatttacccgatatggcacaaaccaaacaaaatgcattacaacaaattgaaaaaaatgcacctgaggttttatcagtcgatttatttaccgaagcctttgctcaagcatttgaagtgtttgactctaaccgcccactagttgtaatcagtgaaggtttaatcaactattttgataaagacttattaaagcaactgatccaatccattgcccactatggtgcttcctttaaaaagcttcattatttaaccgacctgtatcctgaacccgttaaaaacaaacttgcaagtattatctggaacagtagtaaattacttaaacttatgtctcgaagctcatttagttttcattttaagactccactagaagtgaaagacttttttaaagatgcaggctttagtcaagttaacgttgaacaacctcaaatattctttggacaagtttctaaagacaacgatgaagagcatttaggtgacttagtctggactatccatgttcaattaaagtaa

SEQ ID NO: 3888 - DNA, 2091 bp, Acinetobacter baumannii
ataacgaacaaaagagcacttagggtgctcttttttgtttttagtgagcgaaggtccatctcatggcatgggtctgttaaactaagccttggtgttttagcgatatgtgttatgagtcttgcaaagttaattaatgaattaaatgctcagcaaaaaaaagcagcgacgactacggctcaaaactgtctggttttggctggagcgggttgcggcaagacaaaaactattgttgctcgcgcagcttatttaattgatcaaggtttgcctgcaaatcaaattcagattttaacgttcacccgccgagctgcgagtgaaattgttgcaagggttgaacagcatgttggggcacaagccaaaggtcttcgtgcatccacttttcacaccttttgcatgtatttattgcgtcgtaatccgcaagcgtttggtttaacccaatttagtattattgatcgtgatgatcagttactcatgtttcgcttattgagaggcaaagacaaagataatgttttgcctaaagcggcagagctgtgtgatttatattcttatgcccgaaatacgcaatctaagctttctgaagcgttactcaagcaattacctgaagcatatgaatataaatcacaaattgctgagttaatgaaaacctatgaacagcgtaaaagagagcgtaattttttagactatgatgacattttgtcgatcgtcgctgttcatttacaaaactcagaagtattgacgaactgggttgctggtttctgccaagctttgttggttgatgagatgcaagataccaaccctttacagtgggcacttttgcagccactgattggtaaggtgaaattattttgtgtgggagatgacgcccaatcgatttacggtttccgtggggccgattttgaaaacattcattcttttaaagaacgtattccagatgcagtgattcataccttggatctgaattatcgctcgactcaagaaatattagatttatcaaattggttactcgctcacagtccaatcgattaccaaaaacagttacaggcacatcgtggcaaaggacaaaagccacaactccatttgtttggtaatgaatttgaagaagccaactggattgcacaagacttaatagagcgacaccaacagggtgcaaattggtacgaccatatggtgttagttcgctcaggctatagcgcacgctatttggaaggagcatttattgccgctgaaattccgtatcgttttattggtggcgtaaagttacttgaatcagcgcatgtaaaggatgtgctcagtttattgcgtattgtgagtaacccacaggatgacttggcttggatgcgctttttaaccttatgggatggtattggagatgtgggtgccagcaagttagcgcaagagttaatgagcattagtgaggtcgaagagcgttgtcatcgtttggagcgtcatggaaaagttcctttacaggctattttgattttgaaacagcttgatgtgttacagcagcatgttgaggcaagcattggtctagcacttgatgcattaagtgaacagttagagcaaaactataaaactaaagactggtcacgtcgtgctagggattttgatttagtcaaacaacttgcgcgtaaacatgcatctcttggtgagtttcttgaagaatatgtgcttgaaccaatttcaatttctgaaattgaaaaagcgggtgatgatgatttagtgaccttaattacaattcactccgctaaaggtgcagaacagaaagtgtgttatgtgccacatgtctcaccaaaccaatatccctatgcgcgtgcacagggcgattttgatgaagtcgaagaagagcgcagagtattgtatgttgcattaacacgtgcggaaaatgaattgattttgacgaagcaaaatctcaatacatggtcacaagacacgtatgacgaacaaggccgcaaaatcgaaagctattttctaaatgatttacctgcccatttggttcaggtcaaaattcatcgtcaggtgccacagccatttgccaaaaagcaatggaatacttcacgaacagtaaacttaggttttggtatcgatcttgactaa

SEQ ID NO: 3889 - DNA, 939 bp, Acinetobacter baumannii
agatgcttaaatgcgggtaactgtatgattaagtggatcatattagcgatttttgtgatatctgcattgtatatccaacatcgcggcaaagtgcgtcactcgttttatcgtcaattttttgaccattcaaccttgctcgcaccgattaactttttaatgtacatcttttcaaaggtaccgaatcaaccctatatcgacactcaacactttaaagatttaaaagtgttagatgaaaattgggaaatgattcgagatgaagcgaaagctttatatgatcaaggtgggattaaagcatcaagtacctataacgacttaggttttaactcgttctttaaaacagggtggaaacgtttttacctcaagtggtatgaatcaagccatccttctgctgctgagctttgcccaaaaacaacggctttactcaaaacattaccaacgattaaagcggcaatgtttacagagcttgctcctgacagccgtttggtcagacaccgtgatccatatgcggggtcactccgttatcatttgggcttgattactccgaatgatgaccgttgtttcattgacgtagatggtgaaagatactcttggcgtgatggtcaaagtgtcgtgtttgacgaaacttatattcactatgctgaaaataagactgatcaaaaccgtatcatcttctttgccgatgttgaacgtccaatgaaagtaaaatggatggaacgtttcaaccattggtttggtcgtaatgtgatgactgcggcaagttcaccgaatgaaactggtgaccaaacagggggcttaaataaagcctttggttatgtttaccaaattcgtattaaagctaaagctttaaaagctaaaaaccgtaaattgtattacttcttgaagtggttcctcatgcttggaattttcttcctgatttttgttcgaccatacgtgttttaa

SEQ ID NO: 3890 - DNA, 420 bp, Acinetobacter baumannii
aaaagcttaaattttggtcttatctttatgcagtggttaaagacatgcttatcgctgtttttatcgtttgctatcctattagtaggatcggctgctgctgcttcgtctgtacataagcgatgtttaatgccatctgaacagatatccatgcaaatggaaatgtcttcaaatcagggcatgatgcatactgactgtatgaaaaccgaggtgaagataaaaaaagatatacatgatccatcatgtatgtctgagcaagattgtattatgtcttttgccaagattgcttatgccaacattgctcaagatatttcgcactcaattgtgttctctccaatagaacgatctattttttattctccagatcaagaccttccttctccatacccttctggtttatggaaacccccacgctctaactaa

SEQ ID NO: 3891 - DNA, 387 bp, Acinetobacter baumannii
gcacaattaaactacattcatcataatttatataaatgcggcattatctggagagtgtgcatgagttcaacccaatttgatcatgtaacggtcatcaaaaaatcaaatgtttattttggtggagcatgtatcagccataccgtgcaatttgaagatggaacgaaaaaaacattaggtgttattttgccgactgaacagcctttaacatttgaaacccatgttcctgagcgtatggaaattatttcaggtgaatgtcgcgttaaaattgcagacagcaatgaaagtgaattgttccgcgctggtcaatctttttatgtaccaggcaatagcgttttcaaaatcgagactgatgaggtactcgattatgtttgccacttagaaggctaa

SEQ ID NO: 3892 - DNA, 2394 bp, Acinetobacter baumannii
ggttttataaagatgaagattagcgaaaattggttacgcacatgggttaacccagcaattgatagcgatacattatctgatcagttgactatgcttggtcttgaagtagatgagctggcacctgttgctaagccatttactggcgttgtagttggtgaagttctaacagttgaacagcaccctgatgcagaccgtctgcgtgtaacaacagtgaatattgattcaggtgagcctttacaaattgtatgtggtgcccctaacgttcgtgctggaatgaaagcacctgtggcaactattggtgcaatattaccaggtgattttaaaatcaaaaaaggtaagcttcgtggtgttgagtcacaaggcatgctgtgcggtgcctctgaaattgaccttgaagataaaatcgatggtttacttgagttacctgatgatgctccagtaggggtaaacattcgtgaatacttaaaacttgatgataatgtcatcgatattagtattacaccaaaccgtggtgactgctttagtattcgtggtatcgcacgtgaagttgcagtgattaaccaactgcaaatgaatgagcctgaaatcaaatcagttgatgcgacaattactgatgagaaaaaagtagtcatcaacacggatggtgctccacgctacttaggacgtgtcattaaaaatgtaaatgttaaagcttcgaccccagagtggatggaacaagctttagcacgttcaggaattcgtactcatagtattttagttgatgtaacgaattacgtcctcatggaattgggtcagccaatgcatgctttcgatttagctaaaatcgaaggaactgtacacgttcgccaagctaagccacaagaaaagttacagcttttgaatgatcaagaagttgagttgcaagaagatgtgatggttattgctgatgaccagaaagcactagcaatcgctggtatcatgggtggtctagcatcaagcgtaactgatgatacgactgatatcttcttggaaagtgcattttttgctccgcttgcgattgctggacgtgctcgccgctttggcttacatacagattcttcacaacgttatgaacgcggtgtagattttgaattgccgttaattgcgatgaaccgtgcttctcagcttattcaagagttggcgggtggtgagttcggcccaattactgtagctgaaaaatctgatttacttccgaaacgtgaagcgattgaacttaagcaagctcaagtagaccagttgttgggttaccaagtagcggcagagttcattacagatgcattaactcgattaggttgtgaagtcactgttaaagcggatggtgaatggagcgtagttccaccatcacatcgctacgatatggcaatttatcaagatttgattgaagaagttgcacgtattgatggttatgacaatattcagatcagcttaccaagtatggatgttcaacttgctaagtaccaagatcgttttgaaatcgcgcagttacgtcaaacggtagtcactttagggtatcaagaagcgattagctttagctttgctgatgcaaaacttgaaaagcaattgaacccgcaagtaagtccgttaatgttggcaaatccaatctctagtgatttggctgcaatgcgcagcacattgctttcgagtttaatcccttgtgtacaatataatttaaaccgtcagcaaagccgtgtacgtttctttgaactaggtttgcgttttgattatcaaaatgctaattctattcaggatctgaagcaaattcctacattggctttagttgccgtaggttctcgtgaacctgaatcatggcatgctaagccacagccaatggatttcttcgattttaaaggtgaagtagaagagattttagctgctggacgtgtcaaagttgagtatgtacgttcagagcgtccatggttgcatccagggcaatctgctgaaatcttagttgatggacaatcaattggttacttgggccgcttgcatccatctttagaaaacgaactagatttgagcacaacttgggttgccgagcttgatcaggctgctgttttgcaatcttatgtatctaattttacagaattatcacgttttccttcggttagacgtgatattgcgcttttaatctctgataatataaatgttagagatattcagcagttaatcgaaaaaactggtggagagcttttagactctacttggttattcgatgtgtatacggggcagggtgtcgaagaaggtaaacgctcattagcgtttgcgttattatggcaacatccttcacgtacgcttgaagatgctgaaattaaatctggtatggacaatataatccaagtgttggaaaacacttatcaagcgacattgagggcctcatga

SEQ ID NO: 3893 - DNA, 222 bp, Acinetobacter baumannii
accagaataaatagggtactgccaaatcaaatacagccaataaccaatcacaatggtgaaataaaggccaatcaatggatgtttcattgtaaattcctcatttttttaggtaagcctatccaacccactgctctatggcagcaggtgagatcaaaagacaaactaagatttaatgtgaatacgagttctaaagtttatgtgcacattgctgaccagacttaa

SEQ ID NO: 3894 - DNA, 474 bp, Acinetobacter baumannii
atattgataaaaatgatgaaattctctagtcaacttttcctgatcttacccttagctatgggaatcggtgttgccatggcttttcagactgcaattaatgctcagcttcgtgagcaattacactcacctttgcaagcagcattgttatcatttttcataggtactatcgtcttagccattatggtgttcttccaaagtgccgagaaaccgagtttaagtgaaatatccaatattccatggcttctctggaccggaggatttcttggggtttatgcaattagcatgagcatttatactgcacctaagcttggttttttaacctttacagggttagtcgtttttgggcaattggtcatttctatgttacttgaccattttggctggttaggtaccgaaaagacacctgttacatggcaacggtttctaggtggagtggtcatctttgttggtgtattacttaccttgcaacgctag

SEQ ID NO: 3895 - DNA, 741 bp, Acinetobacter baumannii
ttttttgtaaatagcccaatattagagccttacatgtctaaactcgctgcttttgatgaacttttacaacaatataaaacatttaattatcacgacaacccagtgcttgcccaacgtttgcaagatgtacaaacatggctaaaagaacggatgaaagagacgcatcacgacttttttaatttgccagaacacaaactgatggctcagtactttttaaaccgtttatatggtggaccagagttcgatgcacttgcagcacaaattgaacgtttattgaaatatgcacataaagcagaaaaggttttacctgaaaacgcaattaagacaggtacaaagtcggtaagtttggctgtacttgccactcaacttgatgaacaagtagcaatgcagcttcttgaagactatccggcagataccgtacttaccgacgagatcatgcgcttaaccttaatcaagcttgatcaggccgaagcccgttaccagcagcttgcccttcttgacgatttaggagcagcactcgataaatacatgcgttcatttatgatgtttactgcttttaaaatgtgtaaaggtattgcacaaaaatatcacttcgaattgatgtatgattttattcaagatggttttagcgcaatgaaacctttaaaatcggctgaggcctttattaaaacttttacggaaaaagaacgccagattgttgaaaaagtacattcaggacatccgaatccgtttagagtgtga

SEQ ID NO: 3896 - DNA, 810 bp, Acinetobacter baumannii
aaagcagtaaaatactccccgtgttttatatcccctcaaagagtagcaatgaccgatcttcaacaagatgaatatgaccgccgttttgcaggtgtagccaaaatttatggtgattcatcgttccagcactatgaacaaagtcatgtgatggtgattggtattggtggggtcggcagttgggcggtagaagctttagcgcgtacaggtattggtgagatcacattagtcgatatggatgtggttgcagcgtcaaatgtaaaccgtcagctacctgcaatgacctcaactctgggctgtgaaaaagttgagattatggcggagcgttgtcgccaaattaacccacgcattaaagtcaatattattgacgacttcttaacacctgaaaatgttgcagagcttttaaaccctgtaccagacattgttttggactgcatcgatgatgttaaagcaaaactggctttaatgctccattgtcgttttaacaaaattcctttgattgtgtcgggtggggcaggtggtaagctcgatccacttaaaattcgcgtggcggatctatcaaaaacagaacaagacccaatgttagcgaagttacgtagtcagcttcgtgctcgtggcatctgtaaaaagccaaaagagaaatttggcattacctgtatttactcaatcgacaatccattttcaagcgcagatgtctgcccatcggctgggttgcgctgtggtggctatggttcagcggtggtggtgacttcaagctttgccatgattgctgtagccgaagttttgaaaaagctcgatttaaagaaagcctaa

SEQ ID NO: 3897 - DNA, 615 bp, Acinetobacter baumannii
actatggtaaatcaaaataattccccatcggatatgggaaaaataccgttatctgatgataaaaacttaatgaacattgcacaatacttaaaaggtgtacagcaaagtcacaaaaggtcaatcccacctttagagcaatggcatccaaagcattgcggtaaaatggatttaacggtgaaagccaatggagaatggtggcacgaaggtcaattaatcaagcgccaagccctattggatttgtttaccaaagtcctatggaaagaagagggtaaattctacctgaaaacccctgtagaacaaattgaaatcgaagttgaagatgaacctttattagtcaatcaggtagatcagattgaaatttcaggtgatgagtttctacaattgacgacgaccaatcaggatgtgattttagttgatgcagaacacccgatttttatgcgggaatatgcaggggagttgcgtccttatgtccatgttcgatttggtattaatgcgcttattcaacgtcaggctttctatcatctcgtgaactatggaacactggtcgaaaatgataaaggcgaaaccattttgcagttaaaaagtggtaatttgcacttgcaattaggcacttga

SEQ ID NO: 3898 - DNA, 1581 bp, Acinetobacter baumannii
tcattaacaaatccgatttatatattttggccgatattaaaacattcaggaatgattcctaaaagttttctaatttataaaaatgataaattagatttatgtaaaactctggctataatcgaagaaagattagaattacccagtccaatggagcaagacgacatggcaggcaaaactttatatgacaaattgtgggatgaccacgtagttactcagcgtgatgatggttcgtgcttactttatatcgaccgtcatttattgcatgaagtaacgagtccgcaagcatttgaaggtttgcaacttgctggtcgtcaaccatggcgtttaagtgcaaacgtagctaccccagaccacaacgttccaacctctaaaaaagaacgtgatcagggcatcgctggtattgaagatgatacatctcgtattcaggttcagaccttagatgataactgtaaggcatttaatatcgttgaattcggtattaatgatattcgccaaggtattgtgcatgttgttggtcctgaacaaggcttaactttaccgggtatgactgtggtgtgtggtgactcacatacagcgactcacggtgctttcggttgcttggcacatggtattgggacatctgaagttgaacatgtgttagcaacacaatgtttggttcagaaaaaatctaaaaatatgttggttcgtgttgatggcgttttaggtaagggcgtaacaccaaaagatgtcgtgttggccattatcggtaaaatcggtactgcaggcggtacgggttatgcaattgagttcggtggccaagttttccgtgatatgtcgattgaaggacgtatgacggtatgtaacatggcgattgaagcgggtgctcgtgtgggtatggtcgcagttgatgataagactattgaatacgtaaaaggccgtagctacgcaccaaaaggtgagcagtgggaacaagccgttgcttactggaacactttacattcagatgttgatgctgtttttgatgctgtagttgagttaaatggtgcagagattgaaccacaagtatcttggggaacttcacctgagatggtgattccggtatcgaaagctgtaccaactttagaacaagcgaaagatgacgtacaacgcaatgactggacacgtgcttatcagtatatgggcttaaatgcaggtcaggcattggctgatattcagcttgatcgtgtctttatcggttcttgtacgaattcccgtattgaagatattcgtgctgctgctgaagtagttaaaggccgtaaagtggcacctagcattaagcaagccatgattgttccgggttctggtttagttaaacaacaggcagaaaaagaaggtttggataaaattttcttggaagctggctttgaatggcgtgagccgggttgctcaatgtgcttggcaatgaacgcagacaagttacaaccgggtgagcattgtgcatcaacctcgaaccgtaactttgaaggtcgtcagggtaatggtggtcgtactcacttggtcagtccggcaatggcagcagcggctgcgatcgcaggtcattttgttgacgttcgttcattttaa

SEQ ID NO: 3899 - DNA, 699 bp, Acinetobacter baumannii
gacatggcaaagttaactaaacgtcaaaaagccattgctgctgctgttgaagcgaacaaagtttacactttggaagaagcagtacaggttcttaacagcttgcctgctgcaaagttcaaagaatctttagacatctctgtaaaccttggcgtagatccacgtaaatctgatcaggttgttcgtggtgcgactacattacctgcaggtactggtaaaactgtacgtgtagctgtatttgctcaaggcgcgcaagcagaagctgcgaaagaagctggtgctgatgttgtaggttttgatgatcttgctgaaagcatccaaggcggaaaccttgactttgatgttgtaatcgctgctcctgacgctatgcgtgttgttggtaagctcggtacaattcttggtccacgtggtttaatgccaaaccctaaagttggtactgtaactcctgacgttgctggcgctgttaaaaacgctaaatctggtcaggcgcgttaccgtgtagacaaagcgggtattattcacgctgcgattggtcaagttggctttgatgctgctgcaatccgtcaaaacgttgaaactttagttgctgacttgaaaaagttaaaacctgcaacttctaaaggtgtatacatcaagaagatcactttgagctcaactatgggtcctggtcttactgttgatgtaaacaacgtttctaactaa

SEQ ID NO: 3900 - DNA, 786 bp, Acinetobacter baumannii
agagaaaaaaagatgaaacatagcattctgattagtggcgcagctcaaggtattggagcagaaattgcacgggtattttatcagcggggttataaagtcggcatttatgacattaatgagtcgcttgctcaaaatttagcgcaggaattaggaccgaatgcatgcgcaggctatctagatgtcagtgactacagtcagtggcaacatatattaaaagaatttaccgactgggcgggcgagcttaatattttggtgaataacgcagggattttatattccggagcctttgaaaatatcgatatcaagtcacaccaaagaacaatcaatattaatgtaaacggcgtaatcaatggctgccatgctgcactcccttatttaaaacaagcttcttttgcacgagtcatcaatctctcttcggcttctgcaatttacgggcaagctgacctcatttcttattcggcgagtaaatttgcagtgagaggaattacggaaggtttagatgtggaatggaaaaaatacggtattcgtgttttagatgtgatgcctttatttgtacaaaccgcaatggtcaacaatatggatgcaggctctattcaaaacatgggagtcgatttaacgcctaatgatattgctcaacaggtactttcacttgtagagaaaaaagctcatttctggacaccgactcacactccagttggtataaaaaccaaactgctttatcaactctcaacaataagtccccagtttttaaatcgcttgacgaatatctatctatcaagaaagtag

SEQ ID NO: 3901 - DNA, 831 bp, Acinetobacter baumannii
ttgagagaaaaaatgcgttttcctactttagtttttgatattgaaactttaactgatttaaaagcgggagcgcatttatatcatcttgatttgccagaggcagatgttgaacaggcactcacaaaaatccgtcgccaagaatccggcatggattttcagcgtttgcctttacatgaaatcgtttgtatttctggtttgtggattgatgaatcaggtttcagattattttcttttagtcgggaacactattcggaagctgaaattttacagaagtttctatccatttttgataagcgccatccaactttagtgagctggaatggctcgcaatttgatttgcccgtcattttgttccgtgccatgtatcatggtctttcggcacccgggttatttgatcaaggcgagcttgatagtcagaagcgttttaataattaccaaaaccgttatcaccaccgtcatattgatttaatggatgttatggcaatgtttaatggccgtaatttccagaaactcgatgatgtagcctgtattttaggtttaccaggtaaacgtggtgagtcgggttatcatgtgcctgaatatgtacgtacagaacaatggttaaagttaaccagttattgtgaaggtgatgtgctcaatacatggtttatttatttgcgttggctattgctcaaaggccaaatgaatgtagatgagcataaccactggattagttcgagtattgagtatttacagactatgcctcagcaagccgattttcttgaggtgtggcaacgtacatcgaaacataccgaatttacgtcccactattttaatcctttaaatttttag

SEQ ID NO: 3902 - DNA, 921 bp, Acinetobacter baumannii
ttaaaccgaaattgttataatctgcttagggccctggagaatattatgtctgatttacgccaacgcttttatatagaggactttcctgttcgcggtgaagtggttcatctagaagaagcattaaaaactattttagctcaacgcgactacatgcctgcggttcaaattctattaggcgagatgttgagcgctacagcattacttgcgagtactttaaaaatcaaaggtcgtatcagcttgcaaatccaggctaacggctctttcaaatgggctatggcagaatgtaaccatttaggcgaagttcgtgctttagcagactacgaaacagatccacgttttggtgaagcaacagatagcagcactgttttagctgctttggttaaccctgttttatttattaatattgaacctgagcatggtgagcgttatcaagggattgtacctcttgatcaagcaaatttagctggctgtttaatgcagtactatgacttgtctgcacaaattccaactcgaattgtactggcaagcaccgcacagcgctcaggtggtttgctcattcagttattacctcgtcatgatgaggaagagcaaaaactggttgatgaagatttatggccacgtttaaccatgctaactgaaacgcttaagtcagaagaactaacagagctttcagcaaatgagatcttgtatcgtctttataacgaagaagaagtacgtttaccagaagttgaacacttaaaatttggttgtacttgttctaaagaacgctgtgccaaagccctcattcaaattggtgttgatgctgttcatgaaacattggaagcacaaaacccgattcaaatggattgccagttctgtaacacccgttatgagttcactgctgaagaagcactgggtctgtttggtgaacatttgagttaa

SEQ ID NO: 3903 - DNA, 1908 bp, Acinetobacter baumannii
atgtctagaaaattaagtcatgtccttttaataggagtcggattgttttcgtcgacttgggttatggcagcggttaaagaatatgatttaacaattgctgaacagacggtgaatattacaggaaagcctctaaaacgaattactgtaaatggtaagtttgttgcacctcttcttgagtttgaggaaggtgatgatgccgttattcgcgtacacaacaagttgaaaaaccaagattcatctattcattggcatggtttaattttacctggcattatggatggagtacctgggttcaacaagtttgatggtattgcaccaaataaaacctatgaatataaattcaaggttcgtcagaatggaacctattggtatcactcgcatagtaaaggccaagagcaagatggcttgtatggtcctctagttatttatcccaaaaataaagttcctttaacggctggagaaaaagctgatagagattacgtagtcttactctctgattttcacaattctactagtggtcagattatgagtaatctcaagaaagaagctgattattaccagaatcgaagagaaacggttattgatgttttcaagcagattaaaagagatggtttaaaagcaacatggaaagatcgttccatgtggaatcagatgcgaatgcttaagacagatatgtctgatgtaacaaactatacgtttttaatgaatggtaagactccagaacaaaattggactggaaattttaaagctggagaaaaagtacgtcttcgttttatcaatgcttcggcaatgtctttgttcgatgtaagaattcctaatctgaaaatgacagtagtcagcgcggatggacaaccagtaaaacccgtgccagtggatgagttccggataggaaccgctgagacttatgatgttattgtagaaccgaaacaagcaagttatcagattgaagctgaatctattgatcgaagtggtttttctatcggtacattacatgatgaaaatacttcacctgtaaaaaatataatgatgccgacacctcgtccccgtgctttactgacgatggaagatatgggaatgaaccatgacatgtcttcgatggaaggtatggatcacgacatgtcttcgatgaaaggtatggatcacgacatgtcttcaatgaaaggtatgaatcacgacatgtcttcgatgaaaggcatggatcacgacatgtcttcgatggaaggtatggatcatgacatgacttcgatgaaaggcatggatcacgacatgtcttcaatgaaaggtatgaatcacgacatgtcttcgatggaaggtatgaatcatgacatgtcttcaaaaacaatgagctcttctggatcagatgaggtggtttacggatgggcgaatgcctcaaccccagctggactaaaagcacttcaatatagtgatctacaatctttaacccctcaaaaagatactcgtgctccagaacgtgaaattgaaatccgtttagggggaaatatggagcgctatatttggacaattaatggtaagaagtttaatgaaactgaaccatttaaagtgaaatatggtgagcgtatacgcttgaaatttgttaacgacagtatgatggctcatccaatgcatttacacggcatgtttatgcaactggaaaatggccaagatccaagtaatatgccgaataaacatacagtaattgttccaccaggtaaaacagttacaactttattaactgctgatgagttaggtgaatgggccatccattgtcatttgctctatcacatgtctgctggaatgatgaataaacttattgtggcaaatgtcgatagtaatagtacatcttcgaaagatgttgttactcaacctaatactaatgataagggggtaaatcaacatgcgcaccactaa

SEQ ID NO: 3904 - DNA, 864 bp, Acinetobacter baumannii
aaaataagaaaggatgatgaaatgaacttgagtaaaaagacaattattgcgcttgtggttgcagccatagctctaattttggctatttgtgtatttgtctggaaaaagcctcagtcttcatcatcttctcaagaaaattcagcttctactcaagaccatccggttgagaaagcagaggttttaccttatttaaatttgaccgaaaccaaagcaaattatgcagtgccgttttgtgaaaagaaaaattgtattgatgtcgatattcaaaccataaaaacccaagacgcgtggttaaatagctggattgaaaaaaatcaggcgaaagttattcaggctcaaattaatttgaaaaaagatttaagccttcaacaagcgattaatgcttacgtgaagaagtcggatgaatggcaagataaatattctaaaaatcgtgcttatgaattacacattcgtacacgcattgcctcgcagcgtaatcagtatgtgttattgcaattggctttagacagtaaacaagaagagattactataaaagaccgttattattttttcgtggcggatcgtaaactgcataaaaacttaacgttgcttgatgtgcttaaaaaagaccagcaaccgacagtacatcaaattgttcaaactgcgtatcaggactggttgaaaaagcaaactgccgatgtcaaaaaacaagccccaaaaactttatattggggacaagctgactggttctttgatggtgaaggggtaggtttgcactatcaggcaaatcagattacgaaagatgcgcctcaacttgatatttatttaacaacagaacaaacgaaaaaaatattgcaacctcaggtttatgaacaaatgttttaa

SEQ ID NO: 3905 - DNA, 1326 bp, Acinetobacter baumannii
ataaaaagaaagaaacgcgagggacgtgtgaaaatattttcgaccaatacctgtccggtaccgaatgaccttgaatcggtcattcatcataaagatgaagtacctgccgaactaggtggaatgagtgaacagcaagttcaaaaaatctggaaaagtattgagtcactctataaaaccggaaactatccgctcattactttttgcttacgtcgacaggggaaaattttattaaatcgaagtattggctatgctcaaggaaactcgccggctggtctgcaaaagaatgcactcctcgcaacgccggatactcccgtttgtctattttcagcatccaaaatgattactgccatgttaattcatcttttagatgaaaaaggcgaaatcaacttacttgacccggtgagctattatattcccgagtatggggtgaacggaaagcgccgcgcgacaatctttcatttgttatctcatcgtggaggcattccttatgttgatggagatgtcacacctgaactgctttttgataaagatgaaattttaaggcgtttatacgcagcaagacctgtttctccagcgggaaatcacctcgcctatcatgcagtaacggcaggttatatcttaggagaaattattgagcgggttacagggcaagaccttcgccagttcgtgcatgagaccatcgagaaaccgatggacatgccctattttaactatggcttaaaaccagaatatcgtgctgaagttgctcttaattgtgcaacaggtttacatccgcgtttaggaacagatcattatctcaatcatgtactaggtggaggcttacaactcgctgtagatgtcactaatgataaccgttttatggataccacctgtcccgctggtaatatttataccagtgcagaacaagctggacgcttctttgaaatgcttttaagtgggggaagctaccaaggcaaacaaattttaagcgagaaaacaatttttagagcaacactccctaccacaggagttaacattgaccgaactttattaataccgatgcgctatgccttaggaccaatgctaggcagtaatccggtaggcttatttggtccaatgactggacaagcttttggtcacctcggtttttccaatattttgtgttgggccgacccagaacgtgatatcagcgtttctttgttaactactggcaaatctgtggtcggtacccaccttcctgccctagctaatctgctttatcaaatttcgactcaatgtccacgaattcctagagatcaacgccgttcactatttggtagtgattcgcatgaaaccgatctggtatag

SEQ ID NO: 3906 - DNA, 1284 bp, Acinetobacter baumannii
attgaaagaaaaaacaaaattaggagaataacgatgacaacagctcaaattgaattagaagaactgtcagtaggcgctgattacgaaaaggttgcaaacagattccgtcccatttttgaaaaaattgcccaaggcgcaattcaacgggaaaaagaacgaatcttgccttttgaaccgattcagtggttaaaagaagccaagttgggtgctgtacgaataccccgtaaatatggtggagatggggtttcattacctcaactgttccagcttttggcagagttagcagaagctgactccaatattgtgcaagctttacgaggtcatttcgcatttgttgaagaccgcttggttgctcataaagagcactcacaagaggtctggtttcagcgtttcgtacaaggtgatttagtcgggaatgcgtggacagaagttggaaacgtacagattggtgatgtcgttacacgagtcactaaagatgcttcgggtaacttggtggtaaatggcgaaaagtactattcaaccggtagtatctttgcagactggattgatttatttgcttacgatgaagtaaatgaccgtcatgtgattgctgctatttaccgccatgaaacaggggtgagcgtgattgatgactgggatggttttggtcaaaagacaacgggcagtggtactttaaaagtacatcaggttcatttgccagcttcacaccttattccatttgaccaacgttttaaatatcagaccgctttttatcaggtggtgcatcttgcaactttaacgggtattgcgcgtgccgcggttgagacgtttagtcaggaaattcgtgaacgtaaacgtatttttagtcatggtaatggtgacttggttcgtcacgacccacaagttttacaagtggtcggcaaagcctcagctcaagcgtatgcaagtgaagcaattacgttaaaaaccgctgaggcactgcaaaaagcctatgaaagccattttgccgaatccgaagtgaaagagcatcaattcaatgtagatgccgagcttgagtcggcacaagggcaggtggtgatttctaatctagtactcgatttaacaagccagttatttaatgctttaggggcatcggcgagcagccaagtgaaacaacttgaccgtttttggcgtaatgctcggacagtgtcttcacataatccgcttatttacaaagaaaaagtaattggagattgggaagtaaaccgtacggatttaccatttgtctggcaaattggagcaagcccacgggcaaagactgcataa

SEQ ID NO: 3907 - DNA, 1290 bp, Acinetobacter baumannii
tcaaggtgttttaagtacagatcaggttgttgccgccgctgtttaattaaaaaaaagactttggaaaggatacctagcttggtatcctttctttttattcctgaaagatttaaaaggcgaaatgttcccgtgtcttttccagctgactcagtggggttagtcactccgcaaaagttccaatttgaagaacccttacatcttgaatgtggccgtgttttaccgcgctttgagttaatggttgaaacttacggcactttaaatgcagataaatcaaatgcgattttaatctgccatgccctttccggacatcatcatgcagcgggttatcaccatgaagatgataaaaaagctggatggtgggatagctgtattggcccgggcaaggcaatcgacacaaataaattttttgtagttgcgcttaataatattggtggatgtagtgggtcgactggtccaacttcaccaaatcctgaaaatgacaatcgtccctatggtccagatttcccattagtaacggtccgtgactgggtcaaaactcaagccatgctttctgaccgcttaggaataagtgtctggtatgcggtggtcggcggttctttgggtggcatgcaggcattacaatggtcggtagactaccctaatcgtttacaaaaatgtgtcgttattgccagtgcgccaaagctttcagcacaaaatattgcgtttaacgaggtggcacgtcagtccatcttgtctgacccagacttccatcatggtcgttatttagaaaatgatagctatccaaaacgaggcctaattttggctcgtatggtcggccatattacctatctttctgaagaagcgatgaagcagaaatttggtcgtgatttaaaatccggcaagtttatgtacggttttgatgtcgagtttcaggtcgaaagttatctccgttaccaaggtgaacagtttagtcgtaactttgatgccaatacttatctcattatgaccaaagctttggattattttgatccatcgcgtgagtacggtcactcgcttacagaagcgatgagtaaaaccaaatgccagttcctgattgtctcgttcaccactgactggcgttttgcaccaagtcgctcacaagaaattgtagatgcactcattaccaatcataaaccagtaagttatcttgatattgatgctgaacaaggtcatgactcgttcttattcccgattccactgtatgtcaaaacactgcgcgctttcttaggcggtgaagaacatttaaaatcgacatcactggaggcaagctaa

SEQ ID NO: 3908 - DNA, 780 bp, Acinetobacter baumannii
ttccccctgaataacaccccatgggtcgatgaaattaaatttaacgaacaaggtctaatcccggccattgctcaacatcatcaaaccggacgtattttgatggtggcttggatgaaccgtgaatcacttgcactcacagcagaaaaaaatcaggctgtgtatttctcccgttctcgccaaaaactttggcacaagggtgaagaatcaggccatttccaaacggtttatgaaattcgtctggactgcgatggcgacgtgattgtattacaggttgagcaacatggcggtatcgcatgtcatacaggtcgtgagtcttgtttctaccgtaaactcaccccacagggttgggaaattgtcgatgcacaattaaaagaccctactgcaatttatggtgacaaagccaaaactgaaagccacgaccatactcacactactgaacaagttgatgtacttgctcacttagggcaattgatgcaagagcgtaagcaagcagaagcagacacttcatatgttgcaagcctctacaaaaaaggtatcaataaaattttagaaaaagtcggcgaagaaagcgtagaaaccattattgctgcgaaagactacgctgctcaaaatacagaaagcaatttaaatgacttgatttatgaaactgccgatttgtggttccatagtattgtcatgttgggttatttcgatcttaatccacaacttattattgacgagttaggtcgtcgtcagggtttatctggtttagttgaaaaagctaaccgcaataaggtttaa

SEQ ID NO: 3909 - DNA, 1266 bp, Acinetobacter baumannii
ccaagcctgaaggttataaaactcgttttgatgattttgcgccactgcaagggcaagtgtatggcgaataagcggattgccattattggtgcgggtccggctgggttaatggccgcggaggtgctgagccagtatgcttatgaaattgatgtgtttgagcaaaaaccttcggctgcgcgtaagtttctgatggctggtaaaacagggctaaatatctcgcatgctgaaccattagcccagttcattgaacgttatgaccatgcagaatggctcaaaccgtgggttgaaaaatgggatgcagtctggattcagaactggatgaaaagtctgggaatagactcgtatgtgggtagttccggtcgtattttccctgttgaaatgaaagctgctcctttacttcgtgcttggttaaaacgtttagcagaacagcaagttaaattcttttatcgtcatcgttgtattaatttaaaaggtacaaaggtgactttagaaaaccaaaataatcaaagcactgaaacttttacccaacaatacgatgcagttgtattagcatgtggggcagtgtcttggtctcaattgggtagtgatggtgcttggcagcaatggatagatcaatccagtattgaaccttttcaagcaagtaatgcaggggtattgcacacttggtcagcttttatggaaagctgttttggtgagcctttaaagcgtattaatgcgtgggttgaacccagccaagttactcatggtgatattgtgattactcactacggtttagaaagtggggtcatttataaactcggacgcgccttacgagaacaacaaaaacaaggaaaaagcttaaatctatttttagatttattgcctgatgtagagcttacacagttagttaaaaagttacaggctagcaaaaaacaatctctcaccaatatctggcgtaaagcaggcttagacacagctaaaattaacttaattagagaagtggttgataaatcgctatggagccaaccagaggttatggctcagcaaattaaagcacttcaaattaggttagatggttttagaccgattgaagaagcaattagttgtgctggtggtgtcaagcaagatgtattaactgaaagtctagagcttaagcaaacttcaggcgttttttgctgtggcgaaatgctggattgggatgctcctacaggcggatatttgcttacagcatgttttgctacgggtcgagcagctggtgaaggtgtgcattcattcttagaaaaataa

SEQ ID NO: 3910 - DNA, 2190 bp, Acinetobacter baumannii
gaatttatgaaacttcaaactatagcttgtgcagtagcaatcgcgactggcggtttattcttctctcatacgatgaacgaagcaagagcagcaaccaatactgctgctgtttctcaatcgatccagccaacgcaagagcaagccttggtggctcgtcaactggcaactttagtagaccgccaacattatttaaatatgcgtctggatgcgaacacatctaaccgtattcttgatatgtacttagacagtcttgatccggaccactcattatttttagacgctgaagttcaaaactataaaaagctctatggttcaaattttggtgcttcattaaaagcggggaatttaactgggccatttgctattcaccagcaatatcgtgagcgcttaaaacagttttatgagttcatgcttgctgagttgaagaaaccacaaaatttaaaacagccaaatacttttattgaagtagatcgcgaaaaagcaccgtattttaaaacttcagctgaacagcaaaatcactggcgtaaaatgctggtttctcagttaattaatttaacgattagccgtgaagaagagcaggcaaaacaaaaggcgttaaaagaaaacccttcacttgctgatggtcaagatttaacaggccccgaagatttaacgccagctcagactttgactaagcgttatacgcgtcagcttgaaagaattagtcgtgtgaaaagcgacgatgtgttggataaaacattaaatgcaatgttggcaacttatgatccgcacagtaactattatccgccaattgatgcgatagagctgaaccgccaaacaaccttacaacttgaaggtattggggtatcgattcgcccagaacgtggtaatgaagattacaccaagattgaaaccattgtagaaggtggtcctgcaagtaagtctggtcaagtgaaatcaggagaccgaatcgttggtgtcgctcaagagggcggcaaaatgatcgatgttgtcggctggtcgagttcggaaattgttgggttgattcgtggtaagcgtggcacaaaagtaacgttgaagcttcttggtgctggtgcatcaatgagtcaggcacgcaatgtgactttggtacgtgatgttattcaagaagaagatgccggtgttcgttcacgtacagttgaagtgacacgtgatggtaaaaagcatctattaggtgtgattgaaattccatcgttctattttgactatcgttcacgtcgtgctggtcagcaatatcgctcagtttctgaagatactgcaaatgcgtttgaggcgttaaaagccaagaaagttgaaggtattattattgacttgcgtaatgacccgggtggttcattagaagaagttgcacgtatgcttggacaagtgattaagtcaggtccagttgtgcaaattcgtgatggtaatggcaacgtaagtgtatttgaagacaacgatggtggtcagcaaatctatacaggtccactcgctgtattggtgaacttagcctcagcatctgcaagtgaaatttactctgctgcaattcaagattatgagcgtggcattatcattggtagtacaaccacaggtaaaggtacagctcaggtccaactcgatactttggcatatggtcaagcaaccttaactcagcgtaaattctaccgtgtaactggtggtagtacgcaaaacaaaggtgtagtgccagatattaagcttgttgatatctataacgaagagtttggtgagcgtaaatcgaaaaatgcgttgaagtgggatacgattccgactgcaccatttaagcgtgaaggttcagtgcagccatatgtcgcaaaactgtctcaactttcggaacaacgtgttgctgttgatccacagtttaagtatttaaataaacgtacagcaattgcgaaggttacgagtgaccagaaacaagttgtgcttgatattgataagcgccgtgcagagcttttgagtttagaaaagcaaactttagatgctgaaaatgaacgtcgtatagcaacaggtcaaaaacctttccctaactgggaaagctatcaggcttctctagatgctctagctgaatcccgtgccaaaatgaaagctaatcaacgtcctgcgttgccagaagaagaaacgttcgtaaatgaagctgcgaatgtattgatggattatgcgaaattgcagaaccgttaa

SEQ ID NO: 3911 - DNA, 513 bp, Acinetobacter baumannii
aacattatgaaaattgataacattcctgactatattgatcctagcctaaatctggaacaaattcgcgatgagtgccaagaactcattcagaaaagagcttacgtctctgctggtgcagcaattgtacccattcctttttttgacgtggtagtagatttgggaattttgtcacagcttattcccgatattaattcccgttttggtttagcgcctgaacatgtcagtgtctatgatccaaaaacaaaaacaattcactgggatgaattacgaaaacgcggctttcaattttcaggctttgtggtcgctcgcactaccgttaaaaaaacctttaacggtttctttggaaagattgttaccaaacaagtgacaaaatttgtaccactaggtgggcaacttgtcgcagcaagtttaggctattttatgatgaaaaaaatagcccaaactcatctaaatgacagctacaaccttgctaaacgtattcaacaaaaaagtcgtggcacggttgtaaactaa

SEQ ID NO: 3912 - DNA, 2151 bp, Acinetobacter baumannii
gtttatatgaatacaattttattaattcctacaggtgaaggggttggtttaacctctgcctgcttaggtatgatttatgcacttgattgtaatgggattaaagcaggctttttaaaaccgttctctcaggtagatcaagaaaatttagaccgaactacatctttatttggtcatttatttcaaagcaaaactgttcaatccatttctcatgaaaagctaacccaacgcattgcggctggtgaagtcgatgagttacttgaagaagcagtaagtcttcatcgcagtatcgcagcagacaataatgtgattattgttgaaggcttattaccaaatgggcaagaccattttgccagtgaacttaatgcaagccttgctcaagcgcttgatgctgaagtggttttagtcagtacagcagatattcaaaacccacgtaaaacagcagagaaagttgaagctcacttacggcagtttggtggtgcaacctctaaccgaacagcgggcgtactctttatgcgtacacgcgggttgtctgaagagacagctcaaatacctgtcgcatttgacccgtcgttacgtccaaccgaagacatcgcaaaatttacgacagaattgcaaaaatataaccgctactttggatcaagcgatttaccaattattggtctagttccgtttagtaataccttaagtgtacctagaacattagacatcgcgagcgtgattgatggccaatgggtaaatcaaggcgaagcaaaaacacgtcgtattttgcactcaagtttaattgcctcaagcattgaatatgaactgaataaattcattgctggtgaactgatcattagcgcctctgaacgtaccgatgtattactggcaagtagtctcgccaccagtaatggtattccactggcaggcttagtgttgactgaacgtgaagcccctgctcccaagcttttagagttttgccaaagtgctatcaaacaagggttgccaattttacatacccatttaaatacactagaaactgcgcagcgcctatccgattttggtaatgaaattccaaccgatgacactgaacgtgccgagcaagtgacccgatttgtttccagtcacatagatgtcgaatggcttaaacagcatagtaataacggtgctacaccacgcctttccccttctgcattccgtcatgaactggtacaaaaatcgattgcagctaaaaaacggattgtccttccagaaggtgatgagccacgcactattgaagctgccgctatatgtcaggctcgtggtattgcgcattgtattttgttagcaaaaccagaagctgtacatgacgtagcaaaagcacgtggtatcgagttaccgaccgggttagaaattattgatccagatcagatccgtgaccaatatattgcaccaatggttgaactccgcaaaggcaaactcaacgacctacaagctaaagagcaattacaagatactgtagttctcggcaccatgatgctagctctagatcatgtggatggattagtttcgggggcagttcatacaaccgccaatacagtgcgtccagcgttccagctgattaaaaccgcaccagcgtactcactggtttcatccattttctttatgcttttaccggatgaagtctatgtctacggtgactgtgcaattaacccggatcctacagccgaacagcttgccgaaattgcgattcagtctgctgactctgcaaaagcgtttggaattgacccacgtattgccatgatcagctactcaactggtacatctggaacgggtgctgatgttgagaaagtacagcaagcgactcaaattgcacagcaacgtcgccctgatttactgattgacggtccactacaatacgatgcggcttcagttgaaagtgtaggacgccaaaaggcgccagactcacgcgttgctggccgtgccaatgtgtttattttccctgacttaaatacaggcaacacaacctataaagcagtacaacgtgcagcaaatgtagttagcgttggcccaatgctgcaaggcctaaataagccagtcaatgacttgtctcgtggtgctttagtagatgacatcgtctttactattgcattaacagccattcaggccgagcagcaagctgctgccaaataa

SEQ ID NO: 3913 - DNA, 201 bp, Acinetobacter baumannii
gtaccgatgaacagtcaaacaaaaacaaatccagagactcaggttccttatgatgttaagcatttacatgatttgcttgagcagcaaaagattgcctacttacgtcatccggtacccactgctaaagagcgtattgatcgtttagctcgtcttaaaagagtcttggtaaaatatcaagatcagattgccgaagcaatgtaa

SEQ ID NO: 3914 - DNA, 303 bp, Acinetobacter baumannii
cggtgctcgaaaaattttggcattgaaataagagtattaaaaatgaatttattccaagttaaaccaaacgaatttgtcaaaattgttgacctaaaaaaaggtaaccaatatttagataaaaatgatccagttctagaacgacttgaattgttaggtttcagaattggtgaaactttacaagttctagctaagggacttttcggtggtgatccagtattggttcaaattgaaacttctcgatttgcgttaagaaagaatgaagctgaacgaatttttgtagagattgtttcaaatgaacagtaa

SEQ ID NO: 3915 - DNA, 894 bp, Acinetobacter baumannii
aattttccgaaactctctagtactgccatgacagccatacagcctttatttactgaattagaacctatgcctaaagcattagcagatgccccaattggtatttttgattcaggtattggaggtatgtcggttgcagcagaaattgccaaatatttgccaaacgaacgtattgtgtattatgcagatacagcctatgttccgtatggtcctcgctctgatgaagaaatcagggaactgactgctcgtgccgtcgactggttatatcgtcagggctgtaaaattgcggtcgtagcttgtaatacggcttccgcatttagccttgatcatttacgagaacattatggcgaacacttcccgattgttggcttggtaccggcactaaaacctgccgtattacaaactcgttctaaagtggttgcagtattggcgacaccagctacttttcgtggccaactcattaaggatgttgtcgaaaagtttgctgttccggcgggtgttaaagtgatgactctaacgagtttagagcttgtcccttgtgtagaagcaggtcagcaaatgagccctgtttgtttaaatgcattaagagaagttttacaacctgcagttgagcaaggcgcggactatttggtacttggttgtacacactatccgtttttaaatgaagctattcgtcatctttttgataaccaattcacactggttgattcgggtttggcagttgcccgacaaacagcccgtattttaataaaaaatgagttattatgtgaccaaatacgtcagaatattgcacgtattgaatgttatgtaagtggtaataatgcagatgcattacaacctgttttacaaaatatgattccacaagaattgacatggacgctgcacaatctgagttga

SEQ ID NO: 3916 - DNA, 357 bp, Acinetobacter baumannii
gaagatgagaaatatgaaatggaacaaatcgagtggaatgactttttaaaagtagaactgcgcgttggtaaaattattcaagctgaggtttttgaaaaggcgcgtaaacctgcctatattttgcatgtagattttggtgaagaattgggtgtacgtaaatcgagtgcacagattacaaaactttatcaaccgcaggatttgattggtaaattagttgttgcggtagtgaatttccctaagaaacaaattggtcctatccaatcggaatatttggtaacagggtttcataatgcagatggtgatgtcgcactttgtatcccagagtttgaagtacctctgggtacaaagttattataa

SEQ ID NO: 3917 - DNA, 1200 bp, Acinetobacter baumannii
aatcgagagaacatcatgtctacccctgaagatatcagtcaaaataaacctttactttggttgatggcagcagcatgtggcctatgtgcaggtgtgaattactattgccaaccccttattcactctattcagcaagattttgctgtaactcaggcacaagctgctttaacagtaacatttgctcaggtgtcttatgccttaggtttactctttattgttccgatgggtgatattgtcaataaagccaaagctattccgtttttgatgatgctttgtgcagttggcctatttacctctgcttttgctgttaacttacctatgctctggatcggtacaattttagcgggtttgttttcagttgcagctcaagtgcttattcctcttgcaacaatgacggttaaacctgaaaaaactggtgagattattggcttcttaatgagtggcttattggtcgggattttactctctaccagtctggctggcttattttccaaccttttccactggaaagtcgtttatgccataagcggtatattaatgcttctgttggcctataccttaaaaagccgcctgccttatgtcatgcgtatgaaactgaactatggacaaatctttgtttccatggctcagcttttaaaagaggaaaagcgacttttattaagagcgcttacaggtgcattcgcctttgcgtcagtgagtattttgtattcaacaatcgcgtttttactgacctcggcacatcatttacccgatctatttattggactggtacctttagttggtatctttggtgcgttatcaacacgttatatcggcaaatatgccgaccaaggctacacacgtttactcacttggatgggttgcggactatttttggtaagctggatttgtttctatttcggacaaactctactttcagcttatgttattggttttgctttaattcaattggcacttgcccttgttcacaccagcaaccaaagtattatcttccgtttacgtcccgatgctaaatctcgtattaatgctatttatatgactacttattttattggtggtgcagccggttcagcattagggatttttgcatggaatcgtggtggatggaccatgacttgcctagcaggtgttggactcgttgtattttgtattttatttagcatgattgatgctttcttacaaaaaaagcaaatggcttag

SEQ ID NO: 3918 - DNA, 915 bp, Acinetobacter baumannii
cggttaaggaattatatgaattattctaatttacttttgtcgagcttattaactgtaggtctttacacctcagcccatgctcaagaaaatcttactgaagaatctgccgctagttcggaagatgttacttcaacccagactcagcatagccgacctcacttacaaattattaaagatttgaaaggcataaaagttaaagatttaaagatcaacgcaaatgctgcccaaccggatacagtaaaagatccattacagtcactgaaccgtccaatttattcttttaacgatatgttagaccgccatgttttgcgtcccgttgctgttgaatatagagaaaagacgccagaagatgtacgtggttcttaccgacaatttcgtaaaaaccttggcgaaccatggaatgctgttaaccagctaattcaaggacgtcctggccgcgccgcaaaaactttaggtcgttttactattaatacgttaacaactttaggtttagccgatccagcgagccgcttaggcttacctcctgaagaagaaagttttggtgtaactctcggttactatggtgttccttctggaccatttcttatgctgcctttctttgggccaagcactttacgtgatggcgttggcttggctgtagatgctcaggcccgtccacaaaaatacattatggatgatcaagatggcctgtattggtcgactaatctattacaagccgttgatacacgcgctcaatatctagatttagaccaaactatacaaggcgatcaatatgcaatgattcgtgatttatatctccaacgtaaagcgttccagattgccgagaaaaaaggtgattcggcagatgtgtcttttattgatgatgacgaatccgaagatgtaccagaagataacactgataaaaccgaaaaataa

SEQ ID NO: 3919 - DNA, 1011 bp, Acinetobacter baumannii
aaaaagaggaagttgagattcaagaaaatccagacattttacttggcaaagaaacaactgattgatctaactttgtcagatgccatagataaatatttggatgaagttgggagcgagtacggtaggacgaaacgctattctctactcttaattaagaagttgccaatcgcgcgcaatattatcacaaaaatacattcaatacatttggctgagcatgttgctctaagacggagaggcgtgccgaatcttggtttagaccctattgcaacaagtacacagcagcatgagcttttacatattagaggtgttctatctcatgcatctgttatgtggggcatggaagttgatttaagtagcttcgataaagctacggcacagcttagaaaaactcgccaaatctcctctagcaaagtgagagatagacttcctacaaatgaagagttaattgctttaacaaaactttttgctgagcgttggaaattaaataaatatggtactaagtatccaatgcatttaattatttggttcgcaattttttcatgcagacgtgaagcagagttaacacgcttatggctgcaagattatgattcttaccattcatcatggaaagttcatgatttgaaaaatccgaacggttctaaaggtaatcacaagtcttttgacgtgttggaaccttgtaaaacaataattgaacttttattagataatgaagtgcggagtcgtatgcttcgattaggatatgatgaacaactcttattgcctctgaacccaaaaagcataggaaaagaatttcgtgaagcatgtaaaatattaggaattgaagatttacattttcatgatttgagacatgagggatgtacacgattggcagaacaaagttttactattcctgaaattcagaaagtgagtttgcatgattcgtggagtagtttacagaggtatgtttctgttaaatcaagacgaaatgtaattcagttggaagaggtgctacgcctcattgatgaaacgtag

SEQ ID NO: 3920 - DNA, 249 bp, Acinetobacter baumannii
atctgtgggaactcatatttagctgcgttaattagtttgcatttacaccaaaatttacaccataatggagaaaatggttcatggtgtaaatttatggggtcaattactgccagaaaaggtgcagatggaagtgttagttaccgagctgctatccggatcaacaaaaaaggttatccagcttattctgaaagcaaaacatttcattcaaaaaaagtggcagaaaactggcttaaaaaaagaggaagttga

SEQ ID NO: 3921 - DNA, 429 bp, Acinetobacter baumannii
aatcaggggaaaaaccacatgcaatacagcataagattttggaaaaataagtattttgttttaataattttgtgcttgggagtaatttcaccttcggtttacgctcaatcttttgatcaaaactttcaagaatggaaggctaaacagcagatgtatgaccaaaagttaaacatcactaagtcttctcattctaatggttctaaaatttctcaaactaaaaattttaatgactctacagggcaaattcatttgaatcaggcgaatgtaaatgagtttcagcagttaaaaggtataggtgagaaaaaggctcaagcgattgtagaatacaggcaaaagaacggtagctttaaaaatattgacgaaattaaaaacgttaaaggaattggaccagctatttttgaaaaaaataaatcgcgtttagccttataa

SEQ ID NO: 3922 - DNA, 972 bp, Acinetobacter baumannii
tggtttaacctctatgatggaacctttaattatggcaattttaggggtgctcgtaggcggtctggtaattgctatgtatcttccaattttccaaatgggctcagttgtataatgcaagacatcattgcgtattttattcaaaacttaactgcactttatattgctgttgcactcgtgagcctatgtatcggtagctttcttaatgtagtgatttaccgcacgccaaaaatgatggagcaagattggcagcaagaatgccaaatgttactcaatcctgagcaaccgattattgatcatgagaagttaactttaagtaagcctgcttcatcgtgccctgcatgtcagcaaccgatccgttggtatcaaaatattcctgttataagctggcttatgttaagaggaaagtgtggccattgccagcacccgattagtattcgctatccagccgtcgaactactcaccatgctatgttcattagtagtcgtcatggtgtttggtccaaccatacaaatgctttttggactcgtcctcacatgggtactgatagcccttacctttattgatttcgatacacaattattgcctgatcgctttaccctaactttagctgcgctcggcttaggtattaatacctttaatatttatacctcacccaactcagccatttggggttatctcattggtttcctatgtctttggattgtctattacttatttaaagtgatcactggcaaagaaggtatgggctacggcgactttaaattgcttgcagcattaggagcatggatggggccattgatgctgccgttaattgtgttattgtcatcgttacttggcgcaatcattggcatcattttattaaaattaagaaatgacaatcagccttttgcttttgggccatatattgccattgctggttgggttgcctttttatggggtgatcagattatgaaaatttatttgggaggttaa

SEQ ID NO: 3923 - DNA, 912 bp, Acinetobacter baumannii
tctaattttgagatgataatgctcacattaaaacaattccaatatttcataaaaattgttgaagaagggagttttaccgctgcttccgaaaagctatttattgcccagtctgctttaagtcgacaaatgaaactattagaagaagaaattgattttcagttgtttgatcgcacggataaaagagtaaaacttacggtagcaggagaggtcttctataagaaaataaaagataacttgctttatttaaatgaaattattgatctatctaaaagtgtttcggaagggaaaaatcgacagattaaaattgctcattccagcagtattgtcgtggataatacaaaggtgcagatattaaaagaagttagcttaacgcagcagttgagctttgagatcaataccttgtcatccgagcagcaaatcttagcgttattaaatggtgaaattgatatcggtttgatccgcccaccagttcggcatactttagatggtataaatactcttaagttatatgaagagcctttaatggtggctgtgcatattgatcataccaagtttgctaaatcagaaaaggtttatttaaaagacttaaaagatgagtgttttgtatcaacacctcatgctgaaagaggaggcttaagttatttggtcgcaaatctgtgtttagccgcaggatttaccccacaaaaaacctccattcagtcgcgtaagatttcacagttacagctcgtggcggcaaatttaggggtaggtattgttcctgcggagtttcaacaaatcttacctgccaatgtaaaactaatacctttggaagattccctatctctttcggaagttttgctggtctatagaaaggaccatgatgaaatcattcagcactgcgccgagcaaattcatcaaatgtttctatcttag

SEQ ID NO: 3924 - DNA, 1467 bp, Acinetobacter baumannii
gagggctttgacatggaatttattcaagcaaatgcaaactggttgtaccttataggcgcaattctctttatcttgacgcttcgcggtctatctggtcctaaaacagcaattcaaggtaaccgttacggtatgatcgcaatggcgattgcagttgtaacaaccttctttgttgccaataacccggttatttggatgattggtggtgcaatggtgcttggtgcgattgtgggtattgcacgtgcacgtactgtaccaatgactcaaatgcctgaaactgttgcacttatgcactcattggtaggtttggctgcggttttgattgcagttgcagcaattttgcataacaaccagcttacagcattgtttgctcaaaatgaggcggcattaacagcggctggcgtgcaacatgcacacatgagcaaggttcacctatttgaattgtttgttggttgttttgttggtgcgattacctttacagcatctgtgtttgcttacggtaaattggctgcgaaaaaatgggctaaaacaatctctggtgcatgggttaaacctgttcaagcacttatctttgttgcgatgttggcttgtggtttctacttcttcacaactggcaatatgactgctttctgggcaatgaccgcacttgcacttgcatttggctgggtatggattgcaccagtaggtggtggtgacatgcctgtagtggtatcgcttcttaactcgttctctggttgggcagcagcaggtattggttttacccttgaaaacaacatgttgatcgttgcgggctcacttgtgggttcatctggtgcgattctgtcatacatcatgtgtaaagcaatgaaccgttcaatcatcaacgtattgtttggtggtgcaatgggtggtgcagcagtttctacagctgctaaaggtgaacaagttcagcgtaactaccgttcaggttctgctgatgatgctggcttcttaatgtcaaatgcagacagcgttgtgattgtaccgggttatggtatggcgcaaggtcgtgcacaaaatgctgtaaaagagttatgtgaaattctaaaagagcaaggtgttcgcgtccgtttcgcaattcacccggttgcaggtcgtatgcctggtcacatgaacgtattgcttgctgaagcagacgtagcatatgaagacatcttggaaatggatgagattaactcagacttcccggcaactgacgtagtacttgttattggtgcaaacgacgttgtgaaccctgctgcaaaagatgacccaggttcaccaatttatggtatgccgattcttgaagcacataaagcgcgtacaatcatggtgattaagcgttctatggcgacaggttatgctggacttgataatgacttgttctataacgaaaaaacaatgatgatctttggtgatgctaagaaagttgttgaagatatgacgaaagcaattaatggtacaggccactaa

SEQ ID NO: 3925 - DNA, 360 bp, Acinetobacter baumannii
gccccatttgataggaagtttaagattatggcacaagagttacttgcccaattacaagcaggcacagcaaaattttcagacgttttagcttatattgaagcatgctaccaacatactccaacagcttttcaaaatggcgcacagcataacgctgcaactgaaaatcaaggcagtgcgaaagttttctcttttgctaagttacaaggtttagaccaagcacaaactttaagtttatttgcagagcactacgcatctgtattagctaccccagagggaactgaccatcaaaatattcgtcagtttatgcaaaatggttgggatggtgtgaagtttgaaggtcaggctttaactgaaaaataa

SEQ ID NO: 3926 - DNA, 441 bp, Acinetobacter baumannii
cccatgcttgatgtaggaatgacagagttactctgttttgcaattattgcaattttagttttaggtccagagaagcttccggaagctgcacgctttgcaggtcgctggtatgttcgactaaaacgctatattacgaatctgcaaaacgagattgatcaggagctacgtctgtctgagttccgcaaagaaatgcaagaggaacttaaccgcattgaagcattggaacgtaaagtacaacaacagcttgaagaaatacaaaaacagcaggtttcagaatctttagaagcaactgaaacagctaaaacaacacaaaagcctatttggaaatgtactcctatatcgggccattacaaagtgccgtatctgactaaagttaagcctttggctcctcaaactgatatttcagaaacatctcctgttgaattgaagattgccgtatga

SEQ ID NO: 3927 - DNA, 225 bp, Acinetobacter baumannii
acggggcttgatttagaaaggtactccaagtcgttaaccagcttaaatcgctttgttcagggttatttagattgtccacacacttatccacctagttttccacacgcttgtccacatggttatagacaggcttatccacaccccaagtatttgttaattctaaaattagatcatttatcagcattttttatgcaattttatcctcagcaaagtaccctaaaatag

SEQ ID NO: 3928 - DNA, 558 bp, Acinetobacter baumannii
aagtcaactgaaacctatggagccataacaatgcagctatctaaattgcttgaccgctggtttccgcatccatttgtttcttttttgattatcatcttctggttaatgctcgcgcatagtcttgatgcgagcgacctgcttatggctgtagttttggggcttgttattccccgtctagttcgtccttttattaccagaaccccgcatatccattggaaacctgccataaaactgtgttttgttgtcttgtgggacattattatttccaattttcgggttgctaaactggtattagggtcaccgaaaaaattacatcctaaatggtaccgtgttccattagaaacagaacatgaacaagtaaactctttactggcaatgattattaccacaacgcctggcacggtctctgccggtattgatcaagagcgtggtgatattttggtccactctcttagcacagaaaatactgaaagtgatgtgcaagacatcaaacaacgctatgaggctccactcatggaaatttttgatgtgaaaagcaaatcggaggacaacgcatga

SEQ ID NO: 3929 - DNA, 2364 bp, Acinetobacter baumannii
atcaaatatgaaggaggtttatatatggaccattatcatgaaaagaaaactataaatgacacgcataacgatcctgtctgtggcatggctgtaacagaggagtctaaatttcatgaacaagttggcaataacaccttttacttttgtagtgaaaaatgtcagataaaatttaagcatgatcctgctttgtatcttgctaaagaagatggatctgctttcacaaatgtctctctaaataaaatggaggcacagtcaaatagtataaatacctcatcaatttatacttgcccaatgcatccagagatccgacaaaatcatcctggtaattgccccatttgcggtatgacattagagcctttgcttccaaatttagatgaagtagatgaaaatcctgagctcaaagattttaaaagaagattttggtacaccttaccgttgaccctaattgtagtatttttggcgatgtttggtcatcaactgaattggtttgaaatgaaggtgcaaagctggattgaacttgtccttactttaccaatcgttttttgggcaggttggccattttttgtaagatgttggcagtcaattttaaatcgtagtcctaatatgtggactttaatcggaattgggactggggctgcatttctatatagtctcgttgggactttggccccacaagtatttccagattcttttatttctatggggcgtgtcgctgtatattttgaagctacagccgccattatttcactgaccttattaggtcaagtacttgaattaaaagctcggtcacagacatcggcagcaattaagtctttacttgggctggctccaaagactgcaagaaaaattaacgaagatggtcgagaggaagatatcccactttcccatgtacatgttggagatttactgagagtgcggccaggtgaaaaagtacctgttgatggagtaattacagaaggttcaagttctattgatgagtcgatgttaacgggagagccagttccagtaacaaaacgtataggtgaccaagtaataggggcgacaatgaatatgaacggttcattagtgatgcgctctgaaaaggttggttcttcaacagtactttcgcagatagttcaaatggtggcacaagctcagcgttctaaagctcctatgcaaagaatggcggatcaggtagctggttggtttgtactggtggtgatcggtatatctattcttaccttttttggttggggaatatttggtccagaaccgagttgggtatacggtttaatcaatgctgttgcagttttaattattgcttgtccgtgtgctttaggattggccacgccaatgtcaatcatggtagcaacaggtcgtggagcatccaatggcgtactcttccgtgatgccgcagcaatagaaaatttacgtaagattgatacattaattattgataaaacaggcaccttaacagaaggtagcccctcatttgataaggtgtttgctttatctggatatgaagaaaatgaagtactcagattagctgccagcttggatcaaggtagtgaacatccgttagcagatgcaattgtacgggctgcccgtgaaagaaatcttgtactaacaacaccgacatctttcgagtcaagttctggaattggtgttaagggcgagttagaaggacaacaattatcattaggtaatacagctctaatggaacaacttggcatttcagttgatgcatatatccctcaagctgagcaattaagagcagaaggtgcgagtgttatgcatttggctgttgatgggaagctcgtagggttattggctgtttctgatccaatcaaagccagtacacctgaggctgtgcatgctctgaagaattctggtttaagaattataatggccacaggagatggtttaactactgcaaaatcagttggagctagattaggtattgatgaagtttatggagaagttaaaccggcagataaactggaactggttaataaattacaaaaagaaggaagaatggttgcaatggcaggtgatggcatcaatgatgccccagctttagctcaagcggatattggtattgcaatgggaacaggaacagatgtggccatgaatagtgctcaagtcactttagtcaaaggtgatttacgggggatagagatcgctcgttccctgtcagaggccacgattaaaaatatgaggcaaaacctgatgtttgcatttctttataatgctttaggcatccctttagctgcgggtattttatatccatttaccggttggctactttctcctatgatcgcagctttagcaatgagcctaagttcagcatcggttattggtaatgctttaaggctacgtagttag

SEQ ID NO: 3930 - DNA, 1008 bp, Acinetobacter baumannii
atttcttgtgaaaaaactaagctaatcggtcatttattaatcaaatttcgtaaaatttcaggtttaaatattagtatgaattctacacagcaatggcaaagtgtcacttggtttgaggtggatgagcatcaagcaggacaacgaatcgataatttcctgttttcacgtttaaagggtgtgccaaagagtcgaatttatcgtttgattcgtgaaggtcaggttcgcgtgaataaaaaacgtattaaagccgagaccaaacttgcaattggggaccagattcgtgttgcacctattcgctatgaacaaaaagatgaaactgctgttcctgtaagcgacagtgtggctcaaggtttattaagtcgtgtggtctatgaagatgaaggtctattagttgtaaataaaccatcgggtattgctgtacatggcggtagcggcgtggcttatggtttgattgaggcactacgcgcggcaacaggtaaaaagtatttagaactgattcaccgtattgaccgcgatacttctggcctagttatgattagtaagaagcgtagcactttaaaaatgctacaagatatgttgcgtgaacacaaaattcgtaagacctatgcagcgattgtaaaaggtcaggtgagtcttgataaacagctcattgatgcgcctttatttcgttatgagttagctaatggcgaacgtcgtgtacgtgtatctaaagaaggtaagccaagtaaaaccgaatgggtggttgcagagcgctttaaaaatgccactttagttcatgcatctcctttatcagggcgtacccatcaaattcgtgtacatggtttaagtattggacatccgttggtgggcgatgataaatatgggcataacactgcatatacgggacctgaagcacgccgtttgtgtttacatgccatgcgtttggatattccgggttatccaacgattgaagcaccgttgccagaagacatgacccagttattagaggctttgagagtagcaaaatga

SEQ ID NO: 3931 - DNA, 879 bp, Acinetobacter baumannii
ttcactcgtgagttttatacttggaatgttgatattcagaatgaatatgatgttcgtattaatacaccaattgctttaccacaaaaccgtccacatgcggatttagatgattggcaagtttggtttgtagggcatgctacggtactcattcaaattggaccttataactttattaccgatccggtatggtgtgactacgcaagtcctttacatggtcgtggtccacgtcgtgtatgcccagcgggttttgctttagagcagttacctaccattcacggggtattgttgagccataaccattatgaccacatggatttagcaacgcttgagtggcttcataagaagtttgctatgccgatttatacagggcttggcaacggattttacttacctaaagaattccatgtaattgaaatggattggtggcaggaaattccttatcacgaattaagaattgtttatacacctgctcagcatggctcggggcggggtttacgtgaccaaaataaggcactttggggcggtttttcggttttggcgaaaacaggacattgtttttttgcgggtgataccggttatgcgggccacttcaaacaaattcatacgcgctatggcgcgccgcgtgtggccttacttccaatcggagcttatgaaccccgtaaattaatgagctatgttcatatgaatccgcaagatgcagttcatgcacatttagatttacaagcacatcggtctgtggcaattcactatcgaacttttcagttaacggatgaagggcgtgaagatcctgaacatgcattagctcaagccattaaagcttcatcaaagcttgctaatcctttttattgcattcgagaagggcataaattgactgtctaa

SEQ ID NO: 3932 - DNA, 1923 bp, Acinetobacter baumannii
tttatgagtgaacaagcatcacaaaattatagtttccaagcggaagtagcacagcttttacatttagtgacgcattctctctattcaaaccctgaaattttcttacgtgaacttatctctaatgcatcagatgcttgtgataaattgcgtttcgaaggaattaatcatcctgaatattatgaaaatgaccctaatttacatgtacgaatcagcttaaataaagaagataaaactttaacgatttctgataacggtattggtttaagccaacaagaagccattgataacttgggtacaattgcaaaatcaggtactaaagatttcatggcaaaattgacgggtgaccagaaagcggatgctcagttaattggtcagtttggtgttggtttctactcaggttttattgttgccgataaaattacggttgaatcacgccgcgcaggtctagatgcttctgaaggggtgcgttggattagtggtggtacaggtgagtttgaagttcagcaaattgataaagcttcacgcggtactgacattattcttcacttgcgtgatgacgcgcttgattatttagagtcttataaagttaagcaaatcgttaataaatattctgaccacattagcttgccaattgaaatgcaaaaagaagtttggcaagaagaagaggttgctgaaggtgaggagcctaaaggcggccaaatggtcaaaacagatgagtgggaagcaattaactcggcaagtgccctatggacacgtaacaagagtgaagtgactgaagagcaatatgttgagttctataaaaacttaactcacgattttgaagctccgcttgcatgggcacataaccgtgtagaaggtagtacggaatatacccagttactttatattccaagtaaagcacctcatgacatttttacacgtgaagcaaaagcaggaattaagctgtatgtaaaacgcgtatttattatggatgatgcggacaatctaattccaaactatttacgctttgtacaaggtgtcgtggacagcgctgatttaccgcttaatgtcagccgtgagttgttgcaagaaagccgtgatgttaagacaatccgtgaaggtaacgcacgccgtgtactcactttgcttgatggcttagctaaatctgaagatgagaaagaccaagaaaaattcaaaacgttctacactgagtttggctcagttcttaaagaaggtttgggtgaagacttcggtaaccgcgaacgtattttaaaattattacgttatgcaacttcaacaaatgatgaggtaacaacttcttttgcggactataaggcacgcatgaaagaaggccaaaaagctatctattatgtgactgctgaaagtttagctgctgctaagaactctccacagttggagttgtttaagaaaaaaggcattgaagtattattaatggcagagcgtgttgacgagtgggcaatgaactttgttcacgagtttgacggtacgccattgaagaatgtatctaaaggtgcagttgatttaggcgacttgcaagatgctgaagagaaaaaggcacttgagcaagcggctgaacagtttaaacctgttgttgagaaattaagtgattcattgaaggctaaaaccaaagaagtccgtgtaacgactcgtttggtagattctccggcatgtttagtgactagtgaaggggaattgtctcctcaacttattcgtatgctcaaacaagcggggcaagccgtacctgaaatcaagccaattttagaaattaatcctgagcatcctttagtgaaaaaacttgaaggttcagaacaatttgatgatttggcgaatgtgatttttgatcaggcggtgattgcagaaggtggattaccggaagatccggcagcttatgtgaagcgcattaatagcttgttgctaaaataa

SEQ ID NO: 3933 - DNA, 849 bp, Acinetobacter baumannii
accagcttcgacacctgccgtaaaaagtaccagctaatgcatctgtttgatactcacacccattttgatgttgccgattttgatgaagatcggcagcaattagcacttgaagctaaaaaagtgggtgtggatgctctggtgttaataggctttttacagtcacgttttgatgagttggtacacactcatcatcagctcaagcagtgggagaatgtacctacttcttatttagcaccggggttgcatccgttttatattgagcagcacaaaccagagcatctttctcatcttgaacagattttgcagcaagaagagtgcgtcgcaataggagaaatcggcttagataccttcttaaaggaacacaagcagcccgatatatatgccaagcaaaaacagtattttgctgatcagttagatctggcaactcaataccaaaaaccggtgttgcttcatatacggaaagcacatggtgatgtgctcgcactattaaaagcgcataagtttaaactcggtggcattgctcatgcctttagtggtggagtagaggaggcaaaaggcctaattaagcttggttttaaaattggtgtgacgggacaaatcacgaaccccaatgcgaaaaagcttcatacggttgtgcaggctataggtgccgagcatttagtgattgaaacagactgtcctgatatgacgccactttgctgtcaaacttcaactgagcagcgtactcgaaatacgcctgtgaatttaccttatgtactaaaaagtttggctgaaaatttaaatatggcagagtcagaattagcagatttgctgtggaaaaactctttatctgctttgaaattatcgtaa

SEQ ID NO: 3934 - DNA, 861 bp, Acinetobacter baumannii
tccgaactcgagagtgttatgcgtgcatatttagaccttctacaacatatccttgataatggcggtgacaaaggcgaccgtacaggcacaggaacccgttctgtatttggtcatcaaatgcgttttgatctctctaagggttttcctttactcaccacaaaaaaagttcactttcgttctatcgtgattgagttactttggttcttaaaaggcgatactaacgttaagtacttacaagacaataaagtcaccatttgggatgaatgggcaacagcagaacaaactgcccgtttcggccgcccagaacatgagcttggcccagtttatggccatcaatggcgtaatttcggcgcaactaaaaatgccgatggtacttataaccaagatggttttgaccaaattaaatggttaattaatgaaattaaaaccaacccaaattcacgccgtttaattgtctctggttggaacccaaatgaggccggacaagttgctttaccgccttgccatacactcttccaattcttcgtacaagacaacaagttgtcatgccagctttatcaacgtagtgctgacgtattcttaggcgtgccatttaatattgccagctatgccctactcacccatatgattgctcaagtgtgtggcttaggtgttggtgattttgtttggacaggtggcgatacgcatctttatgccaaccattttgagcaggcaaaactacaattgacgcgtgagccattaccactttgccaattaaaacttaatccggatgttaaagatattttcgacttccaatttgaagacatcgagattgtaggttacgagtcacatccggcaattaaagcaccagttgcagtataa

SEQ ID NO: 3935 - DNA, 864 bp, Acinetobacter baumannii
gcaaaatgcctaaactttattgctaatctggatgtgtatatgactcttgtttcagttgttcaaatgaattcccaagatgacattgaaagcaactttcaagtaattgagtcattgattcagcaaagcaaggctcaaaatgccagcttaattgtttttcccgaaaactttgtttgttttgcggctggcaaacagcgtgaaacagcagagcaatttgagtcgattcaacaaagacttgagaaacttgcgcatcagtatcaaatctggattgttgcaggcactctaccgtgcccatttcgtccggatggttccatcatacaagatggtcgagtgcgcacagtgagtttatgcatcagtcctgaacgtaccgaagcacgttatgacaaaatacatttatttgatgtacaagttggcgatgctgtgggtggatatcaggaatctcgtttctttgaaccaggaacagacgttgtagtcacatctaccccttttggcaatattggcctaatggtatgttatgacttgcgttttcctgagttagctttaacccttagacagcaaggtgctcatctattaactgctcctgctgcatttacctatacaacaggtcagatgcattggcagcttttgctgcaagcacgtgcaatggatagccaatgctatgttttaggggctgcgcaacaaggttggcatggggaaaaacgccaaacttgggggcatgcaggagcaactgatagtcgtggtcaagttttaagtatgattggttatgaagggaacggtttaattacggtaccttttgatttagctactcaagaacttgtgcgtacatcaatgcctttaatgatgcatcgtaaattaattcactattaa

SEQ ID NO: 3936 - DNA, 198 bp, Acinetobacter baumannii
gctgagcgcgatctgataagtgaaaatagggaacttacaaattttagtgcgttgtctaagcatgagaaaactaaggtgatatcactttatcaagttagacttcgcgataatgcggaatgttttcataaaaaagtagttgcaaatgaaaacacttctcatttattattgtggcactttattgttctatccgatgtttga

SEQ ID NO: 3937 - DNA, 543 bp, Acinetobacter baumannii
atttcattagattacggtttagagaataagattatggcatggcaaaatgtagaagttgtccacgttgtcgcaatggacaaaaatcactgtattggtaaaggcaatgcgttgccatggcatatctctgccgacttaaaacactttaaagaaatcacacaaggtggtgtggtgatcatgggccgcaaaacgcttgagtctatgggccgtgctctaccgaaccgtgtgaactgggtaattacccgtgacattaactggcattttgacggcgtaaaaattgcgtattcaattgaagatgctttaaatgctgctttagaagatgccaaaaacaccgaaaagcaagctttattcattattggtggtggtgaaatctttaagcaaaccttgtcaattgcagaccgtcttgagctcactcatgttgacttagatgtacaaggtgatgcacattatccaacaataccgagtgaatttcacaaaactgcaagcgaacagcaagtagatgaaaaatcaggaacttcattcgaatttgccacttataaaaaataa

SEQ ID NO: 3938 - DNA, 3198 bp, Acinetobacter baumannii
catttccaagatgtctatgacatctatgaagaactaaacgggaggacgattatgattgcccgtgttattcgtttttcaattgcgaatcgtgtatttgtcctgttagccgctttaattctggctgcttggggaacttgggccgtaaagaatactccggtcgatgcattaccagatttgtctgatgtacaagtaattattcgaactaatttttctggtcaggcaccacaaattgttgaaaatcaggtgacctaccctttaacaacaaccatgttatcggtaccgggtgttaaaactgttcgcggttattctttttttggtgactcatttgtttatgtcatctttgatgaacatactgacctttactgggcccgttctcgtgtattggagtatctaaatcaaattcaagggaaaatgcctgcaaatgcgaaatcttcattgggaccagatgccactggcgttggttgggtttatgaatatgcattagtagacccaacaggacagcatgatctttcggagctgagaagcatacaagactggtttttaaagtatgaactgaagacattacctaacgtggctgaagttgccacaattgggggaatggttaagcaatatcaggttgtcttagacccaagcaagatggctactttaggtgtcacacaaaacaatgtcattgaggcgattcaaaaagctaatcaggaaactggtggttcagttctggaaatggctgaaacggaatatatggtgcgggcttctggttatttaaaaactttagatgattttcgccaaattcctttacgaacaaatagtttcggtgttcctgtttctttaggtgatgttgcaactattcaacttggtccagaaatgcgtcgtggcatcagtgaattgaatgggcaaggtgaaacggttgggggtgtcgtgattttacgagcaggtaaaaatgcacgtgaaacgattactgctgtgaaagcgaagctagctgaattacaacaaagtctaccgaaaggtgtacaagttgttcctgtatatgatcgcagtcaattgattgatagagcagtagaaaatctcagccataaattaattgaagagttcattgtggtggctttagtctgtggactcttcctctggcatttacgttcagcaatggtggctattgtttctttgccgcttgggattttatctgctttcttggtgatgcattatcaagggctaaatgccaatatcatgtcgttgggtggtattgctatcgcgattggcgctatggtcgatgccgcaattgtaatggttgaaaatgcacataagcatatcgaaacttggcaacacgaacatcctgagcaagtcttggaagcacaagtccgttggaacatcattacacgttctgccagtgaggtcgggccaactttatttttctgtctactcatcattaccttatccttcattcctatttttactttacaggcacaagaaggtcgcttgttctcaccactggcatttactaaaacctatgcaatggcagcagcagcaggtttatccattaccttgattcccgttttaatgggttattggattcgagggaaattaccttctgaacagcgtaatccactgaaccgttttctgatcaaaatatacagccctatgttggataaggttttagctcatccaaagacaattttacttggtgcattgctaattttccttattagtcttttccctttaacacggttaggtggggagtttctacccaatatggatgaaggtgatttactgtatatgccttcagctttaccgggattgtccgcagcaaaagcttctgagctactccaacagactgatcgaatgattaaaaccgttcctgaagttgcaacagtattcggtaaagctggtcgcgctgagtcagccacagattctgcaccattagaaatgtttgaaaccacgattcagttcaaaccacggtctgaatggcgttcaggtatgacacctgacaaattgataaaagaactagataaggcagtccaagtaccgggtttaacaaacatttgggtgccacctatccgtaaccggattgatatgttggcaactggggtgaaaagtccaatcgggattaaggtttcagcaaatgatctgcaagatattgatcgggtagcacagcaaattgaacaagtggctaaacagatgcccggtgttagttcagctttagctgaacggctcacaggtggtcgatatgttgatgttgatattaaccgtatgcaggctgcgcgatatggtctcaatattaaagatgtacagcaaatcgtctcatcagcgattggcggggaaaatattggtgaaactgttgaaggcttggcacggtatcccattaatgtacgttacccacgagagattcgagattcactggaagccttaagaaatttaccgattctaactgaatctggtcaacaaatagtcttgagtagtgttgcgaatattcaaattacagatgggccgccaatgcttaaaagtgagaatgcccgtccaagtggttgggtctatgtcgatgtacaaggacgtgacttagcttcggttgtacaagatttgaagcaggccatagaccaaaaagtaaaacgttcttctgccatgagcattagctattcaggacagtttgagttcatggagcgtgcgaatgctcgcttaaaagttgttattccaattactttgatgatcatttttctattgctctatttgatttttaggcaagtacaagatgctgttctgattatggcaacactaccttttgccttgattggtggtatttgggctatgtacttgagtgattatcacttttcggttgcgattgctgttggttttattgcacttgctggtgttgccgcagagtttggtgtagtcatgttgttctatttaaagcaagcaattgagcatgcacagcaaagcctatcttcttcaacggcatccttaacagagcaacaactcaatgaggcaattcatacaggggccgtgctacgtgttcgccctaaagcaatgacagtcgctgtcattttggcggggttaatccctattctgttggggactggaacaggttctgaattaatgagtcgtattgctttacctatggttgggggcatgatttcagcccctctcttatctatgtttgttatccctgcggcatatcagcttttaatcaaaagaaaactatcaaagaattga

SEQ ID NO: 3939 - DNA, 561 bp, Acinetobacter baumannii
atgatgaaagacgaaaaatttctaaatgacttaattcaaaaaatacagcaaggtcaccagttcaaatatttatatttctggggacatactcctaagaaagctaatcttattgataaaagctgttttagccagtggtttcctgcgcaatttaatgtagaaggtattgaatactttactgctgagcactatatgatggcgcaaaaagcaaaattatttaatgataaagaaatttttgcacagattttgcaggttaaacatccgaatgaagcgaaacaattaggccgtaaagtacgtaattataatgaacagatatggcaagaaaaacgttttgacatagtggtgcaggcgaattttgctaaattctcacagcatccggagttaaaaaaattcttattagcaacaaaagaccgtattttggttgaagcatctccagtcgataaaatttggggtgttggtatggcgcaagaccatccacacattcaagatccatctctatggcaaggactaaatttgttgggttttgctttaatacatgttcgagagttacttttaactgagtag

SEQ ID NO: 3940 - DNA, 1311 bp, Acinetobacter baumannii
ggtatcgaagatatggcaaagaatgcaagttcacctggcaaacgatttatgaaacttgcaggaatgaccgcgagcattgcaacaaaaaccgtttctaactcgattcgaaacctgactgcggatgaagaacagaaactggctgcaaaaacaaaattatttcaagatatcggacttcaaattgcagacaccttgggagaaatgaaaggtgcggtcatgaaggtcgggcaaattgcatcgcaatataaagatatcttcccgcccgaagtcgccaaagcgatatcaaaactacaacgccaagctccagctatgccttttgcagcgattcagcaacaagttgaacgtgagcttggcaaaccactgaatgttgcctttaaatcttttgaacaagaaccttttgctgctgcatcgattgggcaagttcacaaagctgttctgccaagtggcgaacaagttgtggttaaagttcaatatcctggtgttgatgaagcctgcgaaagtgacttaaaacaagtacgtttagcccttcgcttaatgggtgtacttaaaattgataaaaagctacaagatcagctttttgcagagattcaagatagtctatcagcagagcttaactatgaaatcgaagctcaaaatcttgaggtctttaaaacttttcatagtaaattagacgacaaaattattatcccgactgtttataaagattactcttcaagacgtattttaaccttaagccttgaacaaggtgacagcattgaaactgctagttcttggcctatcgaaattcgaaacacaattggccgtcgtctaatccgcgctttaggtcaagaaatgttctttttaaaacgtttccactgtgaccctcacccaggtaactttgccttccgccaagatggtagtgtgattatttatgattatggcagtgttaaaacactttccaatgaaattgtgtatagtttcaaacgactggtgaatgcagctcgccatgaagatatcgacttaattgaaacagaattactcgaactacattcattagcagaaaaaggtaaattcccgagcgagctttataagctctggattgaagtgttattgcgcccgcttaccacaacctatgattttgcagagaactcatcacatcatgatggcatgctactcgtgaagaaatctttaaaatattgggatgtctttaagccttcaccagatacattaatggtcaatagaaccatttcaggacactactggaacctcattcacttaaaagtgcatgacaatcttaacgatctatttgaagagcttgtaccactttctaattaa

SEQ ID NO: 3941 - DNA, 342 bp, Acinetobacter baumannii
ataagacgagagatgcaaagtgcaagggtgctttgccaccatgttgaaacatggaggaagtatatgtctatacagcaattgaaagagttatttggaaatcaagaagcagtgttggaattagtccaactagaaggtggtgagctcgccttgcgtaatgctggttctgaaaaagagcccttggttaaaattcagtttagtgatgaactaaaagcaatattaggtgaacagacgcctatagttgcacaacatatgattcaagctgctttgtttgggctgttagaaaagcaggtcaatgaatggcaggctgaagttgtggatgagcagcctaaattcttaagttaa

SEQ ID NO: 3942 - DNA, 1731 bp, Acinetobacter baumannii
atcacgttggaacttttatctggtggtgaaatgctcgttcgcgctcttgcggacgaaggcgttgaacatgtttttggttatccaggcggcgcagtattacatatttatgatgcgctatttcaacaagacaaaatcaatcattacctcgtgcgccatgagcaagctgctggtcatatggcagatgcctactcgcgtgctacaggtaagactggcgtagtactggtcacttctggtccaggcgcaaccaatacagtaactccaattgcaacagcttatatggactcaatcccaatggtggttttgtctggccaggttgcatcacatctgattggtgaagacgctttccaggaaactgacatggttggtatttcacgtcctatcgtgaaacacagctttcaggtccgccacgcaagtgaaatccctgcaattattaaaaaagcattctatatcgcatcaagtgggcgccctggtccagttgtagtcgatattcctaaagatgcgactaaccctgcagaaaagtttgcatacgaatatcctgaaaaagtgaagatgcgttcatatcaaccaccttcacgcggccactctggtcaaattcgtaaagcaattgatgaattactaactgcaaaacgtcctgttatttatacaggcggtggtgtcgtacaagggaatgcttctgcgttattaaccgaacttgcgcatttacttggttatccggtaactaacacacttatggggttaggcggattcccgggcgatgacccacagtttattggcatgttgggtatgcacggtacatatgaagccaatatggcaatgcaccatgcagacgtaattttggcgattggtgcgcgttttgatgaccgcgtaacaaacaacccagccaaattctgcccgaactcaaaagtgattcatgtcgatatcgaccctgcaaccatttcaaaaacgattatggcgcatattccgatcgttggtgcagtagagccagttcttcaagaaatgttggcacagttaaaacaattaaatgtgtctaaaccaaatcctgaagcaattgcggcttggtggtctcaaatcaatgaatggcgcaaagttcatggtttgaaatatgaaaatccatctgatggcactatgaagccacagcaggttgttgaaactttatataaagtgaccaatggcgatgccattattacttctgacgtaggtcaacatcagatgtttggtgcactttattataagtacaaacgtcctcgccaatggatcaactcaggtggtcttggcaccatgggtgttggtttaccttatgcaatggctgcgaagcttgctttcccagaccaacaagttgtttgtattacgggtgaagcttcaattcagatgtgtattcaggaactttcaacctgtaaacaatatggcttgaatgtaaaaatcttgtgcttgaacaaccgtgcattaggtatggtgaaacaatggcaagatatgaactatgaaggtcgtcattcaagctcttacgttgagtcattacctgactttgccaagttaatggaagcttatggtcatgtaggcattcaaattaatcatgccgatgaacttgaatctaagcttgcagaagcaatggcaatcaatgataaatgcgtatttatcaacgttatggttgaccgtagcgaacacgtttatccaatgcaggttgcaggtcaatctatgcgtgatatgtggatttctaaaggggagcgcatttaa

SEQ ID NO: 3943 - DNA, 273 bp, Acinetobacter baumannii
atgaagcttttaggtcttgaaaaaataacagtgattgagtgtgagtttgctaaaaaatggctcataagttggatctctgaaatacgtgatgctcattggcggggcgcggaagatattctgaaacaatttccaaaagtatctattttggaaaatcaatgtttcgaattttcgatacataactctaaatgggttatttgtctacaaatcgcgttttctcaaagaatagcgattattaaagctgtaaacattaaaggtgctaacaatggaatttaa

SEQ ID NO: 3944 - DNA, 666 bp, Acinetobacter baumannii
ttcggtctggagcaagccatgaaagcttacacagttgaacaaggtatcgttgcaccattagatcgtgccaatgttgatacagatttaattattccaaaacagtttttaaagtcgattaaacgtacaggttttggcgacaacttatttgatgaacttcgttatttagacgaaggctatccgggacaagacaattcagtacgtccaaaaaatccggatttcgttttaaatcagcctcgctatcaaggtgcaaccgttttaattgctcgtactaactttggttgtggttcaagtcgtgagcatgcaccttgggcattaaacgaatatggtttccgtaccgttattgcgccaagctttgctgatattttctttaataactgttttaaaaacggtatgttgccagttattttgcctgaagacattgttgatcagttatttaaggaatgtgctgcgcaagaaggatatcaattaacaattgatttggctgcgcaagaagttcgtacaccaactggcgaagcatttaaattcgaagtagatccatttcgtaagcattgcttgttaaatggtttggatgatattggcttgacacttcaaaatgcggacgcaattcgcgcttatgaagaaaaaaccaaacaggttcgtccttgggtattccaagagataaattaa

SEQ ID NO: 3945 - DNA, 798 bp, Acinetobacter baumannii
ggccgtatggaaataaatcctaattcacagcagccaactggctcaagcttaccgacttctgctttaggaaatattcaacgtcctggtgagtatttacgtcaaattcgtgtttctcagaaaaaagaattagagcaagtatctttagatttaaatatgccgctgaaaacgctcaatgcgttagagcaagacgactataaatctttgccagaagcgacttttatcaaaggctattatcgttcttatgcgaagtatttaaatactgatgcaactgcaattatccagcgttttgatgagatttatgcaaacgatactgggcttttgccaaatcatgctttaaacaattcaccaattaaaatcatgggtaaattaccgggttctaatagtgatcgtaacaaaaaatggttaaagcgcgcactgcttgcaattttgattattgctgtcgtgtcattaattgtgatgggtgtccaaaaatggacctcaaacaaagaagatgctgagctgccaaaagcaaatcagtctaatgttgaagttttacctatgaaagggaacacctctgcaacagtgggtgaccaattggtgttaaactttaaccgtccaacttctgttcatattgtagatgcaacagggaaggttttagcgacgggtcgtcaggcatcgactttaaccttaaatggtgagtctccattccagattcgtcttgatgatgcaacggctgtgtcattaagtctaaaccaagaacagatttcattgtctccatatacggtaaacggtaaagctgaattccgtttatcccgctaa

SEQ ID NO: 3946 - DNA, 2703 bp, Acinetobacter baumannii
aatatgacggacaagtcgattaaagagttagctctcagcgtaggacgtcctgttgagaagctcctagaacaggctcgtgaagcaggtttgcctcaacgtacagcagacgacattattaccactgaacaacaggacactttagtcaattatttgaaaaaggtgcatggtcaggaaagtggtaacacaggaaaaattgcgttgaaacgtaaaacaaccagtaccgctaaagttgcaagtacttcgggtaaagcaaaaacaattaacgtagaagtacgtaaaaaacaggtttttgctaaaccaaacccagaacaaattgcagcagaagctaaagcgcgcgcagaagcagaagctaaagcgcgtgcagaacaacaagcgcgtgaagctgcagagcaaaaagcgcgtcttcaaacagagcaaaaagcaaaagcaactttagatgcaatgcgtgctgctcatcaacaagatagcgctgcacagtcagctcctaaagctgctgttgtagtgaaaaaacgtggtggtggtacagtaaaacctgcaccaaaaccagcagaaacattagagcaaaagaaagcgcgtgaagcacaaacagctcagttgaaagcaactgaagaagctgcacgtcgtaaagcggctgaggaagctcagcagcgtacgcttgaacaaatgcgtaaaatggcatctaaatattcaaatgatgatgctactgcaactattcgtgtgattgatgattctcctcttgcttcaggtcttgttggccaagcttatgaagattcatttaatcaagaagaccgtgaaattaaacgtggtggtgctacaactaaccctcgcgctggtaagaaaggcggtcgtcgtggtcaagaagagcaaagcttcgttaaccataacaaacgtggtttaaaatcaagccaagcgaacaagcatggttttgaaaagccagttaaaaagcaagtctatgatgtagaaattggttcaagcattgttgttgccgatcttgctcaaaagatggcgattaaagtacgtgaagttatcaagacacttatgaaaatgggtgaattggttaaccagaaccagacaattgaccaagatacagctgcacttgttgtagaagaaatgggtcataaccctgttctagtttctgatacacaagcagaagataacttacttgaagcagctgaagaagcacgtggtgagcaaactactcgtcctccagttgttacaatcatgggtcacgttgaccatggtaaaacatcattgcttgaccgtatccgtcgttctaaagtggcggcaggtgaagcaggtggcattacccagcacattggtgcatatcacgttgaaacagacaaagggattattacattccttgatacaccgggacacgcagcatttacttcaatgcgtgcacgtggtgctaaagcaacggatatcgtggtattggttgttgcagcagatgacggtgtaatgccgcaaactgcagaagcgattgaccatgcacgcgcagcaggaactccaattattgttgctatcaacaaaatggataaagaatctgctgatccagaccgtgtgttaaatgaattaacaaccaaagaaatcgttccagaagaatggggcggtgatgttccggttgctaaggtttcagcacatactggccaaggtattgatgaactccttgatttaattctgattcaatctgaattgatggaattaaaagcatctgctgaaggtgctgcacaaggtgttgttattgaagcacgtgttgataaaggccgtggtgcagtaacttcgattcttgttcaaaacggtacattaaatattggtgaccttgttcttgctggttcatcatatggccgtgttcgtgcgatgtctgatgaaaacggtaagccgattaagtcagcaggaccatctattccagtggaaattttgggtctaccagaagctccaatggcgggtgatgaagttcttgtagtaaatgacgagaagaaggcacgtgaagttgctgatgctcgtgcagaccgtgaacgtgaaaaacgtatcgaacgtcaaagcgcaatgcgtcttgaaaacatcatggcatctatgggcaaaaaagacgttcctacagtgaacgttgttttaagaacagatgttcgtggtactttagaagcattgaatgctgcattacatgaactctctactgatgaagtaaaagttcgcgtaattagttctggtgttggtgcgatcactgagtctgacgtaattcttgccgagtcttcagaagctgtattgttaggcttcaacgttcgtgctgatacagctgctcgtcagaagagtgaccaagacggtatcgatattcgttactacagcatcatctatgaattgattgatgatgtaaaagatgccatgagcggtaaacttgctcctgaacaccgtgaaactatcttgggtgttgctcaagtacgtgaagtgttccgttctagtaagtttggtgctgctgcgggctgtatggttatggaaggcgtgattcaccgtaacaaaccaatccgtgtcttacgtgatgatgttgtgattttccaaggtgaacttgaatcattacgtcgttataaagatgtcgttgatgaagttcgtgccggtatggaatgtggtcttgccgtgaaaggttataacgacatcaaacctcttgataagattgaggtttatgatgttcaaatggttaaacggagtctttaa

SEQ ID NO: 3947 - DNA, 453 bp, Acinetobacter baumannii
ttttctgaggaatatatggaccaagactgtcaaaatctaaagcttgagaatcaattatgtttcctcatttactcaacaaatttagcccttaatcaactttatcgcaaacttttaactccattagggattacttatcctcaatatttggtgatgttggtgttgtgggaaaaagatgagattactgtttcagaaattggcagcaagttatttttagagtcttcaactttaaccccaattttaaaaaagttagaagcattgcagcttcttaatcgtactcgttcaaaagaagatgaaaggcaagtcattatcacgcttagcgaaaaggggaaaaaacttaaagaacaggccgtaaatattccaacgcatatcttagaggccagttcttgtgatacggctacccttctcggtctcaaagatcaattaacacagctccgtacaaatatagctaaataa

SEQ ID NO: 3948 - DNA, 1266 bp, Acinetobacter baumannii
tgcgggctttttttatggcatgatgcaagtaatacatcaatagatcgacatggtatgcaggtttattatttttatcgtcatcaaagcgacggctatgtttttttaagccgtgaaaagcacactgaacatattctggagtttttctggattgatagtgtgagatcggatgttgtgagccagaatgaagaatggcaacaaaaaattcagcaacttgcagatgtatccattaatgagtttcatatgcgagatattgcgaatatcgaacatccttgtgcatttgatacgcttgaagaatacgacctgcttatttttaggaagctcgtaacgccggatgatgaaattaaaaatggcgaatcacatgagagtgtgtttggtttagccaccacaccaatcagttttatttttacgcctaaagtacttattagcgtacgtgagcagggcaacaagtcgattgaaaactatattcagcgtcttgaaaatattttatgtaaaactctcgaagagcaaaataaaacccgtaagctgcctaattcacctgtagatctgtgtttacgtctgctcaatagtatggtggatggttatcttgatattcgttcacctttgaccagaagggtcgagcattggcaacaacagctattacaagggaatcggcggtttaaacagtggcatcaattgtttcatgaaaatatggcctttcagcaggtcgaaaatttatgtgaagaacaaattgaaaccttacaagagtttcgtgatgaaattgtagaaaactatcatcatgttattggagagaagacgcatagttctcaagaccttttattagtgcgtttaaacgatttaatgagtcatgtcgaacgtattcaaaaacataccttgcgtttacgtagtgcgattcaatcggcaatagatttgcatttctcggcaattgctaaccagaccaatgagaacatgcgtattcttgccattattactgctgtgtttgcgccacttacgcttttaacgggtatttatggaatgaactttgaatttattcccgggcttaaatcaccagtaggtttttggattatgcttggggttatgctgctaagtaccattttattgctctactatttttatagacagcatttggtggggcgtggtgaaaaaagtgtgattgatttactggcgcagcagcatcgccaagatcgtatgaacttgttttggtttttggaatatgaaccgattaagcaaactttgaaggaagtggaaaagattactcggttgaagtaa

SEQ ID NO: 3949 - DNA, 1938 bp, Acinetobacter baumannii
aagaaaagttttaaaagcatggtgaaccatgaaaactattggactttttgcccacacaaccttttttggattgatcgaaaaataaataggattgatatgagccagacaacacagaccgatatcattacgcttggtgatgttgccacaagacttcctagcttcattcccaaagtaccccatatcctaaatggtcttaaacaggcttatttaagaacttcaaatactccaacaggtttgggtattgcttttgaaaaagctgttaaaagaaatccgaaaggcacggcattattatttgaagatcaaagttattcttatgaagctttaaatgaatgggcaaaccagatttcccattactatctttctctcggagcgcgtaaaggggacgtcattgctgtaatgattgaaaaccgctctgagctgattgcaacaattgttggtttagccaaaattggtgtgacaattgcacttgtaaatacatctcaagtcggtaaggttctcgctcatagcatcaatcttgtaaaacctattgccgttattgctggtgaagaagtccgagctgctattgatgaaattcgccaagacttaaatgtacctaaagaccgctttcactggttcgcagatcaggcaacacgtcaaaactcgggtacagcgcctgaaggctatgtcaatcttgcagaccaaattgatcaatttccaaaattcaatccgtctactacccgctctgtcactggtaacgatggtctgttctatatctacacatcaggtacaacaggtttaccaaaggcggttattttcaagcacagtcgctggacattagcgtatggcacctatggtcatatcttaaacttggggccagatgacgtcatgtacgtgaccttaccgctttaccatgcaacaggcgtggtagtttgctggtgtggcgttatcgcaggcagtgcaacacttgcgattcgacgtaaatattcgactagcgcattctggaaagatgttcaaaaatttaatgcatctgccattggttatgttggtgaactttgccgctacttgatggatgctcctgtcaccgagcttgaccgcaaccatcgtgtaaccaaaatgattggtaatggtatgcgcccaaatatctgggacaagttcaaacaacgctttggtgttaaagaagtacttgagctttatgcatcgagtgaaggcaatgttggatttagtaatattttcaactttgacaatacggttggcttctctcctactccatatgccattatccagttcgataaagagaaaaacgagccaatacgcgataaaaatggctggtgccagaaagtaaaagcaggtgaagttggcctactcatcgggaaaattaccagccgctcgccatttgatggttacaccgaccctgaaaagaacaagtctgtgatctggaaaaatgtcttcaagaaaggcgattcttatttcaacacaggtgatttggtccgtgatatcggcttccgtcatgcacagttcgttgaccgtctaggtgatactttccgatggaaaggtgaaaacgtatcaacgactgaagttgaaaatatggtatgcgaatacgacaaaattgccgaagctgtcgtttatggggtagaaattccaaatactaatggccgtgccggtatggcagcgatcactctcgcagatggtgaagagctaaatgatgctgatttaaccgaaatggtgaccgtatttaagaaatgtttacctacctatgcagtacctgtatttttacgtgtacaaaaaaaggtcgaaacaacaggtacatttaaatatcagaagaataaactgaaggaagaagcgtttaatccaagcaaaacttctgaacgtttactcgctttattacctggtgcaagcagttattgtgatatcacaactgaaatttttgacaatattcaggcgtataaataccgtttttag

SEQ ID NO: 3950 - DNA, 795 bp, Acinetobacter baumannii
atgtcattactgcaactatgggaagatgtaaaacaaaatgaatggattgatatacctgcaggatggttacagggccgcaccgtttttggtggccttgttgctgggttattaatgcaaaaggcatgctcctatattcaagattcaaataaaagattattaagttgtagtgttacttttgtaggccctgtacaacaaggcgctgcccgattgactattgaagttttaagagaaggaaagtcagtcactacgcttgaagcacgtttatggcaagatgatgcagtacaaacgattttggttgcaagttttggggcttctcgtgcatcgagtattgaggtaaagcaagagccagtcgtccctgcttatgtgccacctgaaaacttatctgtcattccttttgcgaaacatatgcctgaatgctttcagcattttgaagtctgttgggctgaggggaattatccggtaacgggaagtaaacaccccgactttggtggctggtcaaggttctcaccagagcagcatgcgaatcgtcaaatgacattatctgatttgattgttcttatggatatttggccaccgggtgttttgcctatgtttaagcaagttgcacctgcaagttctttatcatggcatattacttatgttcatccagttcggcaccagttgtgtgactggtttaaatataaagtaactactgaatatgcagctgaggggtactccacagaatatgcatatctttgggatcaaaatgatcatttaattgcaatcttgcggcaaactgttacggtatttacctaa

SEQ ID NO: 3951 - DNA, 630 bp, Acinetobacter baumannii
gctttcatactttacaatagcaaagttaatcaaaaaatatctatgacggggcaaccaatgtcaaaaagagaaacgattataacaacagcaatgaccctttttaatcagaaaagttatacctctattggggtagacaaaattattgctgaatctaaagttgcaaaaatgactttttataagtacttctcttctaaagaagttttaattgaagagtgtcttcgccgaagaattttagaagtccaaacttctttattagataaagttaatagtgtagatgacccattaaataaactaaaaagtatttttaattggtatatcgactggattaacactgaagattttagtggttgtttatttaaaaaagcaacgatagaagtcctgcagctctatccttctattaaaaaacaagtaaataaataccgtgaatggatttacagtttagttttatctatatttttagagttagaaattgaagatccaaaagtattaagcagtctttttcttaacattatagatgggcttattattgatgggactattaacaaaccagaaattaactctgaagaaacatggtcttacataaataaactcattgagcttgaaacaaaacaaaaatatgaagctgcttaa

SEQ ID NO: 3952 - DNA, 522 bp, Acinetobacter baumannii
agaaaaggtttttccataaaaaaatttagctgctgcttttttaatctaatattaaatcgtgaatttactcttcttagctcattatttattaaaaattcattatttttatataaaacgatccattccaaattgcttatttataaagtttatttaaatataatcagtttacattggggaagaactgatatgaatttatcttatttaaaaacaagcctgtatacagccgctacaacagcgattttactttgctcaagtcaaagtcaggcacagcaatattataaatggatggatcaaagtggctcgacacattacaccacaacgccaccacctaaaggagcgaaacatttgaacaaagtttcgacttacggcagtcaaccattgttgaaaaatccaacatcaaactcagaacaaccatctcaggataaagataaagtcgtgcaagaagtaactaacgtagcagtggaaaaaggtgcacctgctgtcccggtcccacctgccccgtctgtatcggcaccaagataa

SEQ ID NO: 3953 - DNA, 921 bp, Acinetobacter baumannii
gacattttttggattagtcttatggaattacgccatcttcgatatttcattacagttgctgaagaattaaattttagtaaggccgctctcaaactctatactgctcaaccctcccttagccaacaaattaaagatttagaagaagatgtcggggtacgacttttaaaccgcacaaaacgtaaagttgagttaacagaagaaggtgaagtatttttagagcatgcccgtttaacgcttgctcaagctgataaagcagtagcgatggcccgccaagtctcaaaggctaaacaacaattattacgtatcggtttcgtccccatagcagaaatgaaaatttttccatacgtacttccaaatctgcgcttacaacaccctgacctcaccattgaattatcaagtttaaataacgctgagcaactcaaagccttaaaaagaggtgaactcgacatcacgtttacccgtgataatactgaaaatgatgaaatccaaagccaatttgtcttaacagaacctttaatttttttattaccaagaaaccatccacttgcgaaatatgaccgtattccggtcaaagctttgcatggtattgattttattattccggcagctgaacaatctaatacactacacaatacaattttagagtttactaaaactcatggtattgacctcaatattgtacaaaaggccgatagcattttacttaatataaactctattggttcaggcttaggttgtactattttacctgcctatgtcgcgcctttaggggtctctaacactgtagttcgccctctagatgtcgaattaccttctttagatttatttgttagttatcgtaaaaatacagagtcagtcggtgtaaaaagatttattgatcaactcaacaaagtatttcatcttgataaaaatctagattaa

SEQ ID NO: 3954 - DNA, 993 bp, Acinetobacter baumannii
gtaatgaaacttgactatttacaagccctcaaacgcattccggaagctcggggtgcgtggatcctgcatggacaggaacctttattagaacaaaatttactcgatactttccgcaaaagctggcagcaacaagacattgaaagacagcgctacgatattagtagtgtaagtgactggaaaaatgtctttaatgcactgaacagcttatctttattttctcagcaacttgcgattgaagttcacggcaatatcaagcccgatgcaaatggtctaaaacagctaaaaagttatatccagcataatgaaactaacctgctgttaattgttttacccaaacaagacagtagcagcttaaaatctgcttttttccaagttgttgaagcgaacggtgtggtggttgcccttactgctaactatccgcaagatcgtcaacgaatattagccgctgaggctgagaagttagaaattcaactcgacaatgatgcttggcagtggctcatgcagcatcatgagcataacctgctcgctgctaaaaatagcttgatgcgggtaagagatacttttccagaccagaaactgattcaaattgaacagttatatgcgtgtctacaagatcagtctcgttacaccacttacgatttaagcgatgcgttattagaaggtaatcttgctcagtccattaagatctttcaatatttaatcggttccggtgaaccggaaagcttgatcttatggacattaagtaaagaaatgcgtttattaatgcagttgtttgaacaaccacataatgcattacaactaggtatatggaaaacaaaagttagcttatatcaacaagcattaagaagactcaatccacagcaatttttgggatggtctgccctgcttttacaaattgatgccgcaatcaaaggcatgtcaaatgagaatgcccaacatttaatgcaacaagccattgccgagctgtgtggaaaaacattatttatacattag

SEQ ID NO: 3955 - DNA, 618 bp, Acinetobacter baumannii
aaatttatttgggaggttaagatggcttttattctgggaatcacaggtggtataggcagtggtaaatcagctgcaacacaatggtttgaatcccaaggaatccaagtcgtcgatgccgatattgttgctcgcgaagtagttgaaaaagggcaacctgcccttcaaaaaattcaacaaacctttggagattgggtgcttcaacccgatggcagtttggaccgccgtgccttacgtgaatatatttttcaaaatccacaagcgcgtcatacactcgagcaaattacccatcccgcaatccgtcaatctattattcaacagctacaaaatcctaaaagtccgtatgtgattttagtttcgccattattgtttgaaacaaatcaacatgaactggtcaatcacacgctactgattgatgcgagtgaacaaactcaaattcagcgtgcaagccaacgcgatggacaaaaccaagaacaaatccagaaaattattgctgcacaaatgccacgcgaacgaaaacgtgagcttgcaaatgatatcgtgtttaatgacggattactcgaacatttatatcagcaattagagcctctacatcaaagctatttgaagcgtgcaaactaa

SEQ ID NO: 3956 - DNA, 1335 bp, Acinetobacter baumannii
gattctatttgtggagagaatatgtccgaacatcctcaaggacaaaaacattgttcattttgcggtaaaacgcagtctgaagtcgggaaactgattgcgggcgaggacgcatatatttgtaatgagtgtgtagatgtctgcttagaccttgtacaaaccagccaacaggttgaagcaggtgactgggcgagcaaggcattgccaaaaccacatgaaatacgtgctgcgcttgatcaatatgtaattggtcaggatcttgccaaaaagacattatctgttgccgtttataaccattataagcgtttgaaagtcgggcaatctggtcatgtgtctaaagatgtggaaattgctaaaagtaacattctactgattgggcctaccggttcaggtaaaacattacttgctcaaacattggctcgtttgttagatgtgccgtttgcaatggcagatgcgactactttgacggaagcgggttatgttggcgaagacgttgaaaatatcgtacaaaaacttttgcaaaaagcagattacgatgtagaaaaagctcaaaagggcattatctacattgatgaaatcgacaagattacacgtaaatctgaaaatccatcgattactcgtgatgtgtctggtgaaggtgtacaacaagctttgcttaagatgattgaaggtactgtagcttcaattccaccacaaggtggacgtaaacatccgcagcaagagttcattcaaattgatacctcaaatatcctatttatttgtggtggtgcatttgctggactggaaaaaattgtacaacagcgtcaagagaaaggcggaattggctttacggctgatgttaaaaacaaagatgaaaccaaaaaacttgctgaattatttcgtcaagttgagccaactgatttggttaaatttggtttaattccagaattcattggccgtttaccagtgattgcaacgcttgaagagcttgatgaagaagcgttaatgcaaattctaactgaaccgaaaaatgcattaactcgtcagtatcaatacctgttcaatatggaaaatgttgacctcgtatttgaagattcagctttacgtgcagtggctaagcgtgcgcttgagcgtaataccggagctcgtggcctacgttcgattttggaaaatgttctacttgaaacgatgtatgatttgccaagccgtacagatgtaggaacagttttcattaatgaagcagttattaatggtgaagctgaacctgtctacaagtcagaacgtcagcctaaagaagctgtaacacatgaaagtgttgctaaggcagatttaaaagtaattgattcgaagtctgcttag

SEQ ID NO: 3957 - DNA, 543 bp, Acinetobacter baumannii
aaaagtgtttgtccccgtgatcgaagtcaacgatatagacaatatttaggtagccaaatgatcgactcagaaggtttccgacccaatgtcgggatcattttggcaaacgatgatggacaggttttatgggcaaagcgcattggtcacaatgcttggcaatttccacaaggaggcatccagtttggagaaacccctgaacaggcactttttcgagaactgagagaagaaatcggcttattgcccgagcatgtccagattattgcgcaaaccaaaggatggctgcgttatcgtttgccacatcggtatattcggtcagactctgaccccgtatgtatcggacagaaacagaaatggtttttactgaagttaactgcgcctgcaaaaaacattcagttaaacctcgccgacccgcctgaattcgatgaatggcagtgggttagctattggtatcctcttggtcaagtggtgaacttcaaacgtgatgtttaccgtaaagccatggtggagttgtgtacacagttgccagtgcaacaattaccctaa

SEQ ID NO: 3958 - DNA, 1131 bp, Acinetobacter baumannii
ataagtgaacttgattacatggcaacttcagctaaaaaaaatgctaaggctaaacaagaaaacacatctacgagtaacatcaaaaaacttattggcttaattgaccaacttgaagaacatattattaaaagacataaatttccctatggtttgccatcagcctatgccgaacactacaaagcttatttacccgaacaaatggaacctatcagtgaagaaatgacggataatgaccgaaagtggttttatgaacagcttgatcaaggcttattaaaagaatcgccagaacaaaaggctctccgtcaacaggcatggagattacccccaccattacttcgaggtaaatcggaaatttacatctacattcccgaagaggaccgacttgcccgacactatggcgaaatcgcgactgaaattcgtaaattcaaaaacttggtatcaactaaaaccagaatattcaaaaaaacagcacaacaagctgagaaacattttgaagaagcatttcgtctctactccaaacattatgattgttctttctatatctacacgctaccagaagatatctataaacagattaggcaatctcaattagcccgaaacagccataaaaaatcccagagggtaaaaaaaacttacctctcacttgttcaacgttttattaccagtaatcaaaaaacttactcaagtatggatacggttctaggagccattgagcagcaagctatctcaaaaattccagaatacctcactcaagaatacaatgctgaaatagaacattgtttacgaaaaaaagaagaagctgaatattttctttttgcagctcgaaatgatctatctacagctgaagtcaaagaaattgaagaatatggtaaaaaaactgtaatcatacaagctcagaaccgtgatcaacccctaacttcttttgcaggtcgccctatcgaacgttataaggaaataagagtattttatcagaaaaagatttctgccttagaaactcaaaaaagtaaaattagaaccgacgatcagagaatgaagttactgaatagcgctaaatcttggttaaaggaaagcgagccaagcctatatgatgcgctgaacatttttatagaaaagaaaggtagaaaactttag

SEQ ID NO: 3959 - DNA, 786 bp, Acinetobacter baumannii
attgaagattgccgtatgaaccaactgccttcaaccgctgtaaatagtcaagaaaacctagaccaaatgccaatcatgaatcatttggtggttttaagacgtcatttatttaggattgtaggggtaacattattcttatttttttgtttactgccctttcgaaatcatacttatcaattattatctgagcctctaaggttacaacttcctgcctcatcttccatgattgcaacggatgttacagcaacctttatggcgccatttaaacttaatttatttgttgcgctcatgctggcaatgccatttattctttatgaaatatggtcttttgttcgcccagcgctttatcaaaaagagcgtcatttagcgctgccgttactgatcggtagtattattttattttatgcaggtgtcgcttttgcttattacattaccctgcctgccatattacatttctttattagcgtttcacctgaaacagtagcaccaatgaccgacattaatagttatttaagcttctgcttaaagctatttttagtgtttggtgtcacttttgaaattcctatcgcgaccttgctactcattttgattggtgtggtaaatacgcaaagccttgctgaaaaaagacgttttattattgtaggatgtttctttgtagcgatgttcattaccccacccgatgcgatttcgatggtgatgctagcaattccaatgtggctacttttcgaaataggtttactcttcggcaaaattcttgaaaagagaaaaacccattctgctgaataa

SEQ ID NO: 3960 - DNA, 630 bp, Acinetobacter baumannii
agcaaaagttgcagccgttttatctcatttatacacaacaagaaattattttataacggtaactatatgccatattcagatctctcatttcgcgcgttaagcgtcctccataagtctcgatatctttttaataaacatggttttcataacgtaggagtagaccgcattgtgcgagaagcagaggtgccaaaagcttcgttttataactatttccactctaaagaacggcttattgaaatgtgcctacactttcaaaaagacgtcttaaaagagcaagtacgctcaatcatttacatacaaaaagatttaatcttgcgtgaaaaactcaaaaaggttttctttttacataccagtctggatggttattaccacttgttatttagggctatttttgaaattgagaaactctaccccgcagcttatcaagtggttgtacagtatcggcattggttaactaatgaagtttataaattgcttttaactgtgaaaaaagatgctacgaaaagtgatagcgatatgtttttatttacattagatggtgccattattcagctgctagatgaaactaggggtgatacgagagaactgttattcacttatattttaaagggtatttttcttaaagattaa

SEQ ID NO: 3961 - DNA, 786 bp, Acinetobacter baumannii
ccctgctcctgtggctccttttaccgaaaaacttcgactcaaacacttcagccaactatagctacaatgaataccgaatcatcggctgtagagaaacaaccttcgacttcactcaaatcaagtgatggcaatcaaacaactaccgtcaaaaaagcagcgcaatctaaaactgcccaacaaaaaaatgtattaagtaaaaatacgccgaaaaagcaaaaaattagcgcttataaaggcccggcacctacaggtaaatatatcgtacaacgtaacgagtctttatggagtattgccaatcgtattgcagcacagaccaaacaacctgtggctaaagtcatgcgagatatccaagcacaaaaccgacatgcttttattcaaggcgatgtaaaccgtttacgtcagggaagttcgctaaacttaacagcaaatgcaactaaagcttcccatttaaaacctaaatcgactgaagctaacttagcaaaacctacttctggccgagctaaatatcgtttacaacaagctgaaatgagcattgtggcagagaacagcccaaattctgctcatggaagtgccaaaaagagcacacaacaaagtcaaaacaatactgagttagcagtaaaagttatgacaactcgcaaaaaaaccgttacattacaaaggaatgtaaccaaactaaatcaaactttaagtttaaaagaccaacgtattcaactcttgaatgcgcgtttggcagagttacaacagcaattacaggcccagcaacaaactcacaagcaaaaacattaa

SEQ ID NO: 3962 - DNA, 1170 bp, Acinetobacter baumannii
attggaccctgttccttggccgtattaaatcctgcttctgttcctttatctttatatatccacatgccttggtgcgtgcgtaaatgtccctattgcgactttaactcacatgcggtgcctgatggtgcgctttcggcagaactcgagcaaacttatttaaaagcattggtagccgactttgaaactcaagtcgagttggcacaaggacgttcaattcacagtgtatttattggtggtggaacaccttcacttatttctgctaaaggttatgcatggctatttgaacagcttaaatcgctgcttaactttgaagatgactgtgaaattactttagaagctaatccgggaacactagaacatgacccgtttgcaggctatttagaagcaggaattaatcgtttatcgattggtgtacagacttttaataccgatcacttgcaaaaacttgggcgtattcattcagccaacaatgctatggatgcaattgagcaggcacgacaagcaggctttaagcgagttaatgtcgatttgatgcatggcttgccagaacaaacactagagcaagcactttatgatttaaagacggctgtagagcagggtgcaacacatatcagctggtatcaactgaccattgagccaaatactgtgtttttccgaacacagcctgttttacctcaagatgaggtgttagaagatattcaagagcaaggtgaagcctatctaaaagcaaatggctttatcaattatgaagtgtcagcttggcgtaaagagcagccttcagctcataatttaaattattggcagtttggtgattaccttgcaattggcgcaggtgcacatggcaaagtaacccgaccagatggagtatatcgtttccaaaagactcgtttaccgaaagactatttggctaaagttccagccgaacatttgcaaatgaaaaagattgaagcagatgaactaccttttgagtttatgatgaacgctttacgtttaaatgatggagtaaaagctgagttatatgaactgcgcacaggcttaagtttaaatgatttaaatgatgtacttacttcattacgttcgagaaagttattggtagaggatagcggtcgtttggcttgtacagagcaggggcatattttcttaaactcggtactcgaagagttcttataa

SEQ ID NO: 3963 - DNA, 1257 bp, Acinetobacter baumannii
ttatttgtatgtaggtatactatgaaatctctgaacaacacagctaaaccaattcttccacctatcgcacagttctcagttgcagatagagatgcattcctagaacagctcaaggaagatttttcaactcatgagtacatgacagaaaacggtaagattaaaatattcaaaacgagtataaaccctgaagttgaaaaaatgctcagtcgtgttgagttcatcaagtattttgagaaagagcgcccaatcgctactcttaaatctgttcaaagttttaagggcaaagagcaactacgtgttgaatatgcgaaggatattccacttttgcttaagtgccagcttacaacaatctttgtgtctgctcgctctggcaattacaagatgggcatagagttacaggcctttaaggattcattcttagaactttcaaaggaagaacaatataccctttatgaattttctctgatcaatcagtgttacacatctgaacaggctcaggcttatgttgcagctttaattaaatttcagaagttgtttgcaataagaatgagcagtgcctcaattcgtaaacaactttcgaatcgtgctagtaatcgacgccgttctaaagagcgttgtgttgagcttgtagagactctactcaagatccattctcgaatccttgttgttcgagtagacctaggattaatacgcgatccagctaagcttcaacagcttgctatctcaactgattttgctcaggctgaacatgatagtgagtttatgcaagagtcttttattcggttctatgatgcatctaagcataatcagcttaagcaagcgctcgggtatatcctgcgtattgaacacaccccaaccaagggattccatggacatctttattacttcttcaatgccaatgaccatcgtgaggacatcacgtgggggcaatatattgctgagaaatggagggttgctacaaacaatcttgggactgcttttatctgcaatatgaagaaagatgagtaccgctatcgtgccttaggcattttggagtataccgaccatgaaatgcttaagaatctcaaggctacgtttgactacatatgcaaaaatgatcagtacttcgcctttactaatggagaacaaattcggagcttccgaacaagccaaataccaaaagttcctgctaccaaacttggccgtccacgcaagttcgagcaacttaacctactagactctgatcagtcagatgatgctcaagtaggaggacagtaa

SEQ ID NO: 3964 - DNA, 291 bp, Acinetobacter baumannii
atactcaaatgtatattggcctttcttttgatggtcaatgaaggttggaaaatgaaaatattagttcgtaatttagatcgttcagtgactgaagctgaagttttagagctgtttaaagcttatggtaaagttgagtcttgtgtcgttgtaactgataaagatacgggtaaatcaaagggctttggttttgtcgaaatgccgaatccgcgtgaagccattaaagcaatcaaaggtctaaatacacttaaagtaaaaggttacggtattcgggttaaggcagctgaagagtaa

SEQ ID NO: 3965 - DNA, 186 bp, Acinetobacter baumannii
ataatttttttaatttatgtttatgaaaaatatatttttaattttaaaaaccgcttattaataatggctcaatataaagctgggaatgcaatggacaattataaaattgtctttgagctaataataaaaattcatattttatgtgatttattagacagaccgtattgtctatttttttatctttag

SEQ ID NO: 3966 - DNA, 246 bp, Acinetobacter baumannii
aagtccttgtgtcatgccgatctcactcaaaacaattttcagcataatgccaatattcaacgtttttcgaaattgcataatgcatcttttttcaaaaatcgcacgaaaaaaaatcgctccgatttaggagcgactttttaccaactcatttttagtcgtcagacaataaaccaagcaaacgtaagaacgaaatatacatccatactaaagttgcaagtaaggcaataccacacaaccattccatga

SEQ ID NO: 3967 - DNA, 384 bp, Acinetobacter baumannii
ttattcatgtggaaatacttatttagcattttttgcttaggggcaaatattcactgttatgcgactgatttcgggacaacgaataattttgtctctccaaatttgcagcttaaacaaaatgtacttcctcctactccaaaaaatattcctctgcctgcttttggccagcggattattggttgggggacaggagcagaaggtgcgagacagcgtttagagaatattcagcctgccgatgtttctatgattaaaaaacaaggaacaactttagaaatgatcacggcctggcaagatttttatgaacaagagcaacaacgtaatgaaaataacccaactgcaaaatatcgtgctcgtttaatgaaaaaaattgccgacctttggtaa

SEQ ID NO: 3968 - DNA, 2025 bp, Acinetobacter baumannii
ccgccgccgtggcccaatgggaatgtaagcatgacaaaacaagctttgcttgaagtcagcaatttggtccgggaattccctgctggcgaaagcacgattcaaattttaaaaggcattgacctgaccatttatgagggtgagctggttgctattgtcggccagtccggctctggtaaatctacactcatgaatattttgggctgtctggaccgcccaacaagtggtagttataaggttaatggtcaagaaaccggtaaacttgagccagaccagttagcgcagttacgccgtgaatattttggttttattttccagcgctatcatttactgggtgacttatcagctgaaggtaacgttgaggttccagctgtttatgctggtgttactccagcagaccgtaaacagcgagctactgccctgctcacggagttaggtttaggtactaaaacgcaaaaccgaccaagccagctttcaggtggtcaacagcaacgtgtgtcgattgcacgtgccttaatgaatggcggcgatgtaatcttggccgacgaaccaacaggtgcactcgattcacatagcggcgttgaagtgatgcgaattttgcgtgaactcaacgcggctggccatacgattattttggtaacgcacgatatgcaagttgcaaagaatgcaacgcgtattatcgaaattagtgatggggaaattattagtgaccgtcctaatgttccagaccagtctttagaagaagttaaatctgatccagatgcagcacctgctttacaaaataagcagaaaaaaggcaaaagtatttcagcttggcgttcaaccctagatcgcttatccgaagcctttcaaatggctttactgtctatgaatgcccaccgcatgcgtactttcttaaccatgctggggatcattattggtattgcttctgtcgtaacggtggtcgcactgggtaatggctctcaacaacagattttgagcaacattagcagtttaggcaccaacacaattacggtattccaaggtcgtggttttggtgataactccaagacagccaattttaaaacgctagttcctgccgatgccgatgcattaatgacacagccttatgtcagtgcagtcagcccgatggtcagtacatccaagactatgcgttatcaacaaaatgaagcaaacgcgactattaacggcgtaagtaacgattattttgatgtaaaaggtctagtctttaaagatggccaaacctttgatcaacgaagtgtccgcgaccgatcacaagatgtagtcattgataccaatacgcaaaaacaattctttagcgatggtactaacccaatcgggcaagtcgtgttactgggtagcgtaccagctcgtattatcggcattgtagaacctcagaccagtggaatgggttcggatgacacgctgaatgtatatatgccttataccacggtcatgagccgtatgttagggcaagcgcatgtccgtaatattgtcgtacgtattaatgataaatactcgaccagtgctgctgaaaacgccattgttaacttattaacccagcgacacggtgcccaagatattttcaccatgaacagtgacagtatccgacaaaccattgagaaaaccacaagtactatgaccctcttagtatcagcaattgctgtaatttctctggtagttggtggtatcggggtaatgaatattatgctggtttcggtgactgaacgtacgcaagaaattggtgtacgtatggctgtgggtgctcgacaaagtgatattttgcagcagttcctgattgaagcaattttagtatgtttgattggtggtgtacttggcgtactgctatcacttggcttaggacaactgattaataagtttgccggtggcaactttgctgtcgcctattcaaccacatcaattgttgctgcgtttgtgtgttcaacattgattggtgtcgtattcggcttcttacctgccaagaatgcagcaaaacttgaccctgttgcagcactatcacgagaataa

SEQ ID NO: 3969 - DNA, 1380 bp, Acinetobacter baumannii
aagattacgtgttcaagaaggaactcttgcagcataaaaaaattacagcaaggaggaagcaaggatatgaattccattattcaaatggattcggagataaaccaagcttatgccggttttgggtttttcgatatctaccatagagatagttttaaactgccagctcgtaccacatggattgacggttggaaaattgaatacatggcgattgcagacccacaaacgattcacaaaacaccgattgtgattgttggcggtgcttttcaaaattttaactcgtataaatattgtgttgaacaactatttgaaagtggcccggtgattttaatcgacttgccatctatgggcgcaaatcaacaaattaccaatcgagataccggaatttctgctggaacattagagcttcccgatttgtcggaaatgttaggacgttggctagatatcgtcggaattcaaaaagtttctgtaatgggaatgtcgttgggttcagttgttgcttcttgttttgcttatcatcgtccagatttgatggaccgtatgattttaatgggtgtcatgcaaaagacccgtaaaagctggcggatgattctggaagagtcgctcaaactcatgcaagaaaatcgtatggaagagtttgggcaagcggtaattttatatttggtgaatcatgccaaattagataaaacacgtatgtcgcctacagctaaaaaattattttttaggcaaatggcagaatttacgggtactgaaagagaacgttatgaaattaactgtaatcgccttttgcgtttaacagatgtacctattccagaatgtaagacactggtcgcagcagggcagtacgatagttttactttgcctcatgaaaatgccaattttgctttgcaatgtccggatatggaatttgctctgattgctaacgctgaccatgtgccgcagctccagcgccgtaaagaaactatgagtttgttcacctcatttttgaagggtgaatctatccaaaatctggatggcattattccaatgacgcgtgagcaaatacaaaacatggaacgccgaggtgaagagcgtataccagttctccagcctaaaacgaaactgagccaccgtgaatgtgaaacagaggtgccagtgacgattgttgacgtgactttctttgggatgtatttgaagttagatgatgtagcacagcttgagtttgtaaatgaacacccacgtgatttggctttacatttagaagatgaagagggtgctttctcgattgagtgtttaatttttgaagctactgaacaaggagtccgtgccttatttaaacatggtagctttgagcttgctgaccgtttaagccgcttcattgctcgccagaaacaagcagcttaa

SEQ ID NO: 3970 - DNA, 1764 bp, Acinetobacter baumannii
gtggataagtgtgtggacaatctaaataaccctgaacaaagcgatttaagctggttaacgacttggagtacctttctaaatcaagccccgtttactgcacagacacaagctccagaggcagcttattttttgcagcagctaattgaagcgagcttgcagggtgacagttgtattgagattagcccagagcaaatagaaacacttggccaactggtgatatctgctgaacaagcaaagtctcaagttgccccttgtgtccacgacgggcaggggttggcattataccgatattggaacctagagcaacgtctagctgagcaaattcgccgattaaagcaacaaccaattcaacctgtttcatgtgaagagcatttagacttattaactgatcctcatcagcgagctgctttgcaaatggtgactcggcagagcttaagtattattacaggtgggccgggtacaggtaagacgtatacgcttgctcgtattattgctgtgcttagtcaggcaattccgcatattcgtgtggcgatggctgctccgacgggtaaagctgcacagcgtatgcaagaagccttacaaaactcctttaatgacccaaaactgcttgagtcggggctaatgagtgatgagctaagaaaccaaagtacccaaactatccatcgattattaggtatggggcatagtcaaactccacggtttaatcaaaaacagcctttgccttatgacgttattgtggtggatgaagcctctatgctggacttaaatctggcaacgttattatttgaagcggtccctgagtcttgccgaattattttattaggtgatgccaaccagcttgcttctgtagacgttggagctgtacttgcagatttacagcaaatcgaggctttgtctgaaaaccgtgttcaccttcaaaccagccgtcgttttgcggaaggggctttgattggtcaggttgcccgatttattcaaatgcaaaccagtcaaattgatcatgagcaagttttacaacagtttgaaattgatattgttcaagtttcagagttacgttcaatacctttagaagctgatatgcccgatgtggttcagcttgaatatttacccgaagactcccctataacgctagaaacttactaccaaaaattgatggtgggttttcaaggctatgtgcaaagcttaaaagcttatatacaagatgatcgttcacttgaacatattgaaaatatcgttaagtcattcgatgactaccgtattttaactgccgtacgtcatgggccatttggtttacagcaacttaatcaatatgccgaacgctggttacaacaacagctaggtattgtgactttaggaggatggtatgttggccgtccggttatgatgacttataacgattaccagcttggcatttcaaatggtgacattggtttatgttttgaacatagaactcagccgcaacagtttgaagtgtatttcccaagtttaaataagtgggttgctgcaaatcggctacctaaaagtattcaaagtgcatttgccttaacaattcacaaatcacaaggttctgaatttacccatacagctgttgttcttgatcaggctgccaagaatttgttaagccaagagttgatctacactgcgattacacgagccaaaaaagtagtgagtttattggtcgatccagaggcgttacttcaatcttttacagttcgcacgacaagaaaaagcggtttagttgaaaaagttaatcggttagttcgttaa

SEQ ID NO: 3971 - DNA, 624 bp, Acinetobacter baumannii
caattggttcgccaatctgtgctattaatgaatacacccacccgccctacactgcatataggtcatttcatgactattcgccctattcttaaaaatctttcaatcagtctctgtctaagctgtattactacaagcttatttgcttctcctgccaagttaagttcagtaaaagaactcatgcaaatgagccaaattgattatctattgaaagaatcaatcaatgagttaacgccttattatgatcaacaagctgaacagatcattagcaatattacaggcatcaaaactttaggcccgaaagaaaaagaggcagcgaaaaagttaggcttacttttaaaagattcgagtaaccagctgattagtagccctaaaacgactcaagccttacaagatatttatttaaaaacgtataccgaagaagaaatccaagcaaatttaaagtttttgaaaaccccagaaggccaatcaattacccgtaaaaatgtacagattatggggcaaatttcagaatatatgatggaattgggacagcaaacttttaatgaccctaaagcacgagatcatatgcaagaagaaatgctaaaaattattgcaccattaatgaaagataaagaaaagtcttaa

SEQ ID NO: 3972 - DNA, 240 bp, Acinetobacter baumannii
ccttcggttcgacctacttttgttttggcaaaagtaggcaaaaccattctcatccacaaaacctgttcactgcttgtgtgtatcaaattatatcgcagaaacagtatcttcactgattttgggcaggttgtggatgacgtttccgcgagtcatataaataatgttgtgcctactatcaatttaaaattattacagccttatcttaataaatctcttcatatccctctggacgtgttttaa

SEQ ID NO: 3973 - DNA, 189 bp, Acinetobacter baumannii
gttaagttgctcgaacttgcgtggacggccaagtttggtagcaggaacttttggtatttggcttgttcggaagctccgaatttgttctccattagtaaaggcgaagtactgatcatttttgcatatgtagtcaaacgtagccttgagattcttaagcatttcatggtcggtatactccaaaatgcctaa

SEQ ID NO: 3974 - DNA, 435 bp, Acinetobacter baumannii
tttaatatgctaagttactttttactttttttgagtgcttttggggcggctaccttattaccgctacaatcagaagctgtacttgctgctttattattaaaaaatcaacattcagcttttcttctcattttgattgctactttcggaaatatattgggctcatgtataaactggtggttaggtttaaaaatagaacagtttaaacataaaaaatggttcccggtttctgaaaaacgtttagaacaagcccaacgcttttatcataaatatggcttttattcactgcttttaagttggacacctgtgattggtgaccctattactttggttgctggcttattcaaagaaaatttttggcgctttttatttatggtccttaccgctaaggctgggcgttatattttcatttattgggtaattacaggttttatttaa

SEQ ID NO: 3975 - DNA, 285 bp, Acinetobacter baumannii
tacggaatgctcatcgtatcggtgctttcggcagttccaatgcatcaacgctttagcctgaaggcaacattaaggagcgatttgtctgatgtgtatcagtttacgttccataaccaactagagttggtaacatatttttttgaacaaactgaattaaacgcaacagtttgtcattttgccgatataataagccttcggcgtcggcataattctttaggacctgtccgagctggtgatgaaagcatcattttgattgaggtttcaatcagggaaatttccctttag

SEQ ID NO: 3976 - DNA, 216 bp, Acinetobacter baumannii
gaacctgaccggatggatgaaaccatcaaaacgccatatcagtgtattacatcagccagcaaaaggttgggtaaatatcacggaccggagggcttttttgggctttcacatgaacgttcggtcatgtcaaatccagaactttatagcttgaaatatattcttccgccgttcaataaaccgattcatcgcttcatttcgaaaaccttgttgcgttaa

SEQ ID NO: 3977 - DNA, 1488 bp, Acinetobacter baumannii
cttatgggccgcgaaattcttaccgttgttgaaacggttagtaatgaaaaaggtgttagtcgtgaagcgatcttcgaagctttagaacaagctctagttgctgcaacgaagaaaaaattttacgagggtaccaattctgaagaagctcagcttcgtgtagaaattgatcgtagaactggtgattaccgtacattccgtcaatggactgttgtggcagatgaagatcatgaaatgccagcatgccaagacgcaatttctgatgttgatcctgcaaaatggtcaattggcgacgttcgtgagcttgaagtagaatcgattgagttcggtcgtatcgctgcgcagattgcgaaacaggttatcgtacaaaaaattcgtgaagcagagcgtgcattagttgctgatgcttatgaatcaaaagttggcgagctaatttacggtgaagtgaaaaagcaaactaaagatggtttcatcattgacttaggtgacaatgctgaagcttatttagctcgtgaagaaatgattcctaaagagattcttcgtccaaaacaacgtgtaaatgctattttatatagtgtaaaccgtgaaggccgtggtgctcagcttctattatcacgcgctaagcctgaaatgcttattgctttgatgaagaaagaaattcctgaaatttctgaagaaattattgaaattaaagctgcggcgcgtcaaccaggtgttcgtgcgaaaatcgcagtaaaaacgaacgaccaccgtattgaccctgttggtgcatgtattggtatgcgtggaacacgtatccaagcggtacagcaagagttaaatggtgagcgtattgatgttgtagtttggtctgatgatccagctcaatacatcgcaagtgcattagaaccagctgatgtatcaggcattgtgcttgatgaagatgcaaaaagtgcagacattatttttgctaccaacgatcaattggcacgtgcgattggttcgcaaggtcaaaatgttcgtttagcttctgatttaactggctacaaactcgacatgatgcttgaagaacagtatcgtgctcgtcagcagaatgaagctcagcaatatctcgatatgttcgtatcacgtttagatattgaagaagacttggcaatggcgttagtagagatgggcttcacttctttagaagagattgcttatgtgccagctgaaacttttgacgaaattgaacttgacgctgagttagttgagttattgcaaagtcgtgcaaaagaagctgcattaactgatgcattgaaacagcaagaaaatattcaagaaccgagtgcagaccttctcaatatggaaggcatgacctctgagatcgcttactcgctagccgctcgcggtattattactgttgatgatttggcagatcaagcaactgacgatatctctgatattgaaggtcttggtcatgaaaaagcaggtcaattgatcatgaaagctcgcgaatcatggtttaactag

SEQ ID NO: 3978 - DNA, 672 bp, Acinetobacter baumannii
acgactttacgactgatcaggtcatggattgagatgactgcatataacaaattaaaaattgccattttcaccattatgtcttcgccttctatttatgcgattacattagatcctattcaaattcaatctgcacctggggaattactttatgcagaaatgaattttcagcaagcagatcctaataccccattgcaagtcagtttggccactcaagatgatctcaatggtttgggagtaactcatcaacctccgggtaacctaaacttttatacacgccaaaatggtcagggttctggcgttattgtgattacctcatcgcgtcctattatcgatcctgaactgaatattgtcgtaaaagtcagtgaaggtaacgcaacccgtcttcaacatattaaaaccgttttaaagccatcgcctataaaaaaggccgccatgaacgaaagtccactttcaccgcaatttatcgtaaatgaaaaagatatcgcactaaatttacctgaaagtactcagtacacacctactgaaactacatcaaccgtggctgaaaccacaggtaatgaacataatctaaatattagcactggtactgctccagctttgaatagttctagccctgctcctgtggctccttttaccgaaaaacttcgactcaaacacttcagccaactatag

SEQ ID NO: 3979 - DNA, 669 bp, Acinetobacter baumannii
catagctcacgttcaatattggttataaagtttggttatcttatgtctaccccacattggtttgatcagggttctttagtccttgcaagtaacaacaaaggtaaagtcgcagagtttgaaaaactttttgaacagctcaagttgcctgtagaaattattcctcagggtcgcctaaatattcccgatgccattgaagacggcttaagctttattgaaaatgccattattaaagcgcgtcatgcctctaaaatttcagggaaacctgctatggctgatgactccggtatttgtgttccggttttaggaggtgcacctggtatttattcagcacgttatgctggagaacatggtgacgattcagcgaataatgccaaattattaaatgaccttttgccatttcgtaaaaatggtgaagcgattgaaggtatgtttgtgtgcgtacttgctttagtgactcatgcggaagatccattgccacaaattttccaaggcatctggcatggtgaaattttagaagcgccacgtggtgaaaatggttttggttatgacccactgttctggttgccagagctacaagtttctagcgctgagttgtctaaagaagacaagaataagattagtcatcgtgggcaagcgatgcagttatttagagagagcttgcagaagtag

SEQ ID NO: 3980 - DNA, 456 bp, Acinetobacter baumannii
aatcggacacgcttaatgactgcaacacaatcaaaatcaattatggcttttgactttggcactcaaaagatgggaatggcgattggtcagtctgcaattgaaagtgctaacccattaccactttttgtgatgaaagatggtattcccaactgggaccaacttttaaaaattgtgaaagagtggcagcctgatttatttattgttggtcttccattgaatatggatgatagcgagtcagaactttcaacacgggcacgtaagtttgcacgtcgcttacgccatcaaaccaatattgaaacgtggatggtcgatgaacgactcaccactcgtgaggcaagagaagaacttggtttttatcaagaacaaggtcgtgccaagaagttatcagccgatagttttgccgcggctttgctaattcagagctggtatcgcaatcctgttggtttaacgccataa

SEQ ID NO: 3981 - DNA, 1569 bp, Acinetobacter baumannii
tttagcccgctagctaacagcccgctcaagagattttttggtatgacaacgattatcaaacaagatgacttgattacatcaatcaaggacgccctacagtttatttcgtactatcacccgcaagactttatccaagcgatgagccgtgcttatgatcgcgaagaaaacaaagctgcaaaggatgcaattgcacagattttaattaactctcgcatgtgtgcggaaggtcatcgtccaatttgccaagatactggtattgttaacgttttccttgaagtgggcttagatgttaaatttgatttaacaatgagcttagacgatgcagtaaatgaaggtgttcgccaaggttaccttgaaaacagcaacgttcttcgtgcatctgttcttgctgaccctgcatttggtcgtaaaaatacaaaagataacacccctgccgttattcactacaaactcgtaccaggtaacaaagtagatattactgttgctgctaaaggtggcggttcagaaaacaaatctaaacttgcgatgcttaacccatctgactcgattgttgactgggttcttaaaaccgttccaactatgggtgcaggctggtgtcctcctggtatgctcggtatcggtattggtggtactgctgaaaaagccatgatgcttgcgaaagaagcactcatggaagaaatcaacatggacgaattacttcgccgtggaccagagaacaaaatcgaagaacttcgtatcgaaatctttgaaaaagtaaacgctcttggtattggtgcacaaggtcttggcggtttaacgactgttcttgacattaaaatcaaagactacccatgtcacgctgctggcaaaccagtaggtatgattcctaactgtgctgcgactcgtcacgctcacttccagcttgatggttcaggtgtagctcacattcaagcaccaaaacttgaagactacccatctgtaacttgggatgcttcacaatctaaacgtgtaaaccttgataccattactcaagaagaaatggattcttggaaaccgggcgacacattacttcttagcggtacaatgtacacaggtcgtgacgctgcacataaacgtatggttgaaatgatcgacaacggtgaagaattaccggttgatcttaaaggcaagttcatttactacgttggtcctgttgatccggtacgtgatgaagtggttggtcctgctggtcctacaacggctacacgtatggacaaattcacacgtaaagtactcgagcatactggtctattcggtatgatcggtaaagctgatcgtggtcctacagcaattgaagcaatcaaggacaacaaagcaacttaccttatggcagttggcggtgcagcttacctcgtatctaaagctgttcgcgaagctgaagtggttgcatttgcagacttgggtatggaagcaatctacaaatttgtagtggaagatatgccggtatctgttgcagttgatgtaaacggtacatcaattcacgcagtagctccaaaaatctggcaagcgaaaattggtaaaattccagtaatcgatgccgcagctggctaa

SEQ ID NO: 3982 - DNA, 420 bp, Acinetobacter baumannii
cttgtggaacgctggttagagtttatggggaatcaccccattttgtttggtacactcggagtcttgatcgtattgttcttcatttttgaaggtcaacgtaacggtcgtaaaatttctccacagtcgcttggtattttagtgaaagcgaaaaatgcccttttgattgacttacgcgatagcaaagacttccgcgaaggtcacattagtggtagccgcaatattccttatagccaaattgcaagtcatgctgatgaattaaaagcaagtgaccgtccattggtatttatttgcaacctagggcaagttgctggcagcgctttacagaaagtcgctcaccatgacagctatcgccttgatggtggtatcagtaactggaaagctcaaggcttacctctcgttaaaagcaaaccaaaagcttaa

SEQ ID NO: 3983 - DNA, 936 bp, Acinetobacter baumannii
atcaacatgcgcaccactaaaaaaatatattctaagacacttttatctatagctttaattggattatcaggtctagcttttgcaaataatactgatgttcaacgtacggataatagtattaaatcctctcagtccgagagtatgaaaatgctgttaaaagagcctggtgggctaggttatgttgaccgtaatacttatcaaaattcaacttctggtaatgatggagataacaatgcaggtcttgaagttgaaacatctaatagccgaaatcatgataagcatctgaaagaacatggtggacaagtttttcaaacgactaaatttgagaatgagtggactgtggatgaagatggcaaaggtactttaggatcgaaaattgaaacattgataggcacagatgaaaatcgcctatttattgaagcaaatttggataaagtagaaagtcatgatccaaaatatgatgtgtctgcactttatagccgtaatgtagcacccttctgggatgtacaggcgggggtgagatatagtgaagataaaaataacagcaatagtgatcgggttgatggtgttattggcgtattgggattggctccctatttctttgaaacccaagcttatttgtacggtggtgagaataatttctggggagcaagcttggaagtcgagcgtgatttcttgttaacacagaaattgatcacacaaccttatctcgaagtagatactgtgtttagcgataattctaactatgctgcaaaatcaggtttatctgaattaaagacaggtattaaaaccagatatgaagttactaagagaatccgaccttttgtagatattgcttatcaatatgaaaaaggacaaaaagctaccactatgcaagaagctactgagtctgaaaaaggttggaaatatggtgcaggtatcgaattagttttttaa

SEQ ID NO: 3984 - DNA, 285 bp, Acinetobacter baumannii
acttatgcgcttttaatagtgcgagcacatcaccatgtgctttccgtatatgaagcaacaccggtttttggtattgagttgccagatctaactgatcagcaaaatactgtttttgcttggcatatatatcgggctgcttgtgttcctttaagaaggtatctaagccgatttctcctattgcgacgcactcttcttgctgcaaaatctgttcaagatgagaaagatgctctggtttgtgctgctcaatataaaacggatgcaaccccggtgctaaataagaagtag

SEQ ID NO: 3985 - DNA, 2193 bp, Acinetobacter baumannii
catcaacttagaaatcctccaaaactaaggagatcaggcatgatccacgctggcaatgccattaccgtccaaatgcttgcggacggaattgcagaattccgctttgacttacaaggtgagtcggtcaataaattcaaccgtgcaacaattgaagatttcaaagctgctatcgcggctgtaaaagctaataacgatattaaaggcttagttgttacctcgggcaaatctacattcattgttggtgcagatattaccgaatttggtcaaaactttgcacaaggcgaaaaagcgattgttgactggcttatgcctgttcacgaaatcttcaatagctttgaagatttagaccttccaaaagttgctgctattaacggcatggctttgggtggtggttttgaaatgtgtttagtttgtgactatcgcgtgatgtcagaagctgcacaagtcggtttaccagaaatcaaactcggtatttaccctggtttcggtggtagtgttcgtttaagccgtctcattggtattgataatgcagttgaatggatggcaatggctactccaaagaaaccggctgctgcacttaaagatggcgctgtagatgctgtggttgctgcggacaaattacttgacgctgctactgatctggttaagcaagcgatttctggtcgtttaaactggaaagcaaaacgccaagaaaaacttgaagctgtaaaattgaacccacttgaacaaatgatggcgttcaacacagcaaaaggtgcggtacttgctaaagcaaatcctgctcaataccctgctccaaaattattacttgattcattacaagctggtgcaagccttgcacgtgatgaagcgttaaaagctgaggctgaaggctttgccaaagcagccgtaactcctcaagctgaagcattaattggtttattcattaatgaccaagttgttaaaaaagcatctaagcaacatgaaaagggtgctcatcctgtaaaccaagctgctgtacttggcgcgggtatcatgggtggtggtattgcttaccaagcggcaagcaaaggcactccaatcatcatgaaagatattggtaacccacaacttgcattaggtatgaaagaagcaaacaacttgttaaccaagcaagttgaacgcaagaaaatgaaacctgtgcaaatgggtgaaacacttgctcgcatccgtcctactttaagctacgaagagtttaaagaagtcgacatcgtgatcgaagcggtaactgaaaatccaaaagtaaaagaaatcgtacttgctgaaactgagaaaaatgttcgtgaaaacacgatcattgcttctaacacctctactatttcaattacacgtttagcaaaagcattacaacgtcctgaaaactttgttggtatgcacttcttcaacccagttcacatgatgccacttgttgaagttattcgtggtgaaaaaacttctgaagaagcaattgcaactacggtcgtgcttgctcaaaaaatgggtaaaacaccaatcgttgtaaatgactgcccaggattcttggttaaccgtgtattgttcccttacttcggagcatttgaccttcttgtaaaagacggcgcagatttccagcaaatcgacaatgtaatgtctaagttcggttggccaatgggtcctgcttatctgatcgatgttgtaggtatcgatacaggtgtacatggtgctgaagtgatggctgaaggtttccctgaccgtatgaagccagactacaaaggcgcgatcgaagcaatgtacgaagcgaagcgtcttggtcaaaagaatgatgtaggtttctacaaatacgaactcgacaagaaaggcaagaaagcaaaaactgttgatccaacagcgtatgaagtgattgctccattcgtaactggcgaaaaacgcgaatttgataaccaagaaattattgaccgtatgatgcttgctctttgcaatgaaactgttcgttgcttagaagacaacattgtagcgactgcatctgaggcagacatggcaatgattatgggtattggtttccctccattccgtggtggtccatgccgttacatcgaccaaacaggtgttgctgaatatgttgcactctgcgacaaatatgcgcacttaggtaaggcttatgaagcgccacaaatgttgcgcgacatggctgctaacaacaaaaaattctacggttaa

SEQ ID NO: 3986 - DNA, 2118 bp, Acinetobacter baumannii
aataaaattaggaaaatacaatacatgtcaatgtttaacatcgttcgtaaagaattccaattcggtcagcatcaagtcgttttagaaacgggtcgcgttgcacgtcaagcaaatacagttttaatcacaatgggtggtgtaactgtattggtagcagtagttgctgctccaacagcaaaagctggtcaggatttcttccctttaacagttaactatcaagaaaaacaatatgcagcaggtcgtatccctggtggatatggtaagcgtgaaggtcgtgcttctgaagctgaaactttaatttcacgtcttattgaccgtccaattcgtccattgttcccagaaggttactacaacgaaattcaggtaactgcaactgtggtttcttctgacaaaacgatggaagctgatattgcagcaatgttaggtacttctgctgcgttggcaattgcaggtactccattccgtggtccaatcggtgctgcacgtgttggtttaatcaacggcgaatatgttttaaacccgaattttgagcaaatggctcagtctgaccttgaccttgtggttgctggtacagagtctgctgtattgatggttgaatctgaagcgaaagaactttcagaagaccaaatgttaggtgcggttctttttggtcatgacgaaatgcaaattgcaattcaagcgatcaatgaatttgcagctgctgctggtgcgaaaccatctgactgggttgctcctgcacacaacgaagaattacgtgcaaaattaaaagaagcatttgaagcaaaaatttcagaagcttataccattgcagtaaaacaagatcgttatgcagcattagatgcacttcatgctgaagctgttgctcaattcgttcctgaagaagatgtagacggtattgctgacgaagtagactacttatttgaagatcttaaataccgtaccgtacgtgacaacattttatctggtaaaccacgtattgatggccgtgacaccaaaactgttcgtgcgttagacgtacaagtgggcgtacttgagcgtgcacatggttctgcattatttacacgtggtgaaactcaggcgttggtaacaacgactttgggtaatactcgtgatgcattaatggttgatactcttgctggtactaaaactgacaacttcatgttgcactacaacttccctgcttactcagtaggtgaaacaggtcgtgaatctggtcctaagcgtcgtgaaattggtcatggtcgtttagcgcgtcgtggtgttcaagcagttcttcctgcagctgatcgcttcccgtacgttattcgtattgtatctgacattactgaatctaacggttcatcttcaatggcttctgtatgtggtgcgtcattatcacttatggatgcaggtgttccgcttaaagcaccagttgctggtatcgcaatgggcttagtgaaggaaggcgagcgtttcgcagtactttctgacattttaggtgacgaagaccaccttggtgacatggactttaaagtagcaggttctgcaaacggtattactgcacttcaaatggacatcaagattgaaggtattactgaagaaattatggaagttgcattaaaccaagcatttgctggtcgtatgcatatccttaatgaaatgaacaaagtaatttcacgtgctcgtcctgaaatttcaatgcacgctccaacattcgaagtgattacaattaatccggataaaatccgtgatgttattggtaaaggtggtgcaacaatccgtcaaatcactgaagaaactaaagctgctatcgatattgaagataacggtacagttcgcgtatttggtgaaactaaagctgctgctaaagctgcaattgcgaaaattcaagcgattactgctgaagttgaaccaggtaagatttacgacggtaaagtgattcgtattgtagaattcggtgcgtttgtaaacattatgccgggtactgatggtcttcttcatatttcgcaaatctctaatgagcgtattgcgaacgtaactgatgttcttaaagaaggtcaggaagtaaaagtacaggttcaagacgttgataaccgtggtcgtatcaaattgactatgaaagatattgagcaagcataa

SEQ ID NO: 3987 - DNA, 219 bp, Acinetobacter baumannii
cagatttataggtactgtttagagattgttgagttgtctatccgtgttttcatatttggaatatttttaattgagccattaaaaaagcctgttcaatataaacaggcttttacgaatgaactgaacagcttatgccaatttcttttcttcaataaattggacatcagcaatttgtgcatcccaaaactcagtccacagtgcacaataatcaagacatag

SEQ ID NO: 3988 - DNA, 954 bp, Acinetobacter baumannii
atgcaaagtagacattcacgtctgataattctcggttctggccctgcgggctatagtgcagcagtatatgcagcgcgtgcaaaccttaaacctactttaattgcaggtttacagcttggcggccaacttacaacaacaaccgaagttgacaactggccgggcgatcctgaaggtttaacaggtcctgcattaatggatcgtatgcaagcacatgctgaacgctttggtacagaactcgtctatgaccatattaacgaagtggacttaaatgtacgtcctttcgttcttaaaggtgatatggaagagtacacatgtgatgctttgattattgcaactggtgctacagctcaatatcttggcctagagtctgaacaaaactttatgggacaaggcgtaagcgcatgtgcaacatgtgatggtttcttctacaaaaaccaaaaagtaatggttgtaggtggtggtaacactgctgttgaagaagcactttatttatcaaatattgcttcacatgtaacgctagtacaccgccgtgatagcttacgttctgaaaagattttgcaagatcatttatttgtcaaagaaaaagaaggcaaaatcagcattatctggaatcacgaagttgaagaagtattgggtgacaatactggtgtaacaagtgttcgccttaaatcaactcaagatgaatctaagcaagacgtagaggttcatggtctattcgttgcaattggctacaaaccaaatactggtatgtttgatggtcaattaaacttacgtgatggctatatccaagtacaaagcggtacttctggtaatgcaacagcaacctctgtagctggtgtttttgctgctggtgacgtcgctgacagcatttatcgccaagcgattacttctgctggatcaggctgtatggctgctctagatgctgaaaaatatctagatcaattgaacgattga

SEQ ID NO: 3989 - DNA, 2181 bp, Acinetobacter baumannii
atattacccagagagaatataatcatgtcaaacgaatcaaaatgtcctttttcaggtcataactcaaaaccgcaagtaacagtcggtggtggcacggctaatttacactggtggccaaatcaattacgtgttgacttacttaatcaacattcagaacgctctaatccactcgataaagattttaattaccgtcaagaatttaaaaaactcgactactacgcacttaaagccgatatcaaaaatgtattaaccgattcccaagactggtggccagccgactggggaaattatacgggcttatttatccgtttagcgtggcatgctgccggtacatatcgtatgggcgatggccgtggtggtgccggtcgtggtcaacaacgttttgctccattaaatagttggcctgacaatgcaagtttagataaagcacgccgtttactatggccagttaaacaaaaatacggtcaaaaaatatcttgggccgatttatttattcttgccgggaacatcgcacttgagtcttctggtttccgtacctttggttttggtgccggtcgtgaagatgtttgggaaccagacaacgatgtaaactggggcgatgaaaaagaatggttagctcatcgcaactctgaagcattggcgggcagtaatcttgctgcaaccgaaatgggtctaatttatgtgaaccctgaaggaccacaagcgagtggtgacccacgatcagcagcaccgtttattcgtgccactttcggcaacatggcaatggatgatgaagaaattgttgccttgattgcaggcggtcatactttaggtaaaactcacggcgctgcccctgctgaccatgtccaagcagacccggaaggtgcaccaattgaacaaatgggctttggttgggcaaacagctatggtacaggtgtcggtaaagatgcgatcacttcaggtttagaagttatttggtcacaaacgccaacacaatggagcaattacttctttgaaaaccttttcaaatacgaatgggtacaagaacgttcacctgctggcgcaattcaatgggtagcagcagatgctgaagccattattccagatcctttcgacccatcaattaaacgtaagccaacgatgcttactacagatttgaccctacgttttgaccctgagttcgaaaagatctctcgtcgtttccttaacgatccacaagcctttgccaatgcttttgctcgtgcttggtttaaattaactcaccgtgatatgggaccaaaagcacgttatttaggtccagaagttcctgctgaagatttaatttggcaagatccattacctgctgctagcgctacaccatcttctgcaagcattgctgatgcaaaagcaaaaatcgttgctctagggttatctgctggtgagttggtttcccttgcatgggcatctgcatcaacattccgtggtggagataaacgtggtggtgcaaacggtgcacgtattgctttatcaccacaacgtgagtgggaagtaaacaaaaaagctgttgagactttaactaaaattgaagaactcaaggcatcaacccaattgtcattggcggatttaatcgtgttagctggtaatgttggtgtagagcaagctgctcaagcagcaggtttcaatattaccgttccgtttgcccctggtcgtgttgacgcattacaaagtcaaaccgatgttgaatcattccagttactgctcggtcttgctgacggttttagaaattggaaaaaacagggagtcaacacaccagctgaagtcttattaattgataaagcacaacaactgactttgactgcaccagagttaactgcattgattggtggtttacgtgtactaggcactaactgggatggttctcaacatggtgtcttcactcagcaagttggtgtactcagcacagacttcttcacaaacttactcgacatgtcgaatgtatgggcacctgttgattcaacaagtgaagtatttgaaggtaaagaccgtaaatcaggcacagtgaaatttaccgcaacacgtaatgatttagtctttggttcgaattctatcttacgtgcattagccgaagtttatgctcaggcggatggtaaagaaaaatttgttcaagactttgttgctgcatggactaaagtcatgaatcttgaccgttttgacttagcttaa

SEQ ID NO: 3990 - DNA, 912 bp, Acinetobacter baumannii
aatactcggcttatcaaaattttgtctcaattaagtgatattaaccaaatgaatatgaccactgccaatacagcccgtttactgattacttgtgaagacaagcctgggatcgtacaggctgtatcgagctttttgtaccatcagggtgcaaacattaccgcgcttgatcagtatgcgacggaagctcaaggcggacgttatttcatgcgtgttgaatttgaacttgatcatttacagtctcgtaaagatgctttaattcagactttcgcagcaaatgtagcggaacgttatggcatgcaatggcgtcttgcttttgttaatgatattaaaaaggttggtattttagtttctaaagttgaccatgctttgcttgagctattgtggcgtcatgcacgtggttctttaccgtgtgaaattacccacgtaatttctaaccacgaagatttacgtgaagcggttgaaaactttggtattccatttacagtcattaaagtaactaaagacaataaagcagaggcttatgctcaaattcatgaaatgatgcaaggcaatgacttgttagttcttgcgcgttacatgcagattttaagcgaagatttcgtttctaaatgggaaatgaaaattatcaatattcaccactcattcttacctgcttttgtgggcgcaaacccatacaagcaagcctatgaaaaaggtgtaaagttgattggtgcaacagctcactatgtgactgctgacctagaccaaggcccaattattgagcaagacgttgaacgtgtgagccacgattataatgttgagcagttgcgtgagcttggcgaagatgttgaacgtaatgtattagctcgtgctgttaaatggcatttagaagaccgaattattgtagatggcaataagactgttgttttctaa

SEQ ID NO: 3991 - DNA, 933 bp, Acinetobacter baumannii
tttttatgcagtcttgatatgtctccccgtacgcaaggttatttttttgtattggtgaccatgtgtatttggggcgggtttacgctttttgcccgcttaaatgcacaatggcatatcagtgcttgggatattgccgcactacgctttgctatagccttcctaattttgatgcctatcttaatttataaaaaagatcttgcttttttatggagtaagcatgcggttattttggcattgattggtggagtcatttactgccttacggtttatacagcttttctttatgcaccagctgcacatgctgcaatatttttaaatggttgtattcctatctgtactgctatagctgcttatattttatttagacagccatttgataaacatacatgggtgagtctggcaattatgattactgccttggccctcatgagcgcattgatgttacaaagtagtacctctgcttttggaattggagatttacttctgtttatcagtgcgatttggtgggggatttttactgtactacttaaacagtggaagctctctgcttggcattctatggcaagcgtcgcaatctggtctgcaattatttatttaccgatttatctgttgttcttacctaagcactttatggatgtagatcctttgcacttagctgtacaaagtattttccatggcgtgtttgtcgttattattgcgacattaacctatgttgctgctattcagcgtcttggcgcatttaaaacgggaagtattgtaactttggcaccgtttattgctgctattttagctatacccttacttggtgagtcattaagcccatcaattgtagtgggcttagtaggtatgggaataggcgctttacagccttggcgctggtttagacaagatagcctgacacaaaagattaagcagcaaaatacacaaaattag

SEQ ID NO: 3992 - DNA, 807 bp, Acinetobacter baumannii
aaggtgagcagtatgtcgggttcgacgattacgccttgggtagttggtaactggaaaatgaatccaatgcgtgccaacgccaaccaacttatagaagaatttaaacaattattgcaacaaaaccaaattgcagatgaaaactgccatgtgggcgttgcccctgtttctattgcccttacaacggtacaagcgcaattacaggatgctgcaagaacggtacatacggttgcacaggatgtatcacgtgttgctggtacaggtgcttatactggtgaagtcagtgcagaactattaaaagatagccaaattaatttcgtactggttggacactctgaacgtcgtgatatttttggtgacaacgttgaaattttgaaggcaaaactccaaaatgcattaaatgcgggtatgactgtcatttattgtgtgggcgaaagccttgaacaacgtgagcaaggtcaggccgagcaagttgttttacagcaaatttgtgatattgcacctgtagtgactgcagaacaatggcaaaaccaagtggttattgcctatgaacctatttgggcaattggtacaggtaaaacagtttctccgcaagatgcgcaagcgatgcatgctaaaattcgtgaaggcttatgccaacttacaccagcaggctcaaatattgctattttatatggcggtagtgtaaaagctgaaaatgctgttgagttagctgcatgtccagatatcaatggtgcgttggtgggtggtgcttcattaaatgcagcatctttttatcaaattgtacaagccttcgcgcaaagcaaataa

SEQ ID NO: 3993 - DNA, 1128 bp, Acinetobacter baumannii
caccacggcagtcataacgctgtcttgtctttgaaaatggaaaacttcatgtctaaacagattttaattttggctggcgatgggattggtcctgaaattgttggggcagcagaaaaagtattaaataaagtaaatgaaaaatttaatttgtcgttgacttgggaacatggcttgttaggtggtgcagcgattgatgctcatggagaaccgtacccagcagtaacaagtgaacaagcaaaaaaagctgatgccattttattaggtgctgttggcggaccaaagtgggacactattgaacgttctatccgtcctgaacgcggtcttttaaaaattcgtagtgaacttaacttatttgctaatttgcgcccagcgatcttatatccacaattagccgatgcttctagcttaaaacctgagatagttgctggtttagatattttgattgttcgtgaattgactggtggtatctattttggtcaaccacgtggtattcgtgaactcgaaaatggtgagaaacagggctataacactgacgtttattctgaaagcgaaattaagcgtattgcaaaagttgcttttgaacttgcaggattgcgtggcggtaaagtgtgttctgtagataaggccaatgttttagaagtaacagagctttggaagcaaacggtcacggatttacagcaagccaactatccaaatattcagctttcacatatgtatgtggataatgctgccatgcagcttgtacgtgcgcctaaacagtttgatgtaatcgtgacaggtaacttgtttggcgatattttgtctgatgaagcagcaatgcttaccggctcaattggtatgttgccatcggcttctttagatgaaaatggcaaaggcatgtatgaaccttgtcatggttcagcgcctgatattgcagggcaaaacgttgcaaacccgttggcaaccattctttcagttgcgatgatgcttcgttataccttccgtgaagaagctgctgctaaagcaattgaagatgcagtagggcaagtacttgatcaaggtttacgtacagccgatattatgtctgaaggcatgactaaagttggtacagccgagatgggtgaagcagttgttgctgctcttgcttaa

SEQ ID NO: 3994 - DNA, 2793 bp, Acinetobacter baumannii
ttcagtttaaggaattgttcaatgccaccatttgtcttggttgatgggtcctattttttatttcgtgcatatcatgcattaccaccattgacgacctctacagggttacataccaatgcaatacgtggagcaatttcagccattcaaaaattgatgcgtcgtatgcaaccgacacatatggctgtcatttttgatacgcctgagccaacgttccgtcataagctttcacctatttataaaggtgaccgcccgactatgccggaagaattgtctcaacagattccatatttacatgcattgattaaggctcaagggattcctttatatagtcttccgggtgcagaagccgatgacattatcgggactctcgctaaacgcgccgtaaaagaaggtcatcatgtgcttatctcaaccggagataaagacatggcccagctggttaatgactatgtaaaacttgaagatagctttaaagatcgagtactagacaccgacggcgtatttgaaaaatttggtgtttggccaaaccagattatcgattacttaacccttatgggtgatgcatctgacggcattatgggtgtacctggcgtaggtgcaaagacggctgccaaattactgactgaatatgggacattggataatatcattgccaatgtagaccaacttaaaggtaaactaagccaaaatattaaagataatttagacaatattaagcttgatcaccagttggcaagcattgtctgtgaccttcctttagaactcgactggcatgaattaaaacttactgatccaaatgtagatgccttacgcaatctctatacagagcttgagtttagaaaccagttacagtctctcgatcatccaaacaatccaaatagctcaagctataagcagcaagcttcacaaactattgtccaaaatgaagttaaacctgctcaaacgattgaaacagaagatcaagcaagcttgactagtcaagatgaccagcttggaactgcaaactatcacactgttttaacacaagaagcatgggatcaactctggcaacgcatgcagaatgccgatcattttgctattgatacagaaaccacaagtcttgattaccgtattgccgagatggttggtttttcaatcgcatttgatgcgaaagatgcctactatgttcctttagcacataattacgaaaatgcgccacaacaactgaaccgtgaacaagttttagcgcaaatcaaacctgtacttgaaaatgaagcagttaaaaaaatcggtcatcatcttaaatatgatgcgcacatttttgctaatcacggtattgaacttaaaggttggtatttcgatagcatgctggcatcttatgtactgaatgcagcagctactcgtcatggcatggatgatgttgctcgtgtttacctaagccatttgaccactacttttgagcaaattgctggcaaaggtgcaaaacagaaaacttttaatcaaattgagattgaagttgcagcacattatgcagcagaagatgcacatgtgacttatcgtttatatgaagtactttcaaataaacttaaagcacatcctgaattggaaaatattttatataacattgagatgccagttgctcgaatcttatcgggtatggaagaagatggaatccgtttagatcatgctttcttagataaattaagtgttgaatttgcgaaaactatggaagaccttgaaaatcaggccatggaaattgcaggtgaaacttttaatattgcttcgcctaaacaagtaggtgaaattctatttgataagttaggcattaaaggtggtaaaaaaactgcaactggacaatacagcaccagtgaaagtgttcttgaaaaaattgagcacccattaacggaaattattttagaacaccgtggattagcaaaattaaagagcacctatactgaccgtttaattgagcagtcgcataatgatacccatcgtgtacataccagctatcatcaagcactaacggcaacaggtcgcctatcctcttctgaccctaacttacaaaacattccaattcgtagacagattggccgtcaaatccgtaaagcatttattgcaccggaaggacgagttttgttagcagccgattactcgcaaattgaacttcgtttaatggctcatttttctcaagatgatgccttagttcatgcattccaacatggtcaagatgtacaccgtagaacagcggcagaagtgttaggtattgcaattgaagatgtgaccaatgatcagcgccgtcaggctaaagctgtgaatttcggtctactttacggcatgtccgagtttggtttaattcgtcaacttggctttactcgtgaagaatcgcaaaactatatcaaacaatacttccagcgctatcctggcatttacgaatacatgcaacgtactcgccaagtagcatcggaacaagggtttgttgaaactatcttaggtcgccgtctttatacaccggatattgacgctcgaaatgtgatggtacgtaaagctgctgaacgtgctgcaattaatgcacctttacaaggtagtgctgctgatattattaagttagcaatgattgaagtagataaaatcctgccaaaagatcaagcaaaactattacttcaagttcacgatgaattggtgtttgaagttgattcaaacattgcagatgaactttcaaaacaaattgcggatatcatgcagtctgttctggaaatttctgtaccgttagtcgtagaagtaggccaaggtaaaaactgggatgatgcccattaa

SEQ ID NO: 3995 - DNA, 336 bp, Acinetobacter baumannii
gcgtggttaaggagatttctcatggttgaaactattacaattttcgtccttgccatcttcgtaggttattacgttgtttggggtgttacaccagctttgcacacgccacttatggcggtaaccaacgcattgtcatcaattattgttgttggcgcgatgttgcaaacagttggtctgcctgtacttggtgtagatgcaaatgttgcatttcaaagtgtgaatgttgtgagcgtacttggtgcgattgcagtatttttagcaagcattaatattttcggcggcttcgcagtaactgcacgcatgttggaaatgttcaagcctaagcaaaagaaataa

SEQ ID NO: 3996 - DNA, 303 bp, Acinetobacter baumannii
aaaagcctaagctccatgacgacgtcactggataaaatgatgaaaaataaaattttgatgggtttggtaggtgtcagtattttgttggttactggttgttcttctgatttcgaaaagggtatgaaacaaagctgtaggaatacgggtggtagccgcagtttctgttcctgcttctacgacaggatggaagaacattatggtgaagaaaagttggaggcgattggcatgatgcaagtcaagatgccagaggactttgaagaggtgtcttttaagtctggtcagcaatgtgcacataaactttag

SEQ ID NO: 3997 - DNA, 717 bp, Acinetobacter baumannii
agaacaataagaagagaaaaaatgagccgctctattcgtctattaaatcttttacagcaactccgtgaatctcgttatcccgttactgctcaagtcttggctgaacgcttgggaattagtattcgcagcatttaccgtgatattgatagtttacgtgctcaaggtgtgagaatagatgcatcggcaggtttggggtttcagcttaaagaagacattttattaccaccggttacttttaatgagaatgaagccgaggctctatttttagctttagagtggttgaaagacgttccagatcaggcaatgaaatcggcagccgtttcaatttattccaaactttatgcagttttaccagagcaccggaaatatttgatcgatgacatgacgctaggtgttacacattactggcatccggttgatgaagctttagtagaacaagtacgtttagcgattcgtaaacaagtaaagatcaaagtcgattattgcgatgaacacaagcgtataagtcaacgttctctttggccttttgctttagggtatttacatgacaaagttgtacttgctgcttggtgtgaattacggcaggcctttcgccattttcggatagatcgtattcataacttgcaaatgagtgaggaaatatatcctgaatttaaaaaacatctgtttcaaagatggtggaaacaagaaatgcaaaggactactgacaaaaactga

SEQ ID NO: 3998 - DNA, 1332 bp, Acinetobacter baumannii
tatgcaataagtaaagatatgactatgggcacatcaatgagtggttgcggttgtaataaagaaagttcttgtgaagacactaagcaaaatcaaaatgaatcagaaacaaattctggtaacagtaaagatttaactgctgaagaaagtaaaagttcttgttgtggtaatgaagtaccacaacaatctaagccagatgaaaaagatccttgttctagtactcagccatgctctacgcagtcaaactcatgttgcaccccagattcgataagttcacctgagacagttagtgataatgaggatgtagcgactttcatcagtgactataaaatccctaaaatggattgttccgcagaggaacaaatggttcggatgactttatcttctttggtaaatgttaagaggctagtttttgatttgccgaatcgaaacctaaaagttatgcataatggtgaaagtaatgaaatcactgcaaaacttgaagctcttgggtttggagcaaaattaaataaaactgaagcctatgtaaataaagagcatgcaaatgaaatcagtacgtttctgattccgaaaatggattgctctgctgaggagcaaatggttcgtatggcattgtctccagtgaatgaggtcaaaggactaacatttgatttacctaatcggaaattgaaagtttttcataatgatggtcttaatgaaattactagcaaacttgaagcacttggttttggagccaaacttgaaagtaccgccacctctgtgggtgaaatgcctgaaaaagcagatacgtctgaacaagcaaaagttttaaaaattcttttagcgattaatgctgcacttttcgttattgaatttattagtggcctaattgctgcatctacagggttaatcgcagactctcttgatatgtttgcagatgctgctgtttatgggattgcactttatgctgtaggtaaagctgcaaagtatcaagttaaagccgcgcattttgcgggttggattcaattatttctcgcaataactgtaattgtcgatgtaattagacgttttatattaggtagtgagcctgaatctttattaatgattgtaatcggcttttttgcactaattgcgaatgttgcctgtctttatctaatttctggacataaagatggtggagcacatatgaaagcaagttggattttctccgctaatgatgtgattgtgaatctaggtgtaattattgctggcttccttgtggctttgacaggttccgcatatccagatcttgttataggaataattgtttcacttttcgtacttaacggtgctcgaaaaattttggcattgaaataa

SEQ ID NO: 3999 - DNA, 513 bp, Acinetobacter baumannii
tttgagccaagttatttttgggccgacacaatgacagtaaccacatatattggcttaggaagtaacctacgtgattcacgccagattctatctgaagcgataaccaaacttaaatctcttggtgaagtgaaagtatctaaactttaccaaagtccccctatgggtccccaagatcagccgaattatctaaatgcactcgctcagctaaaaaccgaattacttccgcttgaattacttgaccaattacagcgttttgagcacgaagctgggcgggtgagactccgtcattggggggagcgaactttagatcttgatctactaatttatggcaatgaaaaaatacaaaatgagcgcttaaccgtgccgcatgtaggaatattacaacgagattttgttgtgattcctttattagatttagatgctggtctacatattaatgatcagccacttaaaaatttagaactcatacagcagccaacgctgactgtacttgctgatgagtcttgggcttaa

SEQ ID NO: 4000 - DNA, 213 bp, Acinetobacter baumannii
cttaaccaaaggtcgtattacgtaccgtgctcgctaattagtgaatgcaaaaaagccacttcatcatgtggcttttttattgcgttttttattcacttaatcgactggttttacatcccaccgtttggcattcacgcaatctttcttgcagccaatggtttctttcttgcgttgtctgtaaacgacactgcacgtctacgctatttctattag

SEQ ID NO: 4001 - DNA, 411 bp, Acinetobacter baumannii
aaaagaaaaagaagcctatcagcaattggcagaagcctttgcttcattcgaacctcgttcatctcattagggagcaagatcatgacaaccatccattatcgagaaattgtatgtgacggccacacctttagtgctgaagtcgttgatgaacaatgtacatttgacttgcaacagtttgctcaagcctgcggtcaaagcccagactggattctccagctcattgagtacgatattttagcgattgatacaccacctgaaaaacatcaattcatgggagaagatgttattcgcgctcgtaaagcgtatcgtttgcaacgtgactttgatgcaagccttgcagctgttgcggtgatgttagatttgattgatgaagtgcaacaacttagaaaacagttgaagcattttcattga

SEQ ID NO: 4002 - DNA, 216 bp, Acinetobacter baumannii
tcataccgaagaaaaagcccttatgcatctataaaacaaagtaaaagacaaaacacatattgttatgtaaacaccagttacagtttattagacagtgatgggtttatgctaaaatgtgaaaattctatttgttcgagtttgttatgtcagaacaacctatttcacctactgtacaacttaatacgcgtggtttacgttgtccggaacctgtcatga

SEQ ID NO: 4003 - DNA, 1407 bp, Acinetobacter baumannii
acgatgcgaagcacgttatcaacgtttaatgaagtttggcagcgaaaatttaggcatggcgtcttaaagcaagctcaagagttctctgaaaaaagttcttttcttattggatgtagtggtggcatggattcaatgctactgctacatttaatggctcaaattttccctcaaaagatccgagcaatttatattgatcatcaactgcaagatcaaagtgcagagtgggcggaagtggttgccacacaggcaacaatattaaatattccttatattattcaaaaagttcagatcgcaaacggcaatctggaagcacaagcacgtcaagcgcgttatcaagcatatcagcaacatttacaagaaaatgaaattctgttgcttgctcatcatcaacaagatcaggcagaaacagttattttgcgattattgtcaggtgcgggagtagatggacttgctgcgatgcaggctattgattaccgtaaagatatgacaatttggcgcccctttttggatttaacacgtgagcaaatcgccttatggactgctcagcttgaagttaaatatattgacgatccaatgaactatgacaaccattacgatagggtgtggtgtcgtgaagcactgtggccatttttaacaagccgttttccaaaaatgcagcaagctttgagccgaaccagttatctgatgcaagatgcttctgaaattttagaagaagttcttaaagatgattggcaatattctggttcagctgactatttagatttaacgaaattatccgagttatcttttgcgcggcagcgccagttactttctgcgtggatgaaaggccaagggcaatatcgacctgcatttgaaatggtcgaacggctaagagcagaagttattgagtctaagtcagatgctcaagccgctttacattggaaccagttttactatgtccgttatcaaaatatactctataggttgagtaaacagatttatttcgctgaaactttaaatccggttgatgctgaactagagcattcatttaaattagaagaaagatggcagggcgcagctggactattccatgttgagtgtaaaaaaattggtttaagtcattctttattgaataaaaaattaaaaatcattcgacgtcaaggtggggaaaagattcacctatatggtcgtgttgggcaatggcctttaaaaaaagcaattcaagaagcacatattttgccttggcttcgtcatacaattcaaatattagtcttagataatgttatgcttggggtttttacaccgaaaggattttggttggctcagtctccatattgtgaggaaggagggtggcaaccagatttaatttctcattcttgtaatctggtaaatggcgaatatagttatggcaacagcagtgaattgtaa

SEQ ID NO: 4004 - DNA, 519 bp, Acinetobacter baumannii
catgagggaagtgaattgaaaccattaaatgacacagatattcgtatagcatcatttaaggatgcattgtctattgcagaagtacatgtacagagttggaaagaaacctatacaggtatgattaagcgagaaatactggatgagcttaacgtactagataaacaacagctatggaaagagataagcagaagtcctgatcataagttatttatctatactgaaaatggagtagtgaaaggctttctcgatggttatttaaatccagaaaataatattgctgaaattcgtgctttttatttattaggagaaattcaaagaaaaggagtagggcgtgcgttattccaaaagttctatcaatgcgctttaaatcaaggttatgcttttattcgtttagaagtttttaataaaaatccaagtcgcttcttctatgaaaaaatgggagccaaattaactggtgaagccgaactaccagagttcggccttggaataatagaactattttatgaatggcaactttaa

SEQ ID NO: 4005 - DNA, 588 bp, Acinetobacter baumannii
ggactcttgagtctgagatggcactatgtgataatttttctatccttctctgaaaatggcatttatatgtcaacaggtcatgttgaatatgcaagtttaaatggaacgcatattttcaagcttattggtgaagtgcgagcccattcttgtataagtctagacaaacttttaaacagaattgaacagcaagaaaatgttgttggtgcaatcgttgatttaacccaaacaacatttattgatagtactgtattaggtatcctagctaagctaggtttaaaactgaaacagactcatcatattcaagctgtgatgctatctaccaatccagatatcacaaccttagccaacagcatggggctagggcaggtttttgtcatcctgaattattgtggcgatcctaacgtttgtacgttaacgttaactgacgagcacattactcataatgcgatgctaagaaccgttctggacgcacacaagacattgatgaaactcaatgcaaataatcagaacatgtttgagccgcttgttaagcaattgcaaaaagaacaagacacgcttgaacaagtatctgataagcaaaatgcctaa

SEQ ID NO: 4006 - DNA, 4143 bp, Acinetobacter baumannii
ttccttctgagcccgttctgcaggcgggcttggtttactttccgaggactccagatggcatactcatataccgaaaagaaacggatccgtaagaattttggtaaattgccccaagtaatggatgcaccgtacttattatcgattcaggtcgattcgtacagaacattcttgcaagatggcaaatcaccaaaaaaccgcgaagatatcggtctccaagccgcatttcgttcagtttttcctatcgaaagttattctggcaatgctgctttagaatttgttgagtatagccttggtaaacctgagttcgatgtacgcgaatgtattcttcgtggctcgacttatgcggcaccaatgcgcgttaaaattcgtttgattattaaagatcgcgaaactaaatcaattaaagacgtacgcgaacaagaagtctatatgggtgaaattccgctcatgactgaaaatggtacctttgttatcaacggtactgagcgtgtaatcgtatctcaattacaccgttcgccaggcgtattctttgaccatgataaaggtaagacccactcaagtggtaaagtgttgtattcagcacgtatcattccttaccgtggttcatggttagacttcgaatttgatgcaaaagacttagtttacgtacgtatcgaccgtcgtcgtaaattacttgctactgttgtgttacgtgcactaggttataacaatgaacagatcttgaatttgttctatgaaaaagtacctgtgtatcttgacatgggtagctatcaaattgacctcgtacctgagcgtttacgtggtgaaatggctcaatttgatattactgacaatgaaggtaaagtcattgttgagcaaggtaaacgtattaatgctcgtcatgtacgtcaaatggaagctgcaggtttaactaagctttcagttcctgatgaatacttatatgagcgtatcactgctgaagatattactttacgtgatggtgaagtaattgctgcaaatactctgttaagccatgaagtaatggtgaagttagcagaaggcggtgttaagcaatttaatatcttgttcactaacgatattgaccgtggttcattcgtagctgatacattacgtgctgacttgacgcgtgatcgtgaagaagcattagtagaaatctacaaagtaatgcgtccaggcgagccaccaacaaaagaagctgctgaaaacttattcaataacttgttcttctcttctgaacgctatgacttatctccagtaggtcgtatgaagttcaaccgtcgtttaggtcgtccttacgaagttggtactgatcagaagtcacgcgaagttgaaggtattttatcgcacgaagatattatcgatgtattacgtacattggttgaaatccgtaacggtaaaggtgaagtcgacgatatcgaccacttaggtaaccgtcgtgtacgttctgttggtgaaatgacagagaaccaattccgtgtaggtttagttcgtgttgagcgtgctgttaaagagcgtttaagccaagcagaaacagataacttgtctccacaagatttgattaatgcaaaaccagttgctgctgcaatcaaagaattctttggttcaagccagttatctcagtttatggaccaaaacaacccattatctgagattacacataaacgtcgtgtatctgcgcttggtcctggtggtttaacacgtgaacgtgcaggcttcgaagtacgtgacgtacaccaaactcactatggtcgtgtttgtccaattgaaacgcctgaaggtccaaacattggtttgatcaactcgctttctgtatacgcaaaagcgaatgacttcggtttcttggaaactccataccgcaaagttgtagatggtcgtgtaactgatgatgttgaatatttatctgcaattgaagaagtaggtactgttattgcacaggccgactctgcagtagataaagatggcaacttaacagaagaattcgtttctgttcgtcatcaaggtgaattcgtacgtatgccgcctgaaaaagtaacgcatatggacgtttctgcacagcaggtagtatctgttgctgcatcacttattccattccttgaacacgatgacgcaaaccgtgcgctcatgggttcaaacatgcaacgtcaggcagttcctactttacgtgcggataaaccgcttgtaggtacaggtatggaagcgaacgttgcacgtgactctggtgtgtgtgtaatcgcaaaccgtggcggtgtaattgaatatgtagatgcttctcgtatcgttattcgtgtaaacgaagatgaaatggttgcaggtgaggcaggtgtagatatctataacctcatcaaatatacgcgttcaaaccaaaatacttgtattaaccaaaatgttatcgtgaacttgggcgacaaagttgctcgtggtgacatcttggcagacggtccgtcaacagacatgggtgaacttgcgcttggtcaaaacatgcgtgtagcgttcatgacatggaatggttacaactacgaagactcgatcttattatctgagcgtgtacttcaagaagaccgtttaacatctattcacattcaagaattgtcatgtgtagcacgtgatactaagttaggtgcagaagaaattactgccgatattcctaacgtaggtgaagctgcgctttctaaacttgatgaatcaggtatcgtttatatcggtgctgaagttactgctggcgacatcttagttggtaaagtaacgcctaaaggtgaaactcagttaactcctgaagaaaaactgcttcgtgcaatttttggtgagaaagctgctgacgttaaagactcatctttacgtgttccatctggtactaaaggtacagttattgacgttcaagtcttcactcgtgatggcttagagaaagatgaccgtgctttagcaattgaaaaagcacagcttgattcttatcgtaaagacttgaaagaagaatacaagatcttcgaagaagcggctcgtgagcgtgtaattcgtttgcttaaaggccaagagtctaatggcggtggttcaactaaacgtggtgataaactttctgaagatttattatctggtttagagcttgttgacttacttgaaattcaaccagcagatgaagcaatcgctgagcgtttaactcaaattcaagtgttcttaaaagagaagagcgcagaaatcgatgagaaattcgctgagaagaaacgtaagcttgcaacaggtgatgaattaacaactggtgtattgaaagttgttaaagtttacttagctgttaaacgtcgtattcagcctggtgataagatggctggtcgtcacggtaacaaaggtgttgtatctaacatcttacctgttgaagacatgccacatgatgctaacggtgtgccggtagatatcgtattgaacccgctgggtgtaccatctcgtatgaacgtgggtcagattctagagactcacttgggtatggcggctaaagggcttggtgacaaaatcgaaaaaatgttgaaagaacaacgtacagttttagaactgcgcgaattcttagacaagatttataacaaagtcggcggtgagcaagaagatcttgatagcttgactgatgaagaaattctagcgcttgcaggtaacttgcgtgcgggtgtgcctttagctactcctgtatttgatggtgctgaagaaagtcaaattaaagacttacttgaattggctgacatttcacgtacgggtcaaacagtattgtttgacggacgtacaggtgaacagtttgaccgtccagtaactgttggttacatgtacatgcttaaattgaaccacttggttgatgacaagatgcatgcgcgttcaactggttcttactcacttgttacacaacaaccgcttggtggtaaagcacaattcggtggtcagcgtttcggtgagatggaagtatgggcacttgaagcatacggtgcagcatatacactccaagaaatgcttacagtgaagtcggatgacgttgaaggccgtactcgcatctataagaatattgtagatggtaaccattatatggatccgggtatgcctgaatcgttcaacgtattgaccaaagagatccgttctttaggtatcaacattgaactaaaaaatggtgactaa

SEQ ID NO: 4007 - DNA, 393 bp, Acinetobacter baumannii
gcgcaactgagtagaggagtagctttaatgaaaaaaatgatgatgattgcaggtgttggtttaatgtcaactactctatttgtaggttgccaaaatgctagcccagaaagcaaacgtattggttcggcagctatcggtggtggtgcaggtggtgccgtaggtaaacatataggcggtaatattggtgcaggtttaggagcagcgcttggtgctggtgttgccgctaatgctaaaggctctagcagtaaaacagtacgtaatagtgcgattggtgcaggtgttggggcaatcttagggggtgcagtgattggtggtgacgctggtgctgctgcaggtggagcactcggtggtagtgctggtgcagcctatgaagagaaaaaaggtaagtactaa

SEQ ID NO: 4008 - DNA, 762 bp, Acinetobacter baumannii
attcttatgagtcaatcttccgcagccttaaactctcccaatccgatgaaaaagaaagtcatcacggcactaattgcggttgcaattggtcatatcggggtcttatgggcagtcagccacattaagcctgctgaactaaagccaattgaaaagaaacctttacaagtccgttttgtaaaaattcaagagcaaccaaaacctttaccaccaaaaccaaaagaaccgcctaaaaagccggagcctaaaaaagaagtgaaagaggttaaagttgtcgagaaacctgtaactccacctaagaaagtggaaaaaattcagcaggtcaaaaaggctgaaacacctaaagaaacagtaaaaacagaacctaaagttgaaccaaaaatagtaacgccaacgactactgtgactgaaaaagtcgttgaaaagccaaagccagtggttcaagaagcacctaaagctcaacctgctccagatccatcgccaaaacgcgtttcaattggcggttcgggtgtacagtggagccgctcaccacgtttgactgtttcaccaaaagatttacagggcgaagcacgctcggttgttgtacttattgaagccgatgagaaaggcaagattactaacgtgcgcgtaacccgtagcagcggtattccaagtctagatgacaaagtagtccgtgctgtacgtagtgcaaaatttaaaccttatatggaaaacggtgttgcttatccaattaaagcagagcaaccgtttgacttaaccccttaa

SEQ ID NO: 4009 - DNA, 1299 bp, Acinetobacter baumannii
ttcatcatgagttcaattgtcgcaatcaaaggttttaatgacgttttaccaacgcaaacagcagcgtggagacgtctcgagcagcatttagcatctttaatggatgcttatggttaccaacaaattcgtttgccgatcgttgaacaaacgggactgtttaaacgtgctattggtgatgctaccgatatcgtagaaaaagaaatgtacacattcttcgataaaggaaacccacctgaatcactgactttacgtccggaaggaacagcgggttgtgttcgtgcgttggttgaacataacttgttgcgtggtgctacgccacgtgtgtggtatatgggacctatgttccgttatgaaaaaccacaaaaaggccgttaccgccagttccaccagtttggtgtggaaacttttggtgtagcgactcctgatatcgacgctgaattgattatgttgactgcccgtttgtggaagcgtatgggtgttgatcacatggtgcaacttgagttgaatactttgggtgaaacagatgagcgtacggaatatcgtaatgctttggttgcgttcttaaatgaacataaagatgctttggatgaagattcacagcgccgtttaacaacaaacccattacgtattttagattctaaaattgagtcgactcagaaaattctggaaaatgcgccgaaattacatgacttcttaaaagaagacagtttaagccacttccagcaattacaagattatttgactgccgcaggcattaaatttgtaattaaccaaaaattggtacgtggtctagattattacaataaaactgtttttgaatggacaacaacagcattagggtcgcaaggtacagtatgtgcaggtggacgctatgatggtttggttggccagttaaaaggtaaggctgatcagtctgttccagcggtcggttttgcaatggggatggagcgtttattgcttctacttgagcaagtcgaacaggctgaaattgtacgtgactgtgaagcgttcttggttgcggagcctgcttatcaatctaaagctttagttctagcagaacaattacgtgaccagttagaagctgcgaatagtaacattcgcattaaaactggttcacaaggcagcatgaagagtcagatgaaaaaagctgatcaggctggggctgtttacgccataattttgggtgaacgtgagtgggaagcacagcagcttgctgtaaaagagttggcaacagctgagcaatcacaagttgcgttggctgaactcgtaccattcttaattgaaaaatttacaaaataa

SEQ ID NO: 4010 - DNA, 1239 bp, Acinetobacter baumannii
atacacatgagttctgcagtggtcgtttcatctgaaaatcttgatggacagcagcaatcttcgtccacgccagcatcgcctgctgccgaaaaagtgaatttactcggcatgtcacgtgctgaattagaaaaattctttgaagatattggtgagaaaaagtttcgtgccggtcaggttatgaaatggattcatcaatactttgttactgattttgctgaaatgactaatatttcaggcaaattgcgtgcaaagcttgaacaaatttgtgaaattaaagctcctgaagtggtacaccgtcattattcaaaagacggaacacgtaaatgggtgtttcgcgtaggtgaaggttctggctctttagtagaaactgtattaattcctgccgaagataaaacaggttcacgcaaaactttgtgtatttcttcacaagtgggttgcgcattggactgctcattttgttcaacaggtaagcaaggttttcagcgcgatttaacgccagatgaaattattgggcaactttggatggcaaactattcctatatggaagaagtgcctgttgctgagcgtgagcgttcagtgaccaatgtcgtgatgatgggtatgggtgagccattgctcaactacgatgccgtattaagctcaatgcacattatgctcgatgactttgcttatggtatgtcaaaacgtcgtgtgactttgtcaacgtcaggtgttgtgccaaaaattgaccaacttgcgaaagatattgatgttgctttagcaatttccctacatgcgccaaatgatgaattgcgtaatgaacttgtgcctattaataaaaaatatccattggctcagttgattgcggcatgtcagcgttatattgccaaagatggtaatgaaagcgcgcgtaaacatgtgaccattgaatatgtcatgttagaaggtgtgaacgaccaacctgaacatgcacagcagttgcttaaattacttaaaaacttaccaagtaaaattaacttgattccatttaatccgttccctcatgcgccatatggacgctcaagtcgaaatcgtatcatctctttccaaaaaactttgtctgatgcaggatttgtgtgtacgattcgtcaaacacgtggcgatgatattgatgccgcatgtggacaattggtcggccaagttgctgaccgtacgcgtcgtgctgagcagtggcaaaagaaagtggctcaacgacaagagattttacgtacacaaggataa

SEQ ID NO: 4011 - DNA, 594 bp, Acinetobacter baumannii
acaatgaagaggaacgttactcatagctttttgttgagcctgtgcgcgataacactaagtgcttgtcagagcacttacaatgtagtggatactgttcgtattaagcaggctgaacaagaaaatttggggcagaatgcagcaatatattgttcgggcgcaaaaagttgcgaatttgaacggctaaatgatattactgttgttgatgcacagacacgtcgtattagtaatcaggcaattcatcaaggaattgtgagattaaatggttcggtgttaagtcaaagcaatagtttgtatctatctgtgcctgccaaacaatatgaagtggtgattcgttactatccgatttctccagatcgggctgaaacgattcatgttattcaccaattcaaagctaaccatcgctatatgtttaaaatgtaccgagacaaatctaaccgttcgggtagtttgctgaatgtttctgtaccagatccattatgtgttgacttagagcaggatgggcgggtaattcgccgtttttgtcgaccatttgatgtcaccacaggactaggtgaatttctcgaacagaaaaaactaacaccacggcagtcataa

SEQ ID NO: 4012 - DNA, 288 bp, Acinetobacter baumannii
gcatctcggagaaatcgaatggctttaactaatgcagaccgcgcagagatcattgctaaatttgctcgcgctgaaaacgacactggttcaccagaagtacaagtagctttattgactgctcaaatcaatgatttacaaggtcacttcaaagctcacaaacacgaccaccacagccgtcgcggtttgatccgtatggttaaccaacgtcgtaaattgcttgactacttaaatggtaaagaccacgagcgttacactgctttgatcggtgctttaggtctacgtcgttaa

SEQ ID NO: 4013 - DNA, 981 bp, Acinetobacter baumannii
aaaaaatctggcaacttaaattattacttggtaaaaatagcaaacttgctcgtaaaaaagacaaacatccggaagttaaatttttaccacgccaatatagataagagctttattatgaattttgatcgtaatactcctattgcttttttaggcataggacttatgggaagccgtatggcaagccgtcttatacaagccggctttcaggtcgcagtatggaatcgaacaacatctgcttgtgaagaacttattgatattggcgcgcatgcactcgatctttccaacatcggacagtaccctctcattttaacttgcctagccgacgataaagctgtgcaagcagtatttgatcaaattcaaacaaacttaaaagcgggtcaggtcattgtcgacttctcaagtctctctgttgctgcgacaaaagcacttgctcaggctgctgcttcacaagatgtgatatggattgactcccctgtttcaggcggtacaactggggcagaacaaggcacgctagtcatttttgcaggtggcgatgctcaaactattgaagctttaagtcctgtttataatgttctttcccaacgtgtcacacgaatgggagatacaggcacaggacaagcaactaaaatttgcaatcaactcattgtggcagcaaacagcgccctaattgccgaagcagttgcactggcagaccgggcgggcgtagataccactttactcgctcctgccctagctggcggatttgccgactcaaaaccttttcaaatactggcaccacgtatggcgactcatactttcgaacctgttcagtggaaagttcaaacattattgaaagaccttaacaacgcagtaacattggctaacaatgttaatttagacatccccgttgcacaaaaagctctattacagctacaaactcaccaaaaaaatggctttgctgagaaagatttagctactatgattcaagtagtagagcaataa

SEQ ID NO: 4014 - DNA, 360 bp, Acinetobacter baumannii
atctggtatggacaatataatccaagtgttggaaaacacttatcaagcgacattgagggcctcatgacagcattaactaaagcagacatggctgatcatttaagtgagttaaccagcttaaatcgccgtgaagcaaaacaaatggtcgagttgttctttgacgaaattagccaagcgcttattgcgggtgagcaggttaagctttctggtttcggtaatttcgagcttagagataaacgcgagcgtccaggacgtaatcctaaaacaggcgaggaaattccgatttctgcacgccgtgtagttaccttcagagcgggtcagaaatttagacaacgcgttggaaatgagcagatcgattga

SEQ ID NO: 4015 - DNA, 585 bp, Acinetobacter baumannii
ttctacaatggcgcggttttttcgaagacttggttagcggaagtaggttttacaatggctcatgctcatcacgcagctcatgcatatgttcaccatatcaaagtgagaaaagaagaaagttctcaaggtgacttaaaaacgaaagcgatgttaagcaaagcttcttcgggaaataaaaaacttcatcgaccggtttctaaacgacataaatcggaagatcaaaatattgatctacataagttttcaagtaagcttgaaagcatgtctgcaaagcacagtaaagaaaaatgtgccaagaatattcgtattgccttacaagctgcgggtgcagatgtatcaaagcatcctgtagctgcatctgactgggggcaaacgctagaaaagaatggttataagaaaatcaagccggcatttaatcgtcctcaagaaggggatatttatattatcgaacgtaccagtggtcatacttacgggcatattgcgggctatacgggtaatggctggttctctgatttccgccaaaaaacctatgcggtctataaagaaaaagatgtgaaatatagttactatcgcctcgattcttaa

SEQ ID NO: 4016 - DNA, 597 bp, Acinetobacter baumannii
tgtttttacggcactttagaacgtacattcatgagcagtactttaaatacacgattaatttggattgatctggaaatgacaggtttagataccgacaacgaccagattattgaaattgcaacaattattacagatgatcatttaaatgtacttgccgaaggtccggttttggctattcatcaacctgatcgtattttaaatgcaatggatgagtggaatacgcgtcagcacggccagtcaggtttaattgaacgagttcgtcgtagtaaattgaccgctcgtgatgctgagttacagactttagaatttctaaaaaaatgggtaaatccaaaagtttcaccaatgtgtggtaactcgatttgtcaggatcgccgtttcttacatcgtcttatgcctgaactagaacagtatttccactaccgtaatcttgacgtatctacagtaaaagaactctcaaaacgctggcgtcctgaaattatgagtggcctgaaaaaaaatgcttcacatttggcgatggatgacattcgtgattccatttctgagcttaagtattaccgcgaatacttctttattatgaatactgacggtaaagattga

SEQ ID NO: 4017 - DNA, 807 bp, Acinetobacter baumannii
aaaataagcgggaatttcatggcacttttacgtattgaaaaaaataatggcattgcaacagtttatctaaaccgtcctgataaacgtaacgctatgagttttgccctactcaaagaacttgtaacaacggctaaagctatacaaaaagaccgagatatccgctgtgtaattttgacaggtgaagcacaagtgtttagtgctggtattgatttatctgacttaaacaatcctaagaactctgcatttgccatttgggaacttgttaaaccaggacaaagccttttccaaaaagcttttcttatttggcaaaatttgcccgtccctgttattgccgctcttgaaggttattgttttggggcaggtatgcaacttgcactagctgccgatatccgcattgcccacccagacactaaaatgtcgattatggaaagccgttggggtttagtacccgatatgggacttacccgttcgctcaaaggcttgattggagttgaccttgcaaaagagctgactttaactgcccgtgtttttgacggaaattatgcaaaagatattggacttgtaactcacttaagtgagaatccattagaaaaagcaaatgcgatcgcttcagaaatgttacagcgctcacctgatgcattgactgctgcaaaacgtgtactagatgcaatggaacatcaaccagaaaaatcattacgcttagaaaaaatctggcaacttaaattattacttggtaaaaatagcaaacttgctcgtaaaaaagacaaacatccggaagttaaatttttaccacgccaatatagataa

SEQ ID NO: 4018 - DNA, 528 bp, Acinetobacter baumannii
atcaccttaggaggttttacaatggctcttcttattgaagacaaaaaacagatcgttgcagaagtaagtgaagttgcttctaaagcgtttgcagccgttgttgctgactatcaaggtttaagcgtagagcaattaacaacacttcgtgttgaagctcgtaagttaggtgtaactacacgtattgtacgtaacactttggctaaacgcgcatttcaaggtactcagtttgatatcttgaacgacaaccttgttggtccaacaattctaggtttttcaacttctgaagatgacatgggtgcagctgcacgcttgttcgaagaatttgctaaaactaacaaagcatttgaattaaaagctgctgcatttgacggcaaagtttatcaaggtgctgatgttagcgttattgctaatcttccgaaccaagagaaagcgcttactatgcttgcctctgtccttcaagctcctatttcgaaattgggtcgcctcattacagcactcaaagagaaaaacgagtcagaagctgcttaa

SEQ ID NO: 4019 - DNA, 1560 bp, Acinetobacter baumannii
attactctaggcgtgaattgttatgggtttagttcaataatgtctgactttctgattgatgaagaattacttgctgccatagatatggggtcgaacagttttcaccttgccattgcacgggtagatcacggtgaagttaaaaaagtggcttcaatgtcagaaaaagtacagcttgcagctggtcttgatgaaaataaaaacttaacagaagcagcacagcaacgtggtttagcctgtttggctcgtttcgttgggcgtttaggctcagttcaacctaaccgtttaagaattgtggcaacgaacgctttgcgtcaggctaaaaatggccatgagtttattcaaaaagccgctgaaattttgcccaaacctattgagattattgcaggccgtgaagaagcacgcctgatttatcttggtgtatcacatacgatggccaatggtggacgccgcttagtggttgacattggtggtggatctaccgagtttattattggcgaagaatttgagccaatttatactgaatcattacaaatgggttgtgtagcctatacaaaagcctattttgccgatggtgaaatcacacaaaaagcatttgataaagcagttgttgctgcgcgtaaagagctttcagcaatcgccaccacttataagatggaagggtgggatactgttgtaggttcaagtggaaccattaaagcttgccgtcagattatggtgaatatggggctaagtgacgagcaagaaaatgtcacccgtgaaggtctccataaacttaaagataggttacttaagttcaaaaatatttctgaaattgattttgaaggacttcgagaagaccgacgagcagttttgccagccggattggcaattttgtacgctgtttttgaagttttagaaattgaacgtttggcatattctgatggtgcattacgtgaaggagtcatgtatgacctgttaggccgttttaagcatgaggatatccgcgaccgtagtgtacaagcattaatgggacgttataacgccgatccgaaacaggcagaacgagttgtaaatacggctcaatacttatttgatagtgttgctaagccacttaatttaacgagtgaagacagtgacttacttcgccgtgcagcatatttgcatgaaattggtttagcgattagtcatggtggctatcatcgtcatggtgcttatttattgcaacattccgatattcctggtttctcacaaattgaccaaaatcatctgtcacatttggttgctcatcaccgccgtaaattgcgaaatgatgtaaaaaatgaagttttaaaggctggcggtcataaattagtttatttaagtttgttacttcgcctagcagttttactcaaccatagccgcagtgatcagatgcttcctgccattgaattgaccatcataaatgatcaacaatggcaacttagtgtttctggtgatgccaaacaatggccattgttagttgccgacttgcatgatgagcaagagcagtttaagcattgggacattgaattgaatattcagtcggaaaaatttatcgattaa

SEQ ID NO: 4020 - DNA, 456 bp, Acinetobacter baumannii
tatattaaaggtcccagtttcatgacaacttcattagatgtaaagatttatcacaatcctgcttgtggcacctctcggaatactttggctttgattcgcaatacaggaattgaaccaaccgttattgaatatctcattacaccacctagtcatgacgaattagttaaattgattcaggatgcaaacttaacagtaagagaggctattcgtcagaatgtagatccttatcgggatttacagcttgatcgtagtgatttgagtgatgaacaactactcagttttatgcttgaacatcctattttgattaatcgaccatttgttgttactgaattaggtactcgcttaagtcgtccttcagaagctgtcttagatattctgccattaccacaaaaaggtgctttcactaaagaagatggtgaacaagtgatcgacgaaaatggtcagagagtaaattaa

SEQ ID NO: 4021 - DNA, 309 bp, Acinetobacter baumannii
tgtcaaaaaggatactgtaaaatggcaaaagctcgacattcaagttttgactgctcaccaggttgttcagttgaggccgcaatcagtttgattgatggcaaatggaaatgtgtcattctttggcatttattaaatgaaggaactttacgatttaatgaaattcgtaaacgagttccaagcattacacaaagaatgctgaccaatcagcttcgggagttagaacaagatggcattattcatcgtgaggtttatcctcaagtgcctcctaaagtggaatattgtctaactgaatttagggcgcgggcttga

SEQ ID NO: 4022 - DNA, 894 bp, Acinetobacter baumannii
cgagcgagaggagagagcgtggcattattactgcctatattggcatttatcacaggacttctacttgctcagacctccatttcagaaaccataaaacctattctctcagcttggcttgcacgactcctgattccgattgtgattatttacaacatggtcttttatcaatcgggaagcttgagcttaatgctctttagttttggttcggcgttcattattttctttgcttatttggctttatttaaagaccgcttattggcactttgcgtaagttataccaacatggggtggcttggttttcctttcgctatggctttattcggccctgaagcaactgctccaattgttgctttatatattggaatgtcgctttttggcaatgcttgggctgtgactgccgttactacggcaccgcaaagtaagctcaatatattaaaaaaggttttaacttcaccaccttgtatatcgatattctgtgctgttgtgctcagacttttaggggcccaacatatcgaaagccctgctatacattgggtttatgaggttgctaaatttgcaatgacttttgcaggtatgtgtgtgcttggaatgtggctgcgccgtaccagagtttatataaaagatttaatttacagtacaaaagctcaagcatttaaagtggcctgtggatttgtactttgtggattaagttataggtttttaccgattccaaatataaatcagcacatcggtgtaatgtttttaatgttttgcttgccaccggcagccaatattgtagctctagaaacccattatcaaggcacgggtagatctgctgcttatatcgcttcagggacgattgtgagttgtgtgtgtattgcgatttatgcagtgtttttacacttgttcgtctaa

SEQ ID NO: 4023 - DNA, 777 bp, Acinetobacter baumannii
tttttatggggaaaaagaatgtggaaaaacattcggattttatgtctattaattgttttattaatcgttgcagttcaagcgtggcgtgaccaaaaccaagactggaatcagcctattgtggtggtattacacccaataaatgcagatggcttacaaaccacacaaacttatattcatcagttacaaaacactgatttccaggcgcttaaaagctatttaagtgaatggtcgcaacattatcggggccaatcagcaaactttgaaatacgcttggggcaacagttacagcagcgtccgcctgaggtgccacaaaatgccggtatttttcatgtggtttggtggagtttaaagtttcgtttttatgcatggcgacaacaacagcctgaagataatggagcatcgctcaaactttatttaaattattacgatcccaattatcaaaaagttttggtgcattcgactgctttagaaaagggccgtattggtagtgttaatttgtttgctacacgtgggcaagcatcacaaaatcaggttgtaatcgttcatgagctattgcatggctttggggcaaaagataaatatgatttaaaaacaggtcagcccatatatccattaggatatgcacaacctgaaaaagtacctctttatccacaaaagcgagcagaaatcatgggtggtcgaacgccattatccgagcagaccagcaaaatgccaagtgatttacaagaaaccgtcataggtttaccaacagctcaagaagtggggtggctgaaataa

SEQ ID NO: 4024 - DNA, 630 bp, Acinetobacter baumannii
gcagcaaggggagattgcatgacactagatttattttctccagagccttgttcaaatttattgccttatgatggtgaggttcaggattatggatgtattttaactgccgaagaagctgaacaatattttcattatttgtatcaacatctggcgtggcgacatgatgaagcgaagctatatggcaagcactttataacacctcgtaaagttgcttggtatggagatgagcattatcgatataaatattctggtgtctttcgtgattctttaccgtgggacaaagcacttgctcagctaaaacagcaagtagagcagatcctttcagaaaaatttaattcttgcttggcaaacctgtatgaagatggaacacaaggaatggcttggcatagtgattcggatgtgtctttagccagaaccactacaattgcctctttaagttttggagcaacgaggaagttctcttttaggcatattcaaaccaaagaaaaagttgagatgtggttacaaccgggtcaacttattgtgatgcgtggtgagactcaacaatattggcaacaccgtttaaatcgttcaaccaagattttacaaccacggattaacctgacttttcgtcagttcaaattttcataa

SEQ ID NO: 4025 - DNA, 1077 bp, Acinetobacter baumannii
aaaataattttctggtcgcctatgcacaatatcggaacacgtgaatttattatcgccctcctcttcggcgctttacatagtttattcacgttgtttattgtgctttccagcatttgggtatgcttagccctatgggtccaacaaccttttggctggttaggcagccgtattattattggcatatggattgcctttgctttaagtatggcgggcttatattttaatgggcatattattagccgtcgtacagacgttttaatctacctattagcttttgcctgctctttggtttggtacttttcgattactgcacgtcaagaccgtgactggaaccctgaagttgccaatatgctaagttacgaaaaacacggcgatgttattactttgcataatgtccgtaacttcaactggcatcctgatggaacctatgatgtccgctgggaaacccgtacttttgacctgaaccagttaaatggcataaatattattacttcttactggatggggccacaaatcgcccatacgctagtcagtttcgaatttaaaaatcaacaacctttagttttttcgatcgaaattcgaaaagaaaagactgaagagttttcagcaattggcggcttctttagaaaatatgaactgagcttaattgcatctgatgaaaaagatattgtctacacgcgtagcaatatccgtaaagagcaagtttataatttcccggtcaatatgcctcgctctgagcaaaaagcgctatttttagaataccttaaaaaagcagatgaactacgcgcagaaccaaagtggtacaataccctcacaagtaattgtacaactttaatttttgatatggttcaagccattaacccatatcagcttcctaaagattatcggttaattgcctctggttacttgcctaattatttatatgatcttaaagcactcgatcaaaatattagcttgaaacagtggtaccaaattgcacacattaacccacgtactgaacatttcgaacaatttgcagaccaaagcagtgagcatttctctcaaattgttcgacagggtttacctaaagtaaaatga

SEQ ID NO: 4026 - DNA, 534 bp, Acinetobacter baumannii
atggcaattttagaacaggaaagtttagttatgtcacgtgttgctcgttatcatgccgatcgtaccaatcaaaaactctattttgcacgcctagcgtgtcaacaagcagagcaaactgatcatgtacagcaggtacaagcgtatcgtgaagcagctgtatttcatttacatggtgcgatgttggcatttttgcaagaattggtacgttattaccgtttaaatgacttgcaaccgacattaaaatctattgaagagcatatggcggcaaaaggacaagtttctccggaagtttctgttttgcagcaattggcaaaagatggcttcgttgcagaattaaaacgtgcttaccgtatgtgccaatatgcaccggaaccaactgaaccgacaccggaagaagaaacttcttctaatttgatcattaaagtgactcagggaccacaatcatggttacctgatgtgaaaattttgcgtgaatggcatagagagttaagtcatttaattgatggttttcgtaacgaaatggtcgagttctaa

SEQ ID NO: 4027 - DNA, 1356 bp, Acinetobacter baumannii
ctaatttttatcgaggaagccatgcaagtaacgactgaagcggtttcgggcgttgcccgtcgtttaaatgtttctgtaccgacgagccgtattaacgagcaatttgaagctcgtttgaagcgcactgccaaaactgtgaagatcaacggcttccgtccgggcaaagtacctgcaaacgttgttcgccgcgaatacggtgcaagtatttatcaagaagttgtgaatgacatcattcgtgacagcgtatttgaagcaattcaacaagaaaaaatcaatgcggtaggtatgccgaacattgagaaagttgaacataaagaagatgctttagtttttgaagcaactgtagaagtttatcctgaagttgaagtaaaagcatttgacggtttggaagttgaacgtaaaacagctgaaattaaagacgctgacgttgacaccatgatcgaaaacttgcaaaagcaacgtcaaacttgggctgtaaccaagggtatggcgaaaaaagacatgcaagtgacttttgacttcgaaggttctatcgacggtgagaagttcgaaggcggttctgctgaagactttaaacttgtgttaggttcaggccgtatgattcctggcttcgaagacggcatcattggcatgaaagctggtgaagagaaagttattgatgtaactttccctgaagattaccaagctgaaaacttagcgggtaaagcagctcagttcaaaatcactgtgaagcaagttgaaaagcctaaacttccagagattgatgctgaattcttaaaaatcttcggtgtttctgaagaagaaggcattgaaaaattaaaagctgacgttcgtaaaaacatggaacgtgaagttcgcaatggtttacgtaaccaagttaaacaagctgcatttgatgctcttgttgctgctaacgaaattgaagttccagctgcaatggttgctcaagaaattgaccgtcaacgtcaacaaatggttcaacagttcactcaacaatttggtggtgcaggcgcgcaatcttttgacaagagcatgcttcctgacgaattgttcaaagaacaagcagaacgttctgttaagcttggcgtattggtaagcaaagtattagctgatgctaaacttgaagttgaccaagcacgtgttgatgcttacatcgacgacatggcttcttcttatgaagatccaactgaagtgattgaatacttcaaaaatgatgctcaacaacgcgctcaaattgaagctgttgtattagaagatcaagttgttgatcacatcttagcttctgctaaagtgactgacaaagcagtatcttacgaagatttattgaaagaacaacaagctcgccgtatgggctaa

SEQ ID NO: 4028 - DNA, 681 bp, Acinetobacter baumannii
catgtttttatatttcaaaatggtacttgttccatgattagaaaactcattttattagtgatattcggattaatgtcatttgttacaaatgccaaaacccttgaattacaggagaagaacatgcgtcaaatatttgtgcttcacggttactcagcttctattaacgatcattggtttttggacctaaaacaccaaatagaagatgaaaatacaactgttactttaataccatttccagattctgagcatccggacgtcgatgcttggcagaaagttttagatgagcagattcctgcagttaatgaaaatacttattttgttgcccacagtttaggggtgattaccttgctacactttttacaaagacataattatcaaaatattggaggaatgattttagtatctggattctctggtccaatttcagattcttcacctcttagcccttatataacaaagagtaaagtcgatactaattatttccgtgacatagagaaaaagctggtttatttgtctgataatgatgatttggttccaccacaactaacgattcaattggctaaggatattgatgcgccttatattaccgttcctaatggtgggcactttttaggtcgggaaggttatacggaatttccgcaattagtcgattctttaaaagaaatattagagagtgaataa

SEQ ID NO: 4029 - DNA, 927 bp, Acinetobacter baumannii
gggggttttatggccgattcaagtattccaaaagatatcgctgatagcctcaaaagcatatttaccaatatcaataccgaacgaattagtgaaattttagtcggtgttgtgctttgttttattggttttgtccttgcccgtattatttcaaatacatttattagaaccgttggctcacgttttaatgctcaccagcgtctggtatggcgccgcggtattttctattttattttcttactcttcattatgacgagtttaaaagaagctgggttcaaacttagtgtatttctgggggcagcggggatcttaacagtagcactcggtttcgcatcacaaacatctgccagtaacttgattagtggtttatttttgattggtgaaggttcatttgaggtcggtgatacgattcaaattacacttattcgcggaaacacgatcgaaggcgaagttatctcaattgatttgctttcggtaaagttacttacactcgacaacgtctatattcgtttaccaaacgaacaactcattcgtgctcccgtacacaacttatcaaaatatccaatacggcgtattccaattactttggcaattaactttcatgaagacattattaaagtccgtgaggttctacttaacgtcgcagcgaattatccactcgtgttagatgatccaaaacctgctgttacagttactgccttcagggagtcatcgattgagcttttatttgcaatgtggtgtcgtcaagaaaactctttaaaagttcgagatgaaatgcaagaacgtatccgaaatggttttttagataaccaaattgaaattcctgttccgaaaatgggcttaattgatcgaccatctactgcttttgcagaagatgatatcgatcaatacagcaatcaaaaagagttaaaacgagagcctaaagcttag

SEQ ID NO: 4030 - DNA, 768 bp, Acinetobacter baumannii
gaggtgtttatgcgccgagttttgattgcaattgcaagtctggttgttattacgagtattattttttttacctatcaacatataaaacagcagcaagccaaagatagcagtcaaatgtttgatgtggtaatgactgaaaaaatgaatcagctttatgatcaggctcaagactggactaaacctgtacaacttgatattcacgataaacggctggcaggacactacaaacaagtctcagagtttcttttgagttattgggtccaaaatgtgaacgcacgtaatgaatatttaagagaattaaaagcggcgaaatgggatacgtttttaaatgttgaccgtttagatcatgataaaaaacaaaaatatgctgaaaccgaaaaaatgttagcggatgttcgcagagcttcagataagtatcaatccgaatatgaaaaaattcataaaaccttcttgtcaaaaattcaggaactgtctgttgataaagagatgagacaaatcctcgaaataaaattaggagctcagcaaaaagccgatcaggaccatgcaatttttatgattgagctacaaattttagataaagcagaagaaatgtttaagcttttaaaaacttatccatggcaaaagaaagatcagatgatacttttccatgaaaatgctcaggtcaaaaagtttaatacactgtatcaagacgttttaaaacttaatgcaaaaattgaaaaaattaagaaaaagaatgtagctgccttggaaggggagttaaaagaatag

SEQ ID NO: 4031 - DNA, 621 bp, Acinetobacter baumannii
atgtttattataaatataaataaggttggagatattaaagtgttcaaaaaagcattagttattgcattaatgggggtgtcttcatttacttttgctggtaattggcaagtaaaatttgggggtagcgttattgctccatctgaagacacaacaactgctttaggtgtggtaaaggcagaccatgaatatgcatttactccatcagtagaatacttttttggtcaaactccattttcggcagaattattattagcaacacctattaatcacgatgttttattagatggtcagaaagtagcgcgtattaaacaattgccaccaacaattacagcaaaatatcattttaaaaactcgactcgttttacaccgtatattggtatcggggcaacagcatttattccttgggatgaacaaggcgtagctgacaaagtaaaagaagattttggtgtcgctggccaagttggttttaacttccaacctgctgatgctaaaaattggggagtatttgtagatgttcgttatgcagatattagtccagaagttactttaacaaatggtgctaaatttgacttagatattaacccgtttgtttacactttaggttatagctataaattctaa

SEQ ID NO: 4032 - DNA, 870 bp, Acinetobacter baumannii
agttgtattatgaatcttgcagcctttgaagcttttgtaaaagttatggaaacaggttcgatctctgtggctgcggatcaactatttattacccaacctgctgtcaccaaacgtattcatagcctagaagaatactttggcgtaaagttatttgaatcggcaggccgtggggttcaagcaactcatgctgcgcattcattattaccaaaagttaaaagctggttaaatgaacttcgagatattcaccacacgctaagtcatgaacaaacccaaatacaaggtcgtttaaaaatcgggacgagtcatcacatcggtttgcatcacttgcctgctccgcttaaacactttgttcagcagtttcctcaagtcacgctagacgtacattttgttgattccgaacaagcacacgaacaggtacttgctggcgatttagagttagcttttttaacactcccgccctcaggtgatgagcgtcttaactatattacgatctggaatgatcctttagtttttgtagctgctccatttcatccattggctcaaaaaaagaatttaaccttacaagatttaattgaatatccaagtttgctgcctgccgcacagacttatacagcccaaatcaccttggctgagtttgaaaaacaatgccttaaaccgaaaattaccatgagcaataacccactagagtcaattcgtatgttggtctctattggtttaggttggtcagttttaccaaaaactctgctgaatcaagatatgcagcagcttgatttaaatgtcgagatgaaccggcagttaggcatggtatggcatcctgcacgtactcaatctagagccatgcaggaactaattaaaatgatgcaggagtag

SEQ ID NO: 4033 - DNA, 882 bp, Acinetobacter baumannii
gaaatgattatgcagccaaagatttatgccgtaacgacaagtgatcaacaaaccctgtgtgccaaagcttggggtgatgagaaaaatactccattagtgttagtgcatggttatccagataatcaggaagtatgggaatcggtcattgagcatttaatcaatgatttttatattgtgacttatgatgtccgtggggcaggcttatcctctattcctaaacggatacgggattaccgtttagaacgtttatctttagatttgcaggaagtcgtagatgaggtaatcccaaatcgacagttccatatggctgcgcatgattggggttcaattcagtcttgggaatctgcaacagaacctaaatttaaaggccgtttactctcttatacaacaatttccggtccatgtttggatcatgcggcacttttcttaagagagaagtttaaaacatcacctgcacagatcttaaaaatactcacaaaatcatggtatatcggagcattccatttaccgctaattgctccaactgtatggtcgctgtttagcccagaaaagtggggtaagatcttaaatgacttagagcgaaaagataatttgcctttaaatagtaatatttcttcagatgggaaatacggtattaacttatatcgtgcgaattttattccacgtttaactggccctcgtcagcgttatgcgcaatgtccagttaaagcaattattttaaagtacgacacttttgtcagccccgaatatattacagaagcgatgccaaaatgggttgaaaacttcgaatatgttgagcttgaagcaaatcattgggcgattttaagtcaggctgaaaaagtggcagctcatattcgccaatttattgactctcagagctaa

SEQ ID NO: 4034 - DNA, 1053 bp, Acinetobacter baumannii
gcttacgttatgatcaaactctcaacaagaggaatgatgattatgaaagctgtggcatatcaaaaagcggggcctattacattgccagaggcactcgtagatattgaactcgacactccagtagctaaaggacatgatttacttgttcgtgttcaagctgtatcagtaaatccagtcgataccaaaatacgtaaaaatgtaagtgctgaacaatctggctggaaagttcttggatgggatgctgtaggcacggtagaagcgattggcgataaagttactcaatttaaaattggtgatgtggtttggtatgcaggtgctttaaatcgccaaggcagtaatagtgaattgcaattagttgatgaacgtattgtcggtcataaaccaaaaactttagaagcgactgaagctgcagccctccctttaacagcaatcacagcttgggaaatgttatttgatcgtctacaagttccaaagactgcgcctgctaatacgactattttagtgattggtggagctggtggggtaggttcaattaccattcagcttcttaagcaattaactaacctcacgattattgctacagcttcacgccccgaaacaaaagaatgggtagaacaactaggtgctgattatgtattagaccaccgtcagcctttagctgcacaaattaaacaattaggattaagtgcacctttatatgtattctcaaccactgaaacagatcaacatttatcagatattgtagagttaattgctccacaaggtcattttggacttattgatgaccctgatcagttagatattaaaccgtttaaatctaagtctgtctcagttcactgggaatttatgtttacgcgctcaatgttccaaacggaagatatggaaaaacaaagtgcgctactaaatgaagtcagtaaactggtggatgaaggtaaaatcaaaacaactgtgactcaggttttaagcccaattaatgctgaaaacttaacacgggttcatgagcaaattgaaagtggttcaaccaaagggaaaatcgttttacacggattttaa

SEQ ID NO: 4035 - DNA, 663 bp, Acinetobacter baumannii
acgagaattttcatgaaactggcgttgtttgatttagaccataccttgttaaataccgattcagaccactcgtggggtgaatttttagtcaatgaaggtttggttgatccggttcatcatcgtcagatgaatgataaattttatgaagactacaaagcagggcaactagatccatatgcttataatgagtttgttttcggctttctaacaaagcatgacaataactacttaactgagcttcatcagttgtttatggaaaaagtgattcgtcctcaaatgcgaccaaaaggttttgatgcaatcaaaaaacatcaagatttaggccataccattgtaggtattacagcaacaagtgattttattactgcgccgattttccgtgaatttggaattactgaaatcttagcaactaacgccgaggttgctgatggtaaatatacaggtaaagtggcgggtttagcgtgttatcaaaagggcaaacttgcacgtcttgaggcatggctggacggtcgtagcgtttctgagtcatgggcttattcagattcaattaatgaccgttttttacttgaatatgcaacgcatgcgattgcagtcaaccctgatgatcgccttgaaaaactggctcaagaaaataaatgggaaattcaggactggtcaatttaa

SEQ ID NO: 4036 - DNA, 2634 bp, Acinetobacter baumannii
cttacgtctatgactatttctcacattgacccagaatatcaagcaaacacgattgaaccatcagtccaacaagattgggaaaatcgtaaagtctttaaagttgccgacactgtcgaaggtaaacatcgctacatcctgtcaatgttcccttacccaagtggcaaactgcacatgggtcatgtgcgtaactataccattggcgatgtaattagccgtttttaccgtttaaaaggcgaaaccgtattacaacctatgggttgggatgcatttggtttaccagcggaaaacgctgcaattgcccataaagttgctccggcaaaatggacatttgaaaacatcgcttacatgcgtgaccaattaaaaaaattaggtctatctgtagattgggatcgtgaatttgcaacgtgtacaccagagtactatcactgggaacaatggttgttcgttcagctttataaaaaaggtttaatctaccgtaaactttcaacagtaaactgggacccggttgaccaaacagttttggcaaacgaacaagttgaaaatggtcgtggttggcgttcaggtgcattggttgaaaaacgcgatattccaatgtactacttccgtattacggactatgcacaagaattattagacgacctagacactctacaagacggctggcctcaacaagtgttgaccatgcagcgtaactggattggtcgttcgacaggtatggaaattaccttcccatctgccaatactgaaatttatgctgacggcttaactgtttatacaacacgtgccgacacacttatgggtgtgacgtacgttgccgttgcagcagaacaccctcttgcgcttaaagctgctgaaaataaccctgaattggctgcatttattgaagaatgccgcatgggttcagttgcagaagctgacttggctacagccgagaagaaaggtatggcaacaggtttgtttgtaaaacaccctgtaactggcgaagagcttcctgtctggattgcgaactacgtattaatgtcttacggttctggcgcagtgatggctgtaccagcacatgacgaacgtgacttcgaatttgctaacaagttcaacttgccaattaagcaagtcattgatgccaaaggtgctgacgatgcagactactctgcaactgaatggcaagaatggtacggttctaaagaaggtaaacttgttaactctggcgaatttgacggtctagaattccaagctgcattcgatgcattccttgcaaaattagaaccacaaggtttagcaaattctaaagttcaattccgtttacgtgactggggtgtttctcgtcaacgttactggggttgtccaattccaatgattaactgtgatacttgtggtcaagtcacagttcctgaagatcaacttccggttgtattaccaactgacgttgttccagatggttcaggtaatccactaaataaaatgcctgaattctatgaaactaaatgtccttgctgtggtggcgatgcacgccgtgaaacagatacattggacacatttgtagaatcatcttggtactacgcacgctatgcatctccagactttacgggcggtatggtaaaacctgaagcagctaaaaactggcttcctgtaaaccaatatattggtggtgttgaacacgcgattcttcacttactttatgcacgcttcttccacaaattaatgcgtgatgaaggtgttgtacaaggtaatgagccatttaccaatttgttaactcaaggcatggtgcttgcagatactttctatcgtgaagcagaaaatggtaagaaaacttggttcaaccctgctgacatcgaattagaacgtgatgagaaaggccgcatcatttctgcaaaatattcaggtgatggtcaagaagtgattatcggcggacaagaaaaaatgtccaagtcgaaaaataacggtattgacccacaagctattattgatcaatacggcgcagatacagctcgtgtatttatgatgtttgctgcaccaccagatcaatctttagaatggtctgatgcaggtgttgaaggtgcaaaccgtttcttgaaacgtgtatggcgtctggtagcaagcttccttgaaaaaggaaactctgcaacagcaattgataaagcaaacttgtctaaagatgctcaagatttacgtcgtaagacacacgaaaccattcaaaaagtaagtgatgatattgagcgtcgtcatgcgttcaatactgcaattgctgcattgatggaattgttaaacgcaagcaataagtttgaagcaaaagatgacaatgacgttgctgtagaacgtgaagcaatcaccacattgttaacgttacttgctccatttgctccgcatttaagccagactttattggctcagtttggtacggacttaacagaagcaactttccctgaagttgatgcttctgcattaacccgcaatactcaaacgattgttgtacaagtaaatggtaaacttcgcggtaaacttgaagtttctgttgatatttctaaagatgagttattagctcaagcgaaagcattaccagaagttcagcagttcttaacaggaccaaccaaaaaagaaattgtggttccaaacaaattggttaacctcgtggtttaa

SEQ ID NO: 4037 - DNA, 951 bp, Acinetobacter baumannii
attctttatatcgttatgagccaaaagcagccttatacgcccggtgagtttcaatggtcctttttgttgcctaaatattggggtgtgtggattgcgattactttcctgatgcttttggctattttaccgtgggcaattcaatggcgcttagctcatggattggcaaaccttgcttggaaatatttaaagtctcgtcgtaaaaccacaattcgtaatttagaagtttgctttccagaatggtcacctgaaaaagtacagcaacaagcaaaacaagtttttgtagatatgatgcttggtatttttgagacattaaacgcatggtataagccttactggtttaaaaaccgtgtcactattgaaggcttagaacacattaccaatgcacaagctcaaggcaaaggtgttttattgcttggtacacatagtactttactcgatgcaggtggttatgtatgtgctcaatattttgagccagatgttgtatatcgccctcaaaacaaccccctcctcgatatgctaatttatcgttgccgcggcacaatttataaagcacaaattgatcatgatgacatgcgtggtttgattcgtcatcttaaagagggcgatgcaatttggtatagtcccgatcaagacttcggactcaagcaaggcgttatggcaccattttttggagtgccagctgccactgtaaccgctcaccgccgtttattaaaaatctcgaaagcggttgctgtgcctttatatttttatcgtcatggcgatgtacaagaccctaaatatcatatcttgattgaacttgcggtcgacaatatgccaagtgaagatgaagtcgatgatgcaacgcgtgtgaataagattattgagaaccagcttcgtatcgcaccaactcaatatatgtggtttcaccgtcgctttaaaacacgtccagagggatatgaagagatttattaa

SEQ ID NO: 4038 - DNA, 2679 bp, Acinetobacter baumannii
agcctgatttttaaatttattggtataggaataacattttatatggcgaatacctcgcgctctgcatctcaaagcacagcatcttctgcctctgctgcacataaacgtgccttagtgattgtggagtcgcctgccaaagcgaaaaccatcaacaaatatttaggttcgcagtacattgttaagtcttctgtaggtcacgtacgtgacttgccaacaggtggcagtaaagcaacagagaaaaagccggctgcccggaccaaactcactgaggctgaaaaagaacaaaaagcgaatcaagctttaatcaatcgtatgggcgtcgatccagaacatggatggcaagcgcattacgaagttctgcctggcaaagaaaatgttgttgctgaactcaagaaacttgctaaagatgcagatgcaatctatctcgcaacggacttggatagagaaggggaagcaatcgcttggcacttacgcgaagtgattggtggtgacgatagccgttatcatcgtgtggtatttaacgaaattactaaaaatgccattcaagaagcatttaaacagccaacacgtctcgacttaaaccgtgttaatgcacagcaagcacgtcgtttcttggaccgtgtagtaggcttcatggtttcgccattactgtgggaaaagattgcccgtggtttatcggcaggtcgtgtacagtctgtagcggtaaagcttgttgttgaacgtgaacgtgaaattcgtgcttttattccagaagaatattggcaagtctttgcagacactaaagctaaaaaagatgacattcgtcttgaggctgttaaacaggcgggtaaaacgcttaaattaaaaaataaagctgaaacagatgccctgttagatgtattaaaaggtgctgaatataaagttgcccagcgtgaagataaaccaactaaggtgaatccaagcgccccatacatcacgtcgactttgcaacaggctgcaagtacacgtttaggtttctctgtaaagaaaaccatgatgttggcgcagcgcttgtatgaagctggtttcattacttatatgcgtactgactcaacgtttttgagtgatgatgctgtaagtatggtacgtgcgcatattgaaagccaatatggcgaaaaatatttaccagctaagccaaatcgctatggtaataaagcaggtgctcaagaagcccacgaagctattcgtccatcaaatgttgcgctgactggtgatcaacttgctggtgtagagcgtgatgctcagcgcttatatgatttaatttggcgtcagttcgtagcttgccaaatgactccggcagaatatttatcttcaactttaacagttgaagctggcaatgtggagttaaaggcaaaaggccgtacgcttgtatttgatggctttactaaagttcgtggtgccaacaaatctgatgacgatatcattttacctgcaattaaagtgggtgaaattttaaagctagaaaagctagatccaagtcagcattttaccaaaccaccagctcgttttactgaagcatctttagtaaaagaacttgaaaaacgtggtattggtcgtccgtcgacttatgctgccattatttctacgattcaagaacgtggttacgttaagttagaaaatcgccgtctctttgccgagaaaatgggtgagatcgtaacagatcgtcttgatgaaagttttaataacctaatgaattatgcatttacagcagatttagaaggtcagttggaccgtgtagcaacgggtgagcgtaactggaaagaattgttagacacattctatggtgattttaaaaagcgtttgaccaatgctcaaggtgagcagggaatgcgtcgtaatcagccagttgaagtaccagcagtacattgccctgaatgttcacgtccaatgcagattcgtacgggcactacaggcgtattcttagggtgttcaggctataacttgccacctaaagaacgctgtaaagggaccttgaacttaacgccagttgagtctctagcagcgttatctgatgacgatagtgctgaaacagcagacttgatgtcaaaacatcgttgtccgaaatgtggcacggcaatggatagttatgtcattgatggtggtcgtaagttacatgtttgtggtaacaacccagattgcgatggctatgagcttgaagaaggcgagttcaagatcaaaggttatgatggcccaaccattccatgtgataaatgtgatggtgaaatgcagcttaaaactggccgttttggtccgtatttcgcttgtacaagctgtgacaatactcgtaaagtcttgaaaaatggtcagcctgcaccaccacgtgtagaaccaatcaagatggaacatttgcgttcaaccaagcatgatgattattttgtgttacgtgatggcgcggctggtctgttcttggctgcaagtaagttcccgaaaattcgtgaaacacgtgcaccaaaagttgctgagcttcgtagcgtagctgatcaacttgatccaaaataccagtttattttacaagctccagatgtagaccctgaaggtaatccaaccattgtgaagtttagtcgtaagaaccaatcacaatatgtgggttctgaaacaccagaaggtaaacaaactaaatggagcctaatttatcaagacggtaaatggattgaaggctaa

SEQ ID NO: 4039 - DNA, 2823 bp, Acinetobacter baumannii
aggtgtcatattgctaagcccatgtataaaaaagacaaacagggaatgatcatcgttttgatcgctttgactttgtttttagccatttcaattggttttaaatttcagagtgccgttattgctttatctattgcgctcactgtcatactggttcagtcattatcaagtctgcatcaacgtttaactcatttagaacaacagttttctcaccagacaacgccactttattctattcatatgcaaagaacggtaatttataccgccgctttggttgcattaattgcttatatcaatcattggatgtggattgctggtggggcattattggttttactgttatgtttgattcaaaccatcagtgcatttcatactcgtttattgttcctcgagacagccaagcaaacagtaaatgaatctatacatacagaagtgataacgcctgttttagagcaagttgttccaaacaatattaccgagccagctttacctgaaacaacagcgttaaatcaagaagaacaaatagttcgtacacagaccaccgcatggtggcaaccagcagtcgattggatgattcatggtaatccaattttaagggttgctgttgctgtgcttatggttggggtagtgctcttactgcgttttgcaagtgagcactggcagttgagcttaggtgtaaaacttggttttattgcgattgcaggaggtgtattaacagcatttggatataccttgcaaaagaaaaatcagctatttgctgtggcactgcaaggtgtagggctagctgttgtctttctaacgcttgtgttctcacatcattttggtgtaatcaccagcctaactacagccagtattctatttacgattttattagcaattacagtattcctgagtttaaaacaacaagctatttatttggcaatactcgcactgggtatggcgtatgcggctcctttagttattccgcaatatcgtcctgatgtggtttttttatttagttactatcttgttattaatcttgcagtcgctgctgttaattttattcagccttggaaaatcctaaatcagatcgctttctttgccacaatgtttattggcggtagtgcaatcgcattttatgcagagccagcaaaatttgacacattagactggattttatggctccatatagcgttatttatttggttaagtgttcgttatagccaaaatatctctcgggtttcagaacatgaaaaacaagagggcattcgtttacctccgctcttagatgttggtcttatttttaatgtacctgtactaggctttacgcttcatgcctatttagttcatgagtcgacccaagctttaacaattggtgctgctgttttagcaggcacctatgcggtgttaacgttctggattaaaaaaactcatcctcagctttcagtccttgcaaaaagttttttcattctcgcggttgctttttttgccttaatttttccactcgcaaaaggggcgcactggactgctattggctgggttgcacaaggaacggctttaatcgtttggggagtaactgaacgctaccgtttaagccgatatattggtgtgattttagttttactcagctcccttgcactgttttatcaggtttgggcaaatgaagagtttccaacgctaagcactagcatttatgcaattgcccaattcatttcggccttttatttattgcaatacaacagcaaagaacaacgctattttagcgcaagcatgtttagcggtattttcttatgtttaggcatgtatgcgggcgccgtagcaggtgtagaaataatggcatggcatcatcatgctttaagtccatatttgatgtttgctatcgctctaatagcaatatttagtgcgattgttcactataaacttcgtgtgcaatggcaaagtttgcagttaattttaattagcctgttactgttattagttttgggtgaggcctttgcgagtcaagtatttactttgtttaaatgggtagactcattacaacaaactactttcctagtctctaccattattcttagtggcttatttattatggctcaaccgcagtcaagtcatttgggttacgtcaaggtatgggcgggtttaagctggttagcgttagcgatagttggtgtggctattttcccaaaaatgccaattgtcgctttggcttttgttcctgtggtttattcgctttgggcgtataaggctcataaaacaacactgttacatcaaattccggtgtggtgtttaagtttaatttggttgttagttgtgagcgttgatcgccactccgctgagtacctttattttgttcctttatttaacttaactgacttcttttcaattttggtattcgctggcctactctttattatttatcagcatgcttttgatcaagataaatcattggaatggacttttaaaattacaacaattttagtgggcttactggtatttagtagtgtagtcgtcagaggcttgcaccattactgggcaacaccgctatggagtgcttcaatttggacaaatggtgtagtacagctaagtttgacgttactttgggttatattggcatttattttgactacatactctagtcgaaaaatgattcgtcaactctggtttgtaggcgctgcacttttagggattgttgtattaaaactaattttgcttgatctatcacaaagtgcgacattaactcgggtcatttcgtttattggagcaggtggggtaatgttgattattgcttatcttgcgccattaccaccgtcatcctctgtacagaagaatcaagagcctaagctttag

SEQ ID NO: 4040 - DNA, 366 bp, Acinetobacter baumannii
aggaataatatgatgaatagaaaatttgccatggggctagcactttttagtggtttagcttttacgcatagtttgcaagccgctagtttctcttgcagtgctgcaaaaacaaagactgaactcagtatttgtaagaaccgatctttaaatgatgccgatgtcaaaatggcaacgacgtatcaaattgttttacatgcactaccaatgggtggacgtgataatcaaaaagatacacagcagcaatggctgaaaaaaagaaatgcttgtgcagctaatgtgagttgtatttctaaggcatatcagcaaagacaaaaacaactagacactattttacaagatcgggtcttaagccatggaccattttaa

SEQ ID NO: 4041 - DNA, 840 bp, Acinetobacter baumannii
agggataatattcgacctatgaaaaaagctactcagtccaaagcgtggacaacggttcaaattgcacgtcatcctgaacgtccgcagtttctagattatgtcggtgaaatctttacagagtttgatgcattgcatggtgatcgtttgtttggtgacgatggtgcgatggtaggtggtcttgctcgttttgacggtcaacctgtgatggtcattggacaacaccgtggtcgtagtacccgtgaaaaattaaagcacaactttggtatgtgtaacccagaaggttatcgtaaatctcagcgccttttagatatggctgagcgtttcaatctaccagttttcacctttattgatactatgggtgcatatccgggtgttggtgctgaagaacgtggtcaggcagaagcaattgctactagccttgctcaactttcaagcctgaaagtacctgtaatcgcaacagtacttggtgaaggcggttctggtggtgctttaggtattggtgttgctgacagagtgattatgttgtcacatagtatttattctgtgatttcgcctgaaggctgtgcatctattttgtggaaaactgctgagaaagcagctcaagcgagtgaagctttaggtttaacagcagataaactacaatcgctaggtattgttgaatatgtagtagatgaaggtgaaggtgcgcatttagatcctgagcgtgtgatgcaaaacttaaaagtagttttaaagcaggctttggatgaattgctaccaatggatgcaaatgaacgatgcgaagcacgttatcaacgtttaatgaagtttggcagcgaaaatttaggcatggcgtcttaa

SEQ ID NO: 4042 - DNA, 1830 bp, Acinetobacter baumannii
gtattcaatattaagccatgtatgccaatagtgaatcaaaacgctcgtccccatattgaaaaaattttagctaatctgacccaacttccaggcgtttataagatgctagggaaagagggggagttgttatatgttggcaaagctaaaaatctaaaaaatcgggtgtcgagttattttgttaaaaccattgagcacccgaaaactcaagctttagttgctcgaatttatgatattgaaacgctagttacgcgttcagaaaccgaagcgctgcttttagaacaaaatctcattaaacagcatcgtccgccttataacattatgctgcgtgacgataagtcatatgtctatatctttgtatcggcagataaaccttatccgcgaattgccagtggacgtggcaaaggtaagcaccaaatcggtaaattctttgggccttatccaagtgcttatagtgcgcgagataccttacttgttttacaaaaactttttaatgttcgccaatgtgaaaatagttatttctcacagcgtaagcggccgtgtttgcaatatcaaatcaagcgttgttcggccccttgtgtaggtttggtctcgccagaagattacaaagaagacgtgaataacagtattcgttttttacaaggtgataccaaagagttaaaccaggaactgattgcgaaaatggaacaggcagcagcagatcttgaatttgaaaaagcggttttttatcgggatcggttgtctttacttcgcgaagtacaagcacagcaagccgttttcaaagtgaaaggtgaggccgatattttagcaattgcctatcaggctggcgtgacatgtgtgcagattatgcatgtacgtaacggacgtatgttaggaggtaaaagctattttcctgacatgttaggcgatgaccttggtcaaatgctaagtgacttcatggcaaacttttactttcaggttgccgatgaagtaccaagtgaactgattgtgaatactgctttacctgaccgtaaagagctggaagaagccttagcacagcagtttggaaagaaagtccagattaagagcagtgtacgagaaacacgtgctgaatggttagaacttgccgaaatgaatgttcaacatgcgattaaagggcagttgagtaaccacttagaactcaatgagcgtttccaccagcttgagcaggtagttggccgtccgattgatcggattgaatgttttgatattagtcataccatgggtgaggcaccgattgcatcatgcgtagtgttcgaccaaggtggtgcacgtaaacgggactatcgccaatttgccattcaagatattactgcgggtgacgattatgcagcaatgcgccaagctttaacgcgtcgctataaaaaggcaatgttaccagatctgcttttaattgatggtggtaaaggccagctccatatggccatggaagtaatgcaagagcttgggttagaagcttttatggtaggtgtatcgaaaggtgaaggccgtaaaccggggcttgaaacgcttcattttaccgatggcacaaaaatccagttacctgaagatagtaaggcgctacatttgattcaacaggtgcgtgatgaagctcaccgttttgccattactaaacatcgcgctaaacgtgataaacgccgtagcacctcagttttagaagcaattccgggcttaggacctaaacgccgtcgagatttattaacacattttggtgggattcaaggtgttttaaaagcatctgaaaaagaactgacagtcgtgccgggcttaggtgaagtgatggcaagaacgatttataaaattttgcatgagtag

SEQ ID NO: 4043 - DNA, 954 bp, Acinetobacter baumannii
aggcaaaatatgatgttaacttctaaggcttcgctacgtttaacgctacttgcttctgcgatatttttggtggcatgtcagcctaaaagtgatcctaaagagtcggaagatcagcaaaaaccggctgtggttgaacaaaagcctgtagaactgactttgaaaggggaaacagttccaagtaaagtgactttaccggattgtgatggtaaaacttgtcctgaatttacggtagaacgcctacaaagtaattttccttttattgataagattattgatcaacaagttttaaaagcactcggtcagattcttgaaattgcagaacctgatgcaaaagcagcgcaagctgataagaagacagaagcttcagcagctgctgctacagagcagcaagatagttttgatgctcaggttcagcgctatgcaaattcatttattgatttggacaatgagttaaaggctctaagtagtaatcaccagattaatctgttggtgaaacctaaaatcatacagtctcaaggtaaagtcgtaactgttgttgtaaatagtagtagctatttaggcggggcacatggctcggcagcgcagcaatattataattttgacttaaagaaagaaaagcaggtcaaacttgaagacttattacgtccagagaaaaaagcggctttagacaaattagcacatgaagcgtttaaagcttgggtgacagactcaaaacttgcaaatagtgtgagtgaatatgagcaagcttggccgtttaaactcacagaaaatttcctgttaggtgaccaaggcttgattcttcaatatggcgaatatgaaattggaccttatgtggtcggactacctcgtttagtcattccatatgaccaattacaagatgtattgaaagaagaatatttgccgcagcctaaagctaaaccagcttcgacacctgccgtaaaaagtaccagctaa

SEQ ID NO: 4044 - DNA, 846 bp, Acinetobacter baumannii
atggcgaatatagttatggcaacagcagtgaattgtaatatctgttttattggtggtggtaatatggcccaagcattaattggcgggctcatttcaagaggattaccaccaacacgtattaccgtttcagatcctgtcgaacaaattcgtcaactattgcaagaaaaagaagttcatgtaactcaagataatacggctgctatccagaatgccgatgtagttgttcttgctgtaaaaccacaagttctggcaaatgttctacgtccgttaaaaggtttattatcggataaattggttatttcaattattgccggtgcggaaattaagacaatatcaaatctgattgatagcgaacgtattgtgcgagttatgccaaatacacctgcattggttcaaactggtgctcatggtatttacgcgactgatgtggttggtgcctcggaccgtgaattaacgagtcagattttagcagcaactggtttaacaatttgggtaaactccgaagctcaaattgatgccgtaacggcggtttcaggttcaggtccagcttatttcttctacctcatggaaagtatgattcgtgcaggtaaaaatttaggcttggatgaaaaagttgcaactgctttaactcttcaaacagcattaggtgcagctcaaatggcaattacgagttcaaatactccgtctgagctgcgtaaaaatgtgacgtcaccgaatggtacaacccaagctgcacttgaagtttttgatcgtgcacaaatctctcaaaatattcaatctgcattagctgctgcacagaaacgtagccaagaattggctcaagaactgagtgacagtgcaaaatag

SEQ ID NO: 4045 - DNA, 762 bp, Acinetobacter baumannii
ttttgcgatatagaaaaatcaaaagaaaacgctttgagggatgtcatgcgttatttaattattgctataagttgtgccgcattacttgcaggttgccaaagttcatcacacttagaaaagaattcaggtgagctgaccgccactttacctaaagttgatgttgataaagaacccggtttattggatcaatatcgtttagggggcttcactgtagggggatgggtaaatcaaaagttaggtcagacatttgcgccagttaaaccccaaaatgagcaggcagcagttgtctatctttaccggccagacacgaaatggaatcgtcaagaaattgcagccatcaatttatttgtaaatggaaaacgaattccaagtttattgcataaccattattactggattgaactgccagcaggaacttaccgtatttcagcgagccgccctttgttggggattcattttcaagaacctaaatatatcgatattacggtagatgcaggcgcatcttattatttgaagtatgatgaagaaaataaaatggaccgtagtgagcacacgggtccattcatgttaatgcaagataatattggtcgtagagaaattgcatttaccgagcttaaatcttctagctataattttgttgctgaagatgcttcaggaaaaatacgtcataaaccccaagaattaaaacctgctaaatataatgaaaagtcagatgtacatctgataaaaccatttaaattgtggaaccctttaacttggtaa

SEQ ID NO: 4046 - DNA, 1419 bp, Acinetobacter baumannii
ggttattgtatgaaacccgttattgcgctcattggtcgtccgaatgtcggaaaatcaacgttatttaaccagattaccaagagtcgtgatgcacttgtagccgacttcgcgggtttgactcgtgaccgtaaatatggtgatgcgacttatcaaaataagtctttcattgttgttgatactggcggtattggtgaaagtgaaggcggtatcgataactacatggccgagcagtcgaaaacagccatcaatgaagcagatattattatttttgtagttgatgcgcgtgccggattgttagcttccgatgagcaaattgcccgtgaattacgtactttaggcaagaaaatttatcttgttgccaataaggttgatggtgttcatgctgaagctgctttggttgagttctacaagcttggtatgggtgaaccattacaagttgcagcgagccatggtcgtggcgtacaacaaatgcttgaggatgtacttcaagatattccagaagatgaaagtcctgaagagcatgataaagataccggattacgtctagcaattattggtcgtccgaacgtaggtaaatcaacgttagtaaatcgcttacttggtgaagaccgtgtggtagcgtttgaccaaccgggtacaactcgtgactctatttatattccgttcgagcgtgaaggccgtaaatacactttaattgatacagcaggtgtacgccgtaaaggtaaagttgatgaaatgattgagaaattctcaattgtgaagactttacaagcgatgaaagacgcacatgtggtggtggttgtagttgacgcccgtgaaggtattgttgagcaagacttacatttaattggctatgcgctggaagctgggcgtgccatggtcattgcgatcaataaatgggacaacatgagtgaatacgaccgcaagcagtgtaagcttgatgttgagcgccgttttgactttattccttgggctcgaattcaccttatttctgctctacatggtactggggtgggtgagttatacccatcaattcaccgtgcttatgagtctgcaaacttaaaggtatctcctgcgaaattgacgcagattttgaatgatgcaactgatcagcatcagccgccgacagttcaaggccgtcgtattaaaatgcgttatgcgcacatgggtgggcaaaatccaccaactattgtgattcacggtaacaaggtggataagactcccgcagattatcgccgttatttagagaatgtgttccgtaaggtttataagcttgaaggtacaccggttaaaattgaatttaagacttctgaaaacccgtttgaaggtcgtaagagtcaggttgatgagcgtacagctgcacgtcgtcgtcgttatattcagaaattcaaaaaagcagaaaagaaatttaaacgttaa

SEQ ID NO: 4047 - DNA, 735 bp, Acinetobacter baumannii
gaaaaaagtattttgaatcggtgtaaatctatgaatctcccaaatgttgatatgaatcttcttgatcgacctactttagagaaagttcaagctaaagcactggatcatgcaccacgcatcttattgttgtatggctcgaatcgtgaacgttcttatagtcgtttagcggtgatggaagcaggacgaatcttggaggagtttggtgctgaggtgaaaatttttcatccgaaaggattgcctttgccagaagatgccgatactgaacatccaaaagtaaaagaattgcatgaacttttggcttggtcagagggtatggtttggtgttcacctgagcgtcatggttctatgagttctatttttaaatcccaaatcgactggattcctttggctggtggtgcaatacgtgcgacgcaaggtaaaactttagcacttatgcaagttagtggtggttcacaatcttttaatagcgttaaccagatgcgtattttggggcgctggatgcggatgattacaatcccgaatcaatcttcaattcctaaagcctttttagagtttgaagaagatggacgtatgaaagcatcttcttattacgatcgtatagtagatgtgatggaagaactctataagtttacattacttacgcgtggacaaagcctgtatctaactgatcgatattctgagcgtaaagaatctgctgaagaattatctaaacgtgttaaccagcgtagtctgtaa

SEQ ID NO: 4048 - DNA, 1602 bp, Acinetobacter baumannii
gtgtatttcatgagttttaaagatgagttagcggcacaggtcgctcaacgacgcacatttgctattatttcccaccccgatgccggtaaaaccaccatgacagaaaaactgttgttatggggtaaagcgattcaggttgcagggatggtaaaaagccgtaaatctgatcgtgcagctacatctgactggatggaaatggaaaaagaacgtggtatttcgatcaccacgtctgttatgcagttcccatataaaggtcacacgattaacttactcgatacaccggggcacgaagacttctcggaagatacttatcgtacccttactgctgttgactctgcactaatggtgattgatggtgcaaaaggtgtcgaagaacgtaccatcaaattgatggaagtgtgtcgtatgcgtgacacaccaattatttcattcgtcaacaaaatggaccgtgaaattcgtgagccacttgagttgttagatgaaattgaaaatgtcttaaacattcgctgtgtaccaattacatggccacttggtatgggtcgtgactttgctggtgtatacaatattcttgaagataaattgtatgtctacaaagcaggttttggttcaaccattaccgatattgaagtacgtgatggctataatcacgccgatattcgtgaaaaagttggtgagttagcttgggcttcttttgaagagtcacttgagcttgtacaaatggcaaatgagccattagatcgtgaacttttcttacaaggtaaacaaactccggttttatttggtacagcattaggtaactttggtgttgaccacgttctcgatgcatttatgaactgggcacctgaacctaaagcacatccaacgcaagagcgtatggttgaagcaaaagaagaaggtttctctggctttgtatttaaaattcaagccaacatggaccctaaacaccgtgaccgtattgccttcatgcgtatttgttcaggtaaatacgagaaaggcctgaaaatgaatcacgtacgtattggtaaagaagttcgtattagtgatgcgttgactttccttgcaggcgagcgtgagcacttagaagaagcatggccgggcgatattattggtttacacaaccacggtacaatccagattggtgatactttcactagcggtgaaaacttgcacttcacaggtattcctcacttcgcgccggaaatgttccgccgtgtacgtttgaaagacccattaaagtcaaaacagttgcaaaaaggtttgaaagagttgtctgaagaaggtgcaactcaggtatttatgccacaaattagcaatgatttgatcgtgggagctgtgggtgtacttcagttcgacgttgttgcttaccgcttgaaagaagaatataaagttgactgtgtttacgagccagtaagtgtaaatacagtgcgctggattcattgtgatgatgaaaagattcttaacgagtttaagaaaaaggcacatgaccaactttctattgatggtggcggacacttaacgtatcttgcgccaagccgagtgaacttgcagattatgcaagagcgttggcctgatattgagttccgtagcacacgtgaacactaa

SEQ ID NO: 4049 - DNA, 684 bp, Acinetobacter baumannii
atgagaatcttactagttgaagatgaacaaaaaactggtgattatctaaagcaaggtctttctgaggcaggatatattacagactgggttacagatggcttatcaggtaaacatcaagctctttctgaagaatatgatctaattatactagatgtaatgttaccgaagttagatggttggaatatcattaatgatattcgcaaaagtggcaaaactatgcctatcctttttctctcagcacgtgatcaaattgaagatagagttaaaggcctggaactaggagctgatgattatctcgttaagccttttgcttttgcagaacttcttgcccgaattaaaactttacttcgtcgcggtcaacaaaaggaagatagcaatattattactattgctgatcttgaacttgatcttcgtaaacgccgcgtcacacgtgctggacaaagaattgaccttacagctaaagagttcgcattgatggaattattcatgcgtagacgtggagagattctgcctcgtgctctcattgcttctcaaatatgggatatgaattttgatagtgatacaaacgttgtagaagtcgctattaaacgtctaagaaataaaatagatagtaattttagtcctaagttgattcaaaacatccgcggaatggggtatgtcttagaggtagaagatgactcataa

SEQ ID NO: 4050 - DNA, 2109 bp, Acinetobacter baumannii
gatgagttcatgttattaaagcaaatactggctttccgcccgagtaagcttgatctaatttttgcaataaagacatttattgccggtatgttggcattatttgtttcgttcgaattagacctgattaatccaatgtggtcgatcggtaccgtcctgattatcgccaatccttattcgggtatggtgtcgtctaagtgtttttatcgtttattgggaacggtaggcggggccattattgccttaaccattactccgcatctgattaatacgccgtggatctttacggttgtgttatcactatgggtgggctttgcgctttatgtgtctttattagatcggactcctcgcagttatgcatttatgttggctggttattcaaccgcaatgattgtgtataacgcgattacttatattgatcagtacaatatttttgatattgctttggcacgtgtacttgagatttcaattggtgtgatttcgagtgcagttgtgtctgcaactattttgcccatgcatattggttcggcaatcaaacagcgcgtaacgaaaactctcaaagatacagaaaacctgtttgctaatttgttaaatgcagatcaacagcaaaacaatacacagcttttagctgctattactcgtgatacgaccgatattcatgctctggcagttcacttgagctatgaaaaaggtgagttacatggcatgaccaaacctttgcaagaaatgctccatcaaatgtcgatggtggttgcgaacttggttgctttatctgaacgaattaaacaactgcaagaactcaattttattgaaagtcattcagataaattaaagcagctttcagggcatgtgattcattttctggaacaaaaagatcagatgactgatgaaaatattctgcagttacctgacgagtttgaaaatgatttcttgaacttaaatgattcggcttctgaacatcagcaagtgttattggctgccatgaaaatggatgtgcgtcatttcattagtaatgttttagctgtaaaagttttatggcaacgcatcaagcaaggtaataaagagattccagataacattaccccaatgacgactaaatatccaagtttacaccgagatcatggtgtggcagtcagagggggtattagtgcagtgctgattacatttattgtgactggtgtgtggattctttctggctggaaagctgggttcatgatggcacagatcggtgcagtcactgcctgtatcttaacagcactagataacccggttcctgtcttacgtatttttatatggggcagtgtggcttcggcggttttagtttttatttacgcatttggtatttttcctcatgtcacaacgttttgggaacttggactcgttttattaccaatgttcttgtttgcggtttccatgatggcgaatcaggcactcatgccagtcgggatggtgctaggtattaataccatgatggggctgaacttgcacaatgcttatagcatggacgcagtgtcttatttagatagctcatttggtatggtcatgggcgtattggtgtcattagtcgttattgatgttgtgcgtgccatgtcacccgataccagtgcaaaccgtattttggctttacattaccgtgcgatgcgccaagccatatacattccttatggtattgaatttaaagttcacttacgggggatgttagaccgtgttggtgtcttaaatactaaaatggttcagtcagaagagattaaaaaatctattcaacaggctttggttgaatccagtgcgatcattgatttaagccgactacaagagttagcaaatcaagttccgatatcttcggaattagcccatcacattggccgtttgcaacaagatttagatgagctatttagagctaaagaaaatgaaaaaggtgaaagtgatgtattggtacagcacattcaccaaaccttatttgaacttaaacaacttgcttcaaatattgaagatatgactctgcgtcaaagattatttatttcactaaataatattgcttatagcatgtgtcatgtttcatcaaaccaaatgaatgcagatcgtacgcttacaggagccacagcgcatgggtga

SEQ ID NO: 4051 - DNA, 921 bp, Acinetobacter baumannii
ttcctgatcttcagaaaaatgaatcaattctcttctttttcatttgaatacagatctactgccttactttgcatttatagcttaggtatgctggttttaattcctcatatacagctttttcctacttctttgaaacactcacgctctacaaggcgaaccctgtattcgtctgtggttactctcaaaacaaaaagtcagtctgtatcttttttacattcaccatgcgaagtagaaccaagtcatagttcagataccgcacttattcaggacctgatggctgtatttggaaatgatacgttgtggagtcgcgcagcccaacataaacatccttataaaacctttggcaagatcaagaagaaagcttcaactcctcatgtttcagaaaataatccgctcacagcaagttggaataccatttcaacctggatgccatttgaaaatgatcttgatctaggctcaaactcggaaagtgatgtttatgtacaatttcttgccaagaaaaaatggaatttacgacataacattagtctagatactgaacaaattttccgatatggttcgactagccggaattacactgaaacgacgctgaacttaacgcagaaaatgcaagataacacattattttccaatacatttaatgtaaataagagtggaaaagaagattacaactgggggaattggactttccaacaatttgaatttataaaagataatcgtctgacttacggtatttatagcggtggtgtatatgccaataatgatatccgcctaaatagttggggaccttatatttcatggcgtcaaccgatatggagagattggatttttatgcaaaatgatcttaatttctttaaccatcttgatgatgaccccaagcatcagctcagtgtccaaatgaatctggaagctaatttttag

SEQ ID NO: 4052 - DNA, 1137 bp, Acinetobacter baumannii
ggaacgctcatgcagatcggaatcccaaccgaaactgtcgtcggtgaaaatcgtgtagctgctacgccagagacagtaaagaagttgattagcgctggtcatagcgttgtgattgaacgtggtgctggtgtaaaggctgcgtacattgacagtgcttatgaacaggtcggtgcaaccattacggatgatgcctatacgggtagtcaaattattttgaaagttcgtgcgccacaaggcggggaaattcaaaaacttgcagcaaatacaactgttgtagcaatgtttgatccttatcgtaataccgagctagaccaatttgcgaatcagcaagtgtctgcttttgctctggaattgcttcctcgtacgctttctcgtgcacaaaacatggatgtgttgtcttctcaagcaaacttagctggttataaatcagttttgcttgcagctgctgaatatcaacgcatgttcccaatgcttatgactgctgctggtactgtaaagcctgcacgtgttgtgattatgggtgttggggttgcaggccttcaagcgattgctactgcaaaacgtttgggtgcaattgttgaagcaactgacttgcgtccaacggcaaaagatcaggttgagtctttaggtggtaagtggttagacgtaccaatgtctgaagaagaacagcaacgtgcagcagatgcagcaaaaaatggttatggctggatgccgggtgagcaatacatcaaagaccaagctgcgattgtagataaagctgtgtcgaatgccgatatcgtgattacaacagcattgttgccaggtcgtgatgcaccgcgtctgatcaaagctgaaactgttgccaaaatgaaaccaggctctgtcattttagatatggcagttgaaacaggcggtaacgttgaaggttctaaagttggcgaaactgttgtcactgaaaatggcgtaaaaattttgggtattccaaatattccggccactgttgcgacagaagcttctgcattatatgcacgtaacgtttttaatttcgtagagactttattcgacaaagagaaaaactttgcgattaatcaagaagacgaaatccaaaaagccctattggtcactcatggcggtcaagtgctgcttaagcgtggttaa

SEQ ID NO: 4053 - DNA, 924 bp, Acinetobacter baumannii
gtgttgatcatgagtaatacacaacctgattttttagccgacgaatttttgttagatcactatgtaggtaaaacacctctggtccgtttgcagcgcttggcttgtcatacgcaggcaacggttttagcaaaattggaaggtaataatccagcaggttctgtaaaagatcgtcctgcatataacatgattatgcaggctgaaaagcgtggtcaaattaaaccaggtgatacattggttgaagctaccagtggtaatacaggtattgctttagctatggttgcggcgatgcgcggctataaaatgaaacttattatgcctgggaattcaagtcaggagcgtaaggacgccatgcgtgcttatggcgcagaattgattgaagcgccgaatatggaagctgcacgagatatggctttgcaaatgcaagctgaaggtctaggtttagtcctcaatcagtttggcaatccagataatgtggaagctcattaccttacgactggccctgaaatttggaaacaaacaggtggaaagattacccattttgtaagttcaatgggtacaaccggtaccattatgggtgtttctaagtatttaaaagaacaaaatccagatattcaaattattggtttacaaccttctgaaggttcaaatattgccggtattcgccgttggccacaggaatatttacctacaattttcgaaccaaagcgtgttgatcaaattatggatattccgcaaattgaagcggaaaaaacggctcgccgtttagcacgtgaggaaggaattagtgcaggtacatcttctggcggggcggtatgggcttcagtaaaaattgcagaagaaaatccggatgctgtgattgtttgcattatctgtgaccgtggtgatcgctacttgtctacaggcctgttttcagtacaggactga

SEQ ID NO: 4054 - DNA, 2343 bp, Acinetobacter baumannii
gaatttcccatgacagagctgacgccatatcatgaagaccaaaaattggacaataatacttctgacaatatccactttcgtgacattttagaacaacacatcagtcgtcgtagtttaatcaccaaagcagcaagcggtgcagtagcactgactttagcttctactttaactggctgtaatgataacgatgatgactctggctctaataatggtggaaccacacctgtagacccaaataaaaaaccggaaaaactcacttttacgcccgtagctaaaaatttaaatgatattgtgactgtacctgaaggttatgaagccaatgttatctacgctttaggtgactcaatcaatccaagagttggagattgggacgacaataatattccatctggcccaagcttccagtttcgctctggcgactgccatgacggcatgcattattttggcttaaacacatcaacaaaccgctttgacgagactgtgtcagcacaaggtttgttggtgatgaatcacgaatatattaatcagaccttccttcatcccaaaggtcctacaaaagtggatggacgtcgccctgaagatgaagtcattcgtgaaaccaatgcacatggggtttctgtagttcatattaaaaaagatccaaccactcaaaaagtagaaattgttaaaaattctatttttaatcgtcgtattacagcttctacagttatggagtttgcaggtgctgcagcgggttcaagcctgcttgcaactcgcttctcacctgctggacgtcaaacacgtggcactcataataactgcggtaacggttatacaccttggggcacttatttaaccactgaagaaaactttattggttatttccaacgttcgggtagcgatgaatatgcacgtacagatgcagaaaaaattgcattaaaacgttatggtttaggcgttaaaaaagatgaaccttatctgtatgagaaagatgaaaaaggtgcacctaaaaaagataaagatggcaagatcatttacttaaaagataaaaatggtgagttaatccctaacgttgatgaacaagggcgacaaatttatttaggcacaagttcgcgttacggctgggaaacagcaattggtcaagtagagtcacaagacttgtatgatcgctggaatgccgatgtaaaagcagctcaagctacccaagattaccgaaatgggccaaatacatttggctggatggttgagattgatccatttgatggacgccaaaatccggttaaacgtacttcattaggccgtttcgcacatgaagacagtgcttgccgtgccgtagtaggtcaaccattagcattttatatgggtgatgactctcgtggtgaatacatctataaattcgtttcaaccgctgtgtgggacaccaaagatataaacggtggttatacagctggcgacaaatacatgaatgcaggcaaattgtatgttgctaagtttaataacgatggctcaggtcaatggattgaacttgcttatggcaaaaatggcttaaatgaaagcaacaccacctacccgtttaagtcacaggcagacgttgttacatttgcacgcttagcagcagattctgtaggcgcaacaaaaatggaccgcccagaatggtgtacggtcaacccagtaaacggtgaaatctatgtcacactcaccaataactcaaatcgtggtaaagactatgcaactgatgcagccaatccacgtaactacacagacctatatgcaggcacaaaagaacaaaaaggaaacgtaaacggtcatatcatccgttttaaagaaactgatgacaaaacaactgctgaaaccttcaaatgggatatctatttatttggcgcagaagcagcaatggcttcaaacatcaacttatccggcttaacagataacaatgatttttcatctccggatggtatgtggtttgacccacgcggtgttctctggattgaaaccgatgacggcgcttacactgatgttactaactgtatgatgcttgcagctctgccgggtcaaatcggtgatggtggtacagcaacaacttcaaatggacagcaaaccataacaggtgccaaagttacagacgcaactttgcgccgtttcttagtcggaccaaagcaatgtgaaattactggtattgccatgactcctgactacaaagcaattttcattaatgttcagcaccctggtgaagattcaccaagttacgcaaaaccagaaagtaactggcctgccacacaaaaagacccaagtaataaaactgcacgtccacgctcagcaactgttgtgattacccgtaaagatggcggcgttattgccggttaa

SEQ ID NO: 4055 - DNA, 714 bp, Acinetobacter baumannii
gattctcccatgcgtgttgatgtctggtctgatgtagtatgccctttctgctatatcggcaaaaaacgccttgaacatgtcgctgccgaggcaggtatcgagcttgatattcactggcatagtttcgaactagatcctgatgctcccgcaaaacatgacacttcaaatactgagcgtttggctaaaaaatatggccgtacctatgaagagatggaagaaatggaacgcaacattgcggccatggctgcttctgaaggtattgacttccaatggcaaaaagccaactcaggcaatagctttaatgcacaccgtattatccaccttgcacaaagtaaaggtttaggaaacgaagcaaaagaagcctttttccatgcttatatgactgaaggtttagctattggcgaacgcgaagttgtagaagaaattgcttctcgtattggccttgataatgccgaagttgaatatgtactcgatacaaatgagttggctgactttgttcgtcatgatgaaaaaattgcacatgagcaactcaatgtaactggcgtacctttctttgtatttgaccaaagaatcgcacttgcaggagcacaacctcgtgaagtgtttttacaagtactagaacaagcacaactcaaggcaaatgctgaaaatatcgagcaagatgacgcagctgtttgtaatgatgaaacatgcgatattccacaaaataaatag

SEQ ID NO: 4056 - DNA, 1215 bp, Acinetobacter baumannii
aacattaccatgcctgcatatcaatttactgctattgatgcttcagggaagcagcaaaagggggtgcttgaaggagactcggcacgtcagattcgccaacaattacgcgataaagcatggactccgattagcgttgacccggttgaacaaaaagataagcatcaaagccacggattattccaaaaaaagtttagtgcttacgatttagcactgatgaccagacagctttcagttttggttgctgctgcaattcctttagaagaagctctccgcgccgtgagcagacaaagtgaaaaagcacatgtgcaaaatcttttactctcagttcgttcaaaagtattggaagggcattcactcgcacaaggtatgcaacagtcagggcgttttcctgacctttatattgctactgttgctgcaggtgagcgttcaggacacttagatctcattttagatcagctatcagactacaccgagaaccgttttgccatgcaaaagaaagttcaaggtgccatgatttacccaatcattttaatgctgatgtctttcggtattgtgatgggattaatgacttatgtggtcccagagatcgtaaaaaccttcgatcaaagcaaagatgccttaccatggattacagttgctttaatgaaagcgagtgattttatccgtcatgcatgggtatttattattctttttgcaattgtaggggtggtagcttttgtccgttttttaaaaactactgcgggacattatgcttttgatcgattaacactcaaattgccattattcggtaaactatcccgtggtattaatgctgcgcgctttgccagtactttatctattttgactcgttcaggcgtgccattggtagatgccttaaagattggtgctgctgtgaccaataactgggttatccgtgattcaatttcccaagcggctgagcgtgttaccgaaggcggtaacctcggtacgcaactggagcgcagtggttatttcccaccaatgatggtacaaatgattcgaagtggtgaggcatcaggtgagcttgaccgtatgcttgaacgtgcgtcgacaatgcaagaccgcgaggtgacgacatttatctcaaccttattggcattacttgaaccgcttatgctggtgttaatggcaagcatcgtactggttattgtaattgcggttatgctgccaatcgtaaatatgaacaatatgatttaa

SEQ ID NO: 4057 - DNA, 1503 bp, Acinetobacter baumannii
ggggcagccataatgttaagaaataaattagcacttactgtcatgggcgttgcggtaattagtctggctgcgggtggtggcgctggatactggattgcacatcagaaatacaatcctcaatcaggtccgcaacaggctgccaaagtgttgtattggtacgacccaatgaaacctgaacagcattttgataaaccggggaaatcgccatttatggacatgcaactggttcctaaatatgcagatgaaaatactatgatgactgaagacagttatcctgcggttaagattgatccatccctccaacaaaatttagcaatccgttatgcttcagtcgaacaagctgtgatgggaaatgctttgttaaccaatggtatattgcagaccaatgaacgacaggtagctattttacaaacaagggcaagtggtttcgtccaacgagtgtacggacatgccgttggggatatggtgacgcaaggcagtcccatagctgatatttcaatacccgaatggacaggagaacaaactgaatttctagctgtacttcgaactggagatcgttctcttattcaggcaagccgacaacgtttacagcttttaggaatcccacaaaatgtgattaatcaagtcgagcggacacatcgagtgcaatccaatatgactttaagtgcacctgtgagtggatttattgattcgttagaagtccgcaatggaatggctttagctatggggcaaacgcttgtcaccatcaaggggataagcccaatctggttagaagcatctgttccagaagcacaaattgccgggataaaacggggaatgaaagttgaagctacttttgttgcataccctcaaatagtgtccggtaaagttattgatattttaccaactttggatagcacgagtagaaccataaaagttcgtattgagttgcccaatagagagggaatgctcaagccgggaatgtttgcttctgttaaattctccaacaacccacaaagcaatttagttataccagagcaagctgttatacgtacaggtactcggaacgttgtcattgtgggacatgagcaagggcgttttgaacctgttgtagtacagttaggtcaaagtgatggcaataaaattgcaattctacaagggttgaaagctggtcagaaggtagtaatttcagggcaattcctgattgattctgaagcaaatttacaaggtgtattggataagctgaacactggacaatcgatgacttcatcccaagtggttaagacatcaatatatcaaggcattggtaaagttgaaaaagtcacagctcaagacattaccatttcacatcaggcgattcctgagttgggttggggggctatgactatgagctttaaacaaccagtgcaaccatttacccaaattcagcaaggcgatcaggtccgttttagatttacacatgctagagatacttacgttatttctgacatttccaagatgtctatgacatctatgaagaactaa

SEQ ID NO: 4058 - DNA, 1035 bp, Acinetobacter baumannii
agtatctacatggaagggcactgcgtgggtcagctaacagatgcatcagttgtattacgttttggctatcaagcaattcgtcgtgcaggattgccaacagaagaaatattaactaaagcgggagtcgctttaaatcaggtcgatacaaacgcacgtactccgttaagtgcgcagtatgccttttggactgctgctcaggaagtcagtaaagatccagacatcggtttgcatttaggtgagcatttacctttgtaccgtggtcaggtgattgaacatttatttattagtagtgaaacttttggtgaagggcttaagcgagctttggcttaccagcgactcattagtgatgcttttgatgcaaaactggtggttgaagatggacgctgctatttgaccaatggtgagcaggtaggggcagacaaccttgttaatcgtcatttttcagaatgtgcgatttcaggtgtgctcagattcttcaaatttattaccgaaggccagtttcatccgatcttcattgattttaatttcagtgaaggtgcttctgaagatgaatacttccgtgtctatggctgtccggtaagcttagggcagaaagaaacacggctatattttgaccctgccattttagattttcagctttggcaggcagagcctgaattacttcaattgcatgaacaattggcgattgaaaagttacaagaacttgcccgttatgatttagtgggtgaggttcgtcgtgcaattggttcgacacttgaaagtggagaaacgacgctagaaaccgtagcggcacaattaaatattacgccgcgtcgtttacggacgcagttaagtgaagcaaataccagcttccagcaaatactttctgactaccgttgtcgtttagctaaaaaacttttagctaacactaatgagagtgttgagcgtattgtgtatttaacaggtttttctgaaccgagtacattctaccgcgcgtttaagcgctggactaacgaaacaccggttgagtaccgtaagcgtaagcaacatcgttag

SEQ ID NO: 4059 - DNA, 1161 bp, Acinetobacter baumannii
caacaaaacataaagatagatatgaaaacatttcacatcattacatatcggcagctttttgcccttttgaccttaggatttggttcagtatgtatggctcatgcagaagtaaattcttcctcaacccaacaagtaaacggtttgtcatctggagcacaagccgaagaaaataaagatgaaaatcttttagaccaaattccaagatggattgatgcaaccccaacgattttcccggagcagtccaacgaaccaattgttccaccaaccgagcaaaccgaagatcagacttggtttgaccgtaaacaaaagaaaatccgtaattgggccgatcgtacatctggaaaaattgataattggtttggtgaagttgacccacaaaaacctgcatcagccaccattcgggtcatgatcgataactattggaatgaatatgataattatgaaatcaagcccagaattcgcggtaagattaaattacctactctagagaagcgtttaagtgtggtatttggtgatgactctttagatgacgaatttaataatagcccagccaatatcaatcaaaacccaaatcaagatccaaataaaaagttagatggtaaacgaactcgagatgacaacagctcaatcgcattacgttggtcaaatttctcgaaaaagctaccttttgaaacagatgctgacttaggtatccgttctggtgatgatatttatgtccgtttaaaagcatcgagagactggcaactccgtaatgattttaaattttatgcagaacaaatttatcgttatggcatagatagtgaaaactacttacgaactaatcttgaactcactcatgctcgtccaaatcagccaatcttatcaaaccagttcagcttaacttatgccgatgatcaagatgacgatttaacatgggaaaaccgtcttttccgagaacatagcttctttgcaaataaccgttttaactatggcatttatacaggtggctactacaatgacaacgatttacgtttaaacagttggggaccatttgtatcatggcgtcagcctgttttacgtgaatggttctttgtacaaggcgacctcaattactttaatgaccatcgtgaagatcgcaaccattatgtgagcacattcttacgattagaagcccttttctaa

SEQ ID NO: 4060 - DNA, 267 bp, Acinetobacter baumannii
ttagtttgcatttacaccaaaatttacaccataatggagaaaatggttcatggtgtaaatttatggggtcaattactgccagaaaaggtgcagatggaagtgttagttaccgagctgctatccggatcaacaaaaaaggttatccagcttattctgaaagcaaaacatttcattcaaaaaaagtggcagaaaactggcttaaaaaaagaggaagttgagattcaagaaaatccagacattttacttggcaaagaaacaactgattga

SEQ ID NO: 4061 - DNA, 759 bp, Acinetobacter baumannii
aggtcatgcatggcaaaaccggaatattattatggcgttcactcagtggagtcattgttagaacttgagccggagcgcgtgctgaccctgtttacattgaaagggcgcgacgatcagcgtttgcagaagatcctgcaattggcagagccttttggaattagtgtacaaaaagcaagccgtgatagcctcgaaaagcttgcgggtttgccatttcaccaaggcgtagttgcagcagtacgtccgcacccgactttaaatgaaaaagatctagaccagctcttggctgaaactccagatgccttattgctggcattagatcaggtgacagatccacataacttaggggcatgtatccgtactgccgctgcaatgggtgttcaggcagtgattgtgcctcgcgatcgctcagcaagcttaactccaactgctcgtaaagtcgcagcgggtggggccgaaaaagttaaatttattcaagtgactaatttggctcgtactttagcgcatcttaaagagacaactcatgtccgtgtgatcggtacgatgcttgatgaaaatgcattacctattcagaagtgtgatttctcgggtgctgttgtgattgtaatgggtgcagaagacataggtttacgtccaattactcaagcacagtgtgaccaaaaagcctatattccaatgtcaggtaacttacaaagtttaaatgtaagtgtggcaacgggtatggcactttatgaagcttgtcgtcagcgttctgaggtataa

SEQ ID NO: 4062 - DNA, 186 bp, Acinetobacter baumannii
tgcagatgcattacaacctgttttacaaaatatgattccacaagaattgacatggacgctgcacaatctgagttgagctctgttgtaggcattcagaagaaagcgtttttttatatttatttttcttatttggggcggttcataatcttggctaattcaggccatatcaagattatggggcgataa

SEQ ID NO: 4063 - DNA, 699 bp, Acinetobacter baumannii
acatggcgcatctgtgtttggtgcacttgttggcgaagagccacaagggcagatttaagacaaaggaattacaaagtaatgagcaagattgaagatgttgtcaaattaggtccagtaattccggtgttggcttttgactctgccgaacaaggtgaacatgtatcacgtgcgttgcatgctggtggtgtaaaggtactggaaattactttacgtacagcagctgggcttgctgccattgaacgtgcatctcagttagcagatgacattgtggtgggtgtgggaacaattactaagcctgagcattgtgcgcaagctaaaaaagctggtgctaaatttggggtatcacctggtttgaccaaagacttacatttggctgcacaagatgcaggtttacctcttttaccaggggtaatgacaccgagtgatctcattcaagcgattgagttgggctacgacattgtgaagtttttccctgctcaacaggcaggtggggttgagatgctaaaagcattttatggtccatttccaaacttacgtttctgcccaacaggtggaattacagcagagacagctccagattttttaaagcaacctaatgtggtgtgtgtaggtgggtcatggttaacacctaaacctgttgtcgctgcacaagattgggctgaaattacccgtttagcccaaattgcaagtcagttgtga

SEQ ID NO: 4064 - DNA, 1326 bp, Acinetobacter baumannii
tctttaagcatgaaaataaatatactgatggatggcgctatgcaaggctcatacgcgacagcactattaaaacaacagcaacttcctgaaagcttccaattctattttaaacaaaaacagcatttgtctaatactcaggaattgcaccaacttcatgagttggttcgtcctcgtttaaaaattgcgattgtgacagaaacatggccgcctgaaattaatggtgtagcactctctttgttgcagttatgccaaggtttacagaaacaagggcataaaattctacttgttcgacctgagcaaaaagccaaatgccatgattttttgccagaacaagaatgtctggtcatgtcacaagcgattccaaaatatccaactttgcaatttggctggccccaatatttaaaagtttcaaaagcttttgaaaaatttgtgccagatgtcgtacatattgtgactgaagggccgttaggtttaacagccatgcaagccgcaaaagccaaagatattccggtctctagtggttttcattcgccgtttcaagattttagcaggttcttcgatttggcctttttggtgaagccgattcaaaaatatctttgctggttccataacaatactcaggtgacctgtgttccgagcaaggacacggaagaggctttacgcggttttggtattacatgtcctctagtcgttgttgggcgaggagtggatactactcgtttttcaccaaaacatcgctcagaaagcttacgccagcaatggggcgttgattccgatacacgtgtcatgttgtatgtaggtcgtttatcaccggaaaaagaagtccagctgatcgttgagagttatgcagctatgcaaaacattcagcaacagaaaactaaactggttgtggtgggagatggcccggatcttgctcgattaaaagcactacctgaagcgaaaaatgttatttttacgggtagtttgcgcgggcacgatttggcagtcgcatatgcaagtgccgatgtctttgtatttgcaagccaagttgaaacgtttggtaacgtagttttggaagcaatggcgagcggtttgccagttatcgcgtatgattatgcatgtgcacaccagtatttaatacatggcgtaaacggttggttaagcccacttgggcataagaaccattttatacaacaaatttatcagcttccttcaatacagcaacttagagaaatgggcatacaagcctgtcataaagtacagcaaagcggttggcaacttccggtacagcaattagaacaggcattttatcaggtagtgaaggaaccctcggcggacttcacctaa

SEQ ID NO: 4065 - DNA, 300 bp, Acinetobacter baumannii
gtttttttaatctcaaatcttttttgtgagagtgatgccatgttattcaaaaaattcgctgttgctgctgctgttgctgctactttagctttcgttggttgttctaagaaagaagaagctcctgctgctaacgctgcatctgaagctactgctgctgcatctgaagctactgctgctgcatctgaagctgctactgctgcttctcaagctgttgatgctgctgcatctgaagctgctgcttctactgctgccgcttctgcacctgccgcttctgaagctgctgcttctgctgcacactaa

SEQ ID NO: 4066 - DNA, 408 bp, Acinetobacter baumannii
catgtattaattttaaaaggtgatgaaatgaaaattttccaaaataaagtgtcagttctacgtaatgtactagtaggtgcgactatggctatagctgcttcaagtgcatttgctcatgtcaaacttgaaagtgctacgccagctattaatgcatctgtagcaggtcaaccaaaaaatataactctaaattttggtggagaagtcatgttaatgaatgtcaaattacttgatgctcaacgtaaagacatccctttaaattaccaagtaactcatgatttaaaaaaatcatttgaagtagctatacctaaacttaagaaaggtaagtacacagtggtttggaccacaatgggtactgatggccataacatgaatggtgaatatagcttcaccattaaatcagcgaaataa

SEQ ID NO: 4067 - DNA, 549 bp, Acinetobacter baumannii
ggcagattaatcgtggcacgtcgtcccaagcgttatactgaagaagattttgattctttagaaggacgtgcaagtaaaaccgaacagaaaaaagcagttcaacgtatggctgctttaggtgagcagttagcacaactttctatcaaacaaattcaaaaacttcctgttgatgagcgtttaattgatgctcttttggaagttcagaatattagttcgttcgaagcacgccgtcgccagtttcagcgtgttggtaaactcttgcgcaatgaagatgagacagtcattttatcttatttgacccctcagcaaggcgcgaagaaacaagctcaactcatgcgttgggtggatcgtatgatcgagcagggcgaccctgcaatcaatgagtttagcaaaatctataatgcatcagaacgacatactttacgtcagcatgtgttaagaattaatcgtgataaaacccagcaagttgcagaagcagatcttgaagcaactaaaatgaaatttattaactatgtacaacaggttgctctattgtcagatcaaggttaa

SEQ ID NO: 4068 - DNA, 471 bp, Acinetobacter baumannii
aagagattaataggttttgctatggacaatatcggaatttgggttaccgttatcattgttcttttcgtgctaggctccatttttggtttaagagtgagtccacgtgaaaaggcgctgggaattatgcgagacaaagcccgcaaaatgggactacatccacgcgtaattgctgcacctgaatggacacatgtcccgatggcaactgaaaagcgtgccagcatggttgcttactatagtgtattgatccccgatgctcgtttaccgctcatgcgtgctcgcgttatagacggaaaattaaaagttgtgcaaggcgatgagaaatttaatgattctcccattgcattaaaagggatttatgctattgatatgcaggcaaactgtgtaggcctttattgggatgaggaatcggacctgaaagctacgcaattagatgagatgaaggcttatctgttggccttggctgaagcctga

SEQ ID NO: 4069 - DNA, 402 bp, Acinetobacter baumannii
gtatttctaatgtttatgaagataggagagctctctgaaaaaacgtcgtgctcagtactgacaatacggttttatgaaaaagaaggtttaatcccgcaacctgatcgaactcaaggtaactatagactatatactgaagattacattgatcggttgaaattcattgtgaattgtcgttctttgaatatgaacttaactgaaatcaaaaaattactaaattataaggatctgcctaatctaaattgttctgatgtgaatgagcttatcgattcacatattaacgatgttaaggaaaatattcggaatcagcagaaactcatacagcagctattagaaataagaaagacttgtgatgggttatgtacagtggacaaatgtggtgtattgaagaagttagcctga

SEQ ID NO: 4070 - DNA, 1059 bp, Acinetobacter baumannii
atggctctaattcgtaagcgtcgtttaactgagcaacagcaacgtcgtattgaaaaacagcataaaactcgccaagaagaagtcgatacttcacaagatctagatgggctggttgtacagcactatggacgtcaacttgaagtacaggcactttctgtacccgatcatcacccagaaaaaccgcaagtcgccgaaggcgaaccagaaccgttttggaaacccattgaattaaatagcgtttggcgctgtcacacccgtacaaaccttgaattactggtcactggtgaccgagtgaagtggcaagctgaccctaatacaggtttagggattattaccgcaattcatccacgtacatctttacttacacgcccggatcgctatcacaaagtaaaacctgtagctgcgaatatcagcttaatcgttattgtttttgccccactgccagaaccggcacctactttgattgaccgctacttagtggcatgtgcagatgcgaatattccggctcttttagtgcttaataaatcagatttactcactgaaaatgatccgattctcgacatgctcaaagagtatgaaaatttaggctatgaagtcatgatttgtcattctaaaggtgacatctcagtattgtcccagcgtcttgatggcgagacagtagcttttgtaggtcagtcaggggttgggaaaagctcacttattaatgtgctcattccagatgctgaacaaaaaaccaatatcatttctgaaaactcagcacttggacagcacaccacaacttctacacgtttaatcaactttggtaaaaatggcgccttgattgattcaccgggaattcgcgagtttgggctttggcatctcgatttagataaaattcgtatgggcttccctgaaatcgaagcacatttaggttcgtgtcagttccgtaattgtactcatactcatgaaaagaactgtggcttaaaacaggctgttgaagcaggtgaaattttaccacgccgcctagacagctttttacgtttaatcgatgagattcaagaagcgcagcaaaaaaactaa

SEQ ID NO: 4071 - DNA, 1056 bp, Acinetobacter baumannii
tcttggctaattcaggccatatcaagattatggggcgataagggtattgctatgctcgatacacgctatcagatttttatttcaacctcaggtcgcgagatgcaacctgagcgtatggttctttcccaaactttagtcaatatgggattttttgcttgggggttagaatatagaaatcctctaacaacgacgcttgcccgtcggcaaattgatgagtcagattatgttgttttgctgctgggtagtcagtatggggagcaatcaatttcaggagcgagttatttttctttagagtatgaatatgcgttaagtcgcgcgaagcccattgtcgtttttatgcatgaacaacctgaaagtcgtgatatacatttacaagaggcccatccgcagcttaaagagaaatttctagcattccgaaaaaagttattacatgaagcgaatcatattttttattttaaaagcccacgtgatttagaacttgctgtccgtttaaatatgcctttaatggttgaacaatatatgggacaaggttgggtgcctgcacgccaagcgcatcatttggaagatgaaattaaccgattaaaaagtaaaattttacaattagaacaacagttatcagaatcatcaattcaagcaaatgaagtggcaccgcaagatgtttttgcttttgaatatcaaattcaggcttttcaagatggcaactttaaagagcttaagcgccagagacaaatgacttggtctcaactgttaagtattttggctaaacattttgagacagccatgccagaagagaactttgggacttgcctcaatgagtatttaaatcaggacgggttagaagacgctcgccaagagttgcctagagcacatgcagtggcaggtgcacaaattaatcataaagccctgtttcgtattaaaaagcaaatgcaatcacaaggatggattgttccaaccaagattgatcaacaacatagtttatggaaagtaacgaccaaagcccaaaagctcttgctcagttataaatggaatcatcggagtactcgattaaaagcttag

SEQ ID NO: 4072 - DNA, 597 bp, Acinetobacter baumannii
tacctgataataagagtcgccgtcatgaaaactgtaggtaatgatttggttcgtaatcagctacatgctgatcgtaaatggtatctaatattaggctttgtgctcattattttcggtttggtgttatttagctcactgccatttgctacattttcggttgtgtttctgtttggtattttaatgatggtgggcggtgtattgcatttaattgctgccttaagtgtatttaaaggcggtagccgatggctgtgggcactttttggagtgctgtatttaatggcaggctattatgcattttctacgcctgttactacggctgtggttttaacaagcttattatcaattgctctgattattgcgggtgtaatccgcactataaatgcatttttactaagaccaattgcagggtggggctggaccttattttcaggattattaaccctcgctacaggtattttaattttagtttctaaagattctccgttttgggtgttgggaatgtttttagcagtagatattttatttcagggcattaactttttagggctcgcttctgcgattaagcatttaccttctagttcaaaaacggtttcttaa

SEQ ID NO: 4073 - DNA, 1062 bp, Acinetobacter baumannii
aggaaatcaatcatggcacatcaaatagaaacgatggcattcgttggtcaaaccccttggcatggcttaggtaatcaactccctcagaatcaaccaatagaagtatgggcacaacaggcgggtatggactggcgaatagaatcatccaatgtcagttttatggcaaagaatgaacgtggacaaaatattctgatgccttatgaagagcaacgagtactttatcgctcagatactcatgcgccgttatcggtagtgagtcagcgttatcaggaagtgcagcccaaagaaatcttggagttttaccgagacctgaccgaacaatcaggctttgaactggaaacggcaggtgtacttaaaggtggacgtaagttctgggcattggctaggaccggacaatcggcagcattaaaaggcaaggatgtcagtaatggctacattttgttggcaaccgcatgtgatggcacactagccaccacggcgcaattcaccagtgttcgtgtggtgtgtaacaacaccttggcgattgccttacgcgggcagaatagtagtgctggtgtagtgaaagttccacacagtaccaagttcgatgccgagaagattaaacagcaattgggtatttcggttcatgcatggggcgagcacatgtatgaaatgaaacaactcagccagcgtaaagttacccagcaggaagcagcagcttattttgatgcagtgtttaataacacgaacctgagtattgctgaacaagatgaaagtatcattcagttctaccgtaatgtagctacgcctaaacaaatcaactcatccaaagccgacaataaaacagaaccaaatggacgtgctatgtctaaggtcatggccatgtttaatgggcatggtcgtggtgccgagttagcttcagctaaagatacggcgtatggactgctttgtagtattacggagtttgttgatcatgagcgacgtgcgatctcaacagatcaccgactagattcagcatggtttggggtaggagccaaccttaaacaacgtgggctggaacaggcattaagaatggttgtataa

SEQ ID NO: 4074 - DNA, 279 bp, Acinetobacter baumannii
aaatatcaaatacaggtagagagaatggttatggctaatattcaaaaattcgttgttaataatcaacgtacattaaagaaaaccttaagttactacataatgcatattacggtagccatgttagttgcctactttgtaacgggtaatatttggatggctttaacattaagtatgttagaaccaacagtacaagcttttgcatttttctttcatgaaaaagtatgggcagcaaaagaccgccgtatatcagctttaagcgaaaacgagacgactgcttag

SEQ ID NO: 4075 - DNA, 858 bp, Acinetobacter baumannii
cagatgcaaatgctttcttctcggcaatttgctgcgattgccacaattattgaatatttatatgaacatctagaccagcaaccaagcttagaagatgtcgctacatatatgaatttaagtgcgagttatatccagcggcaattccaagaatgggtaggcattagccctaagaagtttgtgcaatatatgagtttgcagcaagcaaaatattatttaatgcagcaacgtagcttattagatacggctttaaatactggattgtcgggtacgggtcgtttacatgatttgtttattcagcttgaggggatgaccccaggtgaatacaagcagcaaggtgatggggttgaactgaattattcagttgaaacaagcccatttggtgacttattggtagtaagtagtgataaagggatttgttctgttcgctttgttgatagtcgtgaaaatattgaagacatcattaaacaatactttccgaaagctcaactaagaaatcactctccgatttggcatcagcaaattgcacagtggtttagacaagatttttcagaacacttacagcagaaattaccgcttaatcttgcaggaacaccatttcagctacaagtatgggaggctctacttactattcccgaaggacagctacgtacttaccaagatattgctgaacaaattggaaaacctaaagcagtcagagcagtggctacagcaattggccaaaatccgattgcgtatttaattccatgtcatcgggtcattcgcgcaacaggaatggtcggtgagtaccattggcaaaaaggacgtaaactggcattgttagcttgggagatggctaagcagcaaggggagattgcatga

SEQ ID NO: 4076 - DNA, 1011 bp, Acinetobacter baumannii
gtgagtaaaatgaatcaattggagttgaaaaaagtcatccgtccagtgattttgattgtcgcattaatgattgctgtctataccattgtgcatttatggaactactataatgcagcaccgtggacacgtgatggtcgagttcgtggtgacgttattcaggtctcttcagatgtagcaggccttgtaacggaagtattggttcaagataaccagactgtaaaaaaaggtcaggtgctttttaaaattgatgtctctcgccgagctttagatgtagagcaagcaaaatctgatttggcaaaagcaaaagcggcctatgctcaagcacaagcaggtctagcccaagccaaagcaaacttgattaagtccagtactaacattaagttagccgagaaaaacgcaaaccgttattcaaacttaatggatggtgcgatttctaagcaggaacaagatcaggtctttgcaactcgcgatcaatcacacgcggaacatgagcaactccaagctgctattcaacaagctgaagccactattaaacagcaacaggcattggttgaagcagcaacaagtaatttacatttagcagaactcaatatgcaccgtgcagctgttgtggcgccagcagatggaacattatctaactttgatttgcgtccgggtaattatgttcaagttggacaagcggttgcagcattgctagatcgtaagcagctttatgttgtgggatattttgaagaaacaaaattagaccgtattcatattggcgatgaagcaactgtgcaattaatgggtgatagacagaaaattaaaggccatgtgcagggtattgcatcgggtattgaagaccgtgagcgttcaagtagttcgaaactgcttgcaaatgtaaacccgacatttagctgggttcgtttagcgcagcgtgtacctgtaaaaattgtgttagacgaagcaccaaaaaatgagttggcttttgtgtctggccgtactgctacagtacatattattgaaaaataa

SEQ ID NO: 4077 - DNA, 2322 bp, Acinetobacter baumannii
tctaaaaaaatactggagtatacatccatgtcaaacatgcaactcgacactctaagacgcattgtccaagagattaatgcgtccgtgagtttgcatgaatcgttagacattatggtcaatcaggttgctgaggccatgaaagtggatgtttgctctatttatttactcgatgaacgcaatcaacgttatgtattgatggcctcaaaaggcttaaatccagaatctgttgggcatgtttcattgcagttaggtgaaggcttggtgggtctggttgggcaacgtgaagaaattgttaaccttgacaatgcgccaaagcacgaacgctttttgtatttacctgaaacgggcgaagaaatttataactcattccttggcgtacccgtcatgtatcgccgtaaggttatgggtgttttagttgtccaaaatcgacttcctcaagattttagtgaagcagccgaatcatttttagtcaccttatgtgcacagctctcaggtgttattgcacatgcgcatgcggttggaaatattgatgtatttcgcaagccaagcaatgggcctgcctataagacctttcaaggcgtttccggtgcaggtggggtggctttaggtcgcgctattattttatatccgcctgccgacttaggttcagtacctgatcgtgaagcagaagatatcagcgatgaactccgcattttagatcaagctatttcatcggtacgttcagagattcgttctttagatgaaaaaatgcatgactcgctcatggcagaagaacgggctttgtttagcgtattcttaagaatgctagatgaaaatgccttacctgcagaaattaaagaactgatccgtgatgggcattgggcacaaggtgcggtgcgccgtgtaattgaaaaacacactgccctatttgcacaaatggaggacgattatcttcgtgaacgcgtttctgaccttaaagacttagggcgacgtattctagcgtacttacaagaagaagattcgagccaccgtgaacttagcccagacagtattttaattggtgaagaaattagtaccgctgcgctagtagaattaccagtagataatatcgcagctattgtgacgtcagaaggcgcagccaattcacatatggtgattgttgcccgtgcattaggtattccaacggttgtcggcgtaactgaactgcctgtaaatacgcttgatgatgcagaaatgattgtggatgcctatcagggccgtgtttttgtaaaccctccacgtcgtttacgtcaacgttataaagaaattcaaaaagaagacgagcaaatcgcaaaagatctcaaacaatatgagaccaaagaagcgattacaccagacggtgtctctgttcaactgtttgtgaacacgggcctcatgatcgatgtagtccgcggtgtacaacgtggcgctcaaggtgtgggtttgtaccgtagtgaaattccattcatgttacgggaacgtttcccaggtgaagaagaacaacgtgccatctatcgccaacagttaagccactttgccaataagccggtggtcatgcgtaccctagatattggtgccgataaagacttaccttacttcagtattgaagaagagaactcggcattagggtggcgcggtattcgtttcacgctcgaccatccggagattttctcagcacaaatccgggcaatgcttaaagcaagtattggtttaaataatttgcatattctattgccaatggtaacgacagtaagtgaagtcgaagaagtactttatttacttgagcgtgactggattgcagtgcaagaagaagaacaagttaaaattaccaaaccaaaaatcgggattatggttgaggtaccaagtgtactactacaaattgatgagttcgccgaacttgtcgatttcttctcggttggttcaaatgacttaactcaatacttacttgctgtggaccgtaataatccgcatgtcgcaaacgtctattcacacttccatccgtctattttgcgggctttaactcgactcgtgaaggaatgtcataaataccaaaaaccggtaagtatttgtggtgagatggcgggtgatcctttatcggcgatcttactgatggccatgggcttcaataccctttcgatgagttcaagtaacatcttgcgtgtccgaaaagcaatttgccatgtcccaatgtcagatgcccaaaagctgcttgatgatgtcatgaaaatgaataatccgcttattgtaaaaagctggcttgagtactactttaaaactcacggtctagccgatatggttaaatctaaccgccttgtaagcgtataa

SEQ ID NO: 4078 - DNA, 210 bp, Acinetobacter baumannii
gtaaaaaaaataatactcgtaataacaaccagacttgcaattgcaatcaaaactcggcgcataaacacctcctatttccattcttatagttttgctctttatagttataaaatagagcttatagctctttatatgccatttatttcacaatacgcaacactctattctccattcaatgctttaaatccgtgtacatcatccctattatga

SEQ ID NO: 4079 - DNA, 678 bp, Acinetobacter baumannii
cttaaccccttaaacgaatttgagtcccaacggctaaccttaatcaggagttcgaatatgaacttttcaatctattggcaacatgcagatgcagtgagtaaaaccctgtatttcatcttattggcaatgtcgattgctacctggacagttttcatcttacgtttgatggggactcgccaactaaaacaacaagcttatgctcaactctctcaagctattacttcgctcaaagcaaagttacaacctttgagttttgaacaacgtaaagcagttgcagagcaagcattattgcgtcagatttctgctgagaaagccaatgctgataaaggtatttcagttttaggaacaattgcttcaattgcaccattcgttggtttgtttggtacagtatggggtattttccacgcgttagttgctgttggtaagagcggacaggcaggtttagctcaagtggctacaccagtaggtgaagcacttattatgactggtcttggccttgcagttgcgattccagcggtattggcttataacatctgtgtacgtgcgaatcgtggccttgctcatgatttacaagatcaagcacacagtttgttaatcgacaccatgttgcagcaagattcaactgtaaagtctgatgttaaaactgcacagcaaagttatgttggaggtcaagcttaa

SEQ ID NO: 4080 - DNA, 606 bp, Acinetobacter baumannii
cttagtgaaatctgccgtcgccgaacgtggccggtatattgtggagtaagaaagattaaacagcctgaccgtaaccaacaacaaggtgcaaagagtaaccgtccagcaattaacgatgagatccgtgcaaaagaagtacgccttgtcggtgctgatggtgagcaaaaaggaattgtttcattaaatgaagcactgcgtgctgctgaggatgcagatcttgaccttgttgagattgtcgcaaacgctgagccgcctgtttgtaaaatcatggattacaacaagcacttgtttgacctgaaacagaagcaaaaagatgccaagaaaaaacagcatcaagtgcaagtgaaggaaatcaaactacgcccagcaactgatgtaggtgattatcaagttaagcttcgtgctattctgaagttccttgaagaaggcaacaaagttaagatcaccttacgtttccgtggtcgtgaaatggctcaccaacaacttggtttagctcaattgcaaaaaattgaagcagacgtagctgagttaggggttgtagagcaagcaccgaaaatggaaggtcgacaaatgggtatgttacttggaccgaaaaagaaaaagtaa

SEQ ID NO: 4081 - DNA, 630 bp, Acinetobacter baumannii
gaaaatagaatgattgatctatattattggggcacacccaatggacataaaatcacaattgccttagaagaaatgggactggattacaccctttacccaattaatattttagaaaatgatcaatttcaaccaggcttcctgaaaatttctccgaataataaaattcctgccattgttgaccaagatggtccacgtggtgagccaatttcagtatttgaatcaggcgcgatcttacagtatttagggcgaaaaactggattgttctacccgacagacgagcaagagcgagttgaggtggaacaatggcttatgtggcaaatgggtggtttaggtcctatgttgggacaaaatcatcattttaaccgctttgcgccagagaaaattccctatgctatagaccgctatgtaaatgaaactaagcgtctatatggtgtgttgaataaacagctcattggtcagaagtttgttgcaggggaatactcaattgctgatatggcaattttaccttggatcttgcgctatgaatggcaggggattcaattagaggattacccgtatgtacaagaatacattgttcgcttaacagcgcgccctgcagtacaaaaagcgttatctattaaagtcatctaa

SEQ ID NO: 4082 - DNA, 489 bp, Acinetobacter baumannii
tcctgcttttttactttacaagttagcaaatccaacctattgttctttaatgataaatataattctatatatagagaaaaaatgaatatatctaccttatgtcaaatgagtttgctttcattcatgctgtttaatattaatggctgtgcgagtcatccacgccaatctgtagatttgcaagaatatttaaaaaattttataggcaaatcatctacaacgattcagcaagatctcaacttacggagtcttggctttcaagtcgcccgcacaccacaaaaaacttctgatcaacttatttatacgattttacgacccttaagcatcccaattccgatggtgagtaatgtcgatatgagaggtggttctgttcccatacaatcaggtaatttgagcggcaactcttatgatattaactttaattgcaaggttatttttaagctcaaaaatgacattgccgaatctattcaatacgaaggtaaagcttgctaa

SEQ ID NO: 4083 - DNA, 645 bp, Acinetobacter baumannii
tttgatgtgattatgcagattcgtcaatttcaagcacaacgtatgcaagcgcctcgcgattttaccccaattgaaaatactccgatttgtgtagaaattggggcaggcaaaggtaaacatgctttgctatttagtgggcaaaatcctcagcacacgttatatgcaattgaacgaactagagaaaaattcttggccatgcaaaagcagcatggtttggaaccacgagacaacttggtgcctgtacatgcagatgctttaccttgggttgtacatgctctatatcctgctcaagtagaacatttctttatcctctatccgaacccagaacctcataatccggcacaacgctggttgaacatgccattttttgagttcctgttatcacgcctgaaaacaggtggaacgattacattggcaagtaatattcctgaatatattgaagaagctgaacaacagttattaaacgtgtggaagctgccttaccaaaaagaaaaaattgcgcaaacttctgcacgtactcattttgaaattaaatatttagagcgtggcgagctttgtcagcagctcattatgaccaagcctgaaggttataaaactcgttttgatgattttgcgccactgcaagggcaagtgtatggcgaataa

SEQ ID NO: 4084 - DNA, 1458 bp, Acinetobacter baumannii
aatatcgccttttgttttgctctgaacttattcatgaatgctgtcgttattgcgattgcagtgatgttcttattatcactggcgcgcgtttctgtcgtactgactttagtggtttctgccattgtgggcggcctcgtagcgggtttaagcctttctcaaactgttgaagcctttaacgctggtcttggtgatggtgctgaagttgcacttgcctatgcagtgttaggggcatttgctctggcactttcaaaatctggattacctgatttacttgcccataaactgattggtttattgggaatggaagcggggaaaagccgagaaactaaagtgaaatatttactcttaggtattttactgatcgcagctattttctctcagaaccttattccagttcatattgcttttattccagtattggttccgcctctattacgggtaatgaaccatttaaaactagaccgccgcgccgcagcctgtgtacttactttaggcttggtggggacatatattttcttacctgttggctttggtgcgattttccttgaacagattttgatgggaaatatcaacaagattggtgctgcttatggcttacatgtagaacgtggcatgatgcctattggtatggcaattccagttttgggaatggttctaggcaccttggttgcggtatttatcagttaccgtaagccacgaatttatgctgaccgttcgataagccctgtaactacaattgatttagataaacctcttcgtgcaactgcacaagatgaaacagcagacttaaaagcagacgcagaagaacttaaacatgaggcagagcaaggccctcttattgctaaaaaaacaatttttatggctttactggctattggactcactttagttgcgcagctttattccggctcaatgatcttgggtggtttagtgggctttgcagtgctttctacggcaggcatttttaaatggcaagatgcagatgatgtctttgtacaaggcatgagaatgatggctctagtcggctttattatgatctctgctgccggttttgcttcggttatgactcataccggagatattaaccagttggttaaaggtgtggtagaaatcattggtgataaccgtgcgcttgctgcatttttaatgctttgtattggcctatttgtcacgattggtataggttcatctttctcaagtgttcctgtattagctgttatttatgtccctttatgtgtccagttcggtttctcaccgttagcgacaattgcgcttatcgggacagctgctgctttaggtgatgctggatctccggcttctgattctaccttaggaccaacagcaggtttaggtgtagatgggcaacatgaccatatttgggatactgtgataccaacatttattcactttaatattccgctattaatttttggttggattgcagccatggttttataa

SEQ ID NO: 4085 - DNA, 912 bp, Acinetobacter baumannii
atcggagcgattttttttcgtgcgatttttgaaaaaagatgcattatgcaatttcgaaaaacgttgaatattggcattatgctgaaaattgttttgagtgagatcggcatgacacaaggacttttagcaggtaaacgctttttgattgcaggcgttgctagtaaattatcaattgcttatggtattgcacaagcattacaccgtgaaggtgctgagcttgcatttacttatccaaacgaaaaattaaaaaaacgtgtagatgagtttgctgagcaattcggttctaagcttgtgtttccatgtgatgttgccgttgatgctgaaattgataatgcatttgcggaacttgcaaaacattgggacggcgtagacggtgttgtgcactcaatcggctttgcacctgcgcacacgcttgatggtgacttcactgacgtgactgaccgtgacggttttaaaattgctcatgacattagcgcatacagctttgttgcaatggcacgtgctgcaaaacctttattacaagctcgccaaggttgtttattaactttgacttatcaaggttctgagcgcgttatgcctaactacaacgtaatgggtatggcaaaagcttctttagaagctggtgttcgttacttggcatcaagtttgggtgttgacggtatccgtgtaaacgcaatttctgctggtccaattcgtactttagctgcttctggtattaaatctttccgtaaaatgctagatgctaacgaaaaagttgcgccattaaaacgtaacgtaaccattgaagaagtgggtaatgcagcgttattcctatgctcaccttgggcttcaggtattactggtgaaatcctatatgtagatgctggtttcaatactgtaggtatgagccaatctatgatggatgatgaataa

SEQ ID NO: 4086 - DNA, 333 bp, Acinetobacter baumannii
gtagcaaagatggatcaagttaatttttttaaatgcttatcagatgaaacccgtctcaatattgtcactttaattgctgagaataatgaactctgtgtttgtgatctgacagaaaagctacaactgagtcaaccaaagatttctaggcatttagctttattacgctcttctggtctcttacaagacagacgacaaagccaatgggtgtactacagcattaatcaacaacttccagcatggtgttttgaaattctagatactttaaaaaaaacatcatctagtcaagttgtaagcaataccaacacgctttctataaatagttattgtgagtaa

SEQ ID NO: 4087 - DNA, 825 bp, Acinetobacter baumannii
aaagtgaagatactcattactggcgccaatacaggtattggttttgccacagcagaacaacttgtaaaacaaggacaacatgtgattttggcgtgccgaaatcctcaaaaagcactagaggcacaaaacaaactacgctcactcgaccaaggacaagtcgatgtcgtttctcttgacttaaacagccttgaattaactcaaaaagctgccgaagaaattgcagataaatatggcagtcttgatgtacttattaataatgccggtctattttcaaaaacaaagcaactcaccgtagataggtttgaacagcaatttggcgttaactatttaggtcactttttattaactcaaaaactactccccgttttaaagcagtctcctcaagcacgtattattcatctagcgtctattgctcactgggttgggtcaattaagcctaataaatttcgtgcggaaggtttttacaatcctctgttctattatggacaatccaagcttgcaaacttattgttcagcaatgcattagctgaacaactagcagacagttcaattaccaataatgcattacaccccggtggtgttgcttccgatatttatcgtgatttaccaaaaccagtttatgcagccatgaaagtaggtttagttccaacatcggttcctgcaaagctcattacagaaatggcgactggcgacacatggcaaaaccgcaatggtgaacatgtcagtgcgcatatgccagactggaaatcttcccatgccaaaaaccagcaattagcacgcgatctctatcagcaatctatgactctagtggaaaagttcctctaa

SEQ ID NO: 4088 - DNA, 912 bp, Acinetobacter baumannii
tataggaagatttttcttttttttgcagacaatagtctctcttatacagccctgtatatgaaaatttctttatcttcgtttcaaattgggtctttttttgcgctttgctctgcttttctattcagcacaaaagcgatttttattaaacaaacttatgccctttctccattagtagacggtacagtcctgatggctttacggatgttaagcgctttaccgttttttctattaatttgctggttcaataggcatcataatcagggcataaaaaagaaggattggctaattttaatttttgccggtctattaggctactactttgccagctggctcgatttcatgggcctcatgtttattagcgcttctttagagcgaatcatcctatttttatatcccacacttaccgtgatcgcttcaagtctgctctacaaacaaaaattagatgtaaaaagtttattcgccatttttcttagttatggtgggaccgtgttagtgatgctgcaagagcacaacaatgcaccaattcagggcaacttttggctcggaacaagttttgtatttgctagcgctgtagcttttgccggttatttactgctgactccaccattaattaaaaaatttggctcttggaatttcacagggttagccttaactgtggcttgtatcggcacattaactcattacgtattaagcacacctcaacctattcaacttctattacaactcccctctagtgtaatttggtacgggattggcttaggttttttagtcactgtcttacctaccgttatgcttatgcaaagcattgagcgactcggagcatctcaatctgcgatgattgcttcgattggacccgttttaacgattttgcttgccgttgcttttttaaatgaacacctaaatatatggtaa

SEQ ID NO: 4089 - DNA, 1140 bp, Acinetobacter baumannii
ggagtagagatgatgaaaattccagaatatgtcccaatcatgaaagcgaagcaaggtgaatttgatgcgataaaacctattaggtctgagcagttagaatatcaaatacagccaactttccaccctttatttgaaatgcctaatatttataaagaaggggtttcaagacttgttgatattaatagccgttgcgagaaaatagggaaattatggagtggaaatattgctttagtggatggttatttttggaaaccatctgaagctttattggagaatggtgagcatttcttaacctatacgtataacaaattgtttgcattaggagtaaaggtagttcctgtaattggttatgaccgttggtttgatcaaatgagcagtctttatcatcaaacaatgaaaaatttaaattatccagaggctccttatttttgtattagattagatggtgaggcaatgtatgatattgatgaacctgattttttcaaagaacaactagaatcaattatttctgatttaaaattagcagaaaataattgttctatattattagattttggggatgtaagtgtcaatcgtataacaattgaacagatgctaagcaagtctagagactttttagaagtattaactgaatatgattttaaatacatttctatcagtggagcttcatatccttcaagcgttgcagaagccattgaagatcatgatacggatggtccagtacttcgaaaagaaatggttgtatggcagactttaagaaacatgttccctaatgttaaattgaagtttgcagatcatggagcaagacatccagctccagaaaagcagattattaatcaacatacgaatggaaaaattatctacactatagataaaaattactatgtcgtaagaggccatccattttctagagatggtggaagtcatgggcatagaaagcagctagcaatgagattaattaattctatctattatgaagatgtaagctttagttggggagacaataaaatctttgaatgtgcgcacggtattaataattttataggaaatcctacgcaatgggttgcaattgatacgagccaccacattcggtatgtcttagaggaaataggatcttttgagctagcttatcaaaaatag

SEQ ID NO: 4090 - DNA, 183 bp, Acinetobacter baumannii
tttaaagttttcttacactttgaagcattgaaaatatccaaatattctcatattatgattttagcacctattgatgattcttttcatcagcagctcatcaatagtaggctctccctcagaggaataagctcatgttgccatcatgggcttttttcttgtctaatttttagaaaaaacttatga

SEQ ID NO: 4091 - DNA, 609 bp, Acinetobacter baumannii
cgtatgtatgttccaacaattgaaaatgctttagttcctgttgtggttgaacaatcttctcgcggcgaacgttcttttgatatttattcacgacttttacgtgagcgcgtcatttttctaactggtgaagttgaagacaacatggcaaatttgattgttgcccaaatgttgttcttggaagctgaaaatccagataaagatatccatctttatattaactcgccaggtggttcggtcactgctggtatggcgatttatgacacgatgcaatttattaaacctgatgtagtgacatactgtatggggcaggctgcatctatgggcgcattcttattaaatgctggtgctaaaggtaaacgctattgccttgaaaatgcacgtgtaatgattcaccaaccattaggtggattccgtggtcaagcatcagatattgaaattcatgctcgtgaaattttatttattaaagagcgcttgaaccgtttgatggcagaacacagtggtcaagactatgacacgattgctcgtgataccgatcgtgataactttatgactgcacaagcagcaaaagaatatggcttggtcgatcaggtattaagtaagcgtccataa

SEQ ID NO: 4092 - DNA, 288 bp, Acinetobacter baumannii
aatataaatgtcacattcctgtcatggcaacctgttgatataaagcgaactaaaaagaggtataaaatcatggctggtttatctatttggcatgtcgttattttcgcaattgtcgttattttattgttcggtacatctaagctaaaaaatatcggtaaagatgtaggcggtgcagtaagagattttaaaaagtcagttcgtgaagaagacgaagctgcatctttaaatagccctcgtacaattgatgcacaagttaaaacatctgaaagcacatcagtgaaaagctaa

SEQ ID NO: 4093 - DNA, 837 bp, Acinetobacter baumannii
cggaatgatgtgaaaaatgttgtacattcaatgtgtaaacatagggaacaagaatcaatgtgtattgtggctttagcatggcatgttctggatgatatgcccttgtatctgatttcaaatcgtgatgaattttatcatcgaccaaccgcattgttgcatcaatgggaacatacaccaatcattgcagggcaagacttacagtcgggtggtacttggatgggtgttacgccgcagggccgatgggctgtgttaaccaatttccgtgatggacgtgataaaaaacaatatgagacctctcgtggtcatttggttcaggcttttttagagtctgatttgttaccgattcgctttgctcagcaattagaacaacagcaacagaactttgctggttttaacctgtttatgggaactactgatcaggcggtctatatgagtaaccgcggtgaggctcctcaagtattagccaacggcgtatatgtggtttcgaatggtttaatgtccgatcactgggaaaaaaccagacatttacgtacacgttttacgcaagagttcctgcctatgcatcaacacaaaacagaagagttaagtttgcagcatgcagcgtgggatattttagaagatgagcgtaaggtcaccacagcattgttgccaaacacgggcattcagccggaaatggaagaattattgtcatcgacttttattcaaagccccgtatatggaacacggtgttcgaattttttaagaatgaccaataatgaatggatatggttggaaaagacccagcaaggtgaacatagtggtcaaattgtgcagcaacaggtgcttttaaaccgttag

SEQ ID NO: 4094 - DNA, 480 bp, Acinetobacter baumannii
tctgggtgtgtatatcaccgtagtaggcgctaccatgctactcatttctgtattaggggactctcgccactcgagtatgtctggtcctgtacctcatggggagaaatcatcatgatcagtttagaattcttactggcctctgccattgggctacttgttgcgacaggcatttatctaattttacgtgcgcgtaccttccctgttgtgttgggcttagcagtgctgggctatgcggttaacttatttttgtttgcgatgggtcgcttgcaagtcagctcaccagccatcctaaccgaaaccaccaatattacagatccacttccacaagcacttgttttaacagcaatcgtaatcggttttgctactactgcttttattgtgcaacttgcattacgtagccgttatgaatccggtagtgaccatgttgatgctaaagaagatatttctccaacatacgacccacgtgaggatgagccgtga

SEQ ID NO: 4095 - DNA, 360 bp, Acinetobacter baumannii
atggctcgtgtaaaacgtggtgtagtggctcatcgccgtcacaaaaaaattcttgctcgcgctaaaggttactacggtgctcgttcacgcgtttaccgcgtagcgttccaagcggtaatcaaagctggtcaatacgcttaccgtgaccgtcgtcagaagaaacgtcaattccgtgctctatggattgcgcgtatcaacgctggtgctcgtcaaaacggtttgtcttacagccgtatgatcgatggcttgaaaaaagctcaagtgatcatcgaccgtcgcgtattagctgacatcgctatgcatgatgcagtagcatttgctgctttagctgaaaaagctaaaggcgcattagctgcataa

SEQ ID NO: 4096 - DNA, 339 bp, Acinetobacter baumannii
aatttatttttggagcaatcaatgaaaactctattccgtcgtagctttactgcttttatgtgtgttgggactttaattgctggaacccaatcttgggctgcggatgctcaacagaaaaatactgtaagtacagaagttaaagtaaattcaaaagcacaagagaaatgcaaaaagccttgtgatatgaaagatggcaaggaaaatcaacaaaaccatagtcagcatgatcacagccaaatgtctgatatgtcccaaatggatcattctaaaatgatgaacatggatcattctcaaatgagtgagatggaccattctaaaatgaatatgccaaataaataa

SEQ ID NO: 4097 - DNA, 240 bp, Acinetobacter baumannii
atgcagatcgtacgcttacaggagccacagcgcatgggtgagtttaatgtctacggtatttacgtgcctgctttgctcgtccaagccatttttgcatatatatgttttcgctggttaagtcccttaaccaacaaatggattgcacaaggctggattgcattacccagtattttcaatttgtgtttttaccttttactacttttggtgatacaccaaatttttgttgggttaggtgcttaa

SEQ ID NO: 4098 - DNA, 207 bp, Acinetobacter baumannii
ggttactgctttatgccacgtacatttccctgcccacgctgtggtgaaccaagtgtttgggaaggtaatgaatttcgtccgttttgttctgaacgttgcaaacttattgatttaggcgcttgggcaaacgatgaatatagactgcctacccaagatgctcctcagcaagacaagggtagtcagcatgaagatgattatgaggattaa

SEQ ID NO: 4099 - DNA, 630 bp, Acinetobacter baumannii
ataagatgcttatatctcatgaattattttgattattttctctttatttttagtgtcattattatgattgcgacccctggtcctgtcatgattttagtggcaagtgccggacttaaaggtggttataaaaaagcactggaaaccatttttggtacaaaccttgcctctctcgttttaatttttatttcagtactcgtacttaaaggcgtattgggtattaatgaaaattatttaaatattattcgtgttttaggctgcctatatattggttatttgggttttagtattctcaaagaagtcattcaagctcctcatcctgaagcaattcaaaccgtttttgctcaaaatggcggttttaaaaaaggctttttagtgggtatttcaaaccctaaagatattattttcttttcagctttctttccgcaatttgtttctatttcacctcatctagatttaagtctaactattcttacgctgacatggatagttttagactttttaacgctatctctagtctatatatttttccgccgcctctcgaacagccatttatacccgaagatcctcggtttatgtggtctattactgttagttattgccgtttacggtttatatcagacattcatttaa

SEQ ID NO: 4100 - DNA, 282 bp, Acinetobacter baumannii
tttttgcacgttgatgcgggatggagcagtctggtagctcgtcgggctcataacccgaaggtcgttggttcaaatccagctcccgctaccaagtttcttaaagaggctcacagacaaggtgggcctttttgcacagtggactattgttttctgtgctatataggggcgattaacgcccttttttattggttatcgtatcgctatcgtgtagtgtcgacatcaattggtcaaatagtcatgcttcactatagtaagtctgtgtcggttaaaacaaccgattga

SEQ ID NO: 4101 - DNA, 516 bp, Acinetobacter baumannii
tccatgatagtgatagcaatgggtgtttgtggcacagggaaaacccttattggtgagttgttatcagagcgtttggcttgtgagtttcttgatggcgatacgcttcattcagctgcaaataaaagtaagatgagccaaggtatccctttaaccgatgaagatcgcttgccgtggttgcaagctattcgtcaggcaattgaagcaaaacaaagagatggtgaaacggctgtgtttacatgctcatctttaaagcggatgtatcgcgatattttaagagggcaggaccagaatgttaagtttgtatatctaaaaggttcttatgaactattacagcaaagacttgcagaaagatctggtcatttttttgatccggcattgttacaaacccaactagatacattagaggaacctgatgtgaatgaagcaattgctattgatattgctctcacaccagaacagatcattgaacaagttatccagaagctaggggtaactgatagtgtgtgtcgggggtaa

SEQ ID NO: 4102 - DNA, 1512 bp, Acinetobacter baumannii
aatcactcagtgtcgaatatcgaaaaacctaaagccacctatgagcaagcaattgccatagataacgcacgtcttgggcaatcatttaaagtgattgcctatgcgggcacaggtaaaactactacgttacaaatgattagtgatgccatgcctgaacggcgtggtatgtatttggcttttaacaaagccattgctggtgaagctcaaaacaaatttcatcgcaatgtagactgccgtacttttcactcactcgcctttcgcagtgtgccacgtggcgtaactgataaattacgtttacctcgcttaagcccaagctttattgcaaaagaatatcgactagaaccgattaccttacggcgcatgatgggtggacgttatgaaaaatacgtcttaatgccaagtcgcctagcgagccttgtcgccaatgcagtgagctatttctgttcgaccagttctcaatatccagcgcctcgacatattcaggcgccaaactggttacatccagacgatattactgcacttcaaacccatctttaccctgctgttgaacgccgctggttagagtccatcgatccaaaccatcaagccggaattggtcacgatatttacctcaaactttgggcattatctgagcctaatattccggccgattatgtcttatttgatgaagcacaagatgctgaccctttaatgctgggtattttgcttcgtcaaaaaagtacgcaggttatttatgtaggcgatgcacatcagcaaatctacgcgtggcgtggtgcagtaaatgccatgcaacaactgcctttgccagagtctcgtctaacgacctcttttcgttttggagaggcaattgccgatgtcgccaatgcgttgttaggtggcttaaatgagacagttcctttgcttggtaatccgaaccagaaatcaagtgtagtcaataaaccgcatacaaaaatgcgtgatgcgattttgtgtcgtaccaatgctcgcgcaatggagctgttattggcaggcttagttcacggcgataaagtgagtttgcaagctgatcatcaaaaactaaaccgttttgtagatgctgcaagcctcttaaagcaaggaaaacgagttactgacgttcctgagttggcatggtttaactcatggcatgatgttcatgagtactgcgaaaccaatgaaggaagcgatattaaaccattggttaagctggtagatgatcacggcactgacccattaaaaaaagcacttgcaaagattactccccttgagcaagctgactatgtcatctcgactgcccataaagcgaaagggctggaatggaaccgtgtccatattgaagacgactatcaatttaaaattaatggtttagagcataagattacagatgaagagttaagattactgtacgtggcctgtactcgtgctaaagtaagtctaaatatccatcatctttatgatctgatacaacaattaaaactaagggcgcctttaagtcttcgtcagtcggttggttga

SEQ ID NO: 4103 - DNA, 849 bp, Acinetobacter baumannii
gattttaaagttactgaccaattttttgaacttgagggttacatggataaattgcttaaaattatgcaagagctacgtgaaaaatgtccgtgggaccaagagcaaactccaatgtcactgactaaatatgcgattgaagaggcatatgaagtcgaggctgccattcgtcaaggtgacattaatgaaattcggaatgaattgggtgatctgttattacaagtggtatttcaatcgcaaatgtttagcgagcagggggcgttcaattttcaagatgtggttgaggcaattagcgaaaaattagtacgacgtcatccgcacgtttttcaagcagaccaatttaacaacttaacaccagaacaagtaagtgagttatggaaacaaattaaacaacaagaaaagcaaggcaaaacacaatcaagattagatgaaattaaacatggaccaacactatctcaagcgcaggaaattcaaaaaaatgtcgcaaaagttgggtttgattttgaaacggtagaagatgcttatacaaaattagaagaagaattagatgagtttaaacaggcacttaaaaatcaaaatagtaatgaaattcaagatgaatttggagactgcctgttttcattagtcaatgtaggacgtaaacttggcatttcaagtgaaagttcacttttatcaaccatacataaatttagaagtcgttttgcttttattgaagagcaagccataaaacagcaaagaacattggaagacatgaccttgtccgaaatggatgaattgtggaatcaggcaaaacgacaattaaaatcaggggaaaaaccacatgcaatacagcataagattttggaaaaataa

SEQ ID NO: 4104 - DNA, 2301 bp, Acinetobacter baumannii
gtcctgaaagtcatgtcattgattagaacacgtaaaaaaattgtttcctctgcaatcgcctcatcgctctcgatgatagcaacaactgcgatggcgcaagaagcagtttcccaattaccaacaattcatactaaagcgactcaagaagaatctttaaaggtcgatcagtctgcaaactctaaattcgtagctcctctcaaagacacaccaaaatcagtctctattctttctcaaaaattaattaaagatacaaactctaataccctactcgaagcgttacgctatgaacctggtattacattaggtgctggtgaaggcggtaccccgtttacagatatgccttacattcgtggttatagcggtcaatcttctatttatgtagatggtgttcgtaatacaacttctcagaatcgagatatgtttgctattgagcaagttgaagtcattaaaggatcttcttctgctcttggtggtggtggtagcgttgggggcagtattaacctcatccctaaagttgctcatgaaggtgatgtatatcaaggtagtgttcaaagcggtaccgacaactatcgtcatattcaattagatgcgaacaaagattttggtaacggtattgctggccgtgtagtaattatgggccacgaaaatgagaaagccggccaaagtaatggtgctgaatataaacgtgtaggtattgctccaagtattacttttggcttagatacagcaacacgcggaacactaagctactattatttacgtagcaatgatgaacctgatgcaggcattccttttaacaatgcaaacccagcaaagcctcctgttggggttacagtaacacctggtgatggtaagcctgttgatgtaaaagctggaacttattatggttggaaagcacgtgattttgacaaacgtgaaaaccatatcggtacctttaaattagaacatgactttaatgaaaacctgacgttatcgaatatagcgacttacaacaaatctaaatcagattatgtttataccaacgcagatgactcaaaaggtaacatttatagaggtacggttgctcgtcgtgctttaagtcgtattctcgataccgatgcatatagtgatcaactttccctaagaggcaaatttaatactggttcattaaagcattcttttaatgtcggtactgaatggagtttccaagaaacagatcaaggtgtacatacttttactaatgctgctggtgaaaccacatcgaccattttagacagcaatattcaaaactgtacttcagctgctgctgtggcaaatggctggtgtacgagtttaaataatccaggcaatggtgccttcacagataagcgtggatctatcacagcacaatcgaccactcgtagtcacaatgtaggcatttatgctttagacagtattgaatttaatccacaatggttacttaacttaggtgtgcgttgggataaatttgaaactgagaaaaaatataataaggatgtagatggacgtactcctcataaagctggtgataaattagaaagcgatacagactacttctcttatcaagctggtttagtttttaaaccaacagaagatggtagtatttatttaagctatgctacgtcagcaaacccagtaggtgtgcttgctgagggtgatacaggttcagattctattagcgactcaggtactgcaagtgcgagtgcaaatgctctcaagccagaagaagcacgtactttcgagttaggtacaaaatgggacttatttaataaccgtgcgaacttaacagcagcagttttccgtactgaaaagcaaaatacacgtatccaaattgaccctactacgactgccaatgcaggtaaaagtaaagttgatggatttgaaattagtctgaacggaaaaattaccgataagtgggatgtttctacaggctatagctatatagatagtgaaatcaccgaagcagcctataatgcagttgctcaagaaggtaaaccattaccatttgtagcgaaaaacagtgctaccctatggtctacttaccgagtaatgcctcaattgactctaggtgctggtgttgaatatcgcgatcaagtttttgtgaacacaactgctccgaaatatctgccaacctataccatttacaatgctatggctaaatatgatgttaataagaatgtgaatttgcagcttaacatcaacaatatctctgataagcgctatttcacaagtgcgcatgcagctcactacgcatttgaaggtaatggccgtaatgctgtcttagcgattaactttaaatactaa

SEQ ID NO: 4105 - DNA, 1089 bp, Acinetobacter baumannii
attggggaagttgccatgacaatcatatcgagagaatcactccagaaaagccgttggatgttgatgttaagagcgagtgacaatatttattttgcacccggtattccttataaaaaattgcaaggggctatgagttatctccctcaaggaattcatccagatgaaatccttatgctaattgacgatacggtatttggcagtgctaaagctggactttgtgtgacggcgacaggactcttttataaagaaagctttggagatgaagcggtttatctctttaaaagtattcatcatgtcgaggcagatattggcgtcattaatcatggcatcgtactgaatcgtatagaaaccctgacctttacccaactggataagggcacagtacgaacattggcttcatttctaaatgaagtttgtcagggtgaaacagaaaccgatcgggctccaccacagattgatgcagaactgaaggtaattattgatctgtttgcttatttcatcacattcaatatgggtaagtggaatcctgaatctagtcatgcaatatctaaacattttgtaaagctgaatgatgaagcatcacagcactatattaaaaggttactgactgaacatcccaactttgaatatgaagaattattacatcgctttgcagaactgaaagatgtgctggcttacaagcttcgtacggagatgatcgaacaactggtttatgccatggcactgggtcaggttgagcagaatcaggcggatctcttcatgacccatttatgtcgtgtatccaatgtttctaaagccgtatttcctgatctggtcaaaattatctatcaatgtctggctgatgaaatgaatcagtctactacttctactttcaacggtggacaacttcaagcgtgcaaacttcttgatattcagcctaattcactgactgagcagaacttacaatctgcttaccgaaaaaagatggctgagttccatcccgataaataccagaacttacctgaatctgttcgtcagttgattgaaagtcaggcacagcaactgaatgaagcaagagctttattaaaaagctatttggacaataactga

SEQ ID NO: 4106 - DNA, 426 bp, Acinetobacter baumannii
atcagaggagtttcggctcctcttttttatgctacagtttttatctcccaagaaagaagattcgccatgctggaattctggtttaatacgcaagtcccgacttttaaaaaattaatcattttaattattaccctcttaatctgtattgggttatatcaatatcaaccattgcctttagataccattttaatgtttacaggaactggggttatttttttaatctgccgttactttaaattgcattttgctcaaagtaacccgactggtttactttaccgcctatttacgtgggttcctatcgctcttttatttgcacttatctttgtaaaaaccatgcctaacttgctgatctggggcgttcaaggaatcgcttttatggcgcttgctgcttttattttttcacctcaatcgttatttaataaatag

SEQ ID NO: 4107 - DNA, 3378 bp, Acinetobacter baumannii
gtttgtttggtttgtttgtgtgagtcactattaggtgtcacacccatgaaacgtatgttgattaatgcaactcatgccgaagaagttcgcgttgcacttatcactggtaatcgtctttacgattttgatttagagaatcgtacccgagaacagaaaaaatccaatatctataaaggccatgtcacccgcgtagaaccatctttagaagctgtttttgttgaatatggcgcaggtcgtcaaggcttcttgtctatgcgtgaaattgctaacagctattttcaggcagacccacgtcaaacttcaaacattcgtgaacttattactgaaggcacagagcttttagttcaggttgaaaaagaagaacgtggtaataaaggtgcagcactttctacgtttatttcccttgcaggccgttatttagttcttatgccaaataacccgaaaggtggtggtattagccgtcaaatttcaggttcagtacgtgaagaattaaaagaaattttagcttctttaaatgtacctcgtggtatgagcgttattgttcgtactgctggtattgggcgtactcaagaagaattacagctcgatttacaacacttgcttgacctatgggcacaaattcaaggtacagcgagctcaggcccttctccgatgcttgttcatcaagaagcgggtgtagtaacacgtgcaattcgtgattacttacgtgatgacgttgctgaaatcttaattgatagcgaacaggcttataacgaagcatataactttgttaaagcagtgatgcctcgccaattagacaaattaaaaacttatactttaaacgagccattgtttgctcattttggtattgaaagccaaattcaaactgcttacgagcgtgaagtaaaacttccttctggcggttcaattgtgattgaccagactgaagctttagtttcaatcgatattaactctgcgaaatcgactcgtggacatgatgttgaagaaactgcactgaatactaaccttgaagcagcagaagaaattgctcgccaacttcgtttacgtgacattggcggtttagttgttatcgacttcatcgatatgactaaagaacgcaatcaacgtatggttgaagcaaaacttcgtgaagcaacacaaagcgatcgtgcacgtatccagttcggtcaattgtctcgttttggcttaatggaaatgagccgtcaacgcttacgcccatcgcttgaagaagcaactggttatgtatgccctcgctgtcatggtacaggcatggttcgtgacttacgttcgctttctctttcaattatgcgtaaagttgaagagattgcacttcgtgaacgtcatggtgaagttcaggttgaagttccagttgaaatcgcagccttcttgcttaatgaaaaacgccatagtctggtgtatttagagcaaacttctggtgtacgtgtgactgtattaccacacccgcacttagaaactccacattacgaaattgcatataacccagatggctttgctccatctagctatgaacgtacagaagcaacccgttctagcgagaaagagttaggttatgagtcttctgaatggcatttagaagaagcagatcatggccatgctcatgtaactgctacagcttcaactcatgctgcggctcagaaaaaagcaaatcatgcaactcaacctgtagcacaaccttctgctcaaaaagcagcaagcccttgtgcatggttagaaaacctgtttgttcaaaaacaagcgcaaacagttgatcaatctcgttcagcacaaaatgctgctgctgcgattgagcaaatggtgaatacaggcgcagtaagccgcggacagttcggtcaagtagccgtacctgctgttgcagaagttgcaccagttcaatcaaataacgcttatatttcacagtcacctgtgaaacaagacgttcgtgaacatgttgaaaaagatgataaatctcagcaacaacgtcagaacaacaaaaagcgtaaacataaagagcaacgtgaacaacatcaccaatcacatgaacagcaacatcaagttcatgaagaagtggttcaattgtcacgccaagaacaacgtgagttaaaacgtcagcaaaaacgtcaacagcagcaagatcagcaacatcaaaataatgatgtacaacacactgaaaatgctgtgccacgtcgtgaccgtaataatcaacaacgtccaaaccgtccaaatcgccaccgcgatccaagtgtattaaatgaaaatcaaaatacaccggttgttgttgatgaaaaacaaattaaggttgatgtgattgatgcacctaagcatgatgtcatgaacactgctttaatcatcaatgttgatcaaggtcaaagtgagattgttgcacttacacctgagcgtcgtcacgttgagcgagttgaaacgacttctactgaagttgctcaagagccaactccagctcctgttgtagccgagaaagctgctgtagttgaaaccaaagaagaagctcagccaagccaagaagctgctcagccacaaatcaaacgtgctagcaatgaccctcgtatgcgtcgtcgtcagcaacgtgaggctaaacacgctaaggcagctacgccatctattgcgccatcgcaaattccaactttggcacaacacacaatcggtagtttaatccgtcatgtgtatggtgaagattgcaccgtattgattgaacaatttggtctagttccaacgtttaatcgtgctttgcagaaatttgcagaacagtacgcaagtacgttagtagttgaagtttctgctgaaacggaagagaaaaagccggtaactcgtgatgcagaacttccaagccacaaaccggctgaagaagcagaacctgcaccagtacttccgcttactccgccgcaagcaccagctccacgtgttgcaaatgacccgcgtgagcgccgtcgtttagcaaaacttgctgcggaacaagcatttgagcaagtgaaacaacaacattctgctcaagaagaagttgctactcctgctcctgtagcagaagaaaccgttgctgctccaactgctgaaacacaagcaacagttgaaccagcacaacaaccgcttgaacttaatcagtcaactgaagtcgtacaacctgaagctgctcctgcagaggaaaaagctacagaagaaacagtagctgaagctcctgcggcaaaggaacctgcgccatcaaaagcagcaagcaaagcaaaagcagcggctgaagaaacagtagctccgactgaagcaacaactgatgccgaatcagaagacgttaaggcagataaggacaaaccgagtcgccctcgtcgccctcgtggccgtccgccaaaaaaagctaatcctgtagctgagtaa

SEQ ID NO: 4108 - DNA, 318 bp, Acinetobacter baumannii
ggcagaatggtctgttcaggtcttacacagagaaatgaagcactggtcatgatagacacaactgttgatgtaattaataaactcggtttacatgcacgtgcatcaggaaaactgatagaggtcactacaaagtttcgttcgtcaattcaaattggtaagggcgatcatttagtagatgcaaagaatattatgtcgttactgatgttaggtgcaggtaaagggactactttacgtttagtcattgatggcactgacgaagaacaggcattaaatgaagtacaggcgttattcgccgcaaaattttatgaggcagattaa

SEQ ID NO: 4109 - DNA, 189 bp, Acinetobacter baumannii
accgacgtggttatgcacctgttctggtctgtgaaagttgtggttggcaagcgaattgtccgcattgtgatgcgcattttacgttacacactcagccttattcttacttacattgccaccactgtggcacagttcatcgcttgccagaccactgccctgagtgtcagcaaaagagcctcaaaactttag

SEQ ID NO: 4110 - DNA, 405 bp, Acinetobacter baumannii
aaggttacggtattcgggttaaggcagctgaagagtaaggcttttatgcaacaatttttagctctttctgtggttgctccaaatggaacccgtatagctcagggaataaaaacacttgaagttcgttcctgggtccctgcacagctgcctcttaaagatctattcattgttgagaaccaaaattttttaaagaatgatggtgatgaagaagggggagttgccgtcgctttggtcgatgttgattctattcacgtttggcaaaacgatgagattgaacctgcctgtgccaccggttggagtgaaggatattttgcttgggttctaagtaatgtgcgtcctatgaagcgacagttgaaagttccggctaaacgtaaaatttatcaagtctctctggatttaccataa

SEQ ID NO: 4111 - DNA, 1314 bp, Acinetobacter baumannii
tactttgcggtgcataaggattgtcttatgaagaattttaaatttagccttgcatggcaaattttaattgctttaatcctagggatagttgtcggggctgttttacataaccagcctgaaatcaaagatagtattgtaaataacgttcttactccattaggtaagatctttattagcctgattaaaatgattgtaatcccaatcgttttctctacattgattttaggtattgctggtgttggcagtacaaaaagtctagggcgtcttggttttaaaaccattctctatttcgaaattattactactattgctattttggttggcttgtttgcagcgaatatcttccatccaggttcaggcattgatatgtctcaactggtacaaactgatatttctcaatataagcatacaactgaagaagtacagtcacagtctcatggtattatccagacgatattatcgcttatcccaacgaacattattagttcaatggcgcatggcgaaatgttgccagtgattttctttgctgtgctatttggtattggtttatcttcattaccagcaacaacaaaagacccattattaaatgtatttcatgctgtatcggaaacaatgttccgtgtaacacacatcatcatgaaatatgcgccagtgggtgtatttggcttaatcgctgtaactgttgcaaacttcggttttgcttcgcttattccattgggtaaattggttgtattggtttatggtgcaatcttattctttgctttagtggttttaggtattactgcaaaaatgttcagcatcaatatctttactttgtttaagattttgaaagatgaattaattttggcgtattcgactgcaagttcggaaacagttttaccgcgtattatgcaaaaaatggaagcttatggtgcgccaaaagcgatttctagtttcgtaattccaactggttattcatttaaccttgacggttctacgctttaccaaagtatcgcagcaatctttattgcacagctttacggtattgaaatgtcaatcagccaacaagtgattttagttgtaacgttaatgattacttctaaaggtattgcaggtgttcctggggtatcatttgttgtgttattagcgacattaggtagtgttggtattcctgtagaaggcttagcatttattgctggtgttgaccgtatcatggatatggctcgtactgcgttgaacgttgtaggtaacgcgcttgctgtacttgtaatcagtaaatgggaaaaacaatacgactatgaaaaagctgctgcttatgaagcctctcttaagtaa

SEQ ID NO: 4112 - DNA, 573 bp, Acinetobacter baumannii
acgccacaggtaggtggtgattttctaaatacggatataggtagtacgggtagagatttcacgatgattatttatgacggacaagtagctgataactatatgtatcaggattcaaatcaggcagccattgttgtatcccacagcacaccaagcctcccttatccattcaccatgaaacccaataatcactccactgaaaccaacactcctccagccattgatgtagaaaaattcgtagctaaattagaaagtattacctctagacgcagtaaagcgcgttgtgcacgtagcatccgtattgcgcttgagtctgctggtgccgatgttgaaaaccatccgattgcagcatctgattggggcgataccctcaagaaaattggctataaagaaataaatccagcctttgatgagccacaagaaggcgacatttatatcattcacagaacccgcaaccatatttacggtcatatcgctggttacacaggaagcgaatgggtgtcggactttaaacaaagtagttatgacgtctataaagatgataacgtcacctatacttactatagattaggctaa

SEQ ID NO: 4113 - DNA, 1242 bp, Acinetobacter baumannii
acattaaaggtgctaacaatggaatttaaagttattcgtacaagagagcagtatcaagcttatcttgacgaagtgcattctttaattatgctaaatccggctataggaagtcctgagagtgatcggttggaattattatcggttttaatagaagattatgaaaataaacaatatccgatagaggcgcctgatcctattgatgcaattctatttaggatgcatgagaaagggttaaaacaagctgatttggccccatattttggtactactagtagagtttctgaagttcttaatcgaaaaagagctttaaccgtagatatgatccgagcattatctgtagggttgggactgtcggtagagacattaattggtttatcaaattcaaagaatacattagataaaaataatattgattggtctaaatttcctgttaaagagatgaaaaatagggggtggttaaaaacatttcttgctgatacggcagcatcaactgagagtattatccaaaaatatattgctcaatcagggttacaaatcggctcagcttcttttaaacgaaagttgtctggtgatgcccaaacacctaatacgatgtatgcactgtatgcgtggctagctagagtcattctccaagctagagataagaaagatagtctaggaaaatatgaccctaatttaataaatagtaattttttaagagagttagctcaattaagctggtttgagcatgggccaatattagcaattgaatacttagaaaaacatggaattgctgtagtcattgagcctcatcttaaaggtacgcatcttgatggagcggcattgaaggacagtgacggcactcctattattgggctaagtttacgatatgaccgattggataatttttggtttacgttactacatgaatgcgcacatatttggaagcatgttgatgaaacagaagcatttctcgatgatttagattcatcaagtatggaggatcggagggaggctgaagcaaatcgattggcaagagaggcatttataccaagaggagttttgagacgtacagaggcatttatctcaccaagtaaagaatctattgaaaagttggctaaagagttgagagttcatccagcaatcattgcagggcgtattcgaaaagagttgggaaattacaccttattttcagacttggttggtcaatatcaggtcaaggcattattaaccaattctcatttattaagtgttgaggagtag

SEQ ID NO: 4114 - DNA, 1413 bp, Acinetobacter baumannii
agacctttatttaggcagtgcctagataacattattccaaggagaaagtgtcacatggagacggttcagggtggcatgttgcttgtctatactttaattgcgatcgttgctttgattgtcatgatcgcgaagtttagaatttacccctttttagttcttattattgtttctcttggtttagcccttgcagttggcatgccaatggacgggattgttaaatcatatgaagcaggtaccggtaaaacactaggtcaccttgcgattgtgattgcgttaggaaccatgcttggcaagatgatggctgagtcaggtggtgcagaacgaatagcaattactttaattaaatggtttggtgaaaagcatattcactgggctatgatgttcattgcgttaattgtagggcttccggtattttttgaagttggttttgtacttcttattccaattgcattcaatattgccaaacgtacaggtaaatcattattaatcgttggtttacctatggttgcgggtttatctgtcgtacatgggttgattccaccgcatccagccgctttgcttgcggtacaggcttaccatgccgacatcggtaaaaccattatgtacagtttgttggttggcgtcccgacggcggttgttgcaggtccattgtatgcattatggatcaacaaatatgtcaaattgcctgaaaataatcctttagcaaagcagtttgttgaagcagatgctaacaacacacgtgaattgccgagctttgggattaccttatttacgatcatgctaccggttgcattgatgctagttggtagttgggcagatgttttctttgcaccaaaaacattcccaaatgagttattacgctttattggtacttctgatattgcattgcttattgctgttttggtcagctttattacttttggcactatgcagggttttaaccgtgaacaaattgaaaaattctgtggtggatgtctagcttcaattgcgggtattttgctgattgttggtgctggtggcggtttcggcggtattttaagagacagtggaatttctaatgaaatcgtctctactgctttaaaagcaaacctttcaccattgttattaggatggcttgttgctgctctcatacgtctggcaacaggttcggctactgttgcgatggccacggcttgtagcattgtcgcacctattgcggcagcagcaggtgtagtcgttagacctgaacttttagtattagcgacaggttctggatcattaattttctcgcatgtaaacgatgctggtttctggctaatcaaagaatattttggaatgacagttgggcagacactgaagacttggtctgtactggaaacaattatttcggtacttggtttgtctttcacattgttgcttagtgctgttttgtaa

SEQ ID NO: 4115 - DNA, 3030 bp, Acinetobacter baumannii
ctatacttatttaaaaataaagatatgagtacaagattaattcaacacctcaagaataaatgcgaggcagatgataatgttgcaattttatatgctcaatgggagttcgatcaaaagttagtaggaaaagcattagaaaatattggtggtttttacccacattttagtaatcacaatgcttcacattcacagcagattttagtgaatatcgagcgaattctaggaaatgatattgaactattaagtgctactgatacttggcttattcttgaagcggcttattggcatgatgttggcatgttggttgatgctaaaaatgcaaaagaagtccatacaaatcctgatttcaatttcatgattcaaacaatagcaaatgaaaaagggcatgatcttcaaaaattttgccaagcttatgttgagcaaaattggttatcagccattggtattgtagaccatccttttgatgggattgagcaataccgtcaattagttgctgagtggtttcgacgcaggcatgacaagcgagttggcaagattgttgaagatccctttaaagatctaggtattacatcatccagaactgaactattaccaaaccgaatttatcgatatttagggcaaatttgtgtctctcatggtatgaattttgatactttaatggaaacacttccctataaacaaactggtttggggactgaagattgtcatccgcgttttatagggtgtttacttcgtttaggtgatctatttgatttagatgacaaccgcttttgccctgttatggcaaagcacgtcagcaatatgccctctgtaagtaaacatcatcatgataagcatttatcattgcgtgaatttcaacttgataaacgaacagtaaagcttgtcgcagaatgtcctgatgaaatgtcttatgtcgaaactcaaaattggtttggttggatacgtcaagaattccaaaatcaaatgtctcaatggaactttattgtaccaagcttagagtttggttctttaccaacaattgagcagctagacgtaaggatgcaaggtaataaaattttattaagcaataagccaatgaaatttactattgatgaaaacaatgccttagagattttagaaggaagtggattatataaaaatgatactaatatctttagagagttaattcaaaatgcaatcgatgcaacattaatacaagtatggtgtgattttgagaaaggacgtataaaattacccaaaaatccccatccttttgataataaagtacaaaatattttaaagagttatgctcttgaaatatcctttgaacggatcggaattattgatggtagcgatgatgcttggtgggaatttaaaattgaagataaaggaactggaattagtttacttgatttgaattatatgcaaaaggttgcaggttcgagtagaaatatagagcgtcaaaaaataatcaatagaatgccaatatggatgagaccatctggccagtttggaataggattgcatagtgcttttttgctcttaaaagatatcaatgaggaagatcagaaaattacgattattagtacaaattcagttgattataagacatacaaaattgaattaaattctccattaaaatctaaaaaaggttattgttttattgaagagcaaaaagaaataaaaaaagatataggtacaactttaattttgagattaaaaaagaaaagaagagctagaagttattcttacaacaactcagagctatataaatttttgtatacaaaacatgaccctttaaaggaggaaatgtttgatgtgtttaatatagccacgcaagttgagaatataaaagatgaagtcttgagaaatatatgtttgccttatgaatttaatgaagaatggcaggtgaaaattaatagtgtttttcctcaacaaaaaaacacttttgataatattatttgggtggataaatatagtctttatttaatagttgatgaaattaaaatttccaatttaaatgaacttcatagtagacttgatggaggatttaaaggtcagaacgttggtagaataagttattataatcagatatttggtttttatttaatgttttttggcttagaagcaaaaagtacactacaaaccaatagaaatgaatggagtaaagactttgagcgtaaatttattgagcatagatttttgcatgagttatgtaggcatattctagatgagtataaagatcagcttatagatatattaaaagatagtaaaattattgatttatttgatttttgttttaatgaggataagagtaagatttcttggaaagaaattcagatgtttaatgttgataaatggcctaattataaacataaaaataaaaaatgtaagatttataataaaagttttaaagagttgttaagtctaaaaaaatttaatttttattacatagatgagttcataaatcctaattttgatatatctaatttatcaactaatgatttagtttatccagctccatttaatagttggtttaaagactattttgaccaagattggattgataaaggtgggtttgtttctactgaaaaaattaaaggaggaggagaaattgtacgatattcgacagaaaaaacacatgagatcgaaagtggggattttcgtatagttaatcagataaaatttgcaatacaacaagataggaaaagaattaattttaatcaagagtggatgtctaaaatattttttagagaatttaaagccttatttactaaatcaattctagtagagcggttagtcggattagagaacttaaatgttaagcatttaattctaccattctatattttttctaaagatttagaagcggggccgaatattagaatagactatttagaagataatgaattagtgagatctacgtgggattcaagagatgaagaatttgaagatttaaaatttgaagattttctaacactatataaaaaattagaagaaaaaattagtaagcttattaatacaatttatccaaattggatacaaaaataa

SEQ ID NO: 4116 - DNA, 1401 bp, Acinetobacter baumannii
gttcattctttgaaacagcaagccaaatctcgtaaacctcaacaacccgaatatatttttcaggttgaaacactttctcatgaggggcgaggaattgcgcattatggttctcatccagaccatccggcagataagcatggtaaaaaagtgtttattcgttatgcgttgcctggagaaacagtaaaagcccaaattacgcatgaggctaagcggcttgaagaagctgaaatggtagagcttttagcggaaccttcagcaaatcgtgtagaggcagtttgtcctcattatggtatttgcggggggtgtagcatgcagcacatccaccctgatgaacagatccatttaaagcaaaatgtccttcagtcacacttgcaacactttgctggtattcagcctgaacaatggttagagccaattcgttctttgcaaagtgattatcgccgtcgtgctcgaataggtgtgcgctatttgccaaaacaggaccgtttgattctaggttttcgtgagcatcatagtaatcgtttaacatctatccatacttgtagcgttttggataaaaagttatcagataatctgccggaattgcgtaatttactccaaagtctaaaaggcaaagcgcatattggtcatgtagaattagcaaaaggtgatcatgaaatatctttattagttcgtcatatcgaaaaactaaacaatgctgatgtcaaccaattaagacaatttgcgttacacaaaggctggcagttgtatttgcaacctaaaggacccgaaagtcttcgtcgtattgatgaagaacaaggagctatgcgattacattatgctttaaatgcatttgatgtaaattttgctttttcgccattggattttacgcaggtcaatgccacagtaaatgaacaaatggtgcaattggcatgtgaattgcttcaattgcaacagggtgaaagagtactggatctgttttgtgggttaggtaatttttcgcttccacttgcacgatgtgttggtgcaaagggtcaggttgtaggtgtggaagcaagtgaagaaatggtgcagcgggcaacagataatgcaaagcgtaataatctggtgcaagcaagcttcttttcacaagatttaacaaaagatttttcgcatcattcttgggcaaatcaaggatttgatgcattattgattgatcctcctcgtgctggtgcatatgaaattatgcagtatgtaccgaactttggagcaaaaagaatcgtttatgtatcatgtaatccagcaacattagcaagggatgcgggtgttttggttcaacatggttaccagttaaaaaaagcagcggttatggacatgtttacgcacacagaacatgttgaatcgattgctttatttgagaaaattcaagagataaacgattaa

SEQ ID NO: 4117 - DNA, 537 bp, Acinetobacter baumannii
ttacaggtattaatgagaggatcaagcatgcacttagcccaacgtttagccgctgttgttttaaccttaggccttagtgcaggcttagtcgggtgtggtttccatttaaaaggaactaacccgactgcgactccacttgtttataaaaaattaagccttgagttaccggcaaaaaccgatgaccttgaaacacaattaaaagtgtatttaacggcaaatggtgttcaactcagcaatgacaacgacgcctatgttcttcgtgttttagaatacacgcctcgtcgtcagcttctaaatggtaaacttacagaagtgttattacgcttgactgtaactttccaaatcgaagaccgtcaaggtaataaaattacagagccgcgtactttaaccgcagctcgtagttatcaatatgatttggcaacggtcaacactgagaaccagcaagagagttacttgcaacgtattgtaattgatgaccttgcacagcaaattactcgtcaaatttcagccaatcgcttaccaaaagctcaaccatag

SEQ ID NO: 4118 - DNA, 1914 bp, Acinetobacter baumannii
aatatatcatttggtctatttttatgttccggcttatccggttgtacaggagcgtccagcatggacttgccgaatccagtattggcaaaagttactgaacgtgtaattgcacgtagccaaaaaactcgttctacatatttacaacgtattgaacatgcccaaggcaaattcccagctcgtggtgcactctcatgtgccaacttggctcatggttttgctggcatggaagataatgaaaaattaattattaaagttggccgtgaaccaaatattggcattgtgtcttcatataatgaaatgctttcagcacatgccccatataaaacattccctgacattataaaaacagctgcacgtgaaaatggtggtgttgcacagtttgcgggcggtgtaccggcaatgtgtgatggtattactcaaggtaatgccggtatggaattatcactattttcacgtgaaaccattgcgatggggacagcgattgcactttcccataacatgttcgatgccgcattgtgtctcggggtatgcgataagattgttccgggcttgctgattggtgctttgcagtttggttatctaccaaccatttttgtacctgcggggccaatgagtagcggtttgtcgaatgatgataaagctaaaatccgccagcaattcgcgacaggtcaagtaggacgcgatgccctacttgaagctgaatcggctgcctatcatggtcagggcacatgtacattctatggtactgcgaacagtaaccaaatgttgatggaagtgatgggcttgcatttgccaagtgcggcatttgttcatcctcataccccattacgtgatgctctcactgccgaagctgctaaacgtgtacttgacttaactgccgagcgaggcaactacacgccgattggccatgttattgatgaaaaagccattattaatggtattgtggctttactggctacaggcggttcaaccaaccatacgttgcatcttattgcgattgcacgtgcggctggcatcttaattgactgggatgactttgatgagttgtctgctgttgttccattgctcgcaaaaatctatccaaatggcaaggccgatgtaaaccatttccaagctgcgggtggggtagccttccttattcgtaacttgcttgaggctggtttgttacataacgatgtgacgaccgtcgctggtaaaggtttacagcattacaccaaagaaccgaaattgattgacggtaagctcacttgggttgacggcgtggttcaaagccttgatgacaaagtactccgtagcattgatgcgccgtttcagccagatggcggcttgcgcttaatgcaaggtcgccttggccgtggtgttatcaagatttctgcggttgcgccagaacaccgtaaagttaaagcaccggcaattgtttttgattcgcaagaagcggtacaggcagcgtttgatcgtggtgaattgcaccgagactttattgcggttgtccgtttccaaggtgcgcgtgctaatggtatgcctgagttgcaccgcttgactcctgtgttgggtgttttacaagatcaaggcttccatgttgcattagtaactgatggtcgtatgtctggtgcttcaggcaaagtgccagcagtcattcatttgtctccagaagcgttattgaacggtccgattggcaaagttcaaaccggagatatgttaatcattgatgctgaagctggtgtactcgatattgagttagatgagcagacttggcagtcacgtcctgttgctcaaccagaacatcaggcagaaaacgaagttggttttggccgtgaattatttggtgtgttccgtgcggcagcagcgcctgctgaacatggcgcatctgtgtttggtgcacttgttggcgaagagccacaagggcagatttaa

SEQ ID NO: 4119 - DNA, 198 bp, Acinetobacter baumannii
ttaatatcatttaatcttttctacctctcgccatttgatatccgctcaaatggctttttttattttttaaaaaataagcctgattctaggttgttcttaattttaaataacttagcctttgtgttattcgactttcggtcaaaagatcaaccaatcccccacaagattgtctttttgtcatataatttagcccgctag

SEQ ID NO: 4120 - DNA, 414 bp, Acinetobacter baumannii
acggagtctttaatggcgggtggacaacgcttaaagcgaatggcggattcagtacagcgcgagctttctgaacttatccgtcaggagttgaaagatccgcgtctgggtggtcttgtgaccatctcaggcgttaaagtcagtccggacttaggttatgccgatgtctatgtgaccgtgatgggtcgtgaattaagcgatgaccaaaacgaagtggctcaccgtgaaacactagatattttgaataaagcatctggttttttacgtcaggagttgagtcgtcgtattaaaacgcgcatcacgcctcgcttgcgtttccattacgataaaactaatgcatatggtaactatatgtttggccttatcgaaaaagcggtacaagatttaccgaaacgtgagtcagatgacgaagagtaa

SEQ ID NO: 4121 - DNA, 825 bp, Acinetobacter baumannii
aaatctgcattaaatagaggtgaagccatgcaacgttatgcggtcggtattgaatttagtggtattcaatatcgaggttggcaaacacaacagccaggcgttgccagcgttcaggaaactatagagcgtgtactcagcaaaatcgctaatgaaccaatcacacttcacggtgctggtcgaacagatgcaggagtacacgcaacaaatatggtggctcattttgacactaatgcggttcgtccagagcgcggatggatcatgggagcaaatagccaacttcctaaggatatttcaattcagtggattaaacagatggatgaagagttccatgcacgttttaaagccactgctcgtcgctaccgctatgttgtatataacgctccacatcgccctgcacttttacataaacaagtcacgcatatttatcaaaaattagacgtgcaaaaaatgattaaagctgccagcaaatttgaaggtacgcataactttgaaaccttccgtgcagcagcctgccagtcaaatcaacctgtacgacatgtaaagcattgccgtttatttgaacatggacgttatttggttttagatattcaagctgatggctttttacatcatatggttcgaaatattatgggttgcttacttgaaattgggcaaggcatgtatgaaatcgaccatattgatgcaatgttcgcagccgaagatcgaaaggcagcaggaattaccgccccacctgatggtctctattttattcaatgttattatcccgagcagtttgacttaccacaaccaccgctcgggccacattggttaaacctacctgagtag

SEQ ID NO: 4122 - DNA, 345 bp, Acinetobacter baumannii
atgaaagcatttctcgtacttgatgagctgaatcagtttcattgggcgatgcttaaatctgtcctattgattttagcattattacctattgctgaagtttcattaaagctatggttgagtactgagggaagtagccaaatcatgattggtttctttgccttaagtattgtaagcgcttggttaatggtgagcttctttaccgcattaaaaacgagtgtatggcaaactaaacagatggcttctaaatacgaacaattgctttttaaagcttatcgttatgtgccgatggtttttttatcgagtttagttgcttatttatctttgcaattatcgattgctttttaa

SEQ ID NO: 4123 - DNA, 708 bp, Acinetobacter baumannii
gatattttttcaaataagatttataaaaataattatgttatacctatcagtataataatatttaaggatatttccatgctagatctctctcaaattttggcatttggattaatttgtctggcgatggtactcacccctggcccaaacatgatttatcttatctctcgttccattagtcagggcaaaatcgcaggatttatttctctcggtggcgttgccgttggttttgtattttacatgctttgcgcatctttcgggattacagcacttgttgttgcagtaccttatgcatatgacactattcgtattgccggtgcgatgtacttactttggttagcatggaaagctttacgccccaatgccgcacctatttttaatgttaaagatttagcggttgactcaccattaaagttatttttaatgggctttttgactaatttacttaatcctaaaattgcgattatgtatttatctttattacctcagtttattcacccacaacaaggcagtattttagcgcagtctatccaactcgggactatacaaatttttgtaagcgtttcagtaaatgcgctgattgtattttctgctggtagcattgctctttttctacagaaaaaaccactttgggccagcattcaacgctgggtcatgggaacagtattagccggtcttgcggttcgtattcttctagaacaccgccgataa

SEQ ID NO: 4124 - DNA, 477 bp, Acinetobacter baumannii
attatgaaattcctgtttttgtgtactggaaatagttgtcgtagcattttgtctgaagtgctttttaacagtcgtgctcctcatgactggaaagcatacagtgcaggtagtaagccatcaggacaggtgcatccattgactattgaaactttggaaaaccttggtctttcaacagaaggtttatggagtaaaaccattgatgactgtgagcaatataaacctgatgtagtgattactgtgtgtgattcagcagctcaagaagcttgtcctctttatttagggggagcgatcaaggcacattggggcttggctgatccatcacatttagacttgcctaaagaggaaaaattaaaagctttcctagtgacagtagaccatatcaaccgtcgtttagatgctttatttgcacttgatacagcaaatatgtctcgtcctgaattaattgctgcaatcaatcacatatcagatattgaatga

SEQ ID NO: 4125 - DNA, 720 bp, Acinetobacter baumannii
ccatatgaattaacgaaggttattaaaatgtctctacctaaagctctgaagacaaaagaccggattttacaaatcagtttgcagctttttaatgagcgtggcgaacggtctgtcactaccaatcatattgctgcagagttggggattagtcctggaaacttgtattatcactttcgaaacaagcatgaaatcattaaggaattaatgcaccaatatcaggtcgagactttagaaatgctctctttacctgaggacagaccattaacgaccaatgacaaaattaattattttcaggtgctcagtggtcagctatggaactatcgttttatccaccgcgatgtttatcatttagttgaaagtaacgaagactttaaaaagatctatcctcgattcgcagggcaggtcatgcagcaagggcaaagaatttatcaggcctttgttgatgccgggcttatgaaaatgacaccttcggaaattgaagcgctcattattaacctctggattgtcttaacgaactggaccaactttctatatatgtccggacacattagtgataataaccaccttgaagaaaaatgggtttggcaagctttacgtcaaatggtttttttagaaggcccttatttaatgggtgagagccgcgcgacttatgagcaattattggagtcgcttggaccttctgatctttttgccagcttatcgtccctaaaagatgaatag

SEQ ID NO: 4126 - DNA, 1965 bp, Acinetobacter baumannii
aatgctccttcgtatagggcatcactccttaaggatttttttatgccaattatcacattgccaaatggcgatcaaaagagttttgatcaccctgtatctgttatggaagtcgctcaaagtattgggcctggtttagcaaaaaataccgttgctggacgagtaaatgatcgcttagttgatgcatgtgacttaattaccgaagactcgaccttacaaattatcactccaaaagatgaagaaggtcttgagatcattcgccactcttgtgcacaccttgtagggcacgcagtaaaacagctttttcctgaagcaaaaatggtgattggtccggtcatcgaagaaggtttctattacgatatctggatgccacgtccttttacactagatgatatggctgcgattgaagagcgtatgaaaaagctcatcgatcaagattatgaagttatcaaaaaaatgacaccgcgtgatgaagtcatcaaagtattcactgaccgcggcgaagaatataagttacgtcttgtggaagacatgcctgaagaaaaagcaatgggcttgtactaccaccaagaatatgtagatatgtgtcgtggtccgcacgtaccgaacacaaaattcttaaaatcattcaagcttactaaaatctctggtgcttactggcgtggtgatgcgaagaatgaacagcttcaacgtatctatggtactgcttgggctgataaaaaacagttagcagcttatatcaagcgtattgaagaagctgaaaagcgtgatcaccgtaaaattggtaaagcgttagacttgttccatatgcaagaagaagcaccgggtatggtgttctggcatgcaaatggctggactatttatcaagtactagaacagtacatgcgtaaagttcagcaagacaatggttaccaagaaatcaaaactccgcaaatcgtagattttacgctttgggagaaatctggtcatgcggcaaactatgcagaaaacatgtttacgactcattctgaaagtcgtaactatgctgtaaaaccaatgaactgtccttgtcacgttcaagtgtttaaccaaggattaaagtcttaccgtgatttaccaattcgtttagctgagtttggttcttgtcaccgtaatgagccgtctggttctttacacggtattatgcgtgttcgtggttttactcaagatgatgcgcatatcttctgtactaaagaacagatcggtaaagaagttgcagactttattaaactcactttagatgtttataaagactttggctttgaagaagttcaaatgaaattatctactcgcccagaaaagcgtgtaggggatgatgcactttgggatttagctgaaaaatctttggcagatgctttagatgcagctggtcttgaatgggaattgcagccgggtgaaggcgcattctatggtccaaagattgagttctctttaaaagactgtcttggtcgtgtatggcaatgtggtaccattcaatgtgactttaacttgccagttcgtttagatgcttcttatgtaactgaagaaaacgagcgtgatcaacctgtcatgttgcaccgtgcaattcttggtagttttgagcgttttattggtatactaattgaacactacgctggttttatgccgccttggctatcacctgtacaagcatgtgtcatgaatattactgattctcaagctgaagcaagtgagcaagttgtggcaaaactcaaggaaaatggtcttcgtgctatttctgacttgagaaatgaaaaaatcggatttaagattcgtgagcgtactctagagcgcattccttacctgttagttcttggtgatcgaaaagttgaagaaggtacagtgaatgtacgtactcgctcaggaaaaaatttaggtactatgtcagtggatgctttcattgacttagtgaaatctgccgtcgccgaacgtggccggtatattgtggagtaa

SEQ ID NO: 4127 - protein, 123 aa, Acinetobacter baumannii
ELGSQDEGLRECPVDPRDVPGGRSLGGHPRRSVVHQPHNLVDITRAGDPNVRRLLAVHSLPWRGMNRRLIVQFDPDEPSMSAPTFAEPDQGPLAGGRKVNARHDLTLGLWRRDCEISRGFPRR

SEQ ID NO: 4128 - protein, 233 aa, Acinetobacter baumannii
ASASSSDIALIVTTPSEIGKTARKFRYADPLRLSLWSSTFASGVVSMLPRLSIDFQGSDIDRAALVIMHYQVDVFDILFGKEPSPLLDRCNALIRSWRATGRPVLFPNFSLGEEYEHAPPATNRQISPYLPSGRFRTGLPVEGLAIERGDLFYACPRASVFYGTALDADLRTRGVSTLVMAGISTTGVVLSSVAWASDADYDVRLVQDCCYDPDRDAHEALLRSGFGGRVQVV

SEQ ID NO: 4129 - protein, 148 aa, Acinetobacter baumannii
HQGPILGALALPHDDRAVIEIQILDPQLQTLTDPHARSIQKLGEQTMLAFQKTEDANHFIRGQHHRQAPRRPRSSDLLKPGQIRAQHLAVEEQQGRQCLTMRGDRNLALVRQPGQKCLDFAAAQGCRVTHTVETDEGTNPVDISLFGS

SEQ ID NO: 4130 - protein, 343 aa, Acinetobacter baumannii
GQAFIRRTIMENIALIGIDLGKNSFHIHCQDHRGKAVYRKKFTRPKLIEFLATCPATTIAMEACGGSHFMARKLAELGHFPKLISPQFVRPFVKSNKNDFVDAEAICEAASRPSMRFVQPRTESQQAMRALHRVRESLVQDKVKTTNQMHAFLLEFGISVPRGAAVISRLSTLLEDSSLPLYLSQLLLKLQQHYHYLVEQIKDLESQLKRKLDEDEVGQRLLSIPCVGTLTASTISTEIGDGKQYASSRDFAAATGLVPRQYSTGGRTTLLGISKRGNKKIRTLLVQCARVFIQKLEHQSGKLADWVRELLCRKSNFVVTCALANKLARIAWALTARQQTYEA

SEQ ID NO: 4131 - protein, 432 aa, Acinetobacter baumannii
HFITDKHNMSTNLSVIKNPRVQSDQRRLVRRPDVKPNRPLIVILSTVALDAVGIGLIMPVLPGLLRDLVHSNDVTAHYGILLALYALVQFACAPVLGALSDRFGRRPILLVSLAGATVDYAIMATAPFLWVLYIGRIVAGITGATGAVAGAYIADITDGDERARLFGFMSACFGFGMVAGPVLGGLMGGFSPHAPFFAAAALNGLNFLTGCFLLPESHKGERRPLRREALNPLASFRWARGMTVVAALMAVFFIMQLVGQVPAALWVIFGEDRFHWDATTIGISLAAFGILHSLAQAMITGPVAARLGERRALMLGMIADGTGYILLAFATRGWMAFPIMVLLASGGIGMPALQAMLSRQVDEERQGQLQGSLAALTSLTSIVGPLLFTAIYAASITTWNGWAWIAGAALYLLCLPALRRGLWSGAGQRADR

SEQ ID NO: 4132 - protein, 69 aa, Acinetobacter baumannii
LVVTPVDAVVGQNQLCPARLDECGWRIGGHLARAVAVHAAQHVDGIEHTLGGGRSPQFEHAQELRRVAA

SEQ ID NO: 4133 - protein, 92 aa, Acinetobacter baumannii
QRGTGGHGLQALPSTCSACRRCVAGFGAAQGNEPIADRGNDRPMPCGSRRLPASYTRPRSAVGTLAQPDTPDHEQDADDLKRTQRLIQEQPS

SEQ ID NO: 4134 - protein, 220 aa, Acinetobacter baumannii
CMMTRAALSMSLPWKSIDSLGSIETTPEAKVDDQSDNLSGSAYRNFLAVLPISDGVVTIRAMSDEDAEAYAAGTGDALVRRFAHLPLEKYSPQIVRELIHSVIGAGLRDGTLAVLTIADSSSDSFLGSLVFFDINQDDAEIGYWVAPEHRGRKVSGRALALALQISRILGLKRLRARTVQDNPASERVLLNAGFKQEGEARPEIVPSGKTEMSVSYLIEV

SEQ ID NO: 4135 - protein, 63 aa, Acinetobacter baumannii
KNNAGGAYPGHDKRAYAARPKVGVERRAIKDAGSRTCIEKVAPFDRKPFDGQTGAKSSAREIR

SEQ ID NO: 4136 - protein, 124 aa, Acinetobacter baumannii
GLDARAGHEKARSGLLRASDAVERGRGCCLHGSAVVSGLRSGSGPDQSSPFLGPSTFLTTSLLFANPSTITASPCSNAASGPASSKASIAARNSGESGACSTVPPRSPASLSPACSSSTAPTVK

SEQ ID NO: 4137 - protein, 71 aa, Acinetobacter baumannii
TSEADCTIAAEGLDPSGNDGLLPAISGRREDFPQPAVRCGTDGLRAGVVNPPGLTCAALPLTSEGRQRIKR

SEQ ID NO: 4138 - protein, 204 aa, Acinetobacter baumannii
CYGAATMLRSSNDVTQQGSRPKTKLGRMDTTQVTLIHQILAAADERNLPLWIGGGWAIDARLGRVTRKHDDIDLTFPGERRGELEAMVEMLGGRVTEELDYGFLAEIGDELLDCEPAWWADEAYEIAEAPQGSCPEAAEGVIAGRPVRCNSWEAIIWDYFYYADEVPPVDWPTKHIESYRLACTSLGAEKVEVLRAAFRSRYAA

SEQ ID NO: 4139 - protein, 60 aa, Acinetobacter baumannii
LGLALPRTNPPAAMAAIMRGPKITRPVHVRRTRNATELRGHPDPGRSSSPGPNARRSPHH

SEQ ID NO: 4140 - protein, 313 aa, Acinetobacter baumannii
CTHHLNTFDGGVSRLHGFKSQRGADYPFQFAMIAFNHVVPVLNLSVFNVRRAPAFAFEQSKRATIGGRFIRVDESRDLPLLHVVEDFTQKPVCSFAVTTGGEIKIDSAAPAVDGPVQIRPAAIDLHVGFIHVPRAKIGRVTPVPAQPFFHFRRITLNPAVNRGVIDIHSAFSQHLLQLTVTDAVFAVPAYGPQNDVTLKMPAFEWVHVQLHQQKGMISLSPPTICNSAFRSTIRRSIAGSSATPRRWRSGCAGSGGVALIRAGAWMKPTSRCGASGPTCTGQSTSGATRSISTCRRPAAPRQRSGSWARPCEA

SEQ ID NO: 4141 - protein, 90 aa, Acinetobacter baumannii
NLRQGAGQVDLPVPGSRQAGRHDRFLPVADPQRQGSEAVPGQGPARPEALGKACHAQYRQSAELWCSDHRIEARRKAGPGDGPPAGEVSQ

SEQ ID NO: 4142 - protein, 230 aa, Acinetobacter baumannii
VGGHIMFISDKVSSMTKLQPNTVIRAALDLLNEVGVDGLTTRKLAERLGVQQPALYWHFRNKRALLDALAEAMLAENHTHSVPRADDDWRSFLIGNARSFRQALLAYRDGARIHAGTRPGAPQMETADAQLRFLCEAGFSAGDAVNALMTISYFTVGAVLEEQAGDSDAGERGGTVEQAPLSPLLRAAIDAFDEAGPDAAFEQGLAVIVDGLAKRRLVVRNVEGPRKGDD

SEQ ID NO: 4143 - protein, 87 aa, Acinetobacter baumannii
QAGQQKDPNFVGSVCQGIHTKTGTPVWQVGRLGQGVVVSEKQLCRHLCSGKQAGQNSLGTDGATANLRSIKAEIHQFKQSFIWFCEY

SEQ ID NO: 4144 - protein, 339 aa, Acinetobacter baumannii
QAMKTATAPLPPLRSVKVLDQLRERIRYLHYSLRTEQAYVNWVRAFIRFHGVRHPATLGSSEVEAFLSWLANERKVSVSTHRQALAALLFFYGKVLCTDLPWLQEIGRPRPSRRLPVVLTPDEVVRILGFLEGEHRLFAQLLYGTGMRISEGLQLRVKDLDFDHGTIIVREGKGSKDRALMLPESLAPSLREQLSRARAWWLKDQAEGRSGVALPDALERKYPRAGHSWPWFWVFAQHTHSTDPRSGVVRRHHMYDQTFQRAFKRAVEQAGITKPATPHTLRHSFATALLRSGYDIRTVQDLLGHSDVSTTMIYTHVLKVGGAGVRSPLDALPPLTSER

SEQ ID NO: 4145 - protein, 68 aa, Acinetobacter baumannii
HFCLWRHLARSTHRLCPRQQLRPEPGTAIGGCSGGAGVHRQGFWQGHPASRAGKAAGLRPRGRHRGGA

SEQ ID NO: 4146 - protein, 300 aa, Acinetobacter baumannii
RRSCNRMSLRTPDLLFTAIAPAIWGSTYIVTTQYLPNFSPMTVAMLRALPAGLLLVMIVRQIPTGIWWMRIFILGALNISLFWSLLFISVYRLPGGVAATVGAVQPLMVVFISAALLGSPIRLMAVLGAICGTAGVALLVLTPNAALDPVGVAAGLAGAVSMAFGTVLTRKWQPPVPLLTFTAWQLAAGGLLLVPVALVFDPPIPMPTGTNVLGLAWLGLIGAGLTYFLWFRGISRLEPTVVSLLGFLSPGTAVLLGWLFLDQTLSALQIIGVLLVIGSIWLGQRSNRTPRARIACRKSP

SEQ ID NO: 4147 - protein, 105 aa, Acinetobacter baumannii
PAWCLGVQIIHLIGNEVGPVDRLAVLLVLGIPNLALHEYQRPLAQILAVGLGLRAKTLDAEEVGALLLVAGIVAPLFINRYIENCLRLVRIAMTGSVAKIGGSQR

SEQ ID NO: 4148 - protein, 71 aa, Acinetobacter baumannii
LCNSADRNAAFRQHFLKVAIADRIATIPAHRPQDHITLEMAPLEIRHRSVRPISAKHAQASRFLQQSPHEY

SEQ ID NO: 4149 - protein, 254 aa, Acinetobacter baumannii
CVGLCRYGAHNCCLFARPIPIVEVAAEADAMVTVFGILNLTEDSFFDESRRLDPAGAVTAAIEMLRVGSDVVDVGPAASHPDARPVSPADEIRRIAPLLDALSDQMHRVSIDSFQPETQRYALKRGVGYLNDIQGFPDPALYPDIAEADCRLVVMHSAQRDGIATRTGHLRPEDALDEIVRFFEARVSALRRSGVAADRLILDPGMGFFLSPAPETSLHVLSNLQKLKSALGLPLLVSVSRKSFLGATVGLPVK

SEQ ID NO: 4150 - protein, 116 aa, Acinetobacter baumannii
SAQSDSLPLTAANLCNRARHGNSNKPQAIFDIAVNEEWRNDAGDKQERTDFFRIKCFGSQAEAHGKYLGKGSLVFVQGKIRNTKYEKDGQTVYGTDFIADKVDYLDTKAPGGSNQE

SEQ ID NO: 4151 - protein, 180 aa, Acinetobacter baumannii
QRIGQRRVNASVGTGDGLGACALDGIHGGQDNALPPQILDKCARQHDAFVGLQGQLGQCMHGLPIVAHGEGLEPKNRLQLDQVLPPCLFALAVLAPTFHWHLELRGHHAQQGRKRRLIDAQKGARESQVAKLHSEAQSIRGAATLTDHRQVGFVERVVPYQFVFGIWQCQQAFALGGGQD

SEQ ID NO: 4152 - protein, 144 aa, Acinetobacter baumannii
AHSGTANFQHMRVNHRRRDVGMAEQILHGSNVVTAAEQGRRERVAEGVRCGGLRDACLFYGTFEGALKGLVIHVMATHDTAPWIGRMRVLRKNPEPRPGMPGARILPLKGVGKRNAAAALGLVLQPPCPCTRQLLAQAGCQALG

SEQ ID NO: 4153 - protein, 183 aa, Acinetobacter baumannii
VIAGQVDVLPPQRRQILQQCVVQRRAVATQSTGGTLQIYRVPQHDGRRHQIEAAGPVALLLKTAVADFTQSVEEDRPGQRVARLALIQPRMDAAAQLHALQPIQNEQRALDAPQLAQRHGQAVLARVAAEFAQHQRSRYRALLDGGGQPQNFIPMGAYLLDVQPVAANHRLERVIGGIALGDE

SEQ ID NO: 4154 - protein, 109 aa, Acinetobacter baumannii
RDRGRSRKAQDTDQAGARFQIDPHGLCHDQGIRSHASPAQRTGSPLVPAARHQGRGAPCGESFWHWALGADGGHGHAQPPFRSSRLIGAERQPTSDCRQSLQQSPSWQF

SEQ ID NO: 4155 - protein, 72 aa, Acinetobacter baumannii
SHVITHARFIVHSDSTCHLGQHLHCHHPIPAELLTDDGRDAAGVAGGFIARDDRPTDSNGNLVDAHLHPRRT

SEQ ID NO: 4156 - protein, 108 aa, Acinetobacter baumannii
SLSMLGGDWTDGTMTDFKWRHFQGDVILWAVRWYCRYPISYRDLEEMLAERGISVGTVAKLAMRQPFVLFKGLTFQKLCLPGAFRPGDHHNKMLRPGLCVVHASPQYL

SEQ ID NO: 4157 - protein, 128 aa, Acinetobacter baumannii
ACIISPTQIGRYIMKGWLFLVIAIVGEVIATSALKSSEGFTKLAPSAVVIIGYGIAFYFLSLVLKSIPVGVAYAVWSGLGVVIITAIAWLLHGQKLDAWGFVGMGLIIAAFLLARSPSWKSLRRPTPW

SEQ ID NO: 4158 - protein, 81 aa, Acinetobacter baumannii
PDTIDGGPGGYLRNCGRGAVGVDTKRSARSCRRRSGPGGGGFHGVRNRADPQVATSRASAHLYRLATGGRRTSARSSSFSV

SEQ ID NO: 4159 - protein, 176 aa, Acinetobacter baumannii
RTGVAAGVGVREAHPYRRADHLHVLRALPGPGLVDQWPVLHEGRGMPVAPTGDGDGLHVRPRWAPGIGVAAAPLPRPGPWQENVPLPGPDRRGNRRAVCWRPLHEIHMGEVPQAVADGPTDVRLFQLAPGAVPAQAGNLPPHVRIGFHPREEVARAGRRSLRRVARQRPGGTRLGQ

SEQ ID NO: 4160 - protein, 129 aa, Acinetobacter baumannii
RGAVTPVAGEGLPKLRIHQLGQRRRIGFIADVPGLQPRQLGVGGARAGLGHFGQTQVDRVGQDRRQQQGFVLGRVAGLQVCEVAGEARPFIDLHQQLGDFEVRQQHSCLVDHGLRGVWYCRVQRRDLQA

SEQ ID NO: 4161 - protein, 77 aa, Acinetobacter baumannii
ATQVRVAVEPQLGAPLRSRGMAASLDQRGADTPARMCPSHRELVQICGLPLEGVGPELGILGRQGATADDAVAATRD

SEQ ID NO: 4162 - protein, 227 aa, Acinetobacter baumannii
PGALQTLGPCGVSSGWGFSSQRFTGISGTSGHCSTHLLRSVSLGTHGALYELPINRGLKLTIVIKAQIRRLGAADVQDFREIRLSALKKAPEMFGSVYEHEEKKPMEAFAERLRDAVAFGAYIDGEIIGLSVFKQEDGPKDAHKAHLSGVFVEPEQRGRGVAGMLLRAVIDYGREHVEQIMLTVAEGNEAAINLYEKHGFKTYGVEPRAMKNGSEYRDEILMALILR

SEQ ID NO: 4163 - protein, 205 aa, Acinetobacter baumannii
LTYSVKGNRFHPDTFAFGGILQGQRIGYVRVSSFDQNPERQLEGVQVARVFTDKASGKDTQRPELERLLAFVREGDTVVVHSMDRLARNLDDLRRIVQGLTQRGVRMEFVKEGLKFTGEDSPMANLMLSVMGAFAEFERALIRERQREGIVLAKQRGAYRGRKKSLNSEQIAELKRRVAAGDQKTLVARDFGISRETLYQYLRED

SEQ ID NO: 4164 - protein, 112 aa, Acinetobacter baumannii
SCKSMLNNQRSLARCSQCLMMLSHHKKLSLWMGDVMNFNIEQIKPDTKYLLVKYDSTRFVSSHQQESFHKALRTLADKTGLNVAAIDKSIAIEQLSDEDLANVGLMRINNNA

SEQ ID NO: 4165 - protein, 157 aa, Acinetobacter baumannii
KSRSMEFVVEPWHWFVLGILLILSELILPAFAALWFGIAAIMVCFLYWLFPDISLTTQIVLWIVLSVLCTLLWFKFIKPLSIDKTKAGLPREATIGQIGMVIQTGLAHDQIIVRFPMPILGADEWNCRSTTPVKVGDRVRVIDISGNDLIVQPHSTS

SEQ ID NO: 4166 - protein, 62 aa, Acinetobacter baumannii
KFRSKRISIYFLVYRTFTLTSCCNESYTTLLSYRMIKSLFHYSFLDFRLISNLNEYFFASLI

SEQ ID NO: 4167 - protein, 951 aa, Acinetobacter baumannii
EMGPQMQEVADALRLDTELSADSAAYIEELYEQYLTSPTSVAEDWRQYFDKYPKGDQPHSAVREQFLLLGRNANRVQPVVQSTVSTEHERRQIGVLQLIAAYRNRGHQKAKLDPLGLAKREDIPDLDLSAHGLTKSDLDTVFNTGNLEIGKSEATLAEMIEAMEAIYCGSIGVEYMHIVDTKEKRWIQQRLESARGKFNFSNEQKKGFLERLTAAEGLEKYLGNKYVGAKRFGVEGGESFIPMVNEIIQRAGAVGCKEVVIGMPHRGRLNLLVNIMGKNPADLFGEFEGKALHKKGSGDVKYHQGFSSNVMTPGGEVHLALAFNPSHLEIVGPVVEGSVRARQVRRRDIGGDDVLPVIVHGDAAFAGQGVNMETFQMSQTRGYTVGGTVHIIVNNQVGFTTSDPRDARSTEYCTDVAKMIQAPIFHVNGDDPEAVIFATQLAHDFRHEFRKDVVIDLFCYRRRGHNEADEPSGTQPLMYQVIAKKATTRTLYADQLVQEKVLDRAEADQMVEDYRADLEAGNHVANALILEPNTKMFVDWTPYLGHEYTDDWDTSFDINRLKELGEGMSKLPEGFVMQRQVQKVIEDRVKMQTGETPLNWGAAETLAYATLLDEDYLVRITGEDVGRGTFSHRHAKLHNQVDGSTYIPLCHVKENQPRFAIYDSLLSEEAVLAFEYGYATTIPKSLIIWEAQFGDFVNCAQVVIDQFIASGETKWERVCGLTMLLPHGFEGQGPEHSSARLERFLQLCAEDNMQVITPTTPAQIFHALRRQAVRPIRKPLIVMSPKSLLRHKLATSTLEELAHGSFQTVIDEIDQINKSDVTRLVLCGGKVYYDLLEKRREQNLTNVAIVRIEQLYPYPEQRLAEILAAYPNVKELVWAQEEPKNQGAWLFIAPRLYDDILKSGKQIRISFAGREASAAPACGSPYLHAKQQAQLINDALAIEAEQSGDSQ

SEQ ID NO: 4168 - protein, 417 aa, Acinetobacter baumannii
VYMFRQQNLYLLLFSLYWAQGLPVGFMTHALPVILRAEGVSLAHIGGFGLLMLPWSIKIFWAPWVDRHAISHLGHYRSWILPAQFLTVGVLCILSFFPIQVLDQPLYLFIFFITLLFMNLTGATQDIATDALAVNLLQHDQQHWGNTFQVVGSRLGFIVGGGAVLWCLDWLSWQPTFLLLAALVFINTLPILLFKEPSHTSHSPHQYSQPSLVTKIKAYLGYFSQNKELRSWLIVLITFKVADGLAGPLLKPLMVDMGLSFTQIGIYITMLGAVAALLGALIAGWMLKHISRSTALMTFSILKIMSLGGYAYLAYAYEQKVKINVWLIYAVNALEDAFAAMLLVVMLTLVMHYSRKNYAGTDFTFQVSVMATVSGGLYSFSGVIADALGYFHYLIAIVSIAVLFLIPIYLWKVAKTV

SEQ ID NO: 4169 - protein, 118 aa, Acinetobacter baumannii
KTMLLSNLESVPGHQILKQLDVVYGSTVRSKHVGRDLMASLKNIVGGELTGYTELLEESRQEAMQRMIVKAQQLGANAIVGIRFSTSNIAQGASELFVYGTAVVVQPQAPHLPDPFNA

SEQ ID NO: 4170 - protein, 153 aa, Acinetobacter baumannii
WKNPHRRFTMDQDYHRILEVITRFQLVFDQKNWDAFDELLADQLEVDYLQFRGEPLCVVSCHEYKGSRQQALSHLRLQHNLSNPLIRIEQDQAWLECNYQIYRFSENDYFHSFGRYYFTLAKQQGIWKITGICQHLTKNIGNPRIHFSAMGQC

SEQ ID NO: 4171 - protein, 82 aa, Acinetobacter baumannii
RLDPFTFFHYEVVLVSSTDFELDDNYGDDDDVGFDESSGKISAKESLEKRRLIDDLLAQRRLERELKDFDYDLDDDDLDDED

SEQ ID NO: 4172 - protein, 277 aa, Acinetobacter baumannii
TYALYSGRSEFTGINMQLYDKKIIFILPMLAAMVAVSGCQPKSTAKDEQPASSASVKEQKQAEVPVIQAKVVPVKLPKPKVCLEDGCTEYDFQTVQTNQKWINDYFTNRIKKADPNAFANLADKPVEVPEGEPSSSQSAIYVRYLGQNYNLATFAFQTYSYSAGAAHGMSHQEFVNFDLLNKKHITVEELIKPDVEKQLVDALFDANTNWLQEHNISREKLQLSDNFYYGANGIVFVYPIYELASYAEGMSELTLPYFEAAKYIKPEYLPSVPNYNL

SEQ ID NO: 4173 - protein, 193 aa, Acinetobacter baumannii
CLKPSINAWNTNSGKKLNFSLSTQSGAFFMPKGALLMANVKTQGTQLFTVIDGQVVRFVCIKKIGFGQDSFSKLDVTCLEAESREYERGMRDPGEGAFGIDYNDTNTSHDKLAEIADSGEKLDWYVGSGDSKTPPTYDATTGIDLPDDRTWLTFKGYLNDAAPNDIEVDAVWGYEYTLVRTSKVTRTKRAVTP

SEQ ID NO: 4174 - protein, 310 aa, Acinetobacter baumannii
LIRPSTKKREIMRWRDRRVSTNVEDRRGGGGVRAGGISIIGWVVAFVAWKFFGVDPQQAYQATQQVTASQQSNATAPESLTAEQKEASDFVGTVLADTEDTWTPIFKQLGKTYTPPTLVLFSGIAQSGCGTAQSAMGPFYCPADQKVYIDTEFFKDMREQMGISGEQNQTELSRQDQAGDFAQAYVVAHEVGHHVQTLLGISSQVQQARAQVSQREGNQLSVRQELQADCLAGIWANHNQQRTQFLEQGDVEEAMDAAQKIGDDYLQKRATGQVVPDSFTHGSSEQRMHWFQVGLKTGDINQCDTFNNSI

SEQ ID NO: 4175 - protein, 404 aa, Acinetobacter baumannii
LSLTSSGAHNMAKPYYEFFCPVKVIAGNAALEHIPFELATLGAKRPLIITDKGVRANGLLNPIEAAFSTTDAVIGHVFDDVPPDSSLEVVRLAAEAYRTNKCDAIIAVGGGSVIDTSKATNILVSEGGDDLLQYSGAHNLPKPLKPFFVIPTTSGTGSEVTMVAVVSDTQKNVKLAFASYYLMPHAAILDPRMTLTLPPHLTAMTGMDALTHCVEAYTCMAANPLSDAYASAGIKKISENLFNVLENPNDSQGRLELAQASTMAGIAFSNSMVGLVHSLGHALGAVAHLPHGLCMNLFLPYVLEYNKQVNGQKIGELLLPLAGADIYAQTPATQRADRAIATILAMRDRLFSLTKLPRTLRETGKVTEAQLDEVAEKALNDGSIIYNPKEASLKDLREILQKAW

SEQ ID NO: 4176 - protein, 572 aa, Acinetobacter baumannii
MAATYPNVDAANRWAKAVIAGKIPACKWVKLACQRHLDDLKKSKKRDFPYKFEPRLAEKKILFVELLPHTKGEWALKRLKISLEDWQKFGLAVTFGWVRKKDGYRRFRESYWEIPRKNGKSAIAAGVALNMFCNDGEFGSEVYSGATTEKQAWEVFKPARLMASRSPDLLEATGIVVNAASLEVPTDGSIFEPLIGDPPDGQSPHCAIVDEYHEHIDSRLYDTMQTGMGARRQPLIFTITTAGFNIEGPCYDLRERVIQMLSGVIEDDELFGWIWTIDEDDDWTNPKVLQKANPNYDVSVYGDYLESQQKKAVQHPSRQNTFKTKHLNVWVSARTAFFNIEKWKACENKDLDIEQFKAVPCLISADLASKIDLAAAVNLFYRRESDGKIHYYCVAPKFYIPEDTIFNGEEKQVIKLYQKWHNMGLIDAHDTAENDLNKIADDITDMAQHVALTEVPLDEWGGFQIVSKIEEKGYTAVKIPKTTKSFSPAMRELEAAIAAKRFHHDGNPILTWMISNVVAKPDANDNVFPRKPNNSKKIDGAIALLMGINRAMFLAGEADPNDFYDDPIMVGV

SEQ ID NO: 4177 - protein, 162 aa, Acinetobacter baumannii
FMATQIHGLEPALRRMRAIGSDKTVKRIARKAMRQAMNIARDAARQKVKRLDDPTTPEKIWKEIVVQNGRSRNKNTLVMRVGVRGGARIPYTNNAQNRRAGRVGQTYQADGRVFYWRFLELGTSKQPATPFLRPALYENIEQVTDKFVQVFNFELSVVLGAA

SEQ ID NO: 4178 - protein, 251 aa, Acinetobacter baumannii
SNSTSTTYILIGSIKMSRGTRTFEIYRYDPDKDKAPYMQTFKLELTDKHRMLLDALLALKVQDETLTFRRSCREGICGSDGVNINGKNGLACLQNLNDLPEKIVIRPLPGLPVVKDLVVDMNQFYDQYDKIQPFLINNQPAPPKERLQSPEEREHLNGLYECILCACCSTSCPSFWWNPDKFLGPSALLNAYRFIIDSRDTATAERLARLDDPFSLFRCKGIMNCVSVCPKGLNPTKAIGHIRNMLLDQAG

SEQ ID NO: 4179 - protein, 225 aa, Acinetobacter baumannii
VPCTGKCLMSLDKPTLIIRQWNDLQDYQSKFESMKNLTNQRDENTADELWLLQHHEVLTQGQAGKPEHILIPSNIPVVQTDRGGQVTWHGPGQLVAYFMFDLNRLKWNVRTLVSFAEQFMIDVLKKYNIEAYAKPDAPGVYVDGRKIGSLGFKIRRGRSYHGLALNLDCALTGFQTINPCGYAGLEMVRIQDLVTPYPSFKQLCQDFIEYIKATGYFNDPEVKIE

SEQ ID NO: 4180 - protein, 180 aa, Acinetobacter baumannii
GLITMPRIVSIIPPESKGTATLSTGTKVLLDNGEYLQHVNKITLVAEPGQPWKAIIEVHPTNQEQIDALLTDLEVVKRNEAFNRLQEIQEEMQHLQDEKLFLEHKYLSGVTGVSIDGVKDVPKEGTWLLKEDEKILSLPNIIDAKQLLKNFSLHGSCCATPDLKGNDKCPDPAENSDAQT

SEQ ID NO: 4181 - protein, 453 aa, Acinetobacter baumannii
RPLTNESSTLQRGLKNRHIQLIAMGGAIGTGLFLGSAQVIQSAGPSIILGYAIGGLIAFLIMRHLGEMIVEEPVAGSFSHFAYKYWGKFPGFLAGWNYWMLYVLVAMSELTAVAKYINYWWPHIPAWTSVLFFFVVITAINLTNVKFYGESEFWLAIIKVAAVISMIVFGLYLLFTADVGSSISFSNLWSHGGFFPNGFSGLFYMLAFLMFAFGGIELIGMAAAEAKDPKKTIPKAINQVVFRILIFYIGSLAILLSLVPWNQLDLGGLDKSPFVMIFSQMGIGWAAHLLNFIILTAALSVYNSGMFANSRMLYGLAQQGNAPKIFKKVNKQGVPVPAVLLSALLIFGCVLLNYFVPEDALSHLMYIVVGALVLNWAMISMTHLKFKSAMKKLGQKTHFPALWAPFSNYLVLGFIAVVLYIMWSQGFKESVMMIPIWIILMFILFKVLNAKEQ

SEQ ID NO: 4182 - protein, 961 aa, Acinetobacter baumannii
ATMTDAQTAQNIATTYDPTEIEKKWYKTWEEQGYFKPSGHGESFCIMIPPPNVTGSLHMGHGFNNAIMDALTRYNRMMGKNTLWQPGTDHAGIATQMVVERQLGLQDITRHDLGREKFIEKVWEWKEQSGGTITKQIRRLGSSVDWSRERFTMDEGLSNAVKEVFVRLHEDGLIYRGKRLVNWDPKLQTALSDLEVESKEEKGSLWHFKYFFEDKSVKTQDGKDYLVVATTRPETLLGDTAVAVHPEDERYAHLVGKNIVLPITGRLIPIVADDYVEKDFGTGCVKITPAHDFNDYELGKRNSLPIINIFNKNAEVLGEFEYIAKAGEQISKTITAPADYAGLERFEARKKLVAQAEAEGWLDQIQPYDLKAPRGDRSGVIIEPLLTDQWYVKIAPLAEPAIEAVQDGRIKFVPEQYSNMYMAWMRDIQDWCISRQLWWGHRIPAWYDADGNIYVGRSEEEVRAKNNIAADVELKQDEDVLDTWFSSALWTFSTLGWPEQTPELKTFHPTDVLVTGFDIIFFWVARMIMMTMHFMKNEDGSSQIPFKTVYVHGLVRDGEGQKMSKSKGNVLDPLDLIDGIDLESLVAKRTTGLMNPKDAAKIEKSTRKEFPEGINAYGTDAVRFTFCALANTGRDIKFDLKRVEGYRNFCNKIWNATRFVLMNVEGQTVGQQARPDLWELPEQWIISRLQKAEAAVHQAFATYRLDLAAQAIYDFIWNEYCDWYVELTKPVLNDAEVSEERKAEVRRVLLAVMEASLRLAHPLMPYLTEEIWQTLAPMLGQGGPTIMTAQYPIPEQAKINEQAEADMQWLQGLIGAVRNIRGEMGLGNARLLPVLLQNTSDAEREQIIRIEALFKALAKVESIEFLNQDQEPPLSCSSVVSHASVFVPMKGLIDPKAELARLQKDLDKIQKQHDQIANKLANEGFVSKAPAAVVEGEKAKLAEFAAQLEKVKANMEQIAAL

SEQ ID NO: 4183 - protein, 146 aa, Acinetobacter baumannii
NLSAFPCRPVGVRLATLPDAKAESVRKALTEALKYLPAELRKTLTYDRGREMSEHKILEEDLGIDVYFCDPHSPWQKGTCENMNGLIRQYLPKGIDLNQADQHYLNQVAMSLNTRPRKALDWLTPLEKFAQLVDYHMAFETVAPHV

SEQ ID NO: 4184 - protein, 73 aa, Acinetobacter baumannii
AHAASNSAKRTFATSGSGPESPSESSSPSDSSSSSSSSSLTSFVDFVDDSSSSSSSSTSSKTSGISSSVSGSK

SEQ ID NO: 4185 - protein, 117 aa, Acinetobacter baumannii
LMQAGKLKHRITIQRPINTQDPVTGKLIQTWENFKSIFAEVTDLSTRDVIAAKAANSSIQARAKVRYSTTTKQINSTMRVLFGGYYYRIDGNPMRDPDSRREYLTINLSTGEKAWNG

SEQ ID NO: 4186 - protein, 91 aa, Acinetobacter baumannii
KYKAIDLIMVSMCALRDSNPRRSLRRQLLYPVKLRAHNFLIINKKAIAEAMTFYSFKYKLLDYCSLALSTLNKINMRMIQIGIIITDSLKP

SEQ ID NO: 4187 - protein, 424 aa, Acinetobacter baumannii
MSEATGKKAVLHLDGKEIELPIYSGTLGPDVIDVKDVLASGHFTFDPGFMATASCESKITFIDGDKGILLHRGYPIDQLATQADYLETCYLLLNGELPTAEQKVEFDAKVRAHTMVHDQVSRFFNGFRRDAHPMAIMVGVVGALSAFYHNNLDIEDINHREITAIRLIAKIPTLAAWSYKYTVGQPFIYPRNDLNYAENFLHMMFATPADRDYKVNPVLARAMDRIFTLHADHEQNASTSTVRLAGSTGANPYACISAGISALWGPAHGGANEAVLKMLDEIGSVENVAEFMEKVKRKEVKLMGFGHRVYKNFDPRAKVMKQTCDEVLEALGINDPQLALAMELERIALNDPYFVERKLYPNVDFYSGIILKAIGIPTEMFTVIFALARTVGWISHWLEMHSGPYKIGRPRQLYTGEVQRDIKR

SEQ ID NO: 4188 - protein, 131 aa, Acinetobacter baumannii
WLSALTEAQVSALMTTRTFKTIDGRKLEFTVTQEQSSCAHDSIIPHPNRFYDEHKHTYQCAKCGWLFSHDQLLLLKFGGKDKVNDATNTKAMDDVYCWELKKWFNHKYWVAKMKDTHTGVTLRELVIAAKL

SEQ ID NO: 4189 - protein, 702 aa, Acinetobacter baumannii
FNSACITSNTVDIILPMHINFSEHFFKIQKQLENPQAVIDENILIDLVNALRPSDPQDTDEIEQKIQAFIDSLLLTPTAPALLQTFLLRLINQYKQVSLYADSGILSLDGFWNQLGQRLGGHFLPLIEDASQLKILIGKIFYLESDSIWLNNVDDKNWATLFGLIGQSNSNVDEKHAIQREMIKAITVLSYRISGIGLYPEFINAQPELTEYESPFLVQNREIIEFIEKYKKQDISSNDIAVLPPPDASQAFVMLEQCRDVVLKIRRATKRIGVSLSLTYLLSLLEQCLDRIELLLYLVVDDSEGRYVSLGNLISDLTKAHYSEKSVRSLLSTTSELIAFQVTENASRTGEHYVSTDTKGFWGMYKAAAGAGVIIACMASLKILAARMTMAPLMQAFTFSMNYSLGFILIHVLHFTVATKQPAMTAAALAATVQQRKGSKTAQIAELAALIINIIRTQFIAILGNISIAIPTAALITFAWQFYLDEPLLTHTKATYLLHSLNPFTSLAVPHAAIAGVCLFLSGLIAGYFDNMAVYRKVGPRLKAHRRLRNLFGQERLNRFAEYIERNLGALAGNFLFGVMLGSMGTIGFILGLPLDIRHIAFASANFIQGLMTINGSPDIGLIIVSFLGVLCIGLTNLFVSFTLTIIVALRARRVRFEQWKPLAKLVMTHFLTRPSDFFWPPKQPLELEENAQANSGKKAEH

SEQ ID NO: 4190 - protein, 308 aa, Acinetobacter baumannii
FYEATVSSLSQVNADVLKQAQQRIQQDLLTTLAAFSIPEPLKSAVHHAVMLGGKRVRPALCYATASLQDNPNFAAARRAAVAVELIHCYSLAHDDLPCMDNDLLRRGQPTCHVAFGEDTALLAGDILQSMAFEVLGSRLFDEQGQGTDAAIVLKQIQILATASSKMVCGQVLDLQAEAKQISQDELENIHRNKTGALIQAAIMMGAVTIFSGTDQAIPKLRQYGQAIGLAFQVQDDILDITSSTETLGKTAGKDEQVQKSTYPALMGLEQAQIYAKELHDQAFEALAHFGENAKELVEISQFLLARTN

SEQ ID NO: 4191 - protein, 488 aa, Acinetobacter baumannii
SNPLSWFMEIKMSQQFDLVVIGGGPGGYEAAIRAAQLGFKVACIEKRIHNGKPSLGGTCLNVGCIPSKALLDSSHRYEDTVHHLADHGITTGEVNFDLAKLLARKDKIVDQLTGGIDQLLKGNGIEWLKGTGKLLAGKKVEFVPHEGETQILEPKYVILASGSVPVNIPVAPVDQDIIVDSTGALNFPEVPKRLGVIGAGVIGLELGSVWRRLGAEVVVFEAMDAFLPMADKALSKEYQKILTKQGLDIRIGAKVSGTEVNGREVTVKYTQAGEDKEQTFDKLIVCVGRKAYAEGLLAEDSGIKLTERGLVEVNDHCATSVEGVYAIGDLVRGPMLAHKAMEEGVMAVERIHGHAAQVNYDTIISVIYTHPEAAWVGLTEEQAKEKGHEVKTGQFGFAVNGRALAAGEGAGFVKFVADAKTDRLLGMHVIGPAASDIVHQGMIALEFVSSVEDLQLMTFGHPTFSEVVHEAALAVDGRAIHAIQRKRK

SEQ ID NO: 4192 - protein, 203 aa, Acinetobacter baumannii
YLKYIIKWNLIKHRFSSMSNSNIAVVYFSGYGHTKVVAETFANEINAQLIQIDQEGNITEQDWETLNNAKGIVFGAPTYMGTAPWQFKKFADATSKVWFTRGWQDKVFAGFTNSASLNGDKQVTLIQLQTLASQHGGIWVSLGLLPANTKDATREDVNNLGGSVGLLVQSPSDASVDEVPTGDLETAKVYAKRVQAIVNKIYG

SEQ ID NO: 4193 - protein, 302 aa, Acinetobacter baumannii
VFTHNKYNMTFTQLEIFALIAELKSFTATAEKLGISQSAVSHALKSLEQQWGINLISRTQSDIELTTTGQQLLTHVKELLSISDTLEKEVAAIHGLNEGTLRIGSFGASSSIYLLPEILETFRQRYPKIEIYIDEGEDKEVAQWLLERRIEVGFLIMPDERFDTFPLIEDRFVALIPSGYPLAQQLYIDPAHLENCPFIMTMAGSRHQVELILKNFNVKPDIKFYVSQILSIVSMVHNQLGISIVSDMVLTKELLSLYPNVVKRPFKPNLKRSIGLAVKNKKHISPAVKAFIEVAQEVWSDH

SEQ ID NO: 4194 - protein, 388 aa, Acinetobacter baumannii
MNLHEYQAKALLKEYGMPVQEGILATNADEAVAAFEQLGGKFAVMKAQVHAGGRGKAGGVKVAKSKEDVIEFANNIIGTRLVTYQTDANGQPVNSIIVAEDVYPVERELYLGAVVDRSSRRITFMASTEGGVEIEKVAEETPEKIIKVEVDPLVGLQPFQAREVAFALGLKDKQIGQFVKIMTAAYQAFVENDFALFEINPLSVRENGEILCVDAKVGIDSNALYRLPKVAALRDKSQENERELKASEFDLNYVALEGNIGCMVNGAGLAMATMDIIKLYGGQPANFLDVGGGATKERVIEAFKIILADTSVQGVLINIFGGIVRCDMIAEAIIAAVQEVNVTVPVVVRLEGNNAELGAKLLDESGLKLISANGLSDAAEKVVAAVKA

SEQ ID NO: 4195 - protein, 68 aa, Acinetobacter baumannii
RRLHRDLMCHCKLVIQFLCHQDVIRLFCQLLQTFNRSPVLVNDYLTRNPNFLMCESDGVKICYKISEY

SEQ ID NO: 4196 - protein, 853 aa, Acinetobacter baumannii
HKKQPNLITSPLDPRICGDFFWRKFMAILTPEKFENLNRDIEDTGKAINIIGIITPRYGEPFKSLPLVSKEAENRGGYISAPTLTALQAIVPSYNYQLARDDSTGNEYRWNPAATPTPQWEPTGRNYLKDAVDYSNQFSALTKNATVFYPFSSTKRNNVNASSVSASHEAYLKPYILNITVNGADPNKYYRIQQISTPTNPTVPNRWVFEVLNRTNFDSSETVEKTIPVVFPIVKNMGIQTFNVVDGDVTIIVTVDTSKVPTSNFYSVASTDSSYTYIIDPSRYIFSAFKKSDAVSYVDSFSTLTKNSTVLFPFSTLKRNNVNESTVGSHDNILRNFILDVRVMNADPNKYYRLQQMSSPDQATNPNRWIFEELSRSNFDTTETKGKAITAVLPIVKNTGIKSFFVKDGDLGISVTVDTNKTPSNSFYSVASTDNSYTYIFDPSVYSYAAVTSSDINAVNARINAFSKPMQLKNLLNGLRNPIQDVNIIFAPADSITYGVGATDNGAGPNPPHGPATTETYVNIFRNYLGTAFCTSERFDDTILETGEAYFTSEGTSVLSAELANYTFKNSLTGKVFTLTEMQALIGVNPSSPTGTFLDIKSPSVAGAVTDMEFNFNGNAFTINYARLGNGSATESNIDVFVDDVLHSSFNVYTTSPAFDGSTTISGLPDGSKKIRIANRLSNSTIYARLVSITATRKVSVINEGISGTNSKQWLDNNWIPDKISTKANYVFMMIGTNDRHTTQKIGTFKNQYLQLIDRITAKNPKAQIIIMSPPAVTQNEDPNTTVYKFRIADLNYALSQIAELRGLSFISLFEATSKLKAKGENYLFDQIHPNDYGYGVIAEYIINQILSA

SEQ ID NO: 4197 - protein, 220 aa, Acinetobacter baumannii
  UNSURE (2): Identity of amino acid sequences at the above locations are unknown.
SXLQSNVNLYGSRHTDPMILIDQDYNRQKASMGLQARSETLGGMADLMGGLLGEQSAGYKAMFAMSKAFAVAQALINAPQTFSNVYTSVSAIPLIGPYIAPALAAAAVGVQLAQAAQIKQTSLTGMAHNGIDNVPREGTWLLDGGERVLNPNQNKDLTNYLNNQKDSGPQVVVYNNSKANVETNVGDDGKVYVTIDDVYNPNSKYSQAMQESFNISRNRG

SEQ ID NO: 4198 - protein, 486 aa, Acinetobacter baumannii
IVMQKVWSISGRSIAVSALALALAACQSMRGPEPVVKTDIPQSYAYNSASGTSIAEQGYKQFFADPRLLEVIDLALANNRDLRTATLNIERAQQQYQITQNNQLPTIGASGSAIRQVSQSRDPNNPYSTYQVGLGVTAYELDFWGRVRSLKDAALDSYLATQSARDSTQISLISQVAQAWLNYSFATANLRLAEQTLKAQLDSYNLNKKRFDVGIDSEVPLRQAQISVETARNDVANYKTQIAQAQNLLNLLVGQPVPQNLLPTQPVKRIAQQNVFTAGLPSDLLNNRPDVKAAEYNLSAAGANIGAAKARLFPTISLTGSAGYASTDLSDLFKSGGFVWSVGPSLDLPIFDWGTRRANVKISETDQKIALSDYEKSVQSAFREVNDALATRANIGERLTAQQRLVEATNRNYTLSNARFRAGIDSYLTVLDAQRSSYAAEQGLLLLQQANLNNQIELYKTLGGGLKANTSDTVVHQPSSAELKKQ

SEQ ID NO: 4199 - protein, 424 aa, Acinetobacter baumannii
ILSKRGGTMMSAKLWAPALTACALATSIALVGCSKGSDEKQQAAAAQKMPPAEVGVIVAQPQSVEQSVELSGRTSAYQISEVRPQTSGVILKRLFAEGSYVREGQALYELDSRTNRATLENAKASLLQQQANLASLRTKLNRYKQLVSSNAVSKQEYDDLLGQVNVAEAQVAAAKAQVTNANVDLGYSTIRSPISGQSGRSSVTAGALVTANQTDPLVTIQQLDPIYVDINQSSAELLRLRQQLSKGSLNNSNNTKVKLKLEDGSTYPIEGQLAFSDASVNQDTGTITLRAVFSNPNHLLLPGMYTTAQIVQGVVPNAYLIPQAAITRLPTGQAVAMLVNAKGVVESRPVETSGVQGQNWIVTNGLKAGDKVIVDGVAKVKEGQEVSAKPYQAQPANSQGAAPNAAKPAQSGKPQAEQKAASNA

SEQ ID NO: 4200 - protein, 158 aa, Acinetobacter baumannii
KLDKFMLCPLLKGYDFTPGNNLREQETEGGPPRQVPFFVGAWHTVNVSISLNNEDEKEYFWAFWRDKQYKPSNWLWKLALDNARLEECECRFVADSRPKEVERDGKILQLSFQLRIKPIHRDHENDRDIIEAWQNGGPAVIGTIEKVPNEWFSNATGV

SEQ ID NO: 4201 - protein, 338 aa, Acinetobacter baumannii
IMSNVDQRPIILTGDRPTGQLHLGHFVGSLRSRVGLQDSHHQHLLLADAQALTDNADNPDKVRRNILEVALDYLAVGIDPTKTTICVQSCLPALNELTMLYLNFVTVARLERNPTIKSEIQMRGFERDIPAGFLCYPVAQAADITAFKATVVPVGEDQIPMIEQTNEIVRRVNRQIGQDLLPECKALLSNMARLPGFDGKAKMSKSLGNTIVLNASDKDIKKAVNAMYTDPNHLRIEDPGQVEGNIVFTYLDAFDPNKEEVEELKAHYRRGGLGDGTVKKRLEGVLKELITPIRERREELAKDPDYIMDVLRQGTDKCRIITQQTLDEVKDGLGLFKF

SEQ ID NO: 4202 - protein, 112 aa, Acinetobacter baumannii
HYVLVIGIAHAQRCVVGHPLDIYRNIGASPQRRRLGKSGTARKVLQYTLHYQRKVQCQDAMRQQLLAFVDPFPIAKNITGCLLSIPMMHNVKLVKMTLLTQQVFKTMGRHTT

SEQ ID NO: 4203 - protein, 167 aa, Acinetobacter baumannii
RVDKMGGIASVPGRGRKPKPVETKRASGNVGKRPLNNNAPEFTEVTNIDVPSYMENLEFASMIWKSIVPELLKNKVLRITDMHNVEGFCLAYENWRKSQREVQCHGIVVEGAQGGPVKNPALTAANEAARQMTMFGALLGLDPASRNRITGIGQKKKGNAFAGVLEM

SEQ ID NO: 4204 - protein, 145 aa, Acinetobacter baumannii
KMDNLIFQLVIFLILFSIGWAFGRHIEQKHLNELLEKEQQFAHIRIDTNRFATSDQLGHFISSNVVISHDYFKYVLASIKNILGGRLTSYESIVERARREAIVRLKQQAQSVGANHIMGVRLSTTELGMQGGMVEVFAYGTAVKD

SEQ ID NO: 4205 - protein, 74 aa, Acinetobacter baumannii
AALKNHTYIFSQSFKNVYFWLFKWLINCAILFGKQKEAARRKVDANNKKNHVNQIRLAKKYSFRLDISLKSKKE

SEQ ID NO: 4206 - protein, 219 aa, Acinetobacter baumannii
DKTKDDLKLKNMEQHFPNLPSQVPQRGNALSRALFKKLFLAQGWTIEGEVPNFPKAVAIISPHTSNIDGWYGFLAIFGLGIQITVLGKDSLFKPPFKRVLDWAGVIPVKRDSANGLTEQVVATIQQYDKIWIGMAPEGTRKKAKKMKSGFYHIAAKANIPIVMFSFDYDRKTIHCLGYLTPSGNYDEDLAKIFERYEGKISPKNRNWLAEPLQNLVKKT

SEQ ID NO: 4207 - protein, 225 aa, Acinetobacter baumannii
NMTKILMIEDDFMIAESTITLLQYHQFEVEWVNNGLDGLAQLAKTKFDLILLDLGLPMMDGMQVLKQIRQRAATPVLIISARDQLQNRVDGLNLGADDYLIKPYEFDELLARIHALLRRTGVEAQLASQDQLLESGDLVLNVEQHIATFKGQRIDLSNREWAILIPLMTHPNKIFSKANLEDKLYDFDSDVTSNTIEVYVHHLRAKLGKDFIRTIRGLGYRLGQS

SEQ ID NO: 4208 - protein, 151 aa, Acinetobacter baumannii
RTAKRSYCSDNFIDLICGSHYRSLCMDYVLMKSATGLTGSGSRDWFIQRVSAVVLAAYTVVLFGWILCKGGFDYQQWAGFMMTLPMKIFSLLAILSLIAHAWIGMWQVFTDYVTTRQMGPSAKGLRLVLTTAVIIAVFVYAIWGIQIFWAN

SEQ ID NO: 4209 - protein, 127 aa, Acinetobacter baumannii
IQEKRMNGEQLHQLAIEAARNLPFSEQTYPFGPEYEVFKILEKIFMLTVEVSGVKMINVKCDPYKSQEYQELYPFIIPGYHMNKKHWISIKPHKNLTSDFLRDLIGDSYDLVVKKLPLKDQKRLNNQ

SEQ ID NO: 4210 - protein, 106 aa, Acinetobacter baumannii
LYGKVTEEELDEYEFWCELALGIGTTIEEAKQKISLKELSIWKAYRMRRGSLFLGRRIEQAIGNLAAVYIRSHSKNPEQIDALNFMPHEYKQELSLADYLEQLVDE

SEQ ID NO: 4211 - protein, 67 aa, Acinetobacter baumannii
VHHLQYSLNLPSSRDPHAYYGQCFRKRHPAALKFGGLEHFLNYLITLFFIKLNFLSFQDKKYSDELQ

SEQ ID NO: 4212 - protein, 99 aa, Acinetobacter baumannii
VKFDQTTSALSLTKQQKPSFLHNKNSFNLILVLFIDSEWNLKYSSKHNLQQEQAVFMLTLLKFIVLSETHRFAEIKNKELFMNIQMININCLFPCLMHF

SEQ ID NO: 4213 - protein, 60 aa, Acinetobacter baumannii
KEIDDSIALKLTMPYLVLISLRHQDHHRLNHNRNLLTHALNGAVPIDHQLIYVFPTILLH

SEQ ID NO: 4214 - protein, 103 aa, Acinetobacter baumannii
FMTEDVTRLTPYLEYWSSGMYLFKCPGCKYLHPFHVDSHPNGSKWNFNGDVNNPTFTPSLLVNDHHPASRCHLFLTNGKIQFLSDCHHELAGQTVDMVPIGDL

SEQ ID NO: 4215 - protein, 235 aa, Acinetobacter baumannii
KGDDMNMLRKTMCAITLSASVLAPVMSTTAFAAPVAAPEQQAIGNLVNQLSGLQRLTADFEQTTKANTKTVAQKKGLSAQHMNQTFKGSMKVERPGKFYWETVSPSKQTIVTSGKTVWIYDPDLQQAVRQSLDDQVADTPALLLSGNTNQIMKSYRVTQPDKSKLYFTLFPKKEDGAFQSLTISFGANKAPTLMVLQDSLGQTTYVRFKNVKVNASIPASTFNFTPPKGTDIIDQ

SEQ ID NO: 4216 - protein, 182 aa, Acinetobacter baumannii
TRGDTIMTKVNIKAFKKVTKIGAPVERTVKWVVEVTEDNIDFLTSQLKRELTLGEKAEVEGQVFIKKLAFNDLHEISKAYDWEINEDNIADSKLKSVSVKRMQAGHLLGSVCEDAKGTPFFSSVQDVLDSEIPFIESLYAVADEVNNFMGKSRKKNLTNTNSGVSLPSESEPPSKKPSKKSA

SEQ ID NO: 4217 - protein, 431 aa, Acinetobacter baumannii
VCFDKLRFLDSLNLFWCNLQTQICSKMEFSTFFEHAMQNVDLFFLLLGAVLVLAMHAGFAFLELGTVRHKNQVNALSKILTDFALSAIAYFFVGYYISYGQHFFHEGTVLSNDHGYNLMRCFFLLTFAAAIPAIISGGIAERAKMRSQAIATLALVALVYPFFEGMVWNGNYGLQKWLETTFGAAFHDFAGSVVVHAMGGWIALAAVILLGARSGRYKKDGRVSAHPPSSIPFLALGSWILIVGWFGFNVMSAQRVDAISGLVAINSLMAMVGGTITANAIGKNDPGFLHNGPLAGLVAICAGSDIVHPVSALVIGGAAGAMFVYLFTYTQNKLKVDDVLGVWPLHGVCGAFGGIAVGIFGQKWLGGLGGVSFISQLIGTALAIAIALAGGFIVYGILKATIGIRLSQEDEFRGADLSIHKISANSEEGMF

SEQ ID NO: 4218 - protein, 179 aa, Acinetobacter baumannii
MVLERYRSLVMIITDEMLAVLDQSSGPVGLLECIEVSHPNWPRVLRYIVNGSDPMDLTHEDGQTFTYSFAPLNITRSNEEENLDQKITAAIGDVGSEIPDLVDLVLKDSVRIPPILNYRAYVIGKYDLPCTYAKGLEVIVITRDWKGTSFEAQAPGLNDSGNGEIYSASTDPSLEGFYS

SEQ ID NO: 4219 - protein, 241 aa, Acinetobacter baumannii
LNLELNKILKRLFMGISAGGLAVPFNGTMENAIELVSGWKNRTINVVSLSERTDFDTRYDNCISLKIFNNVLIIYHADFLFSAMDDHSLWAKRFKESNLTEWVLFFAAYDSGGTYGYSFFQYGKFVRSVFQMVDDFKIEGRLSELEQKIINSPVFFEYFNEEDESEYLDLEGLKANDLLDANGDIQEWADCYKCYYFEDEYVAEHDLASRFLSEMVTEYVGCDFFYDTEYDQIYLEVIQDY

SEQ ID NO: 4220 - protein, 64 aa, Acinetobacter baumannii
MSREELIYCIEKFIDKNDISIKNTQRIEVLLDDLNSEEEIIESMFLILALYVLKVMSTCMVKMK

SEQ ID NO: 4221 - protein, 106 aa, Acinetobacter baumannii
PLIWGFLLPKFWRNKMSETQSAFGVGAATITQKVTATTGVGSFIGFIAKIDVIAWGGLVIAALGLAVQLYFAWARNRREKVEHKLRKAEYELRIQKLKGDCNVKQD

SEQ ID NO: 4222 - protein, 87 aa, Acinetobacter baumannii
LLICTFFHPKNCVFIKQNNLLISEDFYKFFYDLTLKKMILAQYSKNSREFKDIFYLTVTDQSPNISSKLCYHARFFTATDSTKSKQR

SEQ ID NO: 4223 - protein, 475 aa, Acinetobacter baumannii
ERSWVKILFEPSEDWATVWGNHNLKFRDFIKVHYSLKKRLIWGTSIFSVILGCILIFSAYKVALQEVDEILDTQMKYLAERTAEHPLKTVSSKFDFHKTYHEEDLFIDIWAYKDQAHLSHHLHLLVPPVEQAGFYSHKTAQGIVRTYVLPLKDYQIQVSQQERVREAFAWELAGSMFIPYLIILPFAIFALAAIIRRGLKPIDDFKNELKERDSEELTPIEVHDYPQELLPTIDEMNRLFERISKAQNEQKQFIADAAHELRTPVTALNLQTKILLSQFPEHESLQNLSKGLARIQHLVTQLLALAKQDVTLSMVEPTGYFQLNDVALNCVEQLVNLAMQKEIDLGFVRNEPIEMHSIEPTVHSIIFNLIDNAIKYTPHQGVINISVYTDQDHYACIQIEDSGAGIDPENYDKVLKRFYRVHHHLEVGSGLGLSIVDRATQRLGGTLTLDKSLELGGLSVLVKLPKVLHLHETRA

SEQ ID NO: 4224 - protein, 126 aa, Acinetobacter baumannii
MNECLKYNIFQQHCPARLFFEKIADKWVLLILNILEHETQHFNLLKKNIEGISPKVLSQKLKMLERDGFIERKIQDTSPIRVDYSLTPLGQNVAAMAYQLKEWAETNIEQVLAAQIIYDEKILDQA

SEQ ID NO: 4225 - protein, 361 aa, Acinetobacter baumannii
LKECWLPSSYNYCYTFFFFGWMSMSFDLKVSLQQRSEPSAQQKKLNRLIDKIEQQKVSLSTWQNAQAEIQQHIRQKLMPVYNDLHIVLFQQLEQLWNILHSHEFSKADIQQFDEKIAQLAQMLKRSKMLSAEQLELVKQIDTFYQQHAGESVKKNKKAQPIEFEYEENADKGSEFEEEFEKYAAEQQQAREQAKQQRQQQKREQAEQMAAQSLKTVYLKIAAMIHPDREQDETKKEEKTELFQQASQAYEKQDLFYLLKLQLQLEQNKGLGAKELSAEQLRFYKLALDAQSQQLESQITEILDSFQLAKNVKAEHVHISDVYKAVDADCAELKQQVKWEKERLKHMKKESGVEMLLGHGVL

SEQ ID NO: 4226 - protein, 353 aa, Acinetobacter baumannii
YQLLVSLFNALLIDTLTPLIYQYGVFLHMVIDFKQDILAPVATDFAAMDHLINEGISSKVGLVMSVSKHVVEAGGKRMRPIMCLLAARACGLDNMQNAQRLAAIIEMLHTATLVHDDVVDESGLRRGRPTANATWNNQTAVLVGDFLIARAFDLLVDLNNMTLLKDFSTGTCEIAEGEVLQLQSQHQPDTTEETYLKIIHGKTSRLFELATEGAAILAGQEAYREPLRLFAGHFGNAFQIIDDILDYTSDAETLGKNIGDDLMEGKPTLPLISALAHSIGEEHAIIRRSIATGGVDQLPKVIEIVQKSGALDYCQRRAQEETEAALQALSILPDTPYRQALINLTRLALHRIQ

SEQ ID NO: 4227 - protein, 413 aa, Acinetobacter baumannii
TSLLVLRYKNTIVRITVDMSFVPQIKIPATYMRGGTSKGVFFKLDDLPEKAQVAGQARDQLLLRVIGSPDPYGKQIDGMGGATSSTSKTVILAKSTQPDHDVDYLFGQVSIDQAFVDWSGNCGNLTAAVGSFAISNGLVDADRIPENGLCTVRIWQKNIQKTIIAHVPITNGQVQETGDFELDGVTFPAAEVQIEFLDPADDGEEGGDMFPTGNVVDQLDVPEIGSFQATFINAGIPTIFLNAEDLGYEGTELQDHINGDAAALARFEKIRAYGAVQMGLIKDISEAAARQHTPKIAFVSKPKNYTASSGKNVSENDVDLLVRALSMGKLHHAMMGTAAVAIGTAAAIPGTLVNLAAGGGEREAVRFGHPSGTLRVGAQAELTNGQWVVKKAIMSRSARVLMEGWVRVPGDSF

SEQ ID NO: 4228 - protein, 62 aa, Acinetobacter baumannii
FAVRSSYQLLSLLLCFYISKQADLFSHSLHLKSFYDQEIALYFYTSIVLTRVYFGNFNSCLQ

SEQ ID NO: 4229 - protein, 279 aa, Acinetobacter baumannii
WGKRNVLPRADFKSEKHGFSLPLALDRWNPAIKAADESDNTISIMDPIGYDWWTETGVTAKRISAALRSLNGADVVVNINSPGGDVFEGLTIYNLLREYEGHVTVRVLGLAASAASFIAMAADEIQIARAGFFMIHNAWTGVWGNRNDMRETADFLEQIDETIADIYSIRTGLSIDELKAQMDKESWINGKNSVEQGFADSYLDSDVVEESTTNSTKDRIAAHKIDLIMAKAGISRSERRDLMKDFKGTPSAAKEQTTPSASLDLSGLIKDMQDAARKF

SEQ ID NO: 4230 - protein, 230 aa, Acinetobacter baumannii
KGMRHMSYKVFLKISDSTYTQFASIREKLHAGVRESQSKVLGDVLSDLSCEIIEQVFSVLLKDEQDNSTMTQKQRYESEKVLQQILDTFRKYMPWSVSFFGNERLLPLVDYMTSLMKEREQDVYITYPITPQLVQQAQTLTEQIREGNMQSVEKAFQTLIQIVDLGVTSLVREPKKRLKFNLVVDKTLNGVINMTTHLGYKRLEKLGTQVDQTTATHYINHFLAFMHQAA

SEQ ID NO: 4231 - protein, 153 aa, Acinetobacter baumannii
QCQLSLELIQQTPVGVSTYRMPAVKSNRPVNLSMGQVLAVNLRSPVAIASILHRLSGVIVFLLVPVLLWILDKSLSSPEGFDYVKNVVFGNILVRFVVWVFVAGLIFHFIAGVKHLLADLGFAEELQSGRIAATISLILSVVAIIAAFVWIMF

SEQ ID NO: 4232 - protein, 236 aa, Acinetobacter baumannii
YCIRMTNQKLFFQINILFLFFCFIILLFVFPVGGKIDMYLIQPWIDSTGHFFNRDNWYLERLNHEIVKQIITAVYVIFFGLWLASFKLKKLKPYRWQYGYMFFVSMLGSSIVGLIKSQSAHACPWNMVHPNTLGSYIWDFSAKHGHCFPGGHASAGFILMTGYFVYRLEQPKRAYFYLFSGILLGFMMGWAQMMRGAHFLSHNLWTGWVVWAINILFYAICIHRFEFEKQVKQELT

SEQ ID NO: 4233 - protein, 117 aa, Acinetobacter baumannii
QMSRPCREFGCTNLVKSASQKGYCDDHAHKRSGWGKQQDRTGSTTERGYGHAWRKLRESILERDGYLCVHCRAVGRVSPATDVDHIKAKAFGGTDDPDNLQSLCGTCHKEKTAKESG

SEQ ID NO: 4234 - protein, 74 aa, Acinetobacter baumannii
SMRLPIVEAIIMLVIVLCFIFLGFQIWKEFTSQKIELNKDEWICSKSEVSVQNIMIGGKLMPQAINKCVEYKLR

SEQ ID NO: 4235 - protein, 308 aa, Acinetobacter baumannii
EMASGLLLLLDDIATILDDVALMSKMAAKKTAGVLGDDLALNAQQVTGVRADRELPIVWKVAKGSFVNKLILVPLALLISVIAPWLINPLLMLGGLFLCYEGVEKVLHTITHKKASTSEEAQKEFDSEELDLATFEKDKVKGAIRTDFILSAEIVVISLGTVATATLMTKVSVLSIIAVVMTIGVYGLVGMIVKIDDLGLYLTKQAASFKQTIGRGLLAFAPLLMKLLSIVGTIAMFLVGGGIINHTIPLLHHVTENTVDHVETIPAVGNIIGALTPTLINFAIGIVAGAIVLLVVSLIQKMWPKASS

SEQ ID NO: 4236 - protein, 431 aa, Acinetobacter baumannii
PRRRVFMGNFFLLQAFTVVFALSIATTIFNKRILGFPQAIGVPLVSAIFVFILQWGASLLNGNQFITINIHNIEEAVRHIDFYDFLINGVICFILTSSALKFKISDLRSYWKQISILATIALVICAVLFGSLLYGFQLLVGHHVPILVLLLLGAALGATDPIGIKGVLSSIRAPHHLIVKLEGESLFNDAMCIALFMTLLNVLQGEHFSLVATLEALLYEIVVAVGIGWAFGIGTLRLLRGKHEMESLILTTALLASGAYLVALFAHASAPIACVIGGLIVGNKWKEIREEREIREVNHFWHTVEGIINSFLFTLIGLELFILDLNFSLILGGIVAFFILHISRFAANFMSFAFFPTMRKTKSYNGSLTILSWGGVRGGISLALILAVANIRPLSLYSSILIEYTLFSVLLSGLVCGLGLPCGNECVLLQS

SEQ ID NO: 4237 - protein, 176 aa, Acinetobacter baumannii
HTMSALDLDQLSEYLDGDHNEYGLDFAATHGFLCAIAVGPQFDRWLDELFEGNQKKVPAEIIQQIKVWLESIRQDLANENGIEFPFEVEEADVESSLGDWSVGFVDAMFLNEEAWFAPEYEEQLVDLTLPIMVFSGIDEEDPQMESFRRNGQLMDELAEEIPDNLNELYLMYHTPN

SEQ ID NO: 4238 - protein, 630 aa, Acinetobacter baumannii
AKMSDMHSPTSQVAALISRGKEQGYLTYAEVNDHLPDSITESEQIEDIIQMLQDVGIPVHERAPESDDTMFGESADATDEVAEEEAAAVLASVENEPGRTTDPVRMYMREMGTVELLTREGEISIAKRIEEGIRDVLNSIAYWPNAVEVVLKEYNDFLTGERRLADILSGYLDPETDEDIPEVLEDVEELEEEDESSTKSTKEVKLDDDDEEEESEGDDDSEGDSGPDPEVAKVRFAELEAAWAQTKAVIEKHGRNSPEANEALESLATVFMMFKFTPRLFDIISEMIRGTHEQIRANEREIMRYAVRRGRMDRNQFRTSFPKQESNPAWLDEQIAKAPAEIKAHLEKVRPDVLAFQQKIADIEKELGLNVSEIKDISKRMAIGEAKARRAKKEMVEANLRLVISIAKKYTNRGLQFLDLIQEGNIGLMKAVDKFEYRRGYKFSTYATWWIRQAITRSIADQARTIRIPVHMIETINKINRVSRQLLQEMGREPTPEELGERLEMDEVKVRKVLKIAKEPISMETPIGDDEDSHLGDFIEDQNITSPIDAATSEGLKEATREVLENLTEREAKVLKMRFGIDMPTDHTLEEVGKQFDVTRERIRQIEAKALRKLRHPSRSEHLRSFLEND

SEQ ID NO: 4239 - protein, 405 aa, Acinetobacter baumannii
TIRRFSIMATEIKAPVFPESVADGTIATWHKKVGEPVSRDEVICDIETDKVVLEVVAPADGSLVAIIKGEGDTVLSDEVIAQFEAGAGAAAAAPAAVEQAVAQTQAGAAPVVERNEAVSDQAPAVRKALTESGIAASDVQGTGRGGRITKEDVANHQAKPAANVTPLSVAVGERIEKRVPMTRLRKRVAERLLAATQETAMLTTFNEVNMKPIMELRKQYKDAFEKRHGARLGFMSFFVKAATEALKRYPAVNASIDGDDIVYHGYYDIGVAVSSDRGLVVPVLRDTDRMSYAEVEAGIAAYAAKARDGKLSIEEMTGGTFTITNGGTFGSLLSTPILNQPQTGILGMHKIQERPMAVNGQVEILPMMYLALSYDHRMIDGKEAVGFLVAIKELLEEPAKLILDL

SEQ ID NO: 4240 - protein, 73 aa, Acinetobacter baumannii
KVRSLRVEDNKTLAEVALELIKQNTELVKQTNKLIEQNTIIMQINAEQSAQLSEVLAMFDDVEPPQKAKSLDG

SEQ ID NO: 4241 - protein, 759 aa, Acinetobacter baumannii
MAAGSLGRLTLDLVAKVGSFVEGMSQAERKAKEASDNIKKSFKSFGDQIQDAIGGTQIGSAIEGITGKLGALRGGVLVAGAALAGMAVGGTVLAAGALGQMAIELAKADAQLNQLSRRAVTSAENFQIVAGAASAFGVEQEKLSDILADTSEKLGEYTSTKGGGAKDFFEMLANNTKMSAKEIDEFAKKLSTMDTVDALGQITTKLDDMGATAAEKRFVLESLASDLGDLAPLFANNSELIKEYGDQLHEAGVVRTQESIDKSLVLNAQTQALGTQFQGFKNQLASQMTPVLSNLIQYFVDGAVKSGSFGTVLSAVGTVAKVVGIAIVGVASAVSVVIQSISGFASLIDHVGNVAARLDAATSIKEQINVLKTGFSEGKAIWVDTASGIDKTITSTINLVSNIKTGAMPALTGLSAAQLKVNQANLANSKSTITDTETAKENAKAKEEQAKAAAKAAKAQQDLNKMVGASALSGLRIKGAESIAGGQVRAYTASFAQLTQSALGKGLNRFTAFNDLYHKGTNSKHATGNAFDFTLDDAKKSGEAVTQLEQMAKRYGFVIRVLDEYKKKSARATGGHIHVSVLGYKGTADALKDANAELDIVQKANDEATKIQEERQKQQLAITAKYATPEQKLALDNAEAIKQIKLAYANDPVAAEVFLNLQAKAYQKDLEEYRTAQNQKLISATETAAQAAEKWNSNFADMAGFSPLYGLQQEKSSRYEESFAVFDSQSAMLDQQEQEPNADLESIAEQRESLWQQAY

SEQ ID NO: 4242 - protein, 453 aa, Acinetobacter baumannii
SNYGGCMNKKPNRLARAAKAALRFLGLNGQFSLTPDVLQNLQSTASGKFVTVDSALQLSAVFACVRLVSETVSTLPLKLYKANPDGSSTLAKEHPLYNVLCSSPNYEMTQSRFLLFIVASIVLWGNSYTEIIRSANGRRIVSLDPLLPQNMQVIRNKVSGALEYFYTVDGVRRQINEKDIMHIRSFGIDGVMGIFTISKGRETFGTAMSAEQTAAKFFENGLQTSGFLSTDKTNTPEQRQQLKKNIESFMGSKNAGKVMVLENGYSYNGITMNPEAAQMLETRSFEIEEICRWFRVPPFMIGHLDKQSSWAASAEAQDLQFLKYSLRPLLVNIEQEISRCLIGRLESEVYFVSFNIEGLLRADSKTRSEYYASAADHGWMNRNEIRAKENLPPIPGGDIYTIQSALIPLDQVGTNYKKGMTDGVNEMYYLEPTLNQKSTGFHCPLRWIAGIQQ

SEQ ID NO: 4243 - protein, 171 aa, Acinetobacter baumannii
KVYGLFKESVLSSDHRMLSLTPCAGRCSTVFGDQVCRGCRRFNHEVIQWNTYTAEQRLAVWKRLDDQLDQILVPMLPQANLQHVEGFILGKRVRLMEGASKGRKLYHALKICEKNKHLAHESGLGISEAQVKEVWTEFERRILALAKASYELAWLRADGISHHLLNMFEEE

SEQ ID NO: 4244 - protein, 133 aa, Acinetobacter baumannii
TQRGFRCSLMIDIPIFKIAKADPAVRSLLESDNILRVWRFGKAPEQPETPYVTWQIITGEPNNNLDSRPDSDNAVIQIDVYATDEDVVEQVAESLQFAIELDCYIVRYGEVDNDPITNMPHYSFDVSWVVNRS

SEQ ID NO: 4245 - protein, 319 aa, Acinetobacter baumannii
VSQGSSQTSKPQQHSSKEMNSIVLSLFPLVALIASGYLFKKYHFFSDEFWAGAEKLNYYILFPALLFSTLSTAKIDLQSLSAAIIVMLIVVLAVTAFLYILRMFWQIAPARFGVHVQSMVRFNTYIGLALVTSLFKSEGMAILAILLALCIPLVNVISVLALTSKEHMAIKPVLIALLKNPLIASCVVGAAVNALHIPIWEGFTQFIKLFSVSSLPLGLLCVGAALQFLQIKKDIVVLAADTFARLLAVPALAYMVCMWFSLPSLQTQILVIFFALPTASASYILTKVLGGDSQLMAAVISFQTLCAAVTLPLVIWWLS

SEQ ID NO: 4246 - protein, 214 aa, Acinetobacter baumannii
ISKGVFMPYLLLCIGCVFLGLGVLGLFVPSLQSLDLLTVQTLSHHRLDYLNSITTFLARVGGMPFVCFLSFLVCIYLAWYKKYITVIFISLGVIGSITMGWLLKWCVNRPRPPEAYHIVESYGASFPSAHSVYASTLACLAMIMLCHKHNINSPYIVLISCLWFVCMGLSRIYAGVHFPTDVLAGWGIGFIWIALLWLWLLQTQSRLSRKQIYF

SEQ ID NO: 4247 - protein, 134 aa, Acinetobacter baumannii
AREGKPSLFWSSKRMKVKFLDVIQMGTHLYKSGEVGEFSSQTAEELIKKGLAVLDDGIETAGTTPDQKPKTGKGGKGSKGKNAEPPKNENGADGEENKGSGVEANDSTKETNGSEDKNKSDENTQTPSEDTKPE

SEQ ID NO: 4248 - protein, 303 aa, Acinetobacter baumannii
SVRGVSIMSVLINKDTKVLVQGFTGKNGTFHSAQALDYGTKVVGGVTPGKGGTTHLDLPVFNTMKEAVRETNADASVIYVPAPFVLDSIVEAVDSGVGLIVVITEGVPTIDMLKAKRYLETNGNGTRLVGPNCPGVITPGECKIGIMPGHIHQPGRIGIISRSGTLTYEAVAQTTKLGLGQSTCIGIGGDPIPGMNQIEALQLFQDDPDTDAIIMIGEIGGTAEEEAAEFIKSNVTKPVVGYIAGVTAPKGKRMGHAGAIISGGQGTAEEKFAAFEKAGMAYTRSPAELGSTMLQVLKEKGLA

SEQ ID NO: 4249 - protein, 409 aa, Acinetobacter baumannii
VKFMSERTNDQAAEQLKQVNATLKDLTEKVQPMAEKALKEAKDAGDLSTKTKEAVDQALTDLNLLRQTQNELQTQLGEAEQMFARIGKGGNNNNGVSDRAGDLVIKDESLINFTKDVRGGTRLNVNVPRNALISFAVNPVDGTTPIIAKPNQRLTIRDLLAPGRTGSNAIAYLRETGFTNNAALVPENTAKPYSEITFEEVMESVKTIAHMLKASKQILDDLPQLQSFINNRMLNGLKRAEDTQLLFGSGVGNNLNGIYTQATPYSAPITIANPTKVDIIRLAMLQAALADYYATGTVLHSKDWTEIQLLKDTTGAYLFTSPFGTMTPSLWGLPVAETNQAGLDGKFLTGAFAEGAQIFDREDANVVISTENQDDFEKNMISVRCEERLALAVYRPEAFVKGTFPVPAP

SEQ ID NO: 4250 - protein, 469 aa, Acinetobacter baumannii
STIMRITPLTNLSGTKPTAKLQKNLVLWHIIIIGLAYIQPLTLFDTFGLVSERSGGHVPTSYIFALVAILLTSISYGHMIKRYPSSGSAYTYAQKSIHPNVGFMVGWSSWLDYLLSPLVNIILADIYLRALFPEVNNWLWVIGLTALMTVINLFGARFVARFNSTIVVIQLGVIFYFVYQVYILLTQGVYADGTLNPDKAELWSLTPFWNDMTSISALIGGATVLCFSFTGFDALSSLAEETKDAEKTLPKAIFSTALLAGIIFIVSTYFIQLYFPSNPNIYFKPLDESQPVMVAAIGSIAFKTLVLYFAVVAVMASGISAHAGVSRLMYVMGRDGVINKKLFGHISPRLHTPTYNILIVGVVALSAGFLDLEHIVNLISFGALTAFSFVNFSVISRYALRDGKNKSIKDIINYIIVPTLGFASVFLMWLEIDKLALQIGLAWAVFGVGYLAYKTKGFKYNAPQHNEHE

SEQ ID NO: 4251 - protein, 77 aa, Acinetobacter baumannii
ILVIGGAFLFWSVSMADKSEVKKDLDFCSCELEKYQNLSRTGLSRDELITIDSIIVRLKGRIRNLRELKGEEPKSGR

SEQ ID NO: 4252 - protein, 289 aa, Acinetobacter baumannii
REVIFMPVGTIIVLAFLAFVAVTIFKGVRIVPQGYKWIVQRLGKYHSTLNPGLNFVIPYIDDVAYKVTTKDIVLDIPSQEVITRDNAVLLMNAVAYINLTTPEKAVYGIENYTWAIQNLVQTSLRSIVGEMDLDDALSSRDHIKAKLKAAISDDISDWGITLKTVEIQDIQPSSTMQAAMEAQAAAERQRRATVTKADGEKQAAILEADGRLEASRRDAEAQVVLAEASQKAIEMVTSAVGDKEIPVAYLLGEQYVKAMQEMAKSSNAKTVVLPADVLNTIRGIMGKHN

SEQ ID NO: 4253 - protein, 258 aa, Acinetobacter baumannii
TSCIFTKISMTKAIVMYAKISSVILFCILISGCATNPEKLQTPVELTCIFLKEPLSTTGLYGPLNVEWTTRLERGPYWSEKIDEKGTFFRGAPGSISIRSPDYPSIPGQPAATDGGFYLPKDPKEPVKIYRYFTTKAVPVEVPSDNVTCNTLAYTKEPASHKVSLVSFATAGTVGGVTGAIIGKNFSSGNMSYGQATGAGAAGGAIGGLIVAAIINAEVGKIIGGLPIKESSFMEKLRELGAKREPLKQISLLPPSSP

SEQ ID NO: 4254 - protein, 320 aa, Acinetobacter baumannii
ISILIHLEFSMNATVEQLAPVEQQATAGWVVAALYQFKEVQDPADLQQRLLDLVKTINLCGTLIVAGEGINGTVAGDREAIDTIHQFLLNEGFNAMEYKESHSSDKPFRKMKIKLKKEIVTLGVEVKPRDLVGHYLDPKEWNELIARDDVILIDTRNDYEYKAGTFKGAIDPKTETFREFPEYVKKELEQHKDKKIAMFCTGGIRCEKSTSLLLQEGFKEVYHLKGGILKYLEETPPDESLWEGECFVFDGRTAVTHGVEEGANIKCHACGWPLTPEESALPSYEHGVSCLYCIDKTTEKQKAGFRMRQSQIAAAKRKRL

SEQ ID NO: 4255 - protein, 319 aa, Acinetobacter baumannii
WAILIYLAIDCFSKMKIAQFASIGFISLALFGCDRFSKTPTPTTSVKAREPVIALALGGGGAKGFSHIGVIKVLESHGIKPKIVTGTSAGSFVGSIYASGQTPYQLQNLALKLQESDIRDLTLNRQGIILGQKLQDYVNRNVGNKPIEKFPIRFAAVATRLDNGQKADFIKGNAGQAVRASCSIPNVFVPATIGKQKYVDGGLVSPIPVKTARDMGADIVIAVDISARPAGNRPANMWGLLDQTINIMGQQSINEELKQANVVIQPKVGHLGTLDLKSSNEAILEGEKAAQGQIRQIETAIANFKKSPAAFKPAPRPKF

SEQ ID NO: 4256 - protein, 614 aa, Acinetobacter baumannii
EDIMGAINPKEDYSNIQNLTFDAVIVGGGGSGMRASYQLAQAGLKVAVLTKVFPTRSHTVAAQGGIGASLGNMQEDNWHFHFYDTVKGSDWLGDQDAIEFMCREAPKVVYELEHLGMPFDRNADGTIYQRPFGGHSANYGDKPVPRACAAADRTGHALLHTLYQSNVKMGTQFFVEWIALDLIRNEAGDVLGVTAIDQETGNIAVFQAKATLFATGGAGRVYRASTNAYINTGDGLGMAARAGIPLQDMEFWQFHPTGVAGAGVLLTEGCRGEGAILRNKDGEPFMERYAPTLKDLAPRDFVSRSMDQEIKEGRGCGPKGDYILLDMTHLGADTIMKRLPSVFEIGKKFANVDITKEPIPVVPTIHYQMGGIPTNMHGQVCLPEPGTDNYTKPVKGFYAIGECSCVSVHGANRLGTNSLLDLVVFGKAAGEHIIDYVTKHHGDEYAPLPTNVLEQTLARVRKLDESTSGENAQEVADAIRDIVQDHAGVFRTQALLDKGVKEILALEPRVRNIHLKDKSKVFNTARVEALEVENLYEVAKATLISAAARKECRGAHTVVDYELPADHPTYSYGRRDDEWMKHTLWYSSDNRLEYKPVRFKPLTVDPIPPAPRTF

SEQ ID NO: 4257 - protein, 160 aa, Acinetobacter baumannii
GNVMSVISINKAMAHLRVDEDIDNDIASKLESAERIAKEYLNRNFYLDKAALDLAKEEIPLILSEAKVQYDHDVDFARTLEGDLIDKFIHTASLNYDTAIRKAKMISLGIVVNEAIEIGVLLILGNLYENREDLTTANVYELPRGAEWHLHPFRTDLGVS

SEQ ID NO: 4258 - protein, 132 aa, Acinetobacter baumannii
FEVIMKTKMLCVGLAAALMFVGCSRDAQVASKNLSYAADNFQLDRRIVFYNGITGDYILTIEGKCSFDAVSEKKVDVTCKTGDSEFKKHSLGISDNVTYFSEQLTSKGVSTYHYKVAFKPQSIIPDIDLKVN

SEQ ID NO: 4259 - protein, 271 aa, Acinetobacter baumannii
EVKMAKLDTLQNKVVWITGASSGLGKALAGEFALQGAQVILTSRRFEELEEVRVGLLHPDQHLSVVADITNQEQVQEAYEQILKAKGRIDWLINNAGLSQRALIQDTTMATERAIMEVDYFSQVALTKTVLPTMLKQKSGRVVFVSSVAGLLGTQYRASYSAAKAAIHMWANSLRAEVADQGVEVSVIFPGFVKTNVSFNALNGAGQPQGHQDEAIENGLEADVFAEQSVKALMQGQEYIVVGGTKEKLGVMVSRMSPKLLYKMIRKTKVK

SEQ ID NO: 4260 - protein, 956 aa, Acinetobacter baumannii
SRRIVFLVGFDIMSQIYLYQNSLNKNEVDVIDTDNILFEFLKVKKQFPQAKIYLGNPCPENEITPSIKDKASIARLTEIADDCSIVCHPGELSSFVTWVATKILGSAVSALVKVPKPNMSNNGSMSGSSNNNLSDPENRQRLKQRIPFILGRVKAIPDLFAPVIKYFKDGVEVEESLMCICENPIQVSNFKSGDTPIQEIPGTSLSAYGHNQSLIGNETIFKWGDTFDQPPVIARQNASINGQTLLPPNSTRIEASDIYFQYPNLIKANDQGTADKFNAFDINDSLIISGANFGINDLAITGQVEVDNTNNTFSIASNQTVVDFQNYRKINVTSLLVTDPVRGQLDLAGLYDIDSIAYESGIYTIHLKNPVSTNSNFANLTEVLTANISANLTANSANIFLDGNYVVTGVDIANKQISLATPSAVNDDWNKLADLTDQKTSTGTIKLRGSQENYIGWFTIESAKATGLLLNFQALNGIYQGSDAKFVDIYVEYQQVLNGNPTGNVYNQTIRLNGKANNRDSVGGSMWITLPFTGAVRFRARRTNDNGDAVDLSDETKFYTAYAYHYLSKLVYDNRVLIRQRTQATRAATAIDSRMTNCIAESLVYSYRDGVKSDTRIPSRFIPDLVIELALHKLIGRRTLNEVNVEKLYSVFDEVVDYFGSEKMAEFNYTIDDANQSFEEILRMLAGVSCCNDRRLNRQIYFELERAGREPYLLFNHRNKKARTEVRTIRTKPENNYDGVEMTYVDSEAGWIEKTLKIPNDQITNPKKIEGYGIVYKQQAHIVAWRAWNKIQFQAINCRFSCFAEGELVGSGDPVAVVDDTRLAPTFFGDPSQAILSGEVLAWNGLNITGSQPCKLSTEHSFVIHLQLKSGYIDIIPVTQGQTDFDFILSRPPVEALVTEGEVKTVYSLSTDDRQDDDLFLITTKRRAGIFENELTLVNLDERYYQNDSDIKNNLI

SEQ ID NO: 4261 - protein, 434 aa, Acinetobacter baumannii
ESLMDLFLNRKSFVVKSLAITVTALMMSGANAATSDKEEIRKLRQEVEALKALVQEQRQVQQQQQQVQQQQQVQLAEVKAQPQPAAAPASPLASLKSKTGADVNLYGFVRGDANYIIEGADNDFADVSKSNGKTQDKLRATAKTTRLGLDFTAPVSGAKVGGKIELDFASSDNDKSENVRIRHAYLTYNNWLFGQTTSNFLSSHAPEMIDFSTNIGGGTTRIPQVRYNYKLAPATQLFVSAEEGNSSATGDSVKYRLPVLTAKVTQGYADGNGNASARAFVENYKSGAGDDKTGWGIAAGTDFKVSDPLKLFADASYVVGNSNYLYGSNSAYTLVNDNIEQNEFVAVQVGGTYKILPNLRSTLAYGAQFADDGTDYAKNNVTANEKVQQAWINFIYTPVKPIDLGVEYVNGKRDTFEGKSYKDNRVGLMAKYSF

SEQ ID NO: 4262 - protein, 425 aa, Acinetobacter baumannii
LIMIDPKLLRNNIEVVNAGLAKRGVQLDVQEWASLETRRKDLQSKTEKLQAERNAGAKQVGQIKKSGGDASEIMARMQAIGDEIKAAEVALSELQNEIEQKALSIPNLPDESVPAGKDENDNVEISKWGTPRQFDFEIKDHTDLGEWMGGLEFETATKLTGSRFSVLKGPLARLQRALTQFMLDTHTLKNGYTEAYVPYLVNADSLRGTGQLPKFEEDLFKLQGEKEYYLIPTAEVPVTNFVRDEIIDADRLPLKYAAHTPCFRSEAGSYGRDTRGLIRQHQFDKVEMVQIVKPETSMQALEELTAHAEGILQALGLPYRKILLCGGDMGFGATKTYDLEVWVPSQNTYREISSCSNMGDFQARRMKARYRMDQKKTELVHTLNGSGLAVGRTLLAVMENYQREDGSIEIPEVLRPYMGGATFID

SEQ ID NO: 4263 - protein, 552 aa, Acinetobacter baumannii
SLTMLNFFSTLRNKQISLFMFNLIIAIWLGAILNIGFYHQVHTLTPYFGVKAILFLAATLVILVATYYAVLQILNWKWTAKIFAILLIFIGGLSSYFVNTLGVIISPDQIQNMVQTDVSEVTDLISLRFVLWTIFFVILPIFLITQVKFKQEKVSRLLLKKVFSLVASFAVVGVLLFTYYVDFAAIFREHRDLKGMISPQNSISSLMSYYHKKAPKKNLPLVIYGQDAHQVQRVQKNLPKLMILVVGETARAESFSLNGYAKNTNPELSKQDIFNFSQVSSCGTATAVSVPCMFSGMPRVDYDEQLASHREGLLDIAKRAGYQVTWIDNNSGCKGACDRVEQYQIPENLKKKWCKDGECYDDILIDSLKQYLATIAKDDDRPRLIVLHQVGSHGPAYYKRAPEAYQPFKPTCDTNAIQGCSQTELLNSYDNTIVYTDHVLSQMINTLKEISKYQTGLWYLSDHGESTGEHGLYLHGSPYAIAPSQQTHVPMIMWFSESWKQHNLAQVNCLSQQTKQKLSQDNLFPSLLSLLDVKTQVINPQLDMLHSCAHVN

SEQ ID NO: 4264 - protein, 109 aa, Acinetobacter baumannii
TPAMMQAFHMMRLLMLDRTPSRELREDLWVFPMDYPIKLIGDAGEELRIAVVDILVKHFPDFDQTTLKVQESRTGKYHSLTAQLRFDELEQVHALYADLAACPQIRTAL

SEQ ID NO: 4265 - protein, 137 aa, Acinetobacter baumannii
FRGILLMNIRQLFYCVYDPENFHCVHFVILAAKVIFGKDYTPCFLGLTGPLQESIKTSRTTVHRNKHIKKPEDGCIVLMTYLDQSSHVGLFFQGRIFHLIERGPQRITVEQANSIFSRIRYYEPNLSLPELSQQERS

SEQ ID NO: 4266 - protein, 122 aa, Acinetobacter baumannii
MWVVVAAKFWREIIIGFLAFLLVICLAVLNHKTGQLKEADQKCQSQIQEIERKNLKALAEKQNQINKVSAEYEQAKAEQSTKVETITREVQKIVERPVYKSSCIDDDGVQQLNDLIKAGNTS

SEQ ID NO: 4267 - protein, 186 aa, Acinetobacter baumannii
KVTVMSNKTKLFVVCSTLAAAFGGLVIYGPSDQQVQATAIKEGYTAKPTIPVKGDRPTIGNGTTFYPDGRAVKMTDPAITRKQAFEYLKFTMNKDAKAFNKTLLNIPISQTEYDLYLDFSYQYGVPTFAKSSMLKHLKAGQYKAACDSLLKYKYVAKRDCSIRKNGCYGVWTRQLERHAKCMGANS

SEQ ID NO: 4268 - protein, 131 aa, Acinetobacter baumannii
IVYVEKTNGDNVRKAIFLISALFSVGLHANPVNCEDITKKIDEKTKSIAFEKVFEVERAKSVDGMMFVKSRKIPQYQNEISLFMQQSRDMGCPAYTGDITGAPYFKHAQKCIDSKLRDREACDKRNWENTP

SEQ ID NO: 4269 - protein, 157 aa, Acinetobacter baumannii
VIHVVLYEPEIPANTGNIIRLCANTGAQLHLVKPLGFELDDKKLKRAGLDYHEWARMQIWDNIELCLADLKAKGVEHIFPLTTKGSATPHTVDLNRPVALLMGPETRGLPEHVRLMFPQEQWIRLPMAENSRSLNLSNATAVIVYEAWRQQGFKKLG

SEQ ID NO: 4270 - protein, 92 aa, Acinetobacter baumannii
CVDLAFHAVMNAFYYNPNEETEGLKGFYQKLCHKMNRRGFQYIVGEDALGRETITIFNPDVIVDQKTEDGIATMHDPNKLQEVTRFESPDNF

SEQ ID NO: 4271 - protein, 107 aa, Acinetobacter baumannii
LEYVMYAVIQSGGKQHRVVEGETLKVELLKAESGATITFDDVLMVVNGDNIQIGAPVVAGAKVTAEVIGHGRHDKIRIIKMRRRKHYRKQQGHRQWFTELKITGISG

SEQ ID NO: 4272 - protein, 61 aa, Acinetobacter baumannii
SPVVERGSLRKIQVSSTGVCNFSGFVAHPEIKMQKRITLDIFAYMTIAFVIDIFVKIQLVY

SEQ ID NO: 4273 - protein, 91 aa, Acinetobacter baumannii
SRGVRDMATKKAGGSTKNGRDSNPKMLGVKVYGGQTVTAGNIIVRQRGTEFHAGANVGMGRDHTLFATADGVVKFEVKGQFGRRYVKVETV

SEQ ID NO: 4274 - protein, 460 aa, Acinetobacter baumannii
RFKVDIFPISLKLQQQRCLIVGGGHIALRKATLLAKAGAIIDVVAPAIEDQLLQLIKTTGGEPFIEAFAEKFLSTPYRLVIAATNDAEVNKTVFEQCEARNLLVNSVDDIPHCRFMVPAIIDRSPLIVSVASNGTSPVLSRQIRTQLETSIPHGMGKLAEFSGKWRNQVKEKISNPDERRIFWENLYASPLKEQVFNDNLDVADSMLEQALQEWKAPKGEVYLVGAGPGDPELITLKALRLMQQADVVIYDRLVSAPILELCRRDATKIYVGKARSNHSVPQEGINALLVDYAKKGKRVCRLKGGDPFIFGRGGEEIQELFQAGVPFQVVPGITAASGCSAYAGIPLTHRDYAQSVRFLTGHLKEGSPELPWNELVYENQTLVLYMGLVGLERICEQLIAHGQRPDMPVALISKGTTPEQKVVVGSLADIASKVTEHQIHAPTLTIIGEVVRLREQLQWN

SEQ ID NO: 4275 - protein, 77 aa, Acinetobacter baumannii
AKLFSTVFSRGFIMQQLMIMVTEVGKLEHTCNLLAEVNKGGKVIKVFDYNGNQLPISIDGTVTFNRRRWELPVKVDL

SEQ ID NO: 4276 - protein, 1058 aa, Acinetobacter baumannii
MAQFFIHRPIFAWVIALVIMLAGILTLTKMPIAQYPTIAPPTVTIAATYPGASAETVENTVTQIIEQQMNGLDGLRYISSNSAGNGQASIQLNFEQGVDPDIAQVQVQNKLQSATALLPEDVQRQGVTVTKSGASFLQVIAFYSPDNNLSDSDIKDYVNSSIKEPLSRVAGVGEVQVFGGSYAMRIWLDPAKLTSYQLTPSDIATALQAQNSQVAVGQLGGAPAVQGQVLNATVNAQSLLQTPEQFKNIFLKNTASGAEVRLKDVARVELGSDNYQFDSKFNGKPAAGLAIKIATGANALDTAEAVEQRLSELRKNYPTGLADKLAYDTTPFIRLSIESVVHTLIEAVILVFIVMFLFLQNWRATIIPTLAVPVVVLGTFAVINIFGFSINTLTMFAMVLAIGLLVDDAIVVVENVERVMSEDHTDPVTATSRSMQQISGALVGITSVLTAVFVPMAFFGGTTGVIYRQFSITLVTAMVLSLIVALTFTPALCATILKQHDPNKEPSNNIFARFFRSFNNGFDRMSHSYQNGVSRMLKGKIFSGVLYAVVVALLVFLFQKLPSSFLPEEDQGVVMTLVQLPPNATLDRTGKVIDTMTNFFMNEKDTVESIFTVSGFSFTGVGQNAGIGFVKLKDWSKRTTPETQIGSLIQRGMALNMIIKDASYVMPLQLPAMPELGVTAGFNLQLKDSSGQGHEKLIAARNTILGLASQDKRLVGVRPNGQEDTPQYQINVDQAQAGAMGVSIAEINNTMRIAWGGSYINDFVDRGRVKKVYVQGDAGSRMMPEDLNKWYVRNNKGEMVPFSAFATGEWTYGSPRLERYNGVSSVNIQGTPAPGVSSGDAMKAMEEIIGKLPSMGLQGFDYEWTGLSLEERESGAQAPFLYALSLLIVFLCLAALYESWSIPFSVLLVVPLGVIGAIVLTYLGMIIKGDPNLSNNIYFQVAIIAVIGLSAKNAILIVEFAKELQEKGEDLLDATLHAAKMRLRPIIMTTLAFGFGVLPLALSTGAGAGSQHSVGFGVLGGVLSATFLGIFFIPVFYVWIRSIFKYKPKTINTQEHKS

SEQ ID NO: 4277 - protein, 178 aa, Acinetobacter baumannii
QVISTKAVKPTLQLAYVKLMMDVVGRGLVMASQVDSEIQEEVSKFPVHFVLSMNVFPNGPAFFARVTEDKQLELLKRAEKKPDLTITFKHVTHAFLVFSFQESTAQAFANDRMIADGDVSAAIRLVRCLNKMESLILPKLVASLAVKEYPTELTLKEKFNQAANIYLKVAKSYFKRSA

SEQ ID NO: 4278 - protein, 61 aa, Acinetobacter baumannii
IVELLSRLAMRIFLEPSGNPLIVVDPSNAGDVVYTLKLECRTSSTKTSIFDSVALPFPSLA

SEQ ID NO: 4279 - protein, 87 aa, Acinetobacter baumannii
WPPSGGFLLPPTKVNKMTSKLIHAHDVDKGSDVYFDPIGVEGALIEWTGKKDYSQYIYSVKLYMRSGNIISCVVNEDGKKKILEHVH

SEQ ID NO: 4280 - protein, 313 aa, Acinetobacter baumannii
SRSSGIQIFALFHLAPLFIAKNLTIELSYLNDIVKNRQDISNFRQFSKMKKSAQRVQDFQEIPAHNAIPDLLWFRVRNAPAETVYPQHAHAWGEFIYAFSGVLEVNIDQINYLTPPPYGIWLPPYTKHSGINRNEVTHATLYVHESLCQKLPQESWYIINVPTCTCFTRSLEAKTHKMKPKFEYIRLLQVLLDQLIQAELVGSYLPTTDHPALAKILNDLHQCPADNSTLQELAERINMTERTLARYSQKELGMFLHEWRQRLKVMKAMTMLNQGKTIESIAFDLGYASASAFIYMFKRWMGFTPDQFRKLYQ

SEQ ID NO: 4281 - protein, 402 aa, Acinetobacter baumannii
LITSSPNQGRNTMQSGAIRPIPNMLPRHLFNEEHEAFRETVRKFYEKEVVPNIEKYEKQQHVDRDLWNKAGSLGLLCTTMPEQYGGSGVDRLYSMILIEEQAYAMDSSTGFSLHSDIVANYINNFGNEEQKQKWLPKMATGETVTAIAMTEPGTGSDLQAVRTTAVLDGDEYVINGSKIFITNGYLCDMAIVVCKTGNSDKGSANLSLIIVEADRAGFTKGKPLNKIGMKGQDTCELFFDNVRVPKENLLGMEGMGFIMLMKELAWERMLVAIICQAGAKAAFAHTVQYTKDRKAFGKPIGAFQNTRFKLAELRTEIDFCRTYLDRCMELQLDEKLSVEAAAAAKYKISDMFSKVVDECLQLHGGYGYMMEYPIARAYIDHRANRIYAGTNEIMKELISRTL

SEQ ID NO: 4282 - protein, 490 aa, Acinetobacter baumannii
IDLLGACMTVQTFIPNGAKAASENTVTQPTHTTDVSIKKLYIETQGCQMNEYDSHRMADLLGDSHGYVLTNNPNEADILLMNTCSIREKAQEKVFSELGRWRKLKEQNPDLVIGVGGCVASQEGDNIQKRAPYVDMIFGPQTLHRLPQMLDQHHAQVEKPKKEKIKLVDISFPDIEKFDFLPEPRVEGFKAFVSIMEGCSKYCSFCVVPYTRGEEVSRPLDDVLAEIAGLAEKGVREISLLGQNVNGYRGETFEGGICTFPELLRLVAEIPGIGRLRYTTSHPLEFSDELIQCYEDLPQMVSHLHLPVQSGSNDVLKAMKRNHTIDVYIDKIAKLRKIRPDMHLSSDFIIGFPGETDENFAETLQFIKDLDFDHSYSFVYSKRPGTPASDLPDTTPEHVKKERLAQVQQVIKQSSIEKTDAMLGKIERVLIEKVSDQDPNILVGTADNTRLVTFVGDASWVGRFAEIEITEIKTLNLVYGELLNLEPDVA

SEQ ID NO: 4283 - protein, 790 aa, Acinetobacter baumannii
TTMFLLKNLVSSISKVTQDLGNIVSITPVVNTGSSVNVNVSDINIANVSTTGLLSNVISTVTDTVSNTTTDLVSNVVGTVTGTVGSTNPIDTVTNIIGGVTGGVTGNPLEVVTDIIGGVTGGVVGGTSPISPVIDVVQGGIDILQGVESLKTEIINTGIETVADAVIGVLPQAEHPVSEIADLGTLTFETSRDTVNGALEVVSDLVGGDIQGATESATGILDTLITNGTTATGIVTGVAGSVTDVIGGVTGGVDGNPLEVITDIIGGVTGGVGGDNPLGVVTDIIGGVTGGIIGGGTSPISPVIDVVQGGIDILQGVESLKTEIINTGIDTVADTIIGVLPQAEHPVSEIADLGTLTFETSRDTVNGALEVVSDLVGGDIQGATENATGILGTLIQNGSTATGIVTDILGGVTGTIGGVTGGIGGDNPLGVVTDIIGGITGGIGGDNPLGVVTDIIGGVTGGIGGDNPLGVVTDIIGGVTGGIGGDNPLGVVTDIIGGVTGGIGGDNPLGVVTDIIGGVTGGIIGGGTSPISPVIDVVQGGIDILQGVESLKTEIINTGIDTVADTIIGILPQAEHPVSEIADLGTLTFETSRDTVNGALEVVSDLVGGDIQGATESATGILDTLITNGTTATGLVTEIIGGVTGTIGGVTGGDSPLGLVTDLLGGLTGSVGGDSPLGVVTDLLGGLTGSVGGDSPLGVVTDLLGGLTGGVTGGTDNPIGIVTDIVGSLTGGVTGEGSLDVISNLLGGLTGGSLLGGVTSTVSSVTNTTHTIVPTSLLTDNFLENSFNTV

SEQ ID NO: 4284 - protein, 815 aa, Acinetobacter baumannii
TYLPSMKPNDMTKNWVDPEAKAEAERYDNPIPSRTLILDTLEQLQTPQSHAELVDHFHIQDQKSIEALSHRLSAMVRDGQLMKDGFKFQLVADQPTYEATVYINSKGLGTAHIDGQDDLLLPERELRLVFNGDRVRVRQTSVDRKGKPWGFITEVIQHRVKQLIGKLSVHDGEYFIQPNNPNQHQPIPLEKELVEHAKANVGDMLRVAIDTYPTREEFATAHIIQSMADKADTEIIIPQTILEFGLPYEFPDEVIKEAESFKEPAEKDREGRVDLRDLALVTIDGEDARDFDDAVYAEKRPGGGYRVVVAIADVSHYVRLDSALNEEAEERGTSVYFPHFVLPMLPEALSNGLCSLNPHVDRLCMVCDLKLSRTGRVTGYEFYPAVMHSKARLTYTQVGQYFEGATDAIPKDRDIHKSLNTLFQLYQILKNLRVDRHAMEFETIETYMTFDELGGIKEILPRTRNDAHKLIEECMLLANVAAAEYALEHDIPMLYRVHEAPEFSRIQKVKDFVKLLGLPFPDQPTQADYQKVIEATKDRIDAPSIHAVLLRSMMQAYYGAKNAGHYGLAYEAYTHFTSPIRRYPDLLLHRAIKAHLKQKPYPLSGAALDDAGEHFSQTERRADEASRSVTTWLKCHYMQQHLGDEFIGIVSAVTEFGLFVTLKDLYVDGMIHISQLGDDFFIYDQASQNLIGQNRGQVFGLGDEVKIQVAGVNLEERKIDFQLIKQVTHAGRVVRSRAPRTTKTSTQTTEEVFGKPSVSTDGEKPVRKKKEKGKPSSYSKKSGKKTSTKAEAKPEKVKKKAKPKKKKSNAKSKAD

SEQ ID NO: 4285 - protein, 279 aa, Acinetobacter baumannii
KIMTNAPKPEQDLTHNEHSFDGITFEVVEEEDNPEGQKVKRRGIYLWPNLITTAALLSGFYSIIASLNGEFAQAIYAIFLAALFDGLDGRVARAIGAQSAFGEQYDSLSDLLAFGVAPAMLMYSWSLHDLGRIGLACCFVYTACAAFRLARFNVQIGVVDKRYFIGIASPLAAIIIISLVWVARDYPFIFDLRDIAIQTINAVIMVVVGLLMISNIKYYSFKQMDRKRVPFVVMLPVVLIFAAITYNIPMGILIVSIIYALSGFVTTLLAKKNNETIKT

SEQ ID NO: 4286 - protein, 131 aa, Acinetobacter baumannii
LSRTITMRHRNSGVKLGRTSSHRKAMFQNLANSLFEHELIKTTLPKAKELRRVAEPLITLAKNDTVANRRLAFARTRNAATVGKLFTVLGPRYKERNGGYLRVLKAGFRAGDAAPMAYVELVDREVNTSAE

SEQ ID NO: 4287 - protein, 192 aa, Acinetobacter baumannii
KECAMKDHVLNKKVLLVAGCISVSACLQVFPDYFIYWRESLLGEFWRLWTAHWVHVGWIHFLLNMMAFACLPFIFPHTKVWHILSLLFLLPPFISLVFYFYLPNIDAYAGLSGVLHGLYTAVALVYLQYRKERNFAFLVLGLIVAKLIWENTFGQTGTAQLIGSPVLTEAHLYGAIGGAIFGGCYWLIQRFK

SEQ ID NO: 4288 - protein, 151 aa, Acinetobacter baumannii
AFNALKNIDAALNNIDYWRNRRCSTTNNATSNATDDVSYYTKRIVTANTASNTTDNVSHYTKRIITADTASNTTDDVSYYAKRIVTANTTSNAADNVSYYAKRVITADTTSNTTDDVSYYTKRIVTTDTTSYAADSTCHATKDISHNTSRC

SEQ ID NO: 4289 - protein, 215 aa, Acinetobacter baumannii
SLHFFGCFLKYAFALKSIRLEDSPVHALEQKILTEGIVLSDQVLKVDAFLNHQIDPVLMQQIGKEFAARFKDAGITKIITIEASGIAPAIMAGLELGVPVIFARKYQSLTLKDDLYRAKVFSFTKQTESTIAISNKHINSSDKALVIDDFLANGQAALGLIDLIHQANAEVVGVGIVIEKSFQPGRDLLLEKGYRVESLARVQSLADGTVTFVKE

SEQ ID NO: 4290 - protein, 315 aa, Acinetobacter baumannii
ISVYVLFGNTVGKRHLYAFKIMLKKRSLSIEPFYYWWQDRVFIAAIILAILLHIFVLLIHFAMPAPSEQSTKEIAISIRPTEDVIKHADFLAQADQQGSGAFREAHRMSSNSPMPMPSDASTGEAQLETLEKVQQQRELKFEEKVLMTVLSWQKQAEESQRKKALEQLQSQFQAKAAMVASLEAQYLQRQQDFSRQQKIKTVDGIQAKKDASAAYLDKFREKVELYGNRYYPEEAKQQQLKGEVRLMVILNAQGGIRAIRLLESSGHPVLDEAAKASVRRGAPFGRFDANMKDISELRIIRTWRFDPAETEFEVH

SEQ ID NO: 4291 - protein, 507 aa, Acinetobacter baumannii
SYILNNGYKNKMEKQVDVLIIGAGISGIGVAAHLSKNSPQRQFEILERRESFGGTWDLFRYPGIRSDSDMSTFGFNFKPWRKANVLADGASIKGYLGEVIDEFKLKEKIHFGHRVLSANYDSASKKWHVIVEDNKKKQQTWVANFVVGCTGYYNYDQGYAPTFPNQEAFKGQLIHPQHWPENLDYKGKKVVIIGSGATAITLVPAMSKGGAGHVTMLQRSPTYIASVPSIDFIYEKTRRFMSEEAAYKFTRARNIGMQRAIYALSQKHPKTVRRLLLKAIEMQLKGKVDMKHFTPSYNPWDQRLCVVPDGDLFKILREGKASVETDQIEKFTETGIQLKSGKHLDADIIVSATGLQVQIMGGVQATIDGEPVKSSEHMLYNGVMLSDVPNMAMIIGYVNASWTLKVDIAADYICRLLNYMDKNNYDEVIPSGDKSVMEEDTVMGSLSSGYISRAADVIPKQGKQAPWQVTNNYLEDRKSLKNAKFDDGVLRFHKHSEVTTRKPKLVS

SEQ ID NO: 4292 - protein, 106 aa, Acinetobacter baumannii
SIKYDHFGSYSPHHFESPLLETHQSGGYTLWQLEYDIQQNKLGSQLRNHEHLSHLKSGSDSSSQEAVESAYNLISIVRKSSSLILDDHNLTKEYFFHVKLIVELRN

SEQ ID NO: 4293 - protein, 203 aa, Acinetobacter baumannii
GYMHSQPLPDCWNLNQILDDLNAHGFAIVNQAYSAEYHTQVAKECSHHFDEFREAGIQNGVVSTIRSDHILWINESLPVAEQHVETLTSFCQHLNQAFFLGIKEVEAHFACYNPGEFYALHRDNPQQKNDRIMSTVYYLHPQWQDDWGGQLRLQDKNNIWHIITPEPNRLVIFQSNLLHEVLVSKQQRLSITAWLRSGNSIWV

SEQ ID NO: 4294 - protein, 667 aa, Acinetobacter baumannii
SGFNAFMRPGKKSSSNKSRVMKNKYAHRSWLGAVCLLGCSLSYAAEEQFNDALNAANSGNTALLDQYQLAMQNDVLGYYPEYWKLNTNLGFQSPTSIVSFAQRYPQSAMAEKLAADYVEEKVKQADFASAQPILPYVSNPDQAENCALAQVRAKSGDALVFAEYKDVWLATESQPESCIGLGRMMLSSPLMSTQDKQQRLWVQLRAGLSGQALATAQTLGLNLSLAQLNQIQANPLNYLWSAPKTNDVDYAYLIFALGRLANNDLGNAFANVQRVAQGTPESVQKYLYRTVAYIGGTTVMKNNFNREVLQYFDASYGYPLSPEEAEIYARQAIRFSAWESLIRAIDSMSVSQKQEDRWQYWLARATEQRGDSNSKNTAQRIYKKLAESGDDYHNLLAKDRLGVRYNHQPYNDEPTASDLRRLDQNIHFNRAFTLRRINANPTYTNREWNWAVRQAYLQHDDGLLLAAAKRAHDMGWYDRAIYAADRTTNKHNDTYRYVTPHKTNVVSHSYNAGIDPAWAYGLMRQESRFVTSARSHVGAGGLMQIMPDTAKLIARQMGETYNPAALSEMNTNIRYGTFYLSMIQGQLSNNPVLATAGYNAGPNRARRWQPDYQPIEADQYTETIPLLETRDYVKHVMTNATHYGVILGQGAQSLIQRMKVIPTRSSP

SEQ ID NO: 4295 - protein, 129 aa, Acinetobacter baumannii
KMAKDTRTRKKVTRTVSEGVAHIHASFNNTIVTITDRQGNALAWATSGGQGFRGSRKSTPFAAQVAAEVAGKAALDYGLKNLDVLVKGPGPGRESAVRALGAVGYKINSITDVTPIPHNGCRPPKKRRV

SEQ ID NO: 4296 - protein, 178 aa, Acinetobacter baumannii
TVLNEFSRKLSVSNDVGTIVCVVFVTLDTVEVTPPSKLPPVNPPSKLEITSKLPSPVTPPVKLPTISVTIPIGLSVPPVTPPVKPPSRSVTTPSGLSPPTLPVKPPRRSVTTPSGLSPPTLPVKPPSKSVTNPSGLSPPVTPPIVPVTPPMISVTKPVAVVPFVISVSRIPVADSVAP

SEQ ID NO: 4297 - protein, 369 aa, Acinetobacter baumannii
SLLKGFLLTAAIRRTVTFPEISMERLKSILGAYNGHLKQIEQRLDVKITHRGDVFYIDGEIDAVGRAEALLQRLYEETEASQQISADLLHLLIQSSQTERNFELVGEEMDEHDAPMDVYFQTRKGRINPRGANQKRYVQRILQSDISFGVGPAGTGKTYLAVAAAVDMLERNEIQRILLVRPAVEAGEKLGFLPGDLTQKIDPYLRPLYDALYEMLGFEKVAKLIERQVIEVAPLAYMRGRTLNHSFVILDEAQNTTPEQMKMFLTRLGFGSRAVITGDITQVDLPRGQQSGLAHALRVLENIKEIHITRFHSRDVVRHQLVQKIVEAYEGWDGEQQRLNAEARAERKARQEALIAENDTAADLQHQDA

SEQ ID NO: 4298 - protein, 342 aa, Acinetobacter baumannii
IILEVAIMTRTANEFLTPQAIKVEAVSGTSAKVILEPLERGFGHTLGNALRRILLSSLPGAAVVEVKIEGVEHEYSTLEGLQQDIVELLLNLKGLSIKLFDQNEAYLTLEKQGPGDITAADLRLPHNVEVVNPEHLIGTLSATGSLKMRLKVSQGRGYETSDSRFPEGETRPVGRLQLDASYSPIKRVSYTVENARVEQRTDLDKLVIDLETNGTVDPEEAIRKAATILQQQIAIFVDLQKDQTPVAQEPREEIDPILLRPVDDLELTVRSANCLKAENIYYIGDLVQRTEVELLKTPNLGKKSLTEIKDVLASKGLQLGMRLENWPPASLRMDDRFAYRSR

SEQ ID NO: 4299 - protein, 376 aa, Acinetobacter baumannii
CTSEKEKTNYIEDRKMSKVQKICQGLAVSFLAASVLSGCSYVVKSGANVALGFTEKHVVPPILAMQDAEMVCNTGSALTPAIMSTKGMGADPTRVAVLMYAASGVCAENQALEQELRYLRASKAGQVTEAQDARIAQKRWAAIAAERQYAGYKLFADRWESKYKYHLGDSCPTMRSDIDQTVYLLGMISGLQAVTNDINSGGSVNVPKDIAAIVERGMVCLDNQKFWGAPNATRAVIWTLLPGANEGKPDPYETLKQSVQIGEQKGVRLSHALYAVAAQASGDDAKIRDALKTYAASQADDKPVNPNFKLIDSMAGLIVRGISDRYWTEHTGVRTGDDGMSHFWDEKNEGSAELDELFDGGAASEAPADTKTAPAQ

SEQ ID NO: 4300 - protein, 416 aa, Acinetobacter baumannii
RMLERFLKKLPFYNKTWFQFILFVIKRFEADRCREQAGSLTYTTLFAVVPMLTVFLVMISSIKALEPARQQLQHLIYSNFLPKSTIAFDKALNAFTEKSSNLTVIGVLFLFVTTVLMLTSIETVFNRIWRVKETRSGIVGFMRYWTIISLGPIILGSAYVISSTVASMNLLSNNFTGYQLDGAFLLWLISFVLTILGFFILYWTIPNRTVPLYAAAIAACLSAALFETLKNLFSFVMSNFTSYEIIYGAFAAVPIFLLWVFLSWNIVLLGVEVSFALTAFHSGKEQKRHPVLMLLDILELFYKKQKLGESVSDKEALEILGRGEVGRWPAYVLLLEEQNLVKRTDKDEYVLVRNLSQVDFWSFFTALPYPLPLRQDVSNVHDDDEWMEKIGPALVESNDYLAAKLSIPLSTIFEEK

SEQ ID NO: 4301 - protein, 85 aa, Acinetobacter baumannii
MSEEMTLEERKVIYRARRGLKEIDVYFDPYVKNYYLKADPAEKALFAELVEQEDPDLLDWFMEVSEPPRTELRDFIYKLKHYVHG

SEQ ID NO: 4302 - protein, 61 aa, Acinetobacter baumannii
TQYCQPISGIIKFSHTIKNTVSFLIHFKNVDILKVIHIFSLMNFKFSFSWIKTPCTNNTKL

SEQ ID NO: 4303 - protein, 686 aa, Acinetobacter baumannii
KIMWLLAMTLQQATLPTPRFDQITLDNLKQDIQQAIQAGQEFLNTLTAAPSETDQQLAVLEQIDALENNLSESWGVLSHLNAVMNNAETREVYQSLLPALSEYYTQLGQHTALYQTYQLIHDGQSYSKLSPAQQSAIRLALRDFKLSGVALEGEEKKRYAEISARLSQLSSDFSNHVLDATQAYFKPLTEDQLKGLPESNVELLKQYGKQRELDQAVATLDFPAYFAIMTYADDRALREELYKAYVTRASDQSEQTEFDNSKIMEEILSLRQEMAKLLGFNNYAEYSLASKMAPDVKTVHDFLVDLAEHARTPALQEVAELQAIAKQDGIDELKPWDTTYYSEKLKQQQFNLSQEALKPYFPAPKVIQGLFQIVQRLYGINIVEREAPVWHPDARYFELEDQGEVIGGFFFDLYARTGKRGGAWMSGFRSRMQTVHGLQKPICYMVCNFTPPVGNQPALLTHDEVITLFHEFGHGLHHMLTEVDNISVAGTHGVAWDAVELPSQFMEFWSWDKESLDVLSEHIESKQTLPQELLDALLNARFFQSGMQTLRQLEFALFDLTIHTKTPALKSEQIQQTLNDIRKQYAVVPTVDYNRFQHSFSHIFAGGYAAGYYSYKWAEVLASDAFDRFENEGIFNTQTGKEFRQAILAVGGKDTALEAFVNFRGREPKIDALLRHQGWTNDNKTA

SEQ ID NO: 4304 - protein, 219 aa, Acinetobacter baumannii
NWLRQKNKKYRIVFFLTKFVKPMQPYILVLYYSKYGSTKEMAHLIANGVESAGVNVKIRTVPNIATVVTEAEPSIPEEGDIYCTLEELANCAGLALGSPTRFGNMASEMKYFWDQTTSLWLNGALHNKPACVFTSSGSMHGGQESTLLTMLPPLFHHGMVILGLPNSIPALSNTKTGGTPYGASHVSGPRHDQSLSQDEKILCEAQGKRLGEIVKKLYS

SEQ ID NO: 4305 - protein, 304 aa, Acinetobacter baumannii
MEERKNLDTRASALMVLLCMVLGLQQVVLKIAAPDISPIMQIALRSGLSVVLVLPLLWRDHSIHLFSYRQCKAGALVALFFSLEFYFVTQALKFTSTSHTVVLLYTAPIFVALGLHWKFPTERLNRAQWGGITLAFMGIILTFYPTTTATNAPALAQVLLGDLYALMAGLAWALSTIIVRLSPLAQAPATQTLFYQLFGCFVLLLLIAFLTNQTTIHFTTLTILSLSFQTLIVSFASLLLWFWLLRNYLASRLGVFSFLTPLFGVLFSILLLEEKLEIKFIFGSILVLSGIVIMSLKQGKANSS

SEQ ID NO: 4306 - protein, 181 aa, Acinetobacter baumannii
LKRRRRMSIETKAIVSRIGETDQLYLTENTPELALERAELRMQLVTLSRVRQEQIHFLQEAIVLLEQARMEYEEMPMSLYLNLSLHLAKAYMLYFELNKEKRFALIAQQILKPLAHHQHGDIYFFLAYASAAQQESALTRHWLTKYLSTAQCDLELLHEHPIFNPVRHETWYKNLIKLRTH

SEQ ID NO: 4307 - protein, 220 aa, Acinetobacter baumannii
MKYRDLGLQSISQLAWWIICASVGLLSSVLHAEPVNVQGYVMHVQMTPAVCALDPSKQKQRKCLEGYSLTITGLMPETTRTDCSTQSSATLSPLQAKVVARVMPDNNARVQLWRSVGGCVPMNASQYFRTIINFAERLKIPANLTSSTNVEMQQSTLRQQFTKLNPSLPQNGIRFTCQLSRSDVVLTEVKVCYTVNGQYKQCSNHVVSNCPSEITIKGSY

SEQ ID NO: 4308 - protein, 116 aa, Acinetobacter baumannii
NLIRTHKKQQENIGIDMQLTSIVVRLLKRSHGRITMFEQQPTLQLLFEQLGLDSDDASIENFIRTHQLPAEQKLHEASFWSQGQSDFLKSHWEKDDEWIVVIDELNEQLHEDSVKK

SEQ ID NO: 4309 - protein, 161 aa, Acinetobacter baumannii
GFILKISLSLQQDFQSPELELKRAQLKKIIETTLRHVGYKEDCEIGIACVDLEESHQLNFQYREKDKPTNVLSFPSDIPEEVLPMLDALPLGDLVICIPVVLQEALEQKKTPQNHFAHLLVHGVLHLLGYDHETSDEDAEEMEGLEIEILAKLNIANPYQE

SEQ ID NO: 4310 - protein, 238 aa, Acinetobacter baumannii
RLCGFFSKSSSGSSFMQTLFSSLVKRLHKVYRKAEAFIEEERDFTLSQTFLNATLERYVTNNVEFLDDLHADLYHDWLRLYATMHVKGLETTLSVDLKLIQMEFNKEQQLIVFEQISNTQIVEAKYKNFWQKIAVKAAIFYYHKILKKDPLGMILERFDVAQEKDDLIFLDLNRWFAKKASIIETLGKVHINYARVREAELVVFGNVNLAALLFRDQDDDSEDELEDTEITPIQQKDV

SEQ ID NO: 4311 - protein, 359 aa, Acinetobacter baumannii
MRFGMPKLISEKNQLQQLSLNSNGGVVYQPARGFFKVVYQGLILPNLPAPLRYFNYISLIGQPRIPLCYNANSIVTSAVDTATVLVSNSLHSVGHLKTYSIRRQCQLNPSRYQFDKTDLIEWQIPRVQLRRIDFEMSCDLIVQTPSDISNSSALQWGISDYWSILCHCEGEILYKGQKYEVNGLGRFKHARALHLPFLSLCFYTCQIINLNETTQVTLSQIRNQWNIILFSRLDIQELGKQPLTFTEDVNFHIHRVYPKVETPHGREMYLPREFSWQCKKNGKVIFELYGESRGDYKFGLAAGYIGSFRYQLSWNDQCLQGEGGYCEYIDCRPLRWQEKNQNEKMLDKLLLLQPCLYKK

SEQ ID NO: 4312 - protein, 148 aa, Acinetobacter baumannii
LKVLDMPLQRKQNSKLLWILIGGLSILVVLFFAAQWFFKKTETSAPMVDPQPASVPAPEKTTKPSESSEPVVQTQTANSQQLVNEDVLKQPIPAQESLAKEEVSKLNDIHRQLQDQEATLKAQHADADQLIKLKEEQVKLLEAQVKQQ

SEQ ID NO: 4313 - protein, 96 aa, Acinetobacter baumannii
TTSITGEIGDVPPPIMPPVTPPIISVTTPRGLSPPTPPVTPPIISVITSSGLPSTPPVTPPITSVTLPATPVTIPVAVVPFVISVSRIPVADSVAP

SEQ ID NO: 4314 - protein, 169 aa, Acinetobacter baumannii
KTQILGGIRLAPYIAGYKLGWVTDKTIRTKLCQVGYIGYDAASLIYKGQEFAKKVIPSCIRENALERILWHKQQGDQVVVVSASLSVYLESWCKSLDLDVICNQLEIDNGILTGCFIDGDCGYLEKVNRIKNKYDLTQYSIIYAYGDTPNDYEMLELAHRKYYKWQEIN

SEQ ID NO: 4315 - protein, 738 aa, Acinetobacter baumannii
ENKIGIFMQEYQEKRSGLGLLGYIWNEWISTFIILILLLMTLIIGTGEMIHGQLLRIGERLYGDPATGMQYSFLRAEPEKPTCDRHPNIDAQVKEQMKANASDDFASFFGAASESDVRASLLAAQQQCEEKYQAYDKTIKYIEANPGVRTYRTIETGFFGIFKFGTENRAILLVFMVLISAITASLKYHHIGLRNPATKIDYKVYSLFMLIGNALLSFSVISQYRSVINSGVTPTYETVTIYWIWMILFVVLTLISLYQLFVSPPPKREGGNIGLALLSVPLYAYMALITGIVFTFFMDYPMGQGIYLGLLVEFSGIFLNLALFIWAGMLLTQTRVMDLFLNVLRPWNLAPETLTWLILIAAAVPTAYTGASGIFVIAAGAIIYKEVWNAGARRQYALAVSAMSGSLGVVVRPCLLVVLIAMLDSRHVTSDELFGHGIYVFWLTAFIFLGVSLLLAEEKFRVNSPKVALPGMARAFVPVIPYILITVVVLAFYKYALDTGMNEFTAPVILPLVLIAMILYDKMVMPKEAPALNIHEAIVREHEKKSPFLQTHDPHSSQFRLGFGGALRFATSETVGHIGALIILMALSASVGGLIERSEVVELLPTHLGSIYISLACIALLLAIIGMCTDPFGAVILVAATIAPVAYENGIHPIHFWMIVLVAFEFGYVTPPVALNHLLTRLSVGDDEVNAADAEAKEKYTSFYYRYERWLLPIIVLFSSLVLVTYAPLILKLFGWYK

SEQ ID NO: 4316 - protein, 244 aa, Acinetobacter baumannii
IYRMLLLSLFVEFVMSFFAKLFGFKQKTTAQEDVALKAAKELEPSNETSFIELIKNRRSIYAIGNNLSQSNDEIEKLIQEAIRHSPSAFNSQSSRAVILFEQSHHKFWNTVLEVLKTIIPTEAVSGTQQKIQSFAAGAGTVLFYEDQSVIKSLQEQFELYADNFPIWSEHSTAIAQFAVWNVLAEQNIGASLQHYNPIIDEKINTSFNIPAEWKLRAQLVFGSIEGAAGEKAFIDDESRFKTFG

SEQ ID NO: 4317 - protein, 226 aa, Acinetobacter baumannii
VIGIISRNNKGSFMKTRPSKIVCVGRSYADHVKELNNAMPGRPVLFIKPPSSLIGLDEGISWNPAWGSCHFECEFVLRIDQPLKGETDPQKVLQAIGAVTLGLDLTLRDLQNELKDKGQPWERAKAFDGSCVLADWVDVSEITNWEETRFTFHINDELRQDGNTALLMFNIAYLLVDINQVFSLEPGDVIMTGTPAGVGPLNAGDQLKMTLKGATQDFVWETFVKA

SEQ ID NO: 4318 - protein, 131 aa, Acinetobacter baumannii
FILINHLNFKLKYSRFSIIFQFFIGLSLAVLFYQLMPLLWWLVVISLLFISFIFFLKRPQLAQIAYLDKKLWSLAYHSQNTISRVKILKVIDYQIFIVIYFEGNKTLTSIIWFDQMSLAEWKKLKTLEKLY

SEQ ID NO: 4319 - protein, 168 aa, Acinetobacter baumannii
YIVMTEQKSALSLRYYLNLEESQDGFGLVTFGKKQFTRFLTPVISIAIIIWGLYLGFSGVGRYYVALGVFFLVMQGLMRYWLLPMMFKRQFVRYQFGKSEQGIDLYQDYFELYAAGRKQAVQYSEVQTFAKGKLTYMLELKNKTVIIVPKRAFAQASDQTIFENTFKK

SEQ ID NO: 4320 - protein, 142 aa, Acinetobacter baumannii
TTSITGEIGDVPPPIMPPVTPPMMSVTTPRGLSPPIPPVTPPIMSVTTPSGLSPPIPPVTPPMMSVTTPRGLSPPIPPVTPPIMSVTTPRGLSPPIPPVIPPMMSVTTPSGLSPPIPPVTPPIVPVTPPRISVTIPVAVEPF

SEQ ID NO: 4321 - protein, 343 aa, Acinetobacter baumannii
NRYLTRLRTLIGDNYMKQPVRVAVTGAAGQIGYSLLFRIASGEMLGKDQPVILQLLEVPVEKAQQALKGVMMELDDCAFPLLAGMIGTDDPKVAFKDADYALLVGSRPRGPGMERADLLKVNGEIFIGQGQALNEVASRDVKVLVVGNPANTNAYIAMKSAPDLPAKNFTAMLRLDHNRALTQVAQKAGVAVADIEKLTVWGNHSPTMYADYRFATANGESLKDKINDPAWNKDVFLPTVGKRGAAIIEARGLSSAASAANAAIDHMRDWALGTNGKWVTMGVPSDGSYGIPEGVMFGFPVTTENGEYKIVQGLEIDEFSRERINFTLNELEEERAAIADMVK

SEQ ID NO: 4322 - protein, 78 aa, Acinetobacter baumannii
IDRVVRVIKMKKRFIAGAKCPKCEAIDRIVMLTTAEDEWIECIECGYSENRPTHIDEPETPAIPDEIGVIQFKSRRSD

SEQ ID NO: 4323 - protein, 290 aa, Acinetobacter baumannii
GIKVNMNYRHHFHAGNFADVMKHVLLLQLLNRLNAKDKPYRYIDTHGGAGKYDLSQAPAQKSGEFLTGIHRLVQLSDMEKRQAPEAIQQYLKLVEELRAQEGKGSYPGSPWFALQGMREIDKATIFEMQRDVFQQLRHNIHDKRAGLHERDAYEGLLAVIPPKEKRGLVMIDPPYELERKDFPQLVELLQSAYKKWPTGVFAVWYPIKDRAMIERFEKKMFKTGIRRQLICEICVWPDDTPVGLNGCGLLVINPPWQFSEQADQALQWLFPHLRMQETGGHAAVRWLVGE

SEQ ID NO: 4324 - protein, 257 aa, Acinetobacter baumannii
YAKVIDASALTYQSVQGYLLMATKFLKSFSIATGISTTLLIASFSSHALAMSPFQANYQFSYNNKGMGSATRALSQQGNNWTYQFTAKAGGIASASETSKFSFANGKIGSQSFSRTSKILIHNNTMSINFNPGNKTISTKKDDKARSFAWQAGVLDELNAELQIREDLKNGSLKSSYPLADAKEVENRRFVKQGNEKIKTSYGTFDTVKVVLQHKKPERSTIFWLAPKLDYLPVKVSHIDGKTSYGLLLTSYTGKTN

SEQ ID NO: 4325 - protein, 212 aa, Acinetobacter baumannii
GETFMARYIGPKCKLSRREGTDLQLKSGVKPFDVKTKKANKAPGQHGQARGGKQSEYSLQLREKQKVRRIYGVLERQFSNYYKEAARVKGATGENLLKLLESRLDNVVYRMGFGSTRAEARQLVSHRSITLNGRRVNIASIQVKAGDVIAVHEGAKQQLRIKNAIELAAQRGIPAWIEVDHSKLEGTFKAAPDRSDLPAEINESLIVELYSK

SEQ ID NO: 4326 - protein, 263 aa, Acinetobacter baumannii
SRPLMAAFNVERITHVHHWNDTLFSFKTTRDASLRFKNGQFVMIGLEVNGKPLMRAYSIASANYEEELEFFSIKVQDGPLTSILQKVQVGDEILVSKKPTGTLVHDDLLPGKNLYLLSSGTGLAPFLSIIRDPETYERFEKVIVVHGTRYISELAYQDLILNELPNNEFFEELGIKDKLVYYPTVTREPFHTQGRVTTAIETGALFEKIGLPRFNRETDRAMLCGSPAFLKDVAALLDQHGLVESPRMGEMGDYVIERAFVEK

SEQ ID NO: 4327 - protein, 73 aa, Acinetobacter baumannii
SHYSEIQKIIHHRVSMIIQLQHIHHTTIFTITVTIVLIHQMIAHHFPTQADVMGAVAVTKKPFHIKGLLSSLR

SEQ ID NO: 4328 - protein, 205 aa, Acinetobacter baumannii
MQLSLKYILALTASLSMAPLHAEMMQSSSLNSDVDGPNANLAARVLSKDTQNFNSRFSNINSLSITERSGDQIRRQAIAAKIEIPEDEPSVIEKLNTVASNTVRKFSQTGMASWYGRQFHGRKTASGETFDMNALTAAHRSLPLNCYIRVTNKDNGKSVVVKVNDRGPFHGNRVLDLSYGAAKRLGITNAGTAKVSIERVDGPTS

SEQ ID NO: 4329 - protein, 66 aa, Acinetobacter baumannii
SSSSSLHAVRNNAEIDNVIAKAIFDRFIEYPFYVLFIPHIFHAQILRHKKSALHRTLFNLTVIFTI

SEQ ID NO: 4330 - protein, 84 aa, Acinetobacter baumannii
YFTSLALVLCPSVFNGRHCFVICIEPFNSYPFFHAEHSRRNRIVKTLFFPLFLIIFVLIIQALDQSYQKKIGISKPQKHPEFMQ

SEQ ID NO: 4331 - protein, 76 aa, Acinetobacter baumannii
SRGFYMPQVKLKEGEPVDVAIRRFKRSCEKAGVLADVRKREFYEKPTQERKRKKAAAVKRYQKKLARESVRTTRLY

SEQ ID NO: 4332 - protein, 185 aa, Acinetobacter baumannii
FIQSAHTTVISLVNVTQRIASTGWNEMNKPILDPCSGSRMFWFNRQNPHVVYGDIRQEKHILCDGRSLIIEPDIVMDFRDMPFKDGQFNLVVFDPPHLIKAGEKSWLALKYGKLNQDWREDIRKGFQECFRVLAKGGVLIFKWNETQIKTNEILALTKHAPLFGHSSGKRSNTHWFGFMKFEDEI

SEQ ID NO: 4333 - protein, 389 aa, Acinetobacter baumannii
RVESFALKLDEETGAQEWKFDNSSPYFDAELISYRYTLLKRYRQQHRTLDLIYLLKEGLTYDIANIGHPMLFAATHVGTKKLIEDYIEEVSQSLAYIASSECITFQRKEKIEFFENCEKAYGQPALMFSGGATLGLFHTGVCKALIEQDLMPKVLSGSSAGAIMTGMLGISASEDIQNLLNGEQFFSDAFHFRKLRELIKGNGGIADVHYLKKFLIENLGDLTFEEAFKKSGLNINVAVAPYDATENPRIMNAIMTPNVLVWSAVLASCAVPVLFPPVRLTSKRYDGEHTPYMANTKWVDGSVRSDFPQERMARLYNLNYTIASQVNPHVVPFMQDDARRFRKDVLSWPERILRRQGKVLSMGLMDFTRQRLGAISPVRRLFDHGYGVV

SEQ ID NO: 4334 - protein, 105 aa, Acinetobacter baumannii
ILRSIYLIKISFKKSLFIEALFVILLRILKSILFEFEELMSQQSVEKKSVPWLLMGLGLLIPFLIIGILFLAAKSDAQNKKQYEQQRLEMEKRIAEKEAANSDKK

SEQ ID NO: 4335 - protein, 382 aa, Acinetobacter baumannii
SRMSPSPQYKFLRQAPRDGLSTAMQPSRWQQLHIDPWLCLFLFLNALLGLTVLYSASAQDVGLVSKQAMSFGIGFLVMISLAQIPPKVYQAFSPYFYLFGLFSLIGVMVFGEVRMGAQRWIDIPGFGSVQPSEFMKIGMPMMVAWFLARKPLPPSFSQVILSLMLIGVPFLLIAEQPDLGTSLLVLASGIFVLFLSGLSWRMIGAAAACAAIVIPIAWEFLLHDYQRQRVLTLLDPEADALGTGWNIIQSKTAIGSGGFSGKGFLEGTQSHLHFLPEGHTDFIIAAYSEEFGLIGVLILVILYSAIIFRTFQIGLQSFHNYGRLVAGAFGLSFFVYVFVNAGMVSGILPVVGVPLPFMSYGGTAIITLMATFGLVMSIHTHR

SEQ ID NO: 4336 - protein, 74 aa, Acinetobacter baumannii
NHSSLHSYEFLGHAYRKFAGTSDVFRPELVFVLIAGAKRTEAYGQNVQLLNQEEQLQCSVKPFCLRLALLQVEV

SEQ ID NO: 4337 - protein, 74 aa, Acinetobacter baumannii
SSKSANLFQSEFTPLGVAKVSCLLAVSIPVTTYSPSKKMFAVFAVRFADIVEVNTSVTFEKLVLVATGFLKWIV

SEQ ID NO: 4338 - protein, 268 aa, Acinetobacter baumannii
KKKSFFMKIVILNKPYDVLSQFRKDEAHMTVSDFVDDPTLRIAGRLDMDSEGLVFLTDHGGLNQFITNPANKKYKTYLVQVDGDVTEEALEQLRKGVELNDGMTLPAKAIKVSEPEWLWDRDPPVRYRASIPTSWIEISICEGRNRQVRRMTSAVGFPTLRLIRTKIGTIDLVQLGLQPGETKEIEPLLYPDFKDVPAEQPYRSRSYVKKPGGTGGKPMVRKNKDGSAKKSGTKRIWQMDESEKPRRKTNGTTRPNTKAPRGRSRNSR

SEQ ID NO: 4339 - protein, 341 aa, Acinetobacter baumannii
TNFPSLWFDGIKFAICIGFITLKWGTPLMRFGLFCIFIILCICSLLLGAEQIQWSTLFSFSHESWLTLTASRIPRLITIVLTGIGLAVCGVILQHIVRNKFVEPETSGGLDAAKLGILVSLTLVPVTSTLSKMIFAIIFCFIASLIYIAIIRRIRFRNTVLVPVIGLMYGSVLSALAEFYAYRFNILQSMQGWLLGDFSKIVQGHYEVIYIIFPIVVLTYLFAHRFTVIGMGEEMASSLGLSYAAIAAIGLILVAITVSTTVITVGAIPFVGLVVPNLVALKYGENLAKTLPIVALGGASLLLICDILGRSIIYPFEVPIGLTAGGVGGIIFLILILREFR

SEQ ID NO: 4340 - protein, 373 aa, Acinetobacter baumannii
GCLPMINDDQNKTTSLSLEQIREDIDSVDQQIQELLNRRASLAEAVAKAKFASEENPLFYRPEREAQVLRKVMERNQGPLSDVTMARLFREIMSACLALEAPQSIAFLGPEGTFTQSAVLKHFGKDAVVRPLPTIDEVFREVEAGSAHYGVVPVENSSEGIVNHTLDCFKTSNLNVIGEVELRIHHQFLVSENTRKDSIKQIYAHQQTLAQCRQWLDAHYPGVERVALNSNAEAARRIRNEWHSAAIASDIAAGMYNLEILHSNIEDNPENTTRFLVIGREKIPQSGNDKTSLLISAHDRAGALLEILAPFAKHNISLTSIETRPALPEKWAYVFFIDLEGHIDQENVAAAINEIRPMVKELRILGSYPAAVL

SEQ ID NO: 4341 - protein, 62 aa, Acinetobacter baumannii
KDAPHVYKSALYKTAGLLSKLQISHAWVKPPFFGKETSTAHTQYLHIKPHRSVLLCFGTYHQ

SEQ ID NO: 4342 - protein, 63 aa, Acinetobacter baumannii
KLLLFQQMSKFEILKFLSPYLCFKEKLQDGKLYEKNIRFNNLSSGCCCDECTSKGLEGDSFWY

SEQ ID NO: 4343 - protein, 322 aa, Acinetobacter baumannii
NFMLFHLPKLPAEIRVSHLNARVNEQRKKIAQTTASRLELLQLAQQLAKEAKIRRKNNQKIFVLDFKGDIQASAVENLREEITLILATAKAGRDRVVVRLESPGGMVHGYGLAAAQLVRLRDAGFHLTICVDKVAASGGYMMACIANEIISAPFAVVGSIGVVAQVPNFNRLLKEHNVDFELYTAGQYKRTVTMFGENTPEGKAKFEEELQQTHVLFKHFVEKYRPQLNVDKVATGEHWYGQDALDLNLVDKLQTSDEYLLALLPQHDVYVINTRKKATLGEKLGLQAAQMTDSLIPAVMNKVADTLAKANSTLVQMRDTKF

SEQ ID NO: 4344 - protein, 236 aa, Acinetobacter baumannii
RTMFYPLPRKIQLAASTSNWPIESTQSILLLVGLDDLENISDWTHQPLADHLEMLSKRAQALEIPVMMIQSSQLQQTMLQLGQHLSSNTQAQVIMAGNLSPLFKQVMQLVLSITDYVAVVNDAILASSLEQHIQWIEKISFDHIQHINTQTLMRLWSLSAPSSQVLSDKGILLAVAEQVGRHPMEIHPEIDLRNYGLDASGVNYLVELWRANGASLTVDELMQTPTLQHIMQLLKR

SEQ ID NO: 4345 - protein, 180 aa, Acinetobacter baumannii
PKTPKFRIIRLLNSWCFFMAAWTPHVTVATVVEKDGRYLFVEEHSEGFVHTVFNQPAGHVECGETLTEAAIRETLEETGHHIDIDALLGIYTYTPPMFPDRTYYRFCFLAHVTHVESDPKLDTGIVSAVWMTLDELKESARARSPLVIKAIEDAMKGQHYPLALIYEHPFSPSLTSHLDA

SEQ ID NO: 4346 - protein, 219 aa, Acinetobacter baumannii
LYNPANARNRNMTTITLPALPYGYDDLAPHISKETLEYHHDKHHNTYVVNLNNLIKGTDLEGKTLEEIIKATAGDASKAGIFNNAAQVWNHTFYWNSMKPNGGGKPTGAIAAKIDEAFGSYEKFAEEFTAAATTQFGSGWAWLVADEVNGKLSITKTSNADTPLAHGQIAVLTIDVWEHAYYIDFRNLRPKYIATFLENLVNWDYANAKLAGQPAGVEK

SEQ ID NO: 4347 - protein, 265 aa, Acinetobacter baumannii
AGVLFTIQTPLHQILFKGMNGMVELPFQQSQALNVRQNRALALAGVFQATQLTHMTAMTGQQSIGESGNFYFELLIKASLNIRPTTNNNAVQTLDFFNQLADISLGLKTLENCITQPFTNAPKSRLPKMRSAKLPMSYAMSLLQLEKKVYSNPEYVAIIEKAQQKILKQLSFFDNNYLHPSILANLAQTYVDTAGQINPRILVRGNAEAFKDTNHTNRIRACLFTGLQMAHLWRQLGGSSWNMIFSKRKLLQDIQALARLQYQVI

SEQ ID NO: 4348 - protein, 423 aa, Acinetobacter baumannii
FIGPPLMFANISISEFDPELAQAIASEDERQEAHIELIASENYCSPAVMEAQGSKLTNKYAEGYPGKRYYGGCEFVDVIEQMAIDRAKELFGADYANVQPHAGSQANSAVYLALLNPGDTVLGMSLAHGGHLTHGAKVSFSGKTYNAVQYGLNAETGEIDYEEVERLALEHKPRMIVAGFSAYSRVVDWQRFRDIADKVGAYLFVDMAHVAGLVAAGVYPNPVQIADVTTTTTHKTLRGPRSGLILAKANEEIEKKLQSAVFPGNQGGPLMHAIAAKAICFKEAMSDDFKAYQQQVVKNAQAMAEVFIARGYDVVSGGTDNHLFLLSLIKQDVTGKDADAWLGAAHITVNKNSVPNDPRSPFVTSGIRIGTPAVTTRGFGEAEVRELAGWIADVIDSKGDEKVIADVKAKVEAVCAKFPVYAK

SEQ ID NO: 4349 - protein, 405 aa, Acinetobacter baumannii
KSALLYPKMLGSSASYKILELPRMTRKSAIAALLLLPSFSYAATVLSAPPELNNKSYVLMDYETGQILASKNENEKLAPASMTKMMTSYIIEQKLLKGELTENEQVRMNESAWCKGSSSESCMYVPLNGTATVLEMLRGIIIQSGNDASKAMAEHIAGNEGTFAHMMNQEAKRIGMTNTQFINSTGMPAEGHYSTAKDMAVLAQHIIKDSSKYYPIYSEKEFTFNGIKQGNRNALLYTDPSVDGLKTGHTDEAGYCLTTSSKRGPMRLISVIFGTPSMSERADQTRALLAWGFANFETANVQPANQVLAKAKVWFGKENEVQVGLAENFNVTMPKGKADGIKTQLVVQPNLNAPLQKGQVVGKLVASLDGKVIAEKPLVALKPVEEAGFFARLIDHIKQFFSNLF

SEQ ID NO: 4350 - protein, 241 aa, Acinetobacter baumannii
SRQFKNILKNMTQTSLSQSPNDTTSSQDVIEIKTVTRSVGRKATITKEELFQAALNLIGPQKSIASLSLREVAREAGIAPNSFYRHFKDIDELAISLIDRAGIVLRKIIRQARLRASLQDSIIRSSVEIFLQQLDADEGNLSLLLREGFTGSASYKAAVDRQLNFFQQELQEDLIRLERLNNNHLYHPELVAKAITQLVFHMGAKVIDLPIDQRAEVAEQTMIMIRMILEGARHLDEAKIR

SEQ ID NO: 4351 - protein, 210 aa, Acinetobacter baumannii
VFKLFCIHNKELRATMAFRNNVPQASWRLAKIALGGIVLTGLAVGTYAYAQQKPLPTVDKVELDRYLGVWYEVARKPAFFQKKCAYNVSATYTLNENGNIVVDNRCYDNQKQLQQSIGEAFVVNPPYNTKLKVSFLPEAVRWIPIIRGDYWILKLDEDYQTVLVGEPSRKYLWVLSRTPHPHKEVVDEYLNYAKTLGFDIRDIIHTEHKE

SEQ ID NO: 4352 - protein, 81 aa, Acinetobacter baumannii
RTKFCFSRFGFGGLSMNWFDAVLKVRQVITDKHGVERPAQTINGTLDCPICNEGEVIYSISSHNGHISGQCDTANCVNWME

SEQ ID NO: 4353 - protein, 294 aa, Acinetobacter baumannii
ISFTKNFDRWSKNPHIYRHITLGARKKVENADIWRPNPTFKVKKMADYNVSMRDLLQAGAHFGHQTRFWNPKMRQYIFGARNKIHIINLEHTVPALNDALNFANQLASKKNKVLFVGTKRAASNIIREQAQRAGQPYVDHRWLGGMLTNWKTLRQSINRLKDLQTQSQDGTFAKLTKREALERTREMEKLERSLGGVKNMGGLPDALFVIDVDHEAIAIKEAKNLGIPVIGIVDTNSNPDNVDYVIPGNDDAIRAVTLYASAMADAILAGKEYAQSQANAQAKGDDAAKDASEA

SEQ ID NO: 4354 - protein, 276 aa, Acinetobacter baumannii
KISTVIVGINNNFFRLSMLALISPAKTLDYETALPTDEFTQPRLLEHSAQLIDVCRKLSASEIASLMSVSEKIATLNADRFRDWKPEFDFSNARQAIYAFKGDVYTGLDAYHLKDKDIDFAQQHLRMLSGLYGLLRPLDLMMPYRLEMGTKLKNTRGHNLYEFWDDIITNQINEDLAAIKSELLVNLASDEYYKSVNEKKIKAEIVKPVFLDQKNGKYKVISFYAKKARGLMARFIIENQLNKAEDLKAFNTEGYYFDADNSSAKELVFKRDEQQA

SEQ ID NO: 4355 - protein, 81 aa, Acinetobacter baumannii
MSTTSSATTPIEINALGQPCPMPLLMLKRELKKLSGKQLFLLKSSDPHSEIDVTRYCQLHHFTCQTMQISEREFHYLIETQ

SEQ ID NO: 4356 - protein, 301 aa, Acinetobacter baumannii
IMNTIDITNSLEKDKLVNTEQSQLTDTQLHHGTSYVSHFEPHASKKPNSTEIKISAQDAHVYYGDFEAIKGIDLDIYQNEVIAFIGPSGCGKSTFLRTLNRMNDTIDGCRVTGKITLDNKNIYDPNLDVVLLRAQVGMVFQKPNPFPKSIFDNVAYGPKLHGLARDKYDLEEIVENSLRKAGLWEEVKDRLNQPGTGLSGGQQQRLCIARTIAVSPEVILMDEPCSALDPIATAKVEELISELSDQYTIVIVTHSMQQAARVSDRTAYFHLGDLIEVNSTEKVFTQPDHQLTEAYITGRFG

SEQ ID NO: 4357 - protein, 74 aa, Acinetobacter baumannii
FFDTVSLMRIHITSYFFKHISSSSSQMILLNRHDNTMRGLNISINCKTDKLHGSYLFCQLANFGVSILVNYCLT

SEQ ID NO: 4358 - protein, 223 aa, Acinetobacter baumannii
IRGTDLDMIGQQRNILATLGIDVWIPRTQVCQKNNAHTLWRDQVVEPHESITVPTIDVPAFEQKNTQTQVLEIPKVVEEPSIVVAEVSQPEKLVEKPKVIEQETIAPFELQAYCLEKCVIFVDVTALETEEKQLWANIQKAKVGQYSELRWPFPLAAYQDQRGVGSYIQGFLDAVAAEKKILCLGKCTYIQHANIIHLASLKEMLDKPLLKKRLWQLMQDNNE

SEQ ID NO: 4359 - protein, 356 aa, Acinetobacter baumannii
CVCTRKCINRSVRVDLFHAMRVFNKVVETNSFSLAADSLGLPRASVTTTIQALEKHLQVRLLNRTTRKISLTPDGAVYYDRTARILADVADIESSFHDAERGPRGQLRIDVPVSIGRLILIPRLRDFHARYPDIDLVIGLNDRPVDLVGEAVDCAIRVGELKDSSLIARRIGTFQCATAASPIYLEKYGEPTSIEDLQKNHKAIHFFSSRTGRNFDWDFVVDDLIKSVSVRGRVSVNDGDAYIDLALQGFGIIQGPRYMLTNHLESGLLKEVLPRWTPAPMPISAVYLQNRHLSLKVKVFVDWVAELFAGCPLLGGTALPFDQKCEFACDKETGHEYTIRTLVEQHNIAEAYTLKT

SEQ ID NO: 4360 - protein, 399 aa, Acinetobacter baumannii
LACTAMRFDKTIKPKENIMLAYDADLELFRDNFKRFMNEHIAPHYDQWEREGIMPRSVWSQLGENGFLCVDVPEEYGGYGVPTYYSLMLVEESARAGFCALSTAISCHSEIAAPYILHIGTEEQKQYWLPKMVTGEVVGAIGMTEPGAGSDLQSMRTSAILQDDHYLLNGSKTFISNGQHADLVVLAVKTDPQARAKGVSLLLVDTHLEGFKKGTNLDKIGLHSQDTSELFFDNVKVPKNQLLGQAGQGFAYLMQELPRERTAIASTAVGAIRGAIDLATAYVKERHAFGQPISQFQNTRFVLAQAKIDELATTAFYERNVALYQEGKLDVETAAALKSFSTDMQMKVADNLLQLFGGYGYMTEYPISRFFVDARIQRIYGGTNEIMKEIVARGLIGKA

SEQ ID NO: 4361 - protein, 479 aa, Acinetobacter baumannii
FSRLNQKYRVNKIKPYIFYAFYFMKTELLSPAGSLKNMRYAFAYGADAVYAGQPRYSLRVRNNAFDHDNLKIGIDEAHALGKKFYVVVNIQPHNSKLKNFIRDLEPIVAMQPNALIMSDPGLIMMVREHFPEMQIHLSVQANAINWATVKFWKDYGLSRVILSRELSLEEIEEIQQHVPDIELEVFVHGALCMAYSGRCLLSGYMNKRDANQGACTNACRWDYKLHEAQEDVNGDVIPVTQLNTPEKPCCSSGQSETTSVQTLLVQRNDEEMFAAEEDEHGTYFMNSKDLRAVQHVDRLTKMGIASLKIEGRTKSYFYCARTAQIYRKAIDDALAGKPFDPSLMTQLEGLANRGYTEGFLRRHVHSEYQNYADGSSHFDYQQFCGEVVERRDNYIRIEVKNRFVVGDSLELMTPQGNITFNLTEMRDLKGNPITDAKGSGHFVEIPLSQDVDISYALLIRNLPHAKESITASTLAYSAS

SEQ ID NO: 4362 - protein, 77 aa, Acinetobacter baumannii
CKSTDDSGEFLMLVKINSNIYVLASDVISIKKNQRTGSDSYGKWFAYVKTDQNITGFEVPEDEVKILVQDINRFLEK

SEQ ID NO: 4363 - protein, 489 aa, Acinetobacter baumannii
IPATNTHSTSATKFHWSKMSMANKVLQLIQESGAKWVDFRFTDTKGKEQHVTYPADSIDEDTFEDGKMFDGSSIAGWKGIEASDMILRPDAETGFIDPFFAEPTVVVTCDVIEPSTGQGYERDPRSIARRAEEYLKSTGIGDTAFFGPEPEFFVFDEVKWDIDMSGARHTLIAEEAAWSTGKDYESGNSGHRPRVKGGYFPVPPVDSAQDMRAEMCAKIEDIMGPGRVEVHHHEVASCQLEIGVSFNTLVRKADEVQQFKYAVWNVAHQYAKTATFMPKPMVGDNGSGMHVHMSISKDGKNLFAGDEYAGLSEMALYFIGGIIKHARALNAITNPSTNSYKRLVPHFEAPIMLAYSARNRSASIRIPYVSNPKGKRIEARFPDPMMNPYLGFAALLMAGIDGIQNKIHPGEAADKNLYDLPPEEEAKIPTVAHSLDMALEALQADHEFLLKGGVFTKEMLDAYIELKTEDVRRLNTTTHPVEFDMYYSL

SEQ ID NO: 4364 - protein, 79 aa, Acinetobacter baumannii
TFETTDSYVNWFAFFQLNLWHVKSSRLWIRSGTPLRQITSEGQYFTHLQLISQVYNSDCNILTHIKGSFDDCFRLGNFL

SEQ ID NO: 4365 - protein, 677 aa, Acinetobacter baumannii
RERTVNENQPFDLVTHYQPAGDQPQAIEKLVNGIEKGFRNQLLLGVTGSGKTYTMANVIAQTQRPTIVMAHNKTLAAQLYGEFKAFFPNNAVEYFVSYYDYYQPEAYVPSSDTFIEKDAAINDHIDQMRLSATRALLERRDAIIVASVSAIYGLGDPNAYMQMLLHVVQGDRVSRDEIIRRLVEMQYTRNELEFLRGTYRIRGEIIDIFPAESDQHAIRIELFDDEVDSIRWFDPLTGKMVRKVPRVTIYPKSHYVTPKDNLTRAIDTIKDELQDQLKFFREHDKLLEAQRIEQRTRYDLEMMQQLGYTNGIENYSRHLSGRPAGEAPPTLFDYVPEDALLIIDESHVTVPQIGAMYKGDRSRKENLVNYGFRLPSALDNRPMKFEEWERIVPTTIFVSATPARYELEKSEQVVEQVVRPTGLIDPEIEVRPVLTQVDDVLSEINIRKNLNERVLVTTLTKRMAEDLTSYLKEYGVKVAYLHSDIDTVERVKIIHELRTGVFDVLVGINLLREGLDMPEVSLVAILDADKEGFLRSERSLIQTIGRAARNVKGKAILYADTITDSMRKAIDETERRRAKQIEFNEQHGITPRSAVRQAVKEIDTGEVLSDDQIDEKVLEQAQALSADERHILSDPKLFSKHITKLEKEMLKASKDLQFEQAARIRDEIVRLKAQMLQ

SEQ ID NO: 4366 - protein, 156 aa, Acinetobacter baumannii
TRRTRSMKSIGEWFDEYSESHQNPINKKIHWVCVPAILFSIIGIIAHFSALLTALLVVLTLIFYARLDLVLAVAMAALLVVMAWLIYVLPVGVGFYIALFVFAWIGQFYGHKVEGKKPSFFKDLQFLLIGPVWCMDAYLAKILPHWKSRQKKLIAQ

SEQ ID NO: 4367 - protein, 364 aa, Acinetobacter baumannii
KRATEPSVMQAIEKRNSLFNSLTQAVFDKNMANFWLQKINPLWSVQHGLVQIVKKEFVAHDTVSLTLKCNRLVKMGAAGQHHPVIVEIAGRRYERTYSLTQIDAEHLRLTVKKVADGIVSNWFIAESKIGDVFELGQPYGDMQENIQTPKLIMLAAGSGITPMLSLITAIKQSQQLEKTQVQLLYWVKQRSDAAFTEYFEQVAEQNPNFSYQVFYTQETPNDERLNAEHLALVDGIENSTVYACGPSGFVSTVEQLFEKAPTVLTEAFSLTNESSADDIGYVNVTLTQSNKVIAIPKGQSILVSLEHEGLKPTHGCRMGICNKCVCSKTQGSTRNLLNGSQNTEPSQLLKICVNSAQSDLVIDL

SEQ ID NO: 4368 - protein, 439 aa, Acinetobacter baumannii
IFKTSISMSLSPKQEQLFKQASKHIPGGVNSPVRAFNGVGGTPVFIEKAKGAYLWDVDGKRYVDYVGSWGPMILGHAHPDIIKAVQTAAEDGLSFGAPTVHETTLADIICEIMPSIELVRMTNSGTEATMTAIRLARGYTGRDKIVKFEGCYHGHSDSLLVKAGSGLLTKGEGEPTSKGVPADFAKHTLTLPYNDIPALKECFAKFGHEIAGVIIEPVAGNMNMVKPIDGFLQAIRDVCDEYKSVFIIDEVMTGFRVALGGAQSVYNVKPDLTTLGKIIGAGLPVGAFGGKREIMECIAPLGGVYQAGTLSGNPLAMRAGIEMFKHLRQPDFYSKLSAQLEKLLAGLQAAADEAGIPFKTQQAGAMFGLYFTDQEDITSFDSMLACDIEAFKKFFHGMLKRGVNLAPSAFEAGFISSAHSDEDIEFTIQAAKETFAEMK

SEQ ID NO: 4369 - protein, 614 aa, Acinetobacter baumannii
MKKTFDLYQTAQVLLASTSFLLAMSTHAYTWKLDDISTSTKYTVEPHFFYIGKGAEWQNIQFSSDYSTENDTTVLVKYDDKLIYNTTLNGDGQFKFNIPASQSGFHRLDFIIQQYAKPTTLNQTKETFCTEDIDHLTYLSNSQLDFTPIRNEYRLKDLPDALFNPQARRPTPFVGILKYNRKEITEASMLGRLVSSWSSVTPIEWVDSGQTNLNPETNFIIEVIRSASPLKGGALVQIAKPAEGVPTLSITYHTPQELTAAINGLINPTYVQQLDTGSAIFPTTISAPAWAQFKKIDTLADLGIQDFRLNHAEKNLFLDFPAVWQPTDILQGQIALRIQSGLLQGSNITAWIDGGLAGSMKTADLASDPVNRQFNIFAKEISNTTNFSLKLENSVIANSQCLPNAHGSLWVDTAKSTVKLPHKLKNGVAALSMTLATKPTIAIDDQSGALNIAIILGQVAKNMLLTQAPMPVNLVRFSPTSPQAVNVRVNKEIYQQQVLMHQNIIYAPAAANGFIVSYNNNRFDVITDSENGAQTFMHLWGKIQHKIPNNVTKMLVSENGNIYVLQKLIVGNQKAPLVQQSSFFLLVVIISAIMIIVIFLWYWLRRNNEKTDTN

SEQ ID NO: 4370 - protein, 219 aa, Acinetobacter baumannii
NMYATSETNKTIKNLALFDFDGTLCSKDSFTGFIFYALSKRHIVKQGLKILPWIQAYYLNFYPAHAMRAKLFRSMFRDTPAIELQRLGEEYAQELVSALSPEIFAQLQQHQLLGDQVVLVSASIDIYLAPLCKLLDIELICTETQIKNGMMTGYYSTPDCSSEQKKLRIHEQYSLKHYQRIYAYGNSSEDLDMLSLATHPFMVGEDRILPSLTPQKKLA

SEQ ID NO: 4371 - protein, 923 aa, Acinetobacter baumannii
CMDAAKWYSICCIFLFKTTEDKTLMLVKPSFKKRLLLTTLLSLSATQIFASNNSEQIPIGKLPEWVVPESYDLDFKIDPAQKGYTGKTTIHLKLAQATDHIWIHGKSLTVKDVNIISAEGAKTKAKYEQASEVDGVSKIKFAKTLPAGQYQLVLDFNAAYDQQLDGIYKIEFEGKPYVMTQMEAISARQSFPSFDEPRFKTPFNIRLTIPSKYSGFANTQQTSEQAEKSGWKTLSFAQTKPLPTYLLALAVGPWQLQKGPDIGATSWRKQPIQLRGIAPDAKAEKMQHALSETPAILKILEDYFAFGYPFDKLDLLAAPDFAAGAMENPGLITFRDYLMLLDKDSPVSFVQNSFNVNAHELAHQWFGDVVTMPWWDDLWLNESFATWMQSKITQKLHPEFNADLERIADTADAMKSDSLVSVRRIRQPILSNADIQTAFDGITYQKGAAVLNMFESYLGEEKFKQGVRNYINKHQYGNATANDLISALAEQSGQGERFARGMKSFLDQPGVPLINTSLQQEGNKVFLNVKQSRYLPVGSKGDARSLWGVPLCVRYEVPNAASKVQCELVDQAESKIELKGASLGSWYIPNANAAGYYQFSLPQKEFTRLTAATEKLSNTEQLAYAYAISAAFNHGDINLLAVVDAAKKFANSDSRQISTALFSQLSTIHRHVLKTEAEREYFRKVLANLYLPKLNQLGYVSKTGESAEDSLWRSELVRFLALDIQVSEVRTQLLKQSDALFAQKQLNFAQVTPELLPTILAVRVQEKGQPAFDRLSGELQRVTQPTQRLAILTALGSANQEATRQQARQLILNPRVKVGEVRTVVNSINNYGDEQGGLWSWFKVNHDAVFDRLGKSSAGRFPAMFSGAACSQQQAAQLNDFFAPRTKELVGVERGLKQTKERIQLCESLVAKQDGSIVQQLKL

SEQ ID NO: 4372 - protein, 385 aa, Acinetobacter baumannii
KGYLAHMLYIWMPETNGVWHWSNGENWLQAASLDQLIQDLQIHQGKEATVFFPSRHAQMLQQTMAKSHYKQLGADGVKYLLEEFVTLPIDHMKVVHHFHADQLTVLGVAQGMVETWQHSLALLPTKLVALLPDFLVLPEPQAQQVILCNIDHQLLVRENKWLGNSIDDLGLFLEFQSAETHYQYSGLTAEQLESLEAASSAEQRSEFVYQFQPLDKTKQHPFNVLPKSKGQERTFSNYWKACAAVVLAIIVVQFSYDLLRWVKLKKVADQTAEQAIEQYKYWFGPSSRVTEQNIKGQFESHLRMSQQGDTQALSLLSRVGPILMQRQILAQQLNYDASILTMALKAKSADDLQALTQQLNQQGFKAELGNVQADGSGAIGVVKIQ

SEQ ID NO: 4373 - protein, 814 aa, Acinetobacter baumannii
QAIASLTHCLGFYLIYMKFERGIGFFALIFSILVIGAFIALSIYLIRLDNIIREKFEGQRWDIPAKVFARPLEIYNNAPITQANFTQELKLLGYKTSSNYDKSGTYVAQGSNMYVHTRGFDYGDSVEPEQVLELSFANDQVVEVRSTKPSSTGVARLEPLLIGGIYPQHNEDRVLIKLNSVPKPLIEALISTEDRNFYHHHGISIRGTARALVSNVTGGRRQGGSTLTQQLVKNFYLTPERTLKRKVNEALMALLIELHYSKDEILEAYLNEVNLGQNGNYSINGYGLASQFYFGLPLRELNVAQQAYLVGLVQGPSLYNPWKNPEGAKNRRDTVLNNMRVMGYLTQAEYETEIARPLNVLSKPSLGPAKFPDFLDIVRRQLRTEYQESDLTNQGLRIFTTLDPIAQTQVQNAFKASVERLANSNPARLKNLQGAVLIAHPENGELIAAVGSTQDFTGFNRALDAKRQVGSLLKPVIYLSAIESGRYNWASQIEDAPISVPVDGGKSWTPKNYSGGGHGIVSLSEALANSYNLSAVRLGQEFGLSTFTNNLRKFGVESTIPAYPSIFLGAVNMSPMEVLGIYENFATGGFKYPTRAIRSVVDANGRLLDRYGLNVQQTIDPSVGYIMNYGLQQVMSSGTGRAAYNSLSPALKLAGKSGTTNDTRDSWFAGYSGNHVAVVWLGLDDNKVTGLTGSSGALPVWINVMKQLRQTPVNLRQPDSVQWQWIDRASGDLSAQACDGAMYIPMLAHTVPHRATPCGAPYYQVDPTYTPQSDNTIPESQDDNTDSYIRESENQMEQDLSNNTRIISSGSYNN

SEQ ID NO: 4374 - protein, 355 aa, Acinetobacter baumannii
IILAIHINTSPRYSGIHMQSLSNRQSLIASYILMGIFLLSVIPLHLLASFFAGFLIYEIIISLSSIVERYIDGQRARIFISILLSIITISLLAFFITSLISFVVYDLKGVGLHSINGKVDQTLLHLQAEIGKYLPGYIPDSVTELKDEIFAFMKDNVTTLKNASSDILHNLVTMVMGLIIGILVAIHGFHRRTPQPVFKSLLIQRIQKLSISFRNVVFAQIKISAINTLLFILFAFVLLPIWGVHLPFAKTLTILTFMFGLIPILGNLISNTLTFIAALTISLGLAGVALLYLVLVHKLEYFINAKIIGHKINANAWEILLAMLIFESIFGLSGLIAAPIFYAYLKLELKDARLI

SEQ ID NO: 4375 - protein, 115 aa, Acinetobacter baumannii
IKIAIATSTIGLGIFLLTKIFHKCKQILSIYKIFKISLTDLFDNDYHLNRSRIYHGAQQMNAPFSLFTRNTDSAHALPMLHSNNLFALGREIRIMHAGEEYRLRLTRNNRLILTK

SEQ ID NO: 4376 - protein, 71 aa, Acinetobacter baumannii
LMTAREQGVVKWFNDTKGFGFIQRNGGDDVFVHFRAIVGDGHRSLRDGQRVEFSVVQGQKGFQAENVQPLD

SEQ ID NO: 4377 - protein, 424 aa, Acinetobacter baumannii
KTKAQQKWNLREDIPMKMKLLMTSVLSTSLFLVACGGGSSDDGPAPTNPSGTPTNNIQNPVVKVEAYTSTNLGSVAAESSILTYKMLGQSGQEVQATSLVFTPNTPPPVGGWPIVVWAHGTTGVADACAPSKAALADSTKDLISKLLVAGYVVVAPDYEGLGTPGIHPFLNVKSEAFSITDAVVAARNYLSQRNLLTSKKWVTVGHSQGGHAALGAAQYASRAQLDYKGTVAVAPASNLRSILVDGEAQVANAPIDIKIGTYAQLDTYTALVTAGIRNTQPSFDYGQVFTSQISSIAQQAETICSGPLGQAFGAGMTKYATEHNGTLDGYTRTQPNFMAVPLVKTFLDKDSQPLQVKVTTPIIIYQGIADSTVPKLATDLLISNATAVGTKINSYVTGNWDHGTAMSSNVDNIVGNVQTLLSAQ

SEQ ID NO: 4378 - protein, 295 aa, Acinetobacter baumannii
LTMATIDLPDNLVQTLSLVLNQLQQVLPEPKQETDFTAPAFRWENQQLKAIYTPKNIYLDDLKGIERQKEKIIQNTLQFLNGLPANDVLLTGSRGTGKSSIVRALLTEYAPQGLRLIEIERDDLADLPKIQKIIQNRPEKYIVYCDDLAFNAEDENYRSLKSVLDGSLQSGSTNFIIYATSNRRHLLPEFMHENTPVTKVDVPQYTELHPQEAIEEKISLSDRFGLWLSFYPMDQNLYLEIVEHYLDKANMPFNDEVRAESLRWCQMRGQRSGRAAYQFSKHWIGLNALKDLSNN

SEQ ID NO: 4379 - protein, 83 aa, Acinetobacter baumannii
LVMATYIEKLQDPKTVQKLESLLGGHIMSVYRNAGFNPPVPVSHGGRFIYADPPPEKYARHLHEGMKLFAQALDELAEKRWRE

SEQ ID NO: 4380 - protein, 246 aa, Acinetobacter baumannii
FCKAYPMNRFFIETELTVGSTIQLTESVFHHWVRVLRAQLQEQAILFNGQGGEYLATLTEINKKNAFVTIENFNPVNRNAPFKAILGQVMSKGDRMDYAIQKATELGVSKIQLLTSERCEMRLKYDRDQKKLDHWQAVAIAACEQCGLNLVPEVLAPIALHEWLNSSDLPTSKFVLAPEKEQKDVLAGIQPELALLIGPEGGLSENEITQANQAGFMNWCIGDRVLRTETAPVVALSILNYRFLSI

SEQ ID NO: 4381 - protein, 466 aa, Acinetobacter baumannii
TIHFVVQIKISFSSGGRRMSSNINLNAKKATEIKLFSFSTPAMRAFHMTWLAFFVCFFAWFACAPLMPVIKGEFGLTKDQIANINIAAVAITILVRLAVGPLCDKYGPRITYTTLLLLGSIPVFGVAAANSYESFLFFRLLIGAIGASFVITQYHTSIMFAPNVVGTANAAAAGWGNAGGGATQALMPLLLGAIVMFGVEQTMGWRVALIVPGVMMVIVGVLYWKLTQDCPQGNFKEVRAQGIEVGSGKKGGMAILMQAARNYRVWILFLAYGACFGIEIFIHNVAAMYYVDQFKMDLKTAGLTAGIFGLLALFARALGGIISDKVALKKGLDGRTKVLVLMILGEGLFLILFSQMNVVALAIISMTIFALFTHMACGATYALVPFIDRNALGGVAGIIGAGGNVGAVAAGFLLKGVLDLQTCLFILGGLVMVAGCSVILIRFTTEHKEKEKILFEQALLERNSAA

SEQ ID NO: 4382 - protein, 486 aa, Acinetobacter baumannii
GGHLVITSKQNWLLSSLMGSLLLAGCSLAPEYQPAKVIVPVKFKESDPKLEDNNWKIAQPADQQTRGEWWRIYNDAQLNELEQQAIAGNQNLKAVAANIQASRALRSAAQAERLPSIDAGFGPTRQKPSPASLGLDDNTHTSAQTLWRAQANVSYELDLFGRVASSVNAATADLQQQEALYQSALLALQADVAQGYFLIRQLDTEQAIYNRTIKLLGETRDLMQLRFKNGLVSELDVSRAQTELATAQTTALNIARNRASAEHALAVLLGKPPADFNLAVQPLTANSIRLPAGLPSTLLERRPDIAAAERAMAADNARIGIARAAFFPKLSLTGALGYESSSLSELGKWSSRTFLLGPVAGTILSLPLFDGGQRKAGVAQARAAYEESVANYRQTVLNAFREVENGLSDQRILDQQIQAQNQALSSSRHANQLSHLRYREGAISYLDVIDSDRTILQQEQLAAQLKGNQIIASINLIRALGGGWSS

SEQ ID NO: 4383 - protein, 197 aa, Acinetobacter baumannii
VLFYFILLLNFLLILLMAKNIRPYLDHHPQIDPSCYIDEMSVVVGDVKLAENVSVWPFAVIRGDVNSIQIGKNSNVQDHCMLHVSHKNDAKPNGSPLIIGEDVTVGHHVTLHGCTIGNRVLVGINTVILDDVVIEDDVMIGAGSLVPPRKVLKSGYLYVGSPVQQVRPLTEKELAFLPYSARHYVKVQNNHKDNQIN

SEQ ID NO: 4384 - protein, 64 aa, Acinetobacter baumannii
KPFYMKGLFSHCYRPHHIRLSRKMMSNHLMNENYGDCYRKYGGVVNMLKLNNHAHPMVNNFLNF

SEQ ID NO: 4385 - protein, 218 aa, Acinetobacter baumannii
RLIYKMIEKEFKVKHYIALGLLFIAIIISGIQPLEFEAYLLHQAGTVFMVILLFIIFKKIGLDFLSFTFYLLFLLIHIIGAHYLYSYVPYNDWIQQVFHFNLDQYMGWSRNMYDRLVHLAYGVLLYPLIYRVFQVWLPTARPFSLFLLVVQFVMASSVFYELIEWAIAIGLSPEQAENYNGQQGDMWDAHKDMLLATIGAILYGLIALLTTPKNQTIN

SEQ ID NO: 4386 - protein, 222 aa, Acinetobacter baumannii
NSTYVLLFSGSSMSEQIFIQGPVGKIELFVDRPEGEIKGFAVVCHPHPLQGGTPQHKVPALLTQIFNEYGCIVYRPSFRGLGGSEGVHDEGHGETEDILAVIEHVRKLHAGLPFYAGGFSFGSHVLAKCHAQLSPELQPVQLILCGLPTATVVGLRHYKTPEIQGDILLIHGEQDDITLLSDAIEWAKPQKHPITILPGANHFFTGYLKQLRQIITRFIIMK

SEQ ID NO: 4387 - protein, 143 aa, Acinetobacter baumannii
HLNFQAPMLHQGLDFSFSGLKTAVSVQLKKLNGENRDADIAASFQEAIVDTLVKKSVKALKQTGLKRLVIAGGVSANLRLREQLETSLAKIKAQVYYAEPALCTDNGAMIAFAGYQRLKAGQHDGLAVTTTPRWPMTELTIPE

SEQ ID NO: 4388 - protein, 315 aa, Acinetobacter baumannii
CENFMTDALVLRDLSKTYRNGFQALKGINLTVPEGEFYALLGPNGAGKSTTIGIISSLTKKTSGTVEIFGHNLDTHPSLAKQQLGVVPQEFNFGQFEKAFDILVTQAGYYGIHRKIAEKRAEHYLEKLGLWEKRNIQARMLSGGMKRRLMIARAMMHEPKLLILDEPTAGVDIELRRSMWDFLTEMNENGTSIILTTHYLEEAEMLCRQIAIIDRGVIKEDTSMKSFLNQLSEESFIFDLAEPIAPLQLNIIGVKFNLIDSSTLEVTMDKAHTLNDLFQLLESQGIRVRSMRNKSNRLEELFVKMVEKNLEGAAK

SEQ ID NO: 4389 - protein, 72 aa, Acinetobacter baumannii
RGSYKLGLLSRAKIAAYCSMNFIIKQNEVSSVLNKNGSSFIKNEPLFINQLKSSFKAYILNLSIVNFSLQQY

SEQ ID NO: 4390 - protein, 105 aa, Acinetobacter baumannii
SMKYKALSEAEVLAVLAEGELDASDLLYTANPNFEKRFKRLNTALAKLLDEVREYFPNAQYYCPSDAMVLLLGSSHADKDGQPHQQELVAANSDALSGRISGGDW

SEQ ID NO: 4391 - protein, 514 aa, Acinetobacter baumannii
IMKYDFEQSDKAFFGHPKPLQTLFFTELWERFSYYGIRPLLVLYMIAMVNDGGLALDRPTAAAIVGLFAGSMYLMTVFGGWVADNWLSQARAVWYGSIIIALGHLSIALTSVFDQSFFYLGLVLIVLGTGLFKTCISVIVGTLYKANDARRDAGFSIFYMGINMGSFIAPLITGLLAKDHGWHLGFGIGGIGMLIALLIFRFMAMPQLQTFNELRQEANSCSKPVVENKNAPKIVFSFLFAVAVVIALTFLGIIHINPVAVATYLTVGISIGIIAYFAYLLLFLNLEQHEKFKIIICFVLLAASALFWSAFEQKPTTFTLFAQDYTDRIVFGFEIPTVWFESINALFIIIFAPVAAWLWAKLGKANKDPSYISKFIIALLFAAGGFLLMSLASHFAIHGRVVSPFWLVGTLFLLTIGELCLSPIGLSTMTKLAPDVIRSQIMGLWFTGTALGNLMAGLIGGQVSADGINHLPSLFMRCVLALVIGAIVLFLLKKPMNKLMDKSTNKVQPDLETI

SEQ ID NO: 4392 - protein, 429 aa, Acinetobacter baumannii
FYRYIDIIRYIFYNDLSHSYNFLLTMTKTSHQFSQSLIYMLIGSAIILALSLGVRHGFGLYLVPMSHEFGWGQHVFSLAIAMQNLIWGAIQPFTGAIADKYGSKVVVTVGGLLYTLGLLLMAFSSSVLILNLSLGLIIGLALSATSFTVLLSAVGRAAPPEKRSMAMGIASAAGSFGQFIMLPSTLLLLKTVGWSSALMVSALLIALIIPLAWMLKGPSNQTPKAIAQPQLTFKQVLHIARKHKPFWWLALGFLVCGFQVVFLGVHLPGYLIDHGFDATTGTVFLALVGLFNIVGTYGAGWLGDRFSKPKLLMALYGSRGIAIIAFLLLPLSTYTVYAFGIIMGLLWLSTVPLTNGIVANMFGVKYLSMLSGIVFFTHQVGSFFGGWLGGVNHDLTGNYNAIWLCSIALSILGVIVHFFVNEEAVIHDA

SEQ ID NO: 4393 - protein, 162 aa, Acinetobacter baumannii
FWRYTSMLKKLALAALLAAGSSVAMADNDVGCGVGTQVWAGQKGVVPKILAATTNGIFTNQLLGITFGTLGCRQGGTVTAQVVTFTNENAEALARDMAVGQGESLNVLAELMQIKPQDKDRFFKVSKANFGEIYSTNNQNTLQVLASLQNVMAKDEVLKAYV

SEQ ID NO: 4394 - protein, 368 aa, Acinetobacter baumannii
ERTLMNMPVKVEYFKNPKNRDLTPAELEAFAKELDQIKQEVLDDLGEKDAKYIRRVYAAIRYSSFLGRACLFAGWFPPAWILGTGLLGFSKIMENMELGHNVMHGQYDWMNDPKFNGQTYEWDTVGTSDNWRQTHNYKHHTYTNIKGIDDDIGYGLLRLFPEQRWKPGFLLQPIYSIPFCLLFQWGVAIQNLEIGRVLYKRKTKAQFLEELKPVNKKIGKQLFKDYVFFPLIAGPAALPVFTGNLVANGLRNIWTFSIIFCGHFTKDAEVFPKSVLQEESRGHWYMRQIRGSSNLTGSEAFHILSGHLSHQIEHHLFPDIPARRYRQMAPKVEAVCKKYGLNYNNASFVKQFGQVVGRIVKYAFPFKK

SEQ ID NO: 4395 - protein, 343 aa, Acinetobacter baumannii
IYMYIGPYQLSNNLIVAPMAGVTDRPFRTLCKYFGAGHAVSEMMTADKTLRMTKKSLYRANFDGELAPISAQIAGSDPEQLAEAARYQVANGAQIVDINMGCPAKKVCNKLAGSALLQDEDLVARILDAVVAAVDVPVTLKTRLGFLNGQENILRVAKRAEEAGIAALALHGRTREDMYLNTARYELIKHVKELIHIPVIANGDIDSPEKAKYVLDYTGADAIMIGRAAQGRPWIFREIAHYLKTGEHLAAPNIEEVKEVLLGHLSELYQFYGEYSGCRIARKHIAWYTKGLRSSNEFRQNMYKVETTAEQALVVESYFNQLLAEGNLMSDVQVEQVNLLDTH

SEQ ID NO: 4396 - protein, 488 aa, Acinetobacter baumannii
IDMYKYKKVSDDLTLQIQNGRQPVGSRLPSIRDCAQHYQVSINTVKEAYRKLEDQGLISVRPQSGYYVCHAPSNLPDLEERYISEEKVPLSGISCFLAQIVKKQMDPDYVNLALACPSGENFYPIERLKRLTAQVLRTQPDIFKSYTLPPGSIRLRTQIARRSLQLGMFLSADDIVLTHGTMEALSLAIMATTQAGDSIALEIPTFHNLYPLLQNLGRKIVEVPTSPHTGMCLDALEELLKSQSVQAILTIPTGHNPLGFSMPENNRRRLAELANQFQIPVIEDAMYAELQLTEPLLPNIKAFDQNGWVLACGSYTKTVAPDYRIGWLEAGRFRNIVQQLKFTTTVAEPALLTETLGLFLENGGYDLHLRQLKKRYQQQIDTIKSYICRYFPVGTRVSRPQAGFILWLELPESIDTLELFHQAMDEKILCMPGILCSADKRFSHCLRIAACFELNPKMLNALMRLGELAKNMLPVQKDIDQIPTNSVG

SEQ ID NO: 4397 - protein, 60 aa, Acinetobacter baumannii
IFFHLVATLHHNFYKILISVYNIKITHLTKKFQEYASFYLFRHIIRCTHAFTQCFRISCS

SEQ ID NO: 4398 - protein, 419 aa, Acinetobacter baumannii
CVFQYFYILIFKKKYYRICLKKINVRGDIQMMQTQISVEQNLDHIGQKKFSCFSTKNYYLEVSEFIKTLNTPAANTTLLNEEIAKCFEEIKKQGHQNPVLIGAIPFDITKKSSLNSYANHKKITQASSTINSLKNRNNIEIINKSLLIQRQKFEGTVQLALDAFEKKKVEKVVLSQAVEYEFNRHQEPENLLAALLKQNPNAYNFVIPVEHNNYILGASPELLLSKQGRIVTSNPLAGSRPKSKISEKNFVSQQELNHSEKDQHEHRIVVENIIRNLATHCVELKVSEFPDILETSTMLHLSSEFQGVLKQQAPDALNLALELHPTPAVCGSPTHVAKQFILDHEGYDRHYYTGLVGWMDAEGNGEWVVTIRCGLLSENKMRLYAGAGIVEGSDAEAEWLETEAKMQTMLNILNTKIAV

SEQ ID NO: 4399 - protein, 178 aa, Acinetobacter baumannii
TIVQNHSHNHSHHSHGILRIKKMEKYLRLLNPKTTNYDAIPSGNHGALTAADVCIAMSYAKLTPLQDNLFRLKYLGANNIENVELFSKLLLTKYQAKFIQAGVNAVSHQPTVRVALVEFCLVSADYKPTERNREIIFGFSDTTVRNHMKSHIDNVLADLKQACELGVEKIFWQINKTN

SEQ ID NO: 4400 - protein, 128 aa, Acinetobacter baumannii
VMSQKINATDITEEEALNAVFFERADEFIKQANDFCRPPKGQKPDPAELRGQVSAAMLFATARFNTWVAANNFKDGNEMRDAKDQVMSYLLQQFQMMLEDNFDEYCEQFDNYLRFRKNEDFHTHKHDH

SEQ ID NO: 4401 - protein, 944 aa, Acinetobacter baumannii
KSAQISYYSHTTIDFLLFKLIGIYMFMQFKQLTLSLCIFGLSAASFAQTTLVKSKQNVEEYKLDNGFRVVLAPNDKENKIFINTIYLTGSLNDPQGKSGLAHLLEHLAFKGTQNVKGEEFQRRLDQYTLMTNASTDYYSTKYTNIVRPEKTALDQVLYLESERMDKLVLQEKFVPSEIEIVKREREVRMDQPFAVLMDQMWKSAYGNQYLGRLPIGDLPELKSIKMPELNQFYRSWYAPNNAVMVISGKFDKTDVLKTIDQYFSPIPARAVPKPVQVPVLDSTKLKNREFVVKKGSDLAKFHIYMDGKNTKIQPELAFAPMLYTMQPSGHLYQNMVETGVSTDVQASTWLDQDFNVVFLGAIYSPKNDPKKVESALLSGIEKGKPFTETELNRVKSLMKTQGELVNKDAVALGSRLSDYTVADGQWDQYFKDLDSIDKVKLNEVNQTLKQFLVAGHRIDGDILPTPEDQKKALQLDAKDKPKTLDQTDVKAEPLKDPKVYQQEVAEFLKTSKQYAESNEKKIIRGKLKNGMKYALFPVETRDDRTYATITMDFGTEKSLFDKGTVVDLTSYLLLRGSDKYSLQDIADKSIDAGGAAYASADGNGMTINIQSKTEKFDEFFKFVLEVMKNPKFEQSQFDLIKSQSLSSLDRPYTEPDVVAGLTLSRLVEEYQPGDLRYHFEPELAKKQLKNVTQEQVKELYQHFFAMNHAQIAITGAFDAQKMKKLLNQEFGSWNSKQPYEKILIQHVDFPAQQVHVLSEQREFGSYQSVLALPVGKNHPDASALILMNYILGESQISSRLAQELREKNALVYGFGTGLQLDRDTNVGALSISANYTAGRSAQVSASVHKVLNDLITHGITEQELAAAKADIMKKRVTALEDERNIHGMLNLELESGKTLLDRVKHDQELTKLTVADVNAVIKKYIKPSNLVEVMADQYGQAQKQ

SEQ ID NO: 4402 - protein, 768 aa, Acinetobacter baumannii
KMNQNIKGLSMNNVSDNRNFKSGNDQRINHRSFVLNGVASAQMALRLGYALGTVFVLCASNTYAAVIDNSTKTLEQQQAAQTNVAALPAITVKAEQDDTYAGGQVATSSNVGFLGSKKFLDTPFNTISYTDKYIEDKQAKDITEVIAATDPSIYTNGASGGWSENYYIRGYASSTNDMSMNGLFGITPFYRTSPEMFSRVEVLKGPSALLNGMPPAGSVGGTVNLVTKYAADEPFARLTTTYMSDAQFGGHVDVGRRFGENKEFGVRINGMYRDGDAAVNDQSKESRLFSLGLDWQGERARVFVDAYDALDHVDGVTRGVNVSTAVGIPKPPKADTLLSPDWGSVETKDKGAMIRGEYDFSDQLMAYAAYGQSTTQYKYNGASAGTITSSTGTLSSMLGQLTFEVDKKSADAGFKGKFETGPVKHQWVANATYYNHAQDDYGYRIIPGFSDPVITNIYDPNPNWGPKPEFTPPFLFHSTLSTSSFGLADTLSFAQDKVQLTLGLRHQTVKATSSVNTLPENAKSATTPGVALLIKATDKISVYANYIEGLTKGDQAPATASNPGEIFPPQKTKQQELGLKVDLGTFAHTLSAFEITKPSSYLDPSKLVNNLPTFVSDGEQRNRGIEWSFFGSPIEHVRLMGGFTYLDPELTKTKSGGNDGHTAVAVPKNQAKLGAEWDTQVAQGTLTLSGNINAVSKQYINAENTLSVPGRTLLDVGARYSTKVEDHPVTFRANIYNLTNKAYWAQPQLTNLALGAPRTYMLSVSYDF

SEQ ID NO: 4403 - protein, 136 aa, Acinetobacter baumannii
CFDQIKIRKMIVNAPVIFNHETQPEFELPIKNYQEFYRFYLTEHRNIMSRRLHAVGSSIGLYFFSKAIRKKQAKYALYGLVSGYACAWVGHFMFEKNKPASFKQPLYSFISDWRMLSDVATGRLSLIDRKHDKIPS

SEQ ID NO: 4404 - protein, 377 aa, Acinetobacter baumannii
LICHIFYSQCSYRRAYKHSTKSDVQPIALMRENRMRLNPRQIAIALAVTGAAVTTTANAARDTIQIAGSSTVLPFASVVAEEFGNTFPQFKTPVVGSGGSSAGLKQFCQGVGDNTIDVANASRKIKSTEIEACNKAGVKQIQEIKIGYDGIVFASSSSKAAYKLKPYHVFAALAAQLPSKGKLVPNPYTNWNQIDKSLPNEPITLVIPASNHGTREVFQEKMVEAGCEAYEYFKSLDKDAQKKACSTFRKDGRVIEIAGDYTETLARLKTSPSAVGVFGLSFYDMNRDKLRVATVNNVVPSEKTVLNGTYPVSRPLYFYVKGEHLKSVKGLPKYVEYFLSKKATGKGSKAERDGLIAMSDAERAKVLADFKAGKTVK

SEQ ID NO: 4405 - protein, 109 aa, Acinetobacter baumannii
SGYHSRRIKMNFKFAKNGTVIIAKIIKMTVLSQKEILLSPKNWSRIATLWQRLQQSFRLMVGVPDYQTYLEHMKAHHPDLTPMDAQTFYRHCVDARYPSAGGTLKKCPC

SEQ ID NO: 4406 - protein, 763 aa, Acinetobacter baumannii
ALGQKLGPQNSIQRKGLYMAGEKSTIIYTLTDEAPLLATYSLLPIIETFTKPAGIEIVKSDISVAARVLAEFADYLSEEQKVSDNLAELGRLTQDPDTNIIKLPNISASVAQLTACIKELQSKGYAIPDYPENPATEEEKTIKARYGKCLGSAVNPVLREGNSDRRAPAAVKNYAKKHPHSMSEWKQWSQTHVSHMEEGDFYHGEKSMTLDRPRNVKMELITNSGKSIVLKPKVALQEGEIIDSMFMSKKALCDFYEKQLDDCREAGILFSLHVKATMMKVSHPIVFGHCVKIYYKEAFEKHGKLFDELGINVNNGMAGLYEKIETLPTSLREEIIEDLHACQEHRPALAMVDSAKGITNFHSPNDIIVDASMPAMIRAGGKMWGADGKQYDAKAVMPESTFARIYQEMINFCKWHGNFDPKTMGTVPNVGLMAQKAEEYGSHDKTFEIPEAGIANITDLDTGEVLLTQNVEEGDIWRMCQVKDAPIRDWVKLAVTRARNSGMPAIFWLDPYRPHENELIKKVQKYLKDHDTTGLDIQIMSQVRAMRYTLERVVRGLDTISVTGNILRDYLTDLFPIMELGTSAKMLSIVPLMAGGGMYETGAGGSAPKHVQQLVEENHLRWDSLGEFLALAVSLEEMGIKENNARAKLLAKTLDEATGKLLDNDKSPSRRTGELDNRGSHFYLSLYWAEALAAQNEDAELKAKFAPLAKALAENEQKIVAELAQVQGKPADIGGYYAVDPAKVSAVMRPSATFNAALSTVQA

SEQ ID NO: 4407 - protein, 235 aa, Acinetobacter baumannii
FLPQWKTVLNAVVSFRAEKLSFKARMTPFDMRASFLRFGTMTSRPPQRAKRPCLVGSCKDFASNKGYCDQHQNRIKQKDRERGTAHQRGYDARWEKERTKFLDENPLCADHRKRGLVEAATVVDHIVPHKGDQVLFWDKNNWQPLCKSCHDRKTATEYKGGWSYQRPVTQKPVDCYVFKVGEMVQAATAYAIDTLSCGWTDSFEIKSIEDKKIEVHDADGFVHKLHHSHFKAVTA

SEQ ID NO: 4408 - protein, 475 aa, Acinetobacter baumannii
KMTQAIIWSLGMNIPLIINIVVFVGLIFLLAQTRKTDWSLSKKVLAGLILGVVFGLGLHLIYGGGHPILAESISWFNIVGNGYVKLLQMVVMPLVFVSILGAVAKLHQASSLGKISFYTIGTLLFTTLIAALVGVFVTNLFGLTAKGLVQGAAETARLTAIQTDYVGKVTDLSVPQFILSFIPSNPFAELTGANPTSIISVVIFAVFLGIAALNLMKDDAEKGQRILTAIQTLQSWVMKLVRLVMTLTPYGVFALMTKVVASSNVADILNLGGFLVASYLGLAIMFVVHAIILTVTGVSPLKFFKKVAPVLTFAFTSRSSAASIPLSIEAQTRRLGVPESIASFSASFGATIGQNGCAGLYPAMLAVMVAPTMGINTLDPMWIASLVGIVTLSSIGVAGVGGGATFAALIVLPAMGLPVTLVALLISIEPLIDMGRTALNVNGSMTAGVVTSQFMGQTDKAIMNSEDEIELTQHH

SEQ ID NO: 4409 - protein, 244 aa, Acinetobacter baumannii
VNKHQYNMFCLPPAGSSASIYHPWKKQISDNIRIIPIEYSGHGIKINEPLIDDPDLLAMQIANEIQAYSDKPFILFGHSVGGGLIWKVLNYLNEKPIIDQLRLIVISSRPEHHYIQHMRYKHELTDEKIIDELKRYNNFPDEILNNQEALTFFLKIIRNDFYLSDQLLSEKIHKTEVPIVTFYGKQDPDIPNKRMMDAWQQHTENWLGSIEFEGDHFYFLNPETRVKMLENIAAIVETLTVNIE

SEQ ID NO: 4410 - protein, 73 aa, Acinetobacter baumannii
CIKQHLVHWRFTGYTNNSTHSNLADKLGINKKDSLLNGQVEALFPPTRPLVLEKCALHRPQMLSDEMPHLLHL

SEQ ID NO: 4411 - protein, 224 aa, Acinetobacter baumannii
QEKQMRILLAEDDRSQAESIQSWLELDGYQVDWVERGDYALTAIEQHDYDCILLDRGLPQLAGEKVLTTIRHKQKNVPVIFITARDSIHDRVEGLDLGANDYLVKPFSLEELSARIRAQLRKQTLSQQSILTWGDLQLDTQAKVVLCAGKTIDLTAKEFQILRKLMVHPEHIITRDQLEEALYAWGEEIESNAIEVFIYQLRKKIGSSSIKTIRGLGYRMGDLK

SEQ ID NO: 4412 - protein, 734 aa, Acinetobacter baumannii
NLGQEIMTRIIVASKEGLDVLQDGQLNKVVLNQPTIIQIGVSQKDIASMEKQGGSLVIHLKNGETIVLENFFNEATNTTEHSLVFPTEQGKFVEAQFDAQGKVIDYRGLNHVTDLAYTSTSPSAATMAVDNDPSFSMGNVLKAGLAVLAAEGLYLWAFDKDDKDDSPSTPDLIAPAAPTATLADDTVTVTGKTEANAKIYIKDAAGNTVASGVADASGNYTIKLDKPLVNGDKLNVIAQDAAGNNSKVTVVTGTKDTIAPDVPQAQLSDDGSLLTGKAEANAKITVYDATGKVLGTVFANKDGIYSLKLTPPLTSEAGGKVVAEDAAGNKSEEVKIIAGKDTIPPASPFVEVNKEGSVIHGKTEANAKVQIKDAGGKVIGSGTADAQGEFQITLSPALKEAQKGTVVVEDAAGNVSKPVEITPGFDSIAPDKPTVQINTDGTSVTGTAEANAKIEIKDTTGKVIGSGTADANGKFTISISPALTDNKHASVSAIDNAGNKSEVVDIVGTKDTTPPAKPILNSVDDDVGAVKGAITAGSETDDARPKLTGSGEANATLTIYDNGVAIGVVTVTSGRSWSFTFDKDLALGKHTITLTQTDAAGLTSEASSPFTFYVVAPKAASLSETSVDILSTEGPSLADSVGLHTLKVAQNTTTETNNPQKSVPLDDLLKSSTASESDPIAKLLSSTALKTTQASEPIEVNASVGQTTSNPNHPLPDTTSSVLQNLLDQTYPVV

SEQ ID NO: 4413 - protein, 329 aa, Acinetobacter baumannii
KIMQHLQWWTDFVAWQADALPMVLVTVVRADGSTPREVGATMLLRFNLQQQWQQSDTIGGGHLEFQAIDIAKAMLKESETCVRRIERFNLSARLGQCCGGVMWLLFEKILPAEIASDLSGSLQAWRAGKHIWRNVSYQYASTWQTMDMEQQPSFEFHSGSSEEWQFSQQIQPNTMQVLICGAGHVAEAIVRCLLPIGVRVKWIDPRDDIFPSDLLEQAYCITTDTLDAEIEHFDRSGAVLILTHDHQLDLQLCFTALKPTAKPFAYVGMIGSKSKRAIFEKRMQVRGYTSETLQRLVCPIGIDGISSKQPAMIAIAVVAQLLQVFDVKK

SEQ ID NO: 4414 - protein, 266 aa, Acinetobacter baumannii
FFVQYLFLPLQFIGKAVSAALFGILLLIAFALTASMGSHEYMGFYRYDYLLIYALIIQICLLYLKLESWAEAKVIALFHVMAMVMEIFLTHPAIASWQYPQPAVFKILTVPLFAGFMYSAVGSFFARSIRLLQVSFEKLPSFGSMLLLAFFSYINFMSKFFVPDIRYILFAISVFIFWKTKLYFQLNEHKFKTPMLPVLLTLAFLIWIAENISTFYKIWLYPSQVEAWHMVGWGKLGSWYLLLLLSLVLVLKILGHRDNQGNWNLR

SEQ ID NO: 4415 - protein, 456 aa, Acinetobacter baumannii
HAGHLCSVFASKRQGHLVKFFLSLFTLFSIFCTTLTNAALLNIAPESVEAAAWTIVDTQSGQIIAEHNSHVQRAPASLTKMMVAYIALKEIKAGKLKLNEVITATPVVSVVQWDESQMYLKAGEQISVDQLLAGLIVMSANDAAVTLAEKISGDVPHFVQRMNQEAQALGMKDTHFSNPAGITMPDHYTTAHDLSLLSQAVIHQTPEYLHYSKMPSFSYNQRFHHATNLALKYDPSVDGLKTGYTKAAGYNLALTASRPSFSPNLPQRRLLVIVLGTPSAVKRAEIADKLMNLAYAYTRDEVVIPEQKLIAELPVIKSTLKMFKVETKQPTIVTTSLYAEPTPIDLNTFDYATQRIQVLDSNQQPKVIAPLETTQTRVNIQLNEQKLTAPLMKAMNLATVSIYQNNQLIRSLQIENDVHIEEANIFQRIMMWFSSLFSIFSSSEHSAAKLYPIDSH

SEQ ID NO: 4416 - protein, 436 aa, Acinetobacter baumannii
WSGQFYYCCSSLLLLGGSVKMAPIDILFLFGFLGIWIPQAFWAWLSYQAWKYSKTAEKELQNLPIPERWPVLSVLIPAYNEGVVIEDTLHAIAQQDYPAESYEVLLINDGSKDNTLEIAENLAKIYPCIKIVNVPKGMGGKGKSRTLNNGLPHAKGELIVVYDADSTPEPDCVRLLAQTLLADKKLVAVNGKVRTRNWQDSILTRFIAIEFIFFQWIFQGGRWQRFELSTLMGTNYVIWRDALETLGGFDEKSLVDDTEMSFRIFIGQKRIKWVPYAIGWQQDPPSLSVFVKQRSRWTQGNFYVTRKYLPVALRTPFPIGIEILNNIMCYILFVPALFWSHITLTLGLLDIAGISVPGPFTLLWGLSFCLYVAQMWFTLSLEKVKPELYFYSVLSYVSYSQIFLFIVFKAAFDMLKNKIQGNSLQWYKTERSKEKK

SEQ ID NO: 4417 - protein, 205 aa, Acinetobacter baumannii
IYFNYHEVKFIMLLMIDNYDSFTYNIVQYFGELNQEVKVVRNDQVTLEDIERWQPKYLVIGPGPCSPSEAGISIPAINHFAGKIPLLGVCLGHQSIGQAFGGKIVRAKTVMHGRLSDMYHSNKGIFSNLPSPFSATRYHSLVIDQETLPDCLEVTCWTNEADGSMEEIMGVKHKTLPVEGVQFHPESILSQHGHQIFKNFLDIYA

SEQ ID NO: 4418 - protein, 146 aa, Acinetobacter baumannii
IFLKIHLIYRWCNCFIPRVNQITEGNFMKMLKVILMTAGMATAGVVVANTPVNQAAIAPATVTTVKQALASKDNTPVKLHGQVVKSLGDEKYQFRDKSGSITIDVDDELWQGRPVSANTNVTLIGEVDIDYKPLKRVEIDVDQVQF

SEQ ID NO: 4419 - protein, 320 aa, Acinetobacter baumannii
HFLNFIMLKSFFFLSCNFFLGSLISSSVLAQAPIKNQSKIDFHNNQAQFQIKSKNTGHEYLIQIYKPPVAPPQHGYPVLYILDGNATFPSAMNIAQSIGAGSAKLGLDPLIIVAVGYPQQKTFDVQKRAYDYTPKPSAEFQAQGKYKYGGADQFIAFLNNELKPEIAKQFPINSQQQSLYGHSFGGLFVLYHFFQKPTAFQRYFAASPSLWFDQGMLFRELEQWQSQKQTVFPMLMTTAGTHEQGGPHTQFNQRINKDDFFKVLENKRSDQFTYWHFNNPAEQHITNLYASLPKALMFASCQNLESCKSLFDEPSQKTAK

SEQ ID NO: 4420 - protein, 415 aa, Acinetobacter baumannii
YHIKSFLMINKLAFNNKKIERFLMSTFYRMSLLVFLATCLGIGIFRFSYTALMPIMIVQYGWTHDFASYLGSANLLGYLVGALLALFSIKEKSIPALIITSAFLGSLSLLCCSFIHMSLAWFILWRTISGIAGGLLMILAPSFAMKNIAISQRLKVNFLGFSGIGAGVLSATLIIPALKNMPVQYVWEIFAAISIIGSLVLSQLLRHPPTESVQTVNQAPQNFKHSRLGLVIIIAYMCSAFAYIPHSLFWMDYLSGTLHFPLQQRNLFWVLYGVGSCIGAFVAYCLSRFIGYLQAIKCLYGVYCLAVALPFFSHAIALLTLSSFLTGLLTPATVFISSYSLLQIYEQRYQKIWSLATIGFANTQLLGGVVISTLHHLHWSYAHLFLMGGIVLLFALSLLIPIRSSMPNTLGETES

SEQ ID NO: 4421 - protein, 862 aa, Acinetobacter baumannii
NEIKALHYAGLFFGENFMAIITEEKMQNLDRDIEDAGKCLNIDGIITPRYGELFKSFPMVSREGEENFLFATQQIIEAGLLEGFTTEAELLASRPTVSKKYAKANDTKIVWFWNKPVGASDGNYWISTGLSEYSQSKNYFDQYSSLTKNATVFYPFSSTKRNNVNASSVSASHEAYLKPYILNITVNGADPNKYYRIQQISTPTNASVPNRWVFEVLNRTNFDTSETVEKTIPVVFPIVNNTGIKTFSVVDGDVTIIVTVDTSKVPTGDFYSVASGDSSYTYIIDPSRYVFSAFKKSDAVGYVDSISTLTKNSTVLFPFSTLKRNNVNESTVGTHDNILRNFILDVRVMNADPNKYYRLQQMSSPDQATNPNRWIFEELDRANFDTVETKGKAITAVFPIVKNTGIKNFVVKEGDLSISVTVNTNKTPSNSFYSVASTDNSYTYIIDPSLYSYAAVTSSDINAVNTRIDKFTKPMQLKNLLNDLRNPIQDVDIIFGPADSITYGLGATGNEGGTGQPGTHGPATTQTYVNIFRNFLGTAFCTSPRYGDDTITQTGTAYFTSEGTSVLSAELANYTFKNSVTGKVFTLTEMQSLIGINGSSPTGSFLDLKSPSVAGAVTDMEFNFNGNAFTINYARLGNGSATESNIDVFVDDVLHSSFNVYTASTPDFLGTYTVGELPEGQKKIRIANRLSNSTIYARLMSITATRKISVTNEGLSGTNSKQWLDNNWIPNVITAKANYVFMMIGTNDRHTTQKIGTFKNQYLQLIDRITAKNPKAQIIIMSPPAVTQNEDPNTTVYKFRIADLNYALSQIAQLRGHSFISLFEATSKLKAKGENYLFDQIHPNDYGYGVIAEYIINQILNA

SEQ ID NO: 4422 - protein, 129 aa, Acinetobacter baumannii
MMFLKQNTYNKSFSCERCEWSCEPFKQIIHTLKALSANAYNNHVNDVNHFLARARERKKHLLLNLNQFKSNIVHNLNTSEITLTQENTHKSFTSFTCNTIYCFYSCFHVNHCSKSFTQPFTSFTWNFED

SEQ ID NO: 4423 - protein, 153 aa, Acinetobacter baumannii
LTANIMTTLKNQITDALKTSMRAKDMATVTVLRSLQAAIKQIEVDERIELDDAQVLAVIEKQIKQRKESIKAFEGAGRDDLASKEQAEAEVLSQFLPEAMTEEELDSLIEQTIAAQEATSMKDMGKVMNSLRPIIAGRADPAQVSAKIKAKLA

SEQ ID NO: 4424 - protein, 240 aa, Acinetobacter baumannii
NINKEKHMAFPHHTEHHAIQRSGWLRASVLGANDGIISVTSLIMGMAASGASSHTLFITCVAGLISGATSMAAGEYISVKSQEDIEKSDLAIEAKELKKYPQKELDELTQIYISRGLSKELAKEVAIQLTTHDALGAHARDEIGIHENTAANPIQAALSSAASFSFGAFFPMLAILFSPEHLIMPSVLITGIAALAILGALSSYFAGTSKIKGSLRITLWGILAMAFSSWIGSLFNVTPL

SEQ ID NO: 4425 - protein, 258 aa, Acinetobacter baumannii
ILNKVHAMNTKKQLSRGANSCLDEINIQYEKLTAFGLDIHKVQLSQIKEIPQLDHIYQELNIFLPPNIKSSRFIRQLEFLTGRLAAKYALQSFNLQDSIVYQGRHGEPLWPEGVMGGISHVGSKKSCYAIAYARNNTPKEKIFGIDIESQKHHIFFQKKDEFYDVFLNKNEQEEIEKLLKDQAYLYLIIFSAKESIIKAFYLKYKQIIDFKNIKLKALDGAFLYFYLRQESLSGITLEVKVYFFHTNNEIITISCIEN

SEQ ID NO: 4426 - protein, 152 aa, Acinetobacter baumannii
KGDKPFCFIWLCLANLFYGNVAFHYSVAFFVMWIAISALNLAFAVMLGAFGAHGLKAHASPEQLAWWQTATDYFFYHALGLLALGILSKVLPHFPIKLSFLLIQIGILFFCGSLYIMALGLPRILGAITPIGGALMIAGWLILAWNAFKYAK

SEQ ID NO: 4427 - protein, 424 aa, Acinetobacter baumannii
TMSKNRNKAKGRQKDDLKKLKVRGTGPIQDRTGTTLIDRPRSAVRTAKPVTFDSAMTLSAVFACVKILVESVATLPLQMFKLNADGSRTIVKDHPVIQLLSNKPNRYQTAVEFREQFMLNLVAGNAVCKRDYIGKKLVSLQVINSGSVDLKIKDNGDPVYECQINGRKVELTEKQIWHVKMFGTGLWGMSPIAYGAASIGVGLSASDKTTRLMSNGAKPTGALKTKRILKDAQRDTLRKELDILVNGDDGDIAVLEDDMQFEQISLTPADLELIEIRKLSVEDACRFFGVPPILVYMSDGSTTWGSGIEQIIDGFYKFGLRPYLERIEESIRIHLLERHEWDEYEFEFKTKDLLRASYLQRIAANKDRIISGQSSINEIRREEGDLPDPNGDFLLVPVNMTTAERMKKGNFKVNENGKTTASAE

SEQ ID NO: 4428 - protein, 74 aa, Acinetobacter baumannii
HQYNILHEYALKIVFGDNVLLIILNRPTLANASSQPVPGAYIHLIYLSTKNIACFKKMHRTKLLLWGNGYPIFY

SEQ ID NO: 4429 - protein, 137 aa, Acinetobacter baumannii
NMSNNNYIDELLKLLAMFAFIGVLLLAFKCQTIFALDMTTSYEVSVRIVIYIVTAAILGFLTRNHIEFTTQFLIAVPFAYFWLKPILDYKAIQTIPDVPFYLSGHGQSLGLLIVIIFCFALWVFKETSSNSFESQNV

SEQ ID NO: 4430 - protein, 261 aa, Acinetobacter baumannii
RSGKMNFNQLQIALWTLVRKEVRRFLRIWPQTLLPPAITMSLYFVIFGNLVGSRIGQMGGVSYMQFIVPGLIMMAVITNSYANVSSSFFSVKFQKSIEELIMSPVPLHIILWGYVIGGICRGVLVGAIVTAMSMFFTDLFIHNWFVTIYTVLITSVLFSLGGFINAVYAKSFDDISIIPTFVLTPLTYLGGVFYAISALGPFWQKLSLINPIVYMVNAFRFGILGHSDVNVSFSLIIVTLCCAVLYGIAYYLLARGSGMRE

SEQ ID NO: 4431 - protein, 182 aa, Acinetobacter baumannii
SVLNFLEVLMSTMGRPPKGLQEKILSGSRIRTDRDGDAQEANASVALGMPPCPRWVKGGAKKHWDTLGPVLVQAGLLSVVDGDVFGLHCDNMAAYEKALEKLEEINSWVTTTPNGFEVQAAWLQVRNKLQEQIIKTAAEFGLTPRARSSVKVNKQQQLDLLGADAGQKEENDPYANFSIRSS

SEQ ID NO: 4432 - protein, 595 aa, Acinetobacter baumannii
YIIKIYWGKNMNIHVEIDTHWCLEQLLQEGRITERDKLLVQTTNRQKDQLKWHPLQWIAHFNLKDQHHVQAHLSLNRLCQWFADRAQLPLFVIDPLKADVSALTQVMSQEFAIRNHILAVEVHADRIVIGTDQPFQTDWLNNLEKSLAPKKIERVFLNPEQLQRYLREYYQVSRAVNSAQKDAAHNRDNKGVEALLQLGDSQNPDANDQHIVKLVDWILQFAFEQSASDIHMEPRKDNGKVRFRIDGVLHTIYNMPSNTLTAVISRIKILGRLNVAEKRKPQDGRLKTRTPKGQETELRLSTLPTAFGEKLVMRIFDPDVLVRSFQQLGFDQSLLQQWQRITQNSHGIILVTGPTGSGKTTTLYSSLKQLATEQVNVCTIEDPIEMLEPSFNQMQVNHAIELGFADGVRALMRQDPDIIMIGEIRDQDTANMAIQAALTGHLVLSTLHTNDAPSSLTRLHDLGVQPFLTAATILGVLAQRLVRKLCPNCKQQTHINEDEWQHLTFDYIMEMPEKVYRAVGCEECRHTGYKGRIGIYEFMPVSLELKHLISSHATLNELRSQTKKESVEPLRIAGARKVIEGLTTLEEVLRVVPLN

SEQ ID NO: 4433 - protein, 114 aa, Acinetobacter baumannii
SKIKWEKNKMSWLMILGLAAIIFFNRYYFLEPNVKVKLPVLMNKMLNYSAPCLLSAICIPVIFFENNELRGFLDNPYLYATIFCTVVAFYFKKVLPSVLLSLAFFYFINFLINH

SEQ ID NO: 4434 - protein, 286 aa, Acinetobacter baumannii
TLVNYQKFLEIMNSTYTAPRRLIKTPDEIEKMRIAGRLAAEVLDMIKPHIKAGVSTLELDTICRNHIENVQHAIPACVGYGGAPGRPAFQHSICTSVNHVVCHGIPSENKILKNGDILNIDVTVIKDGYHGDTNMMYIVGGETSILANRLCKVAQEAMYRGMATVRDGSYLGDIGHAIQKYVESERFSVVREYCGHGIGTVFHDEPQVLHYGQAGTGMRLEAGMTFTIEPMVNAGVWQTKLLGDKWTVVTKDHKLSAQYEHTILVTKTGIEVLTARPEEDLSRFNQ

SEQ ID NO: 4435 - protein, 720 aa, Acinetobacter baumannii
SNVKICEIKIDENSHLINQDSFMLEQFSKSPSLLSVTDYEEHIWMLQLQQPEQVNRRFNLWKLNQDLDIQLLIKAIQDIIKTTPDLNVRYTFSDEGDLYKYPFDDHSACLEVKKSNTEQVFEQVATLKAQAWNAEFHPPFFTSLIETEQDYFLILALHPILDENYQKSDFIQAIQNRYQQNSPNNMPLVLTEIDISNHLAANSSKAPEQPNQTYVSEIILEEFRNTLAEPEMSQHDDFFDFGGHSLLATRIIGNLLNKHGIEIQFNDFFKSPSAADLAQYAFVKSAKTEKTTLQSVDKAPLTLAQDFLWQAYSAFDFSPIYNLPFAVEFLEEINEDVFFQAFTDIVERHAGLRTIFNSANGQTYQQVVPTYELKQFKWFWNSAESHDATLASEASYKFDLTRELPLRIRLIRNAKGRQTLSFLVHHMVIDEWSLNTIMADLAHAYLARSNAQAPNWKAPAQSILDFSLLQQKQGINQDHLNYWTNLLRGATKGLNLPVSEHELNAEKEKPPVQWLELKFAPEMHEKLLAFSRQHSSSIFTVLYTAIAHALQQQGNLKDIVIGTSASGRTDPEFFDTVGYFTTMVAHRTQFSPSDSFQSLLHNISTMINTSMAYADIPINHIQNALGMSADEGLLFDVFIHIHSNNALNGALKTPQGQDLPYRQILPERDESMFGLHFEIMENVIDGQHQLSMIITYQAHRFPTATVQSICEKIKATLAQI

SEQ ID NO: 4436 - protein, 97 aa, Acinetobacter baumannii
IGVKTVSVDFNQAIEIAKENARILLPKASSFDLEGIILNNNEYEVTLSYMIDYSDKIKDGSQDSGVGFIMAALARKREEKVFIVSINGKFKGFRNSK

SEQ ID NO: 4437 - protein, 149 aa, Acinetobacter baumannii
RTQKMKNPMEMTGLEFLQAMIEGHIPPASISKTIPMQPTEISEGSVTFKAQADHNHLNPLGGVHGGFAATVLDSVTGCAVHTMLPAGVGYGTIDLNVKMCRPLPQNQVLIATGKVINLSKNLGISEGKMTDEEGKLYAYATATCMIIRP

SEQ ID NO: 4438 - protein, 592 aa, Acinetobacter baumannii
VNQNQQAGQPQATFIPSDFNDLHLMFGLEEVKAQIVQAINTSIPFPPEPPKTNKPIHSEGEIEKNSHVPMVEENLVAGESGQGGDISIENDAVPESIQKFIDRYYLIEAKTDVWDNFDKVVIKKNAFTALLGQKQYKLWLDHKKVIPKSEFEHNVNVATNLTIQELLDNFVVLANSEEAWNLVERRTWLIKHIRIAYPNIFDLWFKSPARKIIPRQNLIFDPKQEHDHDENYINIYRGLNIDVMRDQHGEQLTRAEVYEDCKGIMTLINDLCDGEKEAVLFLLKWLAFPLQNIGAKMATCVLMHGHIHGSGKSLMFVSIMKKIYGEYHTTVGQAQLDNQYNEWIENKLFGVFEEIVDNKKKHNVMGMIKHLITGETLYVSKKFVSGWEMNNHLNTVFLSNNTQPLPIEEKDRRFLVLNPCKDLDGPLHERVMQELKTNGVQAFYTYLMGLDLTDFHEHVKPPMTIAKRTMIDYSRAGFDTFYHEWKNGDTKYPYISCKSEQLYKAFGQWSRTTGEHQISMKRFIIEGKKHGIVPSDKAKHWKGKRSSGQNKVIIIGEKPKDEQEQLRLGLQIEQFQDSLDGVNDVPEAKYVQ

SEQ ID NO: 4439 - protein, 312 aa, Acinetobacter baumannii
GGQKTTSQHFKYIYNILINIEQHMAISKISTYLMPKRESYPNNKTDWQLDPSRAVLLIHDMQRYFLNFYDAESELIKTVVNHLVQLRSWAHQNNVPVVYTAQPYEQPAEDRALLNAMWGPGLPASTIDQQKIIDQLSPAEHDIVLTKWRYSAFKRSDLLERMQNWNRDQLIIGGVYAHIGCMVTAIEAFMSDIQPFLVGDAVADFSEEEHRLALKYVSSRCGQVVDTESVVGQVATGITRPWLEQKVQQLIEEDELDPEENLILYGLDSLRIMQFSSELKAQGINISFEELGRTPTLSNWWSLVDARQRIAG

SEQ ID NO: 4440 - protein, 255 aa, Acinetobacter baumannii
HYKKGSIGHMQQKHPGRTLVLWIIAAHLFMGMVAYEWLPVSFRGSWIFILLLLISGAFLEVGLSLIVGLVAFIGVAVYFLLDLGAQTHIERQLLLLFIIPLIPLFLSAVRHNIEINVQKYRDIQSYDRNYRRDIFPLSALKYFQRSFFKLLDHHNVQDYEVFEIRILNRSLIKEMLGDDVWKTTQNEMIKILSQHEPNEIVFQFADDDLENIYSIMIRQQKTEEDPVFLKKLKEITTLRLEVEYKIVPLPPEEMS

SEQ ID NO: 4441 - protein, 127 aa, Acinetobacter baumannii
NCEKMKTFAPFFQVLGISITLCTQAVFADEGISTQEADSLIKDDIASTQVLQEICPTFVGANKKLETNTQKIIAMYLSGYSNKSITFSALQNDSEYKTLLSEARQAAKEMDHHEQHELCEEVVNYKD

SEQ ID NO: 4442 - protein, 730 aa, Acinetobacter baumannii
FMENKKRMTTQTSGWVSAFKAFLDRRALIMLFLGFSAGIPILLIFSSLSLWLGEAGIDKSAVTFFSWAALGYSFKFVWAPLIDELPVPVLTKALGRRRAWLLIAQCLIVLAICTMAFADPALGHSYLVQMAAGAVLLGFSAATQDIVIDAYRIELAETEMQTVLASTYNAGYRIGMIVAGAGALFLAAHLGTAKGNYIYEAWKTTYLTMAAVMLVGIITTLLVREPKVDRIYKNYKSSDYYRLVLVFFIAVISFVLTYIYSGQVTEAISKAGNIQDSAALFGLEALRFLTATGVAILVGYLLVKIGVVNQQMAKETWIAPILDFFKRYGVKLALVLLFLIGFFRISDIIAGVISNVFYQDLNFSKEQIAEAVKVYGVIFSLVGGFLGGLLAQRMNIMKLMFVGAVLASSTNLIFIGLVKSGKPLDMVDVQIGNHHYKVKPDEVGYWKLKVPSSSFNSTQQIDVKAGYALQDQQAETIVRAQPLVTTHSESVPLQILPLMGSDQISAKSSEGSVVVRGQYFGKALSPTQKIVVNLDGQNFDAKMTDQKGVFNAAIDMQKLLSSPSQQLTASIVDGNQKILSIAHHYEVASNSVPKPELDVNIDPLPYIDTQSGQEVEISGKVIKPYSSLWLYFAIVVDNMASGLAGAAFIAFLSSLTSVSFTAVQYAIFSSLMTLTPKLLGGYSGTIVSNIGYPNFFLMTTMIGIPILILVVWVGKLLKDHQTHDIEKAGE

SEQ ID NO: 4443 - protein, 102 aa, Acinetobacter baumannii
IGRKKMEGIMPEFIVTIEADSAPQIVLGQMLLGGTVTALKLEKRKLVSVAELVAKYGLSDETIRTKCISINQGTNGKHMYDPDAADAILKNQKVRRGPKRKN

SEQ ID NO: 4444 - protein, 324 aa, Acinetobacter baumannii
IHMNWKKKYGGVALIIAAAVTLQACDQKVADTTQASQKLAEPITVKHALGTTVIDHLPQRVAVLDMNEADFLDQLNVPIMGMPKDYVPHFLEKYKKDAQIQDLGAIVQPNMERIYALKPDLILMTPLHVNQYQELSKIAPTIHYDINFNNSESNHIGLVKDHMMTLGKIFNKEDLARQKVSELDEQVKQVQAVTANRPERALVVLHNNGAFSNFGIQSRYGFIFNAFGVKPASGVVDTSLHGQPISSEFIKKADPDILYIVDRTAVMEHRSNINAASVENPLLRQTKAWKNGRVIFVDADAWYTTAASPTSLKIVMEDVKKGYQ

SEQ ID NO: 4445 - protein, 1061 aa, Acinetobacter baumannii
SHMNISKFFIDRPIFAGVLSVLILLAGLLSVFQLPISEYPEVVPPSVVVRAQYPGANPKVIAETVASPLEESINGVEDMLYMQSQANSDGNLTITVNFKLGIDPDKAQQLVQNRVSQAMPRLPEDVQRLGVTTLKSSPTLTMVVHLTSPDNRYDMTYLRNYAVLNVKDRLARLQGVGEVGLFGSGDYAMRVWLDPQKVAQRNLTATEIVNAIREQNIQVAAGTIGASPSNSPLQLSVNAQGRLTTEQEFADIILKTAPDGAVTRLGDVARVELAASQYGLRSLLDNKQAVAIPIFQAPGANALQVSDQVRSTMKELSKDFPSSIKYDIVYDPTQFVRASIKAVVHTLLEAIALVVVVVILFLQTWRASIIPLLAVPVSIIGTFALMLAFGYSINALSLFGMVLAIGIVVDDAIVVVENVERNIEAGLNPREATYRAMREVSGPIIAIALTLVAVFVPLAFMTGLTGQFYKQFAMTIAISTVISAFNSLTLSPALAALLLKGHNAKPDALTRIMNRVFGRFFALFNRVFSRASDRYSQGVSRVISHKASAMGVYAALLGLTVGISYIVPGGFVPAQDKQYLISFAQLPNGASLDRTEAVIRKMSDTALKQPGVESAVAFPGLSINGFTNSSSAGIVFVTLKPFDERKAKDLSANAIAGALNQKYSAIQDAYIAVFPPPPVMGLGTMGGFKLQLEDRGALGYSALNDAAQNFMKAAQSAPELGPMFSSYQINVPQLNVDLDRVKAKQQGVAVTDVFNTMQIYLGSQYVNDFNRFGRVYQVRAQADAPFRANPEDILQLKTRNSAGQMVPLSSLVNVTQTYGPEMVVRYNGYTSADINGGPAPGYSSSQAEAAVERIAAQTLPRGIKFEWTDLTYQKILAGNAGLWVFPISVLLVFLVLAAQYESLTLPLAVILIVPMGILAALTGVWLTAGDNNIFTQIGLMVLVGLACKNAILIVEFARELEMQGATAFKAAVEASRLRLRPILMTSIAFIMGVVPLVTSTGAGSEMRHAMGVAVFFGMIGVTFFGLFLTPAFYVLIRTLNSKHKLHSAAVHEAPLSTPHDH

SEQ ID NO: 4446 - protein, 544 aa, Acinetobacter baumannii
NVMKKQLIEFVRWSPERAQHYRNKGYWIDQPLTRILTVGVQSHPHSPAIICGERQLSYIELDRLSTNLASRLAEKGLGKGDTALVQLPNVAEFYIVFFALLKAGVVVLNALYSHRQYELNAFIKQIQPKLLIGSRQHEVFSNNQFIDSLHEVNLSPEIILMLNHQATDFGLLDWIETPAETLVDFSSTPADEVAFFQLSGGSTGTPKLIPRTHNDYDYSVRASAEICDLNSNTRLLCALPAPHNFMLSSPGALGVLHAGGCVVMAPNPEPLNCFSIIQRHQVNMASLVPSAVIMWLEKAAQYKDQIQSLELLQVGGASFPESLARQVPEILNCKLQQVFGMAEGLVNYTRLDDSDEQIFTTQGRPISSDDEIKIVDEQYKEVPEGEIGMLATRGPYTFCGYYQSPEHNSQVFDEDNYYYSGDLVQRTSDGNLRVVGRIKDQINRGGEKIASEEIEKLILLHPEVMHAALVAIVDEQFGEKSCAFIVSRNPELKAVVLRRHLMELGIAQYKLPDQIKLIESLPLTAVGKVDKKQLRSILNTSTTS

SEQ ID NO: 4447 - protein, 339 aa, Acinetobacter baumannii
IAMNTKRNIYKDAEHPFAQYVRILGKGKTGSRSLSYEEAYQAFTMILKGEVLDVQLGAFLMLLRVKEESIDELAGFVQATKDQLHFAPLEVDLDWSSYAGKRKHYPWFLLAALTLAHHGYKIVMHGASGHTINRVYTEQVLEYLDYKICHSEQEVRTQLAEQNFAYLPLDVISPVLSELISLRNVMGLRSPIHTLARLINPFKAKATLQAIFHPAYRTSHQHSALRLGYQNSAVIKGEGGEFERNPDAKTLICGIKNGELYEHELPKLTPERSPIEEELDLATFKAVWLGQQHHEYGEMAVTETMGIALYTMGVVSNFEEAMQKAKVLWETRNLSNLNS

SEQ ID NO: 4448 - protein, 197 aa, Acinetobacter baumannii
LNMNTIDIIILILLLIGGLNGLRQGFIKAFANLVGWIFALIMGAKYAVLLAPSMSGLSQDPVVQKIAAFAFIALLIIVLTWIVTAFLNGLLKSLKLGPLNRLAGGAFGSLKGLLVVLITMQGVGPWVESSPHWKQSKFIQFLLPYAPLATELSKDAASEAFHQITSGGGVTRTSPKPMDESEETELRPDHSTKNPFY

SEQ ID NO: 4449 - protein, 154 aa, Acinetobacter baumannii
KKMNNIDLAIEDFVNKTLNLEGLTLKGFEKLAISNGFYFKQQGGDENHGTYAIFKTYNAHSAAITKCHCGHIHRLEDMCIKCHPVNENLKTLNIKFPTTCSLCEFSEYMEIQVEAQNTGYLWSGKVKCPNCSNTGDLLYSDGNAFINWAIDLPF

SEQ ID NO: 4450 - protein, 582 aa, Acinetobacter baumannii
VMMNNALSDIFHNQTALTRERLSFCEANIKDLNEWVTTLSIMQLGDTSKALFTAILELNELNCSETLRFDLIQTLHPTINNVLASLEKNFFNQGVISTDRNEHIIELAMLLRCYFASIYLNIAQTSHEQLQKQKFSLFSFKQKKNLQTARILATFHALQQLTNLLYQQHMLYSEPVKGQWLIAHQLYETAVQYKYHLTNINHIQGVQHPLANITQAYAQLILLDIFNTNQIRQSEIQALFQCSFDWARMIQILPKDTASTKYVVDPTKDHPPVYNKKQSSNFNPSIFISTQALLEHVTATMHKNAQYMSKNEKIYLSPTLKFHVQTILGTTAQRRHERYEYNAALQICFGLSTAHFYLSKAKNFEETLQLSNNYNLQSESKVLSNLEKKEQQTSSYQRLSRESKTIYQTTVLDISVNGYRIKWSGEAPKNLRTGEYILVKETLHGQWRGGVIRWIKQSTEKSLELGLEILSQAMFPCAVHIQAERHTRNYHPALLLQTQNLEEIQNTLILPGSQIFREQQTIHLRLGTEEIKVYLLKAQLITQSFIQFQFELLNEQQQYLLDQFMLKKNNTVNSQDLWEALK

SEQ ID NO: 4451 - protein, 281 aa, Acinetobacter baumannii
VSSKYSSFYHLICVLRRSFKMASFMKKIFVSTTLVLAAVATNVQAKDWKVIRFGTESSYAPFEYKTPDGKLTGFDVDLGNAICAKLKAKCVWVENSFDGMIPALKAKKFDGILSSMTVTDERAKQILFSSKIYNTPTRMVAKKGSPLLPTPTSLKGKRVGVQQGTIQETYAKTYWAPKGVSVVPYPTQDLIYQDMMSGRLDATLQDAIMVDGAFLKQPKGKNFSFAGGNVVDVKTLGVGAAIGLRKEDADLKANIDKALAAIIADGTYKKLEKKYFSFSIY

SEQ ID NO: 4452 - protein, 66 aa, Acinetobacter baumannii
HDQKDVRPRQYSSYGIKNKKHTILSQKLSNLRMWGFLDVKKFNLGKILLRFYSIEAFFERNKKNPL

SEQ ID NO: 4453 - protein, 62 aa, Acinetobacter baumannii
KYFDRVVRKFLMQLKFLKKYFLYDFLIHAFLKPKMTILAGQLKRDFILSTAFSMKIKRDKHV

SEQ ID NO: 4454 - protein, 60 aa, Acinetobacter baumannii
ADFEQTLFHFPKSKTVHGSTTYRLCLAKYQGQLNKGTSSKYHLQMGILHQHNVDRKFVHP

SEQ ID NO: 4455 - protein, 67 aa, Acinetobacter baumannii
VDLDIWLNKDGMWLNHVPFYFLGNEKEFAQSLLICIFFTGKSLVLLLKNEYDAFHLRRIAQLVRALR

SEQ ID NO: 4456 - protein, 951 aa, Acinetobacter baumannii
CELEKKVEKLQQYAIGQRWLSDTETELGLGVLIDVDERSVSILFPKSDETRVYARNNAPLSRIIFNVNDEVQDQEGNKWNVESIEDRHGVLRYNVVRTLENGEQERKALNETRIGAQIQLSKPLDRLLASQIDYKEWYDLRIEAMLMQAQMQTSPLRGLVGARVGLIPHQLYIAHEVGKRFAPRVLLADEVGLGKTIEAGLIIHQQLKTGRSERILILVPDSLQYQWMIEMRRRFNLQFSLFDLTRTASIKEHDPELNPFLTEQCIIASVDLMVDHDDLREQALEAGFDLLVVDEAHHLMWSEEEGGNDRYDLVEELAENTAGVLLLTATPEQLGVESHFARLRLLDPQRFSSLERFLDEEAQYQQTAQIAEVLMSDEPLTQEHLSALEGLLGHSIEDQPEQRFRAIHELLDRHGTGRILFRNTREAIQGFPGRDCQPAPLPAPADWSKDGKLREQMWPEEAQIDGSWMQNDPRVPWLMEILRKELKHKKVLLIARSGPVVESLESALRLHAGIRTAMFHEGMSLLERDQAAAYFAEESYGAQILLCSEIGSEGRNFQFASDLILFDLPANPDVLEQRIGRLDRIGQENRIQIHVPYLMGTAQERMFRWYNEALNIFSNISPTAQTLQENFIVELKDCLLADQGQTFEDLLEEVNVQRQALEAELQAGRDRLLEYNSCRPIVAQEIVQALEDYDDNTTLPMFVKRFMSSTNIDFDEQSNGTVIIRPTDQMQVQGLALDEEGMTATFYRDQAQMREDAQYLTLEHPFIESVMEMIRTQSFGSTNVAVLKSNALKQGSVLLEVWFKVDVVAPKSLNLPSSLPKQLIRVLLSENGQDLSEKIDPTILKPYLHHLDGNSCRQVVKARREVIEERYKQAFDIAKEGLPQLQQQAKEHYGNKWQYEIDRLTYLKQFNPSIRQDEIERLQKLQKEGLSLLDGLTVTPEAIQVLVVVKP

SEQ ID NO: 4457 - protein, 705 aa, Acinetobacter baumannii
LFIERLRMDTMQAKSTLPSKLVWSLVAIIGAISFGMLALSRGEHVNAVWLVLAAACVYSIAYRFYSLFIATKVFELNPRRLTPAHRLADGLDYVPTNKYVLFGHHFAAIAGAGPLVGPILAAQMGFLPGTIWLLVGVVLAGAVQDFLVLFISTRRDGRSLGEMAKQELGPFAGIVVMLGALGVMIIILAVLALVVVKALAHSPWGVFSIAATIPIALFMGVYMRFIRPGRIAEVSIIGFVLMMLAIVYGGHVAADPYWGEFFTLTGTQLTWCLIIYGFIASVLPVWLLLAPRDYLSTFLKIGVILGLAVGIVIALPDLKMPAVTHFIDGTGPVFSGSLFPFLFITIACGAISGFHALVSSGTTPKLVDNEVNIRMIGYGGMLMESFVGIMAMICATVLDPGVYFAINAPAAVLGTTVESAAEAVRNLGFVVTPEMLTVLAQEVGESSILSRTGGAPTFAIGMAHIISEIFNSRAMMAFWYHFAILFEALFILTAVDAGTRACRFMVQDTVGIVIPAVKSSGSFFGNLLGTAVAVGGWGFFVYQGVIDPLGGVNSLWPLFGVGNQMLASMALILGTVILFKMKKEKYVWVTIIPTIFLFITCMTAGWQKIFHENPKIGFLAQAHKFSDAIARGEILKPAKTIAEMQTIVMSNQINAALCGFFMIVSIVMIIASIGIVRRALASPTPTVNEAPAVYTDPEVVTTRGE

SEQ ID NO: 4458 - protein, 60 aa, Acinetobacter baumannii
IMTEQQPKQKKALVKLPFPMPNESNQAGDAVHNQVRPKPEQYADRTWMPPRGTRRSMGKR

SEQ ID NO: 4459 - protein, 358 aa, Acinetobacter baumannii
SMAEFKFTDLVEPVAVDKKTALRITVLGGGSFGTAMANLAARNGCDTMIWIRDAETAEEINKTHINKRYLPDFTLESSLRAVSDLEQAVCDRDIILVAIPSHSFRDVLKQIAPYITAQAVVSLTKGVEAKTFSFMSDIIREELPEVPYGVLSGPNLAKEIMAGMPSGTVIASDSELVRYAVQHALHSALFRVFGSDDVHGVELGGALKNIYAVAMGIGAAYKIGENTKSMILTRALAEMSRFAVKQGANPLTFLGLSGVGDLFATCNSPLSRNYQIGYALGSGKTLEQASKELGQTAEGINTIVQVRGKAQELDVYMPITNALYEVIFEGAPPLNIALSLMKNGHRSDVEFVLPHHEV

SEQ ID NO: 4460 - protein, 389 aa, Acinetobacter baumannii
IIYELIMRFKKISCLLLSPLFIFSTSIYADNTPKDQEIKKLVDQNFKPLLEKYDVPGMAVGVIQNNKKYEMYYGLQSVQDKKAVNSNTIFELGSVSKLFTATAGGYAKNKGKISFDDTPGKYWKELKNTPIDQVNLLQLATYTSGNLALQFPDEVQTDQQVLTFFKDWKPKNPIGEYRQYSNPSIGLFRKVVALSMNKPFDQVLEKTIFPALGLKHSYVNVPKTQMQNYAFGYNQENQPIRVNPGPLDAPAYGVKSTLPDMLSFIHANLNPQKYPTDIQRAINETHQGRYQVNTMYQALGWEEFSYPATLQTLLDSNSEQIVMKPNKVTAISKEPSVKMYHKTGSTSGFGTYVVFIPKENIGLVMLTNKRIPNEERIKAAYVVLDAIKK

SEQ ID NO: 4461 - protein, 434 aa, Acinetobacter baumannii
SIYEMKPRVFCLVDVNNCYASIERFFNPQLINKPVIVLSNNDGCAVARSQEAKAIGIKMGDPLFKIIDLVKRHNVAVLSSNYPVYAEMSKRFHAILKQFVTDKEHETYSIDEAFLELTAYKQHYDLDAYARLMKNRVWQWIGLPVCVGIGRSKTEAKMANHLAKTYKTFDGVCNLTSFPTNIRDLLYKQTSVSEVWGVGRQHAKKLESMGITKVYDLMMSNPYHMESLFSVVMKRTVLELNGIACIEIEDTPPSRKQIISSRAFKQKITDKDDLKEAIARRTQEAFTRIRKDEALCGCIIGFAHSSPFDVHKPYYKKELSQSFAVPTDDVRKLVKATTRMMEYIYKPGVDFKKCGVVLTALESKHTYTYDLLTDYSELEKTENLMQAIEGIQGKFGKFKLGFGGSMYQNRSWSMSQNLKSNNYFTWEGMLTISN

SEQ ID NO: 4462 - protein, 593 aa, Acinetobacter baumannii
KIDEILFFYGIKIGLKGYRAMFIEIGEFLNLRLKQMGIQHLFGVPGDFNLSYLEQVEADPQLEFIGNCNELNAAYAADGYARINGFSALATTYGVGDLSAINGIAGAYAENVPLIHISGIPPLHAVQKGTLIHHTLVDGNYDNIMNCMKEFTVAQTRLTPANAASEIDRVLRQCFLERRPVHIQLPGDITHVKIEVSERPLDLSYPAVEPELLQSVVSKLCDIIENAQSPALLIDNEASVFGVTSLLNDLSQKCSIPFAGMNTAKNIMDEGSPRYIGTYVGGASQPHVKNIIEQSDCLIGVGARFTDVGSAVFTHQIETKNYIEIKSYGLNIFGQDFPGIEIGQLLVELNKKVASRKSSIPLLEKQPQKVIEAPAQQKLSQDVLWNYISGFLKEDDVIIGEVGTSNSALSGIKLPATAKYIAQPLWGSIGYTLPALLGSLLAAPERRQILFIGDGSFQLTVQELSTIIRHGLKPIIFLLNNGGYTIERLIMGENAAYNDVQNWKYTEIPAVFNGKKGHTTYVVETAGQLKSVLDNVQQNDQLTFIELKIPAMDAPVSLKKLASVIARFDYGDRGYEILKERSQPVKCKDAISF

SEQ ID NO: 4463 - protein, 181 aa, Acinetobacter baumannii
GNCDMDITHKMVGLDDMQKQMSNLVDLATEKKKTKAAAMYAVKPMLDEAKSRAPVAEKAYYRYYRGSYRQRKRGNANPSRQLMIPGKLRAAIKRKSVELNKSVGAAVYVGTTKALFDRKYYPFYWRFIEYGTPTMPANSIFRRTFDAGKVIALERFKFRYRKYIEAIVKRRPVEGLNDVSE

SEQ ID NO: 4464 - protein, 285 aa, Acinetobacter baumannii
IIFENEPIKKESTNMKMYQVDAFTKELFRGNPAAVIVGKEWPDADLMQKIALENNLSETAFVKIIDSENYEIRWFTPTVEVDFCGHATLASAFVLFKDFTEKKTLNFHVRNLGLFVVHQDEDGKIRMDFPIRKAQQVEDYPAILRQALTKPFKAVYQNVQAYIVEYESVQDVLDEQPDMNLLKALGKRTAITTTAMDVAITSKADDQYDCISRYFAPVAGIDEDPVTGSIHTAIAPLWAEKLAKNNIVAYQASSRGGVLYCNVLNQERIEISGYGKLYMQAEIFP

SEQ ID NO: 4465 - protein, 270 aa, Acinetobacter baumannii
MSVEQSLLGKETQYPTSYQPDVLFPIARAQSREKYAHIEGITQGKDWWHVFEISWLNAHGIPQVAIGRITLPASSPNLIESKSLKLYFNSLNFTQFDSTQSFIETVEKDLSAAAGAKVELTLFQVDDLEISKPQGICIDDLMPERLEQHPDATLLKLDESGEEIEVELYSHLLRSNCPVTGQPDWGTVFIRFKGKKPCYRSLLAYIISYRQHNGFHEQCVEQIFADIWQNLQPEKLMVYATYTRRGGLDINPCRVSDLTWMPKPIRLARQ

SEQ ID NO: 4466 - protein, 284 aa, Acinetobacter baumannii
LQNDRQHSGQSGMWHLFPCADGSYPRCCMIHVKNINKSYGNKPILTDVNVEFPTGQVTSLIGPNGAGKSTLLMMMARLIEPDKGEIFLNHQNIADIKTAVYAKHVATLRQAPGFNLRLTVEELVSFGRFPYSRGVLTEQDRQVVDEAIEFLSLEPLRKSYIDEISGGQRQMAFLAMTIAQQTDVLLLDEPLNNLDMKHAVQIMRALRRLCDEQGRTVILVIHDINFATNYSDHIVALKNGKLHFSGLTEQVITEAQLNDLYELDFEITYSERGCMCNYFNSSGA

SEQ ID NO: 4467 - protein, 604 aa, Acinetobacter baumannii
FGNDMNDLTVPEKLAKLRELMTNQSIDALVVMSADPHMSEYLPDYWKARQWLSGFSGSVGTLVVTQNFAGLWADGRYWVQAEQQLAGTGFQLQKLTSDESSTHLAWIEKNLPAGSVISVNGQTLSIQQFKALENTAKQRGFKLETQQDLIGSIWSNRPELPLEQIHLMPEGLNALSRKEKIQAIREILKTKAIEGHFISSLDDIAWVLNARGQDVEYNPVYLSHLYISTQKAVLFIDSNKVDLTTQQAFKADGIEIRDYEDTAKFLANISDASVLLDPAKVSIFHEQAIAKDIQVVYDINPSTLFKSRKHESEIAYIRHAMVKDGVALCHFFNWLEKALHQGQRISELTIDEKITAFRAQQEGFIGPSFSTIAGFNANGALPHYRATEEHYSFIEGDGLLLIDSGGQYVDGTTDITRVVPVGTPTEQQKRDYTLVLKCHIALAKTIYPEGLAAPLLDSICRHTLWQYGLDYRHGTGHGVGFALNVHEGPQVLSYYAPIHAYSKLREGMILSNEPGLYHEGQYGIRIENLVANRLHSGFEKTYGDFLEFETLTLCPIHLDCIVVDMLTDEEKDWLNGYHQTVQERLAEHLSGDVLDWLIYNTRKI

SEQ ID NO: 4468 - protein, 519 aa, Acinetobacter baumannii
LVCEVAMCGVVGIAGKSPVNQMLFDALTMLQHRGQDAAGIVTCHEGRLFLRKDNGMVRDVFHTRHMRALLGNYGIGHVRYPTAGSSSSAEAQPFYVNSPYGITLAHNGNLTNAEEIHDDLFKTDLRHMNTDSDSEVLLNVFAHELQKIGTLNPTPEDIFHTVSRVHERCQGAYGVVAMITGHGLVGFRDPNGIRPLIYGSRVTEQGEMEYIIASESVAITALGFKIERDIAPGEAIFINADGELFTKQCAANPKYRPCIFEYVYFARPDAIIDGISVYKARLKMGEKLAHKILRDWGEDHDIDVVIPIPDTSRTSALELANILGVKFREGFMKNRYIGRTFIMPGQQQRKKSVRQKLNPVELEFKGKNVLLVDDSIVRGTTCNEIIQMARDSGAKKVYFASAAPKVMYPNVYGIDMPAKTELIASERSVEEIQEIIGADRLIFQDLEDLKNAVRTSKVPTLTEFDCSVFDGIYVTGGIDADYLNNLEQKRNDSAKKKKDGYIDVNIDAASVDLTGIKEE

SEQ ID NO: 4469 - protein, 179 aa, Acinetobacter baumannii
TRCEFSCEQIMRKRQPVLKQEKTLNPELKTWLYASGSLTQQLTELGGGKFSVKPFKEHFQRLTFADSQWMNMPHTHTSWVRETYLYGSDVEPWVKAKSIFPIQSLQKKARIFQHIGSKPIGLFLFQRTTPLCDRRVIRLPEGWTRQSCYTWHGCKFIVQETFLPAFEAFLYQQHDKELL

SEQ ID NO: 4470 - protein, 416 aa, Acinetobacter baumannii
AVLEFLEDWQMRFVDEAVITVEAGDGGNGVASFRREKFVPFGGPDGGDGGRGGSIYIQADDDTSTLVDYRYTRKFRAERGKNGAGANCTGRGGEDVVLKVPVGTTIVDTDSGDIIGDLVEDGQRVMVASGGEGGLGNTHFKSSTNRAPRKCTTGTKGEFREIRLELKVLADVGLLGMPNAGKSTFIRAVSAAKPKVADYPFTTMVPNLGVVDADRHRSFVMADIPGLIEGAAEGAGLGIRFLKHLARTRILLHIIDVQPIDGSDPAHNAKAIMNELAKFSPTLAKLPIVLVLNKLDQIAEESREEWCQHILDELQWTGPVFKTSGLLEEGTKEVVYYLMDQIEQQREREVEDPEYAAEVRAFREQLEAETREQTIAAKEAYRAMRKAQRLESMMDDDDDFDDDEDDGDVESIYVRD

SEQ ID NO: 4471 - protein, 500 aa, Acinetobacter baumannii
NMLERPITFFFRGGQQQVENVVPTMTVLQFLREYTQTGKTRQTGTKEGCAEGDCGACTVVIGELVNDNLQLRSVNACIQFLPTLDGKALFTVEDLHSLLPVPDGTLHPVQQAMVDMHGSQCGFCTPGFIMSLWSMYENEQHSPSKDKISDYLSGNLCRCTGYRPILDAAQKAYNYPRVVLERQKVIDVLKEIKALPALHLNDQKQQFFAPKTLQDFATLRLQLPQARIVAGSTDVGLWVTKQGRNLGDMLYIGQVEELKKIVVTDHALTIGANVSLSDALIKISDFYPDFQELQRRFASMPIKNAGTLGGNIANGSPIGDSMPALITLGTRLILRVGEQTREIALEDFYLDYQKTALRLGEFVEAIVIPLREGQTRFKFASYKIAKRFEQDISAVCAAISCELDNDDVAHNVRIAFGGMAAIPKRAKYTEAILEDQQITAELMIQAQQALSQDYQPLDDGRASSAYRLHVAKNCLKRFYVEKILSQTITRVNDLIAMVEI

SEQ ID NO: 4472 - protein, 412 aa, Acinetobacter baumannii
FTVEVKMKNIKTINSITHSILLMGAVISSLGMIGISSVYAQEQVDPAYKPGNPIYDKWDRFYKIEQSQPQEAEKILVELSKLTPTDIKVWKSLTYLQIRLEKRKEALQSLRQARNLAPQDDTLKLQEAYLLNQQKKDREALVLFKELSSSSDPEIAAKATQAVKNLSGGEVKPYFRDIYFAPSYESRYDDVIFPLKIRYGKNIDNGRAQVYGFLNLNRDTQSQGGVRPEIIDENAATLGVGANYQPWTSIPVRAYVEVGGSYDLIDRNRKRFRESVVGGVTGYQEWYSQSNCDHSLCLDNYFTDLYGNVATYSREDYNVIGDLRLRTGLNLYKGESGSVQAYVKLHGLADSEDEYYNNLFEYGPGISWQPFNYQPIKLRVERLYGNYFKDVPVNTKDHYNNTRVELVFYKDF

SEQ ID NO: 4473 - protein, 127 aa, Acinetobacter baumannii
LLKDNFMLSKSKIVIDCIGQESLYVLEKSGSAIYKTPGFDTNFAKDLLKSYKEGLQKLKTIIDSSPSYDNSYYDFEFKTMIYAIDKLLLAIGNIKSEDDEIEAAIFQSYLRKQDESIRKTIEEEEAG

SEQ ID NO: 4474 - protein, 615 aa, Acinetobacter baumannii
MLKDLSQNLGQMNDKNNNVENFLKQIYENIFEQNSNRTALIFENRSISYAEVGTQVAKVMYALKMQDLATGSVVAICLRKSPEHIYTALACALTGIIWLPVDMDSPPSRLNYLLTNSRADVVVSDSSIAGVQTLNINEILSATTEYKPSLNAEINRLPAYYLYTSGSTGTPKCVVLNNQATENTLQQTISEWEITADDVIMAVTPFHHDMSVFDVFASMAVGATLVVPSFEQSKNAVVWANLVDRCKVTIWSSVPAIVDMLFSVAQKEQLQSLRLIAQGGDYIKPSLIAKLRQQLPNARLFSLGGPTETTIWSIWHEINEQDQEIIPYGKALENNGYFILDKNLKPCQMGEVGTMYMIGLNLSNGYLLDGEINYKDFVDIQVSENETQTAFRMSDQGYFREDGNIIFAGREEGYLKIKGVRISAAEVENALTKNPYIHNCVVISCVHPTTETQELVAVYTLENKYKTTRLNSPELKNFLKIHLPSSHIPSKYLAVETIPLTRNGKIDRKAVQEIAQGKIYVTSTLSANSSKTQSSIAEVGDSVLSVFRECIADSQAEKMDIFYRSEILDIGIRPKQLMSIAQKLSQKLNTQIDFYTLVSCKTIQDVVNKVEQQIK

SEQ ID NO: 4475 - protein, 481 aa, Acinetobacter baumannii
DKEEEMQQANMLNEFKLIIGGQLCSGEQGELEIINPATGLTAARCAKASVAQVNQAVSAAKQASKAWQLVSHDERKSILNKIADGIEKHAEMLAELVVLEQGKPLALAQMEVQGAIGWTRYAASMDLPVEVIEDSETKRIERHRQPLGVVASITPWNWPLMIAVWHIMPALRAGNVVISKPSEYTPLSTLRLCEIIQQEVPAGVISIVVGAGEIGEALSSHPDVQKVVFTGSTRTGQHIMAGAAQQLKHLTLELGGNDAGIVLPDANIDEIADKIFNMAFLNAGQTCAALKRLYVHESQYEALSQKLADIANAQVVGDGMASSTTFGPVQNQMQYNKVKALIAEAIAQGAKALSGQKQLPEQGYFIAPTILTEVSDSCRVVQEEQFGPVLPVLKYTDINDAIARANDSEFGLGGSIWSSDLKTAQTYATQLQCGTVWINTHAEVLPHAPFGGWKMSGLGAEFGLEGLLENTIGQTVHISKV

SEQ ID NO: 4476 - protein, 216 aa, Acinetobacter baumannii
LVREYKMVSAQNLLERLYPGRRAALKRQILLDALDCFLEQGIETTSIEMIRAKSESSVGAIYHHFKNKEGIVAALFFSALDDQTALRDEYLKQSKTLKDVVEALIYSYVDWVSEQPEFAKFLITARFNIIEGEEQQQLTQKNKSRNQKIFSLISNFEEFKAFSLIPHELLLSLVIGSTESYCRAWLSQRVKADPKDYREILAKAAWNSLQDLRLEH

SEQ ID NO: 4477 - protein, 147 aa, Acinetobacter baumannii
LPGEILMHICPLHSYFKQSLNDQVEASLAQGNEIKKLAHGESGHDWYFNNQPISAQSTLREMMTKSIKNHKAKKSEKKSSKRATRAQINELIKWLDQSTGRGTLLTQKLECSPSFISQIKNFTRPCSAENYKKIKEAILEIEQDEKK

SEQ ID NO: 4478 - protein, 173 aa, Acinetobacter baumannii
MKSEIFNMVLSLIERREKTVMSLEQALKAAVYRPGDEYLMAQIAEKNGWNINTFRSSINPTTPTHKANIYHFEAILDETKDSRIMDSVCAIHGNAAWFELPKTENLNTADFVMKIGKLAQEQGDLSQSVAKAIGDGCISEDELAVIRKDAFELIRVVSTILAMAEEQHRGDHA

SEQ ID NO: 4479 - protein, 887 aa, Acinetobacter baumannii
FNKEKAPLSGVFLWVKYMSDVLSRVQILLDANTAKFEQNIKSAQKTSETSFTKISSSAKAMAGIVATATVAGAASLYNYSKEQAKVIGELERNAFLAQSTVQEFQKMSVGAEMFGVQQDKLADITKDFNEKLGDFLTTGGGEYVNFLEQVALKTEGSTSKALELTKAMARLSGPEAMALYVKKMEEAKLSQDQMSFLMESMASDSTLLIPLLKNNAEGMKLWGEAAEDAGIILNDKTIKAARELQVQTKMLDMQMQGMKNQLMASVMPALVDIADAFNTGDKEARGMADGGKVLADSLRGVAAIAMGVWAALNLVSNSIAGVTNQAIDSYTLTSKAAKDGGFLDQLPGIQWAKTFITAGVTASAENSYIKMAGRDNDAVIKEFSEKYTKIFDDTVSGRTKTLSGLMEQANKGSAAATQGVQDWKDKQDKAAESAKKLAQAQQELNRKLEERKRLQDSIIYEYGDKEYQMQLNYERQANDIKRAFDGEQQQRFLTIAKNRYDTEKALYLSKLAFEISEHRLTEEEKLNFQYQIDQKEIAARTDITDADKASFYRAAREKHDQSMAWMRLESAQRLNDAQAAFQTEMQNLTAKFEFEREQIRLNKSLDPAEQSTLIASSYRTQDLENEASRHSAWMDYQSATGVDTSAEDAANRRAEAIKNAFEWQLITQEEYQQKMLASEAQFNTDKAALGAQAAADTLSGMTDLMGSLIGEQSGAYKAMFAMSKAFAVAQAIMNAPQTFSNVYTSVSAIPLIGPYIAPVMAGAAVAVQVAQASQIKSVSLDGMAHDGISSVPEDGTWFLKKGERVLDDQQNSALTRFLNSNGGQMNGFNININNYAGARVNTRRDENGLTIDIVDERIAGAFTRLGSESNSHESQMVQQAFNVERRR

SEQ ID NO: 4480 - protein, 239 aa, Acinetobacter baumannii
FLKDKFMRTLAISTLLLGTVLSPMVFAQDDNALHYNIVNVQAEASRQVSNDEMHATLYIEKSNKQPAELSNQINQLMNQALATSRKYPQVKVETGAQSTYPIYDNDSNKLKEWRGRAEIRLESKDFKAASQLINELQQSFQTQSINFSVSDEQRKKVENELMVEASKNFQQRAQMLTQAWNKSQYSLVTLNLNTNNYFPQPVMRASLAKFAAAEAAPAQDMAAGESKITVNANGSIQFK

SEQ ID NO: 4481 - protein, 382 aa, Acinetobacter baumannii
KTEENMIEVVDGQRKLSECKRIVVKIGSSLLTANGQGLDLDAISHWAKQIADLHNAGHEIILVSSGAVAEGMVRMKLASRPTDLPSLQACAAIGQMGLIHTWSSVLENHSIRTAQVLLTHDDLADRRRYLNSCDALQNLIDWRVIPVINENDTVSTDEIRFGDNDTLAAMVAGQVHADLLIILTDQQGMFDSDPRHNPDAKLLSTVRAMDDVLFEMAGGGGVLGRGGMVTKVRAARLAAKSGCPTLIASGESDNVLSRVMAGEMLGTLFTTDKDRMTAHQQWLAAHLQTAGRLVIDDGAVEAIKLKHRSLLPVGVKTIEGHFDRGDVVECVDKQGKRVAVGRVNFSSRSAEIIKGLSSDKVYQVLGEARSLEMIHRDHMAIY

SEQ ID NO: 4482 - protein, 262 aa, Acinetobacter baumannii
QLLLLNSGNIMANLHEIIQWCDQTLKAAEFKDYAPNGLQIEGSTEVKRILCAVTASEDAIDAAIAKNADLLLVHHGYFWKGEPYPITGMRGNRIKKLIQNNISLVAYHLPLDAHPSLGNNIAIAEKLNLQNLEPLDLTEKHPIGNIGYLEQALSVEEFKAKLQNGFDFKVIHLPAEKQSIQKVGFCTGGAQDFIAKAALQNCDAYISGEVSERTFYEAKELSVHYFACGHHATERYGVQRLAQAISKQFAIESEYFELNNPI

SEQ ID NO: 4483 - protein, 84 aa, Acinetobacter baumannii
AASLTLQGGDCMSCEREVILLGDPVVYRDDLKGFDELGVVVEAGSCLKVLWNGEDHPRSEIQERLRGARLDEVDASQRMIRENF

SEQ ID NO: 4484 - protein, 981 aa, Acinetobacter baumannii
QMQLVIIFICLYDAETRLICQPSYRSMCELTSMQAACWFGRSGNATLGGVAAHLYAEFDGQFIDLQKLHLALQRLYKEHPILRLSLSADGIANIMSEKTQQILEVDDFSKLSDHQIEQMLMQKQEQWTHQKLDLSQGQTARFSISVLKNNIFRFHVDTDMIAIDPSSFLNLMEDLSLFYEDPEISFSRPPNFFDWYQKIRTDPDLKKLNQRDRLWWKQRLPHISPAPSLPFIHQEFKTAKSDRLSTWLSPEERTALQQLAREQHITVTNLILGLFAYTLGHATKDHSFRLNIPTFWREPVLKNVEGTIGDFANLVILDVDMKGITTLAAFCKQIANQMLELLEHSHYSGVNVLRDLSRYHGSAQIAPVVFTAALDLENDNLLSERVRRVFGSMNWVISQGPQVALDAQVAQVDDGILVNWDIRLDALPKEWITNLFESFIHLLKNLAAHPEQLNTQIINSAQNTSSDRTSQKPLNALQQAYLLGRTQALPLGSVAMQEFRQYHGKMDIVLLRQRLAEMVRRHDSLRTYIDKNRLIQYVSDQVSVNLKEIDLTTWEPERASHHIESYKNSYTHELFDLNQSPWNITVFLLKNNLLTIFVRFDALILDGRSIASLMLELFDGQQHDIQTQIEKNEVENSLSVHHTDMAYWERKFSKLSAIPTLPWKTPLQHLPTSRYQRNSLVIEKDQFKQLSKIGAKHSLFKNSIIMAIILEVLSHWSTDKSLCVAVPTLPLYAGPFSNSSTFIAVEWKTSDQFAEQANRLQTEVLEGLQHLSFSGVDLARLLFEKVGTAPVLPIVITNGLSWPVLSESHPIQQQDGLTQTPQVAIDIRFSTRNDGALIFDIDYAQEAFSSQMIEDFLDALQLAIKQIIGSEIFSFDLSNFFSELQKKRPYFKNNESDHSSIPLENNAKQQNQLLDIYLEVIGHTPNKEVDNSTHFTHLGLRPHHLKVVSKRINEIYAIQLSPVQLIQCRNIADVEKLLTPH

SEQ ID NO: 4485 - protein, 109 aa, Acinetobacter baumannii
VKKLRSRPELKFKYQLALRLGRTVEELENTMSNKEFEYWKAFNVLEPIGLFREDILFAGLGRTIADAMVPGHNLKLDNFMMFKEKQPMPKAEIQNNLKAFFSGYSKSKV

SEQ ID NO: 4486 - protein, 263 aa, Acinetobacter baumannii
PQFCSSEAELNTRKSINNNCYRCLGMNTHLNQSIRFSKSRPPHLFLRGAIDILPLSISVIPWAILAGSMAVHAGLSFYKALAMSGIVFAGAAQLVSLSMVMEGASLLTIYVTIFFLTAQHFIYALTLRNDISILPLSKRLTLGFLLTDELFAVSVPNEKKHPQYLFGAGLCFYLFWVVFSLVGILLATALPNLLNYHLDFSIIAIFVAMIVPMCKGKPVMAGILMTCVSGFVLKFFHIEGAILISGLLGMFIAVIVENKMGEK

SEQ ID NO: 4487 - protein, 400 aa, Acinetobacter baumannii
KLLCVEDMNVRRTFTWLPWVLLIIVIASFIAWQKYHQPKPTVAVDGVQMPAEKVEPLVDTSRTGGVVSYSAAVKVAAPAVVNIFTTQKVKQNHPLLSDPVFREFFGNQVPEQQQQNENSLGSGVIVRADGYILTNNHVIAQADQIVVALHDGRRAEATIVGTDPDTDLAVIKIDLDKLPVLPFKLSGNEVGDVVLAIGNPFGVGQTVTQGIISATGRSDLGINTYEDFIQTDAAINPGNSGGALIDVAGNLIGVNTAIFSQSGGSLGIGFAIPAKVCQQVLNSILKDGRVVRGWLGISLLPPTQDDVLAPKQQVGVVVADVLKNGPADAAGIKVGDKIVQVNNEPITSASHLINYVALQAPNSEINVLVEREGKQQNYVVTVGERKAQNTQSQYIPLPRR

SEQ ID NO: 4488 - protein, 385 aa, Acinetobacter baumannii
LLIWMPSPMQQRVIVGMSGGVDSSVSAALLLQQGYQVEGLFMKNWEEDDGTEYCTAMEDLADAQAVADKIGIKLHTANFAMEYWDRVFEHFLAEYAAGRTPNPDILCNKEIKFRAFLDHAMTLGADFIATGHYARRAETAYNSKGEAYAPLLRGLDNNKDQTYFLHAVHGREINKTLFPVGEIEKPEVRRIAEELDLATAKKKDSTGICFIGERRFNDFLKQYLPAQPGKIVLDNGKEVGEHHGLMYYTLGQRGGIGLGGMKGASEGAWFVLHKDVANNRLVVGQGHDHPLMQSTQLWSESIDWVAGEQNIPAEGLRCTAKTRYRQPDQACTVFIDENSEHGVRVEFDEPQRAVTPGQSVVFYSDEVCLGGGVIHHTNAPTPNFI

SEQ ID NO: 4489 - protein, 158 aa, Acinetobacter baumannii
RLNCLSYRHISNFSFRLSMFMKKSLVQSLSVVLLMTMATVSYAADKKKTAEKKTENENVVEVTPSKGTTPEELAAIQVLSEICPSLIGKKDAEFAQGYERLVKDYLPNEADPVAALEKRSKDKSFKKVLKEARNDAKAAGNEQNTLVCQDVKAYQSQN

SEQ ID NO: 4490 - protein, 160 aa, Acinetobacter baumannii
CRNCLQGNFMQLTLVRHGEAAPPVNGNDIKRPLTARGHAQAEQTATFLKDIVKPDIFVVSPLLRAQETLAHIQTYFKDVPVLLCDKIKPDDDAKEAIEWLSQIPYESIVVVCHMNVVGHIAELLTHENFNPFALAEARIYDQAVIANGLSTQKNSFIPTI

SEQ ID NO: 4491 - protein, 169 aa, Acinetobacter baumannii
WCDWGGENTIMKMLAQLQNRFDQWVEQIVQYLDRLTVRERIMVVFTTIFVVVVIVGYSLWKMHSLAEQQQKRLNDLKDLMVWMQSNAVTMKPANELELDKSGKIQRVAQQQGLTVSSQQNGEQLQIVVTHQNYAILANFLTQLAQMGLSIQKMEMVSSEGQIKLTATVQ

SEQ ID NO: 4492 - protein, 525 aa, Acinetobacter baumannii
ESSCRSIGCSARRVSMVDFAEHRKALLCNDAQSIADYESAMGEAVKAVSAWLQNEKMYTGGSIKELRSAISFQPSKEGMGVQQSLQRMIELFLNKSLKVHHPHSLAHLHCPTMVMSQIAEVLINATNQSMDSWDQSPAGSLMEVQLIDWLRQKVGYGSGQAGVFTSGGTQSNLMGVLLARDWCISKNWKDENGNPWSVQRDGIPAEAMKNVKVICSENAHFSVQKNMAMMGMGFQSVVTVPVNENAQMDVDALEKTMAHLQAEGKVVACVVATAGTTDAGAIDPLKKIREITNKYGSWMHIDAAWGGALILSNDYRAMLDGIELSDSITLDFHKHYFQSISCGAFLLKDEANYRFMHYEAEYLNSAYDEEHGVPNLVSKSLQTTRRFDALKLWMTIESLGEELYGSMIDHGVKLTREVADYIKATEGLELLVEPQFASVLFRVVPEGYPVEFIDSLNQNVADELFARGEANIGVTKVGNVQSLKMTTLSPVVTVDNVKNLLAQVLAEAERIKDAIASGNYVPPID

SEQ ID NO: 4493 - protein, 231 aa, Acinetobacter baumannii
EQYCLIEKIKQAASFLYWGKMMAGFYRTNLGKVALQQRNIALNAKQRRLLLLIDHEDFQSLNTEFKKRIAPPELIQQLIDLKLIAPISENDSEFTEQIPLLVSPTTSLEVKAQQKSTIDENESADLTGEIKVSLEPSCHSSNIENTQPPIPVQQLTFEEIQLLMKQSLSQYCGLMAKPLIQKIEQIKNLQELKMCQMQWITSLQESRIPPHELAHTLYSINYSIQLIQQKN

SEQ ID NO: 4494 - protein, 107 aa, Acinetobacter baumannii
FAACKRKYYCIYIGLFSELNMALLITSDCINCDMCLPECPNTAIFEGSKVYEIDPLCCTECVGFYDAPTCKAVCPIDCIKQDPVHIENKEQLLEKFKGLNLIGSFSS

SEQ ID NO: 4495 - protein, 167 aa, Acinetobacter baumannii
LIEWIKNMTAIANNHVVSFHYKLTNAEGETLDQSQGEPLAYLHGAGNIIPGLENALTGKTVGDKFTVNVPAAEGYGEYNPDLVQEVPAQMFQGVDNIQPGMQFQAQTDDGVQIVTVKAVEGDNVIVDANFPLAGQDLTFEVEIVEIREASQEELDHGHVHGAGGHHH

SEQ ID NO: 4496 - protein, 222 aa, Acinetobacter baumannii
NLRCAKHSLYRLCCAFFSPKKVSHLQTTRIYNGKTMPNLVLPTRALYVVNKAIDLFHHRGFHLIGVDRIVRESEITKATFYNYFHSKERLIEICLMVQKEKLQEQVVAMVEYDLNTSAIDKLKKLYDLHTDLEGPYYLLFKAIFEIKNSYPNAYQSAVRYRTWLKNEIYSQLRLLKPDVSFTDAKLFLYMVEGTIIQLLSSGGVSERESVFECFLRGITTCK

SEQ ID NO: 4497 - protein, 380 aa, Acinetobacter baumannii
AIQWLISLFLCLFVAFNNWQSWKFWQKMAIFPRHLRQICDKMKLPTPRKRGETYTITVSHQGKRYYCTRDTAKECEQWAALKLLELKAQKKIESGEEKPKFLFRDLNNKYYQEVGMLNPSKSSRAWIKGQHKNFEVKFGALAQKSIYDITPKDLTNWRNKRLSEVSENTVLKEISHFSAMFTFAQKELFLIDENPWMQMTKPKKPKARDRRIHPSEIDLMLKALDYERGSVPVLPQHYVAWGFLFAIETALRRGELLAMEKKDIYDGYVHLPKTKNGDSRNVPLSEEAKELLKLIQHTGRNIIPQSENAFRLMWEKRKASIGLNNLHFHDTRHEAITRMVRVRKLPVEVLAKITGHKKIDVLVNTYYNPDATDLIEAFNG

SEQ ID NO: 4498 - protein, 798 aa, Acinetobacter baumannii
LLWWRSNMNQTIDLNISKKSAKAGDSIPHESAHLHVTGQATYIDDLPELENTLHLAVGFSNCAKGKISKFDLDAVRQAEGVYAVFSAKDIEVENNWGPIVKDDPIFAEEQVEFYGQALFVVVAESYQQARQAVRLAKIEYVPETPILTIQDAIKKESWVLPPVEFSHGEVEQAFQNAAHQLSGAIELGGQEHFYLEGQISYAIPQENQSLKVYCSTQHPTEMQLLICHALGMNMHQVSVESRRMGGGFGGKESQSAQWACIASLAAKKTGRPCKLRLDRDNDMSATGKRHGFAYEWSVAFDDTGILQGLKVQLASNCGFSADLSGPVNERAICHIGNAYYLNAVELRNLRCKTNTVSNTAYRGFGGPQGMFVIENIIDDIARYLGCDPVEIRQRNFFAEQPGRGRDRMHYGAEIRDNVAPKLVAELLQSSDYAKRRQTTHAFNQNNDIIKRGIALTPLMFGISFNAVHYNQAGALVYVYMDGTVAITHGGTEMGQGLYTKVRQVAAHELGLPIDSVRLIATDTSRVPNTSATAASSGADLNGKAVQNACIKIRERLAKLAADISDSDAGLVQFEDSMVTTANGHSWTFPDLVQRAYMARVQLWDSGFYKTPEIHYDQVNHLGRPFFYYAYGAAVSEVAIDTLTGEMKVLRADILHDVGRSINPAIDIGQIEGGFVQGMGWLTTEELYWQPQGPYAGRLFTHAPSTYKIPTSVDIPHIFNVKLFNNQNQADTIYRSKAVGEPPFMLALSVFSAIRQAVQAAIPENAPLVLNAPATAEEILRAIAIGRGQALAARPQAKM

SEQ ID NO: 4499 - protein, 69 aa, Acinetobacter baumannii
FMTRDDAIKLLNCTYSELADKLKLSTAAVARWANRELPYDREYEILELAAGRIPKRLLKAEKNLSQANN

SEQ ID NO: 4500 - protein, 381 aa, Acinetobacter baumannii
TNARTWSPFMMKKSLFCMTAALFALPTVTSAASPYFSLKDGDGFKRFSVSAGWLHAMPQGSGNPVNINTSVAEGTKSKVGDVSTKAVLDAIDQSKPSGQFWHSTISLLDKFTDTLPSSLAGTAEINGLSQWEQQGSGLEAADVDTVGLMFNYNFTDNLSLEIKGGIPPKVDINGKGNIYAPLSGKATPLKDGSVIGGIIGDGIAKAGGDIPLKQDIHITDLSQGGKAATARAWLPAVELHYQFGKTGVNKFRPYIGAGVMYAYFNDLKMNSGIEADLIQAGHMIQNIHDNKAGAALDRKTSSANPIVKLEATDTFAPIVTVGATYDFNPNLFAVGSVSYSKMNSEAKIYVTDQNTGKELIQANSKIDIDPLITYLGVGYRF

SEQ ID NO: 4501 - protein, 340 aa, Acinetobacter baumannii
SADRTYRRWCGGNYFPHPHFEGVQIMRITKLWMIYLIVICLAVCFLFLNSGLDFDYVIPNRLLRLATIVIAGICVAFSSIVFQTLVGNRILTPSIMGYEAIYLLWQVLLLFFWGTHGLSQLGVNGNFFISIVLMLLYSWVIHKWLLPYGRNDVFLLLLLGLVLTMVVGTVTQFIQLKINPGEFSVFQGLSYASFNRSQPETLFYASLAVVIVLFLGRKALPVLDVLVLGREQAISLGIDHHRYVSFYLALIAILVAVSTSLIGPTVFMGVFIANITYALARSYKHKLTLPIGCAITIAIFIAAQILVEHVFNYKTTVSILVNLVCGIYFLALTVRTRGVA

SEQ ID NO: 4502 - protein, 73 aa, Acinetobacter baumannii
HEVLLVIWIPVFRLLVMVRMGETGFMEWTEHKSLSITNKYIKFDNTIRIFITIDVFALENALIGVCVWIYFMP

SEQ ID NO: 4503 - protein, 286 aa, Acinetobacter baumannii
SKLRLLNMTVSKLFTLLAAAKSELSMQDTPLIIGSRSFQSRLLVGTGKYKDLNETDLAIQASGAEIVTVAIRRVNIGQNPDQPNLLSVIPPEKYTILPNTAGCFDADSAVRTCMLARELLDGHNLVKLEVLGDEKTLYPNVTETLKAARTLIDDGFEIMVYTSDDPIIAQELESMGCVAIMPLGSLIGSGLGILNPHTISIIKENAKVPVLVDAGVGTASDAAIAMELGCDGVLMNTAIAAAQNPILMASAMKKAVEAGREAFLAGRMPRKRMANASSPETGYFFK

SEQ ID NO: 4504 - protein, 614 aa, Acinetobacter baumannii
VFMRDYFKIALQYCHDVRSGVRTAGQLEKFAVKRFLNDLNRSGIPLGSGDEELEKLLTSLKIGTKPPDINFEFKFDVERAQHACFFIETCPHVEGELARLKRDGTRHLLVMSPWQVFVTVNIFGWVNYEGLRRFTYVYLEVAKKNGKTTWLAAVGLYMGFIDGEPGANVYAAATTRDQANILFGAAKTMVAYSPKMQERFGITKQEYSIFQTTTNSSFKALSQDRDGSKDGYNVHCGLVDELHAHKDSGMYDIVSNGIASRTQPLLFAITTAGKDTTSVCYRERKVVVAILKGEATHERYFGMIFCLDKGDDWKNPKNWPKANPNYGISVKPEYLQGMADKCKISPSNEAIFRQKHLNEWVGAVDGWLAESVVSNCEVEVSYKKFKGVVGFGGYDLASRLDLASWVEMRPDFEDGKIIWYVFAHSYINERVMESTEAINGEMRPDDYPVWRDEGWLIETPGASTDFNRIKEDILEHHNDYPFYEVGHDPYHAEQVTADLLDAGLNVIEVPQRTEYLNPAMRWIEVLIAENRIRFCGDPVLKWCILNVVVKEDAKECIFPRKISRAKKIDAAVGMIIAASRAMYWDKEEVFELVPGEENGNFDDFLSGMIKVSRR

SEQ ID NO: 4505 - protein, 135 aa, Acinetobacter baumannii
INMRMLHTMLRVGNLEQSLKFYTEVLGMKLLRKRDYEEGRFTLAFVGYGDEENNTVLELTHNWDTSSYDLGNGYGHIAIGVEDAYKACEEIKARGGKVVREAGPMKGGVTVIAFVEDPDGYKVELIQQDANARNN

SEQ ID NO: 4506 - protein, 76 aa, Acinetobacter baumannii
STMRADIHPKYEKLVATCSCGNVIETRSALGKETIYLDVCSACHPFYTGKQKNVDTGGRIDKFKQRFAGMSRSIKR

SEQ ID NO: 4507 - protein, 398 aa, Acinetobacter baumannii
RLLRRLVIVILTEQKMILSPADQERIETFWNYCLKHQYFNIGYPESADFDYSALFRFFKFSINNCGDWKDYSNYALNSFDFEKDVMAYFAEIFQIPFEESWGYVTNGGTEGNMFGCYLARELFPDSTLYYSKDTHYSVGKIAKLLQMKSCVIESLDNGEIDYDDLTHKIKTNKESHPIIFANIGTTMTGAIDDIEMIQERLAQIGIMRRDYYIHADAALSGMILPFVDHPQAFTFAHGIDSICVSGHKMIGSPIPCGIVVAKRQNVERISVDVDYISTRDQTISGSRNGHTVLLMWAAIRSQTNLQRRQRIQHCLKMAQYAVDRFQAVGIPAWRNPNSITVVFPCPSEHIWKKHYLATSGNMAHLITTAHHRDTRQIDSLIDDVIFDLQGASKRTVGF

SEQ ID NO: 4508 - protein, 302 aa, Acinetobacter baumannii
GDELMSNLLNICGIVIASSQYPDATLQQFYRQYYHCEIKAEQIKAEIQSPSDLSMFFPYQDTWWPVFTIDQISSESFQKFIHNGIRPGIILPDEVFGFPHYFLLKEAVSQGAIPIVLFKTEQPQYFAAKATFSTAIGLRPMAAFVSTGWDENLISQPAGSYIIQLNSANLPLPSREVRQGQHLFYSAKGFDGHVSGYEIIINPPADLPLSNIRYPQLGISWNFNNIDYESTPEHVSTNLIGYIFIVLSIVVVPLDLILTTTYPDLLGTFGSYISWISLVVGAILLLLLISSIIRRVRKNGSN

SEQ ID NO: 4509 - protein, 221 aa, Acinetobacter baumannii
SVNSLSIGSFNMQDAIAVQSLKTDIALLRQHIFPPQYLEHVEGLPIYYGLQEEVVAYYQQWKDLIERAQELFQPFMEDELPDAIHLPSHLNLPLFFFHVDRIRINKTRAKESKTFRGVASLIEKCGQFETDQIFTMQEWLQSDDTAALVAHREFIDLRTYVFQHGQSEYTRSRFYTNGIVLGVEPHFKLVDARDKPRKQRSDSYSDPLADNGVWKVFGKYR

SEQ ID NO: 4510 - protein, 377 aa, Acinetobacter baumannii
NKDSPSLGLYMKKQLPKISTTSKALAKSLLLAQGVLDQAKKYSTLPFTQTHIIRPRIDEKYYSWTHYGIFFPLLPEPHRYLNIMILIGTPGALAFDHDDIITGNPRQTATFFSSTAALEQALLKAYIIPENTKINKDGTLIELGQEISIQGKFPHIHINGHYDGFDFDFDIDITSHVSWFIKTPIYDHFSLLAKFKGFLNYQAKRIETQGLCTYEYARAVGPHSITNKLIPDAYKLPLDFFTYQIINLNEATQLLLTKADIAGQTAAYTLHIRHLDQPAEIYTDVSFDIISHQVDDFVSPSGQKMRLPKYFSWIARNDAKQIILNIQAEIDCPFRYGHGRGYASSYIFTGHYFGNEVQGRGYIEYIDIENPQAFDDE

SEQ ID NO: 4511 - protein, 180 aa, Acinetobacter baumannii
MAVRCVGSKSMIELTPEQLAVLDQSAGPIGWLESVEISHQNWPQVLRYVVNSSEPILLTHEDGQTFEYVYVPLTINRGGDEDNLDQKLTAVIGDVGTIVPDLIKLVLQDDEITPPILNYRAYIIGRYDVPAYVVRDLEVVTVTRDYRGSSFEAQAPGLNDSGNGEIYSASTDESLEGFYA

SEQ ID NO: 4512 - protein, 422 aa, Acinetobacter baumannii
KFLRLNYMFVRSLLAMSLSCIIANVALAASTTEQPLNPNKVSAPVEDPIDPLAVDAASTVKAQAQTQITAQEQNDLNRASTTLQNLQKAEDQNADSGIAASTPVATAKTTTATASTATSAPAVTWTLDSLNNAEWYENIGKGQLPVYARAHVMLNNAHASPGAIDGMSGKNTLKAIASFQQMNGLSPTGELTKETWDALVAKQNKPAFIEYTITDADLKGPYAQSIPSDYALQAKMKGLYYTRVSEMLGEKFHIDEAFLKKINPTATFKKVGEKIIVPNVRNDLPEDIHLIIAHKGAKQLYLFNSRNQMIASFPATIGSTDTPSPTGTYKVVGVARNPWYSYSPSNFVQGNNLKPLSLPPGPNAPVGNIWIGLSKKSFGIHGTPNPSLISKTASHGCIRLTNWDANDLGNKVRSGVTVKFLE

SEQ ID NO: 4513 - protein, 485 aa, Acinetobacter baumannii
FLIREELLKFLPVILSLALITNASYANPFDPKPASGQVEIPNIGSGIGLLDQQKEKFIGEKVFREVHKQMPVIQDVWLEDQFFQVFSNILSETQLGQPIALVVIKDPQINAFAVPGGLFALNTGLISSARNIDEIAGVMAHEIAHVSQRHFSRSEEAFKGQTLLSLAGLLAGVALAAQAGGDAGAAVMLGTQAALLDKQLTYSRNQEREADRIGMQYMYAAGYNPQSMADYFETMHRATSRVSFLPDFWLTHPLTSERMSEARLRANQMPKVKSRIYDVDFEILKWYTMVVAGEATENQLQSLASQKNLAGLLALSAFYLKQGDYTQAQATLEQAKSSGKPLVALIQTDIYLGQNKLDQAYNSIAPLQMTMPENKAFSYKLAEVLLRQGKYAQVQTLVQRFINKNARDIQGWQLLQQAANLDKNSPLRAVNVLRYRAEAQYWSGSEEDAIKSMLHAQRLAKGNQAMSARIDSRLKQMQDERRMKI

SEQ ID NO: 4514 - protein, 540 aa, Acinetobacter baumannii
REISMSDLKLSHLMTDSSLAPALKPAFPKLFAGTLAAVFSGLAILTALWGMIQLIGYLSSYWVIFSAVFWIVGAALAALASWLVHDAEAGFSARLRRQIAHHLIRLPNTTLSKQGDQNLKRLVSDDIATLHHMVAHLPSEIAIFAVIPLVSIVLLIALVGPMALWVLLPGAIASLYYLIIVPHVSKRDGAARMQVMLDIIGSADDYARGIRDNRIYGQQSGALTAYTQSAQNFTQNMVSWVSKVATLAAVATALLQAVATFAIAYFVAYQYDSMTLAATLFFSLAIVTPSLRLGHGLDYVAAGRAAASRLSAFLKEPVLSSGNLQQIEEDVTLEIVNASFAIENQKVFDRLSYAFPKNSITAITGPSGVGKTTLLRALAGLAVLQEGVVQLAKTDILQLHEKLRHEKVLFIPQGGDVLPTTVRENLSLSAVNANDAQLEQALLKAQLKVDLNADATLLSGGEKQRLGIARAFLSSAPIILLDEPTSALDQTNATKIILELNHLAKNQNRTIVMVTHDLALAAHADNRLVLKGPTDSGKSL

SEQ ID NO: 4515 - protein, 535 aa, Acinetobacter baumannii
SFSRRIRSRSRTRCGWSPPLSLLLEDNKRQSFGFAFFMSLIYIIFIELIYFLGTCMSNAYQLIWFRQDLRIHDHAALWHASQQGPSLGLVILSPEQWKQHADAPIKISFYLRQLRTLQKELSALHIPLVIQVIPYWKEIATFISDFSKKYNIENVYANIEIGVNELKRDKTVQDYLNRHGKELFLFHDRTIFPLRSIRNQSQQPYQVFSAFKKACYTKLDTSGLPQCYPVPNKQNEVPLDFLQGKNIDLDEIEKLFCSSLSKEQQDLWPVGEQYALEQLDQFIEQSVCHYKVERDFPHIQATSKLSPYLNIGILSIRQCLQALFRNQHGNFHLVNEGQQTWLDELLWREFYQHILFDFPHVSKHIPFKKDTQKIKWNHNPEHLTAWQMGQTGIPIVDAGMRQLLQTGWMHNRVRMITAMFLCKNLLIDWRIGEQWFMRHLIDGDLAANNGGWQWCASTGTDAVPYFRIFNPIAQSKKFDPEGEYIRQWVKELAHLDNKTIHEPYSSKTDLGLNYPKPIVNLKETRLKAIETFKNI

SEQ ID NO: 4516 - protein, 825 aa, Acinetobacter baumannii
QGASMIFLLFVLSIVIQLVAIWAIFFFNLNRVAGSVITIAVAILTAFILTPWALLLGIPLIALSIIILFKPLRFNLITQPAYKTLANSMPSISTTEQEALEAGTSWWEKELFMGAPDWSQFEKYPYPTLSPEEQSFIDNEVEVLCSMLDEWEIHHQLKDLPPEVWQFIKDKGFLGLIIPKSFGGKEFSSFAQSRIMSIIASRSLTAAVSCMVPNSLGPGELLMHYGTDAQKQQYLPGLAKGEEIPCFGLTSPEAGSDAGAIPDSGVVCYGEYEGAQVLGLRMNFSKRWITLAPIATVVGLAFKLYDPEGLLGDKTKTEYGITCALIPANHAGVKIGARHYPGSPFMNGTVEGEDVFIPIDWIIGGQENAGKGWRMLMECLGVGRGISLPALATAAGEMSYLTVGAFARIRQQFNISVGKFEGVQEASSEIASDAYMLEAFRYLVTCGLNQGGTPAVMTAMAKYYATETMRKVVNHGMDIAGGRAIQLGPRNFLALTYQAIPIAITVEGANILTRSLMIFGQGSMRCHPYLFEELQLLQSDDKANAVQKFDDLLFKHLAYTFNRGARSFAYGWTGGSSDAPQSADQFTASYYKTINRFSANFSLVSDMALGLLAGDLKRKEMLSGRLADINAHLFIATAILKYYEAGQKTEAEQLHAKLALQKAFLNIQEAFWGLFDNFPAKLPAAFVKWICFPLGRVISKPDDELKQQVAELMMEEHPFREQLKRHVYYSTEPNDVTGRLEHTFQMLRTIEPLWDKFKKAESKGKFTGLTFEENIAQAIKEGFISESEAQQLLQYNAIRFDSMLTDVFDEKLNKDLPLSNPHQIV

SEQ ID NO: 4517 - protein, 254 aa, Acinetobacter baumannii
GTKRNSKGLELQQFKRLLIVFFFIIIANICGVLIAIWVFKHFNIYIPLKNQAVAIDLQEPLQVQVKVKDALNVDVKGRVNANIPINEKLNIPLTQTLTPRVYFDNMVPISTVIPVKETLKVDQSLPIDTKVQVRVLGKDITLPLKGNIPLQLDVPIDIQVPLDQKVHLKFDAPVKTVLKENLHIPLNAQLKTNIPIQGSLNVPVKTALNASVDVKNTLPVKIEHGELKIPLSSMSLNRVKSGEDHSSPVQNQTK

SEQ ID NO: 4518 - protein, 172 aa, Acinetobacter baumannii
IQKRTSVWSNPNSVDLNQLASTKMAKSEISMKTLTVASIFSNFDFYQRNYLNILNQPESYYTPVEDAWIDAFPFKKQDLYLGDLLQLWFSSKWDVHTSLKVLKCSKVLDQSKPLYIFQLEGELFLGKNKVLAWSTQHHEVIELQLKNIWAPYVVAKTCDRPDIPYLMKKAAV

SEQ ID NO: 4519 - protein, 243 aa, Acinetobacter baumannii
IWRRSLFTCSEPDKIGEWLMFGSLKSILISFFLIMILTAILFWFYLNIQASVVVSAHESDIRLPESLETKIHVGNNLQVQSVGKLDTSIDIDRQISVPLKGRYLADLEFEVETPITVSVDYATTLKVDQVMPLETTTDLIYKNKLLPRFPLKLNIPIKLDIPFQLKRSYTIPVKIAFNGPVYFEFDESINLPIKHQFNPSLNVNDAMEMGNISSFNAIMYNSVQHTKANLDMKMDLPLRNVHP

SEQ ID NO: 4520 - protein, 129 aa, Acinetobacter baumannii
KFRRFLCMNISKLFYCKYDPEKFHCVHFVIKAAEYIYGQDYSPCFVGLSSPLSEAIKTSRETVHQNKRIDRPKEGCIVLMTYMNESSHVGLFFQGKIFHLGESGVQRITVEQAKIWFKRIRYYEPNLHH

SEQ ID NO: 4521 - protein, 758 aa, Acinetobacter baumannii
ITLSKSKVEVMSQPLFKKVAFIGLGLIGSSLARVIVAEKLATTIVASTRSQKTLEDAKSLGLIQEGFSDPVEAVKGADLVVLALPVRATQKVLEQIKPYLSETTIVTDVGSTKGNVVDAAKAVFGEDLPAGFVPGHPIAGSEHTGVHAGKVDLFANHKVILTPLPTSAEWAVEKLIQLWSAAKAEVICMDVAKHDEVLAHTSHLPHLMAFNLVEQLANREDNLDIFRYAAGGFRDFSRIAASDPQMWHDIFFANKTAILNAVDGFEKQLTVLRKLIENEDSHALMGLLGHAQAARQHFNHMLAKKPLMEKNKVTQQFSILPGNKAFKGKFTVPGDKSVSHRSIMFGAIAEGTTHVTGFLEGEDALATLQAFRDMGVSIEGPKNGEVTIHGVGMHGLKAPASALYMGNSGTSMRLLSGMLSAQKFDSVMTGDASLSKRPMERIAKPLRLMGAQIQTTGEKGTPPVSITGGQQLKGIQYDLPMASAQVKSGILLAGLWAEGETSVTEPEPTRDHTERMLRAFGYDVKTEGNKISLVGGGKLVGTNIQVPSDISSAAFFMVGAAITEGADVVLEAVGINPTRTGVIEILKQMGAELTVENERIAGGEPIADIHIKGSRTLKGIHMPEDQVPLAIDEFPALFIAAACAEGQTVLTGAAELRVKESDRIQVMADGLKIMGIDCTPTEDGIIIEGKGKSGDWSPIFAGGEIESHHDHRIAMSFSMAGLRTSGPITIHGTETVATSFPTFTELANRAGLTIEVSQ

SEQ ID NO: 4522 - protein, 233 aa, Acinetobacter baumannii
RYMSNKDSSLSKEQQKLLKQFKKQISNPHSSKIANQPESKKSQAESEELEDTHLFKQAVAGVKPINNSNIADVKTPRAKKVDAQTLAKRAAAEGGRDTEHAELSDTQAALNPVASQATLSYRIATLQHKVFEDLKAGKMRWFEAVDLHGCTIEQARDAVLQIIQMAKDENQNVIKIVHGKGPEAVLKTYVNGWLRQHRDVLAFVSAPENQGGTGAVLVLLKRAEKNPKFEQKK

SEQ ID NO: 4523 - protein, 459 aa, Acinetobacter baumannii
SDMSVTSVNPATNATNEYYLTRQSQMESNVRSYPRKLPLAIAKAQGCWVTDVEGTQYLDCLAGAGTLALGHNHPAVIQSIQDTLASGLPLHTLDLTTPLKDAFTEALLAYLPGGKEEYCLQFCGPSGADATEAAIKLAKTYTGRSSVISFSGGYHGMTHGSLAMTGNLSAKNAVNGLMPGVQFMPYPHEYRCPLGLGGEAGVDALTYYFENFIEDVESGVTKPAAVILEAIQGEGGVVTAPVKWLQKIREVTEKHNIVLILDEVQAGFARSGKMFAFEHAGIEPDVVVMSKAVGGGLPLAVLGIKRKFDAWQPAGHTGTFRGNQLAMGTGLVVLETIKEQNLAQNAQERGEFLQAELKKLATEFPCIGNVRGRGLMIGVEIVDERKPADRIGSHPADSQLAAAIQTACFNNKLLLEKGGRNGTVIRLLCPLIITQEECVEVIARFKKAVAEALVAVRGA

SEQ ID NO: 4524 - protein, 109 aa, Acinetobacter baumannii
FMQSGKLDVLFDVLKRGTEKNSAGEVKQIWSSIGQFYGDIEPISAANFVQSGVQGSALVCRVVMRPDDFPGIKAEFLLRDVDTNDIYAINGVLPITSSKKALMCSLGKL

SEQ ID NO: 4525 - protein, 418 aa, Acinetobacter baumannii
SHKRNIAVDVRLSDRVNAIKPSPTLAVTNKAAELKAAGKNVIGLGAGEPDFDTPQHIKDAAIEAINNGFTKYTAVDGTPGLKKAIIAKLKRDNNLDYQPNQILVSCGGKQSFFNLALALLNKGDEVIIPAPFWVSYPDMVIIAEGTPVIVKCGEEQRFKITPEQLEAAITPNTRLVVLNSPSNPTGMIYSKAELEALAEVLRRHPQVFVASDDMYEPIRWEDEFYNIATVAPDLYDRTIVLNGVSKAYAMTGWRIGYAAGPAKIIGAMKKIQSQSTSNPTSISQVAAEAALNGPQDVLKPMIEAFKRRHDLVVNGLNDIKGISCLPADGAFYAYANIRPLIRAKGLKSCTEFSEWLLEETGVAVVPGDAFGLGGFMRISYATADEVLVDALARIKKAAESIEGVDAAIASIEAEKATK

SEQ ID NO: 4526 - protein, 320 aa, Acinetobacter baumannii
SIKRLVMLKGVILSVMASLTFGVLYFYTQLLGQLDSEQTFGWRIIATLPFLTLFMWWSGDLNHIKNIYQRILAKPSLLLLLITTSVLTSVQLWLFLWGPMHGRGLQVSLGYFLLPLVLVLAGSVLYGEKISKFQWIAIVLAIIGVGHEIFRLGSIAWETALVAIGYSAYFLLRKKIKTDNLGGFWWDLLIIMPVAIYLTHTGLLPYSKFLDQPTLGLVIAGLGVLSAIGLGCYILASRYLPLVVFGLLGYLEPVLLALASLVLGESIGKEEWFTYLPIWCAVFVLVLEGAFHLYQQQQKAKNLQLNIEKYQKRLKNDAHD

SEQ ID NO: 4527 - protein, 213 aa, Acinetobacter baumannii
VIRRNTLGNRDKHLLTQLDTIAKGLSETLAPFCEVVVHDLTNPEHAILSIHNNLSGRKVGDPATELGLARIMSPEFPNLITNYANQFADGRPAKSTSIGIKDEEGQYVAALCMNIDLTLFRGMQSALEHFTKIETDNIIENLEPNGTEAIRRYIDQFASKHATTPRMLKLNERKQLIQELKNNGLLEIKKAVETVAQHLGISRASAYLYVKET

SEQ ID NO: 4528 - protein, 81 aa, Acinetobacter baumannii
SWLGMLSNTQNNRNVIMQIYLNGELTDTPSQNLLQLIQELALEGKRFAVEHNQQIVPKSKLEQITIAQHDRIEIIHAVGGG

SEQ ID NO: 4529 - protein, 338 aa, Acinetobacter baumannii
TVIGMLYSLARPMLFSLAPERAHELTLSMLDKAHKLGMMRQTVEAKPTTCMGIEFPNPVGLAAGLDKNGDHIDALAGLGFGFIEIGTITPRPQSGNPKPRLFRIPEAKAIINRMGFNNDGVDQLIENVKASKFRGILGINIGKNADTPVEKAVDDYLICLEKVYNYASYITVNISSPNTKNLRSLQSGDALTELLQTLKARQLELAEQYNHYVPLVLKVAPDLTAEDVEFISAQLLDFKIDGLIVTNTTLSREGVENLPYGNESGGLSGAPVFEKSTECLRLFAQTLKGQIPLIGVGGILSGEQAAAKQQAGATLVQIYSGLIYTGPTLVKQCVEAMT

SEQ ID NO: 4530 - protein, 156 aa, Acinetobacter baumannii
LMAGCVEGLIDAQGASISFREEGATSWEVTAEVTDLPMPDSTRPVDDVTTVDSKFKKKATAGAIDNGALALEFLQISGSDQQAKLRDYYNKGKCLEWKIELNDEAKTSYEFCASMSKFTVVRAADKKNRVQTQLEISGEVVVKENDVVVVVPPVTP

SEQ ID NO: 4531 - protein, 311 aa, Acinetobacter baumannii
SSCGIGYDVIMKKQIPIKITAFIILIICSVVGYAGLFKNHGQPPIIEGIFWQPDNDTTPPKGNWHYLGINTFVPQWSVVESKSWWKNSNLPQWEKAIDLQKIKQQPWAKNLILGLAGEYNEHEARANVVALGEKSAQIIQEQNDTSLKGYYFPVEADPTWLRVSTLGHVLEKLPSPIWVSVYSGESEPENYDLWVKSWLPQQAGVFFQDGVGVGVRTPEQARRILDQLEQTLGKDKTVIVLEAFRTKKNGQFRAAYPWEIISQIKAYEGKKIYIFDGPHYMGRWSVYIVGLWYRFVYGSTPATINEPKNSK

SEQ ID NO: 4532 - protein, 465 aa, Acinetobacter baumannii
ENSGEYMNLLLIGVLLALVAIAYQLGLRKSRHLAGKGSNSATLHSRPGYYGALVGLWCGIPAFLILIIWNLVEPSILNHIIFNNVPASVTASLDEAARSVLVDRVQAIASGFGVSDHPAAYELAAAQQYAKFQTIGSFAKFAVVVCAALLGLVWAKKKISQEYRARNQVERAINVGLILCSGVAILTTIGIVMSMFGEAMHFFHFVSPIDFFFGTEWNPGFSTSGNAEGSYGLLPLLWGTLMVSGIALLVAVPVGLMIAIYLAEYASPWLRSWAKPTIEVLAGIPTIVYGVFAMMIIGPFFKAAGAYVGIEINATSALTAGFVMGIMIIPFVSSLSDDIITQVPRALRDGSLGLGATKSETIRQVVLPAALPGITGAFLLAVSRAVGETMIVVLAAGNSPLLHANPFEAVSTVTVTIVKQLTGDTDFASPQALVAFALGLTLFVITLGLNIVALYIVRKYREQYE

SEQ ID NO: 4533 - protein, 204 aa, Acinetobacter baumannii
SMRGLYLITNDDPIQLLLEKLDAALATRQIAILQYRRKKVDKADQPAEVEQIKQLCEKYQVPFVINDDLKLAAQFGLGVHLGQSDGEITDAKSQLPESVIIGRTCLNSLELAQKAIADGATYVAFGAVYATATKPEAGNVGIEVIKQAAAQYDLPICAIGGLTVENSKPVIEAGADLCAVISDILGRSTAEIPARVQAWAQLFS

SEQ ID NO: 4534 - protein, 310 aa, Acinetobacter baumannii
NRSGAYSFVQISHKSFRNVGLIGRPDKSSVVETLCLIHDHLLSLGLNPIFDQETAELVPYDHAQVVSRHLLGEVADLVIVVGGDGSLLHAARALVRYNTPVIGINRGRLGFLTDIKPSEAIFKLDQVLQGHFQLDRRFLLEMEVRTNGEVIYDAIALNDVVLHSGKSVHMIDFELNIDGQYVYRQHSDGLIVSTPTGSTAYALSGGGPILHPSMDAIALVPMHPHTLSSRPIVVGGQSEIKIVIRENRVLPMVSADGQHSVSLNVGDSLHIRKHPFKLSLLHPPGYDFYMACRTKLGWNQDFESFQRDES

SEQ ID NO: 4535 - protein, 107 aa, Acinetobacter baumannii
SKLGVRMKKHNPSKTQFDILVDARLFAPDFAQPKRDFDFYRERSIDQIKCAISNISKASNGNELVIAIAQANAFIDSAYNLEFINLVEKVKWTEELSSAFHGSVLEV

SEQ ID NO: 4536 - protein, 328 aa, Acinetobacter baumannii
IESGLIMKNLTLPNYEDVAAAAERIKDFINKTPVLTSRTVNNEFEAEVFFKCENFQRVGAFKFRGAMNALLQFNETQKKAGVVAFSSGNHAQAIALSSKILGIPATIIMPKDAPAAKMAATREYGGNIVEFDRYTEDREKIGKEIAEKNGLTLIPSYDHPHVIAGQGTAAKELFEEVGDLDYLFVCLGGGGLLAGSALSARQLSPKCKIYGVEPALGNDGQMSFRKGEIVHIDTPPTIADGAQTQYLGKLTFPIIQQKVDDILTVTDEELINAMKFFAERMKMVVEPTGCLGFAAARNLKDELKGKRIGIIISGGNVDISKYAEFLSA

SEQ ID NO: 4537 - protein, 472 aa, Acinetobacter baumannii
RCTGSDTNIGDNVMDANNKHELKQGLSNRHIQLIALGGAIGTGLFLGLSQTIKLAGPSILLGYAIAGIIAFLIMRHLGEMVVEEPVSGSFSYFANKYWGKMAGFMSGWNYWVLYVLVSMAELSAIGTFIQFWWPEIPTWLTALFFFILINGINLVNVRFFGESEFLFSCIKIVAILSMIGFGAYLLLSGSAGPQAGVANLWQHGGFFPHGIHGFIMALAVIMFAFGGLELIGIAAAETKKPETTIPKAVNQIVYRILIFYIGAIGILLCLYPWNMVAEGGSPFVLIFQSLNSNGVANVLNFVVLIAAISVYNSCIYCNSRMLHGLAEQGNAPAILKKVNSRGIPVPAAIVSASITAVCVVVNYLIPGQAFQLFMMLVVAALVINWLMISVTHLKFTKAMKLQKRQTKFQSIMSPWSNYLTISFVCFILIIMAMTPDMRLAVILGPIWLAVLAIMYFFKYRKKMVAIPEVQSN

SEQ ID NO: 4538 - protein, 146 aa, Acinetobacter baumannii
PKAGSAKAIVHIASTIKHCAISNHARLRPKALVKTGTGNSSIKGAQTNLKEYPKAAQLKKVTALLSMPASPSHKERLEKINKMGIPAEKPRNSIINARRSKNALNAETQPEVCVVIRFLFSINYKCAYSIASYNCFQDSLCNQVLF

SEQ ID NO: 4539 - protein, 234 aa, Acinetobacter baumannii
LFKGPDMQAIILDTETHTLNGLPIEIAYAPIEINAGKLTLDKSKLFDQLYQVGTPISYAAMAVHHILESDLENQPHYKTFKLPETTTYIIGHNIDYDIAAIARCGVDVSNIKPICTLALARKTWPDAEAHNISALIYMISQGSSKARELLKGAHRADADIILTANILMHIVYHLNIQDIEELYRVSEEARIPTTINFGKHKGTAIAELPKDYIQWLLRQDELDVYLRKALESAF

SEQ ID NO: 4540 - protein, 283 aa, Acinetobacter baumannii
CYGGINIYNSTNNSIEKTSGFICRERFFVNILIANDDGVFAPGIQALADALKPLGRVVVVAPESERSGFSSALTLDRPLRPIQIAEDVWAVNGTPADCVYLSMNGLFDFEFDLVVSGINSGANLGDDVLYSGTVGAAFEGRLMKQPAIAVSLAGPDVRSYDHKDDYAQAAKWVHDFIAKGLPALPPRHIFNINIPDVPQLKGTQITYQGRRAQSKPITSHVDPRGRQVYWIGLAGEAVTDPQRIASQIQSDFFAVANGFVSVTPIQMDATNYAVLEDLQASLG

SEQ ID NO: 4541 - protein, 244 aa, Acinetobacter baumannii
MKMGKQLQARNKFSPNLPKVQCRFIPANSAECRFIKKDAKTGAVIVSGYAVKWDSINYYGEKFLKGAFADVCAAFKAGTKKVHCYYNHGWRQWYVDSTITMRIGKIIRLEEDHVGLLLEVELTPGLALAQNVGAMVQHGTVDGFSVAFYPPSDIDIEDKGTHIEIKRADLYEISIVDEPADGAARIINDDAINAIESDDDVTELLRSVLPGGYAEKLMARLANLNQPKQTPEPKKDPFAFLDNY

SEQ ID NO: 4542 - protein, 179 aa, Acinetobacter baumannii
KRILIKIHDLCIIKGFYAMDKFDWQIIQALQKNGRLTNQEIGDLIGLSASQCSRRRQLLEQKGVILGYTARIQQQALGLEVTAMIHINLRTHEAKSQQAFQELIEAEDNIQDAFSISGDADFILKVVAENLEQLSQFVTERLLSYNFIGHIKSYIVLKKIKEQNHFLIKPKSMSYHHSQ

SEQ ID NO: 4543 - protein, 465 aa, Acinetobacter baumannii
NHTGARLPYGRFKMKSNRSSLQSQLVKTTMWSSIVVGLLALSLLTIFSIYHNMSVQDEIMDEISDTLLVSDLSKHSMKQFDELSDEFDIQYELLDTGQVLTHSHTYQHELFEKGNLSEGFSYFWFDGQLWRSLAAQQEDSQLQVEVFQPISTRIEEVLKALAGYSGLMVLFWLLQWVIVSWRTEQQLAALNLLSKRIAQKTASNLEPIQEPDVITEIQPVIDALNQLLARLQRALVAEQRFTADASHELRSPLSAIQMRLQVLQRKYQHIPELDHDFERIQEDVSRSTKILENLLLLARLEPNETEQLELSKSVVDLNHVLARVIDTVNIDAQAKQMVIETNILSNETKTFANEELMFIAFRNLFDNAIRYSPALGTIHVELSQYQQKLKISIEDTGNGVDDEVLRRLGQRFFRVLGTKQQGSGLGLSITKKIIQLHGGELHFMHASQGGLKVEVILPFNREIQK

SEQ ID NO: 4544 - protein, 963 aa, Acinetobacter baumannii
VKAGFSASQLNKPKFGLNGFDIMSRIYIIKNALDQQEKITVESENILHTFLQEKTKHPQAKIYKGNPCPENDITPTRDNRASIARLMEMDDECTIVRYPGELSSTVTWIATKLLGQAVSALVKVPKAPTNNSSMTGSSNNNLSNPENRQRIKQRVPYILGAPKAIPDLFAPPYRYFKDGVEVEELLLSVCENPVKLSQFKTGDTPIQEIPGTSLSAYGLNQSLVGTETIFKWGDTFTEPPVIARQCDSINGQTALPPNSTRVEAGDIYFQYPNMIKANDQSTADRFNSFNINEALIISGANFGVGDLSITGQVTVDPVNKTFAIESTQNVLDYQNYRKINVTSLLVTDPVNEQLDLAGLYDIDSITYASSIYTIHLRNPVATNTNFSKVTEVLTSTISANLTANTANIFLDGEYVVTGIDTANKQLTLATPSGVNSDWNKLADLEDQKTSTGNIKLRGSQENWIGWFTINSPKATGLLLNFQALNGIYQGSDAKFVDIFVEYQQVVSDNPTGPVFNQTIRLNGKANNRDSVGGSMWINLPFSGAVRFRARRVNDNGDAVDLSDEVKFYTAYAIRYLSKLVYANRVLIRQRTQATRAATAVDTRQTNCIAESLVYSYRGGVRSAELIPSRNMADLIIDLALNKLIGRRTLNEINTEEIYRVFDDVVEYFGSSKMAEFNYTLDNANQSFEEICRMMAGASGCNERRLNRALYFDFERADRQPILLFNHRNKKAKSEVRTYNFKVENNYDGVEITYVDSEAGWIEKTLKIPNDQITNPKKIDGYGIAYKEQAHIIGWRAWNKLKYQRVNCKFDCFAEGELTERGDPIIVVDDTRLSPIALGDGSITSGEITAWNGLTIGISQPCTLTAGHDYVIHLQKKSGFTDQIPVSQGASEYELILARPPLEALVTEGEVKTVYSITVDDRQDDELFLVSTKNRNGVFENSISATNSDERYYRNDKDIINNLI

SEQ ID NO: 4545 - protein, 113 aa, Acinetobacter baumannii
NNWGLDLMQKNFFCLIVCCFGFISSAFAASDEKVKDCLTLEKLAGVTMEYRQKGGVLSELYKMDFGSKDRNKIVRSLAEEAFETPRYHSEKVQQDAIKNFKNEKFLYCLKHLK

SEQ ID NO: 4546 - protein, 328 aa, Acinetobacter baumannii
SFFISAARQGITMTTATGTTWRQRLEAYYYLCRFDKPIGTELVFWPTMWALWVASKGIPNLGILFVMILGVIFMRAAGCAINDFADRKVDGHVERTKTRPLATGVIRAREAVYVFLGLVLASACLLFFLPIETFYWSFGALFLAFIYPFMKRYTNLPQVFLGAAFSWSIPMAFTAVGKTPDLTCWLLYFGNLAWTVAYDTQYAITDREYDLKIGVKSTAILFGRYDIQIIALLQAISLVLIGTALYLENILFPWAIIALVVVAFDFVYQTIKTKDRNPQVCFWAFRHNRWVGLILFLGNIFKFHIVKMTVRLKSVLCRALFLCLNICA

SEQ ID NO: 4547 - protein, 322 aa, Acinetobacter baumannii
AFFINLELDLRKPMLDQLRAMGVFACVVEKSSFSGAARELGITTSAVSQQIRSLENEMDVILLHRSTRKLSLTEAGQAFFSSCQEMLAAAERGKIRINELRDDLIGDLRIATTPDLAVQHIIPALSHWMSAHRGLSVHFEVGHRYIDLIEERIDIAVRMSSTAVEESDSVIPMAFVDQILVASPSYLNQTSPILHPNDLNNHELLSINAMNDSRSFNFQHAKTGEKLNIEMTSRLQSNNLQVAKALCQQGHGIARILYLDAQKELKNGSLIEILPDWKLPAFTLYAEIAKHDQQPMKIQRCVEALKQYFSQLAGGRAMQIVR

SEQ ID NO: 4548 - protein, 102 aa, Acinetobacter baumannii
DVFMSDYITLDLAKSHLRVLHARDDSYIELLIKAALKAVTNFIDKEFSEIEQPDGSLPEDLVFAALLIIGDMYQNRAAQTDAALYVNIACERLMFPYRKMGV

SEQ ID NO: 4549 - protein, 190 aa, Acinetobacter baumannii
SKFIRLMSMQQSYANILTAVGEDLNRPGLKDTPVRAAKAFSYLTSGYSKTLEEVTNNAVFPSDNHEMVLVKNIEFYSLCEHHLLPFYGRVHVAYLPEGKVLGLSKFARITEMFARRLQIQENLTQQIAEAVAEVTGARGVAVVIDSAHMCMMMRGVGKQESTTRTVSFVGDFKTDKEARREFLSAVPESY

SEQ ID NO: 4550 - protein, 710 aa, Acinetobacter baumannii
PRFMGSIKVRNSLLSKRLKRTEIRLLIIDDNQLRYNQILNLLSGNDYQVNALLLDDLKSFEKQLNTSWDVIIFGRAYDLKIEQTLSLVQASEQPQLPILLLQPDDYQVQQYQSYIQKGIYDVVPLEPLDYFYITLVRALSYSRLLQTEQRLLAELDTIHTHTQTLVDNSHKAVAIFQEGIHIKANTEYLNLFGFQQEEDIIGLPILDVLQPNDLNVFKQRFKKISLGQFDQARFEIQSQHQAISGNNALKLEFIPSQEEDAVQLTIDYQVDLTTPANSAPSEKSVGLSAAWPQINRHLSTHPAQANAVVLFRLAQCPERIFQQGWQTLGQYFNQLHGFLKDHAQMPIFQVDLGSYVGILQAENNSVLNSQLTSLQTLQKEHLLKVNEQNFSVQLKLGYAFLNQPLTENSFSSLLNEAEKQGLPRVTPQLEVMPTVDKTVSPSIEAVPLDLTIEHFDHTPQSSLLQQLRQKLAQGEIHLKYQQIYDKHDQETHNYEVTSGFIAGEQWYDLNDLSDLKEDAELSIQLDRWILVEACKQLHNFIAQYPKAKLIINLNIDILLKDKTFPELISKLLTIIGSKIESPLILQFSEQAIQPCLPIAQQHIARLRQHGAEISIRDFASSMYSDSILQKLDIQLVKLQSSKTDLLSSDQGLNNLQEKILNYLTVKPIGILLAHLNDMNLFANAWNVEARFLQGDYFQKKLDRLTDVQDQ

SEQ ID NO: 4551 - protein, 952 aa, Acinetobacter baumannii
KNLMSGLQEEYLQHQTKIEQLRLSIQYIRWYLVSLILLCLISGIIFFCYFTSYITNFIWSIGFTILTLTCLLFVPKLLTHYRDIHFIKKTDLMLQGICLVSGILMGINIIVLHFSLPDTLISVSDVHILIALFITSAHIIGLTFLTQQPRYFYLLFIPSTVPLIIGQFTHSQITQLPFYFAYNLAFVATLLCAYATQRNYQKISQLLFKNKQLVQVAEQHTQWAEELCVQLQQEVNKSKDIEAQLQFNNHLLEQKVRERTYDLTKMNERLESHHHNLAFAHETAGIRPWDWDIEKQKLEITFFDQQKQTQNTPLHLKSILERIHPNDRKLFDERLKEHLEGKSDHFNITFRILRRNGSWRWIHDVGRVISRDPKTNKALRMVGMTRDIHQEKKDQEHLRLSAIVLEQAAEGIFILDEKLNYIEVNPYYEKLTGFSKSELLSQQLFNITINQKLQQQQFHDSITQQLLKTGEYMGQFDEKFTSGKSVYLWLHINAVKDEYNQIINYIGFARDLTDQKRQEQHLSYLKNYDRLTHLPNRFYYYNQLHQYLVNPSYSFKNLALIRINIDRFRAFNEFLNNDSGDELLKQFAQRLRLTNINAILVAYLNGDDFAIIYEISPIHPNIEQYCQNILQALNAPFYIDEQEYFITASIGVACFPEHGRQIDHLNNHAEQALSEAKRLGGNTISYYCNKTTNPYKTADLEQELRKAIQNDEFVVYYQPKINLNDKSIKGFEALIRWQHPEKGLVMPNMFIPFAERSSLISDIGKVVLDKVGKQLQEWKKAGYADVRVSVNIVAQQIHRGLLLSDLDEVLDTYHLDGSNLELEITESALLDNTDNVKKLLHSIKERNISIALDDFGTGYSSLAYLTEYPIDVLKIDRAFVSKIGDQKQEAIVNAMIAMGKSMGLKLVAEGVETEEQVIYLQKQQCDFLQGFFFSRPLHPNQILQYLQTNTHI

SEQ ID NO: 4552 - protein, 428 aa, Acinetobacter baumannii
LNIIKGRIYIMGYQKIVVPADGDKITVKADLSLNVPNHPIIPFIEGDGIGVDITPAMKKVVDAAILKAYGGKRSIEWMEVYCGEKANKIYGTYMPEETFEALREFVVSIKGPLTTPVGGGIRSLNVALRQELDLYVCVRPVRWFQGVPSPVQHPELTDMVIFRENSEDIYAGIEWKADSEEAKKVIKFLQEEMGVTKIRFPEGCGIGIKPVSKEGTQRLVRKAIQFAIDNDKPSVTLVHKGNIMKYTEGAFKEWGYELALDRFGGELIDGGPWVKIKNPKNGKDIIIKDVIADAFLQQILMRPADYSVIATLNLNGDYISDALAAEVGGIGIAPGANIGGAIAVYEATHGTAPKYAGQDKVNPGSIILSAEMMLRDMGWIEAADLIIKGISGAIAAKTVTYDFERLMPGATLLRCSEFGDAIIQHMED

SEQ ID NO: 4553 - protein, 425 aa, Acinetobacter baumannii
DKIMTAYQKFPIGAPFNILMARDASASLTQIEEMAKQLNARMTTLDSLITRYQDGLKKVEGIPDNIKEDLEARAKEVNKLAGELSELQQKLVDGVNERGIDPNSVASVLIRNKAILDQASSIQRSKGKFQFNDLNARNIVTLTGLGATAQFAANDLGRTVERALTLLDWISFTPVTAELVPLLRESAYEIMADLVPEGQTKPESNLTFGVVDLKVGTIAHWIKISIQLISDMPTLAAYIEGRLAYGVRLKLEAKIVVGDGVTSGARSFIGLIETNQFEVITPGADDTAIDVINRAKYKAASTGLLPEAIILNPEDWGAIERIKGTDGHYIFGSPGAAVQPVLWGLPVILSAAMTSGKYWVGNLTLGVSAFIREDVAVELSTEDGDNFVKNLCTVRAEMRACCGVAIPDACAGGDLPATATPPAGG

SEQ ID NO: 4554 - protein, 100 aa, Acinetobacter baumannii
VPIMSNISLSNVQKSNMLSVKCKRSLNVLFISLLVLTLMACSKSTILSKPVIPANLMQPCPNLNELTGTTGKDWMLWSVDTVAKYNDCKARHGGVIKALN

SEQ ID NO: 4555 - protein, 465 aa, Acinetobacter baumannii
GIVMNALTALSPLDGRYASKCDALRPFLSEFGLIHARVTVEVRWLQALSNRPEIVEVAPFSTETNAALDAIVSNFSEEDANRIKEIERTTNHDVKAVEYFLKEKIAGIAELQNAGEFIHFACTSEDINNLSHALMLKNGREVLVSSMKQILNAISALATTHAEQPMLSRTHGQTASPTTLGKEMANVAYRLARQIKQFENVELLGKINGAVGNYNAHLSAYPNVDWPAHSQAFVESLGLTFNPYTTQIEPHDYMAELFDALRRFNTILIDFNRDVWGYISLGYFKQKLKEGEVGSSTMPHKVNPIDFENSEGNLGIANAVLAHLGEKLPISRWQRDLTDSTVLRNMGVGFAQSLIAFDACLKGIGKLELNANRLNEDLDQAQEVLAEPIQTVMRRYNVEKPYEKLKALTRGQAMTRDMMVNFVNGNELAQVPSEERARLAELTPATYTGNAAEQAKQINELISKI

SEQ ID NO: 4556 - protein, 455 aa, Acinetobacter baumannii
SKVMAKKPIYKSLYFQVIIAIIAGVLVGHFSPSTTQIVNGVEQHIPGLGEQLKPLGDAFIRLIKMIIAPVIFCTVVSGIAGMESMKSVGKTGGVALLYFEIVSTIALLIGLVVINIAKPGVGMNVDPATLDTSGIQKYVTSGESQSTIDFLMHIIPDTVVGAFANGEILQVLLFAILFGFALHKLGDAGRPVLKLIDQIAHVFFNIVNMIMKLAPIGAFGAMAFTIGKYGVGSLVQLGQLIICFYITCLLFIFLILGTISRISGFSILKMIRLIREELLIVLGTSSSESVLPRMLRKLEIAGCEKSVVGLVIPTGYSFNLDGTSIYLTMAAIFIAQATNTQLDIQHQITLLLVLLISSKGAAGVTGSGFIVMAATLSAVGHIPVAGLALILGIDRFMSEARALTNLVGNSLATIVVAKWVGALDKDKLNDALNNPDEVDRKMLAPKNPQVAEGLD

SEQ ID NO: 4557 - protein, 291 aa, Acinetobacter baumannii
AWVIYMTKIAEKSKQEYGDLLKEKDHLQDMEQLEMTIVSIQTPYPSIVRIQGKINTLQPELWQAPNLAIRLIVNNPPEGQPISRVYTVRSFNPVNAQIEIDFVKHEDLSPAMEWLNSAQVGTKIGLIGPRPHFIPNFTAKKHVVMFADDTAVPALYSILKQWENGVSADIFIESFEKDIASQLPELEHVKIHSFHKEHHTSQKGLLLKAAFALENYENITIWAACERNEARALRQFFLEDQQLNKNDVRIAGYWRDGISSSELDKLRAQHYQEHIQQGKTLNEYDDLDLAN

SEQ ID NO: 4558 - protein, 292 aa, Acinetobacter baumannii
EWSMSVVAFKQVDVFTSQAFKGNPVAVIMDASTLTSEQMQAIANWTNLSETTFVLPPTDSQADYQVRIFTPQSELPFAGHPTIGTAYALLEAGLVKAKEGQLVQQCAAGLVTLTVNDSNHISFELPTPKITPLDALQTEKLAEILKCKINTQWNAALVDVGARWVVLQAVNAKAVLASQPDLNALKQFSLDMKVTGSTIYGFYEESNEQKRIEVRSFAPAYGVNEDPVCGSGNGSVASFIRYHGILPAQNDVVLSSQGQALGREGQLQLELHQDKILVGGAAVTCIDGTIKL

SEQ ID NO: 4559 - protein, 352 aa, Acinetobacter baumannii
IMTMNIQQALNHITKNIHLTQPQMEEIMRSIMQGEATEAQIGALMMGLRMKGESIDEMTAAARVMREFAIKIDVSDIKHLVDIVGTGGDGQNLFNVSTASSFVIAAAGATIAKHGNRGVSSKSGSSDLLEQAGIHLDLDMQQTERCIREMGVGFLFAPNHHKAMKYAAGPRRELGIRSIFNLLGPLTNPAGVKRFVIGVFSDELCRPIAEVMKQLGAEHVMVVHSKDGLDEISLAAPTTIAELKDGEITEWTLNPEDVGIESQTLNGLVVADASASLKLIKDALSKNKSDIGEKAANMIALNAGAGIYVAGITKTYAQAVAFAQDIIYGGQALEKMSVLAEFTKTLKQSQAD

SEQ ID NO: 4560 - protein, 355 aa, Acinetobacter baumannii
KSAIIQCQCLYKRVEKLNMSEHRKPEQGVKLRGAEKVARIPVKVVPTVEVPRKPDWIRVKMTAPEEVQRIKTTLRAQKLHTVCEEAACPNLPECFGGGTATFMIMGDICTRRCPFCDVAHGRPNALDPDEPRHMAETIANLKLKYAVITSVDRDDLLDGGAQHFVDCIKEARALSPNTLLEILVPDFRGRMDIALRIMTECPPDVFNHNIETVPRLYKAMRPGSDYQHSLNLLKMFKEYCPDIPTKCGLMVGIGETEEEVIALLDDLRAHDVDYVTIGQYLQPSKQHAPIDRFVTPEEFERYAEHGRKLGFRNIWSAPMVRSSYFADRQYYGEPVPEVRRKVDPAKKIAVQAIEA

SEQ ID NO: 4561 - protein, 470 aa, Acinetobacter baumannii
DLYMQKKLPIPDNLPNHLTDIFYHINISLPKGDLKETVKLDEAINQLNARDVYAVQDYPLHNLSEYAGWAINSEITQTASIESPLFIANWYYWGQQLYRSINPYKLDLKTPSLLEIPAYTKLPEPLDSVIPEQDERLDLSDTDAKKITGPISAMHGVIPKGSIFKQGDVILKKDERLTPEKLIILRRAGIKELTIYKKPKILIVSMHSFDKEEMSEESLYVKDVLKTWGYEQVEIKSLKPERYDAAFNSLKKDNNSALDESLTTSRNDYIKFFEEQTMNFDVILCCTYQNSRSALFQLEKLPIFDQSSISAALNTRCMPGNEIKILKGKDRTPPSRETVQIYDENGKHKGMRVVVTEDKATIINLPGDIQDIAILMHAFVKYILNKHISDFFDHAYFKGKTDIEIVPDVTNRKLLWGHYKTHESGEYILEIIEQQPYQIEPPLSANCIVMVPFQEKVIAKGNDLYFMKID

SEQ ID NO: 4562 - protein, 277 aa, Acinetobacter baumannii
DVYMHREQADYLHLRELGGLELLKAHYHQTQFSKHTHEGYCIGVIEEGAQSFFRTGQLHVAPKGDIILVNADEIHTGSSAVESGWRYRAIYPTPEMLAEVSQDFFEQGHGAPWFPQAVIQDLGLSQQLCLLFDLLEQKDNFLLKETMYLSTLACLMVRHGKSRHTFCELPEAYSKVLKVKDLLADIPEKNFSLQELADMVGLSAWHFLRQFKKHVGLPPHAWLVQARLQKARQLLKQGVQIVMVAQQCGFSDQSHFNRHFKKAMGVTPTQYVASLNL

SEQ ID NO: 4563 - protein, 434 aa, Acinetobacter baumannii
HLHITINQRGSIMNLPMTMSLQTLSFEEFITTIAAALGCGLLVGLERERSKLKHEYKTFAGFRSFAISSLLGAVCFLFGTAIGIVGALLIGAISIVSLKNQPNDPGVTTELAFIMTYFIGALCIWNISLAAGLAVIMTIILLAKQSMHGIASQWITESELRDGIFLLALLLIALPLVPNKPFWGPVLNPHVILKLLTLILFVQALAHIAKRLLSSKNALLLSSLASGFVSSTATIASLGLEVRSGRANAKTNAGAALMSCVSTLVQTLIIVVGISLAWFKLIIFPTLIALAFLAVWAFILLRKAEPSTTSSELDTRMFSLKEAIIIAGTLTLIQAGVYGLSLYLGNAGLIAGTLLASLFEIHAAIAAVIVQGEPNNSQTSLLIAFMGGFAVHAIAKSINSAISGGLHYALAFIPAQILHMTIFIGLLWMNIHWF

SEQ ID NO: 4564 - protein, 91 aa, Acinetobacter baumannii
IMNIEQMLSVLNPEIVERLKTAVEIGKWPNGVALTKEQRETCMQAVIAWELKNLPEEQRSGYIDRGTKEEGEVCEDDHHKHEPEFKPIRFV

SEQ ID NO: 4565 - protein, 166 aa, Acinetobacter baumannii
KRNIKMTNKKNLGIGGIIVLLIAAYLGLDLSGHKSNPTPSSSIPAKQRTETTFSNDGVDTIKAAYERRQSNVQVQGSGRVKAILREDNDGSRHQKFILILKNGLSILVAHNIDLAPKIEDLRKGDIVEFNGEYEYNEKGGVLHWTHHDPQNRHENGWLKHNGRIYQ

SEQ ID NO: 4566 - protein, 96 aa, Acinetobacter baumannii
QSLFLEAFLLPVSGEMGMAEPATSTSTATYGLVTNLAGGGMVLYGGLSTTEWMAVVGGICAFAGLIIQLWSAYRKDQRDEELHKKLMGEDNHDKQD

SEQ ID NO: 4567 - protein, 163 aa, Acinetobacter baumannii
MRIFREFYKVKNRHCTLCFYNIYFKQINLYQLKTLKMFNVSNPANAVVVGIIAIIATVSLLIWKFNFYLGIDIYTSGEVLFKTLLYAALIGLFSYYFRHTIKISNTVILSLPLFFFCIRPILNYKMTHTIGNVPLYATHHGQGLILLSLTILACILWAYTANS

SEQ ID NO: 4568 - protein, 216 aa, Acinetobacter baumannii
GFFMETIGKRIKSLRKAKKLTQKDLGKLLGLSDVSVLKWENETNTPKLENMHELALALDTTVEYLMYGKASEESSVIDFRPVSRLLPVLTHVQAGNWTSVQSISKFDINQWLPAPPSAGKNSFYMIVKGTSNAPYFNDGDYICIDPDVPIDCVQTGEMVVVQHEGDATFKALVKEDNRMYLQALNKNYQPNIIFLKEDSIYKGKYVGKFETGRKFL

SEQ ID NO: 4569 - protein, 271 aa, Acinetobacter baumannii
GLLMINIQNTILGKIVDRKHEELAARLKQRNLQDVEELAKAATPVRGFANALQHKRPGVIAEIKKASPSKGIIRADFNPAEIAQQYEQAGAACLSVLTDVDFFQGADENIAIARNHCALPALRKDFLVDPYNVVEARALHADCILLIVACLSDQQLEEMSKTAFEHQLDVLVEVHDEEELERALKLSEQCLLGVNNRNLKTFDVDLNTTIRLKKLLPASRLLITESGIATPDDVRMMQEHDIHSFLVGESFMKQPRPDQAFTALFGQPQTV

SEQ ID NO: 4570 - protein, 409 aa, Acinetobacter baumannii
EHLMSFSRKQFALSAIFVAILATGGSFMLLHENADAKAAPTAAQQAATVDVAPVVSKTITDWQEYSGRLEAIDQVDIRPQVSGKLIAVHFKDGSLVKKGDLLFTIDPRPFEAELNRAKAQLASAEAQVTYTASNLSRIQRLIQSNAVSRQELDLAENDARSANANLQAARAAVQSARLNLEYTRITAPVSGRISRAEVTVGNVVSAGNGAQVLTSLVSVSRLYASFDVDEQTYLKYISNQRNSAQVPVYMGLANETGFTREGTINSIDNNLNTTSGTIRVRATFDNPNGVLLPGLYARIRLGGGQPRPAILISPTAVGVDQDKRFVVVVDAKNQTAYREVKLGAQQDGLQIVNSGLQAGDRIVVNGLQRIRPGDPVTPHLVPMPNSQITASATPPQPQPTDKTSTPAKG

SEQ ID NO: 4571 - protein, 291 aa, Acinetobacter baumannii
GELMSDSSNQLMPLSLSAPGVNLGAYISTVNQIPILTAEQEKELAERYYYDQDLDAAKMLVMSHLRFVVHIARSYAGYGLPQGDLIQEGNLGLMKAVKRFDPNMGVRLVSFAVHWIKAEIHEYVIRNWRIVKIATTKAQRKLFFNLRSLKKSSKKLTLEEAQSIANDLNVTPEQVLEMEGRLTAYDAAFEAQGDDDDDTPHTAPVLYLEDNRYDPARLVENEDWEEQSTSALHDAMNQLDDRSRNILQRRWLDDDKSTLHELAAEYNVSAERIRQLEKNAMEKIKVAMSAS

SEQ ID NO: 4572 - protein, 481 aa, Acinetobacter baumannii
NMVIQQRKELSMPRKKEVVSGNFVKYDAVVLGSGPAGEGAAMKLAKAGKRVAIVDVRDQLGGNCAHVGTIPSKALRQTVSSIIRYQRDPMFQKVGEWKQFTMKQVLRNAHKVIQQQVDTHTRFYDRNKIGVFHGRAYIQDKNTVLVFSHEGIKETIICKQIVIATGSRPYHPQGLDFDHPRVFDSDKILDLDYSIQKIIIYGAGVIGCEYASIFIGLDHKVDLINTQQKLLSYLDDEIADALSYHLREQGVLIRHNEQMDHLETFDDHVVLHLQSGKKIKADAILWCNGRSGNTEGLGLENVGLVPNSRGQLSVNDQYQTEVENIYAAGDVIGWPSLASAAYDQGRCAGANMSGEDAKPVRDIPTGIYTIPEISSIGKNEQELTEEKIPYEVGQASFRHLARAQITGDTVGELKILFHRDTLEILGIHCFGNNAAEIIHIGQAVMHSPNNTLKYFVETTFNYPTMAEAYRVAALNGMNRLF

SEQ ID NO: 4573 - protein, 219 aa, Acinetobacter baumannii
GYTMPFFGFTPSEGLLNDIQTGIANKNSSEPLYPLRDKIALQLNEEIIENVLTQLVQHFPASEKRDTAEKLAGYVKSTVAVLLKQLLSKAPNDVVKQSVEFSEKSLFKDPQGQYKVGVALDAGLVTNLKHNFAELQAGNDINKAALAELYKQFGDAMVRHFMSDFNKTLDLGMIKRKAADIGAAAVTKAVHIAIDKLIPSLNRTELKAMAEYHDGLFFN

SEQ ID NO: 4574 - protein, 150 aa, Acinetobacter baumannii
CLHMFESSHLFFIILGCLSTCIFLLVCLRPYLFPKQKFFARPVITNFETQMFIRLKQSFPSYHVLAQVAFSALITSNDYKIRSQFNRKVTDFVLLDENMEVIAIIELDDPTHLEKVEEDRLRDQMLIEAGYIVRRYTNIPSVRQLQKDIY

SEQ ID NO: 4575 - protein, 294 aa, Acinetobacter baumannii
EINMTAITASMVKELRDRTGLAMMECKKALTEANGDIELAIDNLRKSGQAKAAKKAGNIAADGAITIVQDGNKAILVEVNCQTDFVAKDENFSNFAHTVAAAALAAGETDAAKIAELKLADGQSVEEARIALVQKIGENIQVRRAKIVEGEQMAIYKHGLKIGVVVSYTGDADTGKGIAMHVAAFNPVAVNAEAVPADLIAKEKEIAEAKALESGKPANIVEKMVTGSVEKYLNEVALDRQMYVIDNEKKVADVLKATGTNVANFVRFEVGEGIEKKAELSFAEEVAAAQAAAK

SEQ ID NO: 4576 - protein, 439 aa, Acinetobacter baumannii
SINMKKIDITGIGIGPFNLGLAALLSHHPEIKSVFLERKPEFRWHEGLLLQGTTLQVPFFADLVTMANPCHPLGYINYLHQHDRLHQFYYYDSFLIPRREYDHYCRWASKQLPDCRFGENVSHVEYDAKLDKFIIESESASGEKQKYISQNLAIGIGTKPRIPKWLETCKHPLVKHSAEFAKIQEQLKQCKQVTVIGSGQSAAECVLALFNSLTPEQVKAGASIRWITRSAGFHPMEYSKLGQECFTPAYMQYFQSLPRDKRRDIAASQGLIYKGISFSTIGDIYDVLYERSVAGEKSGLSLYTSCEVESVEELESGSLRLTCLHTQLDQRCELETDALVAATGYVHDWPEWFQNMKGSILAVDDKNDCIVQEDFTALRCDQGQGRIFIQNAEIFQQGVGSPDLGIGATRNSVIINQLLGRNAYRIPKQSSFQHYGLPE

SEQ ID NO: 4577 - protein, 324 aa, Acinetobacter baumannii
DVNMLKFLALDRFTILLVGMVLLATFFPVSGQAAQYFNTLTTVAIAILFFLHGAKLSREAVIEGILHWKMHLLVFAITFFIFPAIGLLAKPILLPLLGQQLYWGFLFMCFLPSTVQSSIAFTSVAKGNVAGAVCSASFSNLVGMFITPVLVSFFILGQSQHGFDPTSSIIQITLLLLVPFVLGQLLRPYVFPYMAKVPSIVKAFDQGSILMVVYGAFSGAVVAGLWHQVSWKTLLLLTIACSVLLTIIMLLALYLPRAFGFNRADQITVFFCGSKKTLASGVPMAQILFIGQPLGMIVLPIMIFHQIQLMVCGVIANYLAKSQD

SEQ ID NO: 4578 - protein, 130 aa, Acinetobacter baumannii
LRCIMKKIILATAMSGVVLLLGACATTPKNTLAIQKENNQFEVTGIGKTNLIAKNNAVTAAQKTCSKSTTPVIVDEKTSYHGVLKDVVSEKTGQMVEAAAGVIGTLTGKNASLAKDDDYQTTLTFYCKIN

SEQ ID NO: 4579 - protein, 341 aa, Acinetobacter baumannii
SCRMINYLHQEQNWQSQLSDLITDPLELLNLLELSTDQLLSGAILASEKFKLRVPRAFVGKMNAKDPLDPLLLQVLPHHLELEEHPEFVTDPLGEEAANQLPGVLHKYKSRFLLTLTGACAVHCRYCFRRHFPYQENLPKNEDWLNIKNYIESNPDINEVILSGGDPLTLSNRKLALWLERLSSLKQVKILRIHSRVPIVIPNRIDEELISLLKNSRLRIILVVHSNHASELDDFTCSKLLQLSEHHITVLNQAVLLKGVNDSAQTLTDLSYRLFEARVMPYYLHVLDKVKGAQHFDLIPSEIDAIYQDVLASLPGYLVPKLVREIAGEKNKTPLFGATTF

SEQ ID NO: 4580 - protein, 481 aa, Acinetobacter baumannii
KKRMETLDSSIFDLTPIPMWIEDFSEVKQLFDLWRNQGVENLYEFLSQNENLVVECAHKIKIIKVNQKVLDLFEAKNQEELCANLNLIFKKEMFEAHIHELEALWNGKTHFSSTTINYTLSGKRIDVQLRGAILPGSETTFDRILITTEDITPYQNALRQEEKNRRLAESMFIYSPTSLWVEDFSRIKNRIDQLRLLGIEDFRTFLDVHPEFVRQCIEDILILDVNQSTLDLFKAPDKTTLLKNTHKIFAEEMVETFREQLIELWQGNIHHKREAVNYALDGQIRNVLLQFTVFPGYEETWGLVQVALTDITARKKAENYLEYLGQHDVLTKLYNRAFFTEELNRLNRSIIRPVSSIFLDMNGLKETNDQLGHDIGDGLLRRVGNILNQAIMNTAYTASRIGGDEFVILMPGADEANVLMMLQTIQELFNIDNQYYSSHPISIAIGHATTKENEQVEDMLKRADHHMYQKKKSYYQEILLP

SEQ ID NO: 4581 - protein, 268 aa, Acinetobacter baumannii
IKSITMTYQYHDESIVTELPEDTVFVFGSNMAGQHGSGAARVASQHFGAVEGVGRGWAGQSFAIPTLNEHIQQMPLSQIEHYVEDFKVYAKNHPKMKYFVTALGCGIAGYKVSEIAPLFKGIHHNVIFPESFKPYVEEDAVSQFPTLTQKMVQSFINDEVIFYFNHGSESFEDALDKTDLSRAEKAIALIVLNEELYPRDRYGRGRDHELRDILGKLNGKIFNIHGNSEGAMIFVSVIVALMELYDFDEQDFIKLWRGEKNIDHPINR

SEQ ID NO: 4582 - protein, 296 aa, Acinetobacter baumannii
DTGMLLKSLEFFLAVAESGSFSLAAQKMCTVQSNITSHVKKLEEELGVILLNRHNPVTLTNAGHQLHSYAVQMIALHNKAKTIFREGDIDPNETIRLGSMETTAAIRLPQLLNECMQQHPNLPLELQTHPTGYLLNAVQQGEVDCAFVASKYVIPELYSFPVWQEQLVLVCPKQQIDFPDIATLAKTRFIAFRQGCSYRHAIELFLNDHSVPPSQIMEMGSLDGIVSCVELGVGFALLPKSYLNKVADKVSLSCFEINTESAHFTTYLVAQPPETWGSNLKQFICFIEQQFIQKCA

SEQ ID NO: 4583 - protein, 119 aa, Acinetobacter baumannii
MSLINKFLEITEKPAIEVVEIEQLGKVGLRQLTIATREEWTEAQKNDPKTAVGVLFKSTVCDPDSGELALVDLQEEQLLKLPIVVVNDLFLKICKANGIKTQDEIKQEVELKNSEADQN

SEQ ID NO: 4584 - protein, 130 aa, Acinetobacter baumannii
EKLMSKQDYENGLKVRTEVMGEAFVKRAQENTVPFTQPLQDWINEHAWGSTWQREGVLPRKYRSLITLAMLTALKSPTELKGHVRGALNNGCTVEEIQETLLHSLPYCGAPATQEAFRAALEVIQEYQQQ

SEQ ID NO: 4585 - protein, 196 aa, Acinetobacter baumannii
VRLILMTDSAIQIIHQNIHQRQSIGQLVEPAPNTDQLELAFQAALTAPDHHRLKPTRFVIVSGDQRAAFGEVLAKALVDLGESDPAQLERVKQHPFRAPLLILALTQLQDHPKVPHFEQILSTGAAVQNLLLSLQAQGFSTMWRSGAVVESNWLKQHLGLQPHDLISGIIYVGTAAKAIAPRADIDSKEFVKVWQA

SEQ ID NO: 4586 - protein, 123 aa, Acinetobacter baumannii
GFLMTWILNNKRWSLIIVLSILYLIQIGYTNHLAGKVNQAEQQCQAQIQDIERKQVKALAEAQNELNKVSADYEQYKSEQRTKIEYVEREVQKIVERPVYKSACVDADGMQQINDLIKAGNTS

SEQ ID NO: 4587 - protein, 382 aa, Acinetobacter baumannii
GFLIMKKIFISIVFGTRPELIKLAPVILLAKQDSRFQVEVIFTGQHDELVRDAIDFFGVEIDHRLKIMNAGQSLNQLLIHGLTQLENIYTDGQKRDAIVIQGDTTTVLAAGLVAFSMKIPVAHVEAGLRSYDLDHPFPEEGNRQLVSRITKWHFAPTEQSKRNLLNEQIPPSLITVTGNTVVDAVYLGRKLIAEKTGLKNQLEPYGIELKQNDKVVLITAHRRENFGEGIQNICNAVKYLAKQHPDLHFIWPVHLNPAVHNVVHDKFKSHAQIHLVKPLDYPSLLAVIDRSTFILTDSGGLQEESPSFNKPVLILRDTTERPEVVEVGAGVLVGTNQQKIIEEAEKLLTDSQHYQKMAHVENPFGDGRAAQRILDEIARTYN

SEQ ID NO: 4588 - protein, 138 aa, Acinetobacter baumannii
VQIMIKVLGQRMKKLQFIASCPQHGVLDHPPNECHITQEYVAALLFKQLGNYGFDAQHIVHEHEKVEVSIDNHLLPLSITCQQTDHDGHLMCEISANPDEEQDWFEKIETQSIIRQLAQAVENSLKADHSFSAFEWKS

SEQ ID NO: 4589 - protein, 82 aa, Acinetobacter baumannii
CGAICSFIKRLKLSRNNSKSASYANIIFSFGFIVLSNLIAVHANHFLHNCHGLAAHLNCTFQSANKKGSQSFLFYIGRFELI

SEQ ID NO: 4590 - protein, 360 aa, Acinetobacter baumannii
RSAMTTLKNDRFLRALLREPVDTTPIWMMRQAGRYLPEYRETRSKAGDFLSLCKNTEFACEVTLQPLRRYDLDAAILFSDILTIPDALGLGLYFETGEGPKFHKTVRTEQDVANLPKLNAKADLDYVMNAVSTIRSALGGQVPLIGFSGSPWTLATYMVEGGSSKEFRFTKQMMYAQPEVLHALLDHLADSVIDYLNAQIDAGAQAIQIFDSWGGALAHREYVEFSLNYMKKIIAGLQREKDGRRIPVIVFTKGGGQWLEPMITTGADALGLDWTTPLNTARTTVAGRVALQGNLDPAILYGSAASIEKAVKAMLDDAYANGEKTGYVANLGHGITQWVDPAQPKIFVDTVHEYSAKYLG

SEQ ID NO: 4591 - protein, 929 aa, Acinetobacter baumannii
INQIKVDIVGRSLFCLLINMYLNNMKYVGALKNKRSFIFVFVALFHPLESYAQETVEQTQNQAKPDKVVRVAVTGSRISKAQKDGPTSVTVITAADIEKQGFSNAFDALNNLTQNTGFVQGADYGNTFTPAANAISLRGLGPNHTLTLINGHRVADYPVPYDGSVNFVNLANIPTAIIDRIEILNGGASAIYGSDAIAGVVNIILKKKTDGTQFNIKAGGTKKGGENLRLQLSGSKTLDKLSLVYGVELSGREPIWAADRDFMKSRTRLGEKPDTIVGRKNADTGKYLSIGGCQAFNGLFNGSVNNIGQAGADNCASGLARPTYWTVHTQNRSQNGYLGLDYELNDKTQLFADFLIGANQIENNTRSPIWTSLAATSGYFLNQDSGNYEIWNRRFAPEELGGVERINKKWKELSSNLNFGIRGDIGETSWSYEAAYNGSIYTSQLNRQGLLRSNVDEYFLGQQLGTDADGIPIYSPHLDRLSRPLTASEFESISGTTKEKDKSWAQSLTLSANGDVFKLPAGMAKLAAVAEIGRQGFSIKPDQAVENGEFYNTSSSGEYSGTRTRQALGAELFLPLAKPLNLTLSGRYDRYALSDNSIDKLTFGSGLEFRPHPTLLVRGNYATSFRAPDMNYLFLNKQKGYFASTTDYLRCNQTGQPLDKCTFKDYSPGANYTLTGNKELKPEEGKSYSAGFVWSPTNKFDISVDYWDIKIDNLVTNLSADKILRLEADCRLGNQDINSAACIDALARVERNPANAVVDPNVIKNINIVPINAASDHTRGIDFTTRWRWKTDSFGNFLWTVNYSRVLEHEYQQSKDGEKDDYLKDLSIPDWRDRFNTSLSWSFGDWASTVLVNRYGKIPNGDQTAYLSPTYLVNWSGTYQISPKASASIIINNLFDKVKRDDTGGWPYYPVGSYSPFGRQGWLEFNYKF

SEQ ID NO: 4592 - protein, 159 aa, Acinetobacter baumannii
TCKIWLSRIFYNSKNINFLWKIIMNGQCLCGETAFEVELKNHDVHVCHCSMCRRQTSGVIMTVDVVKGSLKFIQQKHLSVFNSSEWGERGFCNACGTTIFWRTKDQSYCNINVFSLNEPVKDLKLDMEIFIDSKPDFYNFKNDTKKLTEAEVSALFNLE

SEQ ID NO: 4593 - protein, 431 aa, Acinetobacter baumannii
VIKMTQNLHHIVIVGGGAGGLELATQLGETFGKNGKAKITLVDQNLTHIWKPLLHEIAAGSLNPHEEQTNYFAHAEKHHYEFVLGTLTAVNKDKKIIDLIPPQVSKEQNTHIQQLSYDTLVLALGSVSNDFNTPGVRENCHFLDSRKQADIFQQDLLHLYIEAQNQPDQRTLNIGIIGAGATGVELAAELIETTKNFYRYGLKKIHPNQVKITLIEASERILPALSEKTAEHSAKQLQKMGVEILTKHRVEKIDEHHIYFSNGNQLNSDITVWAAGVKAPKVLESLSDFERDNINRLMVYATLQTYSDPNVFAFGDCAHCQLDARHPPLGPRAQVASQQASFLVDAMAARLNGRSQPMFTFNDKGSLVSLSRNKAVGELLGDVSVQGYIAKTMYVSLYRLHQATIHGYTQAGLLTMKDLLTRRVRPKIKLY

SEQ ID NO: 4594 - protein, 536 aa, Acinetobacter baumannii
LREIFMNTAVKLNKDQIFSMLPRAAKQKLMIVGIGWIIVAAIEAIAYTVLAFAIVNQWSPSWVLISAIAAILVTVIVTRAGFLTGVRLAGDLFAELGKSLARAKLSWFTNEQRAQIKTIAGQGIPGFMSIPAHQLQTFLHAPFMPLFLTIGISMLAGAGVAFVALGLLLLSLFAQFLAQRALMHIDKKRNTADLAASQATLELVDHVELLRTAAGPERAVQRLENRWEEQEATLVQINRAAAFASFVATLASVLPIAGMATYLVIAGVNHAALVLALLVLIGRAAAPLGELATAGLHINDLFAALRNFNQITHPPELPEPLHPQIPTGHHISVQGVSYAPALENMSLDIALGSRVWVTGPSGSGKSTLLELLTRFDDPQRGKITLGGIALDQMKYEDLVSNIAYVTQEPILFTGTLAENIRLGKPDATDDEIEKAARDAALGAMIDRSSEGINQSVGKQGTALSGGERQRVAIARALLKNAPILILDEATSALDEETEQEIVTTIRALSSTVIFVTHRDSTIWQPTQTINLASTSV

SEQ ID NO: 4595 - protein, 118 aa, Acinetobacter baumannii
LKPFLAQLPMSYLYLAIAIACEVIATSALKASQGFTVPIPSIITVVGYAVAFYLLSLTLKTIPIGIAYAIWSGAGIILISAIGWIFYKQHLDLAACIGLALMIAGIVIINVFSKNTHL

SEQ ID NO: 4596 - protein, 468 aa, Acinetobacter baumannii
AIRMSTSNTSSPMDQNVFDPQAAAQARDRRKKVIEKSLAKRHRKEKAFRFAGLSAVVIGLAFVALLFGSILAKGLPAFWQTSMNVPVYFDPKVIDAGPVPVRTQGETPAHYQERYVDWQTKMGMVDWDSLIVNGMIAKDPSLASQRDYLSSLYASSEAYRLRDMVFADPSLIGKKENLTFLGDANVDVWLKGNIDRSLPDDQQQLDPEIRKLADDLKAKGVLENTFNTTLFKNPDSRSSPAISGLAGAFMGSLFMMLIVIIISIPIGVASAIYLEEFAPKNVITDIIEVNINNLAAVPSIVFGLLGAAIFIGWMHLPLSAPFVGGLVLSLMTLPTVIITTRASLKAVPPSIRQAALGLGASKVQTVFHHVLPLALPGIMTGAIIGVAHALGETAPLLLIGMSAFVASVPTTPFDQATALPVQVYLWQGNELRNFFEGRTAAAIIVLLALMIGLNSLAIWLRKKFEVRW

SEQ ID NO: 4597 - protein, 356 aa, Acinetobacter baumannii
RERIEVNKMSLLQQLAIKHPIFLAPMAGVSTPELAAEVSNQGGLGSLGLGANTPQSAREQILKTQALTENPFQVNFFCHQSTELNVEKAKQWLEYLRPHFEKFGAQPPQELHCIYPSFLDNDDFLNVVLETKPKAVSFHFGIPHPHQIKALKEAGILTMVSATNLIEAQAIEAAGIDIIIAQGIEAGGHRGIFNQTFDGAIKTSDLVQLIVQHCTLPVVAAGGIMTGLQAKHMLGLGAAAVQLGTAFVQCQTSNASAEYRKALFSKPVTQISASLSGRPARGILNHWHTKIDSPTRPVQPEYPYTYDLAKQLNALASKHQDYGFGAFWAGSNVAQIRELEAPDLVNQLVVEMLDSE

SEQ ID NO: 4598 - protein, 884 aa, Acinetobacter baumannii
SSTFVFFCWISTVTQKLDQVTSSTLSLAKTNTTNVTINAFPSAFEQPDIKMTLDKTALKPEQLTHIPNFENIPASTKRIKPLNNFLGQDRAKASVEAGISLPYSGYNIFAVGTAGLGKRTMIKRLLQQHAKTMPTPDDWVYVYNFKQARQPIALRFPAGQGTKFQQTLHQTWQIILKQLERRFSAETYHNRIERIRQETGDEQQQALVELTKEGEELDLKLISRNEKHGFVPVQLKDNQVQELTQTEIDALNSKQRAEIAANIRYMDKKLERLGLHLGDLEDDARDKVSVLNRDIATQVVMPRMDLILNKYGQVKGLEDYLKQYAQDIIDNVELILEQEEDDFAPAMFNRVPARYQANVIVSNKPNSGAPVIFEDFPTHYNLLGHVEQLTHNGTITTDFTLIRPGALHQANGGFLMLEAEQLLEQPYAWQGLKRALKSGQLKLSSLEHMLTLTGSISIEPAAIPLDIKVVLMAEPEIYYEILEVEPELGSVFKIRADFTDTLQRNDENEQAYMQLIADYVQADKLLPFDRSALAALLTDSSRQAEDQSSLSLHASTLGDLIREAHHHAFKANDKMVTDQHINLALQHRQYRLGYLRELYWQDLSRGTQLIETSGHRLGQINALSVIHYADVEFGLPSRLTASVYQGGGDILDIERSVELGGSLHAKGVLLMSSFLKAHFGREQILHFSAALAFEQSYGQVDGDSATVAELSALISAISQLPIDQSWAITGSMNQLGQVQPIGGVNAKIEGFYDACKLQGLTGKQGVIIPRQNMQHLMLRQDVIDAVREGQFHIHAIDTIDQALEILMARPVGTLDKKGKYSKHSIYAAVMEQLEYWQAIEDGAEVEEEPKKKKKNKKKIKKHEELTADDLPQETQEEVATLKQK

SEQ ID NO: 4599 - protein, 633 aa, Acinetobacter baumannii
LKLMSLMKSVVLIFASLAVNIAYSAETNPSIQNYWSIAEQKKLDQDITWQRLMYANKNQKSEVTYAGYFLSENGKNNLKEELKADISALFIPTQDNQSIRCKFPARSQWLIQQLGIQENELPQVKCSEFENWIGQIKPYKATLIYATDFMGNPSSMFGHTLLRLDPKDQQQLNLVSYAVNYAATVAGNDNWSYAWKGLTGQYPGEYSLMPYYRKVKEYGDFESRDLWEYELNLSPEETRFLVSHIWEMQHVSFPYYFVSDNCAYRLLGLVDLVKPESHLQEKFNYASIPMETIKAMQQQGLTKAPVYRPALETQLLAQAHQHGASLAKVAHQLAMKPIKDSSETLKSFSPSDQAKILEMAYDDLYLQFIGRKVEESFAQPQLRQLLALRSQIDLDKQRQEPKRPSTEPTQGHNARNVSLKLGEVQGDKFIEIGHRQAYHDLIDPQGGYRAGTQLLFLNGNAQWRDDHLKLERLDLLEVNSYNPIQPFKTPLTWGFNLGWRQEAVHDGVYSDEKQHGVASFNAQVGYSLADYARKHICYGQVQTYVQAGSNLDKGWRVGVGPTLGCMNQWFEKFNTVVQVELPYWEDQNQWNLRLNTQWQYAINSNNAIRFNWDYEKQNHLDWMKSSLGYVWFF

SEQ ID NO: 4600 - protein, 463 aa, Acinetobacter baumannii
EILMNAVNASFTDYKVADISLADYGRKEIKLAEAEMPALIGLRKRYAASKPLAGAKILGCIHMTIQTAVLIETLVELGAEVRWTSCNIFSTQDHAAAAIAARGIPVFAWKGETEEEYVWCLEQQINVNGQPWDANMILDDGGDLTALVHEKYPALLERIHGITEETTTGVQRLIEMWKDGTLKVPAINVNDSVTKSKNDNKYGCRHSLNDAIKRATDMLLSGRRALVIGYGDVGKGSAQSLRQEGMIVRVTEVDPICAMQACMDGYEVVSPYKNGVQTGKKEDINHDLLGNTDLVVTTTGNYHVCDAAMLDSLKAGAVVCNIGHFDTEIDTAYLRGYKWVEVKPQVHQVYRSEDENNYLILLSEGRLVNLGNATGHPSRVMDGSFANQVLGQIHLFQEKFADLPASEKAAKIRVEVLPKKLDEEVAAAMVAGFGGVLTQLTQEQADYLGIAVEGPFKSDAYKY

SEQ ID NO: 4601 - protein, 246 aa, Acinetobacter baumannii
EKVMMNSVTLPIVGHMCSPFREKFGIPRQPNLVNIESYIEMVEPYNDLLAFEGIEQFSHLWLIWQFHDNKNQETATKFRPQVRPPRLGGNEKIGVFATRSMYRPAPIGLSVVRLNKVEKVGKSLRVYITGSDLLNGTPILDIKPYIQYSDAIVDAQSGYAQAEPERKSVLWSENALSTQQSLFKNKEINAQYLDELEQVLSLDPRPAYQEDPERVYKMKFSNFDIHFKVNGNVITVVDMVKDTSLV

SEQ ID NO: 4602 - protein, 163 aa, Acinetobacter baumannii
EGVMDKFMLEPLQESYSFTPGNNIREQENEGGPPRQSPFFVGAVHRVGVTVYLENDEDRQYFWAFWRLKQRKPENWLWNLALDEGIREDCECRFAYDVLPSESSRNGQAVKMSFQVIVKPIKRSADLDRNIVNVRQGIESNEVIDDIEKVPNEWLSDALGVNQ

SEQ ID NO: 4603 - protein, 279 aa, Acinetobacter baumannii
GRSMHLTGQQSRLHIQRDKIMKIMMLSVAVGFTVAMAGCASKPQINNSSRYAMAPNYYTVRSGDTLSGIAMRYGLDYLSIAEMNGIAPPYRIYVNQSLRLKKSSSPRTVSTQVMAQPEPIKRQTIALPTTTAPTTTTPPPATVAPSTNTTVGASIPSSSLRWVKPNNGPVIQGFNLANNVKGIRYGGNQGDPIYAAADGQVVYAADGLKEYGNLVLIKHIDGYISAYAHNSKMMVKSGDNVTAGQKIAEMGSSGASRVMLEFQIRLDGKPINPANLLPN

SEQ ID NO: 4604 - protein, 179 aa, Acinetobacter baumannii
IMALNIPESLANLEANCGLFAVWMVLQHHGVPIDVAELIKVCRYDDEGTYTIALAVALKKLGFEVSFHSDHDPNISPSERMSYKEAKVLRIPTGPALSYQDIQTETQNGKMVIVYYDTLEGVGNQSLIYSIDQNEICFFDSFEPMSAAVFENQRKAEGICRQAVVIGDRNLNIHSTKLN

SEQ ID NO: 4605 - protein, 342 aa, Acinetobacter baumannii
FVKMLLNSFELFQLFWLWLRNNIEVIMPRKKKGFELPDVKHAARGQWEDIFARFNITVPKKDTHGPCPYCGGEDRFRFDDKYENGDWLCNVCTESKNRDGFDLIGKVTGLPFSQIIEEVASIVGLDATSTITPQMRKQWEEEKKIRDRINQEMKLKKQQQVARQAAGLYRNPYPGETSPYLERKQVPVLPGVKIDHKGNVLIPAYDTEGFMWNMQTIYPDGGKFFVSDEEDPNGNKKGGRTGGCFFLLGTIELVDPIIICIAEGYATGASIHLATGYPVALAFVANNIPKVGAALREKYPQATLVYCADDDSAKDDTGMKYAQQAVAVTGGIVVLPKFNKVA

SEQ ID NO: 4606 - protein, 187 aa, Acinetobacter baumannii
WVKIIMTNKTKLFVIGSTIAASMGGFFIFGPSDQQVQATAAKEGYTAKPTIPVKGDRPTIGNGTTFYPDGRAVTMNDPAITRKQAFEYLKFTMNKDARAFNKTLLNIPISQAEYDLYLDFTYQYGIGAWSGSSMLKNLKIGKYKAACESLLKWKYVAKRDCSVRSNGCYGVWVRQEERYQKCMGVNS

SEQ ID NO: 4607 - protein, 490 aa, Acinetobacter baumannii
SVVFMTQVDIAALSPQVVWQHFQTLCTIPRPSKHEQQLREFLQNWAESRNLETYVDEVGNLIIRKNATPGKEHMSGVILQGHLDMVTQANTGTVHDFFKDPIRPVLEDGWLIAKDTTLGADNGIGVALALAVLDSNDIAHGPIEVLLTVDEEAGMSGARLLQAGVLKGKWLFNIDTEEWGELYLGCAGSIDVEVEQPLSYEPIPENLSIVNIQVAGLKGGHSGVDIHLGRGNANVILARFLNEYLAKLGGHLVEFTGGTARNALPREALATIAISSNQLPELEKLLAEYQTTWKEQLKGIDDNLQLSIQSTGAEVTEVITQQQQNEWLQALATSPYGVTSMSQVLPDVVETSNNIGVVRLNREGGKAVLMVRSMVNQEAQDFAEKIQAHFSQFNIGSTLTPLVSGWTPNPDSAALKCLQQAYQNTFNIEPNLKVIHAGLECGIIAEHYPHLQMVSFGPDIQGAHAPGERVKVDTVEKCWKLLVTALASVE

SEQ ID NO: 4608 - protein, 326 aa, Acinetobacter baumannii
VVGIYMKKVVVFSQIDEEILSRLQQDYHVVVLNPKLGDINEQIRQEVVDADGMIGAGRLLNESNLSPAQKLKIISSVTVGYDNYDVGYLNRKKIWLANTPHVLTETTADLAFTLLLSAARKVPFLDHWTKQGEWKRTVGPQQFGLDVFGKTLGIIGLGNIGAAIARRGFYGFNMNIVYHNRREKPELAEPLKAQYLGLEELLQQSDFVVTAVDLNAESKALMGKAQFELMQKHAIFINIARGSVVDEQALIEALQNEVIFAAGLDVYEKEPLQESALFNLPNVVTLPHVGSATAETRKKMANLAYKNLVEALEDKTPRYLVNPNFV

SEQ ID NO: 4609 - protein, 214 aa, Acinetobacter baumannii
KAVLMIVLGLETSCDETGLALYDSELGLRGQVLYSQIKLHAEYGGVVPELASRDHVRKLIPLMNQLLEQSGVKKQEVDAVAYTRGPGLMGALMTGALFGRTLAFSLNKPAIGVHHMEGHMLAPLLSSQPPEFPFVALLVSGGHTQLMAAHGIGQYELLGESIDDAAGEAFDKVAKMMNLPYPGGPNIAKLALSGDPLAFEFPSPNASSGLRLFF

SEQ ID NO: 4610 - protein, 72 aa, Acinetobacter baumannii
RCNLLFLIIIFIDHSKDLPSLISLIYCRGENEKYQNNKLYNTFNITDGSSDLFFGNDRYKLSLCTRASRPCI

SEQ ID NO: 4611 - protein, 179 aa, Acinetobacter baumannii
RIFVNRTIFLNRIIFCIFKIKGSQIMATTLELWNKVTAFPKGKWTFSRMLCLKAPYFGSISPLFIELKPNYCEISIKKKRSVLNHIGTVHAIAMCNMAELAGGTMTEVTVPTTHRWIPKGMTVEYLKKAETDLIAIATPVEADYNWEKAGEYLVNVDIYDTHKDKVFHATITMWISKKK

SEQ ID NO: 4612 - protein, 195 aa, Acinetobacter baumannii
VWSVPVMANYSTNDFKPGLKVMLDSNPCSIMENEYVKPGKGQAFNRVKLRNLKTGKVLEKTFKSGDTLEAADIVEVEMNYLYNDGEMWHFMDPESFEQIAADKTAMGDAAKWLKDDSNETCTIMLFNGVPLNVNAPNFVVLKVVETDPGVRGDTSGGGGKPAKLETGAVVRVPLFVQQEESVRVDTRTGEYLERA

SEQ ID NO: 4613 - protein, 767 aa, Acinetobacter baumannii
LVCFFVSIETQMDDQSLKQAALNYHEYPNPGKISVTPSKQLVNQRDLALAYSPGVAAPCLEIERDPSAAAKYTARGNLVAVVSNGTAVLGLGNIGPLASKPVMEGKGVLFKKFAGVDVFDIEIAENDPDKIVDIVASLEPTFGGINLEDIKAPECFYIEKKLRERMKIPVFHDDQHGTSIIVGSALLNALQIVNKKIEEIKIVASGAGAAALSCLDLLCALGVNKENIIVADSRGLLTTSREGLDESKKRYVQDIKATQLHEVMAGADMFLGLSAAGILTKDMVKQMAENPIIFALANPDPEILPEHAHEVRPDVIMATGRSDYPNQVNNALCFPYIFRGALDVGATTINEDMKIACVHAIARMAHVEADAATYGEKSASFGRDYLIPRPLDQRLILEIAPAVAKAAMDSGVATRPIEDFSAYRQKLSEFVYNSAFLMKPIFAQAKTDPKRIAYAEGEDERVLRAVQIAVDEDLAKPILVGRTAVIEANIKKLGLRLQHGVNIEIVDQEQNPLYEEFWKDYYQTMQRKGITVEYAQREARRRSTLIAALLVKFGKADGMLCGTYSSYNIHLDFVRNVIGLKEGMNNFFTLNALMLEDRNLFIADTYVNTNPTAEQLAEMTILAAEEVRRFGITPRVALLSHSSFGSDQTDSSAQKMREVYRILSEQAPELEVEGEMHGDAALDENIRHFAFPGSRFKGSANLLIMPNLDAANISFNLLKATSGNNVTIGPILLGAAKPVHILTPTATTRRLINMTALTVAEIQQQEK

SEQ ID NO: 4614 - protein, 422 aa, Acinetobacter baumannii
HDCLKNRGFFMQVYLVGGAVRDYLLGHPYQEKDYVVVGATPEHMLAQGFQPVGKDFPVFLHPETKEEYALARTERKSGQGYHGFQFFTDTTVSLEDDLIRRDLTINAIAMDQDGKIYDPYGGQNDLENKTLRHVSEAFAEDPLRVLRVARFAARYFPYGFQIAPETLQLMQTMADSGELDALTPERVWKETSRALMENHADIYFQTLRDCGALKHLFPEIDALFGVPQRPEYHPEVDCGIHTLMSLQQACKSNYSLDVRFAVLVHDLGKALTPAEELPRHIMHEERGIKPVTQLCERLRVPTQTKQLALSVCKEHLKCHQIMSLKPGTLWRLLQRLDVLRRPERVEAFVQACECDAKGRLGLEDRPYPQAQYMREAMQIVRSIKVQDLPENIKGAEIGEMLIQYRIEALAEFKNQHQSLSHS

SEQ ID NO: 4615 - protein, 64 aa, Acinetobacter baumannii
PACFNMTTIFTTMQISIHDSISSIIIYLLRNMLNLWGKAKNRVDATYCCIFKMIKIFINIRFKF

SEQ ID NO: 4616 - protein, 490 aa, Acinetobacter baumannii
LEDVSVSKDTIIALHAEHQGRWKNREEIAERMIALIGQLYREKNIVVSVYGRSLINRSVIQILKTHRRTRVVDVELSVVNTFPILEALAKVENIGSAEVDIGKLAVEYKEKGGDVDAFVAQAVESIKGSATSEQPKDVVLYGFGRIGRILARLIISQSGLGRGLSLKAIVVRKSSDGDLAKRASLLRRDSIHGTFAGTISVDEENEAIIANGNFIKVIYASSPSEVDYTQYGIENALLIDNTGKWRDAEGLSQHLKCPGVARVVLTAPSKGEMKNVVFGVNNSDILDEDKIISAASCTTNAITPILKVLDDKYKVLNGHVETVHSFTNDQNLIDNYHKADRRGRAATLNMVITETGAAKAVAKALPALKGKLTGNSVRVPTPNVSLAILNLTLDKEVDREEVNEYIRQISINSNLQGQIGYTNSTEVVSSDFIGSRTAGVYDAQATITSGNRLTAYVWYDNEVGYSCQVLRIAEQMCGVSYKKIPAETNA

SEQ ID NO: 4617 - protein, 192 aa, Acinetobacter baumannii
QLSVNRKQDMLKKGVFYIGAVLMVGCTTLPDHSAPKEKTPPVSEKKKSESSSGVKITPYDHPEIQRKSLQVIVPQQKKPQRFNDDGSQLPAFKTLMQKTEQAYKNQQWSEAERYALQAQRLAPQAAETYLFLALTANHKQQYSNAESLARRGLSFAQSQAMKKQLWLVILKAGQQRNNPKTVQEAQQALKAF

SEQ ID NO: 4618 - protein, 306 aa, Acinetobacter baumannii
KILVSRKMPKPIVDVAIAILIHRGKILVGWRGEQQHQGGKHEFPGGKVEQGETPEEACRREIYEEVGIGLKDWHQFDYIHHEYDDIIVNLHLFHSYVPDELLNLIHQPWTWYTREQLLHLNFPKANKDIIKRLYWPHFIKISHTLTSVANSNALLYWRIEDEFGPREVEQLTALDEGQRSNLIINVDIWQQLNPELKKQIKTVHLKQSQLMSLHKGDLEVGIRFIAACHDAVSLQHAQQIGCDAVFVSPVKVTATHPDVSALGWDRFADLIEKCQIPVFALGGMSPDDLATAQQHGAYGLAGIRNF

SEQ ID NO: 4619 - protein, 122 aa, Acinetobacter baumannii
TMLVSEIIYEVLKAPFNDRVGPHPLPEGFDNSATYITYQGITNIPLNTVKGWTGHGRVRIQINVYNHEKLQAEKDAEAVKWAMDQQKYSNCEIAEQRDGGFDEETQVWGQEIDFYLWQNACN

SEQ ID NO: 4620 - protein, 71 aa, Acinetobacter baumannii
GPSFWPSAYEPICLNKTLRVSALIGFQSTKYPVITTFRSEIIHNLNLSIIILYLTYGNKCAFTNFLGIEQS

SEQ ID NO: 4621 - protein, 72 aa, Acinetobacter baumannii
NNGLHIRPFKQLRVTKNVNSWPRTLKPEVRRKVVRTTIYIKNRIFQGLILSNRTCGKLRLGVIVFKTLENVD

SEQ ID NO: 4622 - protein, 232 aa, Acinetobacter baumannii
GDRVMNAYLHRSEDRGHVKAGWLESYHSFSFGSWYNPKYMGVSALRVINDDRIDAHNGFGTHSHDNMEILTCVLDGAISHRDTMGNEGQIKAGEWQLMSAGTGVAHSEINNTDTPVHLLQIWIIPDVKEAEPNYQQISLDPRNQPNEWHLIAGPDANAPMHIRQDAQVKSAVLEKGRELPVETSKRVNYVHVISGEVRIGEYEVKAGDALVFEDNAVIHANEDSQFIWFDLP

SEQ ID NO: 4623 - protein, 87 aa, Acinetobacter baumannii
IHLVRISCFTCKCFFPMMCPTHALVAQLDRVQVSEAWGRGFDPRRAHQFIYNNFINLSQFYKIPTILLGLLIIIAQNIPLFHNVRIS

SEQ ID NO: 4624 - protein, 299 aa, Acinetobacter baumannii
GQTVNQLPFFLKMFRCLQGFDMTKRTPISFEFFPPKTDAGAEKLRIVHQELQQLNPEFFSITYGAGGSTRERTLAAIEDFNGKGTPVAPHLSCIGDDKTRIAELLDLYKAQGIDRIVALRGDLPSGQVGLGELPYAQDLVRFIREHSGDHFHIEVAAYPEMHPQAESLDSDIQRFIEKVQAGANAGITQFFFNPDSYFYFIERLEKAGINIPVAPGIMPITNASNLIRFADGTGAEIPRWIRKQLQAYGDDSESIKAFGHEVVVKLCERLIAGGAPSLHFYSMNQVEPTRQLVVDLGLN

SEQ ID NO: 4625 - protein, 258 aa, Acinetobacter baumannii
MEQVAKLVIRDLHKTFGDHEVLKGISLDANAGDVISIIGSSGSGKSTLLRCINFLEQPSNGTIKLNGEKLRTVFDKKGNLKVVEPKQLQKMRTQLMMVFQHFNLWSHMTVLENVIEGPIHVLGVKRSEAEERARKYLRKVGLPESVESKYPAFLSGGQQQRVAIARALAMEPEVMLFDEPTSALDPELVGEVLKVMQGLAEEGRTMIVVTHEMGFARHVSNQVIFLHQGKIEEQGHPDEVLNNPKSERLKQFLTGSLK

SEQ ID NO: 4626 - protein, 249 aa, Acinetobacter baumannii
TSLFCWCEEGTIMIEILQQYWQAYLWTDGLQMTGVAMTAWLLVLSIGIGFVLAVPLSLARVSENIWLHGPVWLFTYVFRGTPLYIQLLIIYSGIYSFDYIHEHQTLDAFFREGINCTILAFALNTSAYTTEIFAGAIRSIPHGEIEAAQAFGMSKWKLYTRIIIPSMLRRALPFYGNEVILMLHATTIAFTATVPDILKIARDVNAATYDTFSAFGIAAVLYAVLAFILIWIFRKLEKRWLAFLKPSNH

SEQ ID NO: 4627 - protein, 634 aa, Acinetobacter baumannii
LGLFTLKEVSHYLIENKNMAWSITMCLVAVLLTIFILNLILGLLVHFFDYSEPIWWHALSPYFIALLLFIMVWSVVTELYILRKGGHSLAKQLKARRLVKGESTPEEHAALKITEHLAQTFSLNVPTLYVLPDEVGVNALTAGFHSNDIVIILTWGALQNLDELELYGLLGHEFNQILSGEAVENTKLKILYSGLTTFSQWGSKLAKQGFKRYSPGYKHKFETVFVAVGGVIWLAGSLGVLITRFIKYLTLSGRTFRNDQKTMRLLKNSTNTQTLLRIYVHHSGSQIHSAYSESIAHMCFANSLSPQSWMNIHPSIRERIYELNPTLLQDLQLENLKKLRNRPLFSLFHVLEESETEIYTPWSSPQPLPLLRLSPISFALNDAIKPLSSDIRRNKKRPELIQRALQTATGSREVMVAILMIRQYREFIPQDAPVSHAIVDALLNLDGRIHIQIFHDACKNIGHMPASIARQFLTKLALIIQEDGEIGLLDALLLERVKYELNLMPLHLPTAFEEVKPQIVRLIDALLHVQQINSPNQLEVRERILRSLLNPDEMHIYDEISDEPLDLAEILNDIAGLLLRDRLSILAIAEMCLWSDRIITQDELDVLELLYWRFGFESDEIVEQMQKKNSVMII

SEQ ID NO: 4628 - protein, 348 aa, Acinetobacter baumannii
SCLFIHIDNLEFKKDMLSQFVNKTLKVLALCTGLISTSHFAQANDFVTHPNYLNFKQKAMSTYGLSGEQVDAAMNGAKNLPNIINIMTRPGESKPWYDYRSMFLVEGTIQRGVRFKNQYADALNRAEQQFGVSQAVILGILGVETGYGANKGSFITRDALATLAFGYPRRAEYFGDELAALIAWTYKEGYPTNSIVGSYAGAIGFPQFMPSNISKYGVDFDGNGHIDLRNSAEDAIGSIANYLAKQGWQRDQPIGFMARYTGSNPESIIAKDLTQPTPYGALKNQGISPLNPLVKIDDLDMVNVIQLQDYNGPIYYLTYPNFQVITTYNKSRMYATAVWLLGTEVASR

SEQ ID NO: 4629 - protein, 249 aa, Acinetobacter baumannii
FIIFANSVVNLPERHCNSDVSFLLLPACFSSCLGNTTLSDFLSEHLIYRDDDFMVIHKPSDILSVPGKGDLHDSVLTRLVAIEPRTLLIHRLDRDTSGILVFGLSKRGQSAIARQFQDRQTSKIYEALVAGHLEGEGTVDIPVVYDPSRPPLHIVDASHNKPALTHWQAIEHFQIQGQPVTRVKLTPITGRSHQLRVHMQYLGHPIVGDTLYATPEQLLVPRLCLHAKQLSFNHPVTGESLTFNCPVPF

SEQ ID NO: 4630 - protein, 230 aa, Acinetobacter baumannii
VMSFSGYGPLLLSGTWMTIQLALLSLLLSVIIGLIGASSKLSNIKALRYVATAYTTLIRSVPDLVIMLLLFYSLQLGLNQITEALQMDQIDINPFVAGVITLAFIYGAYFTETFRGAFQSVPRGQIEAAMAYGMTPWQVFHRVLFPQMMRFALPGIGNNWQVLIKATALVSIIGLTDIVKITQDAGRSTMQLFFFSIVAAAIYLAITTVSNLILIWLERHYSAGVRKGQL

SEQ ID NO: 4631 - protein, 445 aa, Acinetobacter baumannii
GQQLNYLTVDRDQYTYIFIQLMIGIVYFIRLISSSFYAGVLLSMNKPLSSRFLFKSFGMVAVCMSLAACGDKAWWSNNDEPELESQQIKRLIPSRVHDRESWAKDIDDIMKDLDIPKTKQNVCSIVAVVDQESNFVANPQVPGLGQKAVEEVSTRLNEKFEDKLGKTIGGTIAGYFEEVLRTQPSPDNNYMSQMRKVKTEKDLDLLYREIFDFMAKHYHVSALTGAAKLVGQDIGEKMNPITTLGSMQVHINYAKANKRSSMNTAALRDDLYTEYGGLYYGIHRLMVYPADYDKAIYRFADYNSGMYSSRNAAFQKMLKELTDKDISLDGDLLLYTKDGDPRATQSESEKELITVFASNNVLVTPRQIRDDLKLEKEKKFESTQTYIALTKLYKSKTGKEPLYAIMPQVVISGPKLSRDYNTNWYATRVNGRYETCMQRAKRIRL

SEQ ID NO: 4632 - protein, 155 aa, Acinetobacter baumannii
MKKLIIDANLLLLYVIGLIDNGNYIGRSDRLERYNKKDFDLLIRLLIPFKEIYVTPYIATEVSNLIDIKGKVRNQIFDIYSALLNGVLLQIDSNFKEDSNLPFFTKFGLTDASLTFLVNDYCILTDDERLCSVLYGLKADNVYQFEFVKHLDSLF

SEQ ID NO: 4633 - protein, 571 aa, Acinetobacter baumannii
IEEFMLHYQIEFDDYKQHLVHVTIRFLANPNQELWLPTWIPGSYLIREFSKHIETVKAYDEAGRMLNIKKTEKNRWRLFNTDHELITVEYDVYAYDLSVRGAYVDQTRLYINPACVCLGLEGQEQSACELEIFLPDELKHFQLATGLASKSLVKGRFTLKADHYDQLIDSPFELADQTRFSFETHGIEHEFVISGTHATNVDRLKTDIEKICAAEIDLFGSAPFKNYTFMTMATGNSYGGLEHCNSTSLITPRDDLPKSNEPTEPSKDYQRFLGLCSHEYFHSWLVKFIRPENFANYNLHQEGYTSLLWIFEGFTSYYDDLILLRSGVISQKSYLDLLKSQIDRYLQNPGRFVQTVAESSFDAWIKFYRQDENSNNAGTSYYNKGALVALCLDLGLRLRGSSLDALMRRLYENTQNGVQVNERTIFDLCEELTGDSWVEQINHLINTTEELPLDQLFPEFGLSYTLKNDKTLAYGLKLADKPEGVLVQNAHREGAGAKAGISANDVIIAIDGLKATTKLIEKYAKQKGNYSVLAFRRDELLSFEVTSDSINLTEVELIIEDQSKADKWLKA

SEQ ID NO: 4634 - protein, 489 aa, Acinetobacter baumannii
KGYSMKRSKIALAITLSISALFLTACNDDDDDYTGIDTNKAYVSESNYAIDKVDNASSIKVMTYNMANVQGKTATATAMVLFPKATQPKDGYRVVVWEHGTVGVGDGCAPSKNAINPRFKILAESLLAAGYVIVAPDYEGLGTPGVHPYLNLSSEAKSALAAVKAVKEHYGAQLKGDWMSIGQSQGGHASLGTAEFANTDVSYKGAVAGAPASSLGTIIQIYIDPEMNQDSNFAVSKLDQAIRARRQIDAAIAAGQMSPNDPLALAVPTIDKTAEGYAELLAYAAFASAGIKAQQPDYDLKAIFTSEAADIAELAYGRTGDDGACLSYPAPDTANGLQEKFKAGILAFLADPTHQITQYGIDLNKFKTDQVVQNFLKATQPATNATAEKVIKTPVFIIQGEKDQAVLPVVTQGLFANMKANALKFFPQAGYDQGYKLTIVPNATHTHAIVCQNANAVDFIQAKMSAGTGIVLTDAQKDASQSPHCTGKF

SEQ ID NO: 4635 - protein, 396 aa, Acinetobacter baumannii
SSHSRDCLLERVFMTSGFETLNLHPQLKKAIDALGFTQMTPIQQKVLKYTLAGHDAIGRAQTGTGKTAAFLISVINDLLNNPVQEQRFRGEPRALILAPTRELALQIESDAKSLTKFSNLHLVTLLGGVDFDKQKKQLDANFVDIMVATPGRLIDFVEQKEVWLDQIEFLVIDEADRLLDMGFIPSVKRIVRYSPRKEQRQTLMFSATFSYDVLNLARQWLFEPVTVEIEPEQKTNNDVEQRVYVVAKQDKYRLLQDILREEPIDKVMIFANRRDQVRRLYDHLKKDGYKVGMLSGEIAQDKRLKMLEQFKQGKHNIMIATDVAGRGIHVDGVSHVVNFTLPEQSDDYVHRIGRTGRAGAQGVSISFLSEDDAFYLPEIEKAIGKKLPLTRLDGYC

SEQ ID NO: 4636 - protein, 324 aa, Acinetobacter baumannii
LKNSKNMLHFTFLGTSSGVPTLSRNVSGLAVRNSKNKDWILVDAGEGTQHRIQQARLSLQNLIAICITHVHGDHCYGLVGLLASAGMNARSKPLIVIAPKEIQQWFEITAQLTDLHLPYSIKFIDVNEATRPQQLTDELFIQAHPLSHRVPSFAFSIYIKSTQKKIDIQVLTQLGVSKGDIWGHLKRGYDVEFEGRILKSQDFIKIQNQQIHAIIGGDNDRPELLADACKDAQLLIHEATYLQTVLDKVGKGPMHSSAKMVAEFAEQQSLDNLILTHFSPRHQDKTGQQAITEEVRQFYKGHFYLANDFDEFTLNETGQLLKIE

SEQ ID NO: 4637 - protein, 495 aa, Acinetobacter baumannii
IPDSGRSVMVEVELKFQLPESKKKTVQQYLKKHKAQHIHLQAKYYDTPDRLLAKNGMALRLRKENDLWVQTFKAAGQSHLHRVEEEVFLGKCDQEPDLNFELYKDNKAVTDLITQALGSEVEKLSLQFETDVQRTYHVFEADDTAIEVCLDDGAVKTATAQSKICEVEFELKQGAVKTLIQFAQQWINRYELWLDVRSKAERGNLLALGQAASPAVHAKNLNLDKDISAEQALKKIVENCLGQFLPNMAAIADGVAEAEHIHQARVSLRRLRSALKHFSAWSDELNPVWEEQIAELFRQLGNTRDEDAIRTEILPMIVQHGSPELLLPISEQPLKDLATLFKSADTIKLILALLAFAYSEEDAQNAKGKLKKYIGKSLDKLHHQVVSNADHFTELEVTEQHRTRKKAKQLRYCIEFISSLYPRKNVQQFLKQLQPVQNTLGLYNDLFIAEDLFNKAIEHDPHFWFALGWVKAKQPYLQNQSAEALQKFKQAKTFW

SEQ ID NO: 4638 - protein, 197 aa, Acinetobacter baumannii
RRRLVSNISLIVGLGNPGSEYAQTRHNAGFWFVEQLADKYGITLKNDPKFHGISGRGNIEGHDVRLLLPMTYMNRSGQSVVPFSKFYQIAPEAILIAHDELDMNPGVIRLKTGGGHGGHNGLRDIVPHIGPNFHRLRIGIGHPGSKERVSGHVLGKAPSSEQSLMDGAIDHALSKVKLLVQGQVPQAMNQINAYKPA

SEQ ID NO: 4639 - protein, 72 aa, Acinetobacter baumannii
FLLSVPIRKDLEQFTLSLLSFSVANNVGFIHIPRTAWQYLAHILVGFILQNFLLFLGRPTHSGASSEISAGE

SEQ ID NO: 4640 - protein, 718 aa, Acinetobacter baumannii
HQGLLKKNKYGARHRINRKVKMTTLNYTVRFQKTVLASLIGFCISQPSFALEELSDAGLSETTGEGIAILPQNTYMVFRGAGANETTNQILTDRTKDTGYINYVPVGPLSMTSADTNKNGTIDSGDRAVGKADIFLYGLALSKSDNNTNTRIAPTETAAAISSWGTAVNPWIFKVATENLVPNFSTTNCTGATDPTCQVTYLALEAPLYEMGTKDAAGLDAYKLKLGLWSDIFVRNPNKINGAADQFNYGDSNGLIGTSTDASRANRLRLQGIWNNFSLNGSRLQVFQTLGGATTSGGMSPFYNNTLGIAGVIRLNSGDSKDVKAITTSSLTEGSTTSPWTLIHAGANSTLSTSTTGDCNNGGTGSFGTSAGCRYYVEKRTRTDSKTATKTWDASGLSNAGVLRLSTRETSDTGNLITPAINGGVAPTFDANEGVYLYNPNINLVLGTLYQPLVLGSDGKNFSLEIARIANKPEIYKQIYTDYSGADTSYKGSTCNVYQCGSQLTLGGKNYQGYNATHSSISIGTAYSEDGGKTLRASTDEGAVGISFGKLNSGTISQTTYSNQMTEVHYKQRGVNTQTWVQSYSCTLFICGAGTTGYLYQWEYNNGSTPWAILAPTTKPADATCSPTIGCSSTSGTTPMYGSIANRVWANSSAVWLTAANNEVNNLIGANNGMTGTTFPTLNQAPTPVINSSPINNMGSAVIDGVLIQHLKLTTKGL

SEQ ID NO: 4641 - protein, 448 aa, Acinetobacter baumannii
IKKSRYWMTKFNNNQSDNLFSQVFGVAKKLSSTGLNILQQSQIGEVSKLVEPLSNGKTVEGSARNKSPFEVEQYESPQQMLREHLPKVTRQVFGRHFRKVNGIATFISPDWNEKISSYLFDWLNDFSSKSTLTEKILEEAGAKDLFELTKDTSRSQRLSQALIEQNKLIASIQGAITGVSGMVGAAVDIPVSLVLVLRTIYQTGRSHGFDLTEATDQDVVEFIFKEVDISLIAEKQTLLLALKALRNMLETQDIQQFQQVLGSSNDIETLKSWLVDENGEFKWNWLNKVPQLAVVGKFTPVAGAVLSAVYSWKLQEDVGHKAQAIFGAARHYLNEHPNEHLSPLQAYYAAVTLIQKASPRLLNVGENGSVHAAQHHKIENHDVISKVSVVVKSNTSEKSEEKVQENVHQGIEHLAEKHVVEHEHSEQKPALEPESEENDGVIEGQKYS

SEQ ID NO: 4642 - protein, 60 aa, Acinetobacter baumannii
QVGSVAPVQFVVLKFGTKFSVATLNIHGLTAVPQLDIAAAVSVGAIRVLVLLSDLDKARP

SEQ ID NO: 4643 - protein, 429 aa, Acinetobacter baumannii
SDMSFFALGVNHQTASVELREQIAFNAERLSNLLAEQRHHESLKDLVVVSTCNRTEVYAMAEDAESLLKWLADANNIDVKQLIHHVYRYENAQAITHLMRVASGLDSLMLGEPQILGQVKSALALSKEAQTVSPELNSVFEYAFYAAKRVRSETAVGSHAVSMGYAVAQLALQVFSKPEKLTVMVVAAGEMNSLVAKHLAEMGVAKMIICNRSRERADQLAQEIAHQVEVEIIDFSDLAENLYRADVVSSCTGSLHQVIAYADVKTALKKRRYQQMLMVDLAVPRDIDPKVESLDGVYLYGVDDLQSVIDENLAQRRQAAVEAEVMVNQLATQLITHQKVKEAGSTIHAYRQHSEEISQRELTHALEALHHGGNPEQVLQQFAHRLTQKLIHPTSMLLREAAKAESPDYFEWLQQHLQDVFDHERKPKR

SEQ ID NO: 4644 - protein, 90 aa, Acinetobacter baumannii
YKMSTRGIATDVAQLRQALTAQLYQSVQWTRTMQSLQDQGIQYIVECGPGTVLSNLAKRLPNIEKAFSIDSKSKMEDALNAVLVAEGKIA

SEQ ID NO: 4645 - protein, 192 aa, Acinetobacter baumannii
RERSSTKRKCTNRCTESITMMWPFYLMALVAIVSTVRVVTNTNPVHALLSLIVSLLAVAGIFMIVGAPFAGALEIIVYAGAIMVLFVFVVMMLNLGQHTVEQERKWLSSDAWAYPALMSFLLGLLLVWMLGGEYTTISAPLGAQVIGPKVVGQALFTHYLLLVEVAAMLLLAALVAAYHLGKREPGAEEEKE

SEQ ID NO: 4646 - protein, 108 aa, Acinetobacter baumannii
PSLFRKLWLKLLNVNINKVGNVSLYITDECINCDVCEPVCPNEAIFMGEVIYEINPDLCTECVGHHDQPQCQLFCPVDCIPKDPQHEETEEQLLDKYKRLIAQKSTSN

SEQ ID NO: 4647 - protein, 341 aa, Acinetobacter baumannii
SRHPLVRIQPPLPFTSLHTNRQGCFMPNLVVFSGNAHPQFAQKVVSHLHIPLGAASVGQFSDGEISVEITENVRGKDVFIVQPTCAPTNDNLMEILVMADALRRASAGRITAVIPYFGYARQDRRPRSARVPITAKVVADMLTTVGIDRVVMIDLHADQIQGFFDIPVDNIYGTPALLADLRQQQHDNLMVVSPDVGGVVRARAVAKQMGDIDLAIIDKRRQKANESQVMHLIGDVKDRDCVIVDDMVDTAGTLCKAADALKQFGARRVVAYATHPVLSGKAIENLRNSVIDELVVTDTIPLSEEALNLGKIRQVSVASMVAETIRRINNEESISAMFDSL

SEQ ID NO: 4648 - protein, 459 aa, Acinetobacter baumannii
IMPPRIRRSVMRQFTSLQVAILALGSLCFSTAYADSTLVPMSDAELSATRGQALMSMSYIAPNDSANLEKLRDSSSNVGFYKLGLEAELEINANIRKLQLGCGGVNGAGGCDIDFDNVSLSGVADTREGRVASDAKLTNPFLEFAIKNPNSASTREVAGIRLSAEAVEGLLTIGTENSATPNGINSLSGYMVVAPQVGEATVDAARITQTGSPACGVYPSPAGCGVNQAITGKARGEIALGAGFNLDFQTKSYDITLTPTQKAQLSLPQSVVSGQRMSSVNLLASAIVNGIDLSGTLAADVDILGGITLNGNLRGTINNLPVTVPLLENLGYIHKINLSGSPLSLSMQGQDIRWPGTVSTAMRGWWLELSNPIDIGRIDPTNSVVIKTDTIRDALTEVSKELTQNPLNCGFLAVNCIGGDFNVGTRDLSNARPALLELQNLQLANQSFAPNCYGSLKFC

SEQ ID NO: 4649 - protein, 415 aa, Acinetobacter baumannii
LVRPVLKITFRNVDIMARQTPITRYRNIGISAHIDAGKTTTTERILFYTGVSHKIGEVHDGAATMDWMEQEQERGITITSAATTCFWSGMGNQFPQHRINVIDTPGHVDFTIEVERSMRVLDGACMVYCAVGGVQPQSETVWRQANKYKVPRLAFVNKMDRTGANFFRVVEQMKTRLGANPVPIVVPIGAEDTFTGVVDLIEMKAIIWDEASQGMKFEYGEIPADLVDTAQEWRTNMVEAAAEASEELMDKYLEEGDLSKEDIIAGLRARTLASEIQVMLCGSAFKNKGVQRMLDAVIEFLPSPTEVKAIEGILDDKDETKASREASDEAPFSALAFKIMNDKFVGNLTFVRVYSGVLKQGDAVYNPVKSKRERIGRIVQMHANERQDIDEIRAGDIAACVGLKDVTTGDTLCDE

SEQ ID NO: 4650 - protein, 819 aa, Acinetobacter baumannii
PSTLLKVNVDFKGTEVMNKNKESHGSKFILNTLTASMLLVSGQVFALEALTDADLSAVNGQDGISIQTTYNEINIDNAYWDDHAGTSNSADQVLRAQAGGIKVQKSNASTQTLGTNYRLDVGSNPTTGKTGLDFSLQSNPSLITVNSFRVCNSSSICSPTMGQLAIQTSSPLSLALTTQDGLFNANSQSSMRLGLNNANIYLGQVDARTQLNQLILKNFNFNFVGKGAMLIDPNRGLVLQTNTGNNTAAVGQTPNSTYGYVDFNRVADSASGLTAGTYVDSSGKVTNSGLNIEVMLSSNVDKSNPYALDTTNSPQNSKGLIRLGASGRMVNSYLQVRGMDGSSDKTTLGTANTASGTGSSNSILGNSGIAFRMKGEFTKDNDSMLGSDGKATTLEIGGAGLNAYGFEFGNLTGLNSATRGYFDSGNIYLNLTDTKTLLMPNNATLNAIRLGSGTLTTAADYQHNIHRDTVTNPFSLILAMRGAEFQAFSRRGRFTTSANVAAANQFADNGLNNQWGLALPFYNLNANAAVYGVDAPANGAYYYTKDANGKPIQNLVATSGTTSRLGFGIAVGTTGRDAGGTKTTSILLIDGSPNANNAGNPTDYYMGLRNIDMFLKGNGTIGLENGSLNIGLKDMLLALSTEIAAGYLPGAKYKTCPATGSCTSPIDNFAKNNDVLFGLKLRLGGDLNLSIVPNSSIADGSALTVLGDFTMPATATGNTVQISDPIDGSAIGFDNITGKLAFNTALVVGKDTASGLGKVGVNTAVYFNPDKSIDGALRVKDINFYPPSTGAGARLGELAITGGRLNSSFSIVPRNGAFN

SEQ ID NO: 4651 - protein, 599 aa, Acinetobacter baumannii
EAKPMAETDIAMPESTPVDSRPAFAIVEELKTKFGENFYVQATFEEFPTVWVERARVQEVLMFLRKVERPYVMLFDLSAMDERLRQHRDGLPASDFTVFYHLLSLERNSDIRIKVALNENDLNLPTATNIWPNANWYEREAYDMFGINFEGHPMLRRILLPTYWEGHPLRKEYSARATEYTPYMQDKAKQDFEQEHLRFVPEDWGLKRGNADEDFMFLNLGPNHPSAHGAFRIVLQLDGEEVKDCVPDIGYHHRGVEKMAERQTWHSFIPYTDRVDYLGGCAQNMPYVMAVEQLAGIKVPERAQVIRVMLNELFRINNHLLYCGTAIQDAGGMTPVFYMFADRQKVYDIVEAITGYRMHPAWFRIGGTAHDLPNNWQKLVKELLDWMPKRLNEYYTAAFKNSVFIGRTRNVAQYDAKSALAWGVTGTGLRATGIDFDVRKYRPYSGYENFDFEVPVEYEGDAYARVLVHFREIEQSLKIIKQCLDNMPSGPYKADHPLAVPPPKDKTLQDIETLITHFLSVSWGPVMPAGEASFMTEVVKGASTYYLTSDKATMSYRTRIRTPTFTHLQQIPSVINGSLVSDLIIYLATIDVVMADVDR

SEQ ID NO: 4652 - protein, 98 aa, Acinetobacter baumannii
SCKLGASPSGKAAGFDPAIRWFESSRPCHFLPVMMIVLGASPSGKAAGFDPAIRWFESSRPCHLNTASNLGASPSGKAAGFDPAIRWFESSRPCHSLI

SEQ ID NO: 4653 - protein, 217 aa, Acinetobacter baumannii
KSGTIGGINFVFGVFEGQYIHSLLNNRPARSYPRMSAITPYDWAIIAFVIGVTFLCVFMLTVPLLLGGKSWGRAKQEQFESGVVSAGGARIRLSAKFYLVAIFFVVFDLEALYLYAWSTSVREVGWLGYTTVVIFVVDLLIALVYAFSVGALSWAPADRRKLAGEKVKVGSPTMNIAEITRFNSIEELVTDPTGQIPAQSSGRVKSKTTPALSSEKE

SEQ ID NO: 4654 - protein, 264 aa, Acinetobacter baumannii
HERTISCHVEIMSIEKFSVEKVLSVHRWTPTLFSFTMTRPSHFKFTAGQFARIGLKVGDELVVRAYSVVSSPFDETLEFFSIVVPDGAFTSNLQHLKVDDELYLEKIPYGYLTLARYQQPLPHDLWLLATGTGLAPFLSMLQDFETWSNYQKINLVYSVRTAAELAYVDRIQEIAETFGEGHSGFKFIPIITRDPSAPLHERLPVLIENGELEKVAGLELSPASSHVMLCGNPQMVDDTKEALKRRGLTMNRRGEGNIAVENYW

SEQ ID NO: 4655 - protein, 84 aa, Acinetobacter baumannii
YMTTMFCCILLIFEFSGIFIIYLLFLNVIIYSYFLCMNIKQIISLLNLNSLKCLFFELSTKLSISVFSQLWYAISRQIIQIKNY

SEQ ID NO: 4656 - protein, 904 aa, Acinetobacter baumannii
QRRTSLRDSTMATIHVDGKSYEVNGSENLLQACLSLGIDIPYFCWHPSLGSVGSCRQCAVTQYANPEDTRGRLVMSCMTPASDNTYISIEDKEAVDFRESIVEFLMTNHPHDCPVCEEGGHCHLQDMTVMTGHDRRRYRFTKRTHYNQELGSFIAHEMNRCIACYRCVRYYKDYAGGTDFGVYANASRVYFGRPESGTLESEFSGNLTEVCPTGVFTDKTHSERYNRKWDMQYAPSVCHGCSSGCNISPGERYGEIRRVENRFNGSVNQYFLCDKGRFGTGYVNRADRPRQPQFRNGETVATVSVDQALDQTIAKLEGKKVLGIGSPRASLESNYALRELVGQANYSTGVAQKEQSLVELAASIMQTEGIYNPNMREIESYDAVLILGEDLTQTAPRMALSVRQAAKNKAREMAAKTRTPDWLAEPVQRIGQEAKSPIYILAATQTRLADVATGEVVASPNDIARLGFAVAAAVKGETVNGLDDDAKAFAQTIADTLKAANKPLIIAGTSLQDASIMEAAAELTQNLGSKAGLSLVVPEVNSMGLALFGGLSLEQAFAQDYDTLVIVENDLFRRLPAAQVKAALDKAETVIVLDHSETETVKQADIVLSAASFAEGDGTVVSQEGRAQRFYQVYDPSYYKPEYAIKESWRWLHAIETGLKGKPIDWTVLDDVIETIVKNVPVLEAIQDVAPDAGYRVHGLKIAREPRRYSGRTAMRAPLSVHEPKQPTDPDSALTFSMEGYVGPQKASSLVPFAWAPGWNSPQSWNKYQDEVGGHLKGGDSGVRLFDRLAKRPARSYVAPTAVVANPESFRLVPMHHIFGSGEFTIKTPAMETRIPEAVFAVGEQDATRLNLQEGQRITVKAGETTVSLPIQVIEYLPTGYIGYPVGLAPTVSLAEPVSVALGV

SEQ ID NO: 4657 - protein, 253 aa, Acinetobacter baumannii
KKTTNWNKSVLFQYQPVFASVLKCSTVFLRERFIMSSLIQPELFFSALSPAEQRIQQALEDIRQGKPVLVMDDFDRENEADLIVAAETLTVETMARMIRDGSGIVCLCLTEELADHLELPPMVSQNSSQFHTAFTVTIEAAQGVTTGVSAKDRVTTIKTAIKDGAVASDLNRPGHVFPLRARNGGVLTRRGHTEGTIDLARLAGLKPAGVLCELTNPDGKMASGIQVLAYAQTHHLTLITIEELVQYRQQHGI

SEQ ID NO: 4658 - protein, 473 aa, Acinetobacter baumannii
ADFAMFDTLTERLTQSLRNVTGSGQLTEDNIKDTLREVRMALLEADVALPVTREFIAKVKEEALGQEVMTQLSPGQAFVKIVYDELTKMMGEANETLDLSAKPPVVVLLAGLQGAGKTTTAAKLARFLKERQKKKVMTVSADVYRPAAIKQLETVSAEVGAGFIPSDPSEKPIDIVNRAIEQAKIQFADVLIVDTAGRLHVDEDMMDEIKELHAAVKPTETLFVVDAMTGQDAANTAKAFNDALALTGVILTKTDGDARGGAALSVRAITGKPIKFLGMGEKLDALEPFHPDRVAQRILGMGDVLSLVEEVERKIDKEKAEKMAKKLQKGGSFNFEDMLMQFEQMKKMGGMMGFLDKLPGMSSAGIQQAIEQANPEKQVKKMEAIIQSMTIKERRNPDLMNPSRKKRIAAGCGMDVAEVNKLIKQQAQMAKMMKKFANPSGMSKMMRSLGNMQKQFGGGGGMGPLFGNNDQKK

SEQ ID NO: 4659 - protein, 364 aa, Acinetobacter baumannii
ATIALLNHFYLNDQMTSAQSSNTNFSETDFNLLEDSEDADNHTSDTTATRLSLQVQLDESYLGQRIDQVAAMVWSEFSREKLKQWMKEGHLLVNGNIVKPKYRCEGNETLTLNVELEAQTNSQPENIPLDIVYEDEDILVINKPVGMVVHPGAGNTSGTLVNALLYHSPKSAELSRAGLVHRIDKDTSGLLVVAKNLEAQFSLSKQLGDKSVYRIYDLVTYGNIIAGGTIDEPIKRHPVDRVKMAILPGGRDAVTHYNVKERFRDFTRVQAQLETGRTHQIRVHFSYIGHGLVGDQVYMNRVRIPAGASELLIETLRGFKRQALHAAKLGLKHPRTGEEMLFEAPWPEDFTQLVNVLRTENAAY

SEQ ID NO: 4660 - protein, 308 aa, Acinetobacter baumannii
NWHADCYFTLLFQRNRWKMQFKYSLGVISLCSALFLVGCNDDNSSVSQTPTVQEQKQKLQPIIIQGALPVESERMASKLENKTVETIGGWTFWKGTYNGYPMIISKTRMGMSNSAAATALAIERYKPIAIINQGTAGGHDPDLHVYDIVLGKYATNIGAFRTPKQPLGGGSNSLTWVEAFDVLPTKESDPEPIAIRKFEGDQELLMAAHKVRYDKGEVVEGTIGSADVWNNELDRIQFFHERYGTSVEEMEAASVAQIASQFNVPFLGIRILSNNITNNGAYDPGTGEACQDYVLNVAEEYMKSKLPK

SEQ ID NO: 4661 - protein, 368 aa, Acinetobacter baumannii
HLHLWAGNSNPGKKEMVDTGPQSSEQAYFDKAQKALDRGQYLDATKSLEAIDTYYPTGQYAQQAQLELLYSKFKQKDYEGAIALAERFIRLNPQHPNVDYAYYVRGVSNMEMNYDSLLRYTSLQQSHRDVSYLKVAYQNFVDLIRRFPSSQYSVDAAQRMKFIGQELAESEMNAARFNVKRKAWIAAAERSQWVIEHYPQTPQVPEALATLAYSYDQLGDKATSQQYIEVLKLNYPSLVNKNGTVNMRAARKEGNWINRATLGILGRESKSVTPDTTTSSEAEPKRSLLNRVSFGLIGNSGKEETEETTNTPVEAPKSERSWTNRLSFGLLDKPEPKAAEGATIAPATSSSEAPSASPADNEADDAAQ

SEQ ID NO: 4662 - protein, 63 aa, Acinetobacter baumannii
FLTYGCNLDIIKKIYCQTQQPNFIGRQNMSPIKIKFKMLKILNKIKQNEPLSSTYLVVIIYEF

SEQ ID NO: 4663 - protein, 459 aa, Acinetobacter baumannii
GFNYMNKIIKNGMFLGLSTLISGYGTLLHAEASPTNLPVVSQKALTIIDGQTEWLNKVYKDIHEHPELGFMEKRTSAIVAKELKSLGFDVKTGIAKTGVVGILKNGEGPTVMYRADMDANTVEEATGLPYASKVRVKLDDGTETPVAHMCGHDAHVTWMLSMAKTLVALKKEWSGTVILVAQPAEEPITGAKAMVTDGLWTKYNLPKPDYFFAVHTTPAPVGVVVNAPGPRMAGTDQLDVLFKGVGGHGSLPMLTKNPISMAANAVTQYQTIMGNAVDPQQAAVLSIGSIQAGNSNNVIPSTALVKMNLRWFDPKVRETMLNNIKSMSEGAAQMQGMGKDQLPTFTFKGSSTPVINNKEFSARLNGPLKALLGDKHVLTEYPAVMGSEDVHHLLGDQKDIPFNFMFIGVADPVVFANAVKQGKPVPYIPHSPNYIVDLKALPVGAKVTTVSMLELLTKK

SEQ ID NO: 4664 - protein, 118 aa, Acinetobacter baumannii
VRNYMNTDNLDLKKEFLKLFLDLVLANFTAIVVFVLVGKHLFKSYRILPDFIPLFLSYSFTVGISLIGFLFFYYILYELYLKRMIVILNIGEFSNKFYIFSALSFVGFIVFTLISTVA

SEQ ID NO: 4665 - protein, 197 aa, Acinetobacter baumannii
NYLLDRKYMAIKSDRWIREMSEKHGMIEPYAENQVRFDKNGEKLISYGVSSYGYDVRCAREFKVFTNVHSAIVDPKNFDEKSFIDIESDVCIIPPNSFALARTIEYFRIPRNVLTVCLGKSTYARCGIIVNVTPLEPEWEGHVTLEFSNTTNLPARIYAGEGVAQMLFFESDEVCETSYKDRGGKYQGQTGVTLPKT

SEQ ID NO: 4666 - protein, 352 aa, Acinetobacter baumannii
RMTYIYKNPAGMTDSEKTEHIKKIVTAEGVALRKRYPILNHQNAIGAMILFISLVGMIATAVLYINHQLSAWFAIPIIAFFASLTHELEHDLIHWMYFRKKPWAHHLMMGLVWLARPSTINPWKRRELHFNHHKNSGTEVDLEERALTNGEQWSIRRLIAIGDNGLAVLFRIISASNWTVRKVIFKRAFMAYFPLGIIHWSLWYIFLGFHAVDAVLSWANAPIAWSATTLNIMHVVNILTVVWVAPNVLRTFCLHFVTSNMHYYGDVELGNVIQQTQVLKPWWMMPFQLFCFNFGSTHAIHHFVVKEPFYIRQMTAPVAHKVMRDMGVRFNDVGTFKRANRWNINDLSESKS

SEQ ID NO: 4667 - protein, 71 aa, Acinetobacter baumannii
NLNYQNNNLILGKKMNSYRASSCFLWPVLFFQFRMTIQRQKTSVTIYSMVANTNASTMRPDIKILARLKSI

SEQ ID NO: 4668 - protein, 950 aa, Acinetobacter baumannii
QWSYAGMSVITSTPGQIQVIKRTGDVAAFDAEKISVAIGKAFLAVEGQQSADSSRIHDRITQLTEMVLNTFTRRLPSGGTIHIEEIQDQVELALMRTGEHKVARAYVIYRDQRASARKDTNSNHHPTLQVTDANGQLQPLDLSALQATVNRAAEGLEGIDVQAIIDETVKNLYNGVKESDIATTMMMATRTRIEQEPNYTYVTARLLRDELVSTGLAFLGLPADTAENNALEAFLKKGVELDLLSPDLLKFDLEKLAAAIQPERSNQFTYLGLQTLFDRYFIHSNGVRFELPQLFFMRVSMGLALNEQDKEERAIEFYNLLSSFDYMASTPTLFNSGTLRPQLSSCYLTTIGDDLYDIYGAMRDNAMLSKWAGGLGNDWTPVRALNSYIKGTNGKSQGVVPFLKVANDTAVAVNQGGKRKGAVCAYLETWHLDIEEFLELRKNTGDDRRRTHDMNTANWVPDLFMQRVFEDGEWTLFTPSETPDLHDLTGAEFAERYAYYESVAKEQNMLHKKVRAKDLWRKMLSMLFETGHPWITFKDVCNLRSPQQHVGVVHSSNLCTEITLNTNQDEIAVCNLGSINLVQHVKGGVLDREKLARTVKTAVRMLDNVIDINYYAVPQAKNSNLKHRPVGMGIMGFQDALYEMGMAYGSDEAVNFADESMEVISYYAIQTSSDLAVERGAYSTFKGSLWDQGILPIDSLEIVAKSRPERMFEVDRTQRLDWDSLRAKVQKDGMRNSNVMAIAPTATISNICGVSQSIEPTFQNLYVKSNLSGEFTVINPYLVRALKERGLWDTVMVNDLKHFEGSVQKIARIPEELKAIFATAFEVEPRWIVDAASRRQKWIDQAQSLNLYISGANGKKLDITYKMAWLRGLKTTYYLRALGATSAEKSTINTGALNAVKPATVEAAAPAAAPVVEAKKPEAVEEDGFTQAAPVPMACSIDNPDCEACQ

SEQ ID NO: 4669 - protein, 99 aa, Acinetobacter baumannii
KFLYSIKLVANQTPQAMRRIPVSDIEQRVKQAVAEQLGLKAEEIKNEASFMDDLGADSLDLVELVMSFENDFDITIPDEDSNEITTVQSAIDYVTKKLG

SEQ ID NO: 4670 - protein, 283 aa, Acinetobacter baumannii
SLLYKSMIRVPSPAKLNLFLHITGRRENGYHELQTIFQLIDLYDWMTFTPISEDEIQIEGLGEVQLEQNLIYRAAQILRPHAQNPCGLHIKIEKNIPMGAGLGGGSSNAATTLIVLNQLWQCGLTEEQLAQFGVKLGADVPIFIYGLNAWAEGIGEHLSFIDLDQKQFIVLKPDCFISTQLLFSQKTLTRDSKPTTFCAYQLEPSNFGNNFEPLARELYPEVEEAMQYLDQFGHAKLTGTGACVFAEVTDEMNVDDILKHAPCKAYLVHSLKESPLRHFKVAS

SEQ ID NO: 4671 - protein, 359 aa, Acinetobacter baumannii
TKDFLVLNLLYCSEEYESQVIGHNMPQTATALASWVKAIQKALEKAGVDSQPLLEQAGLDIQALSNPDARYSLKQTANLWKLAVQKTQDSCFGLKVASQVNQNTFHVLGHSLITSTTLKEMFLRIIRYFRVVTDIPELEFYGQGNNHYFVIHVPDEVQPESIDAFISVFIRSSRALQGSVFSPLRIELRRSEPEDLETFQSILKAPIVFNAPKDMIVFDTATIEQPLEGANPTLTQEYDEIINRYLVRLDKENILARVKVKLIEKLSTGDFQQQDVAKSLGLSIRSLQRKLSAENTSYSELLDQTRHELALSYIKNSSHNITEIAYILGFTDVSSFTRAFRRWTDLSPIHYREKYLACS

SEQ ID NO: 4672 - protein, 138 aa, Acinetobacter baumannii
DLHLRSTQETLAMLSRLLKCKIHRAVVTHAELHYEGSCAIDGVLMDLAGIREYEEIHVWNVTNGKRFTTYAIRGEDNSGIISVNGGAAHQADVGDLVIIATFGDFTEAEANAHKPRLVYANPDNTVNHTANCIPVQVA

SEQ ID NO: 4673 - protein, 232 aa, Acinetobacter baumannii
FMNLEEAESLSEQIVKYISEQIISGELVEGERIQELRIAKELDVSRGSVREALLLLERTHLIEIFPRRGAIVSEMSAQQVKALFDTNMMLLGHIVQRISETWRAHEADQLQLLLEQLLEHVKAGDIEKFYDAIFQYLAEQQDMVGNPYLMKFYKELLPSLRRSYFLTLNTSKRELQEAFALFKLVTDAILIRKSQQAALFMEDFCRHLRNLVLESLTRMKQIELAWARRSRR

SEQ ID NO: 4674 - protein, 339 aa, Acinetobacter baumannii
FMNQEIIRQTPLWAENWPIAYAVVQAVVILLVVVLVAALMSFIERRLLAWWQDRYGPNRVGPGGMFQIVADMLKIMFKEDWTPKFADKLTFRLAPAVAMATAVLSFMVIPVSPALGVADMSIGLLFFMAMAGIAVYAVLFGGWSSNNKYSLLGGLRSAAQTISYEVFLGISLMGVVAIAGSFNLREIVEAQRDVWFIIPQFLGFLIFVVAGVAVTHRHPFDQPEAEQELAEGYHVEYGGMKWGMFFVAEYVNVVLISALIVTLFFGGWLAPFNLEIPFVPPVFWFVIKTAFFVMMFVLARGSLMRPRYDQVMNFGWKICLPLALVNLLVTGAVILMNQA

SEQ ID NO: 4675 - protein, 573 aa, Acinetobacter baumannii
KLRQMNSRINFNGASIRQYSTTFLLLGSMSSYVYARPVQETYAVHSFDQALQQSMVAEFALAYDDIPTALHNYTVLAIKSNSTTIKQRALDVALEYNDLQAALNIATHWVVQEPKDVPALFYLSHIALKTHEYQLAAETLDKILKIDPTADLEQILASIAPENAQDREVLLTALRSSAEKDNPSILALIANLEAQNGQLEPALSTINRALRRRPKVTSFILMKANLLIALSDQEGALKWYAKSSRKYKKNLDIRLAEVRYLIQINQPQLALEKLEKIIESNPHAEEALFIAGLTSIDLKQYDKAEQYLVDLRNSAKYQNEAYYYLAINAERKQHYETAKAYYRLVDGSLYIVSRRNLIAIYDKQENLHDALRFLTQERVNYPQHASFLYQAQAEILKKMGNKKAALNLLDEAIKNLPDDPELIYAEVLLLDPYTDRDKLDKTLKQLLQLEPNSPTYLNAYAYTLALQNRRLKEARQYAEQALEYAPEQASILDTLGYIAFLQNDYEAAAEALGKAYELSHNINIGIRYAKALYMQGSLTQFSAVLQQLKQKHANDPQLQQLDALILPTSAKKS

SEQ ID NO: 4676 - protein, 350 aa, Acinetobacter baumannii
FRSHRMEINTIIGIVVAIIIMLIGLRMILKKPNHAEPSLDSDLHINPESNQPVIPRHVRDQLEQPEVTVASAAVAERVEPTLSEPAQSEEKGTKELEQASQTQTVQTQVPVENTPVEVEEVKAEENTVSPTVSENSSVELVDTVSAEPEVVSSSEPKVAEGQPKTEPELSLNPNIETAEIAEFEGESNILDVHLHEQQRFDDESALAMAEQIIALNVYPNPRRALSGDKALKVLLKYGLRYGEMSCFHRYENTDEPSALMFSVLRMTDNGPAGFDLETLSTEQVQGLAFFLALPNSKAVTGFDMMTSIAGLIAREIDGKVYDENNLEFTPQLKEHWRHHVIDYRPAQATA

SEQ ID NO: 4677 - protein, 468 aa, Acinetobacter baumannii
KNIQDGSMNFVVNKKIFILGIASICTSTLHAAAFDKTGQSVAAFLQPGNYFEASLGITDADLSGVESGTNPSHHSISDIANTDYRPTAALKLQLAPQYSFGLLYDQPFGADTEYSGVNGFVATPKDTVMLPGITTIGLASATLGHAPTGNAKSEFDIQNLSFILGYQPTKNWNLYAGPVYQTFKSQVELRGNVFSLYNGYDFHTKTVSDLGWLAGLAYQIPEKAVKVSLTYRSAITHKVNATENAPLIDMLSTQQGRDLVNQHLDYMISIGQMTPQKKAYLNQIIANLPEQEDTGTTKFKSPDSVNLEFQTGLRQGTLLFGSLRWVNWSDLALQPYRFGEISKVVGVLSTPSRPEGFNLVRYYDDQWSLNLGLGQRFSPKWLGSVSVGWDSGAGDKVSTGGPTKGYYNLGVGAQYSPTSQYFISGGVKYYWLGDAKAQFGAQAGSDYYVGEFKDNHSVSYGLKIGYKF

SEQ ID NO: 4678 - protein, 291 aa, Acinetobacter baumannii
VKTQKGFLMSAKRLEQVALATKTAFVFPGQGSQKVGMLAELAEQFSGVGQTFAEASDALGFDLWHIAQSGEGLDQTENTQPVLLTASIALWRLWLDLGGLAPKYLAGHSLGEYSALVAAGSMSLADAVKLVNLRGKLMQNAVPQGEGAMAAILGLADDKVVELCQSVSALGQGSVEAANYNSQGQVVIAGSTASVQQVMALAKEQSAKAIALPVSVPSHCSLMKPAAEKFAEALEQTAIELPTIPVIQNVNAGNCYRCCSITSGFNSTIVPVCTMDTYHAVSTRPRYSVHC

SEQ ID NO: 4679 - protein, 79 aa, Acinetobacter baumannii
LKRLSLLDDFPIKSNHLCLVEGVSPLIIGLFDSFRTCNDFFHFLIFNIICTIAQSVKLNTLLFYNINRFFIVFIFPSEL

SEQ ID NO: 4680 - protein, 218 aa, Acinetobacter baumannii
MSGQIYFVSGIDTEIGKTYATGFLAKLWTEQGKKVITQKLIQTGNADISEDIQKHREIMGQGWFQEDHDKLTMPEIFSYPASPHLATRLDNREIDFQKIENATQTLAERFEIVLLEGAGGLMVPLTTSLLTIDYIAQHQFPVILVTSGRLGSINHTLLSLEALKSRGLKLKALVYNLKDESKDPLISQDTSNYLKDYLAIHFPEAEWIELAKMNELKN

SEQ ID NO: 4681 - protein, 203 aa, Acinetobacter baumannii
FYLHLQKRVKFMSKLAQLCTAICGSSVLFLTGCQHFTQPKAAVTHQVQDEKHFNLQGKIGVRTPQQTGSAFFTWIQQQDNFDIELSGILGVGKTQIQGKPGEVTLNSAKTGLITAPSPEELLERATGWQAPITHLTSWILAKPATLNAQISKDNANRVSQLIEDGWTVNFSYDGEQTLPNKLVLKQALAEDKENRITMVIQNR

SEQ ID NO: 4682 - protein, 158 aa, Acinetobacter baumannii
KMGLFDFVKGIGKKNTAPAEPQAAPATPAEPSAQEIANKLLGLIKSLGLGVEGLSVTYNGSTDTAIIKGQVQSQADKEKIILIVGNVDHVAQVDDQMTVATPEPESKFYTVKSGDNLSKIAKEFYGDANQYQKIFEANKPMLKDPDEIFPGQVLRIPQ

SEQ ID NO: 4683 - protein, 206 aa, Acinetobacter baumannii
NMLHLHVHPENPQQRLIEQAVERIRAGDVVVYPTDAAYAIGCQIGNKNAMERIAQIRGLGPKHQYAIMCCDLSDIATYAKVDNATYRLLKANTPAITTFILPATSEVPRRLMHPKKKTIGLRIPSNPICQALLKELGEPLLTSTLILPGQEDPLDDPYDIENQLAKRIDVFIDGGFGTLTTTSIVDLSGEHPEIIRRGVGDVSAFE

SEQ ID NO: 4684 - protein, 284 aa, Acinetobacter baumannii
IICFIGNNMAEPITYVTSFLVKIITIILGPFLRKPIDIISKFLYLEAYKISTFYSLYFDVKRMFPHSLGGVIDYNINWSEIYLKKKQANCTLRIRAKGNLSYSKITFCVTASLESLKYQSVVEVYDVSTTPCIIALPSIPLRSIEIKGNRIYEPYNSISVEIKEIFDSNNNIIDIRGKWKDILHPIDNLDKIIKEKESDVYRWGQWWNLDFLESEKEEISRFFQAYSVNAKFWGSKTRYFWQPVAWFMSVPFILNIYFWIRNIIWANQLNKALEKHLNDYDYES

SEQ ID NO: 4685 - protein, 164 aa, Acinetobacter baumannii
RMSKTRVIYPGTFDPITNGHVDLVTRASRMFDEVVVAIAIGHHKNPLFSLEERVALAQSSLGHLSNVEFVGFDGLLVNFFKEQKATAVLRGLRAVSDFEYEFQLANMNRQLDPHFEAVFLTPSEQYSFISSTLIREIARLKGDVTKFVPQAVVEAFERKHQQGW

SEQ ID NO: 4686 - protein, 423 aa, Acinetobacter baumannii
RLAKDQTDKAINLSVEIYFWQVNEKEEIGSAQMKSVLCHQAKLQVVDQPNLTPAKGQVLLEVVRCGICGSDLHMQHHCDHMHDLAARVGFNGLAKSTDPFVLGHEFCGKVLDYGPKTRHKFKADTLVCAMPLLNVDQHGYLSTGLSPNASGGYAEQVLAQSSLIFEVPNGLDADSAAMTEPMAVALHAVRRSRVKTGEPAIVIGCGPVGLGVILMLKAAGVKTVVASDFSPNRRKLAEQCGADIVVDPKETSPFANWKEFGLLGNVSDAINMGMGLFDKLQATRLPWWHGWRMIDKLGALPKRPVIFECVGVPGVLQQIIEGAPLFSRIVGVGVCMQSDKIEPALAINKELEIQFVLGYTPLEFRDALHMIAEGKVNCSPLITGVVGLEGVTNAFEALRDPEQHAKILIDPKRSGSDIQLMSH

SEQ ID NO: 4687 - protein, 556 aa, Acinetobacter baumannii
TSYKVGRVFKHSIFLRIYAGLVILVVLVAVFGYLLVQIINYQRAQEYRESLTDGISYVISEGVARQPGKQQKIDWISDASDLLELPIYYTDASKVELSRTEKKRIEAQKSVVRYDASNSIAYVIIGLRDDPQHYLSIKVDKITERQMKALPIFVLDYLMFYPGQEQEYLAKIQKHFSYPINIQNIQDVNLDSEQIGRLRQDQSVMLYKDSATVRGTTISIVSPIPNHPAQVLVLGPVPMFNWMPLQLSAGITLFSLFLLSLGVYGLILPLERKIRQVRYALNRMKSGDLSLRVPIEGSDEMANLASSYNNMSDHIQRLIEAQRELMRAVSHELRTPVARIRFGTEMLAEEDDYNHRMHQVDMIDKDIEALNTLIDEIMTYAKLEQGTPSLDFAEIVLFEVLDQVAVETEALKTQKEIELIPPPLYVKVDAERRYLHRVVQNLVGNAVRYCDNKVRITGGIHNDGMAFVCVEDDGPGIPEQDRKRVFEAFARLDDSRTRASGGYGLGLSIVSRIAYWFGGEIKVDESPSLGGARFIMTWPAHRFKQPPLKTNKKAPA

SEQ ID NO: 4688 - protein, 377 aa, Acinetobacter baumannii
LRYKSIHALKRSSYSLLIRPTGTKLIRLESSKRAKRFFRFISEIRVLITMSKEFTFTIKSICFDENYRPADNTRITTNFANLARGMSREENLRNTLRMIDNRFNALAHWDNPKGDRYGVELEIISVEMNIDAENRTSGLPLIEILKTNIVDKKTNERIEGIVGNNFSSYVRDYDFSVLLLDHNKNKSTFSTPEKFGELHGNLFKSFINSETYKANFKKAPVICLSVSTSKVYHRTENEHPVLGVEYKQEDYSLTDEYFQKMGLKVRYFMPPHSVAPLAFYFTGDLLSDYTNLELISTISTMETFQKIYRPEIYNANSVAGKSYQPSLKHQDYSLTRIVYDREERSRLAIEQGKFVEEQFIKPYQAILEQWSANYAPN

SEQ ID NO: 4689 - protein, 536 aa, Acinetobacter baumannii
WGNKMENNLILPALILVPFIAGFTCWLVDKLDKTLPRWIALIGMLITLGLGLALWQSGTYSYELGSKVPTWTAEFYLPWIQSLGIGIHLAVDGLSLLMVLLTALLGVLAVGCSWGEIQKNVGFFHLNLLWSLGGVIGVFLAIDLFLFFFFWEMMLVPIYFLIALWGHKGSNGRSRVYAATKFFLYTQIAGLVMLIGILGLVVYGYMMTGMIGFDYNYLLAVANRLPAGFAYGFMICFFIGFAVKLPVFPLHGWLPDAHAQAPTAGSVDLAGILIKTAAYGLLRFVIPFFPAASAQFADIAIIFGLIGIFYGAWCAYQQTDMKRLLAYTSISHMGFVLLAIYAGNILTFQGLMIMMLAHGLSSAALFIMSGQIYERLHTRDLRLMGGLRGQLQYLPFFLMFFVAALVGVPGLGNFIGEFLILMGSFNKYPVFTIIASISLVFAGLYGLILIHRALFGEPNSEQKQHYTSPLKDLSAREVSILMICAIGLVWLGIYPQTFLDVSHSSMQWLVNSYVPVQEVVETVQQTATQLDHVEIQ

SEQ ID NO: 4690 - protein, 249 aa, Acinetobacter baumannii
DTCNEIYRGNDMSQEEKLPKILIVEDDERLARLTQEYLIRNGLEVGVETDGNRAIRRIISEQPDLVVLDVMLPGADGLTVCREVRPHYHQPILMLTARTEDMDQVLGLEMGADDYVAKPVQPRVLLARIRALLRRTDKTVEDEVAQRIEFDDLVIDNGGRSVTLNGELVDFTSAEYDLLWLLASNAGRILSREDIFERLRGIEYDGQDRSIDVRISRIRPKIGDDPENPKRIKTVRSKGYLFVKETNGL

SEQ ID NO: 4691 - protein, 246 aa, Acinetobacter baumannii
EEGNAMKKITALLFALCATVTHAELQTLDNDALQAINGQAGADLSLMLNLNQTSNGIFDNGSGGVCENVEFCHIGLAINKRFVQADTTKPSGWAENSDSGNKLWLVFKGVQGTLNIQKMGLDGADLKYLDKSNTEIIKPAIQLSFSAAQPILIRNFGFNALSIEQDNFTSSTTTQGSSANMYDYAYFKKPTYAATANSANQQVATATPSAYDYGRETGFMGLMMNGNLAIQGKVMVFSCDGSHPRC

SEQ ID NO: 4692 - protein, 293 aa, Acinetobacter baumannii
ILIKKYGQANMSNQSIISDGREIDTYFVTPNDIINTLPTDKNYCLFLDIDGTLAPFQIHPEHSFIPNTTLEVIKKIIELNIPVIAVTGRDVETASKLLQSIELPIAGLHGLDIYFDSDTYIRPDLSDINFQKLKEDIINSCEKYPDLLIEDKGHSIALHYRKNPELENNAIYIMQQIKYFYPQLKLNRGKFVVELLPKQADKGKAIQTILNHLNLPLTHPIFIGDDLTDETGFTFINQQFGTSIKVGSGETEAQYRLKDINSVSNFLFFFLEKIKKLYVKNSQDQNGEQICLN

SEQ ID NO: 4693 - protein, 307 aa, Acinetobacter baumannii
KSYNVINHYFSQFLMFDHIAQPISYQHIQLSFPVHLDIKRLDLVHPQISGNKFFKLKYNLLAAKEQGLSSILTFGGAYSNHIAATAYAAHLFGLKSIGIIRGEELASKPLNPTLAKAQSLGMQLHFISRHEYRLRDDANYLQQLQQQFPQTYIIPEGGTNELAVQGCQEILSQYDLEQYDVICCAVGTGGTISGLIERSAAHQKVLGFSALKGDFLQQAIRQWTKKQNWSLTDVYCWGGYAKTSPELFAFIENFEEQYTVPLEPIYTGKMMFGLFDLIKNNYFPANTRILAIHSGGLQADIRNKPHT

SEQ ID NO: 4694 - protein, 562 aa, Acinetobacter baumannii
GHNNMNEFFNGPRGAQFDAMYYWDQFHPILAAIVILLVGWIIALLVAAGVKKLLQKVNTNAKLSSATGRTPNIEGLISKVVFWFILILAVVAALNVLNISGVSGPFSNMVNQVLVYIPNIIAAVVVGFIGWIVARLVRAGVTNVLSRTQLDDKLSSEVGVGGISQNIGEILYWLVLLLFLPIVLSILGLTGLLIPVQNMVNDAVAFLPNIFIAGVIVFVGYILAKIVRGIVEGLINSLGVQSQAEKIGLFKNSNVGKFLGSFVFAIIIITTLIVAFEALGIETISQPATAMLNEILQAIPNIIAAGLILLVAYIVSRFVGRLVAELIAGTGVDEIPAKLDVQRFLGQTKVSNAVGWLIVFFTMLFAVSEAADRLGFDQISGLIAMFIHFGANILLGAVILVIGFWLANVVANVVQRGEYNSSRWLGSLVRVLIIGLVLALGLRAMGIADSIVNLAFGLTLGAVAVAFALAFGLGGRQPAERLLSDLLDKAKKEANQPNPLYQPPTNNKTTGSSSTVSTPSTTTTAPSTTVSSDAKPADSAQVNPSQPPVNKPFGSTGENDEI

SEQ ID NO: 4695 - protein, 299 aa, Acinetobacter baumannii
GFLNMRMTLRQLAVFVAVAQEGTVTKASDAVRLTQSAASMALADLEDGLGAPLFDRLGKRLQLNDLGRFLLPQALEILGRCEAFEQAAKGELQSIDLRIGATLTISDYLMPDLMANFLQRHPQAHLQLQVGNTRQMIEAVNQFQLDLALIEGSCHLPQLQCIHWRDDELAVCCSPDHPLTRLNRPLTPQDFHDVEWILREEGSGTREVFDNAILQDLPDANIRLTLGHNEAILKIVAGGLGMSCISKLAIEPLSEKGQLVILDTPFWQLTRPLYMLVHRQKYQGPGLKAFLKFCDEDQA

SEQ ID NO: 4696 - protein, 224 aa, Acinetobacter baumannii
MAIKHILIDLDGTLTDPKVGIHTSIRYAMDKLGYPLAADLNIDWTIGPPLKASLAKLLATQDDALAEQALLAYRERFSVIGLFENEVYPSVAETLKALKAEGYRLFVATAKPTIYAKRILDHFDLSQYFVQIYGSELTGERTNKAELIHYILEREQLNPEECLMVGDRQYDVLGARHNGIEAVAVTYGYGTPEELTQAQPKAKITKFSELLDYVEEQAAQKKVS

SEQ ID NO: 4697 - protein, 64 aa, Acinetobacter baumannii
FSIKFSHFNYNVLEFNFSIFRIFAKVRFVIQYVLALTFYKIGYNKPPCFKATQFYDVSSAKRNS

SEQ ID NO: 4698 - protein, 81 aa, Acinetobacter baumannii
MWVKVESLKYMDAKYVPNQNYRSSSIPFYSNQIFHLAHVKPVKNERKLRDQSKLMNFADELLKIGRFLQLSSLPVSREKHE

SEQ ID NO: 4699 - protein, 415 aa, Acinetobacter baumannii
RRSNQAEDAMNHMVTTKKAKVQFNWQDPFLIEQQLSPDERMIRDTAHAYCQERLQPRVLEQFRHETTDPSIFREMGELGLLGPTIPEQYGGAGLNYVSYGLVAREIEYVDSGYRSMASVQSSLVMVPIHEFGTEEQKQKYLPKLATGEYIGCFGLTEPDHGSDPGSMITRAKKVEGGYRLSGAKMWITNSPIADVFVVWAKEVSAEGNVGDIRGFILEKGWEGLSAPAIHGKVGLRASITGEIVMDNVFVPEENAFPEIRGLKGPFTCLNSARYGIAWGAMGAAEFCWHTAHQYTMDRKQFGRPLAANQLIQKKLADMQTEIALGLQAALRFGRMKDEGIASVEGTSLIKRNNCGKALDIARMARDMMGGNGISDEFGVARHLVNLEVVNTYEGTHDVHALILGRAQTGIAAFSN

SEQ ID NO: 4700 - protein, 375 aa, Acinetobacter baumannii
WSKNMSAVEKLPEDFCANPDVAWTFPKVFYTSSQVFEHEKEVIFAKSWICVAHGSELAQPNDYITRKVIGENIVIIRGKDSVLRAFYNVCPHRGHELLSGSGKAKNVITCPYHAWTFKLDGSLALARNCDHVESFDKENSSMVPLKVEEYAGFVFINMDENATCVEDQLPGFAERLNQACGVIKDLKLAARFVTETPANWKVIVDNYMECYHCGPAHPGFADSVQVDKYWHTTHQNWTLQYGFARSSEKSFKLDPSVTDPEFHGFWTWPCTMFNVPPGSNFMTVIYEFPVDAETTLQHYDIYFTNEELTQDQKDLIEWYRNVFRPEDLNLVESVQRGLKSRGYRGQGRIMTDKQRSGISEHGIAYFQHLVAQYHQ

SEQ ID NO: 4701 - protein, 64 aa, Acinetobacter baumannii
FKKKHYQEKKYSLFSLDFFYTLVVKQFIKSHNSFRMLLTICCSSATALIDLKNRSHAFENSRGL

SEQ ID NO: 4702 - protein, 80 aa, Acinetobacter baumannii
KRGKKMHDFSKPPHVTSPEETAKKRRLPVYILIIVGLFLLALVVYMVADHSKTPKEEAAFQHETIPQVISGTSDLKTYEG

SEQ ID NO: 4703 - protein, 597 aa, Acinetobacter baumannii
NRCFMQIRDYYPFRNTLFIQHLHIFSYVFMALSILYLIAANWLMLPDSIQLIIPPVILLMTAWVSIKKTLSEGVRQTLHGICGLMVGLSLAVIGQVYQTGADSYLLFLIWTLLLLPWLYRPNIGIFALICITSQLTLFLFFRQTFWAEKFPYLYLFALNLLSLVQFWICQKKYTALRFIFIAWFAVISITGMIQFLSSENLPYLISAFFLGIIAFYYFFNKDDQLCASLMAAVLGVTATIWLVDGINQLFKDSNEFIFLLIAGIIFTWFALISYFLIKIFRQSRFYIIPLAIGAWLAGLALGAFTLVFWETISLIIGIIFVAVAITLLTKSQSYFIRQFAYCLFVSGQTAFLFHLGSETDQILWVLIAQIFILCISYFLKPHWFFILIQMLATYGIAVIYLLQMDHSLWSLNSTQTYLNLVLLNYLVFSSVLLIGSKAVVSYKRSIFLCTLVVIWVSSFFDTFIGLALVDSADQSLWFLYALPCVWLLCFSFFYLYRQLHGITFFAFLVFGILLIALGYFEVFILFVILTWALKNKDRIVYGVTLVVFAFVLWQLYYSLQLSFLAKSASILVSGIILLALYGLLMKEAKINFIEGGK

SEQ ID NO: 4704 - protein, 99 aa, Acinetobacter baumannii
KIMKQEFYTGRVKQYNADKGFGFISTTEGDIFFHISDFPASEGEPKRNEKVRFLAADNRGKFKAIKIERIDPNPAKTKKTKIADHNKAITSELLSNFRR

SEQ ID NO: 4705 - protein, 266 aa, Acinetobacter baumannii
GTMKKSPIFITICLAGAGLGSTFANADTLEVISSGGFYSSMEKLIPIFEKQTGHTVHLSSGSSMGESPTAIPNRLNRGERFDIVVLAAPELSKLAEKGYVDPNSQSALVNSSIGMAVPKGAPKPDISSAAKFEKVLLNAKHIGYSASASGTHLEKDVFPSFPPVEYKVISSKAEKVVGDRVAKRIAEGQFDIGFQQISEIKPFTGKYGQVELVGPIPAPYQKVTVFAAGIGKNSEHAKVAKELIQFVKSPQATQIIEEQGLEQVKQ

SEQ ID NO: 4706 - protein, 319 aa, Acinetobacter baumannii
SDMKNKNIGCWLLLAGSSSVCAMQPLDDQSLAAATGQNGLTLGIQADQVKFKQVALIDTNGIASTSYNSKAGLVIAGNSTNPVPGIEFIKAAVSTNPSFNIAIDTDAGGGNPFLNLAVTMGSDVNGIRLLPFSVYLAPSTSLSSPSDYALTSYAPKSIFSSGTTVNTGVKELIRSTGNLDINFVQTNKPRLNIQLGHAAQSVMVKFGGAIQSICSAASGCPITLVSDNTGATFGFKFAGTNASTGFVLDGFYAGVDPTGLTFGNIGVSSKFDASLNNVTLGNLGTQSTTTFNNLPNGSMGSFGVTGASVTDFKMKVSGF

SEQ ID NO: 4707 - protein, 227 aa, Acinetobacter baumannii
VGMKYTLTRANPDADQYPLQDRQIVTDPLEEEVNKNVFMTRLEDVLHTAVNWGRKNSLWPFNFGTSCCYVEYATTLTGVHDLSRFGAEVIRASPRQADLMIVAGTCFVKMAPVIQRLYEQMLEPKWVISMGACANSGGMYDIYSVVQGVDKIIPVDVYVPGCPPRPEALIQALMLLQDQIQLERRPLSAVIGDDLQPVYKPKMMPERDRKNAQRIAVKNLRSMDEIK

SEQ ID NO: 4708 - protein, 159 aa, Acinetobacter baumannii
IMAKATVVKKHNGGTIAQNKRARHDYFIEEKFEAGMSLLGWEVKSLRAGRMSLTESYVIFKNGEAFLFGAQIQPLLSASTHIVPEATRTRKLLLSRRELEKLMGAVNQKGYSCVPLACYWKGHLVKLEIALVKGKQLHDKRATEKERDWQRDKARIFHK

SEQ ID NO: 4709 - protein, 144 aa, Acinetobacter baumannii
RIENREQRTENREQRTENREQRTENREQRTENREQRTENREQRTENREQRTENREQRTENREQRTENREQRTENREQRTENREQRTENREQRTENREQRTENREQRTENREQRTENREQRTENREQRTENREQSTENRQQRTVS

SEQ ID NO: 4710 - protein, 149 aa, Acinetobacter baumannii
RIENREQRTENREQRTENREQRTENREQRTENREQRTENREQRTENREQRTENREQRTENREQRTENREQRTENREQRTENREQRTENREQRTENREQRTENREQRTENREQRTENREQRTENREQRTENRVQRTDNREQCLNGWIEHS

SEQ ID NO: 4711 - protein, 143 aa, Acinetobacter baumannii
RTENREQRTENREQRTENREQRTENREQRTENREQRTENREQRTENREQRTENREQRTENREQRTENREQRTENREQRTENREQRTENREQRTENREQRTENREQRTENREQRTENREQRTENREQRTEYREQTTENSVLTAG

SEQ ID NO: 4712 - protein, 473 aa, Acinetobacter baumannii
EREKSMHDVIVIGGGNAALCAALTAKESGASVLVIEAAPKEWRGGNSQHTRNLRCMHDAPQDVLVDAYPEEEYWQDLLKVTAGKTNEHLARLVIRSTATCRDWMRKHGVNFQPPLSGALHVARTNAFFMGGGKALINAYYRSAQELGIEILYNTKIKDLKLNQGYFEAAIAEDGRVFKAKSCVLAAGGFESNLEWLREAWGQNENGEWPADNFIIRGTRFNQGNLLKFMIDQGADIIGDPSQSHCVAVDARAPLYDGGICTRIDCVSLGIVVNNKAERFYDEGEDFWPKRYAIWGRLVAKQSQQIAYSIIDSKAIGRFMPPVFAGVKANSIQELAEKIGLDAKTLCHTVEEFNQACVQGTFNHTVLDDCTTQNIVPNKTHWAVPLDQPPFYAYALKPGITFTYLGLKVEDDAAVRFNNKPSHNLFVAGEMMAGNVLGQGYTAGVGMSIGTTFGRIAGKNAAHYALSQGVEHEC

SEQ ID NO: 4713 - protein, 1085 aa, Acinetobacter baumannii
FVGKDMTYKASFTGWENLKIEDLLVAYRKAKADCFFENTFPTAVKFAEYEQNLLTNLKSFLKKLRNENGFIENSKLLGNYRVVPKKLSIDRKNIEGYAGHIHFSDPKKNLNKLFSENVVEPSFRLIGDFPVETHLISALWINMIGEQFDERLGESCYAARLKRIKNNEDFTLDTRKPFHLSAIGSFSPYFQPYQKWRNDGLNAIRDELEKDRSVIAVSLDLKSYYHYIDPKIIVSNKLHESFNIILNHHELLFTKQLAIFLEKWGNGAVEYSKNISFECEIPGGLAIGLTASRIISNMILHRWDKLIKEKVTPIHYGRYVDDMFLVLKDTGNIENSDQLMEFLRERIGGDVLTQDNNDSKKWYINLPNSLEDKTSIQLQADKQKLFLLDGQLGLDLLDSIEKDIYELSSEHRLMPSPDQLDQSTAAKVLSAAGSVGENADTLRRADGLTIRRLSWALQLRHVETLARDLPPKVWQKQRNEFYQFAHNHILRPDSIFEHFTYLPRLLGFAISLNEWHQAELIVLRSYNSLDILKAEIFNQDRSGPYGEINGAKCILHEEIWQEIKYSLTVLFIDAATKYYDPNALFGEEEPKQKSLEEIFFRGLFGSIDSISDFLNTDLSITNFKEKALLVVKSDLGKNPYKQILKLDICDKLIDINHRVANEELFDEFQKSDLVFSQFLRDFLKSSFKERFKKIKDEDKYNFELFLPYLFPTRPYSPAEISELAPECVGLPKNNKKFCKIKPTKIWARYCQAVRGIWIKPTLLATENDNSDKVNCSRSLRIGTDSKNQVIVALTNLKTSEQDWAYSAVNKPNLSLERYQRIADLVNDILRLKPRPDYVFFPELSIPLEWVDSIASRLCNAGISIIAGTEYRHTANDKLISEALLILSDNRLGYYTFSKIWQPKLEPAVGEDKELISVYGKSWDFTRTKYKNKKGQLKVLKKPIYIHNNFHFGVMVCSELQNSKSRISFQGKVDALSVLSWNQDLETFSTLIESAALDVHAYTILVNNRKYGDSRIRVPAKQSFNRDLARVRGGENDFVVAAILDINELRAFQSRAKRWTQDGDKFKPLPEGFVISKTRKLSPPNK

SEQ ID NO: 4714 - protein, 445 aa, Acinetobacter baumannii
HLRLEMSNIDIYNEERTTMSILSWDDFEDDSQKPAAPEHKSAPVNPEKTPDSQNVSAAQPSSQSVAAPQSTGTHSVRSTNPTDSMARASEALEHLDVAPGLEELEMGAQRVQVDDKAMINCRADLNQLVPFKYEWAWQKYLDGCANHWMPQEVNMNHDIALWKSENGLTEDERTIVMRSLGFFSTADSLVANNLVLAIYRHITNPECRQYILRQAFEEAIHTHAYQYCIESLGMDEGEVFNMYREIPSVARKAAWGLKYTQSLSDPTFHTGTPENDQRLLRNLIAFYCVLEGIFFYCGFTQILSMGRRNKMNGVAEQFQYILRDESMHLNFGIDMINQIKIENPHLWTAEFQQEVIQMILEGTMLEIEYARDTMPRGVLGMNASMMEEYLKFICNRRLSQLGLPEQFAGVTNPFAWMSEMMDLRKEKNFFETRVTDYQTGGALSW

SEQ ID NO: 4715 - protein, 221 aa, Acinetobacter baumannii
AMHLLQPQPEVNTSLLVCTHSTHQNPLLPDVVQLSPWPSSKLESEQVDWLILHFNHWFSHHNVTLVRGEFEPEYFPANEHEPAKIQFAHGFFNSALHEISHWTIAGAKRRLLPDLGYWYAPDGRTKEQQDLFEQVEIKPQAIEWLFAQSFGRKFRVSLDNLTGDGGDGRKFKDNVYAQVQRYFSGEAKLPADAARFIECICQCTRAGAALQLNEFKRELLD

SEQ ID NO: 4716 - protein, 273 aa, Acinetobacter baumannii
KRFDMISLPLVYTILALIAYTTSFWYLFIRLMSKREPNPWLFAFVTTLALLLHGTVLCHAMLTPSGINYDVFNLVSFTSGLMLLLSLVFSTFRPIVPLNLLGIPVAAIGLILGFAFSRPDQFIEQHSLGLDTHIILSLSAYAVLLMATIHAILIWFQNRELKKKQKKRIWVNLLPSIQAMESLLFDLIITGFILLTIALAFGFLTVDSFFAQHLAHKTVFSIISWFIYGSLLIGHYKLGWRGQKAIRFTLIGFALLAIGFIGSKFVLEMILGR

SEQ ID NO: 4717 - protein, 279 aa, Acinetobacter baumannii
IHVEYEQSGKTFMELIIYLLIGAIAGFTAGLFGVGGGLIIVPILYVVFTQLHYDPAVIMHIAVGTSLATIIVTSFSSVSAHHKKGAVLWPVFRNLAPGLVIGSFLGAGIADLLSGQHLQLLIGVFAVVMAYRMFKGAHVVVDPTRQLPSTPMQFMAGGGIGIASAIFGIGGGSLTVPYLNRHGVVMQKAVATSAACGLPIAIAGAIGFMWFGAKEHISVPNTIGYIHIYAFIGISVMSFVTAKLGAKVAHALSPQMLKKCFACLLIVVGSYFIYKGFMN

SEQ ID NO: 4718 - protein, 187 aa, Acinetobacter baumannii
YLPDGVGWYSKHTGKGTVQFRNNVMVQATDFRNAMSLLTSAVSVVTTAGMSGRFGFTASAVCSVTDTPPTLLVCMNQAASSHAHFLDNKILTVNVLGAHHEHISKAFSSKLPPEERFKHGEWIELETGAPVLEDALVSFDCEIEQIQQVGTHTIFICPIVAIKQSQHDQSLVYFNRAYHQVGQTETV

SEQ ID NO: 4719 - protein, 255 aa, Acinetobacter baumannii
SIGEFPVSLNKNLVAQRFAKAGQSYSKHAIVQKQICQNLTNLLKQFCPSTMSRVFEIGCGSGNLTRLLVESFQIEDLVLNDLYAEVQQHFNHEEHVKWLIGDVETLEFPQQLDMIVSGSALQWMQDLPRLLQHCYAALNEQGWLCFSTFGPKNLIEIKELTGQGLNYWNLENWNSALTQAGFEILHLAQSETQLYFDLPKAVLQHLKATGVTATAQHRWTKQTLQQFYQDYDRFKHAEGYSLTYHPIYCIARRMK

SEQ ID NO: 4720 - protein, 427 aa, Acinetobacter baumannii
RMTDNFDLEHIWHPYTSMTQPLPTFKVKRAYGATIELDDGRTLIDGMSSWWCAIHGYNHPELNQAVTDQLQNMSHIMFGGLTHDPAIELGKILLKITPPSLDKIFYADSGSVAVEVALKMAVQFWTAQGQPQKTNFITTRSGYHGDTWNAMSVCDPVTGMHQIFGTSLPNRLFVAAPQTKFHEEWNQEDIAELEQAIQQNHENLAALIIEPIVQGAGGMRFYHPEYLRQAKALCEQYHLLLIFDEIATGFGRTGKLFAWEHAQVEPDIMCLGKGLTGGYMTLSATLTTKHVAETISRGEAGVFMHGPTFMANPLACAVALKSTQLLIEQDWQANVKRIEQQLSQYLAPLRQLDYVADVRVLGAIGVVELTFNVDMKTLQQQFVERGIWIRPFGKLVYVMPPYVITQQELSDLLEQLVEVVKTMQGAH

SEQ ID NO: 4721 - protein, 484 aa, Acinetobacter baumannii
SRSEWRTNMSKLIVLSNRISMPSGKASAGGLAVAVQDALNDSNGIWLGWNGQQITDTEAPEFDQAYSHGIDYITCPLTHQQYAQYYCGFANKVLWPAMHDRDDLIEYNAEEYNTYQKVNRLFAEKLQQIAQPDDLIWVHDYHFFSVARHCRELGMQNKIGFFLHIPFASLNIWRKIPVALQLVQDLCQYDVIGLQTQTDQNTCMQTCMGLLEAQKILSDRISYKKRQILIKSYPIGVQPELIQRQAQQAFHTPYVFNFEDIPRQKTIIGVDRIDYSKGLLERFNAFATFLETNPEYHGLVRHLQVATPSRTDIPAYQRLYQRFKAKLELINEEFAHEDWRPIDCCFDTVQHDSLMHIYRRSDICWISSLRDGMNLVAKEYIAAQDPENPGVLILSKYAGAAEQMTQALIVDPLDRAAMMDSLKTALEMSKAERINRYEQLIEGLAATDLSDWRNNFLKDLENSPTFTKSKLSLQEKYQPTYHVL

SEQ ID NO: 4722 - protein, 386 aa, Acinetobacter baumannii
YMSDDQNKPEQTPAQTSNNEPTPAPAPAPAPAPAPAPAPASKLIPTKRSTLLWMLGVLIIGILVILWAWRIGPFATSVQQTDNSYVKGKTTILSSQINGYVKDVLVKDFDHVKKGQVLMHIDATTYDQKVAQAASGVEQAKNTLANQTQSIAQKQADIVAAQAKVEQVRAQYELSLAQLRRYQQLGNSGAASKSEQDKAAADAENNLAALKQAEANVLVAKEALKTAQVAEAGLEAQVSSAKAQLDQAQTTKDYSVIVAPMDGQLGEVNPRVGQYVAAGSQLLYLIPQQTWVIANFKETQIANMRIGQKAWFTVDAMKHKKFTGHVEQISPAAGSEFSVLKPDNATGNFTKVVQRIAVRITIDPNQEGIEHLRPGMSVITSVDTSS

SEQ ID NO: 4723 - protein, 338 aa, Acinetobacter baumannii
STTELSLQWTRIVNNLPNLSDLKVFCTVAKLKSFVESAEELGTSPAFISKRINILENTLSCKLFHRSTRHVSLTEDGKLILERVSNILEEFDEVCELVNNPLSTPTGRMDIISSFGFGRKHVAPILSKLMMLYPKLQIHFDTIDNTKDLIQHSIDLDIRIGNEIAPNMIAKKLASNFRILCASPSYLLKHGVPDSIEDLQTHDCLTISERDQSSVLWKFRHASEDVSVHIKPRFVSNNGEIIHQLAIEGHGIIFRSIWDVADELITGQLQHILPEYWQDADVWAVYPSRLKSSSKLQTCILFIQNELLNRLQHVQNLSRGQLISPAVKREPPPEKVFL

SEQ ID NO: 4724 - protein, 505 aa, Acinetobacter baumannii
PCGDPIIMNFTVSFSTLMPLAPVMIVALTAVVVMLLISIKRNHNLIATTSVVGLNLAALYILLELFGGKFVPANVMGMFMVDPFTMFYQFMILVASLACCTLSHAYIETYKDNREELYLLLLASVAGAMLMVASSHYASFFISLELMSIPVYGLLAYTYQRSQSLEAGIKYLVLSATASAMLLMGMAYIYAYTGSLSFYDSVQALFGAIKQPMVLLGLALIIFAVAFKLSLAPFHKWTPDVYAGAPAPMATFLATAAKVATIGLFVRYLLASGAIMVNSLVTVLTIIAVLSILVGNLLAVRQVNLKRILGYSSIAHFGYLLIALISMTYASLGSVTVYVVTYVLTTIGAFGAVALMSSPYNNVDEAQSLADYRGLFWRRPVLTATLTVMMLSLAGIPLTAGFIGKFLVVMAAVTTQHWFLAAMIIVGSGIGLYYYLRVMVVMYMTPPETPRIDADAHWGQKVGGLMVLAAAALVIILGVYPDPMINLALKAEILSPLHFMLSQQQ

SEQ ID NO: 4725 - protein, 261 aa, Acinetobacter baumannii
IEKEITVRPTVLCFSGLDPSGGAGLQADIEAIGQSGAHAAIACTALTIQNSQQVFGFEATSKELLLAQANAVVGDLPIKCVKSGMLGTTDNIAALAEFLRAHPDYQYVLDPVLVANSGGSLGDQATLVKAFVELIPLATLITPNTVELRALTGVTDLDQATQKLFEMGAKAVLVKGGHEDTPDFIKNSLYIDGELAASSTCPRLEGEYHGSGCSLASFIAGRLALGDSLKIAVQHAETWLFGVLKNAETPVLNGQKIPKRF

SEQ ID NO: 4726 - protein, 449 aa, Acinetobacter baumannii
LIWENEELKMNNDVQVISKELKTTFPSNLGTYEKIGPQTWKWALLFAYFAMVVDGIDIMLLSYSLTSLKAEFGLSTFQAGALGSASLAGMGIGGILGGWACDKFGRVRTIANSVTFFSVATCLLGFMQSFEQFMALRFIGALGIGALYMACNTLMAEYVPTTYRTTVLGTLQTGQTVGYIAATLLAGAIIPDYGWRVLFFLTVVPAFVNIFLQRFVPEPKSWQLTKIESLQGNRQPKERVMAEKPKSSSIYKQIFNNFKHRKMFLLWMTTAFFLQFGYYGINNWMPSYLETEVHMNFKNLTSYMVGSYTAMILGKILAGYLADKFNRRAVFVFGTIASAVFLPIIIFFNTPDNILYLLITFGFLYGIPYGVNATYMAESFSTDVRGTAIGGAYNIGRVGAAIAPATIGFLASGGTFTMAFIVMGAAYFVAGVLPGLFIKDRQYDPQRQS

SEQ ID NO: 4727 - protein, 186 aa, Acinetobacter baumannii
DSREYKMYKILAGVGSIVRTLFMVFTHGFRKRDTILYPEVPAEEIVPPRYRGRIILTRDPDGEERCVACNLCAVACPVGCISLQKAEKEDGRWYPEFFRINFSRCIFCGMCEEACPTTAIQLTPDFELGEYVRQDLVYEKENLLISGPGKYPDYNFYRVTGMAINGKEKGQAQKESAPIDVRSLLP

SEQ ID NO: 4728 - protein, 541 aa, Acinetobacter baumannii
MKSFKVALAQFSPHIGNIDSNTQKMIEQANQAKKQDADLIIFPELSVIGYPAEDLLLRPNLNKRMQKAFAQLSEVKDIVMVFGFVNQTEDGQRYNSAAVMKDGQVLGVFNKHNLPNYGVFDEKRYFQKGHQHLVFEYLGHKFGVLICEDIWSINTVKQLSQLNVDTVLVLNSSPYEVGKPQHRKQTLSELAKQLHLNIVYVNQVGGQDDLIFDGTSFVSNQNGEIALQAPSFKEDLYIAEFDRDTKLYKVVESAPALETFAEIYQGLVMATRDYVERSGFPGVILGLSGGIDSALTLAIAVDAIGAERVQAVMMPYTYTSQISVEDAAEQARRMGVTFGIAEIHSIVNSFMQTLYPFFGNSPADATEENLQARARGTLLMGLSNKFGNLVLSTGNKSELSVGYCTLYGDMVGGFAVLKDVYKTIVFELAKYRNSLSETPVIPERVITRPPSAELRPDQKDQDSLPAYDVLDAILYAYIEEDLGQADIIAKGFDKEVVEKVIRLVDRNEYKRRQGAIGPRITSRAFSRERRYPIVNGWTAND

SEQ ID NO: 4729 - protein, 420 aa, Acinetobacter baumannii
GKGFSMGNRLVWIANGFMVSFAYMLFSKPAVLDTATLLSTQRLATRLSFFSLGFAISAWAPLIPYAQQRLNLNHANFGLLLLCMGIGSMIAMPATGALVKRWGCRPLIAVATILLMVLLPSLTIWHSLVSMAVALFIFGTAAGSLGVAINLQAVVVEKHSLRALMSSFHGMCSLGGLIGAMLVTALLAIGLSPLMSTLSVVMVLLVVSFVAIPSALTTFEQDEQGAAEITDAPKKSSRPNGTILLIGMMCFIAFLSEGAAMDWGGIYLTSKYQLNPAFAGLAYTFFALSMTSGRFAGHILLKQWGEKTIVTYSAIVAALAMVTIVMAPVWQVVVLGYALLGLGCSNIVPVMFSRVGRQNDMPKAAALSLVSTIAYTGSLSGPALIGLIGQWTSLTTVLSGVAVLLTMIAILNRFTLVKAK

SEQ ID NO: 4730 - protein, 325 aa, Acinetobacter baumannii
RCFCFAQVTQTVKLILAPMEGLTDPIMRDTLTSVGHFDWCVTEFIRVTDSILPDHIYYSFCPELKNDGKTAAGTPVHVQFLGNNPEMLAANAAKVVELGAPAIDLNFGCPAKTVNRHRGGSVLLDEPDVVHMLIKAVRDAVPAHIPVSAKMRLGYLDENHTMENAHAVEDAGASWLTVHARTKADGYTPPAYWEKILPIKEALKINVIANGEIWTNADARACQQQSGCEDLMIGRGAVTTPDLTQCIRQNMDEALFTWEQLVDLQIRFLNGQAKTEIGMVGRYKQWLGMMTKAYPQAKELWDQVKRIKALDEIVQQLEQTGSSRI

SEQ ID NO: 4731 - protein, 129 aa, Acinetobacter baumannii
RENCHMATTNQLIRKGRTTLVEKSKVPALKACPQRRGVCTRVYTTTPKKPNSAMRKVCRVRLTSGFEVSSYIGGEGHNLQEHSVVLIRGGRVKDLPGVRYHTVRGSLDCAGVKDRNQSRSKYGAKRPKK

SEQ ID NO: 4732 - protein, 63 aa, Acinetobacter baumannii
LPGCKNAATDCPVLSNAAACNVLVQIDAIPKINIFLFTTKFIDPSWIFFYFDSSLYVDLIDYA

SEQ ID NO: 4733 - protein, 262 aa, Acinetobacter baumannii
LHKCFTTLLIFNMDLETRQLQQLLSAKNQLPEVVLLKATTTSTNDDIREIAQKGITTGLVCSAQQTQGRGQHQRQWISPEGNIYLSTLVQTRTPLDGRFALEVALNILQIPQLQPLSLQVKWPNDLYSTQGKWGGILVEPLSQHQAIVGVGINLKTPPVTESDQPITSLEDLGLEQMSRLELISELYVAIQNAARWFEHGCYNLAGRFNHHAAWLNQLVQFEHSQGLVYGRFVGISNEGAVIIETPEPQQFYQGRLRPQTTQ

SEQ ID NO: 4734 - protein, 121 aa, Acinetobacter baumannii
GEKCMNLEYTHKPDYYLFAQLLVRHIESYIHKHPDADNAIFDLRDVYEIFRQDFASTTTNLEGILHIADSYRVETLNGDQPLIQKYQIDAKNNSLLIDFNTDALNSLRSGKPILEPDATQL

SEQ ID NO: 4735 - protein, 98 aa, Acinetobacter baumannii
IREWQGRLDSNQRMAGSKPAALPLGDAPKFDAVLRWQGRLDSNQRMAGSKPAALPLGDAPNTIIITGRKWQGRLDSNQRMAGSKPAALPLGDAPNLQL

SEQ ID NO: 4736 - protein, 394 aa, Acinetobacter baumannii
LKRCRGHIKMSLLDHFATELDELKRQGNFRQFTQNVQHGRFITIQNKTMLNLASNDYLGLAADIDLRQEFLDCYPLERSYFSSSSSRLLTGNFDEYEQLENSLSQAFGGRAALLFNSGYHMNIGILPAVADSKTLILADKLVHASMIDGIRLSGAQYVRYRHNDLQHLEQLLQKYHDDDQIERIIVVTESIFSMDGDETDLTALVQLKKRFAKTMLYVDEAHSIGVRGQQGLGCAEQYNVIQEIDFLVGTLGKALAAVGGYIICHPIIKDYLINKMRPLIFSTAQPPIVMAWANFIFQKVLMAQSQREHLKNISQYLQQAVVQKGYVSPSTSHIIPVIVGESQATIDKAKQVQESGFYAMPVRPPTVPKNSSRLRISLTSMVEQHELEALVSFL

SEQ ID NO: 4737 - protein, 271 aa, Acinetobacter baumannii
KFAWLIIVMNQSLHQSMEDVPHIRVLDEWHDTIPEDLYIPPAAFEILLEQFEGPLDFLIYLIQKNGFDLIQLDIAPIATQYLAYMDSMKSLNIELTADYMVMAALLADLKSRLLLPKPTVVSIEKDPKQDLIDRLETYLRIKQAAERLGQMPVLDRDTFSANVSLGHIAPVYEGYDVSALHDALFCVFNRPEPVTHTIAQEPVLLEERIAYIEEKLESGDVLSFKELLNPQQGRMGMVVTFMAVLELTRQQKIKIIATGVEAPLAIQGSSI

SEQ ID NO: 4738 - protein, 119 aa, Acinetobacter baumannii
ATTRPSHGVVMSRTYTFFIHLRALPAWLALAREKRAEFSTQKLEPIFEKYPSVKVRWYDVEAFSTKASDIAVFETASLQDYYFVIDAIRDSEFCTMPYFEFVEIIPAIEDGYVEYESSL

SEQ ID NO: 4739 - protein, 181 aa, Acinetobacter baumannii
GQRRVHDTCTNCWIILKCHIIRCIKMPRRRVVAAREILPDPKFSSQTIAKFMNHVMQDGKKSIAESIVYGALERVQEKNKVDPVEFFETTLEKVRPMVEVKARRVGGATYQVPMEVRPSRRTALAMRWLVDAAAKRSEKTMALRLAGELLDAAEGKGAAIKKREDVHRMAEANKAFSHYRF

SEQ ID NO: 4740 - protein, 63 aa, Acinetobacter baumannii
KILRHSQSLSCPYKKSINPLTMFYNNLSLWNIEDVFLDVPRLVSKLRLLCLHKSKAIEYSNHG

SEQ ID NO: 4741 - protein, 458 aa, Acinetobacter baumannii
ISLRPNLEDRECFHFVRPRRSPMDVVNNRRATFKKILNVTSGNFLEQYDFFLFGFYATYIAAKFFHSDNEYVSLMMTFTVFAAGFLMRPLGAIFLGAYVDKVGRRKGLIVTLSLMAIGTILITFVPGYETIGIIAPILVVIGRLLQGFSAGVESGGVSIYLAEIATDKNRGFITSWQSGSQQIAVVFAALLGYWLNTILTHAQVGEWGWRIPFLIGCLIIPLIFLFRRTLEETEDFKAQKTHPSSKEIFSTLVSNWRIVLAGMMMSAMTTTTFYFITVYTTVYAKRTLEMSVTDSLLATVFVGLSNFFWLPMGGLLSDKIGRRPVLVGITTLAIFTSYPVLSWLVSDISFSNLLITLAYFSFFFGMYNGTMVATLAEVMPKRVRTVGFSLAFSLAAAIFGGMTPMACTFLVENTGNASTPAFWLMLAAVCSLISSLYLCRGSKQKDPDAIAEPAKISA

SEQ ID NO: 4742 - protein, 462 aa, Acinetobacter baumannii
RYSRFSRSDINQTVIGEVCMNTEPKPIYGDGNPETHPLTWRLSKQESVRSADDYEALEGYAGFKKALGMKPAEVLEVIKAATVKGRGGAGFPAGIKWSLMAPNDGGPRYLICNADEMEPGTFKDRLLMEKLPHQLIEGMLIAGYTLEATQGYIFIRGEYIEAAQYLNEALEQIRAKGYLGDNILGSGWNFELHVHTGAGRYICGEETALINSLEGRRANPRTKPPFPQVAGAWGRPTIVNNVETYNNLPAIMLRGPEWYIGLSAGKSKDPGTKIYGASGKVKFPGLWELPFGTTAREVIEEHAGGMRDGLKLKAWLPGGASTDFLPADTIDLPMDAETIMKAGSRLGTCLLMVVDETQCMVSLTRNLEEFFARESCGWCTPCRDGLPWAVKALKALETGEGKKEDIDHLQELTRKLWIGKTFCAHAPGAMEPLMGALKHFRSEFEAKVTDRPVVQTSNVEQA

SEQ ID NO: 4743 - protein, 195 aa, Acinetobacter baumannii
APTLYYPMIMAKQFFQSWLPSPEKVSNMKFLRIFGQKTLNPVLWYVNRKSITRAIFVGTFFGLLPIPFHSVFIVMAVLLFEVNLPISLMLAWLSNPLTLAPILYIGFWFGAHIYHVHMINKKMLLGVLHQISRWITHFGHGHIDLSLAKILISGLIVEAFVFATILYIVTEVFWRWMVIRNWKNRTGHKKQEDAL

SEQ ID NO: 4744 - protein, 1151 aa, Acinetobacter baumannii
GIMRLSSLKLSGFKSFADSTTLNFKANRTAVVGPNGCGKSNVIDAIRWVMGESNARQLRGGSMQDVIFTGTSKRKPVGVASVELRFDNTYGKLGGAYNAYNELAVRRQVTREGKSEYFLNGTRCRRRDITDIFLGTGLGPRSYAVIEQGMINRLVDAKPEEMRIFIEEAAGVSRYQARRRETLQHLEHTEQNLSRLEDIALELKSQLKTLKRQSEAAVQYKTLESQIRTLKIEILSFQAEKSVRLQEEYTVQMNELGETFKLVRSELSTIEHDLESTSALFQRLIQQSSPLQQEWQQAEKKLSELKMTLEQKQSLFQQNSTTLVQLEQQKAQTKERLQLSELQLETLNSQLEEQTEALTAIEHTAAEAEQSFAGLQSQQRQAQQQFEQVKAQVEKQQQQKMQMSAQIEQLGKNVQRIEQQKETLQHQANQIQSQVHEDEQGELEQLQQQLCREISTLEAEIEQYVQRIEQAQQAHQVNKNQQQTLKTEIQVLLSEQKNLSQLVAKQSPKQNQDTLRLMQALELTEQGKPHAQIIEKFLAKWLQAHIVETEQAFQEGIARQLKPSEQSSKFKGNLTCLNDWIASPQLSIFSNVAIAQDLSHALNEQKQLQYGQSILTLDGYHVGQDWVIALMYDDESQSAQGMLSHRIRLDEIEQVLQKQQPELQALDQIIVQQKDELGQLQVDLQQKQQVIKQKQKDLQQLDVQIAKQQTAAQAFLLQKQQLKDQLAQLDTQLEEDAMQKDDLEIDLHALAMKLETILPDYKTLQFQVEELTEQLEEQQQVLQQQQQEREILRRNSTQTTQQIELLEKDISFLQSQYQQITAQMEQAKKFVDPIQLELPNLESEFQQQFAQTEKLQKTWNEWQIELNSVQEKQQTLTDQRHQYQQQDEKLREQLEAKRLAWQAAKSDREHYQEQLKELNAELQTGLKIDLTEHQQKLEKVQKQFEKIGAVNLAASQEFEEVSQRFDELSHQIQDLENTVTQLKDAMKSIDQETRKLFMSTFDQINQELQNLFPKVFNGGEASLSLEDDWQSGVKLMARPPGKKNSSLALLSGGEKALTALALVFAIFRLNPAPFCVLDEVDAPLDDANVQRYCNLVKELSEHVQFIYITHNKLAMTMATDLLGVTMPEPGTSKLVTVNLEQAKEYGLVSES

SEQ ID NO: 4745 - protein, 332 aa, Acinetobacter baumannii
KNQLEGTVMTTYEQATYALSEEMQSLVYWSSIYSPADADIDSVRAAYDAMCRHYTLPRDDKLDVEDRVIANEEQPVPVRVYLPKTNRPGSGWPCVLYLHGGGWMVGGLDSHEFITSYLCKDLNAVVIGVDYRLAPEHRFPAAFEDCLAVYHWLKQHGSAWQIDSENIVLAGDSAGGNLAAALAVELQHSGLQAQGLALVYPCLTTAFDTPSAQKHAHAPLLTTEDMHFYLKEYAPNSQDWQDLRLAPLLATDFSDMPTSFVAVAEYDPLSDDGYLFTQKLEQAGIPNEFHLGKGLLHGSLRLMRDCPEVQHLYQNMLSAIHRMLSSTEKTSI

SEQ ID NO: 4746 - protein, 208 aa, Acinetobacter baumannii
SSTSYSRVFNMSSFEQNNNDLSLADIHHEVLLQLEAIIFASEAPVSIARLKEAFNNQYNKQQLRQLLQQLALLQHGRSIELIETAQGFRFQVRSKYRNIIAQIWPERPTKLSPSLLETLAVIAYHQPVTRADIEQIRGVSNNSQILRTLFDWNWIKEAGFRDLPGRPALLITTPQFLNAFGLASLGQLPPLQNAKEAFMALDANAPKS

SEQ ID NO: 4747 - protein, 354 aa, Acinetobacter baumannii
STYRSFIMKKLLPTSTAGSLPKPSWLAEPEKLWSPWKLENEGLIEGKKDALRLALHEQKLAGIDIVSDGEQTRQHFVTTFIEHLNGVDFEKRETVRIRDRYDASVPSVVGAVSRQKPVFVEDAKFLRQQTDQPIKWALPGPMTMIDTLYDGHYKSREKLAWEFAKILNQEAKELEAAGVDIIQFDEPAFNVFFDEVNDWGIATLERAIEGLKCETAVHICYGYGIKANTDWKKTLGSEWRQYEEAFPKLQTSNIDIISLECHNSRVPIDLLELIRGKKVMVGAIDVATNQIETPEEVANTLRKALQFVDSDKLYPCTNCGMAPLSREVARGKLNALSAGAEIVRRELTGYDLTA

SEQ ID NO: 4748 - protein, 249 aa, Acinetobacter baumannii
SGIFPMKSLWLDIGNTRLKYWITENQQIIEHAAELHLQSPADLLLGLIQHFKHQGLHRIGISSVLDTENNQRIQQILKWLEIPVVFAKVHAEYAGLQCGYEVPSQLGIDRWLQVLAVAEEKENYCIIGCGTALTIDLTKGKQHLGGYILPNLYLQRDALIQNTKGIKIPDSAFDNLNPGNNTVDAVHHGILLGLISTIESIMQQSPKKLLLTGGDAPLFAKFLQKYQPTVETDLLLKGLQQYIAHYPKD

SEQ ID NO: 4749 - protein, 277 aa, Acinetobacter baumannii
AVWLKKTFHSGVHTDEESGQTIIAGMGELHLDIIVDRMKREFGVEANIGKPMVAYRETIKKTVEQEGKFVRQTGGKGKFGHVYVRLEPLDVEAAGKEYEFAEEVVGGVVPKEFFGAVDKGIQERMKNGVLAGYPVVGVKAVLFDGSYHDVDSDELSFKMAGSYAFRDGFMKADPVLLEPIMKVEVETPEDYMGDIMGDLNRRRGMVQGMDDLPGGTKAIKAEVPLAEMFGYATQMRSMSQGRATYSMEFAKYAETPRNVAEGIIAKFQAGGKKGDDE

SEQ ID NO: 4750 - protein, 695 aa, Acinetobacter baumannii
SQLRVEKFPPFFMVNKIMAITSVIEQMRQLIQLIAKHNHAYYVMDQPTISDSEYDHLFHQLKALEEQYPEFVQADSPTTKVGGQALSKFESVTHVVPMLSLGNVFNQEDLFAFARRVEERLPNQKVQYEVELKLDGLAISLWYENGVLVRGVTRGDGETGEDITQNVKTIRNLPKVLHSEKYEIPRLLEVRGEVLMPKSGFEKLNADQEAKGEKTFANPRNAAAGSLRQLDPNIAAARPLAFYAYGIAQCEPNHGLTTMHDSLQWLTELGFQIAERQYLCNSIQEVQQRYEQIQQERPNLQVEIDGMVVKVDDLKQQQQLGFLSREPRWATAYKFPAQAALTTVEQIDWQVGRTGTLTPVARLNPVFVGGVTVSNVTLHNIGEIHRLDVRIGDTVSVYRTGDVIPKVEKVWPEFRPAEAEVVHLPESCPVCASPVVMPEGEALARCSGGLYCAAQRIEAIRHFVSRKAMDIEGLGDRWVESLLRLDLLKDVADIYHLHEHRETLLGIEKMGEKSVQNLIDAIEASKKTTLARFIYALGIRGVGETTARMLANTFQTLEALKAANVEALKKTPDVGDITAEWIADFFLAPHNIEVLDRLIAAGIHWDAPTAPTRQPLNGESWVLTGTLEQMTRDQATQMLQALGARVSGSVSSKTKCVVAGEKAGSKLEKAAKLGIPVMNETDFLSLMAGYGQTLS

SEQ ID NO: 4751 - protein, 412 aa, Acinetobacter baumannii
RVNRQTGSAKLKTIKILMLVSYTECVVFLGQNNVIKIKTYTNIVSSKNSTQRFSQKHSKSKLLSAVLNRHDELIATDKKKFMITKTLPLTDIHRHLDGNIRIQTILELGQQYHLDLPAYDIESLRPHVQVMDNQPDLLSFLSKLDWGVKVLASLDACKRIAFENMQDAAQQGLDYVELRFSPGYMGMTHQLPLEGVVEAVIAGVKEGSQAYGVKANLIGIMSRTFGQEACEKELNALLAHKNDIKALDLAGDELGFPGNLFIDHFKKARNAGWHITVHAGEAAGPESIWQAIEELGAERIGHGVKAVQDLKLLDYLAKHQIGIESCLTSNIQTNTVPSLAQHPLKTFLEHGVLATINTDDPAVEGIEIQHEYLTAAPLAGLSPEQIYTAQENGLKIAFLSEQEKDELRQKYQ

SEQ ID NO: 4752 - protein, 111 aa, Acinetobacter baumannii
TRCRRGKRIMGQIPLEHGLIVATILFALGFYGVMVRRNLLFMLMSLEIMMNAAALAFVLAGSVWAQPDGQVMFILILTLAAAEACIGLAIVLQFYHRFHHLDVDAASEMRG

SEQ ID NO: 4753 - protein, 153 aa, Acinetobacter baumannii
AIISPLVLKLLNFMMYRQQSVTLDLDTDVTHQCYLHQTRDDHLIGIIEFNKPSYELKWGDLEYFRRRTEEFSVMPFPECINAMIVDIRNINVFLDNEVPILPWRLLEEDCPVRLVVPQDRLEHYAGLFEPTWLSTDVDSAIAEIREFMDMFVH

SEQ ID NO: 4754 - protein, 64 aa, Acinetobacter baumannii
KQISEENTMKKPGRFLAPVVIAGITVGFLASAYKFVFSKSESSKQTTSHKHDSEKSSNDSKASN

SEQ ID NO: 4755 - protein, 223 aa, Acinetobacter baumannii
DVPSTVLRLCCAFFSPRKGTGFLSHLETTRIYNGKTMPTLEISSKKLQVVQTAIQLFTTHGFHNAGVDLIIKEAKIPKATFYNYFHSKERLIEMCIAFQKSLLKEEVLSIIYSSRYYTQKDKLKEIIVLHTNLNSLYHLLLKAVFEIKRLYPQAYRMAVEYRKWLHRELFDLIFSCETRAFNFDADMVLNLIDGLLLQVLSSNSVDERDVVLERFWGRGVHKR

SEQ ID NO: 4756 - protein, 62 aa, Acinetobacter baumannii
SAARFKPTTEVVAIKLWLRLIEINSMTTTAVKATIITGAKGISVENDTVKFMIIGSPHGQVE

SEQ ID NO: 4757 - protein, 287 aa, Acinetobacter baumannii
SMKSLAFIHRNDTRFAVGDFYPVLSVFSYHELGNTLSPFLLLDHLGPGKIAPSMKRRGVNDHPHRGFETVTLVYAGELEHKDSSGGGGFISAGDVQWMTAASGVIHRELFSEEYSRSGGPFEMIQLWVNLPAANKMNSPRYQSLKKAEIPMVKLENEAGFVRIIAGQFKHVMGPALTHTPITVLDVELQAGQQAAFPAQSGETALVYLRSGRAQFQKDEDVLEEQGLAVMSNQGEYFSITALQSCKLLILTGQPITEPINGHGPFVMNTYDEILQAYDDIKNGRFAK

SEQ ID NO: 4758 - protein, 105 aa, Acinetobacter baumannii
SLMRIYLMANFVLNAQARAEDKQGKGASRRLRRESLVPAIIYGGNAEPVAVTLELRELVKALESNAFFEEVVEIKVGDKVENVKIQALQRHPAKNTPMHADFKRA

SEQ ID NO: 4759 - protein, 173 aa, Acinetobacter baumannii
LTMRITTMTTENKLDELKAKAADAKVQGEKALDDLKENVKEKQTAGKEAVADKVDELKTKAADAKVQGEKALEDLKENVKEKQAAAKEAVEDKASDLKGKLDDAQHSLQDKFDHLRTEAAHKLDDAKAKAAELKEEAATKFDELKTQATAKFDELKKTATEKLNKLKNHDSAE

SEQ ID NO: 4760 - protein, 416 aa, Acinetobacter baumannii
SVFGVNNMSWLSSLKSVFSPAQEVKEEEIQTVLQNYLLPDSKDALKERISQLQVQGRVLQLTINTFPDEKEYLQQIHDDLAGALQKCGIEELNLHVVQQKRPTQESSGQGCSSKAPKENSNLPPVLDASPKSEPDPNNPPIQKAAPQQRDVPLHPRIKNVILVSSGKGGVGKSTTTVNLALALQKMGLKVGVLDADIYGPSIPTMLGNAGKTPLIESENFVPLDAYGMAVLSIGHLTGDNNTPVAWRGPKATGALMQLFNQTLWPDLDVLMIDMPPGTGDIQLTLAQRIPVTGSIIVTTPQNVALLDATKGIELFNKVGIPVLGVVENMSTHICSNCGHEEQIFGIGGGDKLSEQYHIPLLGRLPLNAQIREHADQGKPSVIAMDDAADSYIDIAKAVWQQIERVPQRARDDKRIF

SEQ ID NO: 4761 - protein, 262 aa, Acinetobacter baumannii
EQNGRCPKCCFSGRRKNCMTQERKVALVTGASRGIGAAIAQQLIQDGYFVVGTATSESGAQKLTDSFGEQGAGLALDVRNLDEIEAVVSHIEQNYGPVLVLVNNAGITKDNLLLRMSEDDWDDILNIHLKAVYRLSKRVLKGMTKARFGRIINISSVVAHFANPGQANYSAAKAGIEAFSRSLAKEMGSRQITVNSVAPGFIATEMTDALSEDIRKKMSDQVALNRLGEPQDIANAVSFLASDKAGYITGTVLHVNGGLYMA

SEQ ID NO: 4762 - protein, 156 aa, Acinetobacter baumannii
SRVGLSMDAPSDAFLWVKALHIIAVVCWFAALFYLPRLYVYHAMSDDATSHQRFEVMERKLYRGIMWPSMIATLITAHFLVDWGDATRHYHEATWFYLKVGLVALLVIYHLVCGYYRKKLIGNAHYKSHKFWRFFNEMPTLILFAVVILVVVKPQF

SEQ ID NO: 4763 - protein, 415 aa, Acinetobacter baumannii
KDKGIVMGALQGIRVLDLSRVLAGPWCGQILADLGAEVIKIERPRVGDDTRMWGPPWMPDQDGNMTRESGYFQCTNRNKYSVAVDITTPEGQALIYEIAKTADVVIENYKTGSLAKYGLDYASLSELNPNIVYCSITGFGQDGPRAEEPGYDFIIQGMSGLMSITGEPDDVAGGGAQKVGVAVVDIQTGLYSTIAIQAALIARSHTGRGQYIDMSLLDVQVAALANQGMNYLASGKAPQRMGNQHPSIVPYQTFKAKDKEFIIACGNDKQFKDLCIAIGYPELLENEKFVRNQDRVKYRNELIPLLSEHFLRKTAKEWVDMIHALKVPVGVINSIEDALAETQIVHRNLVVNIPHRLNENFQTIGSPIKLSDTPVEYHHAPPELGEHTAQILSRFKTAEELAALKEKGIIDGKIA

SEQ ID NO: 4764 - protein, 975 aa, Acinetobacter baumannii
IMFIKSILSSITSIIPLPENSNTSSNLGNGSGDGLLNGISSGNGEHNYGIGNGIADDASITAPITIPLNLSGNSITLIGNSSSSSVNSSPTTTSNNVNDNDVTNNGNGSTISSGTGNGSGDGLLNGAASGNGEHNYGIGNGIADDASITAPLSIPINLAGNSITLIGDSSSSSVNNSATNTSNTVNDNDTTYNGNGSGAGNGSGDGLLNGIGSGNGEQNYGIGNGIADDASITAPITLPINLSGNSITLIGNSSASSVNSSPTTTSNTVNDNDTTYNGNGTGDSGVSALGGSGNGSGDGAGNGIASGNGEHNYGIGNGNGDDVDITAPITGVLNISGNSFTLIGNSSSSSVNTAPTTTSNTVNDNDTIDNGNSGGTGSGSGNGSGDGLLNGAASGNGEHNYGIGNGNGDDVDITSPITGIFNFSGNSFSLIGNSSSSSINTAPTTTTNTVNDNDVTDNGNDGGGLVGGSSGNGSGDGLLNGAASGNGEHNYGIGNGNGDDADFTFPLTGVLNFSGNSLSGFGSSSSDSVNVAPTTATNTVNDNDTIDNANTGSLGDGSGNGSGDGILNGAASGNGEHNYGIGNGNGDDADFTLPFTGGLNILGNALSGIGGSSTDSINISPTTTSNTVNDNDTTNNGNTSGGVIGSGDSGNGSGDGLLNGISSGNGEHNYGIGNGNGDDVDVVAPITTPINVLGNSFSFIGGEGTGDILGPITGVIGGIGGDGDILSPITGIIGGIGGDGDILSPITGIIGGIGGIGGDLGDNPLTGIIQSGIDVLQNLESLKTGLINTGIDTIAGTIIGVFPDAEHPVGDFADLGKLLFETSRDSVNGTLEAISDLAGADLDGASGSITGVIDTLITNGSTASTIIQHIVGDDLVTENGGLLGSITTIIGGVDSGDGGLLGGLDGLISINYGDSDNSNSVDVEDILGNILGSIGSNQGIAVGEPDPTGGSLIHTISLNTVNQLTDQLLHALPTV

SEQ ID NO: 4765 - protein, 720 aa, Acinetobacter baumannii
IPLIFSQRLLIFAYLPASVKIFHLINTNERMRSVRKILVTNALPYANGPIHMGHLLGYIQADIWVRAMRAMGHDVTYVCADDAHGTAIMLRAEANGISPEEQIANVQKEHIRDFDGFGVHFDHYDSTHSDANKARSTDIYIKNREAGNIAVRPVTQLFDPEKGMFLSDRFIKGTCPKCKSEDQYGDSCEVCGTTYNATELLNPRSTLSGATPVEKSSDHYFFKLPNFAEYLQKWTRDEGRLPLSIANKLDEWFEAGLADWDISRDAPYFGFEIPDAPNKYFYVWVDAPIGYMSSFENYIKTKRPDLNFDDFWKKDSQNEVYHFIGKDIVYFHALFWPAMLEGANYRTPTGLFVNGFLTVNGQKMSKSRGTFIKAETYLQHLNPEYLRYYFASKLSDKVEDSDLNLDDFVQKVNSDLVGKVVNIASRCAKFINSSFNNTLSSTCAESDLVQSFIDAGDSIAAAYEAREFSTAIREIMALADRANQYIDEKKPWALAKQEGQEQQVLDVCSVGINLFRQLAVYLAPVLPTLAQQVQDFLKLESFDFESRKQILVSHEIAQFQPLMQRVDPKAVAAMVDASKESLGAPAPQATKAAKKEKSAEKKAAPTPAVGEAEIIGIEDFLKVDLRVAQVVEAGTVEGSDKLLQLTLDVGEAEPRNVFSGIRSQYAPEDLKGKLVVMVANLAPRKMRFGISNGMVLAAGNGEGIFIISPDSGAKPGDKVS

SEQ ID NO: 4766 - protein, 373 aa, Acinetobacter baumannii
RKLMAKRYKVATIAGDGIGLEVLPEGIKVVKAAAEKYGIDLQLDAFDWASCDYYLKHGKMMPDDWFETLQGYDAIYFGAVGWPDKVPDHISLWGSLLQFRRGFDQYVNLRPVRLMPGVKCPLVGKKPGDIDFYVVRENSEGEYSAIGGKAFEGTDREFVLQEAVFTRHGVDRILRYAFEFANQRDAKKITAATKSNGIAVSMPYWDERVDAMAKQYPQIQADKQHVDILAARFVLQPERFDVVVASNLFGDILSDLGPACTGTIGLAASANLNPERKFPSLFEPVHGSAPDIYGKQIANPIAAIWSGAMMFEFFGEEDERCIQAGQDIMQAIENVLINGPKTADIGGQAKTYEVGDAIASCVAQTKMDVFAME

SEQ ID NO: 4767 - protein, 486 aa, Acinetobacter baumannii
EDDMSSLQSTELFQQQAYINGQWLAAQSNATVPVSNPATGEEIGTIPNMGAAEATQAVEAAYTALQSWKALTAQNRADILLAWHKLVLDHTDELALIMTIEQGKPLAEAKGEVRYAASFIQWFAEEGKRIYGDVIPTVNNQQRFIISKEPVGVVAAITPWNFPIAMITRKAAPALAAGCTVVIKPANETPYCALAIAKLAEKAGIPAGVINVVTGKSQEIGSVFTSHEKVKKLTFTGSTPVGRLLMQQCSSTIKKLALELGGNAPLIVFDDADLDKAVQGAIFAKFRNAGQTCVCANRIYVHDNIYQAFAEKFVQEVQKFKVGNGLEDGVQIGPLINEKAVLKAQQLIDDAVSKGAKIACGGKQHALGQTFYEPSVLTNVDRTMEIVQEEIFGPVAPLIRFTDEADVVAQANDTIFGLAAYVYSENISRLWRVSEQLEYGMVGMNATAISNEVVPFGGVKQSGVGREGSKYGLEEFMTIKYMCLGL

SEQ ID NO: 4768 - protein, 105 aa, Acinetobacter baumannii
SQLFVVWLYFCAKYIQIEISFLALKYLKSGNLINKTKRNEDHVMKKLMVSISVVFFILTTGCEMRTTSKQQPSNERAMSIAGSPVYEKDYKIPDLQANNHEQSNY

SEQ ID NO: 4769 - protein, 565 aa, Acinetobacter baumannii
NGRIRYGITPSKNGCMDMDNQNTKIYTDKFLAVTSLLFVFISVAGLAIYSQESIKIAATWMQWTTSVFTTPVLLFAFLAIIFTFGLAFSKYGKIKLGEGKPQYTTMSWIFMFILSGIGSSTLYWGFLDWAYYYQTPGLSLPPESAEALKYSVAYSFFHSGLSAWAIYALASISLCYSYHVRKNKGLSLASVIEAVTGFKSTGVVGRLVDLMFLLCMFGALTISLVLTAVTFTNILSQLTGIPNTFMTKVIIILAVSVLFALSSYVGMDKGMQRLSHMVCLGVVLFAIYVLCFGPTQFILNNSLMSFGLMATNFVDMSLFTDPMGDGKFTREWTVFYWLWWISYAPGVALFVTRVSKGRTIKEVIFAMVIGGSVGLWFIFGVFENYSVYSFIHGAVNVPQILSQQGGEVAIGQLLSLLPAGKLMMWIFLGIMVVFLAAHMDAVGYAVSATCTRGLSEGQDPSPNARLFWCVMLTLVPIAMIFSKAPLDTMKTATIVTALPFIVIILIQTYGLVKWLIQDYAKVPSHLIEQQGYDDQEIGLNQTQDEQAKRMQLELASSIKLDRKTS

SEQ ID NO: 4770 - protein, 64 aa, Acinetobacter baumannii
GAIMAVQQNRKSRSRRDMRRSHDALTENALTVDQATGETHRRHHVTKDGFYRGRQLFAKAADAE

SEQ ID NO: 4771 - protein, 378 aa, Acinetobacter baumannii
LIVMNINVVKVRLARELLLVHLVANDVIRLSTVGQRMTEQKNSSKTTALAQALLLEQVEFFKKQLSIENSPIYFRQFIQLFMQHADEIKLYEVVDLEQLQAVVKRYAFEMQLGAGLLEFIGEIAQRIYLSAMKSPVQLQDLVSDHQFEMWLSKFLEMEHIPHYLNQFLRTSPSVQQLCQYIATSTLEQKLPKFLTASRVDDYHFEWQHKLKKFSFLQQQRLEHKLETWIASFIHEQLTELSLLSAEDLESLVRHIWEDIRHKKIYEFMKQLTPLDVEEFFVLIYEYWKELRQSQFMQGLILYGVEVFYDFYKDQSLFEVLSAIGLSETDLQTEALRFYPKVMDAFNEHGILEPLLQALLAPFYQSSKTLDIIEKHFSE

SEQ ID NO: 4772 - protein, 417 aa, Acinetobacter baumannii
WQVMYLVRVIPQALVCRSERRLVELPEKMPPTMHFHKELNMNASTKALIPVVQLSDHEQEVQRALQICNACRYCESFCAVFAAMTKRLEFNQADIHYLANLCHNCGACLHACQYAPPHEFGVNIPKAMAQVRLETYQEFATPQPLGRLYKSVGIPFVSALSAIFFLCMLAVVWYKGTDLFAGYQGNFYAIFPHNFLALLFGATFTVAIVLLGIGISKFWRQTSKVIHSKVKKPDLVQATQNVLTLKYLDGGHGKGCNEQDDRYTQIRRVFHHLTFYGFMLCFAATGVATLYHYFLDLHAPYPIFSLPVILGTLGGIGLVIGPSGLLYLNLKRHPLHGDREQKPVDRGFIFLLILVSASGLALMAFRNTPYMALLLIFHLATVMTFFITMPFGKFAHGFYRSASLLKFAIEERISKKS

SEQ ID NO: 4773 - protein, 200 aa, Acinetobacter baumannii
GHSMISWLFIGLVATILLTPGPTNTLLASSGVQVGLKKSAKLIPAEVLGYVISISAWGMLIGKVSATLPLLPPILKLLSACYIIFLAIKLWHTANQQLELDQPTIRPRELFCATLLNPKALLFASAIFPVAAWTNFHIYLIHMLAYLALITPIALFWIFLGSVLAANKVRWLNQSNLQRTASLVLVSFSIPISYSALLNL

SEQ ID NO: 4774 - protein, 72 aa, Acinetobacter baumannii
SIPIIYSQFLVQKVLLVLLELLVVLLARYFSYQYLLQNQKDPFFSPHIIVYSKVIKLTLIVILEKRDTSAIN

SEQ ID NO: 4775 - protein, 210 aa, Acinetobacter baumannii
VNTMFESLIPLFSIAMALMLGAISPGPSFIYVAQNSISKSRKHGLFTALGTGTGAALFGFLAVMGLQAVLLAVPSAYLILKIGGGLYLLWLAFKIIKHAKEPIAMENDAKSKMTYKQAYRYGLITQLSNPKIAVVLASVFTALLPKEIPNYYYVALPLICFMIDAGWYSCVAMLLSSEKPRKMYLKAKTGVDRVAGSIVSVLGLKLIFFK

SEQ ID NO: 4776 - protein, 622 aa, Acinetobacter baumannii
IMAIPQHTIDQILDRTDIVDLIGQRVKLKKTGRTYSGCCPFHQEKTPSFHVYRDKQYYHCFGCQANGNAIRFLMDIDNRNFIDVMKELSGNTGVELPKDNTDNKKLSYTRQVTKPSTPPKTVAEPTTQAPIEDQYNTFEPVYFDDPFAQFEQPFSFDGPVQEGNLYDLLENVAQFYEHQLPTSQKAKNYFKQRGLSDQTIQFWRLGYAPEDWQHLEKAFPYDIEGLKQLGLIRSSDSGRDFDLLRDRVIFPIRDPKGRVVGFGGRALNDEIKPKYINSPDSEVFHKNQLLYGLYEGRKLKANDWLMVEGYMDVIALQQYGITGAVATLGTASNTEHLNILFKQNNRITIAFDGDAAGQKAARRTLEIALPLLNDGRELKFFVLPNDHDPDSLIRREGVENFQKLLQQAPLLSDFVFAHLTGQHDISTPEGKSLVMGELRELTELLPKQGSFRYLLTQSFREKLGLGKRFTPQISHDASLSFNIQTKDEDFAIAILMHHPFLYIHFEGLRAYIPQDELLAKILAILNRIFDELPDDQELATYYVLGACSTYCHEIADIMQRTNIQALTQAPEVADKLAKEYALGLQERYLRQKLKSKISLVESRNLRQQLNELTKQISLRLLS

SEQ ID NO: 4777 - protein, 195 aa, Acinetobacter baumannii
TSQISDMSKRQKIAAHNRDELLNAAEECFRIHGINVPLQVVIDHAGVGRATFYRNFCDRKALISALLERAITQLEQKAAHFQQFEDGLFRLIEGHIAQLPKLAILQDFWRVIDRQDPIMLKIYERRNNALKPLIENAIEQKLCRADLTADDYAMVTAMLGSSFQGHEPEEQTRLAKRAIELLFHGIQVQKIRGIE

SEQ ID NO: 4778 - protein, 196 aa, Acinetobacter baumannii
NDKIEKIAQNIKLMSLPEKHLSIVYHSPYGHTAKVASAIASGAEVMGVKVHVMNIEHIDWDVLDASQGIIFGSPTYMGSVTADFKKFMDSTSKRWKNRLWQGKLAAGFANSGGLSGDKLAVLQQLNIFAMQHGMLWSGLPLMTTGHTETDLNRLSSCLGLMTQSDNAPVEITPPQGDLDTAKWFGEYIAGLLYRLN

SEQ ID NO: 4779 - protein, 413 aa, Acinetobacter baumannii
YMPFLIFTTNRELLMSNSHVDVIVLGAGASGLMLAAHAAKRGRSVLILEKANKIGKKILMSGGGKCNFTNLYVEPDNYISHNPYFVISALSRYSNWDFIGLVCDYGIAYEERKHGQLFTLNGAKEILEMLVSECNKTNKVEIQTHCEVGQVDPLEQGGFSVHTNQGRFSCESLVVATGGLSIPTLGGSGFGYELAQKFGHTVFPTRAGLVPFTFSDHIKEVTTRLSGNALDVTLTNSKNSFTEALLFTHRGLSGPSSLQLSNYWNTGESFKIDFFPSQDLATYLKDKKKAQPKVLLRTLLNEFTAKSIVQELQQLIWPEQSETPIGNISDAQLDHIAEQLHGFTVKPSGTEGYRTAEVTLGGIDTTEVSSKTLESKKQKGLFFIGEVLDVTGHLGGYNFQWAWSSAYAAAQYV

SEQ ID NO: 4780 - protein, 194 aa, Acinetobacter baumannii
ICRIAALIMSANTFPAQIEPFKWAEQGFTWSGQLPLSRFARIAREAVGSIDNQLINIDCKLSMDAYHRIVWLDGHMETKVPMECQRCLEPVEMPIVSDFHIALVDDESLIERLDEDADFIVLGESESSTKGDFDTPASINLLALLEDELLLLMPLSPKHDACEHKHQPTIQNVVEEKRDNPFDVLAGLKGKLNS

SEQ ID NO: 4781 - protein, 293 aa, Acinetobacter baumannii
VFGMIERISLNSLKFFYFVAKYGSVTLAAKKLFVTQSAVSKQIYNLEEALNTALFDRKNKTLVMTKQGEILLSCCHQVFGQLDECLIQLSQPKTENKQLVLSCEPTLSMKWLIPRLSKFKKLGHDFEVVLLTAGGVVDFEKDNIDIAIRRNDFDWGEHIYSEKIADEYIALVQATKPSETNDLLISTSRPNFFKNITRIAELKQSLKGYTKIELEHFYLCLEGCLAGLGATVISIYMIEKELEWKVLQKNSPVVQDGSAYFLLSHSTFEEDPRKTIFLEWLKAEMNESQHKLL

SEQ ID NO: 4782 - protein, 476 aa, Acinetobacter baumannii
GQLMPYSLREFSFSTSLKFFLLFTIIITLCCFIGIASRPLSFLAFFWPANSVFLGLLLRFPQTRQIGSFAGAFTGYMVADLVNGTPLFLTLILTISNYLYVVTTLALAILFNRHIKAAYQGYSYLLLFALCGIGSITGAFFAATFVPMFNTKFMIGSFWAEFGYWVTSELQNALLLLPIILNIPPYLKIKTHLKGNRIYIKAIDFLPLFAVLISIGVSYYDSGPGSLLYPIAALIWCAIRYKPIIVALITSFTSAYIIYHVSGHYLLLYPQDYLSNNISIRIGLIMMTVAPLTVSSISALHSELIQKLQHAIAHDELTSSLTRRQFLQSVRLLQEKVQKENKTSAFFMLDVDHFKKVNDSYGHLIGDRALQTCVTTIQNILHPHDLLGRFGGEEFAIFIPDTTREAAFELAERIRIQISQQPIYVYGKLPIFVQVSIGISLYSPSYHRSIESLFKEADDALYQAKRQGRNRVFISL

SEQ ID NO: 4783 - protein, 171 aa, Acinetobacter baumannii
RKMMILTDKKPRVNVEGILTAEEIHEIEHHIGHYPYPRAASLDALKCVQRRNGWVDDAQMNAIAQLLTISVADLEGVATFYNRIYRQPVGRHVILLCDSIACFLMGAETLAEAFQRELGIQFGQTTQDGRFTLLPICCLGNCDKGPTLMIDEDTHGLVEVTSIKQLLEKYV

SEQ ID NO: 4784 - protein, 206 aa, Acinetobacter baumannii
GNKIMAEFIAVILITILAVVSPGADFAIVTKNSYLYGRKIGVFTSLGISLGVLVHVTYTLVAVTFVMTYTPQILNIVKYIGALYLIYIGYKTFTQKPVLDSAALTAIGTFQAIKYGFFTNALNPKTTLFVISTYTQIVSLTTPKTVLLAYGFFMSFAHFVWFSLVAMLFSSMLLRQKMLAKQVQINKVIGSLLCVLGVILLFTKFQ

SEQ ID NO: 4785 - protein, 632 aa, Acinetobacter baumannii
DARMSYLYLTVLFPLIGFILLAAGRDKLSENVAAIIGVGSVGLSALFALIAGMAFTSSGQQVFVQNLWTWFNVGGFAPGISLHLDGLSLLMMGMITGVGFLIHIFASWYMRGEEGYARFFSYFNLFVASMLLLVLGDNLALLFLGWEGVGLCSYLLIGFYYANPANGWAAIKAFTVTRVGDVFLLIALFLLYQQFGTLNTQYIVEHAAEVMTKSSSLTIWTALMLFLGAAGKSAQIPLQTWLADAMAGPTPVSALIHAATMVTAGVYLCCRLFSVFELAPEVMQFISVTGAVTLLVAGFAALVQTDIKRILAYSTMSQLGYMFMAVGAEAYQAGLFHMLAHAFFKALLFLSSGAVILAYHHEQNIFKMGGLFYKNKFLFACFAIGGGALAAIPFLTIGFFSKDAILGEVWVQGQSIALYNSLYWAGVAGAFLTSIYTFRLIWVVFFGKENTHYHEIKGATYWAPLGILAVLSTFVGAALKAPVANILNTAKIPEFHVAEQFVEGMHGAEHLAVGIALVGLAVGIGLFAFAYGAVKSFAKTSLGAGLAHICRTAFGFDALYDIVFVKPYLFFAKLFGRDPIDSLWLVLPALVKGGNSFTSSRQTGSLREYASSMSLGVVVLLMILIVIQVVGK

SEQ ID NO: 4786 - protein, 176 aa, Acinetobacter baumannii
LFFVLQSFLSLPIIDSYDRRFIMRGNPEVIDYLNMLIGGELAARDQYLIHSRMYEDWGLNKIYERIDHEMQEEASHADAIIRRVLFLGAKPNMHREDINVGTDVVSCLKADLALEYHVREKLATGIKLCEEKGDYISRDMLRQQLSDTEEDHTYWLEKQLRLIELIGLQNYIQSQI

SEQ ID NO: 4787 - protein, 214 aa, Acinetobacter baumannii
VTSVAIQEIRHPLIRHKLGLLRRADISTKNFRELAQEVTMLLTYEATKDLPVVDCEIEGWAGNVTTQRIAGKKITIVPILRAGIGMLDGVLNLIPSAKVSVLGLERDEATLEVRTYYKKLVPDVANRIAMIIDPMLATGNSLVAAIDVLKASGCKDIRVMVLVAAPEGIAKVEAAHPDIQLYTASIDNGLNEHGYIVPGLGDAGDKIFGSVQKD

SEQ ID NO: 4788 - protein, 99 aa, Acinetobacter baumannii
IIPVSGLSPRSPPMPPMPPIMPVIGLKISPSPPIPPMIPVIGLKISPSPPIPPITPVIGPKISPVPSPPINEKELPNTLIGVVIGATTSTSSPLPLPMP

SEQ ID NO: 4789 - protein, 311 aa, Acinetobacter baumannii
GCAVMSEKLQKVLARIGLGSRRYMEEVIAAGRVSVNGRVAQVGERIEPGDELRIDGRKVQFQIEDEIRRRVLIYYKPEGEICSRNDPEKRPTVFDHLPQIANDRWVMVGRLDINSTGLLLFTNDGELANRLMHPSNEIEREYAVRVMGEVTPQLRQNMVNGVELEDGPAKFESFSEIGGEGINRWYQVVVKEGRNREVRRIFESQGLKVSRLLRTRYGTVILPRELRTGRWMELDKTDIDNLAKSVELKPRQGTGLFGMAKRRTERMTEKPMAARRGGYLRQQRRDDEKEAPANTGNQRKSTGFNRGFKKF

SEQ ID NO: 4790 - protein, 409 aa, Acinetobacter baumannii
MKRVVITGMGINSCIGNSLEEVTHSLKNGISGTRFNPTYAELNFKSHVSAAAEQDFDNIDRKLKRFMGVCAMYAYNSAVAAVEHAGLKAEDLADNPRYGIAGGSGGGSTASVVEMTELLETKGARKVGPFFVPRNMTNTITANVGVAFKLQGIAHSIASACATSADAIGYAYNLIALGKQDLMLAGGGEEDHWSQSLLFDAMGALCSKYNDTPETASRPYSKDRDGFVIAGGGGFVVLESLEHAQARGANILAEVVAYAANSDGADMVAPSGEGATRCILMALEEAKQHGVDKIDYVNTHGTSTPAGDVTELKAMERAFGEGKVPPLSSTKSMTGHSLGAAGVHEAIYSVLMLQNDFIAPNINVTELDEGTEGFDIVLEKRDTKLNTVMSNSFGFGGVNACLIFKKWDA

SEQ ID NO: 4791 - protein, 282 aa, Acinetobacter baumannii
NILVLVKKCYLKHHGLKILRSWLMFYVQKTLHIKDWYMEFVQGLPQGVFVGQTRVQHPLALPTELTELTGFNLALHVKDEAQRVQQHRMMLLDEFAQFGVKKMTWMTQTHSTICHTVNEQIPFTALIGDGLITQTQGHALMMMTADCLPVVLGNAEGTEIANLHAGWRGLPGGIIENTVAAMQSPPTWAWLGAAISQPCFEIGAQVKTAFCSKYPELETAFIDGAAPNKFHADLYAIARFILQSLGVEKVLGGDQCSYQQQDEYFSYRRDAKTGRMATFVFM

SEQ ID NO: 4792 - protein, 69 aa, Acinetobacter baumannii
LLSVCCTLVAKGPILHAHKITKIPIISTPNIHNRVERFVGISLLAGAGAGAGAGAGAGAGAGVGSLLDV

SEQ ID NO: 4793 - protein, 197 aa, Acinetobacter baumannii
LNTVCKDRLHSSGIVCLSQFLHVLITLNKDVEDMKRSLLFLGILSLTAGAQVSAADLSWGDPTLDSGQFKVSGAVRSRYLHKDYVVGANEGSQNDDWRLTDIKLVLGYENPNWIAGADARCYQYDRLCDAIFLKKAWVGYKLSDQQRVTAGLQPVDFGFGEFWGSSYYETLLNTVGLEDIDNLGIKYKFADDKYNLT

SEQ ID NO: 4794 - protein, 190 aa, Acinetobacter baumannii
GGKVMKKHFSLMLAVVTVLFLAGLVMKNEWHLHQSKSIFIKLKPVDPRSILQGDYMALAYELNLQSLKALTGSESEALDQVIFNHASVPAKVILDSRNRVIRTVLDPKSLSNEQNLILKNPDNHYQSLYPASRSFLFAEGLAHCYEKAKYAEFKVNTKGEAILFDLRGEELQPLNCKQQQSWWKGTVRSL

SEQ ID NO: 4795 - protein, 318 aa, Acinetobacter baumannii
LTKVKVEFAVELKQLKYFIAVIESGSLGKAAKNLDIGTSALSQQISKLESELSIRLLQRTALGTVPTPAGLAFFQQVQLALRHLDHAVDSAHSSRLSGHVTVGFSPSVAAVIGTHFLNLMRNRYPDIKVRLIEGLSGDLKALVNARQLDVAIIFSDDVDPQWAIQPLVKEQMFLISPKEVLSQYDLESCIDTQTITHSQLKELPLILPSQRHGLRLLLEQKIHQLRVAYEIDGLHLLMESISQLEMATIQPAGASLNSRQDLCLLRVVEPAIERINYLISLSEEELSPATLATKVVIRACVANLINEKRWPGAELINT

SEQ ID NO: 4796 - protein, 319 aa, Acinetobacter baumannii
KDLFMRRSIPSIQGLICFESAAKHLSYTYAAQELCITQSAVSRQIQQLEDFLGVELFIRTRHGVELTIAGQQYFKSIKPYLLGLEKCTADVISHKGLGGTLKLGVVPTFATRWLLPKLHLLNQKHPEITVHLETSTKPFLFNDNIFDAAIFAGTQQQIDHWPGIQAHYLMDEEIVPVCSPRLIEKYFPDAVMINENTYDLSPEDLLKIPLLQQTTRPSIWQEWFLTHHMQHPKPFDGQRHELFSMLAVAASHDMGMALIPQMLIESELQKKELVIVSNKKLKGSRKYYLIHSSQDISPTIQKFVEWIYQELEQLKSNTN

SEQ ID NO: 4797 - protein, 186 aa, Acinetobacter baumannii
MNLFTSKTMFTLNAFKLVIYRQFIIFTLFIFRHLKSYPIRFLTPEEKALAQRVFGSLLDCERPKIIATRYLPWQAHGILMAPNGNIYVNLSDYSSNYALESKFIQGIFIHELAHVMQYQRGIHVLLKGALLQSAYYLSFKYYNPYKYTYHPQKAFSSYNIEQQGEIARDICSGKLPNIICLPRLDL

SEQ ID NO: 4798 - protein, 60 aa, Acinetobacter baumannii
ISSFSPVEPNGLFTGGCDGFTCAESAGFASDETVVDGAVVVVDGVETVDELPVVLLLVGG

SEQ ID NO: 4799 - protein, 314 aa, Acinetobacter baumannii
ANTFIMEIKQIKYFLTVVESGSIGKAAQKLDVGASAISQQISKLEQELSIRLLQRNAFGVTPTPAGLAFLKHSQLILRQVNFAVDAAHSARLSGHVSLGFPPTITALIGIPLMKLMSERYPDIRLEIVETLSGNLIQSINSRQLDIAIIFTNEIDKQWSIQPLVREQMYLMARKEVLEKYGLSECIKSGIIQSQQIGDIPLVLPRQRHSLRKLLEHKIGQLNVVYEIDGLHLLMDSLIHLDLASVRPGSACLQEYKHKLQLLKVVDPEVERINYLVSLAEEELSPAALAAKSAIKACVKELIQNQIWPCSEIIL

SEQ ID NO: 4800 - protein, 205 aa, Acinetobacter baumannii
ILAFRPMSETLPDPRKRPRQARSVATFEAILEAAARILESLGFAGFNTNAVAELAGVSIGSLYQYFPSKDALIIELIRRERAKLSTHIVEAIQQNDAADLKEKLKLIIQAAVQHQLSRPQLARTLEFASELIGKNSEESEHQHELETIISDLFICSGISHPQTAAQDVIALSKGIINAAGIAGESNLNDLQQRVEKAVFGYLDLD

SEQ ID NO: 4801 - protein, 235 aa, Acinetobacter baumannii
QIQFNLGFDPTDGGNYKGTSKDSSRYSGNFVEADDLTTGTNIEEKNMWIARASRKFELDKAQKFSTELGGSVWYSDLENKRTDEDGHRKSWNVFAQTQYQAWQWMFLAGKQDVTNGDNLLPNSSTIGAFDYPYQVANKGKYLVNEINYTFAQPFHKLENIKPYISHSRFFKDEDGYKDSERLIAGVYFNYKAIGIQGEYIMSKNDPMVGGGANGLAQGSSNDWDKLFYLSIGYYF

SEQ ID NO: 4802 - protein, 562 aa, Acinetobacter baumannii
ITISWYSSTKNSRDRMSKTPRYLETPPDWTPEEQPTLPGSPAAIAHSVPKRFLYFFIGLFVAISASSSNGFITANLPLIQGEYGLTPSEAAWLPAAYVMANVSSNLILFKARQQYGLRVFSEIGLVIFIAVLVLHIFVHTYEMALFARVVAGLAGAPLSSLGMYYTMQAFKKADMAKGIYIAFGFQQLGVPLAWIISPFLVSTDSWSVLYTFELGLALCCLAMVVSLKLPRSLRIYVFEKQDFFTFALLAPGFACLCIVLTQGPILWWFNSEWLAYVLIAGFSLVVLGLLYEHYRANPLIMTRWLGASSTLRFIFGAFAIRLLMSEQSYAAVNFLKTMGMGPDQFVPLYVVILVGILSGTLFSALTFSRERIIFHLLFAEFLILIACGLDYHLTSDVRPSNFFASQFLVGFAGGLFIGPLLLIGFAQTLAKGPSYVVTFIVLFSATQTFGGLVGSSFFSTYQQHRTQNYQVEIIKDLEQADPLVAQRLSTYQRSAAITTNDPALQTAQSMRSLNQVVTREAQVRAYNDVIALNGIFAVALLLWGGFNIARSKYLQRRGISRP

SEQ ID NO: 4803 - protein, 256 aa, Acinetobacter baumannii
YIISINLSLSVHMKLQNKILLITGWGVGIEPLHALKLGLTKAGYDTQLINIFNVLSCDFHEQLDFLTDIDVVVGWSLGGQLATYLVDFFYKQTGQTKTLITLASNPCFVANTSWHTAMPADVFSQFKASFLQNPQATLKRFYYLITLGSSQAKQDWLSVQNIANPPTNELLLEGLQMLEQLNLVDNLKTYSGRQLHLFAEQDNVIPCKIMENFKDIATENMGYKLLKDATHAFPYLQVERTIEEICQFLTIHQQSS

SEQ ID NO: 4804 - protein, 63 aa, Acinetobacter baumannii
MMISENLLKTEKKLNQIFEIHQKVLHLPLYDLYQLTYHIYLILKFAYKDFYLSQILPLIKLFL

SEQ ID NO: 4805 - protein, 323 aa, Acinetobacter baumannii
KKDSNMASHYEMFPAVVTRVEQLTPLIKRFTFKRQDGQNFPRFSGGSHIIVKMNEQLSNAYSLMSCTQDLSTYQVCVRKDVEGKGGSVFMHDQCNEGCEIQISEPKNLFPLAETGNKHILIAGGIGITPFLPQMDELAARGADFELHYAYRSPEHAALLDELKQKHAEHVFSYVDSEGSMLNLDELISSQPKGTHVYVCGPKPMIDAVIDCCNKHRYRDEYIHWEQFASTVPEDGEAFTVVLAKSNQEIEVQSNQTILQAIETLNIDVECLCREGVCGTCETAILEGEAEHFDQYLSDAEKASQKSMMICVSRAKGKKLVLDL

SEQ ID NO: 4806 - protein, 131 aa, Acinetobacter baumannii
PGGSTMSLSQKEIAVRFLELAAAGEVDEAYGNYTAPNFKHHNPYYAGDKTSLKEGMRESAIETPNKVLEVQHVIEDGALVAVHSKLEMQMNDKLTILAVVHICRFENGKIAEFWDIGQIQPDPLVNENGMF

SEQ ID NO: 4807 - protein, 259 aa, Acinetobacter baumannii
FHNSSEGNAMRISDQVVMKLQALIEERHMKKGDRLPAERQLATSLGVSRPSLREAIQQLNSQGVLISRRGDGTYIQQLPEQWPQQLIVNPISNLIEEDPLYRFDVQEARLVLEGGTAWYAALRSTPEDRAKIHHYFNEISRHQNAGDSAQAAVADAEFHLAIAEASHNVVLIQMMRSLFDLLQYNVLLGRKKVYNDPVNGDLLSEQHFQVMDAIDRKDPEAARQAVCGHIEFVINHVRSLDEDEARQKRANRLNRVDSK

SEQ ID NO: 4808 - protein, 157 aa, Acinetobacter baumannii
NSRLCGCPLRSTSSSRSNESIKMTAVIASSKAKPLAEQWKGEITSGRHQYFCDEPEKLEGHDQGPAPYDLLTGSLAACTLITLRMYAKHKGYDFGEYSVEIDFHTNREHEEHIERRIVFKELPNEELQQKILTICSKTPVTKTLLRSLDIHTVLVTA

SEQ ID NO: 4809 - protein, 566 aa, Acinetobacter baumannii
AMISGHPSKHPLYIPYAGYTLLELPLLNKGSAFTQEERSNFNLHGLLPHIIETIEEQSQRSYQQYCAFNDDINKHIYLRNIQDTNETLFYHLIENHLEEMMPIIYTPTVGEACQRFSDIYRRHRGVFISYPDRDVIDDILQNVNKNNVKVIVITDGERILGLGDQGIGGMGIPIGKLSLYTACGGISPAYTLPITIDVGTNNPQLLNDPIYMGWRQPRISGDEYYDFVDMVIEAVKRRWPKALIQFEDFAQKNAMPLLEKYRDKICCFNDDIQGTAAVSVGSLIAASRAAGKQLKDQTIAFLGAGSAGCGIAEQIVAQMVSEGLTDAEARARVYMVDRFGLITENQPNLLDFQRKLAQKAEVVDQWGNIEEVISLLDVVKNAKPTVLIGVSGQPGLFTEEIIKTMAANCERPIVMPLSNPTSRVEAVPADIVEWTEGKALIATGSPFAPVNHYGKLYNISQCNNSYIFPGIGLGVVASGAKRVTENMLMASSSALADCSPLLKDPQADLLPPLGEIQQVSKVIAFEVAKAAMADGVAVTISDDLLKQKIDQSFWKPEYRKYKRIPF

SEQ ID NO: 4810 - protein, 149 aa, Acinetobacter baumannii
KRSSAKLVKHLCCEWIKMSQTSRLIDRRLAKALVFLQACMIPVSALVAWSIKDMTAALSAALGALVCWLATSYFAWQSFRTAGARASKQVLSNMYRGMLGKFAIMIVGFILILSNVKPLSPLALLFGFILVQAMSWVAPFWVSRLQKRV

SEQ ID NO: 4811 - protein, 265 aa, Acinetobacter baumannii
QSTSALQHSLLMSDVANVQVYVCPILRVPDNHLILSHYLSFLNAAEKLRYDQYHSHAARLFLISRVLMKSVLSDKLGILPHEVIIQLQPNGKPFVRGNKTIYFNLSHSADFIVFAVTEKGEIGVDVERMDHEFEWRRVDSVLAPSEIEWIQQNEWTNPTSVYQRFFQIWTLKESYIKCTGEGMSRHLKKLNFHVSPEHIQFCDLTNNDVQRTEQYHFKSYIYNYSFIFSLCLQQSHCLESFNIDCFQLLPYISTHRITLEPCEHN

SEQ ID NO: 4812 - protein, 422 aa, Acinetobacter baumannii
LLRSIFVVFIEIRMERVVITGMGINSCIGNTLEKVTESLKAGRSGIRYNEVYAKLNFRSHVSATAEMNFENINPELKKHMGVCAMYAYNSALDALQHAKLDVTDIANNPKYGVIGGTGGTSTASIIDMLHTLKEKGVSEVSPDLAPRYLTSTISSNLSRAFNLKGVSQSVASACATSADAIGYAYHLIAAGKQDLMLAGGGEEDHWSQTAIFDAMGALCSKYNDAPETASRPYSVDNDGFVIAGGGGMVVLESLSHAQKRGAKILAEVVGYAANSDGVDMVAPSGEGATRCIKLALAEAKQNGSDTIDYINTHGTSTPAGDIPELLAIERAFCSEKVPPLSSTKSMTGHSLGAAGVHEAIYSILMLQNSFIAPSINITELREEAKKFDIVQTSRETELKTVMSNSFGFGGVNTCLVFRKWEE

SEQ ID NO: 4813 - protein, 137 aa, Acinetobacter baumannii
CVLSLPVFNLLIRYKEIRMSNSDIQKINTNEVMSAVTVFNKVVYLSGQVPKNTEQDVAGQTREILATIDELLALANTDKSRLLSAQLYLKNLSDFSTVNAIWVDWLKGCVAPSRATIQADLVNPDWLIEIAVTAAQK

SEQ ID NO: 4814 - protein, 599 aa, Acinetobacter baumannii
KSMSLTSNLRQFQSAARLEQILGSVHDTNNDFSWSAAIERDEKEQYPQRAVDFLNAVGMNRFYVPSELGGRMEIGEELLYLHRVLARRDLTINSTYSTNAWSVIVWIGGNANQCQNIANRILSGAAPALAYSEKAHGADLLSSEVTAQPSDSKYVLNGEKWSINRATLGDSLSLIAKTSNDRGPRSLSAFWLDKRHMASKGTYSLNRLPTVGMRGLDISGIGFNNAEIHKDALIGEEGQGLELGLKTLQVTRAYCSSFSLGAGDTMLRIATEFAIERELYNKKVISIPLVREQLATAYAYLLAAEVLSLVGARGLHVCINQFSTWSPIVKVLVPEYVESLAKITSSVLGSRFFLRNAYADGMFQKAFRDHLIVSVFDGSSTVCLDSLSFQLKSANKGRSKKADHLNQAEAKARYRQLYDLQVETGAIDFRELEIFNRDGDLVMESLETIIEMLNDSNVTVGLSAETLATLHERANQLLVEQRSLDQKIQDYFSNSEQSKEFETMRFSLARDYAELFARIAVLGFWVFNRHGLRPALQDGAWLIIFLNAAEGQTAPPMTSLRESTLADLLDRISTNHMLSVIDFALAPRDAKPVKKEITP

SEQ ID NO: 4815 - protein, 113 aa, Acinetobacter baumannii
CKSLPLRPTVQSAVLPATCPLSATDFFGLKPVVVSFELIRLSFPIYLNLFIKHDGVVPFSLLISGLTFGSTYFCFGKSRQNHCHLQNSSTTIEYPIYRRTNFKKCSPASNSCR

SEQ ID NO: 4816 - protein, 457 aa, Acinetobacter baumannii
IMTTLTCFKAYDIRGKLGTELNEEIAYKIGRAYGQIYKPKTVVIGCDIRLSSEDLKQATIRGLNEAGVNVLDLGMTGTEEVYFAAFHLDVQGGIEVTASHNPMDYNGMKLVRENARPISADTGLKEIQALAETNNFEEVSQKGTTQSYNILPEFVDHLLTYIEPAKIRPLKLVVNAGNGAAGHVIDAIEEKFKALNVPVEFIKIHHEADGTFPNGIPNPILIENRDSTRNAVLEHKADMGIAWDGDFDRCFLFDEKGQFIEGYYIVGLLAQAFLIKQSGEKIVHDPRLVWNTFDIVDEYKGVAVQSKSGHAFIKDVMREHNAVYGGEMSAHHYFRDFAYCDSGMIPWLLTIALLSETGQSLSTLVENMIAKFPCSGEINFKVADTQTTIQKIFDFYADQNPQIDRTDGVSLDFGAWRFNVRASNTEPLLRLNIESRADRQAQPMQYYVDELTGLIQS

SEQ ID NO: 4817 - protein, 275 aa, Acinetobacter baumannii
FRSTTQHYRNFGEMPAVPHSSLNPVLIQLEQVSVHRDQRDILKKVDFALHENEIVTLIGPNGAGKSTLIKVLLGILKPSSGRVISNKKLKMAYVPQKFNPSHSLPLRVQDLLDLEKCSPAFRQEIIQDTGIAKLQQSKVQQLSGGERQRVLLARALLRKPDILVLDEPMQGLDIQSEAELYEYVRSLPERYGCAILIVSHDLQWVMQGTQRVVCLNKHICCSGLPESIQQHPEYQAIFGTQRVFYQHHHDHCAHGDAAHPCPHNSRPHIHPEPEA

SEQ ID NO: 4818 - protein, 111 aa, Acinetobacter baumannii
KLSTLIESLCMKQHQYHVTVQHLKDAKGEVSTYTKRLEFYTGNHDDIFEIVEKLKNAEFFDDQTTKSFAVGLKLFSEVMLENRDHPLFQEFLPQFGQFMKNLKQQVKTQSP

SEQ ID NO: 4819 - protein, 462 aa, Acinetobacter baumannii
KDKTRKSKKDIMMQTIHGNGSHPKKSSHRLAGISSMVGTTIEWYDFFVYGAAAALIFNKLFFPNLDPLTGVLAAFATYAVGFIGRPLGGLVFGHFGDKIGRKSMLLLTLMLMGIPTVLIGLLPTYESIGYWAAIGLVILRFIQGMAMGGEWGGAVLMAVEHAPEGGKGFWGSLPQASTGGGLMLASIALGLVSLLPEQALFSWGWRLPFLASIILLAVGWYIRVKVPESPDFEKVKQQSEEVKVPAFQVFKNHPKQLITIILARAAENAWFYIASTFTLAYTTTQLGIPRQDILFATICGAAVILFMTPLCGHLSDKVGQRNMFMFGLCVLALYSYPFFSMLNTKDPVLVWTAIVLAIGVVFPIMYAPQAQLFARQFPAEIRYSGISISVQLAGVLGGGLAPMIATKLLSIGQGNPYLIMFYIGSMAVVAIISTSFMPRDWSYKKDETYYKKANLNLKTKID

SEQ ID NO: 4820 - protein, 633 aa, Acinetobacter baumannii
FSETSRKKLNESVKCTPLTHRKFAIFDVFLRHLFSIDMNTAIQAALDHAVQTLQQEGVLPSDWNNSSNLTRTKDRSHGDFASNIAMIGSKAAGMKPRDLAEKILAALPEVADISKAEIAGPGFINFFLNADQRFAILDQIQAQKESFGRSQSNAAKKIQVEFVSANPTSSLHVGHGRGAAYGMTVANLLEATGAKVDREYYVNDAGRQMDILATSTYLRYLELLGQNLVFPKNAYQGDYVKEIAQGIIDKDGDAYVREVANVYKDVPEDVQYAEELDSEGNKVVLSGDKEKHIDGLIANSQQLLGEGYRVFHQAALHAILDDIKDDLADFGVTFNQWFSEASLSAKIDEALETLNQRGFLYEKDGNIWFKSTEFGDEKDRVVKRRNGQTTYFASDIAYHLNKLQRGYTDLVDIWGSDHHGYISRVKAAIDAMGYDSKKLTVLLVQFVSLWRGGEMVQMSSRSGQFVTLRDLRKEVGNDAARFYYVMRKSEQHIDFDLDLAVSQSKDNAVYYIQYAHARICRMLEKAASTGLQFEVSAARSHAARLSLDAETEILAKLAAYPDVVLRAANAYEPHQVGNYLKELAALFHGWYNEHKVLSDDAELTQARLLLSINVQQVLRNGLELLGVSAPEAM

SEQ ID NO: 4821 - protein, 172 aa, Acinetobacter baumannii
EGRTTMVTIEHAFLIPAKIDKVFTYLANPANDAGWQLSCKHSELLDSTPRVGSKYEIGFSFIGREMSFKGEITHLVPNELYAFKVVEGPFHYTGTYRFKPHPEGTWIEWVFEAEPGSFFGVLPPALLKKMVLAQFKKDVDNLQALAQKGEAYESVGNENKLTIEGTVANSRW

SEQ ID NO: 4822 - protein, 469 aa, Acinetobacter baumannii
IEETAMSSGRIIQIIGAVIDVEFERTSVPKIYDALQVDGTETTLEVQQQLGDGVVRTIAMGSTEGLKRGLTVTSTNAPISVPVGTATLGRIMDVLGRPIDEAGPVATEERLPIHRQAPSYAEQAASTDLLETGIKVIDLLCPFAKGGKVGLFGGAGVGKTVNMMELINNIAKAHSGLSVFAGVGERTREGNDFYHEMKDSNVLDKVAMVYGQMNEPPGNRLRVALTGLTMAEYFRDEKDENGKGRDVLLFVDNIYRYTLAGTEVSALLGRMPSAVGYQPTLAEEMGVLQERITSTKSGSITSIQAVYVPADDLTDPSPATTFAHLDATVVLSRDIASSGIYPAIDPLDSTSRQLDPLVVGQEHYEIARAVQNVLQRYKELKDIIAILGMDELAEEDKLVVYRARKIQRFFSQPFHVAEVFTGAPGKLVPLKETIRGFKGLLAGEYDHIPEQAFYMVGGIDEVIAKAEKL

SEQ ID NO: 4823 - protein, 292 aa, Acinetobacter baumannii
FMAAEEHALTSTEYIKHHLTNMTYGKMPDGTWKLAETAEEAHSMGFTAIHLDSMGWSIGLGVIFCLLFWIVARAANAGVPTKFQSAIEMIIEFVDSSVRDTFHGKSRLIAPLALTIFVWIFLMNLMDLIPVDWIPQVAAFVGANVFGMDPHHVYFKIVPSTDPNITLGMSLSVFVLILFYSIREKGVGGFVGELALNPFNPSNPVAKALLIPVNLILELVTFLARPISLALRLFGNMYAGELIFILIALLPFWIQWALSVPWAIFHILVITLQAFIFMMLTIVYLSMASEKH

SEQ ID NO: 4824 - protein, 131 aa, Acinetobacter baumannii
FMDAHLLTKIIHMTAVAAALMVFVLRASTLFIGVQGEQPNPAGRKVLVALQHLSFTVVFITGAILLVMKNFQVQPWFYAKIILFLVLLSSLMKAFKKDDTILLAQRRAGLVISAIAFVAIIILVIVKPVFA

SEQ ID NO: 4825 - protein, 71 aa, Acinetobacter baumannii
VDLYPDRIIAVLDSMGVICALGDLPHSCNHVAGIHLYDAYHRLLEHGKRKTLMVLPNCQTMVGLNFFNLIW

SEQ ID NO: 4826 - protein, 203 aa, Acinetobacter baumannii
WAAYTQFFDEVFPSFGFSINGISEDDSMALLPILSFPDPRLRTIAKPVEEVTDEIRQLAADMFETMYAAPGIGLAASQVDRHIQLIVMDLSESKDEPMVFINPKVTPLTEETQPYEEGCLSVPQIYDKVDRPSRVKIEAINLEGQAFEIEADGLLAVCIQHEMDHLNGKLFVDYLSPLKRQRAREKVEKIVRQREREKVAVKR

SEQ ID NO: 4827 - protein, 200 aa, Acinetobacter baumannii
CGNYMIESWFFVLAMLAVLLIPGPTNALLATAAHSQGLSKTFWLIPMEWLGYAYGISFWAVFIHLADPVWPALLLILHITSVLYVFWMAFRLWKTTHLQQFSQNHRNIRPRQLFFSTLKNPKSLLFAAGIFPAETWNSPENFLMVLAAFTLILIPAASFWMFFGRALLTGSMKKIKADHLYKGSAMLLILCMLPVVFRFF

SEQ ID NO: 4828 - protein, 91 aa, Acinetobacter baumannii
KGDYPMNKDKAYWSAIIRTLVAKEMRVEPETIDPDQKFTSYGLDSIVALSVSGDLEDLTKLELEPTLLWDYPTINALAEYLVSELQQGVAS

SEQ ID NO: 4829 - protein, 143 aa, Acinetobacter baumannii
GDHLMATMQCDVVSVKESIYSGAVTMLIAKGAGGELGILPGHAPLVTLLQPGPIRVLLENGTEEIVYVSGGVLEVQPHVVTVLADTAIRADNLDEAAILEARKNAEQLLANQKSDLDSAAALAALAETAAQLETIRKIKNRAQ

SEQ ID NO: 4830 - protein, 231 aa, Acinetobacter baumannii
CTHHLNTFDGGVSRLHGFKSQRGADYPFQFAMIAFNHVVPVLNLSVFNVRRAPAFAFEQSKRATIGGRFIRVDESRDLPLLHVVEDFTQKPVCSFAVTTGGEIKIDSAAPAVDGPVQIRPAAIDLHVGFIHVPRAKIGRVTPVPAQPFFHFRRITLNPAVNRGVIDIHSAFSQHLLQLTVTDAVFAVPAYGPQNDVTLKMPAFEWVHVQLHQQKGMISLSPPTICNSALDS

SEQ ID NO: 4831 - protein, 112 aa, Acinetobacter baumannii
YRSQLRPQQKLLLFMQIEAAHVLAGVGKVAVAQSKHAGKLVDTRLSELVYEQAPLLRRIQVVKPNWHKRYNIDTDGSHHGDHDGQVLAPVRYDAGDVNGAWHVTWLPSVLLV

SEQ ID NO: 4832 - protein, 576 aa, Acinetobacter baumannii
MDDQKETIMQTFSPKAVIERLQNIVGRSYVLTDDQSTRQYRQGRRFGEGKVLAVVVPGTLLEQWQVLQAAIEADCIVIMQAANTGLTGGSTPYGDDYDRPVLVMSTRRLKGIQVIHDGKQVICLPGATLDNLEQILKGYNREPHSVIGSSCIGASVLGGVCNNSGGALVRRGPAYTELALYAQVNAAGQLELVNHLGVNLGSTPEEILTRLEKQQYQAVDILDDSEKQASDHRYAHDVTQVDEDTPARFNADPSRLFEASGSAGKVCVFAVRLDTYEKVESSVFYIGSNDADDLTAIRRYLLTSLPSLPIAGEYIHRDAYLIGEKYGKDTFLFIEKFGTANVPKAFAMKDKVDGFLEKFKIKGLTDQILQAITFFLPSHLPKRMTEYRDRYEHHLVLRVENNSKAQTEQFLKEYFTVHQSGNYFVCSEEEGRKAFLHRFAIAGAAIRYRDTHRSEVEDIVALDIALRRNDREWVEQLPAEMEKKIIHKLYYGHFFCHVFHQDYILKKGHDPLEIEHQMWKLLDARRAEYPAEHNVGHLYIAKPALANFYQKLDPTNSFNVGIGHTSKLKYWGKAKS

SEQ ID NO: 4833 - protein, 334 aa, Acinetobacter baumannii
KILFYAFSLFRFYLRLTKKSLTTNANSCTIVVQICTGTITKMKVDWDHLQFFLVLARTKTLTNAARIIGVEHSTVARRIQALELALGTTLFKREATGYELTLEGMALVPRVEQMEQAFLQIEKPHQPLQGRVRIGTPEGFGTAFLARLLAEFSIQYPLLTIDLIPVPKMIKLSHREADIVVSIERPTSGPYIITRLSDYCLKIYGSQNYLAQNPPIRRLEDLTQHRFVNYIDDLVYSPELYCLERLPLKLNANFRSSSILAQQIAVSAGAGLAILPKFLADDKPELEEVLEQQVRFTHTFWMLTFVDLQHEPRIKLVWDYLRKQADKYQHLLVD

SEQ ID NO: 4834 - protein, 707 aa, Acinetobacter baumannii
KMPHSKFLLQPLWVAMLAVSHSGLVFAKSEKNDADTNTLHSLAPIVVTAQQGNDANGLIVHADPKQPIQPVPATDGADYLQSIMGFNSIQSGGTNGDVTFRGMFGSRIKILTDGTENLGACPNRMDAPTSYISPESYDRISVIKGPQTVQYANTGSAATVLFERQPEKLTSEKPYRGQASVLLGSYGRIDHNVEAAVGDEKKYIRLNANRSESNSYQDGDGNTVPSAWKKWNVDVALGFTPDENTWVEITGGKSDGESLYAGRSMDGSQFARESLGLRFEKKNITDVIKKIEGQVNYSYNDHIMDNFSLRTPPLVEMNHGGMTMLMPNAMAMQVTRRTLNSRLAMTSEWNKLSLITGIDSQFNKHGGSMSSPTMPSMNIPYRQDMRFQSYGAFGELGYQWSNLNKLVTGVRLDRVTVEDERADSQAKGFNTKLEKTLPSAFVRWENQRPDLDFKSYIGLGYVERMPDYWELFSPEHGNAGTTNTFNGVNPEKTLQLDLGFQQQHGALNIWASAYAGLVDDYILMNYHDHSHLHPNEHGGHGSHGITPGAKNVDATIAGAEAGIGYQFTDRIQADLSAMYAWGKNTTDDKPLPQISPLEGRLNIRYVADKYNLGLLWRAVAEQNRVSLHQGNIVGYDLKPSKGFSTLSLNGSYNLRKDIDVSVGIDNVFDKTYTEHLNKAGSAGFGFASEEQFNNIGRNYWVRMSMKF

SEQ ID NO: 4835 - protein, 332 aa, Acinetobacter baumannii
MQLQMAMVNLPSCSCIDISMLLTKLLSKHCYKHKENITMAKQSAGQLFRDAVAQEKPLQVVGTINANHALLAKRAGYKAIYLSGGGVAAGSLGLPDLGISNLDDVLTDVRRITDVCDLPLLVDADTGFGASAFNIARTTKALIKFGAAAMHIEDQVGAKRCGHRPNKAIVTQEEMVDRIKAAVDARGDDSFVIMARTDALAVEGLQAAIDRAGAYIEAGADMLFPEAITELDMYKQFAQKTGVPILANITEFGSTPLFTTEELASADVSLALYPLSAFRAMNKAAETVYETLRKEGTQKNVVDIMQTRKELYERINYYAFEDYLDNAFAKKK

SEQ ID NO: 4836 - protein, 293 aa, Acinetobacter baumannii
VKLHTVKKYVEGNMLTRVVFNQKGGVGKSSITVNLAAISAKHGLRTLVIDLDPQANSSQYLLGEEATYAADKAVLEPNIENFFEDVLGNNQQKGLIGNALGSILKAPRNKDLDSFVHSTSFAKLDVLPASPTLGALEHALESKHKIYKLRDSIQSLVGRYDRIYIDTPPAFNFFTLSALIAADKVLIPFDCDVFSKRALQTLIENVLETQDDHNDRLEIEGIVVNQFQSQAKLPREVVQQLKDEGLPVLNSMLPPSILMKESHQKNLPLAHLAPEHKLTQSYEALFSEIEPKR

SEQ ID NO: 4837 - protein, 425 aa, Acinetobacter baumannii
EMTQGAYWVFVCCSSFMLLQHTYADDSEMSFVSQNSARLDVWSSDRDLSSLKNIGQASFWSNGTLKFNPAFKLHYDIVVSDETDHTVNPDQVSKVNRNLRELYASYNWDQTFYLDLGRQIVVWGRADGINPTDNLSPRDYTRLVPDETDQRLGNDAIKLTYIPESGTNKWTALWYPRSRSDVIPLRQIAGVQYDIDRKSRPAFAMRWDYSVDGLDVGASYFSGLDHMPDLSVLSASPTGEVTLQLKNNPMSVYGVDFSYNHNDLVWRGEAAYTKTDSNGSEDLTHKKNNLTVVMGPEWSLKNSTLSLVGVYKHTEDFKSADSLTNPLVREVYRYQQTISDQYQQNQYGAMLRYALNLLNDNLKLEFTGFYFAPEPNELLRVRINYSLNDHWQLNAGGDRFWGRNDTVLGQFRDNSLVYAQVRYNF

SEQ ID NO: 4838 - protein, 229 aa, Acinetobacter baumannii
TSINLITIVIKIDVIFMTNRHETDLVNEDTLKKKRGRPKCFDEQQVLEKAMLLFWEHGYEATSISDLTHALEITAPSLYSAFGDKAGLFYKSIDYYLAHEACPIETIFLEAKTAKIAFELYLYDNVKRLVQPNKPAGCMLVVAAMNCSDATQEVQQNLLVKRIKTKEKLLKRLEQGVEQGDLPISAPLQEMTDFYATVIQGLTIQARDGASTEQLHKVVEHAMKAWTLF

SEQ ID NO: 4839 - protein, 225 aa, Acinetobacter baumannii
TRTKLEIKQSKYRGIIHVFGKTQRGVSERPNKPKKPLIPKWLGTLVAILAVLCIAVMLMLWKPWQPVSSKNQITSEHYKEEETNKDYRFYDLLPQQQVTPIPEQAIPESKNQGTAMIVEAPSTAQPAASEPASVSTDDTTDSTAAIPQQPNYILQVRSYTDPDQADARRAEIILNGLSADVIKSSENGKTWYRVISGPYDTQEAALAAQQTLQHSGIDSIVIKRR

SEQ ID NO: 4840 - protein, 92 aa, Acinetobacter baumannii
FGNNLTSEEFFMELTLGLVAIASAILIAFGALGTAIGFGLLGGRFLEAVARQPELAPQLQTRMFLIAGLLDAVPMIGVGIGLFFIFANPFVG

SEQ ID NO: 4841 - protein, 345 aa, Acinetobacter baumannii
EINKMNTENHLMIERQGKLGVITLDRVTHLNALSLDMIEGIGAQLELWRNDAAVQAILIKSNSPKAFCAGGDIRYLYDSYKNGTADYKGYFSAEYKMLNTLREYEKPIIVVLDGYVLGGGFGLAQACHIVVSSEKSRFAMPETAIGFFPDVGATHFLSRLDDIGVYMAITGEQISSSDALYLDLIDYHVPSDQLQALQDALVEAPSLSKEGIEHIITRFITRPAESELKQLAEGIRKHFGFQHLDEIEQSLENEQDESLKTWASKMLSILQQRSFIAKQTSLKLQHLGRGLSLQQCMQLERDLQDIWFEHGDFIEGVRALIVDKDKQPRWQERNPELEQILEKLS

SEQ ID NO: 4842 - protein, 152 aa, Acinetobacter baumannii
ALNKGGNMFNPNVVVKNIVTQPGADSFISLVARLLIAYIFLAAGWGKITGYAATAGYMEAMGVPGGLLPLVILVEFGGGLALLFGFQARFAAFGLGIFSILTAFLFHQGGADAAAQYNNGIHFMKNLAMAGGLFFLMLHGAGRISLDHAIEK

SEQ ID NO: 4843 - protein, 210 aa, Acinetobacter baumannii
FKNKTYITRPVMGIKKETVMETILGLCIGVGLSAACGFRVFVPLLVMSIATMMGWFEPSKGFEWLALPSVCLALGVATVCEVAAYYIPWVDNALDTVATPAAMIAGTLATMAVSSGEMSQFASWAAAIIVGGGTAGVVQMSTVAARGVSTATTGGLGNFIVATGEWIGAILLSVSAMLVPALVAIVVLIAVIWVVRWIRHKKQEQAHTPL

SEQ ID NO: 4844 - protein, 622 aa, Acinetobacter baumannii
FMDNLNNAKKDNFSRKTILVTGAAGFIGSRLIVELLREGHQVIAALRNAATKKDKLLGFIATEGLVDPSISLVEYDLSRDFKLDSLLSDAQTKIHVIYHLAASFNWGISKAEAERTNIKSGLALIEWAATLKQLERFIWIGGYRVAAPPQESADELYCKHGGYEASKILGHQAFIEACKRLNVPWTAINPATVIDGFYNYGDMQYIGIADMIDKLYQGRLLALPGGRDTFLPLCNMQYIVSFLIRTMSYPETIAQEYMLLDPATPKFHRLVHLAAEHLGVSSPHLQIPKVLLEKLPEVLLDGSKEQLSFISTEHYHVAGAEAMAAKMGIADLISIMPYFSRWIDRLVFTRFGRMQVPTPNSFSYQNRYWTEIYTKQPVGSEKASALFLHGIPFDSACWSPIINKITYDQVAMMDLPGLGRSGSYEMMEDNNHQFIDTAAELLAPNSVVIAHSLGCLFALNLAKKYPDKVARLILISPYFVQAQAAKMFQIQAISKLIFRFVPKDVIAKDLHPEGQQNLSVRYAMDSLRRMSVSKHISEYMHHINLPQQRAAQTALLSELRSKIEIIVGEKDPIVTPISPDIPVHIIAGAGHNPHVTHVEAVYDYLTPVLTKYISTTAQLIDV

SEQ ID NO: 4845 - protein, 296 aa, Acinetobacter baumannii
LEGKCVIKKAVLPVAGLGTRFLPASKSIPKEMVTVVDRPAIEYVVREAVEAGIEQIILVTHSSKASIENYFDRNFELETTLEQKKKFDLLAEITQIVPEHVSIISVRQPQPLGLGHAVLCAKSIVGEDDFAVLLPDVLVKDSSGQNDLSRMISRYNSSQAAQIMVEAVPDHLVDQYGIVDVKLSPNEGESIAMQGIVEKPPVGAAPSNLSVVGRYVLPAKIMQLLENTPKGAGNEIQLTDAIAMLQDTDTVEAYRMQGQTFDCGSKLGYLKAVLHYGLEHPKLGMEFKQLIQELKL

SEQ ID NO: 4846 - protein, 302 aa, Acinetobacter baumannii
NAILSRFVVVELLMAFYSPLRYPGGKGKLSYYIKALIKENNLFDGHYLEPYAGGAGVALELLMEEYVRKIHINDIDPAIFSFWHSVLYETEDLCRLINDTPVDMTTWHEQKAVLANPDQHSSLQIGFATFFLNRTNRSGILKAGVIGGKEQSGQWKLDVRYQKNELLRRINEIASYQSRIGLSNVDSAELIKSLPQGPHNNTLVYLDPPYYAKGQDLYRNFYNHQDHVEIMRALKSSSIKNWIVSYDNVDAIREIYKDFRVLEYSLQYTAQQKKIGEEVMIFSNDVLIPNVRLGKSIDVSEV

SEQ ID NO: 4847 - protein, 131 aa, Acinetobacter baumannii
SNNKDNLMNRDYEQFPDDDNGNVLWQMVEDGDDLTELHEIEFSIAFQDQQNAEQCAMHLLYQEQKISLFQDDSVEPNEWIITIFVTMEPEYSDIVDLEQWFSTIAEQFNGEYDGWGCMAYVFDEEEDDILQ

SEQ ID NO: 4848 - protein, 111 aa, Acinetobacter baumannii
ITLKFRENYPMKKAYKNIVLKFKKLKKREFKEMPDYLLVIFGASAFLISSYWGFVVTEVTPDFIRAVNKQAHIDILGISLGTILLALAAEVWFFGAIAFRCNNLLYERWFK

SEQ ID NO: 4849 - protein, 484 aa, Acinetobacter baumannii
ANIKRTSNMTMVHHSDEASSPDHLQRKLSNRHLQLIAIGGAIGTGLFMGSGKTISLAGPSILVIYMLIGGMFFFLMRALGELLLANLHYKSFVDMAYDLIGPWAGYYIGWTYWLGWVLVGIADLSAVINYLSFWLPEGASFSPMQQAMISAGCVLFVLGLNLLTVKLFGEVEFWFALIKILAIIGLIGVGGYMILTHFQAPHGDVVSISNVWSHGGLFPKGVSGFLAGFQIAVFAFIGVELIGTTAAETKDPQTNLPKAINAIPVRIILFYVLALFVVMSVTPWNHIRADKSPFVELFLNAGIPISAIIMNLVVLSSVMSSMNSGVFSTSRMLFGLSKDGQAPSVLGRLSKRAVPSNGLIFSCIFIMGGAVLQYFVPNTMEAFTLASSLCVILFISVWILIMACYLRYRKIRPELHAASTFKMPGGVLMAYAVIAFFLFTLVILALEPDTLKALYVSPVWLVVLSVTYYAFYKPRMRKLGQEIF

SEQ ID NO: 4850 - protein, 382 aa, Acinetobacter baumannii
SRVKEIIMQFTEEQLLIRDMAKSFAQEQIKPNASDWDRDGTFPKETLTQMGQLGFMGMLVSEEWGGSDTGNLAYVLALEEVAAADGATSTIMSVHNSVGCVPILKFGTDEQKERFLKPLAQGEMIGAFALTEPHTGSDAAAIKTRAVKDGDDYILNGAKQFITSGNNAGVIIVFAVTDPSAGKKGISAFLVPRETPGYEVIRVEEKLGLHASDTCQIALTDVRIHKSLMLGKEGEGLKIALANLEGGRIGIAAQAVGLARAALEEATRYAKERITFGKPIFEHQTIAFRLASMATEIEAARQLVHYAARLKEAGQPCLNEASMAKLFASEMTERVCSSALQVFGGYGYLRDFPIERIYRDARICQIYEGTSDIQRLVIARSL

SEQ ID NO: 4851 - protein, 67 aa, Acinetobacter baumannii
GKNLSKYASIILESKKAKNGSPLSRLPFSTIKNLIELMNYAFQRDSFAHVTPSSASFFDLACSQAHC

SEQ ID NO: 4852 - protein, 93 aa, Acinetobacter baumannii
VPFEFGAGNETRTRDPNLGKVMLYQLSYSRMYEQFLLKLSQKKPIWSGKRDSNSRPQPWQGYALPTELFPRAAYNTLSKTRVNNFMQIIMLIA

SEQ ID NO: 4853 - protein, 263 aa, Acinetobacter baumannii
EMSDFIQLEYLQEKLQQLLAKSLFAIYLYGSAVDGGLGPESDLDVLVVVTQPLTSALREQLAQELLKISQPVGELQRPLEVTILLKDEIQSGNYPLSYEMQFGEWLREELKEGGTLSSQKDPDISILLRKARFHHTVLFGPALDQWAPEISDQELWQAMSDTYPEIVAHWDEDADERNQILALCRIYFSLVMKGIASKDNAARWVMPQLPPEQKFVLQRLIQEYRGEIGKQNWQEEHYALQPIVNFLSSKIEEQFEQKRNLIT

SEQ ID NO: 4854 - protein, 62 aa, Acinetobacter baumannii
KSYDLLHQANSVDEATLQLCDKHLLQRVCTLLEINRLSLYLHKKAKPMTASQKQNLVQHKQG

SEQ ID NO: 4855 - protein, 408 aa, Acinetobacter baumannii
VSNDMQMISPTRLASFNDMQDSNFFTQFLNICCEKPVQPSYTEYVSLQHALYEGDIEMDKVIDWVMQNPKDHRIIFEKILFQGRDELSELIPTELENFFNYIEQKPEWLDQRQIDEAVKFTHRLGINNGFILRDLSLMAGYLYPGFNQPLILTGALKKEAGTRLAETTKWWVDITEPQGLSRLSAGFTSTIYVRFIHALVRRQLKKSDRWDSEVWGIPLNQFDLAMTNLAFSSVVLLGIRALGIWPTKQEAKSFLHFWRYVGWLMGIDEKWLIQSEPEGWRLLYWMQFAHPRSDHSSIELGLSLSKEPFERKYLHLRSLQQKLAYRQHLELTQFFIGKKRMKLLGLPQQSASWFAYYLLVRNLLLYNGAKLSPKVEKFLSKSGRNIQKLGLTLYQNQGKAKTLASMHQ

SEQ ID NO: 4856 - protein, 312 aa, Acinetobacter baumannii
LRRDLLMTAQSVILPLPSDHARFIVLRLKDLTIAELKEQLEALFETRDRLITQHSDAQIKTAVAFGPELWKQLYSQSPAGFKQLEPENGAFNMPVVPADVLIHIASMRSDICFALSQAFFEGIKDKVEVLDERVCFRYFDGRDITGFIDGTENPQFPDDRAETALLPESAGVFADGSFIFAQRYAHDLEKWKKLKVDAQENVMGRTKLESIELDDDVKPENAHVARTVVEDEEGEEMEILRHSLPYGDGRGDQGLFFIAYTKDLSIIDAMLKRMFGTSGDGIHDRLLHFVTPLDGAYYFAPSEELLEEILEA

SEQ ID NO: 4857 - protein, 384 aa, Acinetobacter baumannii
LMLDVPFTMLTQLSSHHYHTLKVWYLVQHSLVSFKKIIDYFGNCEKATQPDGLAKWSSLGLHANHLKRVNEFQTPQGQAQFEQLVQQVRQHTDFILTADDSGYPSQLLPYTDYPPIIFGKGQAQALLQPQIAIVGSRKPSPHGRQVAYDFAYYLSEKGFFISSGLAYGIDEAAHQGASTHQRTIAVTGTGLDTTYPAQNKKLAEHILAQNGAIITEFLPGTPPLQQHFPRRNRIVSGLSLGVLVVEATLKSGSLITANKAAEQGKTVFAIPGHIYSEFHQGCHQLIREGAILIDHPEQIIEDLALPTQWQSQQQNQTEEANTNTPEIPEHLIDLYQSLDWVGQNIDQLVVHHNIPVSELTSSLMELELLGLCMQQSGLYLRCRS

SEQ ID NO: 4858 - protein, 240 aa, Acinetobacter baumannii
EQMESWQEDLLSAFLVVKNEYQLFEIVKSTASRLGFDYCAYGMQSPLSIAEPKTIMLNNYPEAWQKRYVERQYVKIDPTVQHCMVSLQPLVWSSQSAKTQAEKDFWEEACSYGLNVGWAQSSRDFIGTRGMLTLARSNDQLSEKEQKAQYTNMYWLTQTVHSSIAKIVNDVEFAKFNLYLTNREKEALRWTAEGKTSAEIAQILGVTERTVNFHLSNAMQKLNVNNKISAAIRAVMLGLL

SEQ ID NO: 4859 - protein, 270 aa, Acinetobacter baumannii
AMMEWLQLLLPAWIMGTLLVFLTAPLGCLMLWRRMSFFADTMAHGTLLGVAIAGALSLPLWLGVAGTAILLVAILWALHDNRLPNDALLALCSATLLCSGLLFIQHVPSLRPELLSYLFGDLLSIDWPDLPIFTLIIAVSLAILYRYWQPQIQIAIDPDIAISEGVNAKWQRLIFMLLLALFTVLALRAVGSLLMGALLVIPALSARLLAHSPKQMVIWAFVLAQLGVSVGLWSSAALNISTGLSIVLCMALSFALIFMVQKIKNQTQAA

SEQ ID NO: 4860 - protein, 410 aa, Acinetobacter baumannii
QSKDFFMDQSTTSKARPMTSTQGSWFAILAVAIAAFALVTSEFLPVGVLNSVAADLHISVGTAGLIITVPGIMAAIAAPLLPVSVKQLDRRYVLILLTAIMVIANTITAFAENFHVLLLSRLILGISIGGFWATAIALSGKLAPANLPIAKATAVVMAGVTFATVLGVPIGTWLSEFYGWRSAFGITAAIGLVVLVLQLIFLPKLLPESAIHIRDLPALLRTPKARSGMLIVLLIGLAHFCAYSYLAPFFKNVAGFNGTTISSLLLLYGIAGIFGNAFAGYSGNLNVRYTLAFVGTCFAIVFFGFPIFAIHEFGAIVLTALWGFAFGAFPTSANIWMFVHAPHAVEKGMPLFVGMFQVMIATGSLLGGYVVDHFNENTLIYGVLSFVALALISTFTLAKGLNNPKATCEN

SEQ ID NO: 4861 - protein, 391 aa, Acinetobacter baumannii
IGKDNLMSSNETTTGFKPKKSVALSGQVAGNTALCTVGRSGNDLHYRGYDILDLAAGSEFEEVAHLLVHGKLPNKAELKAYKAKLKALRGLPAALKTALEQLPPSAHPMDVMRTGVSVLGCLTPEHEDHNEAGAKDIADKLMASLGSMLLYWYHFSNNGRRIEVETDDDSIAAHFLHLLHGEKPCEEWIQAMHTSLILYAEHEFNASTFTSRVVAGTGSDMYSAITGGIGALRGPKHGGANEVAFVIQQRYDNPDEAEADIRKRVENKEVVIGFGHPVYTVSDPRNEVIKKVAHDLAEAQENTKMYLIAERLEAVMKEVKNMFPNLDWFSAVSYHLMGVPTAMFTPLFVIARTAGWSAHVIEQRQDGKIIRPSANYTGPENLEFKPLAERG

SEQ ID NO: 4862 - protein, 188 aa, Acinetobacter baumannii
VEALVMNIIAGFQNNFSEGLYTKFKSYRYRVFVEYLGWELNCPNNEELDQFDKVDTAYVVAQDRESNIIGCARLLPTTQPYLLGEIFPQLLNGMPIPCSPEIWELSRFSAVDFANPPSSTSQAVSSPVSIAILQEAINFAREQGAKQLITTSPLGVERLLRAAGFRAHRAGPPMTIDGYSMFACLIDI

SEQ ID NO: 4863 - protein, 240 aa, Acinetobacter baumannii
LVFWNFIMNNNIIIFGYGTGISKAVAHKFGKEGYKIGLVARNAQKLEKAILELKAQGIEAYAFACDLAVLEDIPNLIKRIKDQLGEIKNIHWNAFHDIEGNILETPPLELTKSFHIRVSSYIATVQACLGDLEKNHGSILSTNGIFAFDAVGIDLVAKEYSSLATTAAAQYKTTNLLAHSLADTNVYVSQVIVNGFVDGRPEAKDKTYAVHPETVAEQFWYLHQHKQETVSLCGEAIQAA

SEQ ID NO: 4864 - protein, 315 aa, Acinetobacter baumannii
SLFCSWCITMGQVMKYHKWAFIFPILAVLIWSLNIVVTRYVSDYISPVSISFYRWLIAFIILTPFMFLSVWRQRRLVIPYLPKLAVLSAFGMVLYQGLAYTAAHYTSATNMGIVNAFIPIFTIFVSLAILKDVPNRFAVFGSILSFAGLLYVMSQGNINKLLSGGGHLGDALMIIAVFFYAFYGVFLKKWQLPLPIMTSLYVQIGFSVLFHLPLIFWFGLDALNAQNAPSAIYAGVFASLIAPLVWMLAVQQLGPNRTSIFMNLVPVFTAIIASIWLSEQWTIYHTFGGIMILVGIIMAQKKVNSKKSDLLPEQN

SEQ ID NO: 4865 - protein, 509 aa, Acinetobacter baumannii
AKTCEFHRSKNNMSEIKLIPVSKLLLDLENPRFPEEVTGQRAAINLMLKIQEDKITNLAKDIAVNGLDPSENLMVFESDDEPGFYVVAEGNRRTTALKLLANPNSADSEKFKKIFNKIKESATNSISKVSCVVFDDEGYEHWVNLKHTGDNKGVGRSSWTTPEADRYREKHGKTSIQRQLYDFMERQEEAYADILMNKKFVHATNLSRLFGDKRTKRCFGLTTMDGYLYSALPFNEFVSKLKKILEVMTEVSDGKNSPDFNVKRIYKKEDRADFLNELGFDPEPQLLPHSWKLDDPKAGYVDKDPQQGKAEEELPKPQGEVENKGQKNNDVKDDEVDEPNKPKIINKPIPNTNRNSLVPSTLKLNFGGDMKCSKIFYELKNKLGHDETPYSLAVMLRVFIDLSTTAFMEKKGIKYVDTKQPTRSPGLHDKVVECCKYLKEQGLLTQPQVTAICTFSKDKLKADGSLQQYVHNQHLKPSKDIVNTEWDNFQPLFEKIWSTEMQVTNKGGA

SEQ ID NO: 4866 - protein, 593 aa, Acinetobacter baumannii
CGLWFEEQHLHLIFNWSYQLCLMFKILRYKNSPRHFKEMTMLNMWQQLYDPLNNIWLSSAVALIPIIFFFLALAVFRLKGSIAGTGTVIIALLIALFFYQMPGQMAFASIIYGFFYGLWPISWIIIGAVFLYKISVKTGQFEVIRSSILSITEDQRLQMLLVGFAFGTFLEGAAGFGAPVAITAALLVGLGFKPLYAAGLCLIVNTAPVAFGAMGIPIIVAGQVSGVDTMEISQMVGRQLPFLTIIVLFWIMAIMDGWRGVKETWPAVLVGGGAFAIAQYLTSNFIGPELPDITAAIASLVSLTLLFRVWKPKHIFRFEPEAGQTLAQQPTTVQRYSIGKIAKAWSPFAILTVMVTIWSVKPFKALFAKDGALEHWIFKLEVPYLHKLVEKMPPIVSEMKPYEAIYKFDWFSATGTAIFIAAIITVIFLKMKASEAVTTFGETLNELKTPIYSIGMVLAFAFIANYSGLSATLALALSHTGHAFTFFSPFLGWLGVFLTGSDTSSNALFSALQATTAQQIGIPEVLLVAANTSGGVTGKMISPQSIAIACAAVGLVGKESDLFRFTVKHSIIFTVFVGIIITVQAYLVPWMIP

SEQ ID NO: 4867 - protein, 251 aa, Acinetobacter baumannii
IMQWQSILLEKRNGVGLITLNRPQALNALNSELISEINQALDQLEKDREIGCIVLAGSEKAFAAGADIKEMADLAFPDIYLDDFFHLADRIAQRRKPLIAAVSGYALGGGCELALMCDFIYCADNAKFGLPEVTLGVIPGIGGTQRLTHAIGKAKAMEMCLTARQMGAVEAEQSGLVARVFSKEELLEQTLQAAEKIAARSLTANMMLKETINRAFEVNLTEGLRFERRMFHSIFATADQKEGMQANFKNQ

SEQ ID NO: 4868 - protein, 425 aa, Acinetobacter baumannii
RIRCAMKIAVFGTTLHAGVMAALLAEYGNQIYWCTCVSCEENISVLSYQDQEVNHYLNKQRKAGFLKESPFSEIPLDIEVYLFCFSPTQIELALKTVEKLSERPIIHPKLMINGSTFGLHGTEKLKQHLPKDEWVYFPDVIQEGNAINSVLDVKHVIVGVESRDASEIMQELLRPFFQFSYQYLFMPILDAEFTKLSISGMLATRISYMNDLAMVAEKLGIDIANVKHGIAADTRIGAAYLSPGVGFGGENFSHDILTLSSTVLETGTKSRLLEQVWAINEQQKEILFRKLWNYYHCDLSGKTVAIWGASFKENTSNIHNSPIHILLAALWAQGVKVRLHDPQALDEIASIYGSREDLILCSDQYEAAQNAHALCLVTAWKQYWSPDFKRLQQLMKHPLILDGRNIYDPAYVKARGFAYEGVGRL

SEQ ID NO: 4869 - protein, 71 aa, Acinetobacter baumannii
PSVRPTFVLAKVGKTIVICKTRPQPSNILSIAEPILKNVVLPQTVADDASEYQIPINQLFNLLLLFSKCVV

SEQ ID NO: 4870 - protein, 558 aa, Acinetobacter baumannii
QQIRTEGKDMMDYQNAVQAFDLESTAKQMLSGSLDALNACYECCDRHADSDKIALYWQGKDGRKEQYTFRELKEWSSQFANFLKSQGVKAGDRISGLLPRTPELIVTILAAWRIGAVYQPLFTAFGPKAIEHRIQLAQSKLVVTDMGNRSKLDEIEKCPAIMTVADAQGTPLKAGDFNFWNEVKQQSDQCDLVMRSIQDPFLLMFTSGTTGPAKPLEVPLKALIAFGRYMQDAIGLTEEDSFWNIADPGWAYGLYYAITGPLFLGHATLFYEGGFSTDSLCQIVKDYKVNNLAGAPTAYRMMMAADPAQMAPLKGQFRVVSSAGEPLNPEVIRWFKQVLDAPIYDHYGQTEVGMVVCNHHGLKHEIHAGSAGFPSPGYRVAIVNEQGEELPPDTPGILAVDISQSPMMWFGGYKESRKSPFVGHYYLTGDTAELHADGSMSFVGRSDDVITTSGYRIGPFDVESALLEHDAVIEAAVIGVPDPDRTEVVKAFVILAAGVQPSDALAEELSQFVKRRLSAHAYPRLVEFVSELPKTPSGKIQRFLLRNQEIAKKQAKAG

SEQ ID NO: 4871 - protein, 392 aa, Acinetobacter baumannii
YQYRWPFNSALFTRTCGLTDVRKVIMPRPITAVIHRQALQNNLAVVRKAMPNSKVFAVVKANAYGHGIERVYEAFKAADGFALLDLDEAKRIRALGWTGPILLLEGVFSPQDLFDCVQYQLSFTIHSEAQIEWVEKHPYPAQFDVFLKMNSGMNRLGFKPQHYVQAWERLNNLVNVAKITHMMHFSDADGDRFGQQGIDYQITAFEEIVKDLPGERSVSNSAAILRYQDQLKSDYVRSGIMLYGSSPDYPTHSIADWGLQPTMSLRSEIISVQHLEPNESVGYGSNFVAEQPMTIGIVACGYADGYQRISPTGTPVLVDSIRTRTVGRVSMDMLAVDLTGIESAKVGSEVVLWGQSSTGVVLSIDDVAVSSGTVGYELMCAVTARVQFINQV

SEQ ID NO: 4872 - protein, 204 aa, Acinetobacter baumannii
VLKRLLDIIIASVALILLSPLYFYVAYKVKKNLGSPVLFRQVRPGLHGKPFEMIKFRTMKDATDAQGNPLPDSERLTPFGKMLRSTSLDEMPELWNVIKGDMSIVGPRPLLMEYLPLYNKEQAKRHDVRPGMTGHAQVNGRNAIGWEEKFKLDTWYVENRSLWLDFKIMLQTVKKVIAKDDINEAGEATMSKFTGSEEKEIEKK

SEQ ID NO: 4873 - protein, 259 aa, Acinetobacter baumannii
SAIFIYDVINQNRLYTNLMINCELDNMENKNQCRQCAVCGKSFPLKDLVSGEVIRNVISDEILKDYPVWSYSSFICRADLADYRIKYVQSLLRSEKGELSNLENEVIGSMQRHELISRNTESDFDQNWTFGEKLADKIASFGGSWAFLICFALFLTGWIVLNTVVMVVRPVDPYPFILLNLVLSCLAAIQAPIIMMSQNRQEAKDRLRSQHDYQINLKAELEIRHLHEKMDHLLSHQWERLAHIQEIQLDLLAEMNKKR

SEQ ID NO: 4874 - protein, 698 aa, Acinetobacter baumannii
LFMRHKLGLLSSLGLSFISTLTWGEETSTVLETIRVQAESTREDVSQNSSATKFTHDVLDVPFNRAYLSKQIMEQQDVQRIDDALTLVSGVFHQNSFGGGFWDNYSFRGFSTDPNLGAAMIRNGLSVNRGISAPKDVVNIESLEFLKGPMAALYGRGETGGLLNLNSKKPQWESESELNLRANTQEQYRISLEHTAPINDELAYRLAVAHEDNQSFRDHVSSERWFFSPQLTWKISDQTQLDFDSEFTEHKGTFDRGVSTVNHQFVMDPKTFTGEPDDGDLKIKDYFYQLRLSHEFNPDWKLNSAVSYKDAQMVGFATEPRRMQADGRTLERQRRYRDYTSEDVLAQTELLGKIDTSWARHEILLSTELGQLDYKQNQLRRNHSTSSTNTIDIYQPEYGKYLPNLTPFTDTKERQRYFALNVQDQIFFNDQWSVLFGNRFDQVEQDFKNHIKQTEDNQTLHQNSPRFGVNFKASEQWAFYSNYGRSFAMNSGMNRNGQTFAPEKGESYEVGTKYKINDQSVLSLALFKMKKRNVLTTDPIDSNFQTAAGEVSSKGVEFDLNSQINDRWFVNANYSYTDAQIEKDQDLAKDARLSNVPKHQGSVSTNYEILQDGARKAGVGANLTYVGERSGHNLDNGFNLPSYTLVNLNGYYAPSDRLRYQLNVNNLFDKTYYVSSYSDLWVQPGEPLNASISAQWKF

SEQ ID NO: 4875 - protein, 429 aa, Acinetobacter baumannii
TGVREGMEMRVIVLGSGVIGVASAYYLARQGAEVTVLDRQSGPAEETSFGNAGQISPGYSTPWAAPGIPFKAVKWMFQHHAPLAINLDGSMWQLQWMAQMLKNCNPQSYAVNKERMMRVAEYSRDCLRELRKDTGIHYENRAKGTLQLFRKEAQMEAVQRDISVLEECGVSYELLNGNELGRVEPALANAQDKLVGGLHLPNDETGDCYLFTNALAQIAKELGVNFQFNQNVEKLIVEGDQIKGVQVNGKILTADRYVLAFGSYSRDFLKPLDLQLPVYPVKGYSLTIPIVDPAFAPQSTVLDETYKIAITRFDQRIRVGGMAELSGFNLGLNEDRRATLQMVTQDLFPGGDMEQASFWTGLRPMTPDSTPIIGATRFKNLFLNTGHGTLGWTMACGSGKLISDIVLNHKTDISTDGLSIQRYSHAHAA

SEQ ID NO: 4876 - protein, 71 aa, Acinetobacter baumannii
PLRRSYFYCVQLLENTFLCIFFIQVLFETNKEIFDHQRKFMHDCCANMHRDNNKNESGLGSSTVFSGFSTH

SEQ ID NO: 4877 - protein, 1005 aa, Acinetobacter baumannii
LCNSAHPYITSTKLIEKKFGSKYMVVIGITPKQGDIYQPQVLEKVKRITEEVDNAPGVVRSTMMSLAARQAKGIEANAEGFDAKKLLPSSSVTQEDIDHLKKLLALNPTYMNSVVSKDQQTAAILLELEESPEGFQKMMGPINKIVESEQSKDMTISVGGNPVYLDKAEDYSKRINILFPIAVLVIGLLHFEAFRSKQGLILPLVTALLAVAWGMGMMGLFKQPMDIFNSPTPILILAIAAGHAVQLLKRYYEDFDRLIAQGMEPKAANSEAVVQSLVRVGPVMVLAGGIAAAGFFSLLTFNIPTIRSFGIFTGIGIISTLVIEMTFIPALRSMLPPPSVVKVKRKGLPIWDWIPNRIGDVILSVRPRMMLMTAIAAMGILLAIGTSRIVVDNDSRNFFSRDLPMQQDDRFLNQSLGGTNSLYIMVDTKVRDGIENPEILKAIDNTEKFANSIPEVGKTISIVDYIKRMNQAMNADQPQAFQVPATKDVVAQYLLLYSMSGEPTDFDSYIDTTQRYAKITILLKTGSNHRIKEILESLKTYMAGQLGDKAVVSFGGDVTQTIALTETMVHGKLMNILQISFAVFFISALVFRSISAGLIVLTPLLFSILAIFGVMGWLDIPLNIPNSLISAMAVGIGADYAIYFLYRLREILREEGGDIKDAIRKTLSTAGKASLFVATAVAGGYGVLSLSQGFHVHQWLAMFIVIAMLFSVFATLIMVPTMILILKPRFIFSSKKKSIPVAQTVVTSLLLGTALTMSMPKTSHADEVQDIVNRSDDASKFLSSTASAKFILTSKNGEQRVRLTKNMTKLAGNTQNNMRLTEFISPADVQGTTTLLIENAKGSDSMFVYLPALKKVRRLASANKGDAFIGTDFSYGDVLGYKLSDWKYTKLADSKFNGKDCYMIEATPINNTVKSDFGYSKRRMCILKDNFVTATIDIWDTAGKPLKHIEFTDIRPYGKVKPRWQAMKSMAKNLQTQHMTQVIVNDFAAEKTLSDKLFSPQSLEK

SEQ ID NO: 4878 - protein, 228 aa, Acinetobacter baumannii
IYRLRREGNREKMTMIIGVYGASGFGKEVMPLVRQQFPTLSKEQFAFIDDGLSGTTLNGYPVLSYLDFISKPADHKAVTIAIANSVVREKLVSLLEKDGVQHLAVQSTNTVILDEVEIGEGSLLCPFTCLTSNIKIGKFFHANIYSYVAHDCVIGDYVTFAPGAKCNGNIHIEDHAYIGTGAVIKQGTPDKPLIIGKGAIVGMGAVVTKSVPAGVTVVGNPARILERK

SEQ ID NO: 4879 - protein, 303 aa, Acinetobacter baumannii
FTLRGSRMNIAFIGLGNMGGRMAQNLLKAGLKVYGYDLSEVAIQHFAEAGGIVCDSPQNAAKQADVVITMLPAAKHVKEVYLGENGVLEVLKAGSLCIDSSTIDPQTIKDIAAVAQSKNIKICDAPVSGGTIGAQAGTLTFMVGADEQTFNEVKPVLSHMGKNIVHCGDVGAGQIAKICNNLILGISMAAVAEGMALGVKLGIDPQALAGVINTSSGRCWSSDVCNPWPHINENAPASRGYQDGFATQLMLKDLGLAVEAAGQVKQPVLLGGMVQQLYQQMCMRGNAHLDFSSIIQQYLPQEA

SEQ ID NO: 4880 - protein, 523 aa, Acinetobacter baumannii
TNKRLRNSAMQQLNPSEISALIKQRIGDLDTSATAKNEGTIVMVSDGIVRIHGLADAMYGEMIEFDGGLFGMALNLEQDSVGAVVLGNYLSLQEGQKARCTGRVLEVPVGPELLGRVVDALGNPIDGKGPIDAKLTDAVEKVAPGVIWRQSVDQPVQTGYKSVDTMIPVGRGQRELIIGDRQTGKTAMAIDAIIAQKNSGIKCVYVAIGQKQSTIANVVRKLEETGAMAYTTVVAAAAADPAAMQYLAPYSGCTMGEYFRDRGEDALIIYDDLSKQAVAYRQISLLLRRPPGREAYPGDVFYLHSRLLERASRVSAEYVEKFTNGAVTGKTGSLTALPIIETQAGDVSAFVPTNVISITDGQIFLETSLFNAGIRPAVNAGISVSRVGGSAQTKIIKKLSGGIRTALAQYRELAAFAQFASDLDEATRKQLEHGQRVTELMKQKQYAPYSIADQAVSVYASNEGYMADVEVKKIVDFDAALIAYFRSEYAPLMKQIDETGDYNKDIEAAIKAGIESFKATQTY

SEQ ID NO: 4881 - protein, 200 aa, Acinetobacter baumannii
KTMRKVPQQQRSKIIVDHILEATQQCIAQYGLLHTTTPKIAEKSGVSVGSIYQYFENKDQIIEELLRRKSELLGQQLKELVIQEGNIPLELLIPLAIELGFNALKADHGFFIEVLKHWHDNSHSQAAQILEKHFFEVGLYTFSRNPHQWDFEQVKHKSFVIINSTLFTMMRYVSQNNFLISEQQLKRELSSMILAYLSQK

SEQ ID NO: 4882 - protein, 74 aa, Acinetobacter baumannii
FNERNEMTNKLSPEQSWWGWKLLIVASILSVLFMIIFYLAINNEPDYMPSQKKKQMMESHEQMNHAEMHSSSAQ

SEQ ID NO: 4883 - protein, 321 aa, Acinetobacter baumannii
VKESNIMSNNNDYDISDSKDCEKFANQFIQEFPIRSAEIGQGTVIKRALPSRQKRMIGAWCFLDHAGPVTFPAGNGLDVGPHPHIGLQTFTWMIEGTMMHTDSLGSKQLIRPKQVNLMTAGHGISHTEVAPDTETQMHAAQLWIALPDHKRNMDPKFEHYPDLPVVEKDGLEFTVLVGEYLETTSPVVVHTPLVGVDLIATQDTKTRIPLNPEFEYGFMALDGVAHVNGHELTADNMVVLDTGLNEIEIEVKKGNRVLLIGGEPFETPILLWWNFVARTMDDLKEAREQWVNHDVRFGEIPDYVGARLEAPVLPDQMRASK

SEQ ID NO: 4884 - protein, 875 aa, Acinetobacter baumannii
TIGGAWLMNTKYRKPLAGTQLEYYDVRQAVEDIQPGAYEKLPYTSKVLAEQLVRRADAENLTAYLTQLIERRQDLDFPWYPARVVCHDILGQTALVDLAGLRDAIAEKGGDPSKVNPVVPTQLIVDHSLAVEYGGADPDAFAKNRAVEDRRNEDRFHFIEWTKTAFKNVDVIPAGNGIMHQINLEKMSPVIQARDGVAFPDTCVGTDSHTPHTDALGVISVGVGGLEAENVMLGRASWMRLPDIIGVELVGQRQAGITATDIVLALTEFLRKERVVGAYLEFFGEGADSMSVGDRATISNMTPEYGATAAMFYIDQNTIDYLRLTGREDAQVALVEQYAKEIGLWASEMTKAEYPRVLRFDLSTVTRNIAGPSNPHARVSTSDLKEKGIAGVVENRSDGLMPDGAIIIAAITSCTNTSNPRNTVAAGLLARKANELGLVRKPWVKSSFAPGSKAAALYLEEAGVLKDLEKLGFGIVAYACTTCNGMSGALDPAIQQEIIDRDLYATAVLSGNRNFDGRIHPYAKQAFLASPPLVVAYAIAGTIRFDIEKDALGYDKEGNPIYLKDIWPSDAEIDALVKQAVKPEQFRKVYIPMFDLGEVEQAKSPLYDWRPQSTYIRRPPYWEGALAAPRTLANMRPLAILGDNITTDHLSPSNAILMDSAAGEYLHKMGVPEEDFNSYATHRGDHLTAQRATFANPKLYNEMVRRSDGTIKQGSKARVEPEGEVMRMWEAIETYMNRKQPLIIIAGADYGQGSSRDWAAKGVRLAGVEAIVAEGFERIHRTNLVGMGVLPLEFKPGVNRKTLKLDGTELYSVIGNIAPRSTLTLVIERATADGKEEIVEVPVTCRLDTEEEVSVYEAGGVLQRFAQDFLEGQVA

SEQ ID NO: 4885 - protein, 231 aa, Acinetobacter baumannii
LSIGSLLGFEHGLPLNHLMELLDFILHVDQHLAEFITNYGTWIYGILFLIIFVETGLVVMPFLPGDSLLFAAGALAASTGTMDPWLLGILLFIAAVLGDTVNYHIGRFIGPRVFEMNSRFINKQHLIKTQEFFARHGGKTIIFARFIPFARTFAPFVAGAGSMNYKFFLTYNVIGAFCWVASFVTLGYLFGGHPLVKDNFTHLIFGIIIISILPGVIGFIRQKLKNRKANV

SEQ ID NO: 4886 - protein, 1326 aa, Acinetobacter baumannii
VAAGSCFMNNLARLEPEVLSRHAISAEQLGIWYIQRFEPTCSAYNMVVAFDVKVNQSLGNKPMEILEAVMHDYPLLRVSMPANDQGIEQLIWDRVYPNIIFSDTRHIEASDLTQLVEQDTKQPFDLTQPPLWRIHCYERGQNHYVIAFVIHHALMDFWSIGLLLRDVSKRFGLVAESDAVNGIEFAQYADKQQSSVIDDTDESLIFWKNALKHAPHVHSIPLDYPRPAVQHHKGSSLVFRVPESVSSGLVNLAKDYEITLFGLVLSGFYILLHKLSNENNLVIATPVAGRLERSLRNALGQFVNTIAIHMDIDADLTLRQFTQQVQEQLRQSLKHQKVAFSRVVEAVSPKRDGSINPLAQVGMFWERLGGMDEFKELLLPIQTPATLAGQDLTLGSFPVRQQEGQLDLTLEMGGEYQGELVGVLKYNSELFSAQSAENMVQLLQAVLSEMVAHPERKIVELDIAPDYKDGIQFEALRGKATDYAQHDLFAMILKQINERGDKHALTSNDHAVSYRELGQHIAGITEYLRAHGITQGDRVGLMLDRTALLPAAILGIWAAGAAYVPLDPNFPTERLQNIIEDAEPKVILTQTELMDGLNVSVPRLDINQAGVVALEQVRETLAFGDIAYVMYTSGSTGKPKGVRIGHPSIINFLLSMNDRLQVTTETQLLAITTYAFDISILELLIPLMYGGVVHVCPREVSQDGNQLVDYLNAKSINVLQATPASWKMLLDSEWSGNAGLTALCGGEALDTILAEKLLGKVGCLWNVYGPTETTVWSSAARITDAKCIDLGEPLANTQLYVLDEQQRLVPPGVMGELWIGGDGLAVDYWHRPELTDAQFRTLPSLPNAGRLYRTGDKVCLRTDGRLTHHGRLDFQVKIRGFRIELGEIENVLKQIDGITDAVVLVKTTAGNDQKLVAYVTGQELDIAGLKKTMQIHLPAYMVPSAFIRLDEFPMTANNKLDRKAFPEPIFGQSNDYVAPRDPIEIELCTTFEQILSVKRVGIHDDFFELGGHSLLAVKLVNHLKKAFGTELSVALLAQYSTVERLGEIIRENKEIKPSIVIELRRGTYEQPLWLFHPIGGSTFCYMELSRHLNPNRTLRAIQSPGLIEADAAEVAIEEMATLYIAEMQKMQPQGPYFLGGWCFGGAIAYEISRQLRQIGQQVTGIVMIDTRAPIPENVPEDADDAMLLSWFARDLAAPYGKKLTIPAQYLRELSPDQMFDHVLKEAKAINVLPLDADPSDFRLYFDTYLANGIALQTYFPEPEDFPILLVKAKDEQEDFGESLGWDQLVKDTLTQVDLPGDHSSIMYAENVVAVAQTIDQMYPIPT

SEQ ID NO: 4887 - protein, 194 aa, Acinetobacter baumannii
IRRGLFMTRSVSIDVLKVILALFVIALHSKIFIDFNDILYFFSVNGIFRIAVPVFLVITGYYFYLVTNFGAWLKRVAFLYIIWMFFYGLFYIDFSLSVYALLKNIYFILFGYHHLWYLIGTVFGGILLFYLKDSNVKFQFFLAILFFTLGCIVQYLGNFHLFNSKWDMVLNANPIYRNFLTVLLSLFNFWLSYS

SEQ ID NO: 4888 - protein, 70 aa, Acinetobacter baumannii
PPRGWVWRKKKMVFSRFKGPGEIKKSGESSNRGNPKKRILIINRDFLKLFHWGAPPEISRKGKYPGPWGS

SEQ ID NO: 4889 - protein, 236 aa, Acinetobacter baumannii
HSFFIVYSKCCSFATIPYFYIFYAYSTYLLQLVLFVVMKKVLQGAFFPFVIFASGMLLLGCDQAQDHAKEQESVQTNDQISEQADDSQQEITATQNKTELKNGNVFYIVRDAANLQLKAGDYIEKLKDTQLDVEQAIQDKDQHELKTTVTTLKAQLEGLNQALLGLDIRSQEVENIRQSLLQANQQALSMPLLNGKLEQINFDQIEKQLNTIQMDMVKLAAMIMAGDEKSDSKTDS

SEQ ID NO: 4890 - protein, 147 aa, Acinetobacter baumannii
LSLMRHCSAKLNQNDKRKMMKGLYIVPLAAATLLLSACATTVKPTYVSPTQYQSLSCQQLQSEYNRIQQYIDNGVQTPKSTGMGVGLGLGGGWGRGGWGFGPSISVNMGQSSSTKNTELSRVLGQQEAIVQAAQFKNCPIIVRKKTN

SEQ ID NO: 4891 - protein, 390 aa, Acinetobacter baumannii
RYIILLITAMSLEKNIERLQSIDALRGLVIIIMLLDHVRETFYLHKQVTDPMDVTVTEPALFGSRLLAHICAPVFVLLTGISAFLFQSKKQDLQQTRAFLLKRGLFLIVLELTLVNFAWTATFPPEVIYLQVIWAIGISMVVLACCVGLPLPVLAGVALVIIFGHNLLDSVHFSQSILQNIWFVLHERGWLEFAGIKLRTSYPVLPWIGVILLGYVLGQFFSSKYSANQRSRALLSLGLASIGLFVLLRFINVYGDQPWQHFESLQLSLMSFFNLTKYPPSLLFILLNVGIGLLVLVAFERIQQYSFLKPLVVFGSVPMFFYLLHLYVLKLMYVLALSVWGANYGNYLSVNHVWMLWLITIVLSFALYPAVKWFSKFKHQNKHISILKYF

SEQ ID NO: 4892 - protein, 111 aa, Acinetobacter baumannii
TDYIFILLIDTNHYENNMTIYKSFLALSFVLVSLGISGCNLHTQQEFEKICLSGGHSKTSCECIYQRLEQTYSPKLMQRLEHVSLQSPVLPRDFAPTFFSVMQRCDKNSLG

SEQ ID NO: 4893 - protein, 184 aa, Acinetobacter baumannii
VGYIREFPKMRQQSEHHHAEHNDYHHGHHRSGRRGRLFEAGRMKLLVLHLIQQSPKHGYEIIKEISDLVGDGYTPSAGTIYPTLTSLEEMNLINLLDVERKQYQITEFGEAYLNEHQDKLSGLLEKLRLRREIHSNDQLIEIHRAMENLKTALRLKLNTTDLKQEQIYQIAEKIDQAAVAIGRL

SEQ ID NO: 4894 - protein, 292 aa, Acinetobacter baumannii
VKRMANLKEIRAKVASIKSTQKITRAMQMVAASKMRRAQERMAQGRPYADNMRRVIAHLVQANPEYKHRYMVDRPVKRVGYIIVSSDRGLAGGLNINLFKKVVQHVKAQQEQSIEVQFALIGQKAVSFFKNYGGKVLGATTQIGDAPSLEQLTGSVQVMLDAFDKGELDRIYLVSNGFVNAMTQKPKVEQLVPLAPAEEGDDLNRTYGWDYIYEPEAEELLNGLLVRYIESMVYQGVIENVACEQSARMVAMKAATDNAGQLIKDLQLIYNKLRQAAITQEISEIVGGAAAV

SEQ ID NO: 4895 - protein, 427 aa, Acinetobacter baumannii
LWRIFRDRKNPALCILLNERTFLMFQHIPPYAGDPILSLMEQFNADTRSEKVNLSIGLYYNEDSIVPQLETIIEAQKRIEPKNGKTKLYLPMEGFKPYREAIQALLFGANSPAVKAGRAVTIQTLGGSGALKVGADFLKTYFPNSDVWVSQPTWDNHVAIFNGAGIKTHFYPYFDAETRGVDFDGMLSTLKTLPEQSIVLLHPCCHNPTGADLNPAQWDQVIAVLKDRNLIPFLDIAYQGFGDGMEEDAYAIRALDQAGLNFIVSNSFSKIFSLYGERVGGLTFVCDDAEAAQCTFGQLKATVRRIYSSPPTTGAWLVDEVLNDAELNQQWQGEVKEMRERIIKMRSILKDELTKALPDRDFSYLVNQKGMFSYTGLTAEQVDILREEYAIYLVRSGRICVAGLNMNNVYTVAKAMAEVLAKSVEAA

SEQ ID NO: 4896 - protein, 194 aa, Acinetobacter baumannii
KESITMITTSVTEAAECLQQGQVLAYPTEAVWGLGCDPFNEQAFQKILELKQRPIEKGVILLAGHISQVEHLLTSLPQTTQQEIIDCWTNHQPSERATTWLLPADQHIPSWIKGEHPLVAVRVTTHPLCVALCNAFHGFIVSTSANPSGQEPAHSLQDACQYFGSQLNYLNGDLGQSQQPSRIINALTGEVIRP

SEQ ID NO: 4897 - protein, 525 aa, Acinetobacter baumannii
WFVMTTNTQITEDRILILDFGSQYSQLIARRVREAGVYSEMYAFDMSEEDIRAFKPNGIILSGGPESVHEEGSPRAPQVVFELGVPVLGICYGLQTMSEQLGGKVEPGTVHEFGYAEVDIVKRDQLIGNLQDRENQLHVWMSHGDKVSQIPEGFTITASTPSCPVAAVSDETRRFYGVQFHPEVTHTAKGEELLSNFVHKICGCGGLWTPEHIIDLRVEQLREQIGNEKVLLGLSGGVDSSVVAALLHKAIGDQLTCVFVDNGLLRLNEGDQVMQMFAENMGIRVIRADAEARFLNALAGVTDPEAKRKIIGREFIEVFAEEARKLDGVKFLAQGTIYPDVIESAASKQGKAHVIKSHHNVGGLPEDLAFELVEPLRDLFKDEVRKLGTTLGLPHSMIYRHPFPGPGLGVRILGEVKKEYADILRLADDIFMQELRDSGWYDKTAQAFAVFQPVKSVGVVGDGRRYAWVIALRAVETVDFMTARFAHLPYELVDKISTRIMNEIKDVSRVVYDVSSKPPATIEWE

SEQ ID NO: 4898 - protein, 282 aa, Acinetobacter baumannii
WSVMFRVFVFSMFSLMSTLGWSQGLVVSTHPIYLIAKEITKGVEEPQLLLQGQSGHDVQLTPAHRKAINDASLVIWLGKAHEAPLNKLLSNNKKAIALLDSGILSILPQRNTRGAALPNTVDTHVWLEPNNAVRIGFFIAALRSQQHPENKAKYWNNANTFARNMLQAAQAYDSSSNGKPYWSYHDAYQYLERSLNLKFAGALTDDPHVAPTAAQIKYLNDSRPKAQMCLLAESFTTKGQYQKLGSITFQPVDESMNNEDNFVTAWKKLAIKTDKCVLNTQK

SEQ ID NO: 4899 - protein, 257 aa, Acinetobacter baumannii
SRSMKNEDQQFSLLESIEVHEFLYEKEDIVRPHASLWGDFNFSLNGILEIQVEEQIYLSPPSYGLWIPPQTVHQSTHIDHEIHYICIRLHPRLCSILGDICRCFSIQPFFRTLVLQILEQQKQTEKPEYLEHLLQVLFDQLQQAPAYSHYLPQTRHPVLLPILEKLSDPLLFNLSLQQLLQNFSVSDRHLLRLSQQELQLSLSEWRNRAKIVYAIHQIRQGTPIKRLAYDLGYQHSSSFIEFFKRYTGQTPVQIRNN

SEQ ID NO: 4900 - protein, 232 aa, Acinetobacter baumannii
FAAMLHCCFTTMPLNDNFVYAPPQDPLSILFEDDDLIVVDKPAGLLSVMGRLPEHHDSAYLRVLEKFPLAKVTHRLDMATSGLLMFAKHRDAEVAVSKMFQARTVKKHYIALVQGQVKQEGSVEVPLITDWENRPRQIVHFELGKHAKTLFQPLVYDATTDQSRVLLEPVTGRSHQLRVHMMHIGHPIMGDKLYHPEPKRFHLNRMALHAAYLAFQHPLKGTDVVIESQVPF

SEQ ID NO: 4901 - protein, 527 aa, Acinetobacter baumannii
RKCIEKYFLITEHNKNMTYGEVMNTIQKIELDTAKLLINGQFIESKTQEWQDIVNPATQEVIGRVPFATVEEVDAAIQAAQDAFASWRQTPIQARMRIMLKLQDLIRANMKEIAQVLTAEQGKTLADAEGDIQRGLEVVEHACSVGTLQMGEYVEGVARGVDTYTLQQPLGVCAGITPFNFPAMIPLWMFPMAIVCGNTFVLKPSEQDPLSTMMLVELAIQAGIPAGVLNVVHGGKEVVDHLCTHKDIKAISFVGSTAVGTHVYNLAGQHGKRVQAMMGAKNHVVVMPDANKEQTLNALVGAAFGAAGQRCMALSVAVMVGDSKQWIQELVEKAKTLKVNAGHEPNTDIGPVISKRAKARVIDLINSGVEQGAELLLDGRNVQVQGYESGNFVGATIFSGVNTDMRIYKEEIFGPVLSIICVDTLDEAIALINANPFGNGVGLFTQSGAIARTFQNLIDIGQVGINIPIPVPVPFFSFTGSRGSKLGDLGPYGKQAVQFYTQTKTITSRWFEDSHEVGGVNTTISLR

SEQ ID NO: 4902 - protein, 141 aa, Acinetobacter baumannii
AGSMVSIPPHFSISTDGFIRMNENQLMSYPLQHIISIVESRHTEASQIFYYGFTEWATSQTPALSTGWDWELIENNGITTVKRVGLPRSNIMIVDVSGMDIGFDINETLLEKKIDTLFWEPFIYAQINTSLTKSSLSQTFS

SEQ ID NO: 4903 - protein, 220 aa, Acinetobacter baumannii
NGIISLLLSIFAMSLQVWFAYMLACWVISISPGAGAIASMSSGLNYGFRHGYWNAIGLQIALLIQIMIVAAGVGVLFATTPLAFQAVKWFGVAYLLYLAYLQWTAPVKDIEIQHEKKDKSVSALLFNGFVVNISNPKAIVFLLAVLPQFLDLSKPQWIQYLIMAATMVTIDLIVMAGYTGLASKVLRLLRSPKQQKYLNRGFAVMFSCAALLLSTVHQAA

SEQ ID NO: 4904 - protein, 66 aa, Acinetobacter baumannii
QPIITKSDISTVMVKKNQMQICRYYMLFVQSYLMINILMSNAIGFDYKIPLCSDSALFMLDEILLL

SEQ ID NO: 4905 - protein, 412 aa, Acinetobacter baumannii
GTTMLQTMIADFQQHFWLYVSIPFMSGLIGYVTKVIAIQMMFSPLEFKGIKPFFGWQGIVPRKAEKMATTAVELMTAKLIKPEEIFARLDPKRIAKEIEKPLMAAAEDITREVAQEYQPGLWEGMPEFARQRLIRRVQSKAPEIVEHIMSEVQRDVNRYFDIKHLVISNLLKDKRLLNNIFKRVGKQEFKFFSNVGFVFGFGIGVIQMLCWIVTQGKYPWMLPLFGGFVGFFSDWIALQMMFRPLYPKKILGYTWQGLFIKRQNEVAADYAALISKQLLTSRHMMEELFSGTHSARVIELVNRHVKQEIDMQAGVIRPLVVYAIGGEKYQNMKTQVAERIMQQLPETMKYVESYAEDAMNIRNTLIERMQKLTPSEFEGMLRPAFKEDEWALIAVGAVLGFVVGELQIQFML

SEQ ID NO: 4906 - protein, 146 aa, Acinetobacter baumannii
LATIIERKTRLCILATLPDAKAESVRKALTEALKYLPAELRKTLTYDRGREMSEHKILEEDLGIDVYFCDPHSPWQKGTCENMNGLIRQYLPKGIDLNQADQHYLNQVAMSLNTRPRKALDWLTPLEKFAQLVDYHMAFETVAPHV

SEQ ID NO: 4907 - protein, 170 aa, Acinetobacter baumannii
IYVFLARILKKEEISMRPLDRIDRMILDILQREGRIAISELASRVNLSTTPCSERVKRLERDGIIMGYYARLNPAYVDRNLLVFLEIKLSAKSGDVFDQVARDLVEIPEVLECHLISGEFDYLVKARLKEMSAYRRLLGDLLKKLPASASSHSYVVMEEVKETLYLDVSK

SEQ ID NO: 4908 - protein, 159 aa, Acinetobacter baumannii
GIAMNINLTLIGQAIAFAFFVAFCMKFVWPPLINAISERQRKIADGLNAAEKAKADLADAQAQVKQELDAAKAQAAQLIEQANRRAAQLIEEARTQAAAEGERIRQQAKEAVDQEINSAREELRQQVAALAVTGAEKILNQQVDAKAHNAMLSQLAAKL

SEQ ID NO: 4909 - protein, 394 aa, Acinetobacter baumannii
EVKMLNTAFEPWPSFTTEEADAVKNVLLSNKVNYWTGQECRIFEKEFAEFSDTKYAVALANGTVALDVALKALDIGAGDDVIVTSRTFLASASSIVTAGANPVFADVELDSQNISRRTIEAVLTPNTKAIICVHLAGWMCDMDPIMQLAAERGIYVIEDCAQAHGAKYKGKAAGSIGHIAAWSFCQDKIMTTGGEGGMVTTNDETLWKKMWSYKDHGKSYDSIYNKQHPPGFRWLHDSFGTNWRMMEMQAVIGRIQLTRMAEWTKKRTENAEKILKAFEDSPFFSVHTPSVDYIHAYYKCYVHVNLEALPDGWSRDRIMQEINSQEVPCFSGSCSEVYLEHAFDGTPWRPEKRLENAQKLGETSLMFLVHPTLSQDSIEKTILAINAVNRALQS

SEQ ID NO: 4910 - protein, 231 aa, Acinetobacter baumannii
KRKIKVGNTMISVHHLECSRSFRILWALEELGLDYDIHFYQRLPNYSAPETLKCIHPLGKAPILTDDEQVIAESAVILEYLQQRYDQKQQFKPKQAQDLQQYIYWMHYAEGSLMPLLVMTLVMNNVNKHVPWLIQPVAKKITEGVKANFVRPRMKDHISFLENYLAEHEYFAGDFSFADIQMSFPLEALQSRLQGKYPHIQAFLHRIQQRPAFQKARQKGLGSNERNCADI

SEQ ID NO: 4911 - protein, 88 aa, Acinetobacter baumannii
LNEIRHLSPPSEETDIKKAGFNPAFSFDYSHSIVAGGLDDTSYTTRDTSLISFIMRVEILSTNSYGKCAKRAVIKSTVSTARSAITHA

SEQ ID NO: 4912 - protein, 182 aa, Acinetobacter baumannii
ARRIMAELLTLARPYAKAAFAYASEQGATDNWSNALQVLSAAVQDEAFSAYLNRPELTPAEQVKLFAKVLGEDQSQAVSNFLTLLADNDRLVLLPEIAAEYEQLKSQNNNNVDVVIESAFPLTAEQEQLLKSALEKRFNSTVTVSVEVKPELIAGVVIRAGDQVIDDSALNKLEKMRTRLLA

SEQ ID NO: 4913 - protein, 390 aa, Acinetobacter baumannii
FLGIIIMKKVFNGMVNFHALGIKKHLLALALCTGVAIGTIAEVHATSPNHNPPSLKSNAPNVYVVKRGDTLWDISGHFLNKPWRWPEIWASNQHVKNPHWIYPGDRLLLCSLDGRPLVGKDEGDGCVGIIRRYTGQTTNLQPQVRVEALNNSVPVIPLEHIKQWLENSTILPADSITNTPYIVGTADQRVLAGKGQTIYARGQGLINGQRYAVYREGEPYYFTDNKGKKHSLGIELLQVASGVAVSSEKDITTLELTDSYNAEVRRGDRVMPEEQATLPTLFYPVDAKQVTDGGKIIRVMGSIGRAAKNSVVTLDRGTTQGIQVGQVFDITQQGESIRDPKTKEVIQLPGQQIGSLMVFRTFDQLSYAFVLESDLPIKVGSSIQPPQFND

SEQ ID NO: 4914 - protein, 385 aa, Acinetobacter baumannii
FKMIISSGNDYRAAAQRRLPPFLFHYIDGGAYAEYTLKRNVQDLSEIALRQRVLNDMSALSLETKLFNETLSMPVALAPVGLTGMYARRGEVQAAMAADKKGIPFTLSTVSVCPIEEVAPAINRPMWFQLYVLRDRGFMRNALERAKAAGCSTLVFTVDMPVPGARYRDAHSGMSGPNAAMRRYMQSVFHPHWSWNVGLMGRPHDLGNISKYLGKPTGLEDYIGWLGSNFDPSISWKDLEWIREFWDGPMVIKGILDPEDAKDAVRFGADGIVVSNHGGRQLDGVMSSARALPAIADAVKGDLAILADSGIRNGLDVVRMLALGADTVLLGRAFVYALAAAGGQGVSNLLDLIDKEMRVAMTLTGAKSISDINADCLVQAIKQGL

SEQ ID NO: 4915 - protein, 143 aa, Acinetobacter baumannii
FLVFRSGLLLACAAVFLQIAVFLQPLLPKQYQIAPVCETITRALLKPKAQTEAMSHAMHHSHHQHHIEQAQVPDHHDHHDANHQCQYCTVYANLVLPPEFGVKEVLVRIQVRLVAYQQAFRHVYFALQRLFLLPQGRAPPLFA

SEQ ID NO: 4916 - protein, 390 aa, Acinetobacter baumannii
GYFVSEVENKMKFLMISSFLPSVLNFRGKLLEAIHHQSHEIHIIAPDLELFQPEMDKLKSLGYSVYSVEMQRTGTNPIADIKTLFEIYKITKKIKPDYVLSYTIKPVIYGTLAAYLAKVPNRFSLITGLGYAFQNVDSTSKRSTFQKIVHWLYKQALIRSSKVFFQNPDDLALFKQLNLLSNKVPAVVVNGSGVNVTDFEVVNLPRAVNGEVRVSFLLIARLLQDKGIREYVEAAKLIKKEYPQIEFNLVGWIDENPTAIKQQELDSWIDGKIIKYWGKLSDVRPAIAESSIYVLPSYREGTPRTVLEAMSMGRAIITTDAPGCRETVEHDGNGYLVEVKSVTSLEMAMRKFIQNPELTEIMGTRSREIALHKYDVHQVNHHMMTEMGIK

SEQ ID NO: 4917 - protein, 627 aa, Acinetobacter baumannii
KSIVKKIIYQFASAPRLTKQCFLVLIDLFAFPIILWLCYAIRLFDLGAEVIPGINYGVAFVTILAILSLMLTGVYRFIVRTFNEAFIAKLAIAVTLMVIVLYSMNAFSPAFVPTSIPLMFGFLMFSWVWCSRAFIRFIVKATLQTGEERKRIAIYGAGDAGQQIAAVLYRSGNHLPVFFIDDNTSLQDHMVGGLKVLSLEKALQRFEKYKTDEILLALPSVGRVRKSEIIQQLEPAHLKITELPGLTQLVDGELKVADIREVDIIDLLGRDPVPPVDHLLAKNIHNKIVMVTGAGGSIGSELCRQIVKNQPKMLIIYEITEFALYSIDKELRLAAQCEIVPILGTVQDQQKLERIIEQYSVQTVYHAAAYKHVPLVECNPIAGLKNNAIGTANSLNAAVKKGVETFVLISTDKAVRPTNVMGASKRMAELYCQAMAEAQKQTQISIVRFGNVLGSSGSVVPLFKQQIAKGGPITVTHPEVTRYFMTIPEASQLVIQAGALGRGGDVFLLDMGEPVRIQDLARQMISLSGLTVREQGSMQGDIEIHYSGLRPGEKLYEELLIDQENTEYTEHSRILRSFEKFYPLTEIQEVFDRINNMTAVQQDIDWALCQLEHYVDGYKRSKDIMVN

SEQ ID NO: 4918 - protein, 242 aa, Acinetobacter baumannii
LKIVDNMQDLTFAPEPLQSQGRTLTEHVFKQIQTAIVLGQIPAGSKISEPELARTYGISRGPLREAIHRLEGQRLVERTAHVGARVVSLSLQQFKELYQIRASLEGLACKLAAQHIDKKQILALRDVLRMHAEDENFKAGKGYYLQEGQDDFHYCIIKSSGNKTLEKMLCDELYHLIRMYRIQFSNTPDRPSKAWDEHIRILDAIADGDGELAELLMHRHINASYKIIEQTLLQAQGEHNNG

SEQ ID NO: 4919 - protein, 630 aa, Acinetobacter baumannii
VMAVMCTDNIIATLESHAKLNGNKIAFEYLGRQSGGIQSLTYADLNERVQHQAQILMNLVDSGDRAVLLFEPGLDFIVSFFACLKAKIIAVPVSLPFNRNGFSNILNIMNDCEPKIVLTTKKILELAGLITLKAQNENLILHAVDAELQRDLVEKDFPLITEKDICFLQYTSGSTGWPKGVIVTHKNIMANEVMIAEAFGTQPEDVGLTWLPVYHDMGLIGSVLQTVYVGLTCYVMSPLDFIRKPLKWLQFISEKGVTISGGPNFAYELCLHRITDEQAAALDLSRVRVLFNGAEPIKAHVMQRFMEKFNTQSRLRLDTFLPCYGLAEVTLLVSGVTGPLNAISLDRDKLNAHLVQTSQDQTAVQVVSCGKISKHIDCRIVNPHTRKEVAAHEVGEIWLAGESVTAGYWQKPEVNQETFEATILNESGQPGQVHYLRTGDMGFIKNGDLYITGRLKDVIIIRGKNYYPQDIECSVEMAHPAVRKGCVAAVNFADSEGVTVVLEIKKKSLDKTLNFETIRTQVKEQVAADIGLPVDGVYLLHQGRINKTTSGKIRRRKIKEQIERGQLVCLTHPNRRTVIARNYVKNGLDVIRDREQRGQLIRYSSNLLNSMIKEREVRTLIFNRLKSALF

SEQ ID NO: 4920 - protein, 565 aa, Acinetobacter baumannii
RFCLRRSWTLMSKSIEQFPKDLSSPLIQLKSSVEKNSKLHIKELFALEPERFQNYSVKFDQLFFDYSKQRITKNILEQLVALANNKQLTQWINRLFSQDKINCTEQREAMHWALRLPSEYSKFPELTKQVHIQLQRMYTLVEKIHAGQYRGATGEVIQDVVNIGVGGSDLGPHMVTHALADFKVKTAKPLNVHFVSTMDGSQLSDLLHQLRPETTLFIISSKSFGTIDTLSNAQTVRQWLEKALGKHDRVVKSHFIGVSTKAEKMNEWGIAPDNQLLLWDWVGGRYSLWSCIGFPIALTIGIDGFQQLLAGAHAVDEHFQNTSFERNIPVLMALLGIWNNNFLNIQTHAVLPYDGRLKYLAAYLQQLEMESNGKSVQRDGQKVELDTCPIVWGEVGPNAQHAFYQLLHQGTQAVSCDFIAPIQRYNADHFTYVENAEALIEQHHLALSNCLAQSRLLAFGNEALDVKELEKLPIYKQYEGNQPSSTLLLDELNPYNLGMLIALYEHKVFVQSVIWNINPFDQWGVEKGKQIANQLLPILNGAQNDLSTLDASTRGLIKILLGKAE

SEQ ID NO: 4921 - protein, 131 aa, Acinetobacter baumannii
SQSVQEQLLFVCRQGILGLNIRIIVKGKAMSLEQQLIERLQTLAPSHLEVINESAGHGGYFPGKESHFKVIVVSEEFNGLRLVQRHQKVYALASDLMNPGQIHALAIHAYLPSEWQGQAPASPECAHAPKN

SEQ ID NO: 4922 - protein, 69 aa, Acinetobacter baumannii
NHGLTEPNRHLNHKNMLPPKNLFLPVSLQIDSTKQEVEVIPYNAAQLDLSSHIAVPHNVSAMLLDNYST

SEQ ID NO: 4923 - protein, 97 aa, Acinetobacter baumannii
CSEVIWFFEETGCHGFQSMSITAIHKTAKIATSVPNHLGIKGFLGLLGLSDTPRCVLPNTWIIPLYFDCFISSLVLVYFKTSLRIDRFPCKALFLTT

SEQ ID NO: 4924 - protein, 171 aa, Acinetobacter baumannii
KFEVMSMSSCMHEHHDSLHGVHDHHNVASRLAEAETLCTAVGARLTPLRKEVLELILNASGPMGAYDLLARIKSQTDRPAAPPTVYRTLDFLLEKGLIHRLTSINAYIPCCHPREGHQAAFLICTECHTVKEASSQGLTQQLDQLAALDDFAAQHSIIEISGKCQQCRTAR

SEQ ID NO: 4925 - protein, 209 aa, Acinetobacter baumannii
TRILLHYSRIAVKTNALLDINYNLQERLMTQSVYHIPVKAISGETVDLDQYKGKVLLIVNTASKCGLTPQYEGLEKLYQAKKDQGLEILGFPANNFKEQEPGSDEEIQQFCSLNYDVHFPLFSKISVAGEDKHPLYQALTTAQPERIGEGPFRERLEGLGIPTNPAPEVLWNFEKFLVNKNGEVVARFAPNLTADDEQIVKAVEAELAK

SEQ ID NO: 4926 - protein, 81 aa, Acinetobacter baumannii
RSASGVVQLDLPTPLLSPVCFKFTQCSYPSSSNTTQLTLLIEFVADSLILLNIFLNFSLSAEFGLANNLRAVVLLFPSATT

SEQ ID NO: 4927 - protein, 69 aa, Acinetobacter baumannii
NINSHYILCVSVIYYTCKCLQVSGLLSKIKKLNPLYESFFVQLYIFNFLSLFKISVPPILNLDTHKPRF

SEQ ID NO: 4928 - protein, 488 aa, Acinetobacter baumannii
QRNSKRNFNMTTARHSDTENSPDHLQRKLSNRHLQLIAIGGAIGTGLFMGSGKTISLAGPSILFIYMIIGGMFFFLMRAMGELLLANLHYKSFVDMAHDLIGPWAGYYLGWTYWLGWVLVGIADLSAVINYLSFWLPDGASFSPIQQAMISAGCVLFVMGLNLLTVRLFGEIEFWFALIKILAIIGLIGVGGYMIFSHFQAPQGAVASISNVWSHGGLFPKGTEGFLAGFQIAVFAFVGVELVGTTAAETKDPQKNLPKAINAIPVRIILFYVLALFIVMSVTPWDHIRADKSPFVDLFLNAGIPVSAIIMNLVVLSSVMSSMNSGVFSTSRMLFGLSKDGQAPGAFGRLSKRAVPSNGLIFSCTFIMGGAVLQYFVPNTMEAFTLASSLCVILFISVWSLIMVCYLRYRKLRPELHEKSTFKMPGGIWMSYVVLAFMLFTLVILALEPDTLKALYVSPVWLIILGVTYHVLYKPRMKRLGRELVNDH

SEQ ID NO: 4929 - protein, 103 aa, Acinetobacter baumannii
TQYTPYQYIKLYKRKQMSHIGQDKKIVNRVKRLKGQINSIENAIEQPEYSCIDILQQVAAIKGAINGLMSELMEQHLHHHVLKGAEVDQNELDEFLKVLKRYG

SEQ ID NO: 4930 - protein, 363 aa, Acinetobacter baumannii
SFYTINNFFILTNVTHLFSLVQFNILVGSILGLNFMQDYSVSRHHQHQFDEGNPLAQKRILIATILTASMMVLEVFGGWFFNSMALLADGWHMSSHMLALGLAYFAYRAARHYSNDHRFSFGTWKIEILAGYSSAILLMVVAIFMAFQSIQRLFNPVEIFYNEAIPIAILGLVINLICAWLLHDDGHHHHHHHHHHHHHHHHHEHGHGHHHHDLNQKAAFLHVVADAVTSVFAIVALFAGKYFGWDFLDAILGILGAILVAKWSFGLMKETGKTLLDAEMDHPVVDEIREVIAEFPKHVEITDIHVWKVAKGKFSCILALETDDISLNADQIRDALSIHDEIVHISVEINTLKPVYVPRETLA

SEQ ID NO: 4931 - protein, 63 aa, Acinetobacter baumannii
TPQTHRTTTNFDYLFQLSLAIVAGKFINNENTVIHIRTVYKSSGEGEQCICISWVFVALLWAL

SEQ ID NO: 4932 - protein, 660 aa, Acinetobacter baumannii
QAKTLQQNFRGTHQMAKIIGIDLGTTNSCVAVLEGDKVKVIENAEGARTTPSIIAYKEGEILVGQSAKRQAVTNPKNTLFAIKRLIGRRYEDQAVQKDIGLVPYKIIKADNGDAWVEVNDKKLAPQQISAEILKKMKKTAEDYLGETVTEAVITVPAYFNDAQRQATKDAGKIAGLDVKRIINEPTAAALAFGMDKKEGDRKVAVYDLGGGTFDVSIIEIADLDGDQQIEVLSTNGDTFLGGEDFDNALIEYLVEEFKKEQNVNLKNDPLALQRLKEAAEKAKIELSSSNATEINLPYITADATGPKHLVINVTRAKLEGLVADLVARTIEPCKIALKDAGLSTSDISDVILVGGQSRMPLVQQKVQEFFGREPRKDVNPDEAVAIGAAIQGAVLSGDKNDVLLLDVTPLTLGIETMGGVLTPIIEKNTTIPAKKSQVFSTAADNQPAVDISVYQGERKMAQQNKLLGNFQLGDIPPAPRGVPQIEVSFDINADGILKVSAKDKSTGKEQSIQIKANSGLSDAEIEAMIKDAEANAEEDRKFEELAKARNEADALISSSNKAVKDLGDKVTEDEKTAVNTAVSELEAATKENDVEVIKAKTEALQNILMPITQRAYEQAQQAGGAEGFDPNAFQGGDAGQQKADDGVVDAEFTEVKDDKK

SEQ ID NO: 4933 - protein, 90 aa, Acinetobacter baumannii
TLHLNVCRNERKAIMKKLGLISVVLAGVAFTAVGCASEAGLNASGSAQTSASPSGVQAGVGVDAGVSGQAQPGQVDAGASGSVSGSATAQ

SEQ ID NO: 4934 - protein, 314 aa, Acinetobacter baumannii
EFIYIFIFAMKKFLWWGISLYFSISLQVTAFAQSNLSNISFNQPLKYRIDYIDPRFKLTKEQFIQIGKEAAEIWQKETGKTYFIYDSQAELTINLVLDNQQATKNERKNSINELLKQQEEWREKNKAILLFKQQIDQEASLLNKEKENLNYKFEQYQKDVSLFNQGNYGQFTQSSLNKRQAELSQLSLELQTKFSQHSNKIEMLNRQIKQINQQQNLLNQSIEQFNLSTTSGSKTFHKGLFSQNQIQIYGFTSFDDLRLTLAHEFGHALGLKHTDDPKSLMYPLLREQDIHNFKLTNSDLDLLATLYGSNDENH

SEQ ID NO: 4935 - protein, 243 aa, Acinetobacter baumannii
NVLLSCLRVGFMIKKLGILALFSLTTSLSFANVDTVRENIKKQYPNLKISNIQKTEMPGLYSANLDQQIIYLGEDGQHMFVGSMIRLKDQKNLTKDLVLGQNSIDWKQLPLKDAIKTVKGNGQHVLAVFSDPNCPYCKQLEPELDKLKDVTIYTFIYPLKPQSIVVSRQVWCAPNQSYSWKKLIEQGVKPTVASCTNPIDRNLELGKKLGFNGTPTLIFANGFKLVGARSAEEIQAVWKELGL

SEQ ID NO: 4936 - protein, 308 aa, Acinetobacter baumannii
TVAYIVIIARHMDTLKAIQVFVSIAQHGNLTKAAEHLNYSRAMVSRYLEHLEHTFSTRLFQRNTRKISLTPAGEKTLLYCENILQQQQLLQELAAPEQHNGTIRFTCGLFLFELGVAECIRQFKRQHPHIQFDVYLTESTMDLIDAQVDLALRITQKVADGLIARPVCQIESVFCAHPDYLKQHSPLLHPRQLIQHECIAHHSQHQFWTLFDNEQQPQNYPLNVTFKSNDVNALYDMCLHAQGVAMLPTLLVERDLKEKRLKALFKNFTAPELSLSVVYASRQHLPRITQEFIAFMIENLDFYLKPQN

SEQ ID NO: 4937 - protein, 113 aa, Acinetobacter baumannii
LSFHYDKHLNAKFIFALPIIHNFFSQRAYHWLSFVVIAVQILQFFIKITFLNQLYYFINETIDKHLCNFINFLFFLYLTDIFKIFPFIETQYKLRRLLQSFSTFKIDFSLRNP

SEQ ID NO: 4938 - protein, 298 aa, Acinetobacter baumannii
SVLHETGEYLMKLFKLSASALATATALTMAQSALAQDLKIQSFLAKPEHFGVTSTLIEGDKEVLLVNAQFSKSEALRIAANILDSGKTLKTIFVSYGDPDYYFGLDVFKQYFPNVQIIATPETVKHIQDTQALKVKYWGPQMGANAPSQIIVPQAYTAKTLKLENESIEIKGKKELTYLWVPSAKAVVGGIPVSSGIHLWMADTPKTRDRVEVIQSLESIKALQPKIVVPAHMVEGAPQGLDAVNFSINYLNSYEKAAKATKNATELSKLMQKQYPTLQSVDSLQLGAKVVKGEMQWP

SEQ ID NO: 4939 - protein, 196 aa, Acinetobacter baumannii
YWPHLFLSCLAWYKSSFYHFYALEMPMNAVATDTQPLVGIIMGSQSDWATLEHTANMLKQLGVPFEAEVVSAHRTPDRLFEYAETARDRGIQVIIAGAGGAAHLPGMCAAKTDLPVLGVPVKSSILNGVDSLLSIVQMPAGIAVGTLAIGPAGATNAAIMAAQILGLTRPEIAKNVADFRAAQTDKVASNNIPGQV

SEQ ID NO: 4940 - protein, 62 aa, Acinetobacter baumannii
CIPHANLDLIKLYRHSVSNHCLPLFTTQQKAIAVLIHHNKASTCKMPCYLNLQKRLYFKKTG

SEQ ID NO: 4941 - protein, 80 aa, Acinetobacter baumannii
KKINTRWVLFKHNPLFFNCPTGFGKTNLMQPVGKASCNQNQLEKYVLTFQDFVQKMWTPLQKGKGKKFKKNCAFLNLVLT

SEQ ID NO: 4942 - protein, 475 aa, Acinetobacter baumannii
KHSNSYSYCVQKQWRRRAMHLHILGICGTFMGSLALLARDLGHKVTGSDSNVYPPMSTQLENAGIELMQGYDRSHLQPHPDLVIVGNAMKRGIDAVEYMLNEGLPYISGPQFLADHVLQGKHVLGVAGTHGKTTTTTMLAWVLDQAGLNPGFLIGGVPLGFSESARLGGGKYFVVEADEYDSAFFDKRSKFVHYHPKTAILNNLEFDHADIFDDLAAIQKQFHHLVRTIPSEGRIIAPITETHIDEVLEMGCWTPVIRTSLEANEKAALSAELISIDGSHFKVLENGNVIGEVKWSMTGQHSVANALATIAAAQHVGVSLEKACEALSNFGGVKRRMELLGTINGIEVYDDFAHHPTAIDTTLDGARKRLGERRLWAIIEPRSNTMRMGSHKDGLAHSARLADEVIWYQPEGLDWDLQPVIEAATNHAQVSRSLDEIIDRIVNEAGEGDAVVIMSNGGFGGLHQKLMSALKAKAA

SEQ ID NO: 4943 - protein, 363 aa, Acinetobacter baumannii
EGFKETGMTAFNQKIQTLLDKGQGPAARALDRLPRLAQESLAKILGYSYQYPDLDSFTKCMMAVQIKQGRVGFIGSDPIESRRAFDAQMQAIRQKPTDIELVEDIRLPLQSGTIFARHYHPAPNKKLPLIVFYHGGGFVVGGLDTHDEVCRLLAKYAKVQVLSIDYPLAPEVSPQHLIQSCEDALAWVYQNRRQLKILKSRIAVAGDSAGGNISTVVAQRSVNKAYAPQAQLLIYPTVDFKSRHPSFYAYNEGLVLTNTDIDYVTQYYATHHNVELDDPIISPTYGNLKKNPPAFVITAGHDVLHDEAKIYSHKLRQNGVKMHYEEFLDQTHGFINLTPISRKAKRYTIEISKNFRKFWDKNS

SEQ ID NO: 4944 - protein, 456 aa, Acinetobacter baumannii
LGYNQSKKVKIYRLSMSLIANTTVVRGRFLDIQQTVSEPTDIPNQIRYLEDGVLISEHGKIKWFGAWEDAQQHLPAGVEVQHYPEQLIVPGFIDTHIHFPQTEMVGAYGEQLLSWLNTYTFPTEIQFQDKTYASEIAQFFVKELLKHGTTTALVFCTVHPESVDALFEAAERVQMRLIAGKVLMDRNAPEALCDTPETAYSDTKALIEKWHGKGRALYAITPRFAPTSTPEQLERAGQLKEEFPDVYVHTHLSENKDEIAWVKSLFPEQAGYLDVYQHYGLTGKRSVFAHCVHLEDEEWQCMHDTQSAIAFCPTSNLFLGSGLFPLKKTWEKQVKVGLGTDIGAGTSFSLLQTVNEAYKVQQLQGDKLSAYEALYHATLGGAKALDLQDQLGNFNVGKEADFVVLNLKPTALQELRQSKSKSVEDSLFALFTLGDDRNIEATYIYGNRAYQKETAK

SEQ ID NO: 4945 - protein, 63 aa, Acinetobacter baumannii
TLHNKIADLYRKIIFGSFDMKRTFQPSELKRKRVHGFRARMATKAGRQVLARRRAKGRHSLTV

SEQ ID NO: 4946 - protein, 342 aa, Acinetobacter baumannii
YRCLIHLATGRGFFMPNCRMYGGFMETIGNLWLYVAFFGIVIVMLLIDFLGFKQKQGQDVSIKQAAYWSVAWVSVAALFGGGLWLYLQQTVGVTLANQKTMEYFAGYLLEKSLAIDNVFVWLMIFAAFAIPAALQRKILLYGVLGAIVLRTLFIFIGAWFVQEFSWVLYIFGAFLVYTGFKFLKGQEEETNIEDIKLLKWLRNHMRITPQLEGDKFFVRQNGLLWATPLFLVLILVEASDVIFAVDSIPAIFAVTSDPFIVLTANLMAILGLRAMFFLLAGAATKLHYLPYGLGIILLFIGAKMLLLDVFHMPIWISLSFIVIVLAITAYLSLRHNKKQLQS

SEQ ID NO: 4947 - protein, 67 aa, Acinetobacter baumannii
IASKFLNTKNTGPLGPAGAIKPAGVLPDKGPCISGEPSIRVTPRALQLLNGFFERRPSPSIDMPAGI

SEQ ID NO: 4948 - protein, 86 aa, Acinetobacter baumannii
PPPNITAMLCVRYRQYTFIKKSVSEHREIHGVGKTLIMLIQMFNSSGNWSRFFYAQLPDVWRIYGNNRQFMAVRSILWHSHCHASD

SEQ ID NO: 4949 - protein, 93 aa, Acinetobacter baumannii
LHQKNNWRINMWSLIVAIVVGFFAGLIARALHPGDDKAGFIVTTLIGIAGSLLATYGGRLLGLYGENSAAGFIASVIGAVIILFIYNLIARKS

SEQ ID NO: 4950 - protein, 187 aa, Acinetobacter baumannii
GNMKKLLMLLCLGVSSHSVWANTLVEMQTNLGNIEIELYDDKAPMSVNNFKGYIKSGFYKETIFHRVIPGFMAQGGGMTANMHEKSTRAPIKNEAGNGIANTRGTLAMARTSNPDSATSQFFINVADNNFLNRSPGNPGYAVFGKVVKGMDVVDRIVQAPTSNYGMHQNVPKQPIKIVDIKIKNFQK

SEQ ID NO: 4951 - protein, 198 aa, Acinetobacter baumannii
MSLETLNLSLFHVINGAQDASQFIIRLAIFFANDLLYILLFILTFLWFYGDQDLKNRVIKSVFLTCVSLLVGYVISLFYHHPRPFVMGVGTTFIEHAPTASFPSNHMLIFSTIALSYLFAQRKMIGIILLFLSFVVAWSRIYLGVHFPLDMLGAFIVALLVNTAGYYFWNVYGTPLTAFFIHLYQIICKPLLDRGLIK

SEQ ID NO: 4952 - protein, 130 aa, Acinetobacter baumannii
NRMEIKMSYYHILIEVNDHISTIEQTRDIELFDIIELKPYLHSILLPYFNEQEIELEDENIEYKDILHLEVKQTLLPIEHLIEEEQKQLPSDTDVTITAYEIFNDRDLSQDVTSVIFDILEAVKLDQSIV

SEQ ID NO: 4953 - protein, 402 aa, Acinetobacter baumannii
HFIRERYFMTTQEKQKKLSLRPLSPRDPEQPHRAATPLELLFDLIFVVAIATAGQQLHHAIIENHLWHALPSYLMVFFALWWAWMNFSWFASAYDNDDALYRCLTFVQIVGSLVMAAGIPDVFHSQDFDIIIVGYVIMRLALVTQWLRAAKHDPERRITAYRYAIGIVLVQIGWLVANFAHALSIPLFLLLVVVELFVPIYAEKYSPTPWHPHHIVERYALLTIIVLGESIVGSFNAIRDALAAQSINIPAVFLMIGGLMLMFAMWWAYFDRSEQHHHVKGVRPFVWGYGHYFVFVSVAAVGAALAAAVDVTTHHAHISDLYMGVIVAVSVVLYTSCIWILYEFQCLSGITKWFYPITALIILCIPFICNNVGYSVFAMGIVYTLRLFISNKFMENIEPKQV

SEQ ID NO: 4954 - protein, 107 aa, Acinetobacter baumannii
PMVRILRWFIRLYQIAISPLLGPRCRYIPTCSQYALEALQTHGAIKGVWLSSKRICRCHPWGGSGYDPVPPKAIRFISFHQIDSQTHHVAVPFRDRLMKQNLSNHLG

SEQ ID NO: 4955 - protein, 432 aa, Acinetobacter baumannii
DNMRRFSCIVGSVFLAMAQAQAELVINGSTISSNATVPVTNSDTYTPNNNFQSCLANLRSQAIAAGVSGSTYDRYTQNLTPDYSVIDKLSYQPEFSTPIWDYLSGLVDEERVALGKQKLAQHRDVLNRASQVYGVPAETIVAVWGVESNFGDISGKYPLLQALGTLSCEGRRQSYFRTEFFATMRILQRGDLTEDQLKGSWAGAFGHTQFMPSTYERLAVDFDGDGRRDLVSSTADALASTANFLNKAGWQTGMPWGFEVQIPAGMSIDGEGRRSKKPLSSWSARGVTRIDGSPLIQGPLSGSTPAGLMAPAGPSGPVFLVFKNFDAIYSYNAAESYGLAIAHLSDRLRGAGPFVSSWPTDDPGTSRAERREIQQFLINRGYDIGAVDGLIGDKTRVAIRQEQTRLGLNPTGRAGQQILRAFRQEQARKMMQ

SEQ ID NO: 4956 - protein, 364 aa, Acinetobacter baumannii
GLVRALIFLRSNAMNAFPTLTPLSLPCNSSFDAKDWEILSSHWYPVARIQDVSTAPQRVKLLDVNMALYKTESGEIHLVRDICPHRGVPLTKGWVDGEEIVCPYHGLRYNTEGKCTQIPAQPELTKISDRFSLTKFPVVQRYGLIWTSIHGRDIAKANIPVLDTWDDAEHQAILPPFVDIGGSSGRQLEGFIDVAHFAWVHHNAFANRDNPIVPKYHTERTNYGLKTVYISNVSNYPHELKHLEPEGFLWKRTFEVYPPFSAVLTVDFPEGGILKILNACCPISSNKTRLFVPLTRNFDQTGDLEKVYAFNAQIFAEDQDMVESQKPEELPLDLMMEAHFEADRSSTTYRRILAEWGLSKRYTV

SEQ ID NO: 4957 - protein, 115 aa, Acinetobacter baumannii
QTKRGTAMSAKLVVTLLATSLLTVGCVAYTDDPYYRGGYGYHDHDDDRYDRNDGRRYSEWERKRWEERKRLYEQQRKDIREQQKDRREWEKRHREWEKKRLEDRDHDHRDYRHDD

SEQ ID NO: 4958 - protein, 338 aa, Acinetobacter baumannii
KIMRHKSHYFVEIVYFLIDFSFYILIIRFFSNLPPLIMRLTSLLLGMAFAFSNFQANANLATPLHTQVQQKNVQHLTYKIAEVDPRFGLSQEQLIQITQQAADIWKEGTGKNYFTYDPNAKLEIRLVYDDSQNRSAERQKIASQFKQDQQRVIDEQQQIKQLKQNLSQTQSDLENKKQILNEKLKNFDQQMMQFKEGKLAPEYTAKSLSKTQKDLQKQTVALKKDIAAYNQQAADLNKKVTHFNQINDEFNQSLNQFKQNAQADVFKKGIYNGKQIMIYEYSSIDDLRLTIAHELGHALGLKHSDQPGALMYSVRKDSDKKSNILTDADRDLLSALPQ

SEQ ID NO: 4959 - protein, 129 aa, Acinetobacter baumannii
NVWSLMRSKKINLVVVPLLLTACSHNDGPLVQDVYNNQYDCARDWNNETCKQENSSSGHGSSYVGSRYLRPAYYQNNREVSYHGNTLHPYSNLSVSRPIISNFGEKRVFPIPNNLGGLVPNGFSFPRVN

SEQ ID NO: 4960 - protein, 201 aa, Acinetobacter baumannii
CQKGLYMFKNPFKRRSSMANEQNEQAQDIQNEQVEQSNEQTQAEGVEQANDVTVESLQAQITKLEENLKLEKARTANAVYEAQKSVERIQRESEKHKETVLEKFAKELLDSVDNLERAIQAAGDEETPVLEGVKLTLKSLLTTLEKFGVVEADTQNGFNADLHQAVGIDPNAKANEIGTVLQKGYTLNGRLLRPAMVMVGQ

SEQ ID NO: 4961 - protein, 135 aa, Acinetobacter baumannii
PDLGVMALYSFSTDLRIRCAADYKSVFDGALFKVHQPHFLFLAKLTEQPNSRLGIVVAKKKVRRAHERNRIKRLARESFRLHQPKFGSDIDVVVMPKVGIETITNAELYQQLDFAWQKLQRLAKKHSKVVPTSQN

SEQ ID NO: 4962 - protein, 101 aa, Acinetobacter baumannii
LFIIYRYFKKLKSLLLNPLIFPLMPNTCIYLFSFFSNFTKQSLSLVIFITLTNKDYILTIRIYLYFYFCHEKISMVGNKFILQYKLTGNCFCSKQFIKYFF

SEQ ID NO: 4963 - protein, 401 aa, Acinetobacter baumannii
RVLFSAGKLIRHPLNMKRKIFTPRPDWQVEHQNIGFDYFNLPSLDGSIYWSEGVAYEFTLKQIEQLEDAAYELHQMCLSVVGDLIQRGHYPAYFQIPETAINHIEHSWKQNAPMLYGRFDFAYDGRNIKMLEYNADTPTGLLEASVAQWLWIEQVSGIANRDQFNSIHEDLIKRWKTILPRGSHVHFAACQEAGREDWGNLEYLMDTAYQAHLQVSELSMENIGWNGQDFVDLHNQPIQNIFKLYPWEWIWEEAFSQYIHPQTQWIEPCWKMLLSNKAILVELWKYYPNHPLLVETHTYNPQQALSGKWVKKPILAREGANIQVLQDGHDQGAASGSFYFDDYDKYGYVVQKWVDTPLFSGQLPTLGLWMVGHQCAGMSIREDCYDIIGNDAHFAAHYFVE

SEQ ID NO: 4964 - protein, 454 aa, Acinetobacter baumannii
VNNMHSQTTIAAIATPPGRGGVGVIRLSGPKAYDIAQKLTQKNLPEARMAGFRKFYDAVGSIMDEGIVLCFPNPHSFTGEDVVELQGHGGPVIQNALLGRLFELGAIAAKAGEFSMRAFENGKMDLVQAEAIADLIDATSQAAARSAVRSLQGAFSTKINTVLEKLIHLRLHVEAAIDFPEEEIDFLADGKILALLEDVQQSVHAVQTSARQGQLLREGLQVVIAGKPNAGKSSLLNALAGVERAIVTDIAGTTRDVLHEKISLNGLPITLTDTAGLRETGDIVEKEGIRRAIKEIEQADLLLLVYDLNQGDDPLKLAQEYFAEHIEPRRLMLIGNKCDLTGQSAEISDYQGFRHITVSAKQEMGVQGLVDAITAHAGFHPEEDTFIARTRHLDAMKRTQLYLAEAREQLVVFNAGELVAESLRLAQNALGEITGDFSADDLLGKIFGSFCIGK

SEQ ID NO: 4965 - protein, 178 aa, Acinetobacter baumannii
ESAMTVAMSIMISTEEIQAKVKELGEQINSHYANSDKELVLIGLLRGSVIFMADLCRTITKPHELDFMTVSSYGGGTTSSRDVKILKDLDGEIRGKDVLVVEDIIDSGNTLSKVVEMLQTREPNSIQLCTLVSKPSRREIDLEVKFLGFEVEDKFIVGYGLDYDQKYRHLPFIGEIGL

SEQ ID NO: 4966 - protein, 105 aa, Acinetobacter baumannii
GIHMLWTDCLTRLRQELSDNVFAMWIRPLVAEEVEGILRLYAPNPYWTRYIQENHLELISILAEQLSEGRVRQVEILVDSRPGSILSSSEQPATTTAALQTAPIP

SEQ ID NO: 4967 - protein, 376 aa, Acinetobacter baumannii
EAEMDKTIGIFGGGQLGRMMAQAALPLNIQCTFFEANTDCPAGVLGQVFSSQDEQGLKQFIESADVFSLEFENTPVTDVDVLTQTKTLHPPRIALATAQNRLSEKALFDELEIPVAPYRAVDSLESLKKAVAELGLPIVLKTATGGYDGKGQFVLRSEDQIDTAWAELGPAKSLVAESFVKFSREVSIIAVRGQNGEVKTWPLAENHHHNGILSHSIVPAPNSEALQPVAQDYITRLLNHLNYVGVLTLELFVTEQGLCANEMAPRVHNSGHWSIEGAVCSQFENHIRAVAGLPLGSTDVVRPTVMINIIGQHPKTEDVLALNGAHLHLYNKSERAGRKLGHITLMPVDSNELTNLCRQLAKILPEPLALTDDMII

SEQ ID NO: 4968 - protein, 140 aa, Acinetobacter baumannii
ITVLSFIIFSIHINTYIIVMMKDVPLSPTVLAFVLLIISNCFMTLAWYGHLKFLHHAPFWQAILFGWTIALLEYSFMIPATRLLSDQGWTLGEMKITQEVVTLIVFVPFMVLLFKQPFKLDYVWAMLCLFGCVYFVFRSQ

SEQ ID NO: 4969 - protein, 60 aa, Acinetobacter baumannii
VMTVILRRLIFMETVLIKKKQPNKKGIVKFLLLFGICAIALKRDRHIPQNDKISQSSKGA

SEQ ID NO: 4970 - protein, 592 aa, Acinetobacter baumannii
PFGVIDMQQWARFAILGAMFVTAYLLILAWQKDYGNAATAPQQQAAAVSSHEVSADLPNAKTATVASDVPQANIAQSQTTDATAPVNQQLISVQTDLYHLWINPKGGDIVRIELLSHDKSKDSNQPFVMLENDAKRTYVAQSGLIGLNGPDSSRGGRPLYAVEKTSYTLADAKGVQDQSGHSEKVLTVPMVFKTPEGVEIIKTFTFTQGQYPIVVKHQVVNRSQQNWQGQMFGQLKRDNSEDPGKSSQGIFTLSTFLGGAWGTPDAHYNKLKFANFSEEKLNTEAKGGWVAMVQHYFVSAWIPGHLKLTQANGQPYVAKLESRQSADHMNIIGFTSPVINVPAGTSMEVDAKLYSGPKVQSELKDLAVGLNQTVDYGWLWPIAKLLFLGLQFFHSIVGNWGWSIILLTIMVKMILWPLSSKSYRSMAKMRVIAPEMQRMKEEFGEDRMRFSQEMMALYKREQVNPLSGCLPLLLQMPIFLALYWVLMESVELRHAPWLGWIQDLSAMDPWFILPLIMGATMFAQQMLNPQPADPMQAKVFRIMPIMFTVFMLFFPAGLVLYWIVNNSITILQQWFINKSVEKSRISKAESTS

SEQ ID NO: 4971 - protein, 82 aa, Acinetobacter baumannii
HLKFLKLHLKNPIQNIYLRKALQLQKQKSLHLQPHVKTQLFGLNHGDDAHGHARDGDGDGDGDGDGDGDGDHHHEVTRHKSS

SEQ ID NO: 4972 - protein, 128 aa, Acinetobacter baumannii
AVCSFFLTWSDKMLKIYGIKNCNSMKKAFDALQAKGLSYEFHDYKKQGIDADTLKIWLKEIGQDTVLNKKGTTWKKLSEEEQTRALSSEDHLIEALIAQPSLIKRPVLQTSKGFLVGFDETAYQNLSA

SEQ ID NO: 4973 - protein, 1128 aa, Acinetobacter baumannii
TDSSVFYKVQPFIYPYDYKKMLFNIFSVLEKIGLNAQKRAIHVQFSNELLNHQVFLQRIEGQHQLNGGLMAELICLSTNAQIALKQFIGVQVAVDQVTDSGQLFRTTGIVTEASYGQSDGALTLYKLTIEDATNLWHKRRNSRVFMNKSIVEITEVLFKEWQEKSPLFAASLSLDLGGLSQNYDIRPFTMQHNESDYDFLTRLWRSEGVSWLIDESELFVPHFTAPIQAQKLRLIDDNNQYQALARRSIRYHRSSATEYQDSITGFVAVRSLQPTAVHVQRWQPDALAQEEGNGSVVTTHTHSDNFDSATLSLEQAWHVSPAWMQDLKGEDQATASSSSQLEKLNQHFTDMHASRAKYFKAYSSVRDTQVGYWFNLREHPEIDQHEGADQEFLIIAKNFYNQNNLPKDLHQQVSQLLTQSRWDQHGYDDIERQSNELTLIRRQIKTAPEYNPEQHRPIAYPQRAKVVGPEGETIHVDEWGRIKVRFLFTRSDDHGHDGGAGSNDNDTDSAWVDVLTPWAGEGYGARFLPRIGEVVVIDFFDGNIDRPFVTGRIHEAQRSPTKFDVKGQLPDTKKLSGIRSQEINGSGFNQLRFDDTTGQISTQLQSIHAATQLNLGNLSHPKEQATSQGRGEGFELRTDAWGAVRAGKGMLISTYAQEQAIADHLEAAQAQSLLSQGYESMKMLSEVAAKQQTDALNVINRLPKFIQSLELKTTGQALNSTVNLFKEGINNDPIHALKDCGGFIQDIGALGGNAKGVVDEFNSFFSDAKDAVENLKAFIENVEEHGPDIVKGKLASIKDRIHKNPFESIQEVGKVLANVETKDFDLMSTCGTFSKGSKLEVSPSKALSSLQGFMEGYTQGLESSSDTKQQEQGKIFRQALMLLASPNGIALTTPENIILQASQDIAESASGSINLSAQKNIIGHAQDKISLFAAQKGLRAYAAKGKLELQAQDDAIEAIAKKVIKLISTEEKIELTSPKEIVLTAGGSQLKINANGVFSTTGGKFESKAGQHLFAGGAKVSYEVPELPNTPTFSNRLDIYDLFWESDFSKLSYKAFMPETNSFTSGAIDEHGRTGKIGTPDPTNVQVLIGSDDEWGLLIDSFDEDEILEDQSINSNNSAIDNNIEDRG

SEQ ID NO: 4974 - protein, 419 aa, Acinetobacter baumannii
LPNSTVTVVKLAQSHGHQFGTKLMNTQSNTAFSLLALAIGAFAIGTTEFSPMGLLPNIANDLGISIPTAGMLITGYALGVMLGAPFMTLWFGGFARRNALIFLMAIFTVGNLIAAFSPNYMSLLGARLITSLNHGAFFGIGSVVAASIVPAHKQASAVATMFMGLTIANIGGVPLATWVGQNIGWRMSFLAISVLGIITMLALWKALPQGMVAQKPNVKAELKVLTRTPVVLALLTTVLGAGAMFTLYTYIAPSLTEFTHASPTFITFMLVLIGVGFSIGNHLGGRFADLSINKTLIGFLVLLIVMMVTFPILAQSQIGAAIALVIWGAATFALVPPLQMRVMSVAHEAPGLASSVNIGAFNLGNAVGAAAGALVLDLGWGYSVVSFAGALLAGLGLLLVLFQIKRESSPAQTLQQCSD

SEQ ID NO: 4975 - protein, 280 aa, Acinetobacter baumannii
NRRLGRIMSAAPRIGILGAGGRMGRILIQAVQQAGYQLGAAVVRPESTLIGADAGELAGIGSIGVKLTGSLAEVLEDCDVVIDFSTPAATSEHLKLCREAGVAIVIGTTGMSDEQKAELDETAKHIPVVYAANYSVGVNVSIKLLELAAKVFGDTVDIEVIEAHHRHKVDAPSGTALMMGEAIADTLGRNLKEVAVYGREGHTGPRDRQTIGFETIRGGDIVGEHTVMFIGEGERVEVTHKATNRMNFAAGAVRAAAWVVGREARKYDMKDVLGLNDVQV

SEQ ID NO: 4976 - protein, 84 aa, Acinetobacter baumannii
SSASRMCCFLLAKFLVFLKFSPIFHFLEYFFKNHKINFYQKKTPNSLYLEFIKLYRSLKNNYFSLSYSIQEIKCFYKKEYHCTN

SEQ ID NO: 4977 - protein, 301 aa, Acinetobacter baumannii
TMKSTIEELVAFITIVDTGSFVAAAEHLKQTPSGVSRSLTRLEAKLDVTLLERTTRKLKLTQEGQQFLIKARKILNELNAAEEELQKSDQGTAGLIRVDSATPFVLHVIAPLMHKFRECYPDIEIELNSNDQVIDLLQHKTDVAFRFGELNDSSLHAKLVCKSRLYIVASPDYLALKGTPTQPEELEQHDLIGFTRPTYINSWPIKVGDEYFFAQSKIKASSGETVRQLTIRGHGIARLSEFEIWKDMEEGRLIALFEDKIEHQYQSIHAVYYQQEHLPKRIRLFIEFLAEQLKDGFKNAL

SEQ ID NO: 4978 - protein, 154 aa, Acinetobacter baumannii
NLMSTETSLRPLFWKNYTLEQLTQAEWEALCDGCGLCCLVKLEDEDTHEVAYTKVACKLLDCNTGRCSDYPNRQQQVPDCLQLTPETLKTIHWLPSSCAYKRLNEGKNLPSWHYLNTGSRQSVVKAKKSVAGRCIPETDVHEDDIEDYVVRWVR

SEQ ID NO: 4979 - protein, 639 aa, Acinetobacter baumannii
VNIPTDLTLYQYHSARVEVISLKHNLLETQMPDYRSKTSTHGRNMAGARGLWRATGMKDEDFGKPIIAVVNSFTQFVPGHVHLKDLGQLVAAEIQAAGGVAKEFNTIAVDDGIAMGHDGMLYSLPSRDLIADSVEYMVNAHCADAMVCISNCDKITPGMLMAAMRLNIPVVFVSGGPMEAGKVKFRGDEKAIDLVDAMVVAADDSYTDEEVAEFERSACPTCGSCSGMFTANSMNCLTEALGLSLPGNGSIVATHANRKKLFLKAGQLIVELAKRYYEQNDASILPRSIATKAAFKNAMTLDIAMGGSTNTVLHLLAAANEAEVDFTMDDIDELSRRVPVLSKVAPAKQDVHMEDVHRAGGIMAILGELDRANLLDVSVPTVHEKTLKDALDKWDIIRTEDPDVYEFYRSSPGGVPTQVAFSQNRYYSTLDGDREKGVIRNAEHAFSKDGGLAVLYGNIALDGCIVKTAGVDESILKFTGSARVFESQDAAVEAILGNEIKAGDVVIIRYEGPRGGPGMQEMLYPTSYLKSKGLGKDCALVTDGRFSGGSSGLSIGHVSPEAAEGGAIGLVEDGDTIEIDIPNRTIHLNIDDATLAHRRTVQEAKGWHPKEERKRKVSKALKVYAMHTTSAAKGAVRVL

SEQ ID NO: 4980 - protein, 402 aa, Acinetobacter baumannii
RSNPLIRKSNSLLKILFSSICLISGSAMAAPITDLSKQIVSEKPGSILSIAQQDVTDLFPHADQRLLVNYRSRGVNDEPIVASAFILLPKGTPPKNGWPVLAWAHGTTGVADTCAPSGDYAGGPVHSYQEVASKALDGWLARGYAVVAPDYQGLGTLGAHPYMNAKSQLHTVVDAVRALHMLKPKDFNKQWLVMGHSQGGAAAITIAAYGQKDAPELDLKGAIALAPGGYQYEGIAEYVKTNPNPEPSVAAFFPIVLLGAQAAEPSIIPENLVSPEMGNVLTQARSRCLSELQSDLKKSPSSIFRPNADLKPLLSYLKQQSIENMVPTVPLMIVQGSKDHLVDPRGTYAYYQQLCKSKKPTIYQTIDGGDHRDALRQSHTFATDFLNVIEKNQTKSYCSNLK

SEQ ID NO: 4981 - protein, 178 aa, Acinetobacter baumannii
PCPFMGKNCQVMIMKNIQIQPLTIENFQPFGEVICCDGHDFFHINDAHTERYHALVETEIEGEAKAGISIFRNIKASVLPMEISMLERHPKGSQAFIPLQQQKFLIIVAPALDENTPDISKLCAFVSDGKQSINYRAGTWHHPLLTFEAPSDFAVVDRIGGGANCDIFQFPEAIKITV

SEQ ID NO: 4982 - protein, 346 aa, Acinetobacter baumannii
LFMPEFSFSDALLNWFDQHGRHDLPWQVADDPYKVWVSEIMLQQTQVKTVLQYFDRFMERFPTVEALGYATWDEVAPYWAGLGYYARARNLHKAAGLVAQQGKFPETLEEWIALPGIGRSTAGALMSLGLRQYGVIMDGNVKRVLARFFAIEDDLSKPQHEREMWKLAEELCPTHRNHDYTQAIMDLGATICTPKKPLCLYCPMQAHCQAYQQGLEQELPFKKPKKTPPVKTADVLIIQCEDEWFWQQRQAHGLWGGLFCLPILENEHERLKLSQQFKLQPQPQTFQISHSFTHFTWLLNAHVFHVEPDQKEHLAIELEGQWLSPEQAIAKGVPTAMKKLISTSRS

SEQ ID NO: 4983 - protein, 375 aa, Acinetobacter baumannii
KRMPLSRVEELVADIRAGKMVILMDDEDRENEGDLVIAATHVRPEDINFMITHARGLVCLTLSRERCKQLNLPLMVDQNGAQHGTNFTLSIEAAEGITTGISAAERAHTIQAAVAAHAKPTDIVQPGHIFPLMAQPGGVLHRAGHTEAGCDLARLAGLEPASVICEIIKEDGTMARRADLEIFAEKHGLKIGTIADLIHYRMTNEQTVERLDQRTIQTEYGSFELYRYREIGNPDIHLALVKGEPKEGVTTVRVHGFSPVRDLLKLNKADGEPAWNLDRALQTIAASDRGVLVWIGQDHLQDLGPALDDLTKPKPVKSNAALSHQYQTIGVGAQILRDLGVEKMKLLSSPLRFNALSGFNLEVVEYVTADQITTK

SEQ ID NO: 4984 - protein, 375 aa, Acinetobacter baumannii
  UNSURE (322): Identity of amino acid sequences at the above locations are unknown.
GAPPNMAKRDYYEVLGVSKTASDDEIKKAYRKLAMKYHPDRNPDNAEAEEKFKEASEAYEILSDSEKRSMYDRMGHNAFEGGFGGAGGGFGGFSAEDIFSQFGDIFGGAFGGGGRQQRQRRGSDLRYVMELTLEEAVKGVKKTITFTAPAPCDVCDGKGSKNPKDVETCKTCHGSGQVRMQQGFFSVQQTCGTCRGQGKIIKNPCHACHGSGVADRQQTLEVTIPAGVDNGDRVRLSGKGEAIRDGQAGDLYVEVVVREHEIFQRDGADLYMDVPVSIADAALGKEIEIPTLEGRVSLKIPEGTQTGKLFRLRGKGVRPVRXSMVGDLLCRIVVKTPVNLTSRQRELLKELQASFDGEDSASSPKKKSFFDRLFD

SEQ ID NO: 4985 - protein, 648 aa, Acinetobacter baumannii
RKITLSDRILCAHHQIRKTYNVTQYTAQSLEVLSGLDPVRRRPGMYTDTSRPNHLAQEVIDNAVDEALAGHADKICVTVYKDGSLSVEDNGRGMPVDIHPEYGQSGIEIILTKLHAGGKFSTDNYQFSGGLHGVGISVVNALSTRVEVEVQRQGNLYQMAFEQGEPVAPLAVLEGKAPKRATGTTVRFWPEAKYFDSPKFALKALKHNLKAKAVLAAGLKITYIDQINDEKIEWQFENGLVDYLMDELQDREILPNPAFVSSGQADRAACEFAICWNVEGGEQVQESYVNLIPTAQGGTHVNGLRSGVTEALREFCELRNLLPRNLKLSAEDVWDGVNYILSLKFQEPQFSGQTKERLSSREAANIVLNIAKDAFALWLNQHAEIAMQLAEMAISKAGRRLKAAKKVERKKIVSGPALPGKLADCVGQTREESELFIVEGDSAGGSAKQARDKNFQAIMPIRGKILNTWEVSSDEVLASQEVHDIAIAIGVDPGSDDLSELRYGKICILADADSDGLHIATLLCALFVKHFPALVEEGHLFVAMPPLFRIDIGKDVHYALDDEELETILKNVKGNKNPQITRFKGLGEMNAIQLRETTMDPNTRRLVQLDLDDAHLTAGLLDKLLAKKRAADRKQWLEQKGNLADITV

SEQ ID NO: 4986 - protein, 234 aa, Acinetobacter baumannii
IICTLPICGEKNKIEQNMNKKQIALTTLLCLSSLYTGAASTDKAKLSLDRNHIKVWTYQKADNPVFQYKAETTFDVPLERAVAVILDVDRAAQWVPYMGKVQMLSQDEKKGEFTLYMVLDFPFPLKDRDVVVKGKMSKAANGLITIKNTAVNSNYPIQPDVVRLTRYEGDWTFQKLANNKVKVTTSGYADPAGAIPLSFVNMFVQQQPYQMLLKMKREVMNPIYEQPKLPEILK

SEQ ID NO: 4987 - protein, 357 aa, Acinetobacter baumannii
SKHTVVWSKVKSLTLWLGILSIHLKLFTGWAEICLSESFSMDKKLFFKRCHMNHTFKWQGRHDGEGEAHQRIHHIVNKTQHAEFALIGFSSDEGVKRNKGRVGAADAPDAIRTQLANLPIHRPVSIVDLGTVTCEYGNLEQAQSELAEQVANSLEHGLKPVILGGGHEVAFGSFSGLFQYIQAHAPDKKIGIINFDAHFDLREAEYATSGTPFLQAARLSEQHQKQFNYLCIGVANHANTKVLFDTADALNCSYLRDHEVNIFNLPNVLAAVDAFIEKVDCLYVTIDLDVFAAAVAPGVSAPAVKGIDLATFEAIFKHIQETGKIKLLDIAECNPKFDLDNRTAKLAAYIVYQYLFS

SEQ ID NO: 4988 - protein, 358 aa, Acinetobacter baumannii
SFITHQNGSNPLKEFPMSNNTIQAYAAMQAGEKLVPYQFDAGELQPHQVEVKVEYCGLCHSDISVLNNEWRSTVYPVVAGHEIIGRIVALGSEAKGLQIGQRVGIGWTAESCQACDECIGGQQVLCTGENVATIVGHAGGFADKVRAGWQWAIPLPEDLDPESAGPLLCGGITVFDPLLKHKIQATHHVGVIGIGGLGHIAIKLLKAWGCEITAFSSNPDKTEELKAMGADHVVNSRDTEAVKAQKGKFDLLLSTVNVTLNWRAFISTLAPNGSLHFLGLTLEPVPVSVGSLIDGAKSVTGSPTGSPAALRQLLKFAARKKIAPQIELFPMSQLNEAIERLHSGQARYRIVLKADFAE

SEQ ID NO: 4989 - protein, 124 aa, Acinetobacter baumannii
EDTTMTDKKCPYCDFDEYDIIDKNEFAVILPDPNPLSKGHCVVTPLRHVSSFFDITSKEHQGLLTLLEIARHETQLRHQPDGFHIGFNDGEVFGQTSDHFHIHVIPYYKNQPLKLDQRWGVQKD

SEQ ID NO: 4990 - protein, 70 aa, Acinetobacter baumannii
  UNSURE (70): Identity of amino acid sequences at the above locations are unknown.
KGGFWKKPQKKRVLTQTRPPGGFPLKGGCGPKGGLGPLKTPPPWEKKGLKGGPPKGLFKAPKAPKEKKGX

SEQ ID NO: 4991 - protein, 62 aa, Acinetobacter baumannii
RIGTIAGNNKTIVPAAICVVVGVHLQLHACFLPTHRVWFPLTQAANNLAVQNAQGSHEDRDN

SEQ ID NO: 4992 - protein, 294 aa, Acinetobacter baumannii
SAHAMNRLCKSKNKGWTMKNFKNKVAAITGAGSGIGQQLAILLAKQGCHLSLSDINEKGLQQTVELLKPYSNITVTTKKLDVSDREAVKQWAQETVQDHGSVNLIFNNAGVALGSTVEGATYEDLEWIVGINFWGVVYGTKEFLPFIKQTQDGHIINISSLFGLTAQPTQSGYNATKFAVRGFTESLRQELDIEKSGVSSLCVHPGGIRTNIAKAAKMSDSLSSLGMDPAKSIQNFDKFLRTPPEEAARQILDAVLKNKRRLLIGSDAKFLDALQRLFPTGYQRASTVVTKWMK

SEQ ID NO: 4993 - protein, 242 aa, Acinetobacter baumannii
VYLAKTYKLGNHSLGNNLFMATNDSTSKKKTKSVSKERQFKGLSLSERKEARREKLIEAGIATYGTLGFFSVTVKDVCQEAKLTERYFYESFKKSEDLFQTIFLKMIEELQQNLMQAVIKAAPDPEKMVDAGLRALLTTLKDDPRLARIVYVDAVLVQELHNQATIQETLAQFDRMIQAFVMLTMPQIQHHENELSLIATGLNGYVTQIAIRWVMGGFEQSLEQVLTACRIVFLSLLAQVSK

SEQ ID NO: 4994 - protein, 307 aa, Acinetobacter baumannii
CSMAEFSIIDQYFNRQSHPDVALGIGDDSALITPPPNQQLVICADTLVAGRHFPLETSPHAIGWKSVAVNLSDIAAMGAKPHSILLAISLPQVDHEWLEGFSQGIYDCCNQFGVALIGGDTTQGPHLTITVTAMGWIETGKAVLRSGAKVGDYVCVSGQIGDAAYGLQHLGHSLQQRLDYPTPRCKLGEELKGLASSMIDVSDGLAQDLGHILKASKVGARLILEKIPVDPVLQQLEEQQRWQYALAGGDDYELCFTITPQNYEKLLQKQLDVKITMIGQIVEQTKLTFEHLGSDYPLQIHGYQHFA

SEQ ID NO: 4995 - protein, 211 aa, Acinetobacter baumannii
TTHLISNLVTQGKCKAIVIACNTMTAVAIETIRTQINVPLIAIEPAVKPAVAMTVSKHIAVLATATTVKGKNLKSLIETYAQHIKVSLVPCIGLAEKIETGKAHTVEVKDYLKNILAPLVEQKVDTIILGCTHYPFVSDTIQEIVGRDIQIIEPSEAVTAQLIRQLNQYHLSSESPNEGNHIIWTSSDPLEVADVTFSLLGKHLPVETTDF

SEQ ID NO: 4996 - protein, 272 aa, Acinetobacter baumannii
IQFYRLFCNEIVIINLCNKPVITTKRFTVKSIGYCVVKDDYILIVDDELPIREMIHTSLDMAGFQCLQAEDAKQAHQIIVDQRPALILLDWMLPGGVSGVDLCRRLKRDENLAEIPVIMLTARGEEDHKVQGLDAGADDYMTKPFSTRELVSRIKAVLRRANALSGEKTIDANGLILDPVSQRVSFGNSILDMGPTEYRLLAFFMTHPERAYTRAQLLDQVWGGNVYIEDRTIDVHIRRLRKVLEPFGVDRFVQTVRGTGYRFSTRADLAAG

SEQ ID NO: 4997 - protein, 292 aa, Acinetobacter baumannii
SYHYWRIAVLSFTSRLKKELFIKAQNLVPQHQLSRVVGKVAASENPILKAAVIHAFKTKYGIDLSIAEQGNALKYKSFNDFFTRALKDGVRLVDENPDSIVSPADGAISQIGKITAGEVFQAKGQSFSVEKLIGDPQLAQPFQEGEFATVYLSPRDYHRVHMPFSGTLTETLYVPGELFSVNQVTAENVPGLFARNERMVCLFDTELGRMAVVLVGAMIVAGIETVATGKVKPSGRIELQHHELKLEKGAELGRFYLGSTAIILFEKDKIEWEKRFKAESVVVMGERMGHTL

SEQ ID NO: 4998 - protein, 117 aa, Acinetobacter baumannii
ILNYKTFKGEYKYFNNKKFFGTDGTLPNNDFLQLDKIIIKSKDKKIEIGENDIEQYFFPKNGIDSDKNELADFKIYFLNNNIFILNTFNNGGAAAYNIVLNIKNGKLVANKAWKVEI

SEQ ID NO: 4999 - protein, 352 aa, Acinetobacter baumannii
RSSYLQYQSIYKNMQADFLNFYEKLNKRRAIVSESYLSGAELIEQIQKSPYSRDLIGYHGQPPEVKWPNNAKVAVQFVLNYEEGGEKHIEHGDEGSEQFLSEIIGAASYPAKHMSMDSMYEYGSRAGFWRIHSEFQRRKLPMTIFGVAMALVRNPYIVEAIKQADYDVVSHGYRWLHYQETDLEVEKQHMEQALSVLENLFGNKTIGWYTGRDSPNTRQLLAEFPQIQYDSDYYGDDLPFWTTLTDTAGASRPHLIIPYTLECNDMKFCSPGGFNSSEQFFQYLKDSFDVLYAEGETAPKMMSIGMHCRILGRPGRFKALQRFLDYIEMHDRVWVCRRQDIAEYWFKNHINQ

SEQ ID NO: 5000 - protein, 197 aa, Acinetobacter baumannii
REKYMNIIYLHGFNSSSSSIKGLSLKQYCSELGINVHLPDLNRSPEQVVAQVSELIESLQEVALVGSSLGGFFATYFVAKYNIPAVLINPAMQPWKLFDELFQVESMPYKVNDQWSIDHVQLRQLEQLELKQPENADKILVLLQQGDEILDYRQAQRYYSAATPSSLILTDAHGNHAMEDFEEKLPLVIEFFAHTIK

SEQ ID NO: 5001 - protein, 228 aa, Acinetobacter baumannii
KTEYNYKKYILFQNFKMEKSLKEYQAIIFDMDGTLVDSFSFFLGALNQLAKKYKFKSVELHEVEQYKHLSPKEIMKEMNVSRWKLPWIAKDFIRLMKERDQDVYMFEGMRDHLIELHNRGYTLAIITSNSKENCQSILGTELCELFSHIDGGSSIFGKAQRIKRVLNILNLNKNQAIYVGDQTTDGEAAHKAGIDFAAVGWGYTSAEKLKTIQPKVVLNDLATMKEFF

SEQ ID NO: 5002 - protein, 248 aa, Acinetobacter baumannii
LQRYLYHAFKDFLFLGLMMKILKLSFLALGMGLSGFAQADFIGVKGDVGYWFYDGKANMSSQSPEEQDLDRKGSAQLSLAFEHPIPFIPNAKIRYVNLDTQTKSETLGQANYNVDLDHSDFILYYELLDNIVSVDAGLGATVLNGDITAYTGKRVDIDKTYPIAYLSGEVKLPFTGLSAKGEATYTNFDDAKITDALVEAKYKFADNLLIDLGLTAGYRILNIDLDDYDNNDLKFEFKGPYVGLEAHF

SEQ ID NO: 5003 - protein, 367 aa, Acinetobacter baumannii
DMNLLKPLIMSMMIVCMVTLMGCSKEAPKTEEIPYVMVTQPSTTLHEQKSYAGDVQARQQTALAFRVGGQVTARYVDVGDRVRVGQVLAKLDVEDAQLQLNAAKAQLDNAQAAAKTASDELKRFQQLLPINAVSRSQYDTVKNQYDAAQAALQQARSNYEVSANQTGYNQLVSNKNGVITARNIEIGQVVAAGQAAYQLAIDGEREVVIGVPEQAVSEIKVGQAAWITLWSKPNERFAGYVREVSPAADQSRTFTVKVALKEGQSAIQLGQSARVFFSSTQTNVMSVPLSSVSATDNQPYVWVVNANQTLRKVPVTIGAYGRDSVPVLSGLTPNDWVVIGGVHLLRDKQKIHPIDRENRAVKIQGAK

SEQ ID NO: 5004 - protein, 150 aa, Acinetobacter baumannii
SMSQTLQAAYAAKRKARRFAVQGIYEWQMSHNPVHEIEARTRAENAMHKVDLNYYHELLTQVIAQHEDLDALLIPVLDREIDALDGVELATLRLGAYELRDHLEIPYRVVLDEAIELAKHFGGADSHKYINGVLDRLSSTLRSAEKQQAK

SEQ ID NO: 5005 - protein, 350 aa, Acinetobacter baumannii
MKNHVFNKKYGYSIMATLHAPAFELPEILNTKTNLADARIGAQVIECSDDFFAEAKRMLQFEAPIFVEDKFDDHGKWMDGWETRRKRHAGHDWCIVKLGVSGKISALDIDTTFFTGNYPASASLEACYAPNGDLTGVKWQSILENTELGPSQHHIFMVDNDAIFTHIRLNIFPDGGVARLRVYGDVHIQVTDHEQTLDLLALENGGRVIAYSDAHFGHPRNLINPGRGVNMGDGWETKRRRAPGYDWCILALGKSGKIEKIEIDTAHFKGNFPAEVSIQAVYLENATDAQLIPQSMFWSYLLEAQPMQMDHIHEYMNEILQHEKVSHIRINMIPDGGISRVRLWGKIAKS

SEQ ID NO: 5006 - protein, 498 aa, Acinetobacter baumannii
VDFHSLKVFYKPVQIQKFLKKQHRMTFQYQVLANQLAHRIYQDELKPHQKLISLRDFARQQGISLSTAKSCYELLEARGLIYVKPKSGYFVVARTPSSPIPDSPDFLSLPRHVSNLELHNQIQEAALQSHLVPLGSIQLTPHFIPVEGLRRSIQRALKNCQPQDFLYCNKQGHEQLRKALSDHWREDGIYIAPEDIFITNGCMPALSLVIQKLTEVGDSILIPTPTYNGHLQLLASLKRQIVEIPADHRGIDLERLESLMQQGLAKVCLMTANYQNPLGYCFSNTEKQKIAELSAKYQCFIIEDDIFGECGYSSERPLPIRYWDREGYVIWCGSVSKSLSSAYRVGWFCLTTKLEHLKLELLVSNIGVNTPLQLGLADFIYSRAYREHLEQLRPNLMRQVEEYRSCILRAFEGIPIALSQPEGGYALWIQLPKSVDSLALYYTAQAQGITVVPGHVFGEDERYRHFIRLNAGHELTADVRQAIMSLAEWSRQQMQTVS

SEQ ID NO: 5007 - protein, 469 aa, Acinetobacter baumannii
ISAQLNKEMGDGEHMPPRQSLIQQQNLWKTFFVFLLPLIATNILQNLSGTINTIFVGQMMGVDAIAAVSVFFPILFLLLAFIIGISTGSTVLVGQAWGAQNIEKVQSVVGSTLFMTIIGGIITAIIGVFFAHDILELLGTDPKVMHLSLPYVQWMLAGSPLLFVYIIYTSILRGVGDSTTPLLALALTSVIGLVITPILLKGYFGLPALGIIAPAIATITGYVAILIFLAIYLNKKNHPLRPNRQLLQHIRHNSELSKIILRLGVPTGIQMITTSMAGLVIIGLVNHYGSHATAAYGAVNQVLNYIQFPAISISIAASIFAAQAIGAGKSDLLARVTRTALGMNFLFTGALIALGYLFSKYLMALFITDPTVVVLGQQLLFIVLWAILFFGAGAIFASIMRASGTVTVPMLINISAILFIEIPCAYWFSSMWGLKGIWVAYALAFVSLCIIQGLYYQFIWKKKTIKVLI

SEQ ID NO: 5008 - protein, 69 aa, Acinetobacter baumannii
SDCHNVLGTLKVMASFEFIEDELNDGNGQARFTVFGVGGGGGNAVQHMVQSDIQGVKIIQVFFGVLGPL

SEQ ID NO: 5009 - protein, 279 aa, Acinetobacter baumannii
LKRLHTIFKYEKEKAMDLQLKGKTAIVTAATAGIGLAIAKTLAKEGTDVIITGRTQDKLVAAVAEIEANAPLGKVCGFLADLSTSEGVETLISQHPYTDILVNNLGYYEAKPFTEITDEDWWHMLNVNVMSGVRLSRHYFPKMLENNWGRVIFMSSEVGAFTPPDMVHYGVSKSALLAVSRGMAELTKGTGVTVNSVLPSATRSEGIMDYLRQTAPRPNMTDQQIEAHFFETYRPSSLIARMIEADEIASMVALLASPLGSASNGAAVRVEGGTFRSIL

SEQ ID NO: 5010 - protein, 129 aa, Acinetobacter baumannii
GEIQMGQDHIEQHRRYIVISYAFMFLALFTVIFAAFAYLVARKVAVVDDAEVWIHAHALWIMRNGILFLLMSVFAVVWFIPLFFFAWDSNLWVTASTVAGVVFSAIAWLFLLNAWLKGLSKYLKNKAVF

SEQ ID NO: 5011 - protein, 60 aa, Acinetobacter baumannii
PAFKNNFLRFACVATIEPLPGNDKPSASVKQFIEFAVNIPEHEPQVGHAERSNSATSSSV

SEQ ID NO: 5012 - protein, 254 aa, Acinetobacter baumannii
IEFNFRINVMSTAIKTREIQYTAPDGSYLIGYFAAPESETPVPGVIIGPEWWGRNEYTEQRARELAEHGYAALAIDMYGDKKVTTTAAQAYEWMMQTFEDLDTVTDRANAGLQTLAAQPEVNSEKLAAVGFCYGGKVVLDLARSGAPLKATATFHGTLAPKAPAQKGNIQGEVLVLHGELDSMVTLEDVANFEKEMQAAEVKHEVVVLKDAKHGFSNPLADERAKANGVDLGYNSEAEKQGLAKMYALLERTLK

SEQ ID NO: 5013 - protein, 238 aa, Acinetobacter baumannii
FVCFLINIPIGTLIKEKLISIYFYIVLLEGFVQTVNQSGRPKDLEKRARILQAAKAIFLKSGYHGTSMNLIAQEAGVTKLTVYNHFQDKANLFICAITETCEETLGTKPFELDASADFYQTLYMVCSRALQIIYSPEALKLEHVLFELAAEQSPLALQFFNASHTRLQNQLVEFFQKAAQLGFIQADDPLYQTELLLTLLLGVRHHKVLLRIIPVPNAQEIDRFIRHAIDLFLLRYRH

SEQ ID NO: 5014 - protein, 78 aa, Acinetobacter baumannii
KQIKFPFPLKNIFYFLLWAKSFDIVSQLRKTEDWEGLCQQLHALVFWVQAAVWVVYLFRQFNKQVINWEPLLYAQKVL

SEQ ID NO: 5015 - protein, 191 aa, Acinetobacter baumannii
ANLKSLLALLLLKLYIKTTSLGITVFLAEFNQAPPDQLKTLLNNCVHIPVWAEKIISERPYSSTSVLLGYAEQLSHTWSWQEIQAALATHPKIGERQAKKQLNAKEQNFSAQEQAGISLDEQTQQALLQGNIEYEQKFGFIFLIKAAGLSSNEILKKLHQRLQNNLAIEKVIVHEQLAAIALLRLSQEVQT

SEQ ID NO: 5016 - protein, 567 aa, Acinetobacter baumannii
CKLKGRSPTVTTTTTKFRDVEIRAPRGTELTAKSWLTEAPLRMLMNNLDPDVAENPKELVVYGGIGRAARNWECFDKIVDTLKNLETDETLLVQSGKPVGVFKTHKDAPRVLIANSNLVPHWANWEHFNELDAKALAMYGQMTAGSWIYIGSQGIVQGTYETFVEAGRQHYNGDLKGRWVLTAGLGGMGGAQPLAATLAGACSLNIECQQASIDFRLRTRYVDEQATDLDDALARIDRYTKEGKAISIALHGNAAEILPELVRRGVRPDMVTDQTSAHDPLNGYLPVGWTWDEYRERAKKEPEAVVKAAKQSMAKHVQAMLDFQKMGVPTFDYGNNIRQMAKEEGVANAFDFPGFVPAYIRPLFCRGIGPFRWAALSGDPEDIYKTDAKVKELIPDDEHLHHWLDMARERISFQGLPARICWVGLGLRAKLGLAFNEMVRSGELSAPIVIGRDHLDSGSVASPNRETEAMQDGSDAVSDWPLLNALLNTAGGATWVSLHHGGGVGMGFSQHSGVVIVCDGTDEAAARIARVLTNDPATGVMRHADAGYEIAINCAKEQGLHLPMITQ

SEQ ID NO: 5017 - protein, 301 aa, Acinetobacter baumannii
LNIKDILLIHLFFRNNKKSKMHLKLNNYLISGEYMNIPRFGLGTFRLKEQAVIDSVKNALDVGYRAIDTAQIYENEAAIGQAIAESGVSRQDLFLTTKIWVDNFAQEKFIPSLKESLQKLRTDHVDLTLIHWPAPDLGVSIPEIMQLLLEAKQQGLTKQIGISNFNIALTQQAIDTIGVEHIATNQIELSPYLQNHKLVNFLQEKNIDVTSYMTLAYGKVLQDPVLAEIAAAHKAMTAQIALAWALQRGFAVIPSSTKRENLISNLKAQDIELTAAEMQMIAELDRNSREVSPEPWAPVWD

SEQ ID NO: 5018 - protein, 184 aa, Acinetobacter baumannii
RVVNIMNDQDILNFWFSPEHRSLWFAKSEDFDAKIRDQFAEVHRQATRAELWSWRKTPEGRLAEIIVLDQFSRNIYRDQPESFAYDGLALALSQEAISLQLDAQLNPEQRSFLYMPFMHSESKLIHEFALKLFQRLGNEINLSFEKKHKVIIDRFGRYPHRNAILGRVSTPEETEFLLEPNSSF

SEQ ID NO: 5019 - protein, 166 aa, Acinetobacter baumannii
SNHNEIIEVAMAIRRIEGLLHLASEGRYAILVGRFNSFVVEHLLEGAIDTLKRHGVNEDNITVIHAPGAWELPIVAKKLATSNQFDAIIALGAVIRGSTPHFDFVAGECAKGLGVVALESSLPVINGVLTTDSIEQAIERSGTKAGNKGSEAALTAIEMVNLLKAI

SEQ ID NO: 5020 - protein, 241 aa, Acinetobacter baumannii
MQLKQLAATCALLSATAMVQAKPIWQDFSVTGLYGENYEVVDDKETTITLEYAAKVKYADVFFFMDRMRGENDHKSTYFELSPRLSLGEVSGKKLAYGPIKDVLISTTWESNSENGNNFDNFLYGFAVDLDIPYFQYANLNFYRANNENTDDDYQMTFVYGIPFKIASEDFLVDGFLDWSTAEGDHASELNWTTQWKWNVGKHISPDTRLYLGIEHSVWNNKFGIKGADENNVSALVKYHF

SEQ ID NO: 5021 - protein, 243 aa, Acinetobacter baumannii
KGSLMLKQTLLYTGKAKSVYETDNADHLILVFRDDASAFNGEKIEQLDRKGKVNNRFNAFIMEKLAEAGIETHFEKLLSPTEVLVKKLQMIPVECVIRNYAAGSLCRRLGVEEGKELTPPTFELFYKDDGLGDPMVNESQAIALGWATAEQLEQMKVLTYKVNDVLKALFAEGNMILVDFKLEFGVFHDRIVLGDEFSPDGCRLWDKDTKKKLDKDRFRQGLGGVVEAYEEVAARLGVDLSDI

SEQ ID NO: 5022 - protein, 286 aa, Acinetobacter baumannii
GAPNSQLRLNFRMIPKDQYPSDVKILRVVSINVNGLRSSVTKGLLEWLEQSDADVVCMQESRITHEQWTEKFRPEGWHTHLFPAERAGYAGTAIYSRLPFVSIKDGLGFELADSQGRFISAEFDLGLSHPVHIASLYLPSGSSGEEAQARKDLFLGEYAKILKQWRDENKSIIICGDYNIVHKRIDIKNWSGNQKSSGCLPHERAWLDHIYDELGYVDTFRVVRTEAELYSWWSNRGQARAKNVGWRIDYHACSPDWKARTVNAWVYKDQWFSDHAPVIIDYKIQE

SEQ ID NO: 5023 - protein, 492 aa, Acinetobacter baumannii
SYPKNVIGFTMSPTTAANQAKKLIKVPEMRRIKHIHFVGIGGAGMCGIAEVLANQGYKISGSDIKASKTTQQLEENGIKVYIGHEAENIKNANVLVVSTAIDPENPEVKAAIEQRIPIVRRAEMLGELMRYRHGIAVAGTHGKTTTTSLLTTMLAEENLDPTYVIGGLLNSTGVNAALGESRFIVAEADESDASFLYLQPMAAIVTNIDADHMDTYEGSFDKLKDTFVQFLHNLPFYGLAVVCGDDANIREILPRVGRPVITYGFNEDNDIRAIDVEQDGMRSHFTVLRKGREPLRLTINQPGLHNVLNALAAIGVATDEGVSDEAISRALKGFSGVGRRFQVQGEFELGEGNVKLVDDYGHHPKEVEATIKAARQSHPDRRLVMLFQPHRYSRTRDCFDDFIEVLSQVDQLLLLEVYPAGEKPIVGADSRTLARSIRLRGQVEPILIDPVEGNLQNIMQNVLQPNDLLLTQGAGNVGAISVELAQHHLYVK

SEQ ID NO: 5024 - protein, 322 aa, Acinetobacter baumannii
NKQKVLNYRVKDLNVSNATKFGKVAVLLGGKSAERAVSLDSGQAVLDALLRSGVQAEAFDPQNRSVTELVNYDRAFIVLHGRGGEDGQIQGVLEWLNIPYTGTGVQGSAIGMDKVKTKQIWQGSDLPTAPYRIITKETDLDSVIAELGLPVIIKPVHEGSSVGMSKVEKAEDFAAAIEKATQHDAVVMAEKWITGREFTISFLNGQPLPVIRLQPPADVAFYDYEAKYQRNDVEYGIPCGLSETEEKKLQALCLRAFQAVGAEGWGRIDAMQDEQGNFWLLEVNTVPGMTSHSLVPKAAKAVGYSFDELCVAILEQTLEGTA

SEQ ID NO: 5025 - protein, 60 aa, Acinetobacter baumannii
KIKKRAFALFFIFYGLAFLCLKSRFSENSHLFWYVSSFICLLLGSLYAIGGIFFYKTNLK

SEQ ID NO: 5026 - protein, 96 aa, Acinetobacter baumannii
GIRNAPPPFSYATYGKRQILPKPTAEPTAAIIKPDRDVQFSRVSVIEHLMLKDYLFLLLLLIVIPHAKKEPKNTFVFVENKMHLLSIFIPLTNKQK

SEQ ID NO: 5027 - protein, 476 aa, Acinetobacter baumannii
FIGKKLRDKDENNHMSTQEQGNLKHGLSNRHIQLIALGGAIGTGLFLGISQSIKLAGPSVILGYAIAGFIAFLMMRQLGEMVVEEPVSGSFSHFAYKYWGPFAGFMSGWNYWVLNVLVCMAELSAIGLYIQYWWPQIPTWASALTFFILINGINLLHVKFFGEMEFWFSIVKILAILAMIGFGSYLLATGTAGPQASISNLWALGGFFPFGIEGLVMAMAVIIFAFGGIELFGITAAEARDPDKTLPKAVNQIIYRILIFYIATLFVLFSLFPWNQMAEGGSPFVMVFASLDSQGVATLLNFVILTAAVSVYNGTSYCSSRMLLGLAQQGNAPKALARINKRGIPTNAVLVSAFVTVLCVLLNYIFPEKAFGLLMMLVVAAIVINWVVISWTHLKFRKFMQRQGQTTKFPSFMYPFSNYLCMAFMFGILVVMSLTPDMRVAVMMIPGWILCLMVAYQFKRRKIKAEQPVHALEADM

SEQ ID NO: 5028 - protein, 161 aa, Acinetobacter baumannii
MFMKLSSIPVVKLPLVDVSTDPLDLLVAGLALRMKQLARTSPKFIELVHDRAFRIQIGTDLGVARQIIINHGHIDTVAGSPEKADFILQFADSEQGVKTLLKGDPTAFMTGMQDGSIKMEGDFSLLVWFNQAAKLIPPKLPKPVKDKVRQARAFIKEKTGR

SEQ ID NO: 5029 - protein, 216 aa, Acinetobacter baumannii
DGMKMNKQPQNSALVVVDVQNGFTPGGNLAVADADTIIPTINQLAGCFENVVLTQDWHPDNHISFAANHPGKQPFETIELDYGSQVLWPKHCIQGTHDAEFHPDLNIPTAQLIIRKGFHAHIDSYSAFMEADHTTMTGLTGYLKERGIDTVYVVGIATDFCVAWTALDAVKQGFKTLVIEDACKGIDLNGSLEQAWQTMQQQGVVRIQSTDLLNEC

SEQ ID NO: 5030 - protein, 435 aa, Acinetobacter baumannii
LPWKFNLIAPRQGLFASLLIISFALHTFLLVIATTHQLNENRASQGQLMTSQLVADSLSELEPANTVSLALIANRYATNPSVASIRILDANKQVLATSGMSKTRQGEIFVRDALQNEKKVGSIEITLIQPSIGEILRTQWLAILASLFLHVLLWLAYRAIARPTRSEYLARINEENRLKHEIQELTQALALEKQNTVTLVAQAQQQAKAKPIVRSQPEKSLESTDQNTLALNIQFYDPKQLLSSVNQSVSVPYFKLCQLFLNKSIELCTKHYHLKATDIDVVDEFHAEGTTLAISTSHPHAVECLLMVGTVFQLLSDVLYKRYREDKRFALQTRSAVCNAVEAMQIDAKEAAQRLAQHLHAKESALYLDNEQLKAIQDSYQLVAMPNPSNVMTRHAFMINGMNAECAELAQNIRTEILMGKKSIPQNDSPSSAAS

SEQ ID NO: 5031 - protein, 283 aa, Acinetobacter baumannii
GVNLMDHELEEEKVDQTLSWREKMAVEEHEKLSPRLVYEIIRRDGAEELDRPTAALIFSGIAAGLVISFSFVFKAIIASYIPTDAIWTDLITNFGYTIGFLIAILGHMQLFTENTITTVVPLFKPFTLDKLRAVGRLWGIVFLCNIIGTALASLFFLTTDLFTPNIDKALDELAHHVASFSATQNLLKGVMSGLLIAALVWMLPSVSNKFLVIFFMTYLIGLGDFTHVVVGSTEMSYLVWQGEASLGEYLFNFLIPTTIGNIIGGTGVFTLLIYGQVTEELEQ

SEQ ID NO: 5032 - protein, 192 aa, Acinetobacter baumannii
SMIELIRADQYTKMLWKNGVGFTLEIARSQGEADFEWRISMADVTTSGPFSLFPNKQRIISVLDGQGMVLHVDDLPAKTLNQGDIFAFHGESQVQSELVDGAIQDLNLIYDPAKFHARFQWLNEAAEQAFITSADLIFIFNQGGETEVNVDEHSVQLAAHETLKIEKNASVTSINFPKKQHKNCYIIELIQR

SEQ ID NO: 5033 - protein, 125 aa, Acinetobacter baumannii
KKDDYKEFSMHSKVIGLIAIMGIISSVAFAEPAIQPGETLESLSKARITTNVNTQAATPTAQTSDANAEVKVEDIDPIIEEKTEETLKAAVQPAPQATVEAIVAPVTSSELNVSVDDIDVAHPTE

SEQ ID NO: 5034 - protein, 186 aa, Acinetobacter baumannii
YGCDREYFVRRLVSHLSLGFLIILLAACASAPKKPAPLSPAQVSKLKSMQLPSRLPVPVKGVDRDELKDTWGAARSQGRSHEGIDILAPRGTKVYSVTEGLIADLRNNNLGGKVIWILGPAGTWHYYAHLDGHKRGLNVGDYVKKGDLIGYVGNTGNARYTSPHLHYGLYLDGKGRGAVNPYSYLR

SEQ ID NO: 5035 - protein, 421 aa, Acinetobacter baumannii
VMSEAVPSVVAIDIGTHKVSVLIGKIHAPDNIQVIGMATARNRGMNKGKIVSLDKVIAAIKNAVAEAENMAECRIHSAWVSIPSTELQSFYASGRTPVANPAHVITTNEVVRALELAKASHVTSDYYLASAVPLGFELGDSSEWVQNPINMTAHSMTGHYQLMMMPIATMQNLDRAMKGANIGVEKMVVSCLATAEASLLKDEKEYGVCLVDIGAGITNLAVYLDGRLALARTLQRGGEHVTRDIAAVLQTTTEEAERIKILHGCVDLSAVKPDHMIQVQGIDGPQTISRIELAEIIIARYEEIFSQIREELEQSGAIHGLYHGVVLTGDACQIEGMVSLARRMLGVSAHLGNPPLQVYADDQHQAALRRSMYATAAGLLMFSQSELQEAVEEPEEGNDRSVWERMVNGWNAFNSKLKAIF

SEQ ID NO: 5036 - protein, 366 aa, Acinetobacter baumannii
TVTDSQQSKPKHVMMMAAGTGGHVFPALAVAKQLQQQGCQVSWLATPTGMENRLLKDQNIPIYQIDIQGVRGNGVIRKLAAPFKILKATFSAMRYMKQLKVDAVAGFGGYVAGPGGLAARLLGIPVLIHEQNAVAGFTNAQLSRVAKVVCEAFPNTFPASEKVVTTGNPVRREITDILSPKWRYDEREQAGKPLNILIVGGSLGAKALNERLPPALKQLEVPLNIFHQCGQQQVEATQALYADAPANLTVQVLPFIEDMAKAYSEADLIICRAGALTVTEVATAGVAAVFVPLPIAVDDHQTANAKFLADVGAAKICQQSTMTPEVLNQLFTTLMNRQLLTEMAVKARQHAQPNATQHVVDLIQKM

SEQ ID NO: 5037 - protein, 435 aa, Acinetobacter baumannii
DTIDYSEKTIKLFEMSDTHIPLPERLRPRDLSEIIGQDHLLGEHAPLRQMIDQGHLPSIIFWGPPGVGKTTIALLLAQAIDRPFVSLSALNTGVKELREVIAESGDLLTPVVFIDEIHRFNKSQQDALLGAVEKGKITLIGATTENPSFEVNSALLSRCQVYTLNSLDSEAIQTLLNNALQNDKFLKERYIHIEEYDALLQFAAGDARKALNLLDLIASTFEPEVENTITNAVVVKVAQQNIARYDKSGEQHYDLVSAFIKSIRGSDPDAALYWMARMLKGGEDPVFIARRMLIAASEDIGNSNPNALLLAGECFRSVQAVGMPEARIILGQTAVYLATSAKSNSTYLAINKALELAEKTANLPVPLHLRNAPTKLMKQQGYGINYLYPHDYPEHFVLQDYLPPELKGTKLYESARNKREVEGERLQQRRWQQEQ

SEQ ID NO: 5038 - protein, 259 aa, Acinetobacter baumannii
MIEEKISGGVQSLEVGLSVLNALLEHNQPIILKDLSSKLEMHPAKVHRYLVSLIRMDYAKQLEDGQYALGDQAWRLGLNCIQHSDTLQLVQHLIYDLQSKIGCGIQISKWSPKGPVVVQSIESNHPISIVTKVGSIMPLVNSAAGRLFASYLPEHFVRPLLETEWQKHQELGLNIAPHNWEEFLELKETIRQQQMSAAKGDLLTGINAVGLPVFNSNQGIEFCIVALDSEMFLPVDPQSKIIETLKNEINSINQYIKSR

SEQ ID NO: 5039 - protein, 411 aa, Acinetobacter baumannii
SDEETSLFRSSFIIMKIRLITRPINKIKQVILDFIHHNHIINWTPLQKSALMLTLACAMNFSWILWKGYILITPSIWQWANLSLVESQIWLNLLTLFLLAVLIIPCYRYKDQAWAQKIVPLISVQAFMLMLCHDGYLIGSISPATMVGYVGTIGVGLVLFERKIVYSAFIPATIILAICTYLSMTGVISYAPLFNFTAMRHAQTNPFWLGSMLFFIMPILVACFILFEILLTQWRQRETYIQRLSQIDPLTNVLNRRSLNTHLEALHEQQFDYAVILLDIDHFKKINDIYGHHQGDQVLIKIAQCLSENLRNEDIIGRFGGEEFILLLPHTDIIQAEKIAERCRQALQELTILNNQNIQIHVSASFGISSSAFANDPYLVIRQADQALYAVKASGRNQVRTFHQLPQIKSI

SEQ ID NO: 5040 - protein, 396 aa, Acinetobacter baumannii
KQKEIKMMRRLAAPLLCSSFFLLMACGSNNTNSKSPEQNTTVKTEQTSAAKQTYQVAAVAHFKEPWAITSLPDQRLLVTERQGKLKIFNPQNKQMLDVQGIPAVSYGGQGGLGDVALHPDFAKNHWIYLSYAGKGQGGSGAVISRAKLDLSNPNQPKITDIKQIWQQVPKVSGQGHYGHRMLFGADGKLWVSSGERQKFDPAQNMKSNLGKILRLKDDGSAALGNPFYEQGGVTAEIWSLGHRNPLGMAFDRKGQLWVVEMGPKGGDELNIITKGENYGYPIVSNGDHYSGQPIPDHHTRPEFKAPEIDWTPVISPSSLIIYRGQQFPAWQNKALIGGLSSEAIVVIDLEHKPVKEVQRLEMKQRIRGLHEAQDGSIWVIEDGPNARLLKLSKKPS

SEQ ID NO: 5041 - protein, 133 aa, Acinetobacter baumannii
RMSLSQMKKHFQFIVFTTFMIGSVEVSYADFGFIQDTDGYVNVRRNSTLNSKVTSKLNNNEIVSCVKDERTNNFCLVNASKGVTGFVYKNRVNNLSGYNSIKLSQYSREKAVYNDKNIIVEVYAKKAILDPKL

SEQ ID NO: 5042 - protein, 135 aa, Acinetobacter baumannii
SCFWNEVWCSDRMFLDVFIKTEVSMVTANFAAIAGLSLIAVALVAVFFSPYRRWLGFMLAGMFFWGLLEVVRFGVQVTFEMPVTYSYLTALSLAMVMVTFVLLREDKQAQKALANRQYIEHTPVYEDDQQQCSSR

SEQ ID NO: 5043 - protein, 154 aa, Acinetobacter baumannii
LQKLSLTMRALIQRVLEAKVVVDGETTGEIQHGLLVFLGIGRDDTLATGQKLIDKILKYRIFDDEQGKMGWNVSQANGGILLVSQFTLMAQTQKGLRPDFGPAMPPSDAKALYEQLVEYTRSQFENVQTGIFAADMKVHLINDGPVTFNLEVEA

SEQ ID NO: 5044 - protein, 451 aa, Acinetobacter baumannii
GIFLMNQIFKLFIPMLSSNLIVVLSGLIDIAYVGHFSNDHVAALSVTLSLYTVVYVIGMGILQGVMLKLSEAYGCHDIPRIRQIFIQGVWLMLGSALVSIALLYLFRDLPKLFGASEHVVLITKNCIWALLFILPAHLLMRLFTALSQVTENAYKVLLSDSLFFIFKIILSYLLIYGVALFSIPPLGAIGALLATIIVRWFMLAVYYLFFLEKKYIFIEHPEWSDEDSRQSLRMILKIGIPTAIMALMDVVAFCSVAILILPFGSVVSAAHQIVASTGGFMFIFPSSIASAYSILVSRTMGSGNMKEADKIARQSIWVIMAVSGSLSLCLWLERGLIVTFYSDDLAVQILAASLLLIVCMSHFLDGLMTLLTSLLRCWDVSILPMLIFLVVVLCFGLGGGWWMAYTGLHWGSHSISAMGIYGFWSMAAISYLVACVLSAFCFRFRKQLRGF

SEQ ID NO: 5045 - protein, 247 aa, Acinetobacter baumannii
WKRLEEFLHHLDTDPLVSCENLTSIVNLEHLMTTPVSFHPQAFIELALSRGVLKFGEFTLKSGRVSPYFFNAGLLNDGEALSLLAQGYADKLTQCENVDVIFGPAYKGIPFVAATAVALSQTHNKSVPWGFNRKEAKDHGEGGVLVGAAVEGKKVWIIDDVITAGTAIREVVTILKNAGATIAGVLVALDRQERGQGELSAIQEVQKELEIPVHALITMKDLMDYLEAKGEKEALANMQAYREKYGI

SEQ ID NO: 5046 - protein, 123 aa, Acinetobacter baumannii
ATRCNCSITSISGSTNMISTHILDTNLGKPAAQVEVKLFHAATHELIAAAITNQDGRVSDFGIKNLGKGAYQLEFEVAPYFSSQQIKTFFPRVCIQFFIEDINQHYHIPLLISPFAYSTYRGS

SEQ ID NO: 5047 - protein, 418 aa, Acinetobacter baumannii
QISCPIVLLLGSFEDRLMKKLWQNCHIATMQNGQYSYIEDAAIVTEGHLIHWIGKQQQLPADTYSETVDLNGAWVTPGFIDCHTHSVFGGNRSVEFEKRLQGVSYAEIAASGGGIASTVRATREASEEQLLNSALKRIRCMQQDGVTTIEIKSGYGLNYENERKMLRVIRQIGEKLPMTVKSTCLAAHALPPEYKDQSDAYIEHICTEMLPKLHAEGLVDAVDAFCEHLAFSPAQVERVFKTAQSLGLPVKLHAEQLSSLGGSSLAARYHALSADHLEYMTEDDVKAMAESGTVAVLLPGAFYLLRETQYPPIESLIKHGVRIALSSDLNPGTSPALSLRLMLNMGSTLFRLTPEQALAGVTIHAAQALGLEQTHGSLEQGKVADFVAWDIEHPSEIVYWLGGDLPKRVVQHGQEVIF

SEQ ID NO: 5048 - protein, 454 aa, Acinetobacter baumannii
SIKCSTNCTNSKTSRRTDSAMSQVTSNSSRFNLRAQVVQTLLKVQQGQSLASILNTQLNQVAERDRALFHELVLGTLRQWFALKSISLPLLSKPLNNETVETCLYVGLYQVLCTRIAAHAAISETVDATKQLGFPALSGIVNAILRRATRETEDFEQGLHQAHGLPSWLFKRLKKDWGEQTEALCQSLKQVAPLTLRVNQRHIGRDAYLAKLQSLDIQARACLFSEAAIVLEQSVQITQLPGFEQGWFSVQDEHAQLCATLLPDLNNKTVIDACAAPGGKTAHLLEKFKPAQLIAIDQDPSRLVRVTENLNRLALDQSHTEILAADATKWNPVQPVDCIVLDAPCSATGVIRRHPDIRLLRQSSDIAQTIELQKQILEHMWQQLKVGGTLLYITCSILKSENEQQMINFFTEHPDAKEVKIEADWGIEQVHGRQLLPEAQSGDGFYYCKIQKIT

SEQ ID NO: 5049 - protein, 529 aa, Acinetobacter baumannii
ASKCMSQPTTPSQSVIPAWVDSSLLQGMLRGIERESLRMQSNGFLSQELHPKALGSALTHPKITTDYSEALMEFITSPQPTIGDALHELTDIHAVVHRHLENGEKLWPLSMPCMLDDNEERIRLAQYGTSNIGRFKTLYRRGLGIRYGRRMQTISGVHYNLSFPDSLFSALQAHETDEKLKALSLQDYRSHRYFGLIRNFIRLTPLVMFLVGASPSVCRCFLTGHEHHLLPLIKGSYYLPYATALRMGRLGYQNSAQKSLGIHYNNLTGYLDGLQKAVHSPYPPFSRLGLNDASGEPLQINDHVLQIENEYYSLVRPKQVPQAGETPSQALKNRGVGYVELRAVDVNPYSAIGVNETTAGFLEALALYCLLSDSPELLCPEQDLIEKNQTEVVNRGRAPNATITDLNGSYHIEDWARQHISKMQDCARLLDQTYATDLYSSALAVMQERIDEVDETLSAHVIDDTLKHGGTWSFGSHMAQLHAETYEKHEISAETLQYFEQLAVQSLQQQEQLEQDSQISFDQYLEQYR

SEQ ID NO: 5050 - protein, 262 aa, Acinetobacter baumannii
EIKCQNRLKLFYLRISKEFNMFGKYVFYTGWLLATLSLSVSACADNSKVNCNTNNVYGDLKCLEKENKKLINQLDNKKNKERKDYNQWIKEIKNKCEGKISYASGEGAGLIKNQCYREEYLSRLSFINTGKVKKSDTNIHGLELTYLPYNSNDHLKCIMKKEVNSCSKVNLVKSSNLIKYYPFISPAYGDSIVLPETDDSKQIIVSPFEDNEDEGPQLEISIINAFGVVEQKTISANKNVIIDKNYNLIYKEGNKEKILKLK

SEQ ID NO: 5051 - protein, 338 aa, Acinetobacter baumannii
GFNRFSRILRINSFWIAFVKIIFAGTPEFAATALAALLKTSHEIIAVYTQPDRKAGRGQKLTPSPVKQLALEHNIPVYQPLHFKASTEEGLAAQQELAALGADVMVVAAYGLILPQAVLDTPKYGCLNIHGSLLPRWRGAAPIQRAIATGDDETGITIMQMAAGLDTGDMMYKTYCPITSEDTSATLHDKLAAQGATAICAVLESEETLQKYLAEREVQDESLTVYAHKLVKSEARIDWSMNAVQVDRNIRAFNPWPVAFIQLDENNALRVWNSTISSQSKVNAQAGEIIAIDKQGVHVACGENTFICLTSVQWPGGKALNAQQIAQTQKLHVGQILP

SEQ ID NO: 5052 - protein, 351 aa, Acinetobacter baumannii
MDILENPLELCGFAFIEFVSKENELDPIFETIGFSKVAKHKSKKAYLWRQGNINIILNYQPESYASFFFNEHGPSACAMGFKTRDAAKAFKKAVELGAEPMYSKVGPMELNIPAIKGIGGMPIFLVDRDIYENDFVFFDDAQRNPEGAGLKEIDHLTHNVYKGRMEYWANFYEKIFNFQEIRYFDIKGEYTGLTSKALTAPDGMIRIPLNEDSDKGNGQIAEFLADFNGEGIQHIAFICDDLISTWDKLKGLGLKFMTPPPNTYYEMLEERLPEHGEPTEELKQRGILLDGSTKDGQKKLLLQIFSENMIGPVFFEFIQRKDDDGFGEGNFKALFESIERDQIRRGVLEAK

SEQ ID NO: 5053 - protein, 60 aa, Acinetobacter baumannii
YSVRSVGILTHHHNLIILHSIEANNIGKAKNDNTQSIFSKTYMNNFLFFYNLFLSIKVFE

SEQ ID NO: 5054 - protein, 259 aa, Acinetobacter baumannii
LDNRMRTFQILTFALTAVAAGSTFAAEFSFDRPGSGFGTGITPVGKLAWEQGLPSATYTETTVDGVKEKTVTVNEDMLFRTGLADGLELQLGWQGPAWTQTKRAGKKTDNSGFGDVSIGLKKAIDLNDENLTMAVLAEAIIATGNDEFTAHDDIYSLSSAVAYKYNDLLDTSITMRYEVQNSNWAVTAIPTINYKIAGKLSGYSEFVYRKAESQDYQYGLGTGLVYAVNNRTQLDANIGVDLEGQDKSYKGGLGMAFLF

SEQ ID NO: 5055 - protein, 389 aa, Acinetobacter baumannii
LIDSILLPHSILIKLEAHRMRNYKIDILRGISILLVLLHHFNIPYKLKDTCLGFDFLGEAFSTVIARNGNYGVTMFFVISGFLITHHTLKRDKQFSAINLKHFYIRRAARILPCLVLLILGVSILGSFDLKPFMNQAPNGIEVSYPLTIFAALTFWMNILIIKFGWVNYALGVLWSLSVEEVFYFVFPLLCLLTRSNKVFIVVLIGVILYGPYFRSLHFGEESGAYLYHYFSSFDGIAVGCLTAIFSHKYQPNWTYKKPLSWLIILSMTALYLYAPIKEVSTWGISLFDLATSLLILCFQHPSETQAHNLFTKVMVWLGQRSYETYLFHLVVLGLMKVAFIPAQTDSSIKIMLLIGYLVLTFIISAAIEKYYSSPLNNYIRKVFIKDKS

SEQ ID NO: 5056 - protein, 199 aa, Acinetobacter baumannii
RGARTTTRLGIVKRSFNMTFAIKKIHHVAYRCKDAKETVEWYKKMLNMDFILAFAEDHVPSTKAFDPYMHLFLDAGQGNVLAFFELPTQPEMGRDENTPQWVQHIAFEVEDLNALLAAKKHLEDNGVKVLGITNHGIFHSIYFFDPNGHRLELTYNDAHAEEKIAKITEEMKTEMLEEWSKTKRAPHHTHFLHEEELGA

SEQ ID NO: 5057 - protein, 608 aa, Acinetobacter baumannii
MKNRTLHFACISVLFWMSHSSNAATPEINTNTIEKSQSKQKSDVSVRVKALNQLLQEQWEYTLKNNPETATTLGDLRYNDRWTESSKSQIEKDKKTTQNFLKRFEAIDSTGFSATDQLNKDLMIYQLKETLKNYDLKLYEMPFNQMWGLHLQFPGFISSIPFDNAKQYQDYISRLKQIPLILEQGIQLAKQGQKDGLMPPKYLIEKVAKQINSIATPAGKDSVFASPLKQFPKNISKAEQERLSREILQTIDQNVRPAYQKLGAFIQKDYLPYGRQHEGIWSLPNGEELYRFYVENNTTTSESPENIHQLGLKEVARIEAEMLKIAKAQGFNDLKSFQQSLKTNPAVFPKSREEILEIYRGYIAQMQPELPKLFGLLPKNKVEVLPVEQYREKEAAGAEYHQGTPDGSRPGQVYVNTGDFSERSKISMEATAYHEAIPGHHMQIDIAQNLPNLPMFRKQPNHTVYIEGWALYAEQLGKDVGFYKDPLSDYGRLSSELFRACRLVVDTGVHYKKWTRQQMIDFMREHSALDEPDIQAETDRYIAIPAQALAYKMGQLKILELRELAKQELGDRFDIKAFHDMVLNAGTLPLNILNARIKNWIKEQKAAA

SEQ ID NO: 5058 - protein, 1053 aa, Acinetobacter baumannii
KSCSENSGSQITMKFNLSEWALNNKGIVLYFMLLLGIIGAISYSKLSQSEDPPFTFKVMVVQTYWPGATAKEVSTLVTDRIEKELMTTGQYDKIMAYSRPGESMVTFVAKDSLTSAQIPDVWYNVRKKVNDIRHELPSGVQGPFFNDEFGDTFGNIYVLTGKDFDYALLKEYADRLQLQLQRVKDVGKVELIGLQDQKIWIEISNTKAVQLGIPVSAIQEALQKQNSMASAGFFETGTDRIQIRVSGQLQSVDDIKKMPLLVGDKTIQLGDVADVYRGFSQPAQPRMRFMGDNGIGIAVSMRKGGDIIALGKNLETEFAQLQKTLPLGMKLQKVSDQPVAVQRSIHEFVKVLAEAVIIVLLVSFFSLGFRTGLVVAFSIPLVLAMTFAGMNLFDVGLHKISLGALILALGLLVDDAIIAVEMMAIKMEQGYSRIKAAGFAWKTTAFPMLTGTLITAAGFLPIATAQSSTGEYTRSIFQVVTIALLVSWVAAVLFVPYLGEKLLPDFTKTGHQAPWYVRLWARVTKKPQPQTVAISQGHHYDPYQSSFYLRFRKMVEFCVTYRKTVIATTVGIFVLSVLMFKMVPQQFFPPSNRAEILVDLKLEEGASLTATEQAVKKVEQFLSKQKGIDNYVAYVGTGSPRFYLPLDQQLPQASFAQFVVLASSLDDRDEIRRSLETQIKQLLPQVRTRVSLLENGPPVGYPLQYRVSGEDLNLVRKEAQQVARVISENPNTTNVHLDWGEPSKIISIQIDQDRARQMGVSSLDLANFLNASITGSAIEQYREKRELIEIRLRGDKAERVEVASLASLAVPTANGTTVPLAQIAKIEYKFEDGLIWHRNRLPTITVRADIRTNLQPATVVGELAESMDKLRAELPSGYLIEVGGTVEESARGQSSVNAGMPLFLAVVMTLLMIQLKSLSRATIVFLTAPLGLIGVVLFLLLFNKPFGFVAMLGTIALSGMIMRNSLILIDQIEQDRQAGHPTWEAIIDATVRRFRPIILTALAAVLAMILLSRSILFGPMAVAIMGGLIVATLLTLFLLPALYAAWFKVKKTA

SEQ ID NO: 5059 - protein, 166 aa, Acinetobacter baumannii
IKSSTFKSGDNKPLHHQNVQLKSVHACLKHANIKKFCIEKIHSKKERMVFMNIEIRTDKNIHNSERLITYVRAELTQEFQRHSERITHFSVHFSDENGDKGGDKDIHCMIEARPSGLKPVAVHHKAGNIDASIHGAIEKLKRSLEHTFEKKEHPRGGQPEFIDDEV

SEQ ID NO: 5060 - protein, 72 aa, Acinetobacter baumannii
GESRAKSTRCFRSKTRSKTNPTENDAAVEPRHVFKMNRRFMQSVGIHEFAMGNLNPNAQKLVLFAQRSVRSL

SEQ ID NO: 5061 - protein, 155 aa, Acinetobacter baumannii
SLGRPKDITKMKKIALALGLVGMAAFANAADPLNGTVWKTIDDQTNKPKAVVKFTEQKDGTLTATIQNILTPGEENACTKCEGPYKNKPLKGVTIVHNLKNVGGNSYENGTILDPKSGKTYKLKGELAEGGKKLKLRGYIGVSALGRNQTWIRAN

SEQ ID NO: 5062 - protein, 460 aa, Acinetobacter baumannii
NLLSSSVPRPNFYLYKTRDEDKEAKMEQKLNSFIEVSPQSDFTIHNLPYGIFSRTAEGERQVGVAIGDWVIDLAALEKHGLLKLSDQDTYFNQPTLNKFIESGKANWSKVRKTLQSLLSVDNLTLQENEPLRQEVLVKQDSVTLHLPLQVSGYTDFYSSKEHATNVGCMFRDPKNALLPNWTELPVGYNGRASSVVVSGTQVVRPSGQIKLPNEERPVFSATRKLDFELETAFVIGKPTELGQPISIENAWDHIFGMVLLNDWSARDIQQWEYVPLGPFNSKSFASAISPWVVTLEALEPFKVEGPKQEPKPLAYLQENIANSYDINLSVEIQSPKSTQPDVICRTNFKYMYWSMAQQLTHHTIGGCNVQVGDLMGSGTISGSTPDSYGSLLELTWNTTKPLTLANGETRGFLQDGDTLIMKGHCEKNGIRIGFGEVRNTVLPALTFDFAETSEPNYEAV

SEQ ID NO: 5063 - protein, 177 aa, Acinetobacter baumannii
IKMRFYMRLSYRLVSGLLVLASIVGMSFALYLEHVKGLEPCPLCIFQRVGLMAMGFVALIAFLHNPVSNAIKRFYAFLAGIAILWSVGVAGRHVWLQHLPPDQVPSCGPGLNYLIDALPMKTVLQEVLSGSGECAAIDWTFLGQSLPVWSLAYFLLLLLVCLWQLFRFYPVFKTVKK

SEQ ID NO: 5064 - protein, 293 aa, Acinetobacter baumannii
ANIGRYGLNMAQLPASMRRKRAAITSIHEKPPTRKQKLANAGGWVLLVIAFLVLAVGIYGLYKVITDATVAKLEVVGSTTPVETQQVMRYVQPIVKDNYFTSDLEQIRDKALEISWVDRVVVSRAWPNSIRVRVMPRHAIARWGTGRLLSDGGDVFSEAEPRLHPELPLLHGPVSQSKMMMRRYNEINQLFHPVNLRLKELYLTERMTWFMQFDSGLRIIVDQDQTMNKLQRLSHLAQSDLKPVWTKISAIDLRYRNGLSIQWKNATPPKIVNGQFVVTSDDTSIAGGTKAKP

SEQ ID NO: 5065 - protein, 441 aa, Acinetobacter baumannii
HYCGLEIDYACDLAIFKWPAMISLNIIQRDQAMHTAIANSFAKLPVTVLSGFLGAGKTTLLNHILNNREGRRIAVIVNDMSEVNIDAALVREGGAELSRTDEKLVEMSNGCICCTLREDLLVEVRRLADEGRFDQLVIESTGISEPLPVAETFTFEDEDGNSLNEFARLDTMVTVVDAFNFLKDYSSVDSLQQRGESLGEQDERTVVDLLIDQIEFCDVIVLNKIDLIDQAQQDQLIAILKTLNPRARIEIAQFGKVALDKILNTQLFDFDEAAQAPGWLKELRGEHTPETEEYGISSFVYRARRPFHPERFYDLVQAEWPGVVRSKGFFWLAAERTLAYSWSQAGAMARHGLAGYWWAAIAEEDWPSDLASIEQIKKNWDDRTGDARQELVLIGMQMDEQALIQRLDSCLLSDEEMALGPQAWQNWPNPFKQEDETMLIA

SEQ ID NO: 5066 - protein, 613 aa, Acinetobacter baumannii
NMCGIVGGVAERCVTEILIEGLKRLEYRGYDSAGVALLNKQQILRERRVGKVINLEDAVADQQLTGTIGIAHTRWATHGKPTENNAHPHMSGKVAVVHNGIIENYQELKDDLQALGYVFTSQTDTEVVAHLVAEALKNTDSLLEAVESVVPQLKGAYALGIIHSDYPDELITVREGSPLVIGVGIGENFISSDQLALLPVTNRFIYLEEGDIARLTRTSIEVFVKGERVERPVKELDATVSSASKGEYKHYMLKEIYEQPEAIKQTISQALDGNNLRDDFLKDAEADFSKLQSVQIIACGTSYHSGMIAKYWFEQLIGVPCQVEIASEFRYRSPVIVENTLYICISQSGETADTLAALRETQKRAKANNIDIQTLTICNVATSSMVRETDHHLLTLAGPEIGVASTKAFTTQLAALMLLILKIGQVKQRISNVMIEELARELWHSPKVILDTLKQDAEILRLSELFVEKQHCLFLGRGTHYPIALEGALKLKEISYIHAEGYAAGELKHGPLALVDNEMPIVILAPNDEMLDKLKSNMEEVQARGGELFVFADENSGVVEKDRQHVVQIPAVNEWLAPIIYSVPVQLLSYHVAVLRGTDVDQPRNLAKSVTVE

SEQ ID NO: 5067 - protein, 71 aa, Acinetobacter baumannii
IGHGLILQLKKQWKLSSIFVAVYFNPKASLTKSEFHSFITERCAFLKICLQSYGVFGIVILLIHIFSGDFQ

SEQ ID NO: 5068 - protein, 164 aa, Acinetobacter baumannii
SSKGGKTMLLISACLIGEPVRYDGRSCLHTTLKQLFLNKKAHALCPELLGGFTTPRLPAEIVGGTGQDVLDGKAKIMDSSSLDVTKLYLKGAYRTLDIARQIQATCVVLKENSPSCGSQKIYNGTFQGEKITGVGITTALLQRHGFEVISENEIEEWLAAHPLC

SEQ ID NO: 5069 - protein, 453 aa, Acinetobacter baumannii
RKWGKDMPSLTPLHETYCKWDRTPPSQADVLEGLAQLFSTSLNGVHELIQVINIEVLKNAFGISAQNAKNFQKRPSVQKAYQFSYGALQKYGSCFLAPGLRRIIEKFPTLHEKPLTPTLHFLVGVLNGIFGDYLLKQHSPLALPMVLYDHYGAIQQGELAGRIVILVHGLCMNHLTWSNAHYGGIGERLLAQRDHNTMLYLNYNTGRRISANGRSFSNLLEDLVQRNPRITSIDLIGHSMGGLVSRSALFYGKQNMYQWIHMVENLVCIGSPHHGAVLERFGFALQDRLGAFPFVGLIGQLVNIRSNGILDLRHGSVRDDDWEYMDARIGMMDDNRAPAPLPSHINTFLVAGTLEFEKVRNKALTVIGDYLVSVKSALGEHPNPRFQLKVPDSHKAVFYGLNHFEIQYHSSVAEQITRWLYPHVNDYVQDGIQTHIIDMPNYTLEDLEGIVET

SEQ ID NO: 5070 - protein, 434 aa, Acinetobacter baumannii
AYFMSNWFPKWQPYQGDVDHRPVSTNEYLPPVQSAILGIQHAFAMFGATVLAPLLMGFNPNLAILMSGICTILFFLITGGRVPSYLGSSFAFIGVVAAATGHITGSGANPNLSIALGGIVACGIFYALIGFIVMLTGTRWIEKLMPPVVTGAIVMIIGLNLAPVTIKGVAGQPFEMWMALITVLCMGSIAVFTRGLLQRLLLLVGLILAYVIYAIATNGLGLGKPIDFSQILQASWFGIPSFSHPTFDTKAILIIAPVALILVAENLGHIKAVGAMTGENLTPQLGKAFVADGLATTLSGSVGAPGMTTYGENIGVMAVTRVYSTIVFVIAGIFAIFLGLSPKFGAVISTIPSAVLTGASIVVFGLITIAGAKIWIENKVDFSNNKNLIVASVTIILGAGNFELLFGNFNLGGIGTATFAAIILNWLFSLKDKT

SEQ ID NO: 5071 - protein, 84 aa, Acinetobacter baumannii
EHFMSEALINRLVEFAESGNQQKIILNGNSYQGWIMEISDDALLISTGFSDKVGKDFWLKFEDLTQAELYYWDTRPNEWVPFKL

SEQ ID NO: 5072 - protein, 230 aa, Acinetobacter baumannii
NIFMKRYLGLLVLSLAACSTQTPQPTITHRSPSLPQPSKMVVKIKQQPEDYIVWIATADHRQSVQAYKQFLKQKGLADLVPDHELLRSARDWQKCGVEPYAVPPREIWSNIVPTLNILKALVDDGVINDFEVTSVYRALALNRCAGGADASRHVFNAALDFRIGPEQPSDLDQFNIQQTKTKLCQFWATKGQAFNMGLGVYASGQIHIDSQGFRAWGPDHHYRTSICQGL

SEQ ID NO: 5073 - protein, 743 aa, Acinetobacter baumannii
LSFILLFLLIDFIFMLRISISSPQIKGSFPLSLLSLMILNIQGANAEELIESSSKAAATMPTIKIEAMSELDPIKSYIDYDKANVTRNGLDKKDIPQTVDTIDVQKYKIYGSNDLSVMLQGTPGVSTSYDMRGDGITIRGFGADTGDIYRDGIRESGQVRRSTANIERIEILKGPASVLYGRSAGGGVVNMVSKFANFDSKSSVGAYAGSYDNYGTTADINQVLNDNLAVRLTGEYGEAGSFRSGIENKIEMFSPSFTYKNDDGKLTWTTQYTYDKLNRVPDRGPTRDNLPAGTSIKMGFAQNGDYVDDILQVVRTDVNYEYAPDWNFHWAASYRQAEQNFDHFYFGNYCGLDGKNSKNEACTKKGYIDQIYYWQQTSNKTTTNTFDIKGKFKTGQLEHQIMVGTDWTYEQREPRLANKTQNGSAIYGYVNPITGEREYSRGNGPLKISQHNYNEGTTYGVFIQDLIGLNDQLKLMMGLRYDYFDFSTTNKIKNEHRNVKDSTFSPNVGLVWQPVPEHSFYTSYSKSFAPFGGQMGVNQVTGSTDVAKMDKEPQYNEQYEVGVKSEWFDNRLNTQFSVFDIRKNNIRYKPNPDSEPEVWATAGQHQSRGFEFSFIGRVLDNVFVRGGYGYTDAKVKEDNQNPEREGNYLANTSKNTGNLFVRYLPTEQWYTEVGVTYVGSYYPNINNQVKMEGFNRVDAAIGYSADPWNVTLAVNNLTNKEYWRSDSMPGTPRNVLLRLNYQF

SEQ ID NO: 5074 - protein, 204 aa, Acinetobacter baumannii
EQFMMQLRLGLVLAVSALSLAGCGRFALNNHSLDYKNAKQLAPLEYPADATVRPATPLYPAPTVDQLAIDHAPKFENKRGNRFALPRPEPLQTDTTADASAQTGSALGRPQLVTDGNKNPLLKIDGSTAEIWQYTKATLSTLNYNVIAQGNNQATIKVNDNTYVLKLTGVGSSHSLALFNPDNTFASPDVAAEVLNQIYQNWPA

SEQ ID NO: 5075 - protein, 455 aa, Acinetobacter baumannii
PKFMYEPYPVPEQVREQKLSRYSSLWTFAKQDLRLLLFFLIIAGLVGLGIGYFWSCIFIAFVVFFTLQLRSLYLVNDWIANNPYDVPPNLNGIWGALLFNVYRAQRQERIVQAEMVGLIDRAQSSLVALAEAVVLIDDQHQIEWWNPAAERLLGISPLDRGRNLLTILRQPTFIEYFNNIDQAPDGIKLHSNLDDDRYVQVKLTRFGGESRLLVAYDVTRMHNLEQMRKDFVDNISHELRTPLTVLSGYIETFTDQEDINPRWKRAFDQMQSQTKRMNALVNDLLLLSNLENNKKIAKNQIIEMPSLMNQLFDDAQAYNADYGHTLNLHIDSHCDLIGSDMEIASAFSNLITNAIKYTPKGGTITIGWHDDGEHAYFSVQDTGIGINPKHLPRLTERFYRVDSDRSRQTGGTGLGLAIVKHVLMQHGAYLDVQSKENEGSTFTAVFPKERLYNMT

SEQ ID NO: 5076 - protein, 253 aa, Acinetobacter baumannii
VFVMPRTSKQEHTELSIEADSPVPLYQRVKQLISQKIYEGSWAVNKKIPSESELVNQLGCSRMTVNRALRELTTEGLLVRIQGVGSFVAEGQGRTALFQINNIADEIIARNHKHHAEVLVLEQIYANAEQSVLMQTREGQKLFQSIIVHYENDVPVQVEDRLVDAALIPDYLEQDFKTITPNAYLMAKAPVTEGEHIVEAVLASPQECKWLKITKAEPCLLIRRRTWSNKQLISSARLIYPGSRYYLEGKFNP

SEQ ID NO: 5077 - protein, 388 aa, Acinetobacter baumannii
ERVMNVVIIGAGMGGLTTGIALKKFGHQVRIFEQTEKILPVGAAISLWSNGVKCLNYLGLTEKIAKLGGQMDDLAYVDGLTGDVMTQFSLRPLIEEVGQRPYPVARADLQNMLMDEFGRDQIYLGKKMVGLEDKADFVEVHFADGSSTQADLLIGADGTHSMTRTYVLGQQVQRRYAGYVNWNGLVEISEDLAPAQQWTTYVGKGKRASLMPVADGRFYFFLDVPLPAGLENNRDEYKKLLKQYFVDWCQPVQQLIERLDPQKTNRVEIHDIEPFTQFYKGRVVILGDAAHSTTPDIGQGGCQAMEDAIYLARSLQINTLGLEDALRRYQNKRNERANELVLRARKRCDVTHMKDETVTQAWYAELRREQGGHIMQGIISNIVGNPLD

SEQ ID NO: 5078 - protein, 70 aa, Acinetobacter baumannii
DESMELFKPEKRLMNHPIHFGENPLVILSNFSHSALKQGWSQAEIETVISEASQGDYMKLIRTLRAYTLF

SEQ ID NO: 5079 - protein, 407 aa, Acinetobacter baumannii
SLTMSPLIHSLLDTDLYKFTMLQVVLHKFPQTHSVYHFRCRNLEDTVYPLVDILDDLNEQLDHLCNLKYKEDELQYLRKLRFIKSDFVDYLELFQLKRRFIHASIDEEGRLDIRIEGPMVQAMMFEIFVLAIVNELYFSRIKTDEVWAEGERRLQAKLELIQQYEKAQLPNDPPFLVSDFGTRRRYSFEWQKHVVAAFHNTVPNVFRGTSNVLLAKELNITPIGTMAHEFLQAFQALDVRLRDFQKAALETWVQEYRGDLGIALTDVVGMDAFLRDFDLYFAKLFDGLRHDSGDPYEWGDKAYAHYRKLKIDTKTKMLTFSDGLNLPKAWELHQYFKDRFQVSFGIGTNLTNDMGQTPLNIVLKLVECNGQSVAKISDSPGKTMTDNDTFLAYLRQVFQIEELDEAI

SEQ ID NO: 5080 - protein, 221 aa, Acinetobacter baumannii
LLILQKLRSLIMKLYSYFRSSAAYRVRIGLNLKSLAYETVSVHLVKNEQQSEDYLKLNRSALVPTFVDGDLTLSQSLSILEYLDEQYPETKLLPNDVKERAKIRAFAQAIACDIHPLNNLRVLKYLKNDLNVSDEQKNYWYQHWILEGFQTLEQQLQDSNGQFCFGQHATIADCCLIPQVYNAKRFKIDLSAFPKIESIYQHCLSIPAFYNAAPEQQPDWE

SEQ ID NO: 5081 - protein, 111 aa, Acinetobacter baumannii
MNYIFILFKGINNHENNMKLHKFILVLNLVFGVYSITNDDANAQQEFKRICLSGEYMQASCDCICQQLAQVYSSQTVQRLKHTSLQSPVLPQDFAPNLFSSIQRCDKTEMG

SEQ ID NO: 5082 - protein, 387 aa, Acinetobacter baumannii
ENNMLQLQSKFPAQGVTIFSTMTAMAQRLGALNLSQGFPDFPAPPALLEALSHATLAGHNQYPPGDGILALREQLALQFQQRDQLQLDPVTQITITPGATIAIFCAIQACINAGDEVIIFDPSYDSYGPSVELAGGKAVHIALQAPDFKVNWQQVKDRINDKTRMIVVNTPHNPTGTIWSEQDWLELIALIQDKNIVVLSDEVYEHLVFDGQQHFSALHFPELRERSFVIGSFGKTFHVTGWKTGYCVASPDLMRLFRQIYQYVNFCGTTPCQIALAQYMEQHPEHIQELSQFYQTKRDRFNQAIHNSRFLLKPSQGTYFQNLDYSQIKPDLNDVEMCQFLAEQHKIVAIPVSVFYQQAPESLRLIRFCFAKNDETLQKAGEILNQC

SEQ ID NO: 5083 - protein, 458 aa, Acinetobacter baumannii
EKNMNHQQKNAISPEHEYLGISKSFAYGLQHVLTMYGGIVAPPLIIGTAAGLSAAQVGMLIAAALFVGGLATLIQTIGTKYLGAKLPLVQGVSFAGVATMVAIITTGGGLPAVYGAVIAASLIGLCLAPYFSKIIRFFPPVVTGCVITIIGLSLLPVAIRWMMGGNNKAPDWGSVENISLALLTLGIVIILNMLPQASIRRLSILLAIVAGTTLAYFMGFGDFSQVSSGAWLQFPHLFAFGLPTFELSAILSMLIVTLVIMTETTADIIAVGDIVGTQVDSKRIANGVRADMFSSAIAPIFGSFMQSAFAQNVGLVAITGIKSRFVVAAGGVILIILGLLPVMGRLIAAIPMPVLGGAGLVLFGSVAASGIRTLAKIDYNDQKNLIIVATALSAGMIPIINHEFYAHFPVWVQTLFHSGISSTCIFAILLNLLFNHLPSFRSSRTPHLSQTINTRNTH

SEQ ID NO: 5084 - protein, 439 aa, Acinetobacter baumannii
DDRMNMAEEVHHAPNLKRSKYFATMALIIVVVLWIGLLIANRFLPEYTDLIHILMLGAEAGVVGGLADWYAITVLFRNPFGKLPIPKFLRDHTEIIPRNKARIAESMGRFVQENFLSPQVVERSLEKTDLSLAIGQWLASPQNNTQVVQLIQQTVPKVFEFVSQEQIANFVQNNSVQWVRNTQVNKLASEMLRAVLENDFHQDVLQRGLDIAHEWVVQNPDKTRELTRKMFKALGVWSLAKGASWIGIDVQQRTIDSLVEKVESMLADHEHPWRQEIETIAHSLMLELANPESIASQRLNSGKDALLDSPQVLNFISGAVTILCDAIKEDLMKEDSGIAMNLRAAIQQLGENLVQNVKVREVLNKEMTGLAMNFTDQYSHKIIRYVSERIHEWDSREMIGKIENEVGGDLHMIRVNGVVVGAFIGLTLGVIRAAIESIL

SEQ ID NO: 5085 - protein, 410 aa, Acinetobacter baumannii
SQFMREIILISFLGPDQPNQFTRLMQVLSVHSLQILDVGQAVIHNQLTLGIVVASENETATALAMKEILILAHDIGLTVRFKPISGAEYDQWVSEGGRTRYIVTALAPELTAAHLQAVTQIVSSQGFNIETVTRLSGRVDLEKDSTLPRRACVQFGLSSGPTLDAQAMRAACLLLSSELNIDVAVQEDNAYRRNRRLVCFDMDSTLIEQEVIDELALEAGVGEQVAEITERAMQGELDFQQSFRARVALLKGLDASVLPKIAERLTITEGAERLISTLKALGYKTAILSGGFQYFAEYLQAKLGIDEVHANVLDVQDGVVTGEVKGVIVDGARKAELLRELANKLGISLEQAMAVGDGANDLPMLAIAGLGVAYRAKPLVRQNANQAISSVGLDGVLYLLGMHDKDLSRA

SEQ ID NO: 5086 - protein, 184 aa, Acinetobacter baumannii
EMVMLTTQQQALIKAIEELELAQVQKLLAEGLDPNFIDPEQGPPVSIICDGIFKWWEDVSEAYEAGTPLSQEEKQQALQVYLDILEALIQAKANVHLWDAEEFYGPLWDAASSACAPAVQRLLDEKVDPNTRDEEGLTILSSISQLFFDCDFDEIDWSEALQEERETLELLRRHGAKMSKELTT

SEQ ID NO: 5087 - protein, 287 aa, Acinetobacter baumannii
KVTMTMTLPDFKLDLLIEAEELVPYLGNEYIRIVDLSRASVYEQLHVPHAIHLQPKWLVAQHEEATGVLPDEAGLQALIEKLNISPNHHVVVYDDEGGAWAGRLIWNLHCLGFTRTSLINGGIHAWLGAGLPTTAEVEELPRVDNLIQIDLSHAAQFRVNYEELRKQVEQESVQLWDCRTSDEYSGVRLAARRGGHIPNALHFEWSTALNRQNHLKLHPLERTRQRLEQLGFDLKQPVVVYCQSHHRSGLAYILARLLGWEAKAYDGAWSEWGNRLDSPIITGESPS

SEQ ID NO: 5088 - protein, 489 aa, Acinetobacter baumannii
NGHMEWPNPTKFPQGLEIIMSQNSTLQRGLNTRHIRFLALGSAIGTGLFYGSATAIKMAGPSVLLAYIVAGIAIYIVMRALGEMAVHNPVSGSFSHYASQYIGPLAGFTTGWTYVFEMVIVAIADVTAFGIYMGFWYPDVPRWIWILSLIMFLGAINLIHVKVFGELEFWLSIVKVSAIVAMILGGLGLMFYGFHADHSSVVPGIQNLWIYEGFMPHGIAGLVACLSVVVFAFGGIEIIGITAGESQDPKTTLPKAINAVPVRILLFYVLTIFVLMSIFPWNQIGSQGSPFVQIFENLGIKSAANILNIVVVTAAISAINSDVFGAGRMLYGMANRGQAPRIFQKLSRNGVPWMTVVVMAGVLLIGVVLNYLIPENVFVIIASIATFATVWVWLMILLSQVAMRRKLSTAEIKALDFPVFGWPYAPAFAIGFMVFILVMMGYFPDSRPAIYVGITWLALLTIAYRIWVKPEQSLGKESEPVQQNIEMES

SEQ ID NO: 5089 - protein, 499 aa, Acinetobacter baumannii
SFNIRCSMTDTRENWTSRSGFIIAAVGSAVGLGNIWRFPYVAYENGGGAFLIPYLLALITAGLPLLFLDYAVGHRSTGSPPKAYRALFKGGETLGWWQVCVCIIIGLYYASVLTWAGSYVYFSIGQMWGSDPEGFFFNTYLQTTKATGFDLQFVGHLFWPIVGIWALTLIILYGGVKKGVELSNKIFMPLLFILFTILVIQSLRLPGAVQGLNAFFTPNWSAMMDYKVWLAAYGHTFFSLSVGFGIMVTYASYLKPKTNLTGSGLIVGFANASTEILAGIGIFAALGFMAHAAGTEVKDVVSGGIGLAFIAFPKIISSLGSGADLFGLLFFSSLFVAGISSMVSILEVPIAAMQDKLKWGRKKAVTIIGGGSALVSIILFSSVNAIKLVDIVDHFINNIGIIGGALLSIISVAWFKRSALKELRDHVNRISTIQLGKGWDFTLTVITSLILLTTLCMTVFNLIKNGYDTYSMSLQGVFGWGSVIFCAVVAIVLSKMKDR

SEQ ID NO: 5090 - protein, 515 aa, Acinetobacter baumannii
EANMELLIQPGKLTLADLRQAYLNPIKVKLDESASSAINASVACVEQIVNEGRTAYGINTGFGLLASTKIAPEDLEKLQRSLVLSHAAGVGEALDDAMVRLIILLKANSLARGFSGIRRKVIDALLALINAEVYPHIPLKGSVGASGDLAPLAHMSLVLLGESKARYKGEWLPAVEALKIAGLEPISLAAKEGLALLNGTQVSTAYALRGLFEAEDLFAAATVCGGLSVEAMLGSRAPFDARIHEVRGQRGQIDVAAAYRDLLTDSSEISRSHEECGKVQDPYSLRCQPQVMGACLTQIRQAAEVLEIEANAVSDNPLVFAEQGDVISGGNFHAEPVAMAADNLALAIAEIGSLSERRISMMMDRHMSQLPPFLVANGGVNSGFMIAQVTAAALASDNKALAHPASVDSLPTSANQEDHVSMAPNAGKRLWYMADNVRGILAVEWLGACQGLDFREGLKSSPKLEQARKILRDQVPYYSEDRFFAPDIEQASELLASGCLNELLIPKLLPSLSEV

SEQ ID NO: 5091 - protein, 184 aa, Acinetobacter baumannii
LLSIWVQITHCKFMDTNTLHKPPIHFKDMSWFNRCIVFCGVGFGSGLAPKAPGTFGSAFALLFVPIWLSLGFTLSLIAILIMSVVGIYICGQTAKVINVHDDGRIVWDEFAGQSITFLPLLYLQQINWIWVITGFILFRIFDVWKPWPIRVIDRQVHGGFGIMLDDIIAGVWAALCTLIIIHLS

SEQ ID NO: 5092 - protein, 341 aa, Acinetobacter baumannii
SVIICIIVIQQSVIVRTGQSKYCNHPTFCFSYLRFGWINRIFFKMTQQAQTIQGSIVAIVTPMLKDGGVDWKSLEKLVEWHIEQGTNSIVAVGTTGEASTLSMEEHTQVIKEIIRVANKRIPIIAGTGANSTREAIELTKAAKDLGADAALLVTPYYNKPTQEGLYQHYKAIAEAVELPLILYNVPGRTGVDLSNDTAVRLAEIPNIVGIKDATGDVPRGKALIDALNGKMAVYSGDDETAWELMLLGADGNISVTANIAPKAMSEVCAVAIAKDEQQAKTLNNKIANLHNILFCESNPIPVKWALHEMGLIDTGIRLPLTPLAEQYREPLRNALKDAGII

SEQ ID NO: 5093 - protein, 109 aa, Acinetobacter baumannii
AISIKPLKTTIKLLESMGINNLKIWFIKKMPYFFSLRFMSIFTLFLVHQFEAKDIPVLNSAQIKSALNKKTKLSVWPSFVMYVVYTVILVCVYLPNKSQVQDPKYYAKG

SEQ ID NO: 5094 - protein, 718 aa, Acinetobacter baumannii
GLKMNKKSLVTIQILDLFGSPISKAQYEVKNQRTGQVIAAGTTNSSGCIVEISRDKGTALDVYIKSMFKGSMVKVQSFVMSKDRMVVKITSPKVLLNLKTLTNQGNNGQYKRKTHIVKKGDTLFEIAQKNHTTVRALERLNKIDDPNKISIGQVIKLPVHIPASGNHSHQDKPKHKHSAQSTNKPTASSTKTTPAPAAKRPANPASQTKQENGLPEKAHQLYEDTKKALNEAASSVSKILTIDDRSQDGGTPKANTTNICKTNPQCISSGKSELIREVNIRLAGFGGALPTDEFTELTATCIRQFQRDYMGVPDTGKICGSVLVALDQFYDEYPISSFMGKAACNCGKCSGFGNGKMGVQSGINTANEYPGIHRSLIWILKSLNFYLKNEFKDKKINVAYIESGYRCIENNKKHERTSVNHMGLALDIHFHKNGVRTRELSDMEFIRKNIMAKKMGASEQRIRDKIYLEPKVFRSGEAGATSWVHFDITMFLAKYFNNNMFKTKVSDLNGVKLVNLAASSRILSCGGIVALPKSQNNITDELVLSNEDIIDIMKVTETEVIKFKTEKYFLEQAAGVVDTIMNRTKSGVWGNSVRKVVNADRQFSKITGPKSLDPYGSVENMPMSHVSRKVRNFVNSYLLERANGKKSIIGENLNYANKYYSDEKNRKAWVDKFHNEAVKNGMILGTGKAIHAHGTVRELRDKMPKPFKIVLPKDFKGI

SEQ ID NO: 5095 - protein, 135 aa, Acinetobacter baumannii
AMEINSESSKPMKLKVILLFTIVLAGCQPQPKNEQHRHTVCQSLIEGYLKMTNQQDYKMEQRTDDETSAISHYEYKRNSSNEVVMVNSVYSKLYFSCREHQKSYFLSQHSSQGQTTPLLEVHFPTDSYTTFRERF

SEQ ID NO: 5096 - protein, 607 aa, Acinetobacter baumannii
LLLMKKLISQGIIYFLVAATFVLSQFVFAEDKLLSPEQAFSFSVESPQSHTAKLSWQIQPNYYLYQHKFTVQQGNQPLTLNLPKAVSQYDENYGQSQVYYHQVNFQIKTKPSEHYTVTWQGCAKDRICYPPQTIEFQTDADGLVGLQNQAGAAPKRLLDLVNTQASNSTEPLENQSSATQAEGAAPEIAQDQVWSAKLIEHSLWYGVLLFSGLGMLLAFTPCSLPMLPILTSLIIRDHKGLKAWTIALTFVCSMALVYAGLGLIASSAGLNFQRWLQQPATLIAFSLLFVVFALNLFGLFELRLPQTWLNRLDRIQSMQQGGTLVGAGVMGVVSALLVGPCMTAPLAGTLLFISQTQNQWQGALLLFCLGFGMGIPLLIASVLGAKFLPKAGDWMHQIKVIFAFLMLGLSLYFIRPLLPDWGMQVLSLLLGLAFIIYALYQFFWKKGQLQWLYALLLLLVTPFVVYNQYQHIQNRSLQNSEYMAEWHVATTAADFQKILAAAPTDRAIVVDVYADWCVACQPIEHRILKAPEVQAALAPYYLIKLDLSHYDQSHEALLKQWNILGPPTYLFLNKQQQEIRSLRLTGAFSQQELLQQLGSLSKAKDSN

SEQ ID NO: 5097 - protein, 201 aa, Acinetobacter baumannii
VPMIIYGDVDSGNCYKIKLLLSLLNINHRWIHVDILNKDTQTAEFLSLNPNGKIPVLVLDDGRVLSESNAILGYLAEGTELIPADPYMKAKMYQWMFFEQYSHEPFIAVARFINKYLGLPPERIEEYHKLQPKGHKALSIMNKALVGHDYLVGNKFTIADIALYAYTHVAEEGGFDLKLYPNIQEWCQRIQKYPKYVSMVE

SEQ ID NO: 5098 - protein, 196 aa, Acinetobacter baumannii
NTKINIRSIIMKTQRCGWCSDDPLYIAYHDEEWGKPEHDEARLFEMLCLEGQQAGLSWITVLKKRESYRQHFFNHAIADIAAFTDDFLETKLSDAGLIRHLGKLKAIRDNAIAWQALKAQVGDVSKWLWQFVDATPQHNDVADYRKAPAQTELSLKLSKTLKKNGFKFVGPTTCYAFMQAVGMVNDHENDCQFKAS

SEQ ID NO: 5099 - protein, 73 aa, Acinetobacter baumannii
RLKMKLYRYLTGPDDSAFCARVTKALNYGWELYEAPTMTFNGSQVIVGQAICKTIDENYDPEMDILDVLKNNA

SEQ ID NO: 5100 - protein, 325 aa, Acinetobacter baumannii
CLDFNCDLVWMNSMSALLRFTQFVQKTFALWVIIFAALALWQPEFFVWLKAYIPWILGIIMLGMGMTMTVDDFKGVLQSPKAVLIGVVAQFVVMPGLAFILCKLFNLPPEIAVGVILVGCCPGGTASNVITYMAKGNVALSVACTSVSTLLAPVLTPTIFYLLASQWLKIDAASMFISILQVVLLPIVIGLILRTWLKRQVESYIQVMPLVSVIAIVAIVAAIIGGSKAAILQSGLLILAVVILHNGLGYLLGFAAARFFKLPYVDSKAIAVEVGMQNSGLGVALAAVHFAASPITAVPSAIFSLWHNISGPALATYWASKHKQE

SEQ ID NO: 5101 - protein, 63 aa, Acinetobacter baumannii
SGFVVFWFAPFFIMVSNIEWIIGTPSAALSFHDDAPYIYLGILEFEWYPFIWASIPIIQFSLS

SEQ ID NO: 5102 - protein, 437 aa, Acinetobacter baumannii
DLFLEALLMSLLRRWFDPIRSSWFYQKPSRQAVLPTENGLSIYLRLDDVYSYLAVQQLSQLDEILSDELKPLKIIISHTASEPPNSMTHEEWQHYCLNDAKILANQHRFAFDEFPEIPSPESLKQAAVILKRTPLQGQNFLHLLEDIFHMLWQQQYGKLRTLHAMAVKHQVPQHFPERIFTDEPVRAAYFEFGGRKYHAVDDLLRLTRRLKQQKLLTGNPIFLINHIEWREHLINDAEALNEIQALHPELDVFIALEDPMSWLLLAYIKEELADYYDIQLKVYPLSYRGRDWFDWSLATRVSKRTEVAFTPFCRPTEESTLGMAKLFYSVPENQQLDTIFTILQAVWTKGKDLSFQKHFQQLQQQLGIEQLTEQDIQSVLAQNDALCQDKHQPDLPVLELRIDGQSYVFNSLYRVWMIESIFSNVLEEKYKTASTSN

SEQ ID NO: 5103 - protein, 928 aa, Acinetobacter baumannii
MLFFKQKFTFSYAQSLECSLIALYSKRIRTGENSMVQQIDAPLREDVRLLGNLLGETLKQHAGQELFNQIEQIRALAKGARDGQAEAEKQLEQLFLELPDEELLPLTRAFSHFLNFANIAEQYHVVRSRRQAEFDPDANSPNPLVHLFKKFKDKNISTEKLFQQICDLKIELVLTAHPTEVSRRTLIQKYDDINACLSQLDQQKLTPRERQNALANLKQQISSAWQTDEIRQHRPTPVDEAKWGFATIEQTLWNAVPKFIRELNELVQDNCQQNLPLHIAPVRFASWMGGDRDGNPNVTHQITQEVLWLSRWQAADLYLRDIENLRWELSIQSCSEEMVEAIGSPHPEPYREYLRATRERLKATRHWLAQRLQGLEADDSNVIKSKDELLQPLLLCYRSLIDSNLPEIANGQLLDFIYRVNCFGIELLKLDIRQESGRHRQAISAITEYLGLGNFESWTEQARQNFLIQELQSKRPLLPKYINEPEGSLIGHPDVQEVFATMRTLADQPPESLGAYIISMAEYPSDVLAVLLLQKEAGIQHPLRVVPLFETLKDLDGAATTMNTLFNMHWYKQHIQGKHEVMIGYSDSAKDAGFMSANWAQYRAQEELTAIARKHGVQLTLFHGRGGSISRGGAPTQQALFSQPPGSISGAIRVTEQGEMIRFKFGLEGIAMQNLEIYTAATLEATLLPPPEPKAEWRELMNRMTDHSVKVYRQTVRENPHFVKYLRTVTPELELQMLPLGSRPAKRKVSGGIESLRAIPWVFAWTQIRLMLPAWLGTGAAINEVIADQQKATLDEMLQQWPYFQTLIDMLEMVLSKADANIALYYESHLTEDEDLKVLGNQLRQRLKDAVETLLALKDESKLLSDNEVLDQSMQVRKPYLLPLHLLQAELMKRRRDYLAERQAEHTPVDHALMVSIAGIAAGLRNTG

SEQ ID NO: 5104 - protein, 335 aa, Acinetobacter baumannii
EKRVKNLSYTHANLNFKKSLSMRVLVVMDPIETVNLKKDSTMAMLWAASRRGHELGYALQQDLYIDQGKAYGLISPLKVFEDYNHYYELGEKKKESIAAYDVVLMRKDPPFDMNFVYTTYVLEQAEREGSWIINKPQSLRDCNEKLFATQFPELQVPTLVTSQQSLIREFITEHGDVIVKPLDGMGGMGIFRLYQDGVNIGSTLEMLTELGTRPIMAQRYIPEIVEGDKRILMVNGEPIPYCLARIPQNGEVRGNLAAGGLGQARPLTENDKLIAAKVGPFLREKGLVFVGLDVIGNYVTEINVTSPTCIREIDAQFGTSIADDLFDVLEAGRPA

SEQ ID NO: 5105 - protein, 65 aa, Acinetobacter baumannii
FRVVERKRVDRLVPIETSTHGASPFRPTAKKGGRKGLTTYSKTIIRYGDLRSVKTVWQCRPATRY

SEQ ID NO: 5106 - protein, 62 aa, Acinetobacter baumannii
THSLVWLSIFQPRTLSIRKMPHFDFITINIAFNIKIYTIQLMLTFIIYFHLTVIFLYSTVFE

SEQ ID NO: 5107 - protein, 461 aa, Acinetobacter baumannii
VKSFELFMSTTVIILAAGKGTRMRSQLPKVLQPLAGRPLLGHVIKTAKQLLAENIITIYGHGGDHVKKTFAQENIQWVEQAEQLGTGHAVQMTLPVLPKDGISLILYGDVPLVRQTTLEQLIEASNKTGIGMITLHVDNPTGYGRIVRQDGKIQAIVEHKDATEAQRQIQEINTGIYCVSNAKLHEWLPKLSNENAQGEYYLTDIVAMAVADGLEIASIQPELAFEVEGVNDRLQLAALEREFQKQQAKELMQQGVTFADPARFDLRGTVKVGHDVRIDVNVIIEGDCELGDFVEIGAGCILKNTTIAAGTKVQAYSVFDGAVVGENTQIGPFARLRPGAKLANEVHIGNFVEVKNTTIGLGSKANHFTYLGDAEIGAESNIGAGTITCNYDGANKHKTTIGDAVFIGSNSSLVAPVTIGNGATVGAGSVITKDVAEQSLSFERAQQISKANYQRPQKLKK

SEQ ID NO: 5108 - protein, 244 aa, Acinetobacter baumannii
TVTFLAIIMMVFAFAGMIKGMIGLGLPAVSMGLLTIAMSPFQAASLLIVPSMVTNVWQLFAEGHVWAFIRRFWTLLAGIVVGSIWSFLPTLSQSHGQSSEILLGCMLALYGLYGLCVKKLPHLGKHERWLSPIIGYIGGAVTVATGVIIIPIVPYLQSLHLKRDELVQALGLTFTVSTICLAVFLHHNPMSGITLDYRLSFAALLAALIGMWIGKKIRYRLNEQIFRRIFFIGLMSLGLYMILH

SEQ ID NO: 5109 - protein, 305 aa, Acinetobacter baumannii
IFAFQYVPIMRFDFFDLQLVLHIVSTGSLTKGADRSAISLQAASERIKKLEQYFETPLFIRQTTGVELTTAGHAFVEHARQLLAQKDQLEHEMQRFRQPTTEALTLWCNSSAQSEYLPTLLPQYLVLHPEMNIDLHEAESSEIVDALTQGIASLGLVSSFFNTRHLQTKEFASDPLVLICPVTHELAHYKELNLVDALSYGFIGLKSHHSLQQSIETQAKLLGFNIQYRLRLPNFGAIAEVVAKGVGIAIMPARAAQRLQSDYDFHSIQLLGAWANRKLLLATQSFNQLPSSYQQFADFLLQHRP

SEQ ID NO: 5110 - protein, 319 aa, Acinetobacter baumannii
KIKFIGKQVINISGYYMNIPNVLKYYFTETFLKTAIRKPSQLNLPPTALRPMLEQLCRAFPKQKNVTVRPIRLAGIKGEEIKAQDSATQLIFHIHGGAFFLGSLKTHHAFMTDLAARTQMQIIHVDYPLAPEHPYPEATEALYDVYQSLLVQGIQPKDIILSGDSCGANLALALCLRLKEQPELMPSGLILLSPFLDLTLTSESLRFNQKHDALLSLEALQIGIQHYIGNHIAADDPLVSPIFDNLEGLPPTLVQVGSKEILLDDAKRFREKAEEAGVKVHFKLYTGMWHNFQMFNAWFEEAKQAMADIAEFAHELDKT

SEQ ID NO: 5111 - protein, 208 aa, Acinetobacter baumannii
NMISLELFITFLITTIIFAYIPGPAMLYTAAQTLSRGRKSGLMAAFGIFVGGCFHIIAASLGLTTIFQIIPKLYDIIKILGALYLVWLGIKLIRSTSSPTLQQNVENGQLSLRQSILVEVLNPKTAIFYIAFLPQFINTSLDFPVWSQFIILGLIVNLIFVSADVVCVFLANYISQKLTKSKKPQKSMSVMGGLIFMGLGVFLGFKNQ

SEQ ID NO: 5112 - protein, 63 aa, Acinetobacter baumannii
RPTSVGFFLTVDQIWLHFCLRPCILSVLYLGGDHLNAIKATCGDLCLVICNCHGSGKTNLARF

SEQ ID NO: 5113 - protein, 199 aa, Acinetobacter baumannii
RIHSFMLSWEFTMKYLSLCLALGTAITLSACSTIPSKPKTFDQLGQFSAYPLNAQTFRISFQADPNMSYGAAEEITLVKSAQTTVQKGFRFFKVLNDPSNQSQKPPRQAVVYPSAPSFYPYGYYRRYPGFWHDPFYDFPQVVNIDPVQVSYTIECYRDQKQAPQDAFDATLILKSIGQKYGLSPTGELLPPPEPPVKQK

SEQ ID NO: 5114 - protein, 441 aa, Acinetobacter baumannii
YCISSCIKIDELTLKQQAPLSTDSLDTWLNYWSHVHVTGIDLGLERVIPVAEKLGVTKPNAKVFTVAGTNGKGSTTTTLASILKAQGYKVGLYQSPHIYRFNERVKLGGVEVDDQSLIDAFVQVDQARRECDLSLSFFEATTLAAFVIFKHQQCDVWVLEVGLGGRLDVVNVIDPDIAVITNIGLDHTDWLGDTIEKIAFEKAGIIRPHIPVIFAGEQSLPQAIQEKANSSQATLYAISRDYFYKLADDGKHWYFASERTTLRLPLGTLAIENIAGAVAAVLNSGLKISQLALEEGITNARLAGRFEVREVNGKTIIFDAGHNPHGVEFLLKQLRNFLEYNKQYTEVVAVFSMLADKDIKSVVDLLKPTVLHWKIAELNVPRAAPIQQLNDALQGQTIQQFGNIKEAFKSALEQTNNNQLILACGSFHTLEAIWEYLEECQ

SEQ ID NO: 5115 - protein, 79 aa, Acinetobacter baumannii
FTYSGPHLENGASMTDKIDIAQELQLKQVQIQPKDFSRPSLTECEECGNDIPIERQRYGSVTLCVECKNTQEKLSKRYY

SEQ ID NO: 5116 - protein, 613 aa, Acinetobacter baumannii
DYNSGFTSIEEPDMPQYKAPLRDMQFVLHELLNAEEHYAKLPDFQGNVSRELVDQYLEAAADFCENELSPLNQVGDREGCTWNDGVVTTPTGFKEAYQKYIELGFPSLSAEEQYGGQGLPNSLGIAISEMVGSSNWAWGMYPGLSHGAVRTLEHHGSEEQKNTYLPNLVSGVWTGTMCLTESHAGSDLGIIRTKAEPNADGSYAISGEKIFISAGEHDMAENIIHIVLARLPGAPKGTKGISLFIVPKFNVNADGTLGERNAVRCGSIEHKMGIHGNATCVINFDQAKGYLIGPENRGLNCMFTFMNTARIGTAVQGLSASESSFQGALTYAKERLAMRSLSGPKAPEKEADPIIVHPAVRNMLLTQKAFAEGGRALVYLLAQYADIVEKGETEEERKFADNILSLLTPIAKAFLTETGSESAKHGVQVFGGHGFISEHGMEQIVRDTRIACLYEGTTEIQALDLLGRKVLQTQGAMLRDFTKIVHKFVEANKDNAAMKEFVGPLAALNKEWGDLTMQIGMRAMQNPDEVGAAAVDYLYFSGYVTLAYLWARMALVAQEKLAAGTTDVDFYNAKVTTARFYFKKILPRVRSHVDVIAGGLDPLMALDAEHFAF

SEQ ID NO: 5117 - protein, 187 aa, Acinetobacter baumannii
IQLSCSLNRINMWNYLVSFSTWAENNSGQIQIVIAVVALWLAILGYKKVIKQIQMAKEQEEQNYQQRNYEIKIEVINLLFKISDSIHKKLKGLYDLQTGLKNSEEDFKTKEESILLNDTLKTVQEKIDKTLEIREQLNSTLESFIKKDDIDYKLFEKKLNTLYLALIKENKETNEVDLLKAEFFIED

SEQ ID NO: 5118 - protein, 181 aa, Acinetobacter baumannii
KKASIVMLMSNHLIKHFQKGKRMQLATKSFLGLCLICSTAGAVEPAATPATLPTAASTQNDKPAPTSATVAKPATTTAPTSTQPLTAEQIAKNKQQQDAKIKALVQDQASRLKQLEHANLEALAQNQELQLKNDNLSVQVQVLQSERSAQMFLYGAVTLAGGVLLGFFIASYVYTKRRRQW

SEQ ID NO: 5119 - protein, 136 aa, Acinetobacter baumannii
SQKSQNIWCSTWRWRIWRANSMMSRENGRKLETELDHIRQSVQDILTTPVGTRIMRREYGSLIYQLIDSPFDEIATLQLYAATATALLRWEDRIILNSVSLVNDEEGSYFLDMDCSLVDSNKQASLSIPLSIGSAL

SEQ ID NO: 5120 - protein, 241 aa, Acinetobacter baumannii
GKRSGVLMNLEQVRLVDEAITSRHSVRAFLSTPIEPEVIKDILRVASRAPSGTNTQPWKVYVVTGHKRDEMVERVCAAQIEVSKNPELAEQYKETFAYYPEKWVSPFIDRRRENGWGLYGLLDIKKGEKEKMAAQQLRNFKLFDAPVGIFFTVNKAMGIGSKMDIAMMIQNVMVAAKARGLDTCPQAAWNHFHPLVLDILGAADDEELVCAIALGHADPEHIVNTFITPREPVENFAVFLD

SEQ ID NO: 5121 - protein, 107 aa, Acinetobacter baumannii
RKMSKYHCKCGGLILPDFESFQIGDEVNCMVETHKPIGNGMVSVNQRAFVGTILKINGDEFKITSKRKQYTFFRGEFSPIDAPGPIEYFRLGKCRCELDQEQKPCAE

SEQ ID NO: 5122 - protein, 355 aa, Acinetobacter baumannii
MSTSIYQRPNKKWKADVVLNGVRVTKTLEKKELAIRWAKETERDLILNDSTQKALNSKIVITMREALGRYSDEVSRFKATGKKEMQRIRYFQDNLPNTDWPLSCYKGEFLKQWEDAVSKRTIKPLKPSTILRDYSTLSSFFNWCRKDKGWIESNPVENLRKPKKPPHRERRTEVEELQRMLAALKYKPGTVPTTKMQEVGLIWLIAMATGMRSGEIVNRLPVHVCLSKRYVQLDKTKNGTARKVPLDDFALQLWTLALKIDRKGSPKVFTVSDSSRDSLFRKARKKAGLENSDLTFHDSRHEAASLMARRIKNALTLCKIFGWKDPKQALTYYNPTNDEILDELNQSSGLSRLLA

SEQ ID NO: 5123 - protein, 68 aa, Acinetobacter baumannii
AKTSSTTSQCPCSSSDSSKIILKTVKQKAPEGAFCLYITIYDFDYLSHLNFIKSVYTQSTYIVQVFFS

SEQ ID NO: 5124 - protein, 73 aa, Acinetobacter baumannii
FSRSMNMKTNLSQHPCENKCSKFNGEQCRTCLIGEDLGDDRHLANHISVKCQVIPHDELKHLNRAHQAIGEVS

SEQ ID NO: 5125 - protein, 579 aa, Acinetobacter baumannii
RLTFRTFSMRASRFLFATLRETPNDAEVISHQLMLRAGMIRKLASGLYTWLPMGTRVLKKVDAIVREEMNRSGAMEVFMPVTQPASLWEESGRYEQYGPELLRFKDRHDNPFVLGPTHEEVITDLARNELKSYKQLPVNFYQIQTKFRDEIRPRFGVMRSREFIMKDAYSFHATQESLQETYDVMYDTYSRIFTRLGLDFRPVQADTGSIGGSASHEFHVLAASGEDDIAFSTESDYAANVEMAEAVLVGERAAPTQEFKLVETPNQKTIADVCQFLNADPKQSVKALLVQGVADEKGNVPVVALFLRGDHELNEIKAEKHPLVAAPLAFATEEQLQAFGLTAGFTGPQGLVEKGITVIVDRAASVLSDFVAGANEADKHAVGVNWERDAQITEVFDLRNVVEGDPSPDGKGTLQIKRGIEVGHIFQLGTKYSEALGCKVLGEDGKPFTVTMGCYGIGVTRVVAAAIEQNYDDKGIIWPQAIAPFEIAIVPMNAHKSPRTLEAAEALYAELQAQGFDVLLDDRNERPGVKFSDLELMGIPHRIVIGEKGLDAGTFEYKGRRDAEASNLTKEELLDKLAR

SEQ ID NO: 5126 - protein, 360 aa, Acinetobacter baumannii
QFLPFNATITLSNEPLMTPELPGTYINLLAEIVKRRGISCEQFLEGSGVTPEQLKKPYWYVEFNTLNNLLEHAIQLTHEPALAGYLALEMKASCYGSVGMAAMVSANLEEALKILEQFIGSRCDAFKPELKQEQDDVYWSIHQPLKSFQLSSDATIFLLLGFVHIAKHLTGLSSLGTVQLNMPEPLGFSKIKDKLGVSCLFEQKHNIWIFPKEYLMQPILTADPMLAPLLKAQCKKDIDKLKLRSGWKAEISQVIKKLLINSQGEILKVKQVAQMMNMSERSLQRYLAIENTSFSALVDLTRKQYAQDLLQNSSMSIEAVALSLGYADTPHFTRAFKRWMGVTPKYYQTQLKLKNLEIRE

SEQ ID NO: 5127 - protein, 286 aa, Acinetobacter baumannii
AVQPNIFSRQPPSFRSFIIAVITCLVVLFFDWRMPYVIQPARDVLYAAYNPIYALASYPVLSREWLNQQTKSETQLRRENTAMQAELLQAQVRLQKLSELSAENTRLRGLLDTPLIIDGRMEIAEVIGTDADPLRHIIIINRGAMDHLKVGQTVLDDKGIMGQIINVYPHSSRVMLLSDKEHSLSVRLERTGMRAIVSGTGDLGRLKMEYVPTSANIQVGDKVLSSGLGEHFPAGYAVGTVAKIRRHNSGEFAEIDVTPAAQLATGHHVVVLFSDSLAKEQPYADR

SEQ ID NO: 5128 - protein, 87 aa, Acinetobacter baumannii
LIKPIGNEMARPRSRYKCPHCGEPFAIRSSDALSPLLRMFQAQCQNLNCGFTAQGYMELKFQLSPPAQPNPEINLPTPDRTWKMEPA

SEQ ID NO: 5129 - protein, 121 aa, Acinetobacter baumannii
SSAFLGKSMKNDDLSTRGSRLRDERKRLGFQNQEDLADILNVKKNSVVRYEKHNAALDTDQLDLLEDHGFNIPYILWGRVELNSSDLEENESKLIQLYRQTREEMRPGLISIVETYANQFK

SEQ ID NO: 5130 - protein, 595 aa, Acinetobacter baumannii
TIMPIYNAPLADMKFILNDVFKAEQFWQANEKLAHVDAATAEAILEEMAKFAQNVTHPLNRTGDEEGARYENGEVFTPAGFKDAFRQYAEGGWIGLGADEEWGGQGMPKMLTVLADEMLFATNPSFMLYPLLSVGAGMALSSYASQEQKETYLPKIYSGEWSGTMCLTEPHAGTDLGIIKTKAERNEDGTYNITGTKIFITGGDNDLAENIIHLVLAKTPDAPAGSRGISLFIVPKYLVNEDGSLGDRNHVGPGSIEHKMGIKASATCVMNFDGAKGYLVGKENEGLAAMFVMMNYERLSMGIQGLGASEFAYQNAAQYATDRLQGRSAAGVQSPSKPADSILVHGDVRRMLLNVRANNEASRAFAVYVGQQLDITKFSTDAEAVKKANDRVALLTPIAKAYLTDTAFQATLDAQMVFGGHGYIREWGMEQCIRDLRIAQIYEGTNGVQSQDLIGRKTIKCGGAFIAEYITEIRDFANDLDTDLNFIKDATLDAATEIEAITQFIIEQAAENVEFPNSAAVDYLHAVGLLSFSYMFAKIAAAAKDKSGDFYQNKLALAQYFVERILPDIDARIAKIKAGSDLIMGFSEDYFTNQA

SEQ ID NO: 5131 - protein, 73 aa, Acinetobacter baumannii
GFGPSLKRGTVLENSLCFFPEQWCVKVHRLSCNHSRLNVHSLIHVLSIYGLGLCDRPVQLGYGLPMLAKGSEP

SEQ ID NO: 5132 - protein, 267 aa, Acinetobacter baumannii
IAALNTMQVSKWIRIFLAAIGSILFLDGLFLAFLNKIHVGTLVPLVLGAFFCLYALFYYHLERFFFYHYRLHTLWRFGWLCFWIWLIGLGYFFNFIKENKDASQNLPAVKAIIVLGSGVENGQPSAILAKRLDTAAPVALSQPQAKVILTGGLDFSEKEPEALVMSRYLEQHFHIAKDRMILEDKSTSTELNLKNSKPLLEQAHINANQPIAIVTSDFHTPRAAAIAKKQGYTQVYMVAAETPLITRYNAWLREYFAYASGWLLNEY

SEQ ID NO: 5133 - protein, 173 aa, Acinetobacter baumannii
RMALPPKLKNMNFFNEGNSYLGKVKTVTLPKLARKTEDYRGGGMNGTVKVDLGMSDDGLVLESTYGGLDLLTLRQFGMEKIDGVYLRFAGAYQRDDDSEYDAVEVVVKGRHEEIDGGESTPGEDTEHKVVTNCVYYKLTVNGVVEVEIDILGMKEVIGGVDRLEKQRNILGII

SEQ ID NO: 5134 - protein, 133 aa, Acinetobacter baumannii
SCKFIISNLRAKEMARILIVDDSPTETFRFKEILTKHGYDVLEASNGADGVTLAKAEQPDLVLMDVVMPGVNGFQATRQITRDEDTKHIPVVIVSTKDQATDRVWGKRQGAIDYLIKPIEEKQLIDVIKQFLN

SEQ ID NO: 5135 - protein, 103 aa, Acinetobacter baumannii
FLHTHVRKKVVAANKILLQKGFCAEMEKYTRYKELYMSLPLINKQFMKQGLAITIATMKMNVTHATTEPQEIQQLGTVLNALFFNEKEKGTDSRVMTMACYSL

SEQ ID NO: 5136 - protein, 266 aa, Acinetobacter baumannii
MKNTKINARHLIIDLFLSSAYPQLSIKQILVAAKLFNLSENGIRVATTRLLNEGMIQSVERGIYQLSPSAKDWAKVILNRKNGIKQTKEWQQHYLAVFTGTLGRIDRTALKKRERALRQFGFKELETGIYIRPDNLAYSFEKTCDELVLAGLEKEAKICIIQHVDSTTLKQIFSLWDTKQLEKNYEMYSRDITHWLENYAHSPLNDAAVKALLLGRETIALLMNDPLLPAPFVNESARNQFAQDVQQLDAIGQKLWKKIYEQELNL

SEQ ID NO: 5137 - protein, 276 aa, Acinetobacter baumannii
IGSTTMNTLTQLDDAVFIQDQQVKTDSLKVAEVFGKPHKDVLQKIRTLDSSPDFNERNFSPVEYLDSKGESRPMYEMTKDGFIFLVMGFTGAAAAKIKEAYINTFNQMAAVLYNNDGNHQQIHEGAVVQLKSGGPLYTISKIFYDQNGYMQNAEVIWHNKANLYRELLPINCLTLESKNLIQNKTLEDFWASLHNFGVGKLNHSRNQNILALNLMQIYQCIEGLPPKNQLSAILMHSSNPFPIYMQHNHAVSSAITNKTVKCWIFNTKQQQIPLLW

SEQ ID NO: 5138 - protein, 1033 aa, Acinetobacter baumannii
LMWFTRISVKYPVFTIMMMLSLMVLGLASWKRMTVEEFPNIDFPFVVVTTQYAGASPEAVESDITKKLEDQINTISGIKQITSRSSEGLSMVIAEFNLDTSSAIAAQDVRDKIAPVIAQFRDEIDTPIVQRYDPSSSPIMSVVFESNSMSLAQLSSYVDKKIVPQLKTVSGVGNVNLLGDAKRQIRIKVHPEQLQSYGIGIDQVINTLKNENIEVPAGTLQQKNSELVVQIQSKVIHPLGFGDLVIANKNGSPIFLKQVATVEDTQAELQSSAFYNGRTAVSVDILKSSDANVIQVVDKTYQTLEKLKAQMPAGLNYKVVADSSKGIRASIKDVVRTIIEGAVLAVLIVLLFLGSFRSTVITGLTLPITLLGTLTFIWAFGFSINMMTLLALSLSIGLLIDDAIVVRENIVRHTELGKDHVTAALDGTKEIGLAVLATTLTIVAVFLPVAFMGGLIGRFFYQFGVTVSTAVLISMFISFTLDPMLSAHWKDPVKKKESRLQRFFNHISNLLDRLTHVYEKLLKLALRFRFITVIIAIVSLVVALGLSKMIGTEFVPTPDKGEIRIQFETPVDSSLEYTQAKLHQVDQIIRQFPDIVSTYGVVNSEVDSGKNHAGLGVTLKPKQERSADLTTLNNEFRDRLQTVAGIRVTSVAAAQDSVSGGQKPIMISIKGSDLNELQKISDRFMAEMEKIDGVVDLESSLKEPKPTLGVHINRVLASDLGLSVSQIANAIRPLIAGDNVTTWEDRDGETYDVNIRLNENKRVLPQDVQNLYLNSNKTNANGQNILVPLSAVATTQEKLGASQINRRDLEREVLIEANTSGRPSGDIGQDIDKMQKAFKLPAGYTFDTQGANADMAESAGYALTAITLSIVFIYIVLGSQFNSFIHPAAIMASLPLSLIGVFLALFLFRSTLNLFSIIGIIMLMGLVTKNAILLIDFIKKAMEDGISRYDAILQAGKTRLRPILMTTSAMVMGMVPLALGLGEGGEQSAPMAHAVIGGVITSTLLTLVVVPVIFTYLDDLKNFMLRQTRRFMS

SEQ ID NO: 5139 - protein, 95 aa, Acinetobacter baumannii
STTTRYFTSTDTSADLPNGPCRFCQFRRAFGHFFVPESLTEGNQGSDSLELVDDVDEAIANIAVIFHWPPSTYDDMDIVELSKWHRRAIKRNQTN

SEQ ID NO: 5140 - protein, 116 aa, Acinetobacter baumannii
LWSTTSMITNVWAELDPNELPFIDKEIGPEDFKTQYLCSWDPGHDITHQLKDDQRNIDEAIFQVKTCINNLENSTSRLVRKNAKEVLQVIKQNLNWEKHPELNQKIHLLQSLLYRG

SEQ ID NO: 5141 - protein, 130 aa, Acinetobacter baumannii
RVLTMKMTAKIALFSAAIVTMGSLAACQSTTQPPKPEHGMMQDGPRDSHHHRMKHREFTPEQKAAWEQHRAERKARFEQIQKACEGKAVGQTVNVQVGDKTLEGTCNLRFEPKRPQPPVNAPAPVATQAK

SEQ ID NO: 5142 - protein, 295 aa, Acinetobacter baumannii
RMVTMNTPASNDKNPTPDLAEDNAFFPSPYSLSQYTSPKTDYDGTTYPTPYAGNKKVLMIATDERYIQMQNGKFFSTGNHPVEMLLPMFHLDNAGFEIDVATLSGNLAKLEMWAMPKQEQVVLDTFQKYADKLKNPLKLADILENVVGENSPYAAVFIPGGHGVLAKIPHSLEVKKVLKWAVEQDKFIITLCHGPASLLAAAVDEQPENYIFKDYQICVFPDSLDKGANIDIGYMPGALPWLVGENLEKLGVKILNTGITGQCHRDRKLLTGDSPLASNNLGKLAAETLLAEVKD

SEQ ID NO: 5143 - protein, 285 aa, Acinetobacter baumannii
CGQTHLEYDMILKFGSKGDAVATLQKQLAKMGYKGVKDKPLSVDGHFGESTEFAVIQLQRKFGLVADGKVGDKTRQALAGDSVSKFLKDEDYKKAAIRLKVPELVIRVFGAVEGLGVGFLPNGKAKILFERHRMYFYLCQALGKTFANSQVKITPNIVNTLTGGYKGDAAEYTRLSMAINIHKESALMSTSWGQFQIMGENWKDLGYSSVQEFVDQQQLNEGNQLEAFIRFIEWKPGLLEALRKQDWDTVFTLYNGKNYKKLGYQAKFQKEWDHLEPIYREKTAA

SEQ ID NO: 5144 - protein, 704 aa, Acinetobacter baumannii
YNKTKGVRLETHLMLFYKNILTLSILAAISIPVFAAENENVEKLETIRIKAHPLEQTSKDFAVADTVVDQKHLTEGAATIGDALNSEVGIYANQFGAGSSRPVIRGQDGPRVKVLQNSSENVDVSTLSPDHAVTVDPVLAKQVEVIRGPSTLLFGAGTVGGLVNVIDNKIPTQMPENGYEGQVGLRYNTGSDEKLASAGVTVGLGSQVALRVEGLTRDANNYIAPNYIHEGEKERRVDNTFAQGDSVNVGLSWIYDRGYTGISYSNRRDQYGLPGHSHEYESCSAHLGGRPHLHCDAHEHDHEEGEEAHAHEEHEHEHGGPWIDLKSERYDFKTELNDPFAGFQKLRAQASYTDYQHDEIEEGTIATRFQNKGYDGRIELVHNPIADWEGVIGTQLGQQKLNLTGEEAFMAPTTTKKWSVFALEHKQWKDVHFELSARADQQEIDVDDNSKQDFDGSAFSYAGAANWEFAPNYKLSFVASHQERLPLAQELYANGAHFATNTYELGNDQLSKEKSNNVELGLHFDNDKLDYHLHVYHNWFDDYIYAQTLDRYKDFRLVQYTQDKARFYGAEGEIGYQITPMYKISAFGDYVRGKIDAEGNAPRIPAGRLGTKVDADFGDGFSGSAEYYHVFNQDKIAAYETETEGYNMLNLGVAYSGQYGAKTDYRVYMKANNLLDDTVYQHASFLSNIPQVGRNFTVGVDFSF

SEQ ID NO: 5145 - protein, 471 aa, Acinetobacter baumannii
YIMTNIVTMDIVSIKNFIQKNKVRHLSNKVLHTHPSPKMWKTDLKEEENNYFLLNTDAQYKSINLYLGIPYCIPTDPPHCGFCLFPTQDYKGKREMDFYLDFLSREAHLYKEFYQGAKLESLYVGGGTPNLLQPNDYMKLTKVVSSLFPDAGISSPIEMTLEGIPQLFNEDKIRAIKDAGFNRVSMGVQQVNDELIATSGRKQTRKQVFDAIELFHKYSLSCNVDLIYGWPNQTVEAMLRDLESIVQSGIKHITHYELNIAGRSDFATKQKQNTPSIEKKIEMYNIAKQFLISKGYKQKTVYDWEKEDNNQLISEKYLYEDNLRDCLDANGQSKMTTMSGLGYAAVNMRLQPNSSSIKSVSAMNHRNLTEYYNAISLNKLPVERMFVHDTEDVKLIWIFQALQEMKINTKKYEKIFNSDIKLDYKPIWDALVEEGWVEHNDEYIKLINEGEFYTPLIQALLSQPRIKSLQQ

SEQ ID NO: 5146 - protein, 643 aa, Acinetobacter baumannii
SPETYLFHLSTRSFTWGECMEHVMSKSFQPTRLVGAIAIAMGCSPVIFAEDATDATQLDPIVITASKSAEKASEVPARISIIEPKIVEQSPIAELPHLLMSDAAINMVQSGGLGQTSSIFIRGTNSEHALILRDGARLNTASTGAANLAFIDTTDIKQIEILKGPASVLYGTDAIGGVVQIISKTPEKTSAFVTGEIGENKTYKSIVGADLAENGFYAQVRGQRLESDGSRITDLKGNDIKKASYDQKGFSTKVGVEKEDFGASVDYTQNEGTSQYDTFRYDGSLTSQDFKNELLNIRGRVNLNSDISLNARLSQFKDELDQNGSRDFVHSTTKEAEVYGKWQFTSSQNVLAGVTHQNIDGDVLSYGSPYDEDVNSTGYFVQHQYQNNGLNTQVGVRVEDNEKYGTHTVAQGAIRYQLLPLTSIYANIGSAFKAPTLNDMYGSGGNPNLKPEESISYEVGIDQKLNYNISTGLSAYYTKIDNLIESRCIAVCNGDWINTFPVYQNINIDKASMRGGEVYANWNRDDLFIKSSYNYVKAINDETDQELSRRPRQSFTVSTGLQNEHYGLSISLSAKSKAKDYKQDTPGYTTVDFNGYWNATPNVKLFTNIQNIGDVKYKTASYDKGIYYVNGGRLASAGVTLSY

SEQ ID NO: 5147 - protein, 409 aa, Acinetobacter baumannii
FSHASLFVELKPQLTGFFMAIDQYHHGIRVLELNDGIRPIRTIATAIPGFVATADDADPLVFPENQAVLITNIQAAVAKAGKNGTLAKALQNMANQTNAICVVVRVPTAVDEAAQTANVVGTVTAEGKYTGLKALLVAKSKLGVQPRILGAPGLDTQAVATELVVIAKKLRAMAYAYAWGCKTKEEAVAYREAFAARELMIIWPNFVAFNTTTAQTETVPAVAVAMGLRAKIDNEIGWHKTLSNVAVSGVTGIDADVTWDLQDPATDAGYLNSNEVTTLIQHEGFRFWGSRTCSDDPLFAFENYTRTAQVLADTMAEAHMWANDLPLHGSLATDIIEGQKAKLRELTRNKYLIGGDAWFDPEANTPDTLKVGKLATDYDYTPVPPLEDLTFRQRITDRYLANFAASVKA

SEQ ID NO: 5148 - protein, 208 aa, Acinetobacter baumannii
AHHACICHYVCWLSVFCWLSCFVCNCTRWLIMFYKTNKPEAIEAHVQFFKEKAALHESARKFAAEYDATEVVLHNRCQIFFAGLQLKTSNKVNLHVWRKPAVHYYNISHLRVKATKKEHKAEWEREKERYAELLKKHFPNGEKVSLEPFFNSLGISAGSLIMSGFGWFVHDGWMYIDTSLKLDHLTEILGSEYLAAQQAKTKSEKEAV

SEQ ID NO: 5149 - protein, 163 aa, Acinetobacter baumannii
ALNAIYFSSRVYVGKTMKKVLQPLFLTVLAVPSFVFAAETASAPQTTTVDKVLAAKGPTSAQAVVKQENTTVISPRTGIRYTLGNTGNRPIILQTAAIAPANSANINRIVASNPALSPKSQEKAKVALIGEAAVAGAAAVAANNVTAPAVPNSVTPANPASLN

SEQ ID NO: 5150 - protein, 232 aa, Acinetobacter baumannii
TMNAPIGLILPSQQMLSSDIALITNIRLDSVKRTIERLAERRVITLPPTVEKPTAGRTSTEYVFSGEQGKVDSITVVAQLCPEFTAAIVKRWYELEQQTPAFDINNPQHLLQAIEVQAKQNLRLTAENKTLSQAIETITHTEHGVKFQQACKILNVKQQVLAEWLRKHNWDRYLNNARASTYYSESRGYCETKYSLKEGVKSSGQPYSYTQTEFFILPKGMQILAKRFGESL

SEQ ID NO: 5151 - protein, 161 aa, Acinetobacter baumannii
WMNAQILDPCCGSKMMWFDRNNPNVIYGDIRKEEHTLCDGRSLVIEPDVMMDFRDMPFKDGQFTLVVFDPPHLVKAGKQSWLAAKYGKLSEDWREDIRKGFAECFRVLANGGVLIFKWNETQIKVSELLELTDQKPLFGHISGKRSNTHWITFMKIEVAEG

SEQ ID NO: 5152 - protein, 127 aa, Acinetobacter baumannii
MEDAFQNLKVMVIDDSKTIRRTAETLLQREGCEVITAVDGFEALSKIAEANPDIVFVDIMMPRLDGYQTCALIKNSQNYQNIPVIMLSSKDGLFDQAKGRVVGSDEYLTKPFSKDELLNAIRNHVSS

SEQ ID NO: 5153 - protein, 648 aa, Acinetobacter baumannii
NSRALARLFHLRRKRMRYPAWKYLLILVVLVVSTLYALPSLYPDEPAVQISGAKAGTQIDQSVVQKAEQILKTANIASHDNTFTNNAALLRVSSSEAQLKAKEVLRRDLGDQYVVALNLAPTTPEWLQKIGAKPMKLGLDLRGGVHFLLEVDMDKAISQRMETSATDLRRQFRENKIKFNNLALNNNVITVQFADNADRDAAMDFLRRNGNEYTQQALASTTGSILKLTYTDVRRQEIQAYAVNQNLTTLRNRINELGVAEALVQSQGSNRIVVELPGVQDTAEAKRVLGRTANLEFRLVSDLNDQYIDPYTGKYNGQPLPPGTEVFAYQSLDSGRQLLLQRNRILTGERVQNASSGFSQDSGGAEVNITLDSAGGKLMSDATRNAVGKRMAVLFIENKQKISYVTDPKTGAQTEVRTPYTESVVINAATVQAVLGSTFRITGLSSPQEASELALMLRAGALAAPMYFVEERVVGPSLGQENIDKGVLSTQIGFLLVAIWMVVFFRLFGLIANFALVFNLAMILTIMSWIGASLTLPGIAGIVITIGMAVDANVLICERIREEMLWGASPKQAIVAGYDRAYNTIFDSNLTTFLVAFILFAIGTGPIKGFAVTLMIGIICSMFTAITVTRAIVQIIYGKRRNLKKLSI

SEQ ID NO: 5154 - protein, 64 aa, Acinetobacter baumannii
LNSAKDRHSYNALICPTSSQKLLMYPLSFFNLNHLQLKPVQNWCIYQVAFEVYFLNMEEDLTLN

SEQ ID NO: 5155 - protein, 209 aa, Acinetobacter baumannii
FGSAVLPRNGGGSMNMNFKPQAKKMKVLVACEYSGRVRDVLYKGWDLVVAHPPCTFLSVAGNRWFNVERYGQKAITRLKDREQAIAFFKLFTDLECEMVAIENPIGCMSKTYQKPSQVIHPYMFGDPERKATCLWLKGLPALQATNVVEPTIVKYKNGKGTDSPWHLDTLKLPAEERRKARSLTFQGIANAMALQWGGDVRHLAMREAV

SEQ ID NO: 5156 - protein, 199 aa, Acinetobacter baumannii
YGNANGNQISYMAIRVMTTLYQRQLLKLLKIAEVKMIKPKWGSYRFSVDKNKTGKKRTNRDPSPQIPAFLIKGQSYECDVNTLLSCSVNIIPPSMNNYWLDSGKTSKRLSKRANHFVEVMKRFIQPLQYKGDVQVIIDYHMPDKKVRDIDNILKPCLDALTKCGLIDDDSQVKSLSVNARPIVAGGQIDIQVRKHNTGA

SEQ ID NO: 5157 - protein, 292 aa, Acinetobacter baumannii
KMNAHVSYQVEPVVRKDLDFHLNEAPRFWFNNDPFLTRMFDALSLTFPDGERYFIECVRMFRDKIDDPELQKRVADFIKQEAQHGIAHDKMNQLMKEQGMPVDQFTTTLKKIFRFELTKRSPQYNIAMTAAAEHLTALMAETFYSHKKTLENAHPYVRALFAWHAIEEMEHRDVAFDVMKQVGEVPESTRRFVLVLTTVLMFGFTLYRTNIMLKCDGFSPRERLLMNLKGLPWFFGKNGTLTAMKKQYMDWFKKDFHPSQHPVIRQYPVWIETLEKTNDPIAAGEAFWQAGL

SEQ ID NO: 5158 - protein, 353 aa, Acinetobacter baumannii
KGRAMQEFTISNGYFYLWNTYLKEKGIDWQTLNLSEIQTRQVQNILSASIDAQSSLDLFIELLEITETRLHVTNLALEMAACITPANFGVLGYMASRSDTLGQVVEYIAKFHRLVIDGAQVVPIQIEQDASKIRLYWPLVDDSNILLSELTLAAMVQLAKQIAPVHEFLLQHVEFVHRARGAVVHYQRFFQCKLSFERPYYALTFASESLNVRPQHADPTLVQLLVKQAEEALVQRKIHADLVQQIHWIVQEYFKHKQQAPKIEDIAIELNVSVRSLQRQLQALNTSLKLILDAERMKRCEILLSQNESLTAIADQLGYSDQSALARAYKNLTGQTLLTRKKQLQLIQKNATK

SEQ ID NO: 5159 - protein, 190 aa, Acinetobacter baumannii
SRSAFIMNAKVQIQLQEQLVPFYNATNYLNAYKIAYETATQLRTLLNQISKSAIFVKTYAEEHNLDNSIFIEVENLIAISLQLSNSYADTCNAVIKRHRKAPHDQYDAGDLNEAYALAHEYTTWLETLISKIRIEVKLVKEAVKDVIHSSVFATLESLINIAEYFAEINVNTFSIESEKYEAEFEVSKNG

SEQ ID NO: 5160 - protein, 455 aa, Acinetobacter baumannii
IYLASHLAQVQLGLFCISIGKNHHLTGALIVIALPFKTSTLKTQQSLSNKKGTVMSEAYIIDAIRTPRGKGKKDGSLYEVKPITLLTTLLNELQQRHQLDTSKVDDIVLGCVTPIGDQGGDIAKTAAIAAGWNDDVAGVQINRFCASGLEAVNMAAMKVRSGWEDLVVAGGVESMSRIPMGSDGGPWALDPETNLKSSFVPQGIGADLIATLDGYSREDVDNFAVKSQQKAAAAQSNGYFDQSVVPVKDHAGVVILEKDEFIKGNTTLEGLTKLNPSFEMMGQMGFDAVALQKYPEAQKINHVHHAGNSSGIVDGAAVVLLASEKAVKEQNLKPRAKVLATALVGTDPTIMLTGPAPAARKALEKAGLTIDDIDLFEVNEAFAAVVMRFINELNVPAEKVNVNGGAIALGHPLGATGAMILGTLLDELERQNKKRGLATLCVGGGMGIATIIERV

SEQ ID NO: 5161 - protein, 116 aa, Acinetobacter baumannii
RIKAPQSRTPSNRGSFMSTQFQSQADFKQTSQVQSFYEPAMAVVNELMAVKKSNLKSKGYDENNAAITKEELRQSLMRRLRISHFMASQIVTSLSKSGHIREFGGYVAPKAVSNDK

SEQ ID NO: 5162 - protein, 105 aa, Acinetobacter baumannii
NCKAIRYFEHLSRWQVMIELLFQTVAVLAYLICGFRIATFSHGGNFHRGYSFFAATLIAAFLGQSVHILFFKDPVTLWDAIFAILLAVLIWRTKGNVAKLIWSTT

SEQ ID NO: 5163 - protein, 1512 aa, Acinetobacter baumannii
AKEAFAMKEILKTLTEAMTLPEDSYSEQDAEFLEIFIEEIEEIFVDLQPLINKWMQSENIATLTEIRRHFHTLKGSGRMIGAKSSAELAWTVEDTLNRVINQSLQLTPTIQSYVQLVFKFYFLKLVDNFKQKRAHTLDFRPLILLGQQLQQQQSLEPALEELLQLSNTLTAETVTGLELGYIEQDSLAEPIIQTTHTEIEINLDETLTLFMEEAEEHLATIHQFLDQELHQYDSYNALIRALHTLRGSSAMAQVETIFEASTKVEHLFKILLQEELSSHSEEILLLQEYREFVRDSLELLSRYSSSEQLEARLQQFNQSWDAYVEQHGDRTDPLMPSHGLVSQLLQLDVSELLDAELDFEKGIRNEFPDYLERLSEQANLLLQHTHSQAMLGLHEYTSQLKESYEVLLDKPALLQSDYIFEIYQKAHQQLIQLFDALAAGQRVGVVKQHQSILEELKLYTQYTPDLSNDLPQQDSTSFEPISNIEPEPEVVATVENFSDSADWAVLGQSVQQDRQYISSTQVNRNFDADLLDIFLEEAEELLEGIDTDLNIWVGEQENFAALNNLMRYLHTLKGGANMVQATYLGLIAHELESIYERLIQKQLVATSDLIDFIRLVQDDLADRLQIMREQQLDYAAPYTINALKRAGQNSNFQPLSVVDAFDTESEIFSEQEVISEVIIDEIPVELEPALAELEAHHDQVFDTAVTELATPVEVITSVTSQENRVAANEQDIEAVVEQTFLEEATELLEMAESLLKQWFEQRTNRSILLQLQRAMHSLKGGARMVGLEAVQAIAYQLENAFEQFALHHFNSNIYDHLLESAIAWLKDAIFNHNYQHFDGLQQSLENIQFFETTIQIPTKLTRADLFSSEPVMTFIQGDGTEPPPMMGAWEQTERLDQNNEMIRVSADLIEKMIDLSGENSINRSRIEMDLSQFSHTLVEMELAIQRLADQLRRMEGELETQIIAKHGIEHSRYTDFDPLEMDQYSSLNQLSKSLAESASDLVDFKNTLSDKIRDTESLLLQQSRIQAEIQEGLMRTRLVPFSRLLPRLQRIVRQTSTALNRPAELFVNNTEGELDRNILERLVIPLEHMLRNAIDHGLEDRAQRQQANKPETGRIELNIQRQGTDVVVVFSDDGQGIDVEKVRQKALLAGLIKPEQDLEQQDILQLIFHPGLSTAEQVTQISGRGVGLDVVQSDIKSLGGHVSVESVYGQGTTFTIRVPTTVAVSDALMVKVADQQFAIPLAQIDRIIRVSPASLEQYFESPQELFEYENRRYPLRYLSEFVGNQPIPRLNGVMYSLPVLMIKANNGQTVALLVDQLIGSRAQIVVKPIGQQFSSIGAIAGATILGDGQVCLILDGQNIARQIQSTQRHKQLSEAVYRHRESDERRLIMIVDDSVTVRKVTSRLLERQGYDVVTAKDGVDAIEQLENIKPDLMLLDIEMPRMDGFEVLNLVRHHDIHQYMPIIMITSRTGEKHRERAFSLGVSQYMGKPFQEEELLENIDALLVASDSEVKS

SEQ ID NO: 5164 - protein, 303 aa, Acinetobacter baumannii
CHGAHMHAYTVEPLYVPCDQEMIAADFYIPKTNNKSAVIIMAHGFAGLRQFKLIQYAQRFAQAGYAVILFDYRYWGGSTGKPREMISINSQLEDWKTMIQYASTCKFIDNRRIVLWGTSLSGGYALSLASELKNIQAIMVQIPYVDGAETAKLYPLQRYPQALKLSSQDYMGSKMGLNPKRLPVVDQYKLCFMPTADSYYGYLSIVNPDYYWSGEVPARVFFNLMRYHPIQLVRQINIPVSFIAAQHDSLIPIESSREAATNIAPFVSYHEWDMKHFDIYHGSWFEKAVTTQLEFLHQHIGVM

SEQ ID NO: 5165 - protein, 145 aa, Acinetobacter baumannii
ISGAKVSEAYTKPEGILSLQTIAMPADTNWSGDVFGGWIVSQMDLAGAIHAERFSRGRCATISINQMTFLVPVKVGFVISCYTKILKVGNTSIQMQIEVWDSHDDSRAPIRITEGVFTFVAVDVKGNKRQIPEEAKQKFLISQES

SEQ ID NO: 5166 - protein, 220 aa, Acinetobacter baumannii
VWLAGQLAIYGVLYFLGGLLRLIISHQVTFFINSLCHMFGKRPYTDENSARDNFWLAIATWGEGYHNYHHIFQYDYRNGVKWWQYDPTKWLIWTCSKIGLAKNLRRIPSFNIKKAELAMKFKYAEQDLAIYGHDVNADISQMKQRIAQEYEAFTHTLNDWAKLKEQELQAKKAAMAEKIHKMDHKLKVDFQLLEHRLSHHRECLETLMRNIKKNTNVVPD

SEQ ID NO: 5167 - protein, 74 aa, Acinetobacter baumannii
LIMAMRPDVRRHALVVIVFSLAQWFFMRYILANELFNLTTNQRILYFCVSSLVGALLIFVALIYMVLKGNADKN

SEQ ID NO: 5168 - protein, 230 aa, Acinetobacter baumannii
LCVAVTKTYLSLSFHNQFCQYLSNMVSYLFRLTSIVKQKKLTLNAIKRFSIIQKKLPVWLPPTASLHFDEELLAELDQKGVKKTFVTLHVGAGTFMPVRTDDITNHVMHSEWCDVPQETIDLILATKARGNKVIAVGTTATRALESAAQAHGGKIAAWTGDTQIFIYPGYEFCIVDRLITNFHLPESTLLMLVSALSNRENILAAYEHAVKDRYRFFSYGDAMLIDKLEV

SEQ ID NO: 5169 - protein, 214 aa, Acinetobacter baumannii
ELRAKGQQTDTKKLVDPVKADADKKAAEAKRLAEADKKAAEAKRQAEADKKAAEAKRQAEADKKAAEAKRQAEADKKAAEAKRQAEADKKAAEAKRQAEADKKAAEAKRKAEAEKKAEAEKARELLENGDKKWMVQVALAANQANADAVVSKLRAKGYKVTTSPTSKGIRIMVGPAKDRDTADTTRKKITSDASLNMKSAWVIDWVPLDQRKSD

SEQ ID NO: 5170 - protein, 323 aa, Acinetobacter baumannii
IYNLGVSFVFIINFMIKQKNIIIGSATGYNADLISSFVYSLGKTDFDGILTLIIYKEQMTEFVNAFSDVKNFKIEFKVSTIGKFKSKSKYSGIYKYKFVKNIFKKIIDLTVNEEKPETKIKGLKITGYPHVSRFFEYKEIVENHPDASHVLLTDVRDVFFQSNPFKNLGKGLFVGMENPDFTIGTEQYNQKWILDAYGESFYNLAKDEQVSCSGVTIGDHESIKVYINKMIDEFCKQPYQKMSNRIYDQAMHNKLLITNELVEVTRCQPFESIIVTLGLYPIEQISINDQGFIINRNQEIIPIVHQHDRHPELIQLCDNYIGK

SEQ ID NO: 5171 - protein, 92 aa, Acinetobacter baumannii
MTNFFIFFIIVFILSLLILWMMLDYQFTRYIRTIKVAQLGNMDPSSVLTDEIRINQNSESTSRGTKMWLYPALIGLIIGVMISGSLFLYVFG

SEQ ID NO: 5172 - protein, 709 aa, Acinetobacter baumannii
TNFYAVNEQRIFLGRSCMGFKLKKKSGNRGATGKSSVNFIVKIQSKIEQFASLFGESEKSKPILYAALLCLVCALISLAYLFYNVPRHNQLIRSLGELRLLSQTISKQATEATESGSQEAITKLQQSKKDFDENLLEIENIHGKSTDEYQKVEKIWGEVSKNIDLISSHQRVLNQLYDTNISISETVPEIQAEYNLMVDQMARQGLPSSQVIIAKNQVFIAERILRSINSVLSGTDGNVSTSDFSVDIETFGTYLNAELNGNAELGVDRIADPALRESLESIKSEYDKVLKSAAATVLKNGSQIVNVRQASSQIFAKSDVMLESLGHLSDVARKNWLTLFLGAVLILSLGGLIFSVFKLITLRSVMDKQRVARLQEEYDRNQNAILRLLDEIADLADGDLRSYATVSEDFTGAIADSINFAIDQLRDLVSRIHETSQEVARYTQDTQSITNQLAEASEHQAQEIAGASTAMNEMAQSIDQVSANASESAEVAQRSVQIASNGAQVVNRSIEGMDTIREQIQETSKRIKRLGESSQEIGNIVSLINDIADQTNILALNAAIQASMAGEAGRGFAVVADEVQRLAERSASATKQIETLVKTIQTDTNEAVISMEQTTTEVVRGANLAKDAGIALDEIQKVSGDLAKLIASISDAAKLQSASASHIATTMTVVQEITSQTTTATFDTARSVSELANMAESLRESVTDFKLPD

SEQ ID NO: 5173 - protein, 430 aa, Acinetobacter baumannii
RNLYKQRHKRFVNMKTHKSLMVSCLSVLSITLFVQHAQAAAAFDPNGSWMLGDWNGQRTALQAQGYDFSFGYTGEYAGILDSKQTSTHGSAYTGQLALGSHLDLGKILGWQDTEAQITLTYRDGQSLSEHSPALAGHQSSVQEVWGREQTWRLTDLWIKKKFLDQKLDVKVGRFGEGEDFNSFDCDFQNLALCGSQVGNWVGDQWYNWPVSQWAMRVKYNLQPDLYTQVGVYEYNPENLERGKGFNLSTDGSHGAIIPAEVVWSPKLGVQSMPGEYRLGYYYSTADAKEIADSTKTSHKQGVWVTAKQKLFQPADQTDRGLTGFVNLTFHDSDTNKVDNMQNIGLVYKGLLNQRPQDELALGVARIHINDDWNDVQAKEYDTEYNTELYYGIHATNWLTIRPNVQYVRHVGALKNGDNTWVGGIKFSTAF

SEQ ID NO: 5174 - protein, 61 aa, Acinetobacter baumannii
MVIYNNLYRKLIIVFSPCFTPSKDFFYLTFLALSIRACSLFKAMVAVFLVLYILMSFKGLL

SEQ ID NO: 5175 - protein, 160 aa, Acinetobacter baumannii
SLPYSLEGLNMGYKKKFFEPITGTSINRAIDLCKSIPEKLEKFQEDIRYLDSNQLFQKQFIHQLLVIVNELEELNQLLLIMAKPKDIYFSSLKTALAWISNISNALIITEYYLNPENKYKRLLNKHTFGFEINLILKKVDSVKQILERISKGDPVNRRIH

SEQ ID NO: 5176 - protein, 202 aa, Acinetobacter baumannii
IMNLLPPNTTAFEKKIVETTSKTTELNTNLSSLIRIDDAPADFLSILAWQFSVDRWQDDWPDEVKRAQIKNSIKVHTYKGTNFALRSIVESFGYSLTVHEWWQESPMNEPGTFQITIETNGRALTEKTSKTLVELLHDAKPLTRELKGIEINVINIEGETNVACGCYSGEDVTIYPKVDDPNSLIYPIFAFYEHETTSIYPK

SEQ ID NO: 5177 - protein, 340 aa, Acinetobacter baumannii
KILYGDLLMSDSKVQAFTFGDAEPVMNGRDLSQFYETWLCGNYYEPHISMNALAKSFKAMPYLSTAVFYKKNQLVSSFIPNKLIKSSEFERIAFDYLVFGNGYLQQIDNRLNEPHHYDGLMAKYTRRMKRSNEFLQLLNGFEEHIFKPGTVCHIKGIDVDQEIYGTPEYIAALQSVWLNESATLFRRKYYNNGSHAGFILYMTDSGIDDDDVEGLKQAMKDSRGPGNFRNLFLHAPGGKKDGLQLIPISELAAKDEFLNIKNVTRDDVLASQRTPPQLLGIIPSNAGGFGSISEAREAYWYSEIVPLQNLFANTVNEWAGDQIIRFKEFSQLQFKQEKPQ

SEQ ID NO: 5178 - protein, 65 aa, Acinetobacter baumannii
DRLYILQKSIILFILYALIMLLHQKNAVTTSKNIERNSCYFSLILNEKTYDYFSKITSANCSAIS

SEQ ID NO: 5179 - protein, 456 aa, Acinetobacter baumannii
LRIYGVLLNMYPYSAMAKKTIPLSDSKCTGAKPQEKDYSLYDGHGLILFIRKSGSKVWRFKYKRANGKDGLMTLGNFPALSLKAARDKRRELETLLANGIDPIEYNEIQKAKLDNKYNFESIAREWHTAYKSTGRWGTETAERALKNMEEYVFPKLGKKPIDAIKPKELIQVIKSIEDLGYTEVVKKTRQRLTSIFAFAMSKGFIESNPAYGLQDIFILSKKTKHHPQLPLERLPELQAKLASDTGHPLTRLCVEFALHTFARSSEIRFARWEEFDFEKAIWTIPPTRDFVEGYKYSYRGAKMKTPHLIPLSNQALAIIKEVYKYSGHTQNVFPKNGDPHGFMSESTINKTLRRLGYDTNTEVCGHGFRGMACAALIQSKLFQKDAVEKQMSHQERNNVRLAYTHKAEFLEERKTMLNWWSSYLDVTKETSISPYDYTAQILGEEIIQFKYAKLMK

SEQ ID NO: 5180 - protein, 126 aa, Acinetobacter baumannii
RKSYPHQQKNEVHMAGWYEITQANDGQYRFVLKAGNGEIILNSELYKAKASAVNGIESVQKNSSDDARYDRLTAKNGKPYFNLKAANHQIIGSSQFYASEASRDKGIESVKNNGSSTTIKDLTVQA

SEQ ID NO: 5181 - protein, 295 aa, Acinetobacter baumannii
NITYHTLYLINPVYLLILRVGMPELPEVETTKTSLFPLLNQKVLSVEVRNPSLRWPIPDNVQKLVGQRLIGLNRRSKYILAEFEQDQMLWHLGMSGSFRLCQPNDELRKHDHLIIQFEDQQLRYHDPRRFGCILWLNPETQGKLIDTLGPEPLSTDFHAEYLASKLKNKSVGIKIALMDNHVVVGVGNIYATESLFNVGIHPAQPAGDLTMQQIEKLVVEIKRILKSAIDLGGSTLRDYSNAMGENGYFQQTLLAYGRAGEMCVNCETTLENLKLGQRASVFCPQCQPLKKLRKP

SEQ ID NO: 5182 - protein, 690 aa, Acinetobacter baumannii
IFKYEVKSLKSILLKSALTIALMSSANLVNAELVTTSQIKKISGIDQQYIDSSISEKNDFYAHVNGIWLKNTEIPADKANWGAFNQLRELSISQVHGIVEELSRKKWADGSLEQKIATLYASFMDEKGIEKQGIIPLQAELNQIDSLKNKKQIAVLMAHFARINVNSPIGLGIEQDMKKSTEMVAGLEQSGLGLPDRDYYLKDDKKFIETRAQYLKYIEKTLSLAEDSQAAQHAQEILKLETQLARIQWSNVQNRDLAKRYNKYKLADLYKLTPAFDWQGYLTATELKGKIDTIQVNQPDYFQGLNTIIQNTPLDIWKAYFKLHLINNFSPLLNSAFVDNKFDFYNKTLRDITEQEARWKRGVQLVDKVLGDGIGKLYVEKYFPAEKKQQMELLVQNLIRAYDQSITELDWMSPATKIQARKKLSHMSIKIGYPKKWRDYSDLHIAKNDLVGNIIRASEFRYQYELNKLGKPVDRDEWYMKPQTVNAYYNPSLNEIVFPAAILQPPFFNINADDAVNYGGIGAVIGHEISHGFDDQGSQFDELGNMRNWWNAEDHQHFKAKTQALIEQYNRYEPIAGYHVNGELTLGENIADNSGLAIAYKAYQIALGGKPAPVIDGQTGEQRFYMGWAQVWRAKTREAQAIIYLKTDPHSPDKVRGNGALMNQKPFYEAFKINEDDQMYLPPEKRVNIW

SEQ ID NO: 5183 - protein, 189 aa, Acinetobacter baumannii
RDKYARFIGSSMAANGFIELLRLSKRGNKNYASVQNEAQRWSGIAFEMRGQYFVAPLGEVSEVIYPPKYTPVPNTQSWVKGLANIRGRLLSVSDLAHFISGQRSSFSSTQKVLCISHHDQYVGLVVDQVLGIQHFNKKSFFSESSDLEENLKEYCQGYFHQHNQHWHVFLFSRLLQNPHYMNASTKFIN

SEQ ID NO: 5184 - protein, 392 aa, Acinetobacter baumannii
LSKYSKTMSCSAIYLDHFGNLTCKNCFYTVVNRQFIFLDGHLGQFKVNIKETEGFNMSRDTISIHFVNAALTGVKRLGMDVETLLSHVGIEAELLRQPKARISPEQYTRFIKMLWMVTQDEHVGFDVQPRRLGTFAIMCQLIIHAKTLGQALELSSQFYKLFGDEWSVTLERDKHEARLVPLIPKTLDPDHFITESMLMIWHGLASWLIERRLPLERVHFSYPRPAHADEYDALFFAPVMQFDAPRTEITFAADYLDLPIRQDEKTLEEFLKAAPAQLLVKFKNTNSLTSRIREVLKSQIGEEMPTLNDVASMLYLSPQTLRRRLAAEGKSYQGVKDALRRDAAIHLLLNPELTLEDVAQQVGFSETSTFHRAFKKWTGVTPGLYRQLHGYH

SEQ ID NO: 5185 - protein, 108 aa, Acinetobacter baumannii
GMKYQIQPTQVPDDLSGCWFHPDIEQHDTIGDHAEFYTKEQWAQLQKNLGISILIERFDYMEIEEIPDEDSGDWSKWKPKAPKQNLFLIAAFDSEDGPILWWANPNQS

SEQ ID NO: 5186 - protein, 119 aa, Acinetobacter baumannii
LLGYFQMNQIDQAINQEQIKNPNEEVVTLEEPIRMGDQMITQVTIRKPGVKALSGTSLQAIYQHDVDALCKVLPRVTSPALTPQQIYQMDPVDFANLGGHLVTFLYPKALQKEIKAQTA

SEQ ID NO: 5187 - protein, 604 aa, Acinetobacter baumannii
MLMYWLNEPMDKALNTPTNLTFDNRLTAKFLYWMGWRISSIAEFLKENDKNVHAWKARDEWEKDAPAGRVAQALEAQLVKLIILEKKTPGDFKEIDLLMRQLERMARIDKYSNGGNETDLNPKLKNRTSGPRKPTAKNQLTEEQIEKLCEDFDDGLFEYQKVWYRAREQRNRAVLKSRQIGATFYFAREALIKAVTTGRNQIFLSASKAQAHGFKTYIKNFVMQSIEIDLQGDPISITLPCGNTVQLIFLGTNAKTAQSYHGDLYFDEFFWVHGFATLKKVASAMAAQKQYKKTYFSTPSSKTHEAHAFWTGDAFNKGRTKENRVEIDTSHANLRDGALCGDKMWRHIVNIQDAERQGCDLFDIEELIAENSPEEFANLYMCEFVDDGHSVFPLSVIQPCMVDSWEVWSKDFKPLALRPFGNKPVWIGYDPAESGDSAGLVVIAPPEPDYPKFRLLEHHQFKGMDFASQAQYIKKLTTKYNVKYIGLDKSGMGTGVAQLVLDFFPNLTTFNYSVDVKTQLVMKAMDVINKERFEFDAGSTDVAMSIMAIRKTLTASQRQMTFEASRAENIGHADLAFAIFHAFANEPLTLDDQTKSKKSSMEIY

SEQ ID NO: 5188 - protein, 64 aa, Acinetobacter baumannii
YFFQKKKAISHFNNIFAYKKNMTLSLLSALPVSNKKPLNEFSGFSFSFKKNYLSRLRLRSFSVK

SEQ ID NO: 5189 - protein, 260 aa, Acinetobacter baumannii
NIFHNSMRPSLLPGTPMTVIPTIDIVDALAAEYAAKSPREILELALSQQGEIAISFSGAEDVVLIDMASRLGKPFRVFSLDTGRLHPETYQFIETVRKHYNINIEICFPDAEAVQSMVNEKGLFSFFKDGHQECCGIRKVQPLRKKLATLDGWITGQRKDQSPGTRTEIPVVQADAGFSGPGKQLIKYNPLANWSSADVWSYIRMMEIPYNPLHERGFVSIGCEPCTRPVLPNQHEREGRWWWEEATQKECGLHAGNLKK

SEQ ID NO: 5190 - protein, 180 aa, Acinetobacter baumannii
MSIHKELHILKTDDHGEFALWEVAKSENTLIKKEAIFLSHGAFSDKTVCMGIADYLANHGYICFILEWRGHGTSPKTDIPFNFETVALYEYKTAFHYIYHNFNIASLHCVTHSGGGLCLTMFLINYPEYLKNIQSITFIACQAFGAVNNSLDLIKSFWAKIIVKGLGQRYQGKKNKKGEE

SEQ ID NO: 5191 - protein, 96 aa, Acinetobacter baumannii
KMDLEWLEKQRRELEKRFNPELHKLNEWARKVELDELHKQLSTPKICTADITPINKRALPQELWKDRKIKELEQENKELRRKLAMHVLTYRNGESI

SEQ ID NO: 5192 - protein, 295 aa, Acinetobacter baumannii
FFNQAKMSIQTISSTITRLNKELADITHRMSLEHKKSTDISTKIIQIQTSITKTTSISTVKSKLSEISRKEQEHSRIQIKISELQKKKTDIQNKLIKENQNLAKAEAVERKKIDALVKKQQKEEIEHQKKLKREIESIKVSTQLTGISTSPYIDMTPEPEYDLFISHASEDKEDFVRPLAETLQELGIKVWYDEFSLKVGDSLRRKIDSGLRNSKYGTVVLSADFMKKEWTNYELDALVAREMNGHKMILPIWHKISKTDVINYSPNLADKVALNTSISTIQEIAEQLADVILEK

SEQ ID NO: 5193 - protein, 437 aa, Acinetobacter baumannii
MFNQITNKLKDAAESYQSETEYPFPIYRLEVDGNDISPLVVDRLISLTIKDNRGLVVDSVDIDLDDSDGQLEIPPEGAIIQVWIGWSNTGLVDKGKYKVESVTHRGAPDILSISAFSNDVSEGLKQKRERSFSSKTIQVIFETVGAEYALKTIVHDTLAKRVISYIAQNESDANLITRIADEHDAIATVKNGHLILLPRGASQTVSGLPLPTAQIFRSDGDGHNYTTGTGTDRITGVKAYYYDTGKSKKLYVVIGDNEDNLKEIRYVHRDKKTAELAAQAEYNRCKRASQKLSYTFAFGQPELIPEQEFVFTGLKPQIDDIVWLGTNVTHNLTDSGFTTNVELEAQLPNADDVSTLFEPDKEGDKVLRKKNKKRTGRNYADYTGVIVFYRENGKDLKLTSGDQSNPLKLIKIYKTKKTATIALKREQARIDKAKKVK

SEQ ID NO: 5194 - protein, 277 aa, Acinetobacter baumannii
FLNHGVVQHFLHAAIHPSYRDRLAPKYATSHRQQLALAIPETKFHQKYCYVYVNLCLASFILCHSPNLIRYSNMKALLDFVPLIIFFYLYKTVDPADTQHPLLKLIGSAGGVDNNNILVATTGLIISMLVVYGALFIMQKFRLDKQQWIVLFMTVIFGGITLMLSDDFYIRLKAAILNLVFAGAFLVSPWFGKDRKPLIQRLFDPILALSEKGWKNLNFAWAAMFVVMSGLHVFFAFLFHGGKYWGEFTAFGDMIVMFSFIIIQFIILRKHFKSPDA

SEQ ID NO: 5195 - protein, 80 aa, Acinetobacter baumannii
THDQQIGGEMHSTLEINSHKKMTAEEILEEIEYPLENLENFLLAMTKMKVVERLEEKEFSAIINTLHYQVSNIKRAVHTK

SEQ ID NO: 5196 - protein, 129 aa, Acinetobacter baumannii
KMSHISHNILFEIFFMSLPNCPKCQSEYTYQDGDLLICPECSHEWKEGEALVTEEQEVIKDANGNVLADGDSVTVIKDLKIKGSSSVVKVGTKVKSIRLVPDASDGHNIDCKIDGIGQMKLKSEFVKKA

SEQ ID NO: 5197 - protein, 876 aa, Acinetobacter baumannii
YYLQNPYYLLNLRLYFVTRSPSYLHYSTMFKKFLFQIHWFLGISAGLILSIMGVTGAIYSYDQQILKWVNTDSYVVQVQSSPKLTPAQLYQHFTTIQPEIKINSITIAKDPTASSVVNIEKEGERRGYNMMVNPYTAQVLPEVQGRKLLLLIQQIHRNLTAGEFGKQITGACALMLIYFVLSGLYLRWPKKHSARQWLAVKPKLKGRNFIWDLHAVVGTWVIVFYLLFACTGLYWSYDWWRSGMFKVLGVEQPKMQGHGGSGRNKDQFPKIQLDNAQLITALNQTWSGFNNQIGRDYSTLTVNLPKKDDGKIELSFVDATPQHERARNQAVYNYKTANIEKMELYEDKKLNQKIMSSMLPVHRGSFFGPVYQFVAMLASLAMPLFFVTGWMLYLKRRKQKKLTQAARQSLAGHYIDQNAKPWLITYATQTGVAEQLAWSTATSLQEAHQPVQVKSVQQLTEVDLQQHEQILFVISTYGTGEAPDLASNFAKKLLKTNLRLQHVKYAVLALGSKEYPDTYCSFGHTVDEWLKNNGAKALFDIIEVDNANPTDIQNWNQALVKATKLDLHAVNIEKVFDNWTLQQRDLLNPNSLGQPAYNIELTASHEAVWQAGDIAEIQPGNSPERINKFLQHHHILKNAVVDSLQVSIEKALWNKDLTGEIEPFANLDHLLEQLPTLPTREYSIASIPSQQVLRLVVRQQYDESGDLGLGSGWLTQHTEINQNVALRIRTNESFHLIDDNRPIICIGNGTGIAGLMSLLHTRTRHNYTDNWLIFGERQRAHDFFYASTIEAWQTMGMLKRLDLAFSRDQEQRVYVQDIIRQNAAELVNWIERGAVLYVCGSIEGMASGVDQALIHILGEEQVDELRQQGRYRRDVY

SEQ ID NO: 5198 - protein, 170 aa, Acinetobacter baumannii
EFNHLRSVHMLNTALPVLYKDGTIADNTYQIIAEDGVIPQGDVVLTTAQLDQLANIQGKKALYVTVNDSPEDHTFPLSELDAIFIEFAGFGDGRGYSFAALLRRQGFQGELRATGDVFKDVLNYLKRSGFDSFVIKEGKDVQEAAAGLQDFTHPYQASTAVPKASYQTGA

SEQ ID NO: 5199 - protein, 642 aa, Acinetobacter baumannii
LCLHQTSTSVVILSDLLNRMNKSNRIQTAELDWESIDGIEVPISKQFGDVYFSKDNGLLETRHVFLNGNDLSERLANLQDFEYFSVGETGFGTGLNILALWQLWQQVRPNNHSHLHAISVEKFPLSKADLIRALNVWDELKPLSKQLIEQYPLPLAGCHRLSFPEERFSIDLWLGDAQDIFPGMVKTKAVNAWFLDGFAPSCNPDMWEQNVLNNIVRLSDYGTTFASFSVAGVLKRGLKTHGIDISRPRGFGHKREMLKAIWKAPVSEEILFEPVSDTFHFTQQRIAIIGAGIAGLSTAWAFAQRGHQVTLFERTAPLSGASGNPLALLNPKLCPIEQSHEHLMTLSWQHALNFYKNFQAFRPIQIQQMALKNAQDLLDLTNQYPADIVTQQTSSLESDYPHIILTEAGAVSPHQLRDEILQHPGIELKIANITTLVSFENKVQLKSGNETTLEADHVVVCCARESAALFENYPLLKPIRGQVSWVDNSFATLPLHEAYSYGGYCMQLNTSELILGASFYPNRDDQEVLLDDHVHNFELIHSVFPHYAKQLPPVEQWQGRASVRAQSPDYFPVVGKMQKESRISTFAGLGSKGFLFAPLCSEVLVAQILGEACPVPKSLLQKLDAQRFQKKVKPKKPYFKSQ

SEQ ID NO: 5200 - protein, 200 aa, Acinetobacter baumannii
NSLQFVICTMTAKTLYAYTLQPVPYEVSEAEQRNAQLLIWRSTNKISTKIWAIMGVILALAILGLIFIKNYSTVICWVAIVCVVLYYLGRKYGLEWYVKRKMNEFPVQEIKGIRLGVQPHGIVMRQQMGLQEGVGTIGWKNIYEWYNTPDFILVNFKVKDPKGQEQQGAYILPKRMDSKNFSFNTIRKHLKESVGEPKTL

SEQ ID NO: 5201 - protein, 202 aa, Acinetobacter baumannii
AHIQKRQLLYVPHNHRRAIMQNDSNVETTQAEIKPFPRQLISDMWDSNVTFDTILHIPTLLASSSEQVSDKFQEFLDDAYEEWQSSLLLEQCPALKSTLNEIRENNDIKHYAGEVLQDFHRACGDFEFLIEIEIRIPFNFRFDKDGKYQSNSLGGSFRVQWILAKNMVDAAQYAIKIAEELHSVEEAKARKEQGLEENSNES

SEQ ID NO: 5202 - protein, 402 aa, Acinetobacter baumannii
GYQHSMFKSFFPSPRYFFISAVIWIALNMVLWYSGGSTWGSFIGFHQGYHSEQLPIGVSRFWSPTFIWFYLWFLVSTAIFAGFWRIISNHPWQRWSVWGSAFILFNIWFGVQVSVAVNAWYAPFYNLIQAMLDHGGGDINKLYSGTVTFLLIAMVGVTLAVINAFFASHYVFRWRTAMNEYYTEHWAKLRHIEGASQRVQEDTMRFASVLEDLGVNFIKAIMVLIAFLPILFELSKQVKVLPIVGEIDHSLVWAAIVWAIFGTVLLMVVGIKLPGLQFNNQKVEAAYRKELVYGEDYEERAQPKTLKELFSKVRFNYFRLYLHYSYFNLVSIWYLQLDILYSLVVLFPSIAAGKMTLGLITQISNVFDKVRESFQYLITSWKTIIELLSIYKRLRTFEDTLN

SEQ ID NO: 5203 - protein, 250 aa, Acinetobacter baumannii
LGKQNKFLSRILLGNMNTSIKNWPEQERPRERLLQQGPQSLSDSELLAIFLRSGSRQHSAVELARLLIQQFGSLNAVFDASYNELAQFNGIGATKYSQLLAVKELGRRYLDYHFSQTELSLHSSHLVLDYLRYELKGEKQEVFAVLCLDAELRKLHFKKLFFGSVQHCAVSVNQTLRYALQQHACQLVIAHNHPFGSPQPSLEDIKLTQQLEQACQLVEIRLLDHFIISPEGSFSFAEQQLLNPTSIAVQ

SEQ ID NO: 5204 - protein, 123 aa, Acinetobacter baumannii
NKEHKLMNQLFVYGTLCPNKANAHILEQIGGNWTKASVRGVIHILDWGPDKGLKALELDPEADWVEGYLFSTEKLAENWQMLDDFEGFQYQRVTADIKLESGEYVKAWTYQINMQAKASHNYK

SEQ ID NO: 5205 - protein, 427 aa, Acinetobacter baumannii
APLQQKGILFVSFDLSVIPHKNIVLAVTGGIAAYKSAILVRRLKDYGFDVRVVMTHGAQAFITPLTFQALSGNPVHTELLDPEAEAGMGHIELARWADLLLVAPASCDTLAKFANGLADDLLSTLFLATKAPVWVAPAMNQQMWAAKATQRNLQTLVEDGVHVIMPDAGEQACGDVGLGRMPEPEEIARQVAGYFHQAQRAIAEKFGLLAGKRVVITAGPTREAIDPVRYISNHSTGKMGFALAAACYAAGAKVTLIAGPVSLDTPNGVQRINVASARQMLDVSMESLETGCDIFIATAAVADYRVAEVAEHKIKKAGDELNVSLVKNPDIVATIAAQEKRPFMVGFAAETQNVEEYAAGKLVAKKLDMIACNDVSRADIGFASDENAMTVFFAESYHMKKRELEKASKQEISQQLVEAISDALRRK

SEQ ID NO: 5206 - protein, 122 aa, Acinetobacter baumannii
WKLQKQQARFHMPFEWINQNYGVKAEIGLCVNVDGKPGIIAKDCGNYLGVNFDEDKPGVIRNCHPTWKVEYLGMGKIRQMTAGQKRYQEFLNADWFDGNFAQWLGVDKESRDRREFAKRYGY

SEQ ID NO: 5207 - protein, 411 aa, Acinetobacter baumannii
MIQQQVKNEFPTLEDIHAAAERLDGLVVKTPFVFSETISKTLGAKMWLKFENLQFTASFKERGALNKLLSLSEQEKQHGVIAASAGNHAQGVAYHAQRTGVTATIVMPKSTPNVKVQRVREYGARVILHGQDFSEAAAEMHRVAQEESLTIIHPFDDAEIIAGQGTIALEMLEAVPDLDILVVPIGGGGLISGIAIAAKTINPKIKIIGVQSVVYPSMAKLLCNYQLAVSMGSTVAEGIAVKTPGELTTQIAKHFVDDIVVVTEDMIEEAIALLLNIEKTVCEGAGATGIAAIMSRPDLFLGHKVGVVLSGGNIDTRVMVSVLQRHLTRTGRMVRIRVELPDNPGALARLTAIIAEQGGNIYELRHARFAATSRAKESAVSVDIELKSAPDLEPLIQAMQLEGYIVRKEEI

SEQ ID NO: 5208 - protein, 818 aa, Acinetobacter baumannii
VFWHIFPIKMMIDKRWFMNQPSSRSGLTTFTVIIIGLLALFLLIGGIWLATLGGSIYYIVAGVLLLIVAWQLYKRASAALWVYAALMLGTIIWSVWEVGTDFWALAPRLDILGILGLWLLVPAVTRGINNLGSSKVALSSTLAIAIVLMVYSIFNDPQEINGEIKTPQPETAQAVPGVAESDWPAYGRTQAGERYSPLKQINDQNVKDLKVAWTFRTGDFKTDNDSGETTNQVTPIKIGNNMFICTAHQQLIAIDPATGKEKWRFDPKLKTDKSFQHLTCRGVMYYDANNTTEFATSLQTKKSTSTQCPRKVFVPVNDGRLVAVNADTGKACTDFGQNGEVNLQEFMPYAYPGGYNPTSPGVVTGSTVVIAGSVTDNYSNKEPSGVIRGYDVNTGKLLWVFDTGAADPNAMPGEGTTFVHNSPNAWAPLAYDAKLDIVYVPTGVGTPDIWGGDRTELKERYANSMLAINASTGKLIWNFQTTHHDLWDMDVPSQPSLADIKDKSGKTVPAIYVLTKTGNAFVLDRRNGQPIVPVTEKPVPQTVKRGPQTKGEHYSKTQPFSDLNLAPQDKLTDKDMWGATMLDQLMCRVSFKRLNYDGIYTPPSENGTLVFPGNLGVFEWGGMSVNPDRQVAVMNPIGLPFVSRLIPADPNRAQTAKGAGTEQGVQPMYGVPYGVEISAFLSPLGLPCKQPAWGYVAGVDLKTHEVVWKKRIGTIRDSLPNLFQLPAVKIGVPGLGGSISTAGNVMFVGATQDNYIRAFNVTNGEKLWEARLPAGGQATPMTYEINGKQYVVIMAGGHGSFGTKMGDYLVAYALPDNK

SEQ ID NO: 5209 - protein, 89 aa, Acinetobacter baumannii
VGFLVSFMTTPHEAFTNAVTFAGSISALARKIGVTPWAASKWNPEKIPEDRCLKIEEITQGQVKAEQLRPDINWEYVRKNLKKQNQSVS

SEQ ID NO: 5210 - protein, 142 aa, Acinetobacter baumannii
LSLNLALDQDKKEYSMKKPIVLVLSTLMLGMSATAMADSNHRWDNYHGKDHNRYEQRHDYRYDHRNDHRAPVWSHSERGNHYGRYVAFKRGDRIPVEYRNSRYYVSDWRAHRLYAPPRGYHWVKTPNQYLLVDSKHHIYRVR

SEQ ID NO: 5211 - protein, 106 aa, Acinetobacter baumannii
ESLNFLEEDNMQTAIVRHILVKDKDLAEQLKKKLQSGADFAKLAKQYSTCNSAKRGGELGEVKKGQLVPVIDKVVFTAAERVLQGPIKSQFGYHLLEVKFRMTGLR

SEQ ID NO: 5212 - protein, 208 aa, Acinetobacter baumannii
YGINYHTLKMKEMNKFLLKVLMSLACFSAFNCIAVAASEFDIADIFNSDGTPKEGSINGVKFISAKENGLLTLALFDSESIPNKSGDNYWFLSCNSYKDNYNMNAVICGAQRGEFKILLGSLGYIIEMENKPRGGGRYIVAFDKEPSFEATYRIVDKVEVKKFLAKMIDSKKMQYSYKNEKNKYISNERKIQNTGLTISLLKDMRDYY

SEQ ID NO: 5213 - protein, 193 aa, Acinetobacter baumannii
NMSKKILMLVGDYAEDYETMVPFQFLTGLGYTVHAVCPNKKNGEHIATAIHDFEGEQTYSEKRGHNFAINYDFDAVNTEDYVGLVIPGGRAPEYLRMNERIIEIVREFDRVKKPIAAVCHGAQLLAAADVLKDRLCSAYPACAAEVKLAGGQYADIAVTDAVTDGHLVTAPAWPAHPAWLAQFVKVLGAKISI

SEQ ID NO: 5214 - protein, 493 aa, Acinetobacter baumannii
KFYNALSLCMSEELLINVTPMECRVALIENGTVNELYVERTVKRGLVGNIYKGKVVRVLPGMQAAFVDIGLSRTAFLHINDMVWPRSQPTPNVFELLHPGQILTVQVMKDMLGTKGARLSTDLSIPSRYLVLMPYGNHIGVSQRIESEEERDRLRNIIESIQAEHNLPGSVIVRTAAEGVDEAEIAQDMCYLSKLWEYIQRKQVDVAVPSLIFEELPLPQRIIRDLASEETAKIYVDSREIHGKLREFVDEFVPNMQSRLIHYPGERPLFDLYNVEEDIQKALQTRVALKSGGYLMIDQTEAMTTIDVNTGSYVGGRSLEDTVFKTNMEATQVIARQLRLRNLGGIIIIDFIDMQEAIHREEVMRQFEKMLERDHAKTKITQVSELGLVEMTRKRTRESLEHLLCESCPTCQGRGFVKTAETVCYEIFREILRYTRAFESTSGFTVVAHPSVIDRLLTAEAPAVADLEHFINRVIKFQVENLYTQEQYDIILS

SEQ ID NO: 5215 - protein, 218 aa, Acinetobacter baumannii
SKNKLMSKSVLETYDPKEELFNAYSHGAGVVMAVVASVFLIIKGSYLSTAQWIGLWVYAFSLILVFTSSTLYHFAQTQNLRYWYKKLDHTAIYYLIAGTYTPFLSIAIPTQKAHILLIALWSIAAIGTLFKLVFIHRFQKISLLAYVLMGWLAVFVMDDMRTYLSKDTLMLLITGGLAYTVGALFYALKKVRYTHAIWHIFVLLGAGAHFLAIYWYVV

SEQ ID NO: 5216 - protein, 256 aa, Acinetobacter baumannii
VMNKIPCSVYIVTLNCGAWLERTLQSVSEFDEVIILDSGSTDNTYEIAKRFENTEISHQDWQGYAGQKSLALAKCRNDWVLNLDGDEVLSNELKQEIVETIQQNRLDALITPINDVFLGVPNSKHTKKHAKVRFFRRSKGHYDLANKVHENVIVDGKTQRAQHDIYHYGESSIFVKVEKNNQYSNLKALEKYQKGKSPSIAKLVLVMPVTFMKSYFIRRSFLNGWRGFVNSMINAFYAFLKEAKLFEQTMNKDKNK

SEQ ID NO: 5217 - protein, 186 aa, Acinetobacter baumannii
LCDKKNRLFIGARPMSRHLYAIARRKFSHLSRSICVAATVLGATQIAMAGPTVDQLSDCLVKATTASDKTTVLQWTFTALAAHPDLKAFSNVTPEQKDQLDQKLAQVLQRIIVEQCSAQTKAVIQAEGVKAVGEAFQQLGQSAGEDIVKDPAVKQQLQGTLRYIDLNKLVTTFLTPEIWNKLGITR

SEQ ID NO: 5218 - protein, 114 aa, Acinetobacter baumannii
GKGKNTSGPWFNWNLKQNFISEFKNIDYKKHMSSIRVPIYSISGTGDKFIAPVKGCYKYLKAFKNQDNVFREFGCSNNNLENYSHSRIVLSQNAAKEVWPTILQWIDKNSKEVL

SEQ ID NO: 5219 - protein, 379 aa, Acinetobacter baumannii
YWGKNISGANKFRLSLNNNCYLWRISMKLSRIALATMLVAAPLAAANAGVTVTPLLLGYTFQDTQHNNGGKDGELTNGPELQDDLFVGAALGIELTPWLGFEAEYNQVKGDVDGLAAGAEYKQKQINGNFYVTSDLITKNYDSKIKPYVLLGAGHYKYEIPDLSYHNDEEGTLGNAGVGAFWRLNDALSLRTEARGTYNFDEKFWNYTALAGLNVVLGGHLKPAAPVVEVAPVEPTPVAPQPQELTEDLNMELRVFFDTNKSNIKDQYKPEIAKVAEKLSEYPNATARIEGHTDNTGPRKLNERLSLARANSVKSALVNEYNVDASRLSTQGFAWDQPIADNKTKEGRAMNRRVFATITGSRTVVVQPGQEAAAPAAAQ

SEQ ID NO: 5220 - protein, 511 aa, Acinetobacter baumannii
ITFNQLTHLPYFECKEILLMTDLHRLSIRELAEGLSQAKFSSRELTEHYLKRIAKIDPQVKSYVTVTPEQALREADAADAALKAGNATALTGIPLAHKDIFCTKGIKTTAGSKMLDNFISPYDATVVEKTKAAGLVTLGKVNMDEFAMGSTSESSYVGATSNPWALDHVPGGSSGGSAAAVAADLAPFATGTDTGGSIRQPASFCGLTGLKPTYGRVSRFGIIAYASSLDQAGPMARSAEDCAYLMNVIAGHDAKDSTSVKKEVDDYVANLNNTSVKGLRIGIPKQYFNVAGLDADVKARVEESLKKLEEMGAALVEIDLNMTEAYVPTYYLIAPAEASSNLSRYDGVRYGYRCENPADLMDLYKRSRSEGFGPEVQRRILIGTYALSAGYYDAYYVKAQKVRRLIQQDFLKAFENVDVIAAPAAPTTAYKIGASLDPVEMYLGDIYTIAVNLAGLPAINAPVGFDKDNLPVGLQLIGNYWSESQLLSIVHQYQQNTDWHTKRAAIAEENA

SEQ ID NO: 5221 - protein, 93 aa, Acinetobacter baumannii
RKIKMTIFEALALKVLISIALGLAIGVWILGGYIKNGTKAEQEFLKRHGIGSHLIWQRKWESDFLYGNKSNDNSVPEAIIEATENRRGENDQA

SEQ ID NO: 5222 - protein, 465 aa, Acinetobacter baumannii
NSANLRNCGVFTPMSNQPSQDRLDLVYGLDDRPKPFVAFLAAFQHLLAIIVPIVTPGLLICLALGVPRNETNMILSMSLVISGIATFLQCKKVGPFGAGLLIVQGTSFNFIGPIIGIGSAMVAAGTPVNQVMAAIFGVVIAGSFIEMGVSQILPWVKKLITPLVTGIVVLLIGLTLIKEGLISMGGGYQAMQDHTFASADNLIMSCTVLAIIIVLNRIRIVWIKSSAILIALVIGYILAGFMGYLDFSGLKDAPVIQIPTPMHFGLSFSWGLFIPMAFIYLVTSLEAIGDVTATSKLSNQPVDGPQWMQRIKGGVLVNGANSLLAGLFNTFPSSVFAQNNGVIQLTGVASRYVGIWIAALLILLGLFPAVAGVIQAVPQAVLGGAVMVMFGAVAASGINILSSIHLDRRALLIIAISLALGLGVAQVPQILEHLPELFKNIFSSGVATGGIAALILNVVLPETHK

SEQ ID NO: 5223 - protein, 316 aa, Acinetobacter baumannii
FYNNLECSMNLADRDGFIWQDGQLIDWRDAKIHVLTHTLHYSMGVFEGVRAYETPKGTAIFRLQDHTKRLLNSAKIYQMKVPYDQAALEQAQIDVVRENKLASCYLRPLIWIGSEKLGIAATNNTIHAAVAAWAWGAYLGDEAMAKGIRVKTSSFTHHHPNVTMCKAKASGNYTLSILAHQEVAHSGYDEAMLMDPQGYVCQGSGENVFLIKDGVLHTPDIAGGALDGITRQTVMTIAKDLGYEVVERRITRDEFYIADEAFFTGTAAEVTPIREYDDRQIGAGCRGPITTEIQKTFFDAVQGKNPKYEHWLTYVK

SEQ ID NO: 5224 - protein, 423 aa, Acinetobacter baumannii
KTNNSLNDLCKESNVDQQNNVIDYTQFPDANGHFGIHGGRFVSETLMAALEDLENLYSRMKNDEQFLAEFDRDLAYYVGRPSPLYYAERWSKELGGAQIYLKREDLNHTGSHKVNNTIGQALLAKLSGKKRIIAETGAGQHGVATATIAARLGLECVVYMGAEDVKRQAMNVYRMRLLGATVVPVQSGSKTLKDAMNEAMRDWVTNVDTTYYVIGTVAGPHPYPQLVRDFQSIIGREARKQILEQAGRLPDALVACVGGGSNAMGLFYPFLNDANVKMYGVEAAGFGIETGKHSAPLNAGHVGVLHGNRTYLMSDEQGQIIETHSISAGLDYPGVGPEHSFLKDMKRVEYVPINDTEALQGFRDLTKIEGIIPALESSHAMAYVSKLAPTMSKDQIIIATVSGRGDKDLMTVARIDGVEMVEM

SEQ ID NO: 5225 - protein, 664 aa, Acinetobacter baumannii
ARNNQYLSQIEHKNMAALYHSLFTEKGLELLRESIQNGTKLGITHMSFGDGGGDLPIPDASFTQMINEVYRVQLNRLAPSRDNPNWLEADGVIPSAVGGFNIREVGLWAEDVMVAYANYPPTYKPSGDQGTAQIKTIRIVLQIDNTANFELKIDASVVMATLQSVEEAKLEAMNHADSLVKEQIRYVDNLNSLNDIENPQDKQIVYVTGMGEFEYSLTLMTWAPKQRSDNTILTAEGRFQRDKNKDYLDLKDYIFLAEGKDWTKAIKQAETDAFNLKMGLKIPSGIFGYSEDITFRCHTFGQGISNTWLQKLKPCSVIILGGSLRDLTVSPEGYLDNDQSDGIIADNSDRKLILNVLTEYHGGNGFVFKKGNLSRFIIRSRYNKGKGVLFTPDAPGDNKAAQLWLECTGNKRSGFFMDHSLVNPSYNSGNHFGTIISQGNGADLVNDDKYDVVLSGNYNNLTIYTEYGAGCWHKDTLKGSRIFYTNMSHINWKDEAGDSNEVSYIPSANGTRVIKYGKFQNVVVQNENGQYSGKLTFTHTANNKFEYILGNSTADQNIYYPDKLFLRKGKGTFQPIFPRDNVVLNFGTIPAGRSVEKSLSLLQLGLSSANNTVVVNPVGNIGAGLLWSCYIDSNDLDRVVIRLFNSNSIDVTTADFPWKVSVFL

SEQ ID NO: 5226 - protein, 69 aa, Acinetobacter baumannii
QKDKQMKILAATYSHTQNNVKEHSPVYDLDAYEKRQRQFKRKKLLKNLFDTAIFASAAGFTFSMLFWGA

SEQ ID NO: 5227 - protein, 501 aa, Acinetobacter baumannii
HISKNVSGPSMNEQLNATLMSWVQFFNEPLWDFLVIFLLAVGIFYTVLTGAVQIRMFLQSIRVMKSSRTEGEDEHGLTPFQAFVTGLASRVGVGNIAGVAIAIAIGGPGAVFWMWVTAVLGMSSAFIESTLAQLFKVRDSNSKQFRGGPAYYITQGLRSKTFGVIFALALIFTYGFVFNSVQINAIANASSHAWGWDKANLIAHLGGVDLEISWVGLALVVMVALAIFGGIKRIAKFAEMFVPLKAGLYLSVALYIALSNYAILPDVLKLIVTEAFHFNAAAGGFFGAAVSMAMMQGIKRGLFSNEAGMGSAPNAAAASDVKHPVNQGLVQMLGVFVDTFIVCTSTAIIILVSGVYQDAGFVGVELTQRALETQVGHWGADFLAVLLFLFCYSAVLGNYAYAESNVQFINNNPKVMFIFRIFVLVMVYFGAIGSVPLVWSMADLFMGIMATINLVAILLLTPMARTLLKDYRAQLKQGIKEPVFKINKYPELKKKVDSDIW

SEQ ID NO: 5228 - protein, 148 aa, Acinetobacter baumannii
RRSNHMPIAKLKREKRKDPLWGIILSIIVGSVLMIYPLSYDISGWRPLFMLMIMLFWVVCQPTWCGVWFAFGMGIFTDLLLDAPLGLNALSFVIVTFITRFLIRERRILTFGNLWTIATLVIIAHLAFMWGLKRWGAFIFRLLDIGNH

SEQ ID NO: 5229 - protein, 715 aa, Acinetobacter baumannii
GYIKMSAIQYEKNADNIVILTLDSTGQSANTMNAEFRDSLDEVTQKLKAETELSGVIFRSAKKTFFAGGDLDELIQVQPEHATDFFNMVEKLKGHLRTIETLGVPVVAALNGTALGGGWEIALSCHHRIAINDPKSKFGLPEVTLGLLPGGGGIVRMVRLLGLQNAFPFLMEGKQFGVDKAKSLGLIHDTAENEQELLDKAIAWIKANPKSQQPFDVKGYKIPGGDPKTPAVAQVLAIAPAMLKDKTKGCYPAPEAIMAAAVEGAQVDVDTALRIESRYFTQLATGQISKNMIGTFWHGLNAIKSGASRPADIAKWQATKVGVLGAGMMGAGIAYATAIKGIPVILKDVSVENAEKGKAYSQKLLDKRVSQGRMTAEKRDQILSLITATASAEDLQGCDLIIEAVFENQELKAKVTQEAEQYLAPNGVMASNTSTLPITGLAQASKNDKAFIGLHFFSPVDKMQLVEIIKGKNTSAETLAKAYDFVQQIGKTPIVVNDSRGFFTSRVFGTFIQEGMRLLAEGVHPARIEMAALKAGMPVGPLAIQDEVSLTLTEHVANETRKALQAEGKELPKTPVDEVIHTMIHELNRKGKAAGAGFYDYPENGKKHLWEGLNRWQKDHDISEQDMIDRILFVQALDTLRCYEEGVLESVIDANVGSIFGIGYAPWTGGAIQFLNQYGIDKAQKRAEELAAKYGERFTPPTLLKTKAEQKQNIQ

SEQ ID NO: 5230 - protein, 353 aa, Acinetobacter baumannii
IKIKISRQAMKIVQVLATSGGVGGLEQHTFNLVNELALNHEVHVIAHPCYVDKFSQQVHFHAIDFARSRWNIFLLWQLKNLIQQIQPAIVHAQAGKAAELIARIKPFLSGPKFVTTVHGTKKNKSAYLAGDAVIAVSQALTQGIPESKAHVVYNGVYPQPVLTTENKEKLLQSIQKDFTELDTSKKVVMCIGRLESVKNISLLIESMQQIDANLWIVGDGSLRASLEKQVSELNMQNRVAFLGFRTDARDLVQLADIVVLSSDREGFPLVMVEALQADKAMASTKVNGVIEWLPEQYLAEIGDTQGLAKAIEYALQPEAQNDFGPLYAKAKAELTVPAMAEQTLNIYKGLLKT

SEQ ID NO: 5231 - protein, 151 aa, Acinetobacter baumannii
YGVNKMMMALGLFVFSLRTAAYQELQRVTSWRHPSNSRVGSTPAYQFTGKGEDTITLKGEIYHELTNNRIVLDQVRRMADTGMAYTLIEGTGKIYGLVIIENMEETKTYFFKDGAARKTEFTLTLKIVKEWKPTLIGTLLGMAGGVANRLI

SEQ ID NO: 5232 - protein, 882 aa, Acinetobacter baumannii
DEVKMDFLADDELTLNQEDPRFKPKSERGGISDGALGVVSGVAMGTIEAATAPDALIRGDKKAAALRAQNLEIFKPDDLGGVGEFTYGLTKDFTRIGWNAVTTLGTGGVPGLALNSGLFGYQTFEAEKSDLLNKGADIKTARTGGAIKGITDALGFAIPTHGVAKSVVADAVATTTLATGAGVAGDYLEGSFLENNENKKVAQYGEALKENALSPSTLASNGGMALLLNLWANKGRLRPEQVKEHGNVDTMNDAAHVQANLEHAEGMNPFNPENAKEANSHFDALDSAMESALNDELVSLRAPVSGTPKAIVTSTPVVPITGTPKAIVRPSAINTDEHKAPVIAELLTNPVFDKKPWTKTIVQEASKRGINPVDALVISHLETGGTFDPKIQPPIDKKTGKPISSATGLFQTLDGTFARMGGKNKFDGNDQIKAGLNYYEHNAKVFRTHFNRDPNGLELYYLHFFGEGGGPAFLKAKDNELFVDVATRWSKGNQKKTARQIAEGITSSHQFNGMTVGQVKAKYEKRWNEIASLYSDVSPDASVRSTEVRGSESEFPQFESDITAPPAYKSQSDAEIEAMPFVLSADEHSVKSLQEEFEALSSPLTKEDLEYLKATAHYQYSEGGAYRTPYVEPQVDLSGPGNSANRNLDTLDSDLYQLEPEQQRVILPGPESNTLDINTRTSDSNIQQNSIIAGVDNWTPTRSQNYLKRERSMDDGGVIQELHNSTSNTTFQRQVNQDGTISPVKATRNGNDLFAHPANGKADSPELTAVQHKATQALEREFWKPGKSKVDGAPDLTKSSKGEYGAFTDTADGREAVSILEADPDMEVTFTRLDENGDEEIVTMSSRDLLDYVKEQEEIAKDEIQAVKALASCALRFGSEAA

SEQ ID NO: 5233 - protein, 263 aa, Acinetobacter baumannii
MTPKNLLKVESNILPKIELVQLKIDSKILPTVEKKPILMEDAKYKDFADRLNALMKAKDSPIKTINELKKAIGVSYEMARRYTLGTAKPRIEKLQTLADIFGVEISYLDHGTKLDNNIDLSDKVGFEGRRVPVISWVAAGSFTPIETVLKDTEIEEYLPPNRRCGKNGYALKVVGYSMAPTFLPGDRIYVNPDIQTFDLKTDDLVIVACAGDSEATFKKLIIEGEGTSKFLEPLNPDWPDKIIKLSEDCRLVGKVVGLYRDIY

SEQ ID NO: 5234 - protein, 71 aa, Acinetobacter baumannii
KKPKHVKNKAWRKILMNHDEELVQFCRCRNKHLVKDRLRQPNKSTYGLMDLVCPRCKAQSYYKVNEVKKNV

SEQ ID NO: 5235 - protein, 173 aa, Acinetobacter baumannii
PNTNILMFCFWLRSPPLTKPRIKMSGLIANGTFSNQDVVINSDPFFPSVSSNHVREVLRLDSSVTNQRLISAIEAAVIHVNEQLESLLSKAPTLVEITTKQVNGKPIAAVLYFRAVAAAAGAELCERYRSYDTTNNGSQKAEELTPTIDDYKRDLRFAIRDIKKVRRLNVELF

SEQ ID NO: 5236 - protein, 303 aa, Acinetobacter baumannii
PVKNKAMQQNDLTKSLVEAFLYLAPQEGLYPTHISNITLMRVDHSTQPVAVLQEPSIVLVIQGVKRAYIGKDIFKFQQGQCLFISIAIPFDCDTLVEREPMLAIAIKFEPQMMAELATKMDKEQRPLIEDLDNKEIKLSCGLNIIEMNSVISDVALRLLNLLRSKQDTAILGEQVKRELIYRVLQAGGGDFIQNLSAIMSRSGVIYTICEIIQRDYYRNLTVQELAKQAGMSVSLFHQAFKKVTNYSPLQYIKITRLHKARDLILNNQMGVAEAAYEVGYVSASQFSREFKRLFGVPPKLSTN

SEQ ID NO: 5237 - protein, 200 aa, Acinetobacter baumannii
KAKKFILGAIFAVFFLNMQLSDFSFELPDELIARYPLETRSASRLLHLDAKGQYHDHMFTDIIDLFEEGDLLVLNDTKVMKARLKGKRATGGAIEILVERMLNHTTAYCHIKASNSPKAGAELFVGADNIPVIVRGRHENLFVVEFSQPILPVLEQYGQLPIPPYFNREAEEIDTERYQTVFHNPEKIASVAAPNSKLAF

SEQ ID NO: 5238 - protein, 359 aa, Acinetobacter baumannii
RHEKMKNILSICCLAVINSYSFAQDIKGISFSHQEWEISCSNTGTCKAAGYQNEENGDNPASILLTRKAGPKQPVQIEFALSDYEQSIPANQLKNIHFYINGKDLGAVGVDGTELPIMGKLNSSQVNALLQQSKQKTEIVFKNAQHKWKISDAGMTAVLLKMDDFQKRIGTIGALVKKGSANENQVLMPEPKLDVKRIKTSTKPYLTLQPKNKQYQAIHRSLIAAKPNPKEDGFCEGIYGGNSDGAEPQKIELYKLTNKKVLATTLCWRGAYNEGYGAWVLDESLNGKPAFVTESASDFDSGIISSAQKGRGIGDCWASEEWVWDGKSFVHTKDMWTGMCKGLAAGGVWELDRIESVVK

SEQ ID NO: 5239 - protein, 228 aa, Acinetobacter baumannii
SKRKNMKTKLATLMLSLAFFGSAHADVKTLEQNLKKNYPDLPVKGVYQSPVAGIYEVYTSGRIVYTNQDAKYFFVGNLVDIKQQKNMTEERIAELGKIDVKSLPLNQAIKYVKGKGERTLYIFSDPDCPYCQRLEQNMVGVDNVTVYIFLYPLTSLHPNAEKVSNQIWCSKNPSEAWTNYMLNRKLPAASKSCTSPIQKNIALGPEIKYRWHTNSVLTRWSKNLWRTK

SEQ ID NO: 5240 - protein, 300 aa, Acinetobacter baumannii
VSMNQEVKSGKVLSPSTPWTQRPVPGIEVADEQQTLKATFTEPTIECPECHALVTRTAISFNAYVCPQCDEHLRMKARDRLNWFFDNVVAELGQEFSAKDPLKFVDSKPYPDRMREAQTKTGETEALIAMQGNLNGVDMIACAFEFDFMGGSMGTVVGDRFVKAAELAIEKRQPLICFAASGGARMQEGMLSLMQMARTSAAIQKLKDAGLPYIVVLTHPVYGGVTASLAMLGDIHIAEPKAMIGFAGKRVIEQTVRETLEEPFQRAEYLLDHGVVDQIVHRHALRDTVSRLVSKLMNLP

SEQ ID NO: 5241 - protein, 151 aa, Acinetobacter baumannii
KPMNNIQDLALYLQPLLDRLSPGERAKLAKNIGRDLRTSQRQRITAQQNPDGSSYTARRTRLRDQKGKIKRKMFSRIKSNTHLKVLSNSESIAVGFIGRINRIAKVHQYGLRDRATRSAPDTVYPKRELLGFTDKEINLVESSFIKHINIK

SEQ ID NO: 5242 - protein, 71 aa, Acinetobacter baumannii
MIMKINIISKIHIIYSIFGYTSLQDLHHIYIIRPCLKSFYFKFIGFWVLVLASSYPLWVLQAQFILMISKF

SEQ ID NO: 5243 - protein, 276 aa, Acinetobacter baumannii
KEMKKLLIASLIAISSSSIFAADTTISAAKNDVFKQAEQLYAAKNYPAAFQEVQRLAQTGNAQAIYNLGYMTQMGQGTAKDNAKALKYYEDASNKGYAQASYTLAQIYETGELGVAKDSNKFSQYIQKAAAQGSDDATVKIATILFAQKKPQSHQIALQKLAPLIRKGNYPAIQVKALYDISQGVENKNPLMKRQGIEALQTIAQKGYAPASMALATMMANGNIIPQNLPQAKQIFTELAKQNVPNARESLASVEKIIAEKNKQAAAAPTQPAPKK

SEQ ID NO: 5244 - protein, 925 aa, Acinetobacter baumannii
TTEKKFIHLTKQDLESLSMLASLIGGIFGTKNERELKRMRKIVEQINALEPTISALSDADLSAKTPEFKQRYNNGESLDKLLPEAFAVCREAAKRVMGMRHYDVQLIGGITLHEGKIAEMRTGEGKTLMGTLACYLNALSGEGVHVITVNDYLAQRDAELNRPLFEFLGLSIGTIYSMQEPAEKAAAYLADITYGTNNEFGFDYLRDNMVFSLAEKKQRGLHYAIIDEVDSILIDEARTPLIISGQSEDSSHLYTAINTIPPKLRPQKEEKVADGGHFWIDEKQRSVEMTEIGYETVEQELIQMGLLAEGESLYSATNLNLVHHVSAAIRAHFLFQRDVHYIIHDGEVVIVDEHTGRTMPGRRWSEGLHQAVEAKEGLAIQPENQTLATTTFQNYFRLYKKLSGMTGTADTEAAEMKEIYGLDVVIIPTHRPMIRNDQNDLIYLNRNGKYNAIIQEIMNIRQQGVAPILIGTATIEASEILSSKLKQAGIHHEVLNAKQHEREADIIAQAGSPNAVTIATNMAGRGTDIILGGNWKAKLAKLENPTPEDEARLKAQWEQDHEDVLQAGGLHIIGSERHESRRIDNQLRGRAGRQGDPGVSRFYLSLEDDLMRIFAGDRVVAMMRAMGLKEDEAIEHKMVSRSIENAQRKVEARNFDIRKNLLKYDDVNNEQRKIIYSQRDEILAENTLQEYVEEMHREVMQAMIANFIPPESIHDQWDVEGLENALRIDLGIELPVQEWLEQDRRLDEEGLVERISDEVIARYRQRRAQMGDESAAMLERHFVLNSLDRHWKDHLAAMDYLRQGIHLRGYAQKNPEQEYKKEAFNLFVNMLGVIKTDVVTDLSRVHIPTPEELAEMEAQQQQQAEAMKLSFEHDDVDGLTGEVTASQEALNESATEQQTFPVPESRNAPCPCGSGLKYKQCHGKI

SEQ ID NO: 5245 - protein, 154 aa, Acinetobacter baumannii
NKEKTMATGTVKLHRVFKAPAERVYRAFLDPDALVKWMAPHGFTAKVHSFDAKVGGSYKMSFTNFSTGSTHSFGGTYVELVPNELIRYNDQFDDANLPGTMQVTITLKTVLVGTEIHITQEGIPEVIPVEACYLGWQESLSLLKLLVEADIPDQ

SEQ ID NO: 5246 - protein, 222 aa, Acinetobacter baumannii
VTYLSFLGNFMNKRMKYAFYRNCLSVSIGIASCGALFFSSPTLAANAAPKAVWYRYYDQHGIANISTSVTPAHIRYGYEALDQNMQVIKRNHPYNSEADLNQSSQRALSARYREEDNKLKRAYSNSKTATIKRDQALLAIKKQINYQQDQLSQLQQDKILFKRQEMEYFRKGEQVPERHKTLIENNLMNINKVKQTLEILSKTYNRTNKDYENIIERLKKLE

SEQ ID NO: 5247 - protein, 377 aa, Acinetobacter baumannii
MKFEKLGQSGRARRGRLTLEHGVVETPVFMPVGTYGTVKGMLPRDIEDIQAQIILGNTFHLYLRPGLEVIKQHGGLHDFIKWNKPILTDSGGFQVFSLGAMRKIKEEGVTFRSPIDGSKVFLSPEISMEIQHVLNSDIVMIFDECTPYPATHEEAQKSLQLSLRWAKRCKAHHHDELKNKNALFGIIQGGMYEDLRDESLNGLLEIGFDGYAIGGLSVGEPKEEMIKVLDYLPNKMPHDKPRYLMGVGKPEDIVEAVRRGVDMFDCVMPTRNARNGHYFVTDGLVRIRNSKYRHDQGPLDPHCDCYTCKNFTRAYLFHLEKCGEMLASMLGTIHNLRYYQRLTEGMRDALDNGTFDEFVQDFYARRGLEVPPCPVDE

SEQ ID NO: 5248 - protein, 189 aa, Acinetobacter baumannii
TMPDNISDRRSCVMKIQRLRKKNSIDIARKLPLKCLFIAISLVLAACQSTPQPNNHKGQVKPTHRVQTPVVKKKVSPDGIQDIDWQITQINGHKAKFFNQWPTLSLNSTVKTVTGHTGCNRVFGRYTFDFSQKKLDMEVNAGHSSCDGALAQEAELVDSLQRIKRFQLVGNTLYLLDQSGQRLIQAEKK

SEQ ID NO: 5249 - protein, 444 aa, Acinetobacter baumannii
ILTDIRTYMESTSATAAPVVATNSKTRVLFASLVGTTIEFFDFYIYATAAVIIFPHLFFPASSGSAAVLQSLATFAIAFIARPIGAALFGHLGDRIGRKATLVAALLTMGISTVCIGLLPTYAQIGIVAPLLLALCRLGQGLGLGGEWSGAVLLATENAPEGKRAWYGMFPQLGAPIGFILATGSFLLLSAAIPEQAFMQWGWRIPFIASAVLVIVGLYIRLKLHETPAFQKVLDKQKEVNIPFKEVVTKHTGKLILGTIAAICTFVVFYLTTVFALNWGTTKLGYARGEFLELQLFATLCFAAFIPLSAIFAEKFGRKATSIGVCIAAAIFGLFFSSMLESGNTPIVFLFLCTGLSIMGLTYGPIGTVLSEIFPTSVRYTGSALTFNLAGIFGASFAPLIATKLAETYGLYAVGYYLTAASLLSLIAFLLIRETKNVDVNNQI

SEQ ID NO: 5250 - protein, 166 aa, Acinetobacter baumannii
QSADFSLWFVSYFRSDLGVFGRMSMNNKQRWMGGVVLLGGGVLLAALLLKGNEEIKQVDVQPQTSTSPKLQAKPKQSAQEGQMVQLQPLAVDVETEKRLLEEQRRSREKAVAEQEARAAEFLAMQQQAQADAARKAAAEYAAINARRAAAQQSSDNIPPEIPGSEN

SEQ ID NO: 5251 - protein, 384 aa, Acinetobacter baumannii
QMADGASAKSLPKGVRIRSGAIQIYFERNKQAYNITLPHPPTAEGISAAAKIRSQLITKAEWGILTDKDIAEAKGETIDKKHLILNSNEVLFQEVAQKYLRQCEANLDSRKGYVRILNCHWMPHFALRPINQITNDEIRDLIIDKNFKTAKTLNNSLIPLRGVFETAMNSKLILDNPMHGIENKRIQQAIPDPFSRAEMNALLKWLDVNLEGTNRLYYWYYELAFWSGCRPSELFALRWNDIDWFNGTMRISKSRVRGYEKSVTKTHTVRDVYLNDRSTRALTEIQKLGLSRDYVMICPETGLPFYDERPPRFRLNEAMKACRIRHRPAYNARHTYATMMLMDGVNPVFVADQMGHSLQMLMKRYAKWMHGDKNKIEMAKLNTS

SEQ ID NO: 5252 - protein, 559 aa, Acinetobacter baumannii
SKNERVLLNVLRVPIALRLFLTVLLTTLLIATASLSVLHWTMQKNFAKYVADVEMQKLDRLITNLGNVYTVYHDWGNAIQAQILQIEGTAAPDDYDRLSQWWLRRQYDIAIQQHSFDEHTLINISPDAGTVNKNSIFSDEELRTLEQNLPSEYQPFEGLRFPLSANQFRPSDDKNKSKKGSLKDIETQNGKKRFIALPDRLGLSSRLSLYDAKHQFVVGEPPSSDQMSYRPIMVNSQVVGYLGLKPVLDKEDALSINFFSNQKRYLLLIYALTLLSSLVAALLMATYFKKPIQRLLNATNELTKGNYQHQVVIKRNDELGDLSTQLNHLAEILHQHEESRRQWVADTSHELKTPLAVLQAQIEAMQDGIRKATPEHLDAMMRQVSSLKKLTQDLGDLAQADAQQLKCYLSSVNPWEVILQEVENFRPKLEQAGLEIEVEGEGASLLLDRDRFKQIIVNLIGNSIRYTETGGKIHIHTSQTPQEWTLYVDDSPFGLSDEQLSRLGERFYRVDDSRTRSTGGTGLGLALSCKIAQALGGTLSFEHSPLGGLRCVLTFKKQS

SEQ ID NO: 5253 - protein, 255 aa, Acinetobacter baumannii
HLNEMKKYLISIESTNSERLKKLYSQATFYKYRDEFKQFGVIGKNLSVSEYFQQGVAGKKKPMTPGELGCAMSHIAALKDFLSSDEEYAIIFEDDVIERFEIDFQDLEKHIRSLNFGPCFFLSLGGIQMKICNRVRGKLLPEELYNQKILKVDYDYLEKLAYAYAYVVDRKMAQMLVDYHQPIKIYDHWQDLVGRGEFSFYVSFLFDHPIIENNDALSYLEKERSLVGSHSQDDSDFLRYLRVKLKKYILNKYII

SEQ ID NO: 5254 - protein, 104 aa, Acinetobacter baumannii
RYDDMPFFVLSCTDNEGTLEKRLAVRPQHIERLQKLDDEGRLVAAGAMPKDPNDPQAGFYGSTMIVEFDTREALDEWLKEEPFLKEGIYSHVDVKPFNKAFPKG

SEQ ID NO: 5255 - protein, 65 aa, Acinetobacter baumannii
SVCLTSRMSAVRSRQRPPSLYVKISSAAVVQLVRIPACHAGGRGFEPRPLRHLRLNIVYPTIAIL

SEQ ID NO: 5256 - protein, 211 aa, Acinetobacter baumannii
PTLEAFMEIVCLDLEGVLVPEIWINFAKKTGIKELEATTRDIPDYDVLMTQRLNILKQHGLGLKDIQEVIAEMGPLPGAKEFVEWVSNHFQLVILSDTFYEFAHPLMKQLGWPTIFCHKLETDENGMITAYKLRQPDQKRESVKALHGLNFRVIAAGDSYNDTTMLGEADHGFLFDAPANVIAEFPQFPAINGYDALKEAIRSVSQRNIPA

SEQ ID NO: 5257 - protein, 398 aa, Acinetobacter baumannii
EQSEITTMTDIVIVNGARTAMGGFQGSLSGLTAPELGAVTIKEAIARAGLQPTDVEEVIMGCVLPAGLKQGPARQAMRKAGLPDSTGAVTINKLCGSGMKAVMQAADMIKAGSAEIVVAGGMESMTNAPYVLPKARAGYRMGHGEIKDHMFFDGLEDAETGRLMGSFAQDMANTRGYTREQMDDFAIRSLKRAQTAITEGYFKDEIVPVTVSTRKGDVIVDQDEQPLNAKIDKIPSLKPAFAKDGTITAANASSISDGASALVLTSSEVAAQRGLQPLAKIIATASNSQHPSEFTIAPVGAIEKVLKKAGWNAQDVDLWEINEAFAMVTMCPIDDFKLDPEKVNIHGGACALGHPVGSTGSRIILTLIHALKRTGGKKGVAALCIGGGEATAVAIEIL

SEQ ID NO: 5258 - protein, 62 aa, Acinetobacter baumannii
ISGFFYSYISYTKSYLICNKRYILNLRFYNSNKSSVKGFLEKSMRHNELCVHYTLLILFFYH

SEQ ID NO: 5259 - protein, 283 aa, Acinetobacter baumannii
LKQLGKEGRVSIDATRWAWTAPVNNSSQRLVLLSLADRAGEDHTAWPSIDRLAKDTVLDKKTVQKVLIELINLDLVKDTGERTGPTKRVRILKLNGVKGRGESTQNRDISSAKKAIKSKPNQSENGNIQHSQKRNDSKNGNDPENGALNNPKNGMLNDPKNGMQNLSGNLPMNLSQEHKWIPDVDQLITKIKMAGHGNNIDLIFGLPSFEFELSAFNSYFDNSGLSDSKKLHKFTAWIVDKFDRYKKQNPEYGSQSPIGQQAITARPFINLPTKPKSLLGDAQ

SEQ ID NO: 5260 - protein, 60 aa, Acinetobacter baumannii
CLKLQTLFTGLLQTKKKQNNRSAFFITQIKFCRDTVYISNQNHMDMEHYDFQVQGTFVVQ

SEQ ID NO: 5261 - protein, 420 aa, Acinetobacter baumannii
LLFWDALGGRMKNFYTLEEVLSASDEPLSLLDIIDYCRRSMLHPCVYLDGNLVCIEETREHHSEDKRDYPEHVVEAKWHVPFQGYVFSQDLIEQLRSKNQTFNLLKIDQIISQYSEIPLNEPELNQSLHVYERRYDDDVKDFFWIRDMKDEEYKGIEYSKKEIVFHIEELKRINFNDPDKRKFDALRREYNHEEYKHLLFSKPSFSIHEAASIVSMNNPLFVEVYRDQPNFVKYFQHYLHSYNLISSWSEDGILGESEMIPAELLKETLKKNKILIQSFNAHLIIMEEGNLTVEHKRINEQNEEIERLRETIKNLNTQIEQLQSEQSLEPVKSYNLLDLILDSTDNERYAPDLAYAIQLWESVYVTNPKSGKHSNKANIWIKNNTPYSGDRDDTYTRRLRDITSPLIGWHDDRKKLLINN

SEQ ID NO: 5262 - protein, 74 aa, Acinetobacter baumannii
NMELVRPDHPIAHEAYETVKAMTCEYIKIVARTYSKTQTEAGYFISGIFPCTPDDGFNRKEWISTFEELQGVNK

SEQ ID NO: 5263 - protein, 92 aa, Acinetobacter baumannii
EGGCLMGLARFSAKLNYTSEYGCAYQETYKQSQDNPDAKKVFLDLVEHLAWMGAVGGQASEVVEAFNKGHKQGLERRKELDKQEAVSNEDVK

SEQ ID NO: 5264 - protein, 198 aa, Acinetobacter baumannii
RVVCNISENTMSDILPLSWFQRETSEVAYDLIGCVLCKRQPDGQVIRCTISETEAYLGVRDKACHSYNDKRTARTEVMYRHGGSIYVYLIYGMYEMLNIITQTEGVPEGVMIRSAFLNSASTKKEYKLLAGPGKLTRYLGIDRTLKGQTLGEESGLWIEAATIQPEVVLTPRIGIDYAEEAKDWPERYCWKDHPSLSR

SEQ ID NO: 5265 - protein, 154 aa, Acinetobacter baumannii
KQQWTITMQLNHYLNFQSQAEQAFNFYKSVFGGEFAMLSRYSDMPPHDGVTLSEAQKNLVLHVSLPINEYTVLMASDVIDQFCTPNSVFTQGNNHYIAINLEKDEQEKAKQLFDALSVNGKIEMPLEKTFWGALYGAFTDQFGVKWMVNCQLDT

SEQ ID NO: 5266 - protein, 233 aa, Acinetobacter baumannii
KEKWPMKHIMLVEDEVELAHLVRDYLEAAGFEVSMFHDGQDAYTSFQQRKPNLMILDLMVPRMDGLTICRKVREQSDLPIIMVTARTEEIDRVLGLNMGADDYVCKPFSPKELVARVQAVLRRLERKAEPEQNDSFRIDKAQQRIWYQQKSLSLTPTEFRLLELFLEHVGQVYSRAQLLDHINPDSFDVADRVIDSHIKNLRRKITEVAETGNRHEWIQAVYGVGYRFEYPEE

SEQ ID NO: 5267 - protein, 143 aa, Acinetobacter baumannii
EGEWMYKVIAGSWTQFEEAAKYIREQVFIQEQGIAPKDEWDDFDSTAVHFMVYDKEQPIATARLLPQHSVGRVAVLMLYRKQGIGKILMQHIIEYARQHQLPYLKLSAQTYVTAFYEALGFKVQGEVYQDCGIPHIDMTLALS

SEQ ID NO: 5268 - protein, 213 aa, Acinetobacter baumannii
LQFRGNVLTDIIPFFMFRIYIMGHRLSKIYTRTGDSGTTGLGDGSRVAKDDLRIAALGDVDELNAIIGVLRAQITASQVANKADWDKSLSLIQHWLFDLGGEVCIPNYNLLQPVCIEFLEKEIDRMNEDLPMLKEFILPSGSLSCSYAHQARAVCRRAERSLMSVQTRDQNIQATALQLLNRLSDWLFVASRALQRAEGGQEVLWQKNINEMI

SEQ ID NO: 5269 - protein, 291 aa, Acinetobacter baumannii
KKIRIIVVKKTMTTALNGLKVLDFSTLLPGPFATMYLADMGAEVIHIESPSRPDLIRIMPPYANGQATAHSYLNRNKQSIVLDLKDAASIDLIKDKISEFDVVIEQFRPDVMRRLGLDYATLAEINPRLIYCSITGYGQTGSYKDRAGHDINYLALAGIAGYSGRQDSGPPPLGIQVADIAGGSLHAVIAILAAVVERSRSGIGQYIDISMTDCVASLNSMAASATLAAQVEQAPEQGMLNGGIFYDYYMTQDGRYLSIGSLEPQIACPIKFSRSQMRYSFVGQKLGEGQW

SEQ ID NO: 5270 - protein, 298 aa, Acinetobacter baumannii
NLMLNRLIQKKWYKYQQAKKAKTFDSHWYMRFGWLEQPFTTLEQLDSLFEIHSPGKFTFADSFYAHENGRHFIFFEEVDDQHPVGFLSVLEVFKDGTYTPPETILKLDYHLSYPCVFKIDSTWYMIPESSANKTIELWKCTDFPMKWEKHSNLIKNIEAVDSTPFYHEGLWYLFTSTRRDCKKFGDRLDLFFTEDILNPNWQEHPMNPVCRGSQQFRMAGKPFIYKGQLVRPSQDSLKRYGGNIELKTITQLSPAAYEEKLLEVVLPNWNQADDGCHTINVEDNFVVLDAIRLTPKNN

SEQ ID NO: 5271 - protein, 105 aa, Acinetobacter baumannii
VDYRASTNHHFSYFFPEKHLIITINSTKLELLYSQVTINGDFRMNKSIDQTKQHTETTMVRWTKDQLETIRNEAFQQRKAPAVFIREFLLENHPAFKPKKTDERL

SEQ ID NO: 5272 - protein, 453 aa, Acinetobacter baumannii
ERLRFRSKVTNLIRNYLDDHGFSHVETPILTRATPEGARDYLVPSRVQNGSFYALPQSPQLFKQLLMVGGIDRYYQIAKCFRDEDLRADRQPEFTQIDIETSFLNDDDIMDLMEGMTVKLFNDLLGVKFEKFRRMPYSEAMRDYASDKPDLRIPLKLVDVADLMQEVEFKVFAGPAKDPKGRIAALRVPGAGSLTRSQIDEYTKFVGIYGAKGLAYIKVNEIEKGIEGLQSPIVKFIEPIVMQLLERVGAENGDIVFFGADKAKIVNDAMGALRVKIGHDLNLATCEWAPLWVVDFPMFEETDDGKWTSVHHPFTLPKSSVEDVKSNPGEALSVAYDMVLNGTEVGGGSLRIYTLEMQKAIFEALGISDEEAEQKFSFLLNALRYGAPPHGGLAFGLDRLVMLMTGATSIRDVIAFPKTKTAECPLTQAPAPVEANQLRDLGIRLREQQKKEA

SEQ ID NO: 5273 - protein, 455 aa, Acinetobacter baumannii
GDERMIDLFSIPVEQSVLVTLLTVEQGAGEYIDSLEVSDFYSDRHQIIFKHIKEQHEKGEGHNEILIWELIRSHTLEVKTVPEQYMIELMSGAVVYTMLGSLVKKLKDFSTRRKIQELSKNIGVVAVDTVSYSAEAALDRVQTLVSSLDGNSHENKTMSAGDLSKQVLANILDKHEKIHAGVEVKRGIKTGFFELDNKLDCIDQTDLVIIGARPSMGKTTLAQNILSDVSVNQGEPALFMSGEMNKEQIMERLISGIGQIELKKIRSGRFQSEDAGLIHRAMTIIGNTKIEINDQSAPSLSDIRREARKMVRKYGKVGLIMVDYLQIMTPPQRTGNPTQEMGDISRGLKKLAKDFNCPVVALSQLNRSLENRPNKRPIMSDLRDSGQIEQDADVILFIYRDEVYNKESKDAGIAEIIVGKARNGTVGTVRLATDLARSTFLDLDPQYYHAMEEAV

SEQ ID NO: 5274 - protein, 239 aa, Acinetobacter baumannii
KSMRIIGHRGARREAPENTLGGFQHIKNLGIRGVEFDIRQLQDQELVVIHDDNFLRTAGVDQIVEHSTLAQALSFDHRQNWPNWPTSEPTPTLTDVLNLLDNFDHIEVEVKAVRDMALAEKLVQKLETELQGFEKVVTITSFDLQILTALRDINSQFKRGLLVELPVGATAIELAHQYGCCHIGWHDQLATDEMIQLSHQAGLNISVWTVNDVERAKRLQDLDIQGLITDIPTTMLEAL

SEQ ID NO: 5275 - protein, 374 aa, Acinetobacter baumannii
CCMRTTHLTPSTFFKLSLISLSLILAACNQQEVPKTTASEPKKIELIPQDLIPVKEGSLAAQTAFTGTIRAVQQSSIQAQVSATATAVTADVGQKVQKGQVLVRLNNQDNAARLAQAQANLASAQAQAELARNLMNRKQRLLNQGFIARVEFEQSQVDYKGQLESVRAQQANVDIAKKADRDGIITSPISGVITKRQVEPGQTVSVGQTLFEIVNPDQLEIQAKLPIEQQSALKVGSSIQYQIQGNSKQLHAILTRISPVADQDSRQIEFFASPKEAIDSLSIGAFINGIILHNDSNQGQTIPLDSIQNLQHDPFVWVIRNQTIQKVKIRVVEQRYNENIALVQGLQSTDQVSRIQFEDSDINKKVTLTTEKNK

SEQ ID NO: 5276 - protein, 128 aa, Acinetobacter baumannii
SSKRSALGLRRFMPEPTTSTATIATLSAVSLLPFINGNALLGAVLGAAFIATFEKDLNAYQRIRNMLLATGIGYISAPLITEHTLLKADAVAALITSTLCLFILIKVVDWVKTAKLSDILNIFRGGKS

SEQ ID NO: 5277 - protein, 191 aa, Acinetobacter baumannii
IIRRFLFCIYYFHWHKICLISKHSHIKKDFTMPDPKKFERTLDRFGHYAVEAFHYLALFIIGCMIAWSAAHTVFEILTVKKYASIDDILLLFIYLELGAMVGIYFKTNHMPVRFLIYVAITALTRLLISDIQHDHKADLDQVIITGSILILALSILVVRFASWHYPSVMKEKHSKTPTSLKTPQPQDDELA

SEQ ID NO: 5278 - protein, 291 aa, Acinetobacter baumannii
SDIFQMTDFSRNALVVEGGGMRGAFTSGVLDAFLQQRFNPFDLYVGVSSGSTNVANYLAGQQGRTLTFYIDHSLRPEFIDYKRFFKGGDLLDLKWMWEIGEQEHPLDQQSLFAKNPDFYMVLTHAKTGHAEYLRAGKDNLLNALRASSSIPVLTRHPVDIMGEPYFDGGVADALPVRWAAQQSGVKKLLVLRTRPKNYFKASSRGDQFLAKYAFKHHYGFANSLRNRCARYNASVEFVRSSNPEQQILEVCPPPLKNMAGRLTTNPKKLRYSYEVGLETGLQAIENWNAMK

SEQ ID NO: 5279 - protein, 473 aa, Acinetobacter baumannii
GLLRKKHEAQRVMRPLHPIDFIFLSLEKRQQPMHVGGLFLFEIPENAPETFVHDLVEEIRQSKSIPVPPFNNRLNGLFWDEDEEFDIDHHFRHIALPHPGRIRELLVYISQQHSSLIDRAKPLWTCDIIEGIEGNRFAMYFKIHHAMVDGVAGMRLIEKSLSKTPQEKHVVPLWCVESKRTKRLKVPKPSTSKIKSILGGIKSQLEVTPKVMQELSQTIFKEMGKNPDYVSTFQAPVSILNQRVSASRRFAAQSFELSRLRKISKALGVTINDVVLAVCSGALREYLISHNSLPKKPLIAMVPASLRTDDSDVSNRITMILANLGTHKDQPLERLEIIRRSMQNSKQRFSRMTANEILNYSAVVYGPAGLNIMSGMLPKRQAFNLVISNVPGPREPLYWNGAKLDALYPASIVMDGQALNITMTSYLDKLEVGLTACRNALPKMQNLLTHLEDEIQRFEEIIEEKQLKHHSAS

SEQ ID NO: 5280 - protein, 462 aa, Acinetobacter baumannii
KLIRRCSMNTSIHNLQIEQAVLAALMTVANSYNQVESLLTEEDFHATRHKMIFSAIVDLDSKNSPYDAVLVNQWLEMHGYSEAAGGEQYIMQLLGDAPSSFYNLMSYAEKLKDLTTCRKVEAQAHKVIQSARSLTVSRGDLVLNAQTAFAEISTEQGSENLFHIHDAANNTFVEMHRKMEAAIAGKTLINGIQTGIYDLDKKLGDVEPGCLMVVAARPAMGKTTMLQLIANHVAVIQKKPTLIMSGEMPKEQIAMRLCCAIAPADIGIVRNSPHLLPKDEFTAYTNAVVMLQNVPMYINDTSRPSIANIRESIRKVKHQYGAVGVVLVDYLQIMKTTKQFAREDLKIAYFTGELKAMAKEFDCVIVLLSQLNRELEKRPNKRPMLSDLRESGAIEQDADQIVFLYRDEIYNKESQYRGIAEAIVGKNRHGEPGTAYMYAQLKYCQFTNLDHESLNQIQGATI

SEQ ID NO: 5281 - protein, 261 aa, Acinetobacter baumannii
CEKLSFLMPFTISHAVIAPPLAKLSRNTLPIAALAIGSMTPDLYRLFTMQSGMLTHQWKGLFYPNLALGLLFCVIWYLLYRPVVYRFFGIQHDLKLDSFRHFFSFFIGIIIALLIGIATHLIWDGLTHSDFRTFIFQDFLSQTVHLFGRPYPLHRLLQLGSSALALPFLGWMSIHYYQRHKQHWKVNYKIKIFAWCLFTLSTLLGLFSFWDYARYIPHEVWHSDTYYFTGRSINEFMQGWLSTFSLGCLLFLFLDRQQRMG

SEQ ID NO: 5282 - protein, 155 aa, Acinetobacter baumannii
TQVSNACFNVQKWGINMKAAKLIRDKGFKYAKEIVDSAPENATEWNEGYEFQCGQSVEVSPADLEKYFVDLVELKRLVESLGYISRWGGIERCKKLYFESSFKRDQHIKDLKRYIRDYESVYQLKCSHGYDVACLICGFGTVNGERVYHNKGKSK

SEQ ID NO: 5283 - protein, 922 aa, Acinetobacter baumannii
GKELFYMNAEQLQKTLRASQYAEQVLGLHQAVLEQDYQIDQFAAPLSTEQIYQLVDITLDGIGDEITWMRALRILRSRLMFRWIWQDANQLTDVVTLTRELSDFADASICAAKAFARVALVAKHGEPLSYSGKVQDLIVVAMGKLGAQELNLSSDIDLIFAFDEQGETNGRKCIDVQQFCILWGQKLIYLLEHITADGFVFRVDMRLRPWGDGSALAISHAALEKYLSQHGREWERYAWIKARVVTGGKEGQDLLEMTRPFVFRRYVDYTAFAAMRDMKAMIEREVLRRHIEDDIKLGAGGIREIEFIVQVFQLIYGGSKRELQDRQCLVSLEHIGEAGLLEKQAVLELEDAYLFLRRVEHAIQALNDQQTQLLPEETDLRQRIIDTLGFTSWNEFIDVLNEKRQKVKVQFKQLIEDTSSNAATENFGQLEQQLDEVLDDNAKNLIHEFWHGHALKKLPSNAVQRLKTFWPHLIEAILQSEQPQTALLRLMPLIESVMRRTVYLVMLIESKGALQRLVKMATVSPWICEELTQYPVLLDEFLSMDFELPKRKDLEDSLRQQLLRIEIDQVEDQMRVLRLFKKSNVLTVAASDVLAESPLMKVSDALTDIAEVSVNATLNLAYQTVAKRHGYPKDVEGKRCSLDYKAFAVIGYGKVGGIELGYGSDLDLVFIHYLDEQADTDGTKSITGFEFAMRVAQKFMSLMTTQTLDGRVYEIDTRLRPSGEAGLLVTSLKAYEHYQLKSAWLWEHQALVRARSIAGDEALCQKFEIFRREILTQSRDEAYVREEVLKMRQKMKDHLGSSSEQKKHGIFHLKQDAGGIVDIEFMAQYAVLAWSGTKPDLAHYSDNVRILEDAAKADCLSSEDATALIRAYLSERAESHRLALANQSMQVSAADWRSTRAVVCNLWQRLIDPTASVELDSE

SEQ ID NO: 5284 - protein, 494 aa, Acinetobacter baumannii
LWYSEFCLKYLVQPMQFNPLYSSLNPKLFHIQQPSPLRGAKAGHFNLALAEELQWTDEEKQAWVEICSGQRTFSEFSPLAMVYAGHQFGQWAGQLGDGRGLLIAQILNKKGQTIDLHLKGAGPTPYSRMGDGRAVLRSVIREYLAGHALNALGVASSHAVGFTSSTQGVQREKLEPGAMLLRTSECHIRLGHFEWINQYAPELLAEFTQKCIEWHYPECQQEEQPILAFAKAVIRNTAIMIAKWQLVGFAHGVMNTDNLNITGSTLDFGPYGFMERFRPNWINNHSDYQGRYTYQNQPSIAHWNLWTWLNNLIPLAEPEHKEQFKAALAACLEEFEPTFIEHYTTGLCQKMGLPHFHKDSTECGLSFLRILQAEQLDYTQSFIRLQNKEYKALRDDCLDIRQFDAFLTQYQNIREYQDIDELDANMQQVNPIYILRNHMAQRAIEAAERDDFSEVDRLFKLLNHPYTKQPDLEKPEDLGPLPSDVPDVAVSCSS

SEQ ID NO: 5285 - protein, 370 aa, Acinetobacter baumannii
VPHSLVESLSGCLEFHLNYQQTKVNQHVLNINQTWSISMNLPTTMKIVEITVPGGPEVLKLQDSNVPVPQADEVLIEVKAAGINRPDVLQRMGLYPMPKGVTQIPGLEVAGVVVAVGEQVQQFKVGDKVCALTNGGGYAEYCAVTATQVLPIPENLSFTQAAAIPETFFTVWANLFDIGRLKKDETALIHGGASGIGTTALAICHALGIKTFATVGSEDKVEALSDLTTAINYKTQDFEQEILNHTQEQGVDVILDIVGGSYFQKNLNLLKRDGRLVIIGFMGGRIAKEFDLQKLILKRATITGSTMRARNSQEKAQIAQSLHEHVWPLLAQGKCLPQIYKTYAFSDVQSAHACMEQGDHIGKIVLEMNA

SEQ ID NO: 5286 - protein, 179 aa, Acinetobacter baumannii
EDCSMKKPHALREYLLNAIPDLPQDPDRLLIFANDGKLMSTAANGYSFEMAYTLDMIITDYAGDVDVFGVVLFTWIMDNQSELMANLNKVEEAITFEAELIDNSKYDLHFKIPLTERVIVKKNAEGKFEISYPTEPQYTEFGPPTDFELIDKDGSTLATWRTADMQGRSLDMPFPGKSP

SEQ ID NO: 5287 - protein, 124 aa, Acinetobacter baumannii
YSIRGFIKFWSDEMSENVGFAGQIGPEHVGQVVEKGFKSIINNRPDMEGGPEQPTSAQIEEAARQAGLDYVYQPVVAGQITELDVRTFANHYNELPKPVLMFCRTGNRSNNLYQLAKQMDLLDD

SEQ ID NO: 5288 - protein, 98 aa, Acinetobacter baumannii
MTVSVDSLIEKMLLKLMKQIEAKPIIPIECQLWDEQDIANYFKYSLDYTKRHIISNDNFPPSRELPTSATGDRTVSRWKATDVISFGMAFDKTNIKYS

SEQ ID NO: 5289 - protein, 140 aa, Acinetobacter baumannii
SNSRSNNMMFVDNSCIDSTVFKKSPAERFKNLRTQKKVKEFFIKRRGYKRPDFNRMILDLGRLGWSHEKIAFVLPISGASTVSEWARGGVPNYENGEAFIELWKSETGIERFPREGEWQTYKYKLGQQDFLDELDGVIDH

SEQ ID NO: 5290 - protein, 125 aa, Acinetobacter baumannii
VMTSRATRVQIKGEDPKYPIAFDVELIAPVRIYTAVELAAMPLSQMIRCRDAQEEFYINNKKLSGRAKDIKDRLVAGEKLTLVLEKKHSRVTQTYFIGEEIVGKRIVKQLETRRFIRLPKVEGIA

SEQ ID NO: 5291 - protein, 102 aa, Acinetobacter baumannii
FCESFGRKLMKKFLCLMICSLSFVGCSNEPEPQIMSAKFNSMEECLASIKSKTGEALDPMTDKPEHVSGFLGKTGLQFNCEVKHTGTEGNYVDGWYQEKITN

SEQ ID NO: 5292 - protein, 173 aa, Acinetobacter baumannii
YKRRNSMSQFKLEDADILIDLANQTLSLPKHNKFYVVSTGKNGIGEQENTGKTPRGWHRVVKKFGMQSPKNTVFIARQPTGEVYNSELAAQFPERDWILSRILWLDGLEEGFNKGEGHDTMQRYIYIHGTPDKEPMGVPMSHGCIRMRNEEIIELFDLVSEDALVYLSEQSLT

SEQ ID NO: 5293 - protein, 249 aa, Acinetobacter baumannii
FMLSPARRHRLQALAAKEAAKADEFGGVRPDASVYQLQLTELKNDIHVLRSIQSQEKRAEAKKELIPKHMPYVLGVVQSGAKVEQDEVITTIMLWCFDCCLFEQGLSIAEYALEQNLKMPDSFSRSTATIVAEEIGNAARIAYKQGEIFKINILEKAHKITTSFDMPDEVRAKLLVALGRSYLQSDLYHLAVLFLKSAIAKHEKCGGKQDLQKAEKLLKEQSKNSPEPMLNADGSQVVDDQGNLMFHPT

SEQ ID NO: 5294 - protein, 843 aa, Acinetobacter baumannii
SSMRAECREQVAKALGKRKLSAADSNRISSLYIRAQNTLARTDPDWMFKSPAERAEAIAQKTATDLAVQIAKNNQNIARDAIIKAQLQNEIYNHPKLNPVQALMRKIAYFSDQSGIQSIEKQSQALHSRWMSLVADVFTKTQERFGMSVNKAMTDDIIRVMFGGKSDNPEITAIAKEVSAALEEMRLAFNRAGGNIKKLDNFGFMTSHDQKKVALTDQSEWVNDALAGVDRNQYVKETGELMDELELKSMLEEIYKTISTNGANKDLLILNKQAKAGASPVGGRSKMANRHQESRALHFKDGDAWLAYQKKYGTYDEAGFHEILKNHTHRMSTEVAMMQNLGSNPRNTFESLLDEAKIKLKADPQNGMKHGEIDKQAHRAMSMYNTLDANTRAIDSTLGNVMGGLRALMVASKLGGTTLTTFGDHASMKKVANMLGLSYTKSILPEYMKQLKQGATRDEALRFGLGINEMAGSMTRFGDADIVSSATKSGRFNARMQAFAATTMKLSGLNAVTAGAKRALNLVHMNKLAEMTRKTDWKDLGADDLKILQGNGITERDWQLWQQLEPSKREDGTAVLSQNDFFNAPDDVIKQFLPLDKQDNANALADFRYKAAMKYQTHIFNEESVAIIEAGVRERSIINLGEAGTIQGELGRTLFQFKGFPLAYMFRIGHRAFAQGDIKSRVTFLASLLAYQTLAGALIVQTQNLANGKNPEPVFTIDFFGKSLLKGGGLSFLGDIMSALSDPTGRSASDFISGPLLGQSMKLGMLLTGMGNNIIEGKESTRMMEVANTLKSNIPLQNLWYSKLVVDRMLFSKMQNMIDPDYLPRTQQRLENLGNSYWWDLSE

SEQ ID NO: 5295 - protein, 309 aa, Acinetobacter baumannii
IISSTQRMNIASIKTSYFEPWLQFSHPMVRQLAFTIASPNLLSQLPCSLTIRHSFQLHTDKNWEQHFQNYLPRLKQLDEAPEPLLQFMSRLKSTRLGLRFENLLWFWLQEDQYHPYQLLGHSIQKIDGAKTLGELDFLVLNQNTQEIEHWEVALKYYLGEGQLNLEQWIGLNRQDTLSKKLYHFTDKQFQFSKALGFKVHQRFAVLKGQLYLPLNLPQKQPIPEWVNLKRRLGTWGTKIPKSDFYRLKRHEWLCPHQKASSNTAYWWTDGLYCQNINETRFYMFRHPALLSLKPSLIKNNGVLQETTSL

SEQ ID NO: 5296 - protein, 123 aa, Acinetobacter baumannii
DAKRVFFICQVLFTSKECTMIRKQEITTFEFPENAVIWDVRDSSAYAEGHVKGAVSRPINDLNADILNQVAADQPIYILCGGGSKAPRAAEKLEGLDASREYVVLMGGTRAARDAGLPLEQGA

SEQ ID NO: 5297 - protein, 300 aa, Acinetobacter baumannii
INKRRFQMKMLNKSEAKLAWANGEPLLINNNGWTDFHLLEWSISVFDKYEFALKPREIKIGEMLVPEPIREAPKKGTVCFSPSILTEKAYQQFKWRDSKQDKLLLERGMVHLDEFNVIKHAVALVRISGGSCVINLDAQSDDSAIEVSADIPDPSEVELCLGTHFKDGEAPKEQSLELTSESNYEVELKSLLDELENTTSPGSANDLVSRTRHWSEEQRKPLLDAINKRLTTFTQPQAKEPPSLMVQIQTAPDLATLDILEVDIGGKPQEIQTKLMDFVKKRRFELMEAAKTASEVSHAV

SEQ ID NO: 5298 - protein, 173 aa, Acinetobacter baumannii
NLKRDSHMSEINLSPEAKTAIYKMVHQSQGITPQEIANVLGDSYKSVLNYANPNMETHLPSIKKLEAMIQFTRNPALVKAWAHMLGFVLVPANQADEKSHEVSIVETLLHININNGQANQQVHNVLEDGVVTPAELADTEAILEEMENHIHQLRQALKAAASNYISKSQKEKA

SEQ ID NO: 5299 - protein, 280 aa, Acinetobacter baumannii
RNWRRSMANFISNAFMLPNDLVDKGFMAQMRGAALPCYLYIVRKTRGWNKTDDDISISQLVEGTGYKKDAVLAGIDILLGLGIIEKITYVNRPSNYTLTDNIIAVGKTDTEQSAVGKTDSETESAVGNSDTKSGSAVGKTDKLLSEKPTHNNNIKTNTKTKGNFSEEFEIFWNAYPTCKRKSDKSGTFKTFEKYTRVISLEKLIAILNAFKLDSQWIKNDGEYIPAPSAWLNKKHWENDFWLKAAGLVEQQPQSAETPEYANPQRRHIPTMPKRFKGMNA

SEQ ID NO: 5300 - protein, 405 aa, Acinetobacter baumannii
LIIFMGIMMKLTQGVCGLTLAVFLSACGGGGDGYYNQNSDSGSTTTPTTPSTDQELANSVLNSVKQEGKYLFGSYDLNNESLSKGYIDHALDTFAQGPLKLTLDIRKVDLTKYNDHYREKCFINSTTDYRACYVFKGEEIKSLLTGYNDWDFDITADDLKNIKLASDNISPNLQEYQSNTRIYIFENENKDKNFQDVTITGAFAYPFQQSWGLQQTKQKRFVLINSTTSDYKITTTTMVQEPQTGQPNEKEVTTGAMSVYKDNTSTDGDLYVIQGGSGFNVLINDNPNVPFAEPISFVVNSTPGNTNNATYRVRLGKNQVLSLPNITGIEGSRVENEAPTTNIQKFNGSIYLEGQNIFTFKQDLNGSTLDFKHVINGVSIEGQSTNQNGVVSTTLKSPFAQKFTF

SEQ ID NO: 5301 - protein, 72 aa, Acinetobacter baumannii
WLIGHGSKYAAISQIGAILIEIPIFTKRNTDYWKIFLSMSINCHYSRVVFFCIICPQILGVSNFHVRYQKSP

SEQ ID NO: 5302 - protein, 224 aa, Acinetobacter baumannii
RLCGDSNDGGHSFFDCSTLATIDDKYLNLACCLLLFSKMAHLVLASSSPRRRELLQQLGLNFEIYSPDIDESVHDGELVHQYVERLAREKAQAVLNIFPDSVIIAADTSLGLDGQIIGKPDSKQHAFDIWKQLSGRWHDVFSGICIATQQQILSQVVQTQVEFASLTTQDMEDYWATGEPVGKAGAYAIQGIASQYIPKIQGSYSNVVGLPLYEFSQLFKRVKT

SEQ ID NO: 5303 - protein, 70 aa, Acinetobacter baumannii
FSGGHLLVSKFVAESMHSVHPNGNMFSGAMNLFYLKGAFSHVTFKGLVLGMMLLKLVTVIAIQVTLKVFP

SEQ ID NO: 5304 - protein, 418 aa, Acinetobacter baumannii
HSLGFFMPIRTINKRIIMGIQKILNEEAQYGVPVKIFTQDIDSESIEQLKKMAQLQFIYSHIAVMPDVHVGKGATVGSVIPTKHAIIPAAVGVDIGCGMNAIRLSLKASQLPDNLSRLRDAIERKVPVGFALHKQVKAKASSIIPLEKRLEPIIKKHPGLVRMLRQFEATWQKQLGTLGGGNHFIELCIDENQDIWVMLHSGSRGLGNVIGTYFIELAKKEAQHRFGHVPDKDLSYFAEGSQSFNDYVEAVEWAQEYAFENRKEMMRLILEAIRPLLPSFQMTKEAINCHHNYVSQETHFGENLFVTRKGAIRAGLDELGIIPGSMGARSYIVKGKANPESFCSCSHGAGRKMSRSKAKVLFNQQDLIEQTQGIECRKDSDVVDEIPSAYKDIDEVIANQADLIEVVHTLKQVLCIKG

SEQ ID NO: 5305 - protein, 124 aa, Acinetobacter baumannii
IRSGAKTMRGINKVILVGMLGANPIPKQFQNGGSYAQFSIATSEKYQDKRTGDWIENTEWHRIVAHNRLGEIACQFLKKGSKVYIEGSLHTRKWTDQNNQERYVTEVRAITFQSLDSLPQANPV

SEQ ID NO: 5306 - protein, 275 aa, Acinetobacter baumannii
IIQGKHNPMSRLATRFEKLQSQQRKALVSYVMAGDPQPQVTVPLLHKMVAAGVDVIELGLPFSDPMADGPVIALAAERALAAGTNTLDALNMVKEFREQDQETPVVLMGYLNPVEVIGYEKFVSYAKQCGVDGLLLVDLPPEESKEFGAILKQHDMDQIFLLAPTSTDQRIQHVANQASGFIYYVSLKGVTGAATLDTSEAAARIEKIKGMTNVPVGVGFGISDAASAKAMGSVADAVIVGSAFVKSFATLAADEAVEQTVNKVKELRAALDELV

SEQ ID NO: 5307 - protein, 284 aa, Acinetobacter baumannii
KMQGIDLHTHSNISDGTLSPELLVQAAVDVKLHTLALTDHDTMDGLQRARNAAQPHDLKIISGVEISSQWSRPSTKKSYGVHIVALNMQDEAPILEALEQQKRIRAQRAVVICELLKKCIGFDIYQDVLDKVENQPDRITRTHIAKALVEKNVVSRPQQAFDRFLKEGKRAFVKFEGLGLKETIEVIHNSKGFAVLAHPTRYDLSATNTRYLIELFASCGGDAVELPPPVDPLSTRQMIDRMIEQHHLAISIGSDFHGENMPWIKLGNTPKPTSNQQGIWERFI

SEQ ID NO: 5308 - protein, 204 aa, Acinetobacter baumannii
EVRGHNEGITIRGVKMTGLFIFLGIFVVLIAWGIHIRNNIVRYFNATKRAWAEVANFERQKVKTLEALETTLNQYTQFEKSTLEQVTALRQQILSLNVDHTDIAQLQQIEKMSKELIRSLNVVVENYPELKADTLYGKMMDDIQEQNENVGAAISIFNRNVEVFNNQIEVFPNNIINTMTLSKKTIRPFRDNLATDNFDYKPNF

SEQ ID NO: 5309 - protein, 406 aa, Acinetobacter baumannii
GFFIFKYPSLRDSPIISDYISPHQYAISGMNHSDTLSLSLELLQQPSVTPIDHTCQTIMADRLAKVGFHIEPMRFGDVDNLWARRGTEGPVFCFAGHTDVVPTGRLDAWNSDPFAPEIRDGKLYGRGSADMKTALAAMVVASERFVAKHPNHKGSIAFLITSDEEGPAVNGTVKVIETLEKRNEKITWCLVGEPSSTHKLGDIVKNGRRGSLNAVLKVQGKQGHVAYPHLARNPIHEASPALAELCQTVWDNGNEYFPATSFQISNIHAGTGATNVIPGALEVTFNFRYSTEVTAEQLKQRVHEILDKHGLQYEIVWNLSGLPFLTPVGELVNAAQTAILNVTGTETELSTSGGTSDGRFIAPTGAQVLELGVLNATIHQINEHVDVHDLDPLTDIYEQILENLLA

SEQ ID NO: 5310 - protein, 490 aa, Acinetobacter baumannii
VFFMRIFQRIHQKLNWSGRRYMAVILCVVAIAYLASAIYHTVKPLPQGINFSGKLRHADVKFLADKTYIDANGQQQVDQHIFDEILKMIDEAKTTIVVDMFLFNSEVGDSKLKQRPLMQELTDALISKKRQNRQIQVVMITDPINSVYGGLSPEHYRQLRQAGVDVIETNLAPLRASNPFWSGFWYICCQNIGNNPEKGWLPNPFGDEKITLRSYLNLFNFKANHRKTIVVDTDAGWKSLVTSANPHDGSSRHSNVALMVNGATATDVLQTEAAVAQMSGSSSPSLILGDFEKDVSKPQVQVLTEGAIYEAVLKLINTAKPKEHLDLSMFYLSERKIIKALKSAQERGVIVRVLLDPNKDAFGRQKNGIPNRQVASELHAAGIPIRWCDTHGEQNHSKMILKYNAQQAELIVGSANFTARNLKNYNLETDMLVVGKVQDQVFKDAQNYFNTSWSNLQGRQMSVDYAKYADESKVKYWIYRFMEWSGLSTF

SEQ ID NO: 5311 - protein, 299 aa, Acinetobacter baumannii
GAFMHIVYVSDGKAGHRSQALGLFQAMQRQQANVTFEEVSINDLPVMSLIKALFSSKKSLFQQAPDFIFGVGSHTHFRVWLLGKIFKKAKTIILMKPNLPTVWFNYAVIPEHDGIPANNRVIVTRGALNPIRNEKRHQASRILIALGGSSKRHQWNQEKVLLSVQKIVENNPDAEIILTTSRRTPAEFIDILRQQSFAQHLQIFPVEQTPQGWIFEEMQKAEAVWVTEDSVSMVFEALTAGCRVGVIAIDRLKDDRITHSIDQMIESQLISQNTCVVQLPQPYAFKEADRVATYLLAKN

SEQ ID NO: 5312 - protein, 427 aa, Acinetobacter baumannii
SYFIFNPIPFKLSLYMSHHFLGISVSVFSFEQEQQFFHEIKQMLNQQTFERLILSQYKGELTQLEKITFRVVELHGKKQLSALYHHTTQDVTKNYSFEDGLEQIAVLITQCKQANLFATHQEIQLKKNKKKAMLNMGKKHSVTTVPTVQAHDREKQRYVQQGSAFLKELGITDEKAQIIPSMARKWKQINKFIEIFASAYEQIDAEQKELNIVDFGSGKGYLTFALYDYLQEQQKVPLITGVELRRNLVEFCQNVADKVHFNHLDFFEGDGRSYQPEKLDVMIALHACDIAPDFAIHTGIRLNASMIMCAPCCHKELRPQLHSPEVLQPMLQFGIHAGQQAEMLTDTLRALLLKAYGYETKVFELVSLEHTSKNKMILATKRKNVTQPDVKIMAQIQALKEMYGIKKQTLELLLQDQLPIENIGCKC

SEQ ID NO: 5313 - protein, 65 aa, Acinetobacter baumannii
KYFICSHYFFPNVSMEKSYLRKKVGIMQKFKILCMFFIKSLCYLRLFFIQKHLFCTVFKHIIPFF

SEQ ID NO: 5314 - protein, 279 aa, Acinetobacter baumannii
LTFFEQVMENFEVIKALFLGFVEGLTEFLPISSTGHLILFGHIIDFHSDGGRVFEVVIQLGAILAVCWLYRQKIINLIKGFFSGDVESRHFAISVLIAFFPAVIIGVLAVDFIKSVLFSPIVVAIALIVGALIIFWVESKQFEHKTDDATKITFKQALLVGLAQCVAMIPGTSRSGATIVGGMFAGLSRKAATEFSFFLAMPTMLGAATFDLIKNADVLTSDNMVNIGVGFVAAFIAALLVVKALVLFVERHTLRVFAWYRIVLGVIILIAAMFFNLSA

SEQ ID NO: 5315 - protein, 337 aa, Acinetobacter baumannii
ILLISEKKMRNDTRKKFNHSLAKVAELNGVESAQVQFTVAPAPAQKMEEKIQASSEFFQKINVVPVEAQTGEAIGLSVNSTIAGRTDTSGNGERNPTDPTGFGVDKYECKQTNFDVAITYAKLDAWAPFADFHQRWTNAVAKAIGLDRIMIGFNGTSAAETTDRVANPKLQDVNIGWLQKIRTNAPDRVMSAVTVGAAGTYKNLDALVVDAVNELIDEVHQDDTDLVVICGRSLLADKNFPMVNDASDNTNVLAGQVLLSQKQIGGLPAARVPHFPDNALLITSFDNLSIYYQKDAKRRYIQEKPSKNRIEDYQSSNEAYVIEAYEKVALVEGITIQ

SEQ ID NO: 5316 - protein, 143 aa, Acinetobacter baumannii
MSIIQEFKEFAIKGNMMDLAIGVIIGGAFGKIVDSLVKDIIMPLITVITGGGVDFSQKFIVLGANPNNLQSLDALQKAGINVLTYGNFLTILINFLILAWVVFLMVKLLNKLRRDKNEPEAPAATPEDIQLLREIRDELKKQA

SEQ ID NO: 5317 - protein, 248 aa, Acinetobacter baumannii
GIIMTALIFDTETHKLHGDIIEAAAMEVVFPQISADILIIPTMFDFTKRYKPSEPISLGAMAVHHIVDEDLVKCPSFKTFKWPKENIQYLIGHNIDYDIEAVKRAGADTTGIKSICTLAMARYLWPTLEAHNLTALAYHISRDRKSTRRGLKNAHSALNDCKTTYGLLHTIVQEKNIKSFQELYLFSEKARIPTHIFYGKYKGSAIADLDMHALAFLARKTEDQYLLKAIDYELFQRSNSDFTNELPW

SEQ ID NO: 5318 - protein, 407 aa, Acinetobacter baumannii
NIVMSEQTAQRQYSIGWIMLLALLTALGPLSIDMYLPALPQMAHDFGVSTQMVANTLPAYFFGLAIGQLVYGPLSDRIGRKKPLYFGLALYAVASLFCVLATNEWSLIAARILQALGGCVGVVMARAAIRDRLDVQGSAQAFSSMMIVMGLAPILAPMIGAWILIWFPWQAIFIALSIVGAICWLCVHFFFKETLAVDKRLKLSLYQVATLYGAIFKDASFRLPMFAGCLTGAALFCYISSAPAVFMDQYGLNQQEFAYVFGLNAFGIMLMSSLNKHLTTRVEITKRLKAGSMVQVTGASIVLIAGLISAAPLWLVMLGLFLAISGIGLTGPNAMALAMSKQGARAGTASAIMGSMQFACGLLGGVLLNFLIWSASLNMGVMMVLFTLSGFIVVLKAIRQAKSQSLS

SEQ ID NO: 5319 - protein, 81 aa, Acinetobacter baumannii
TSYILIVCASLLGLFHKEFYKYNVGHEWWTVQIQNAHNEAVHFLELNPFTHFHMNIRFQMTYPTVKYVFSQIVAAKSPFIK

SEQ ID NO: 5320 - protein, 125 aa, Acinetobacter baumannii
GLYMRTLFWRTLVVIFITLGIIGAILPGMPTTVFLILAAWAASKGWPQMDAWLLNHPKYGITLRDWRANGTVPRKAKWIATIMMTASGILMLFTSAPFGVKIFTDTTMLVVAIWLWLRPEPKLKD

SEQ ID NO: 5321 - protein, 64 aa, Acinetobacter baumannii
IHHIAFNGKFFKFLNNTHLNISRCRGEEHIIFFFFHWPLIRLDSTRHDIDNLIFFSKKESYFTL

SEQ ID NO: 5322 - protein, 101 aa, Acinetobacter baumannii
TMNIFAELCCFSTPKNLFFNRKFPNYLAPDFNRMVVDLKNLGWTLEKIAYVLPISGASSVREWICGSFMKYDNGAAFVELWMHLTNKTEKEIPRINRYLIA

SEQ ID NO: 5323 - protein, 912 aa, Acinetobacter baumannii
MSDISRRIDDRLNQIFKFKRVGEWYRQGICPQCSRKECYTHAIKPRVVKCSRLNNCGYEEHVKDICEDLFKDWSKEFPKTEVNPHAAADAYLRHGRGLDIAPLKGLYTQDTFSNEQKYPGLYTGTVRFKLAEGIYWERFIDRPERFGRQKANFIGKYEGLSWSTVDLDDLCNAPSFWITEGIFNAIALIQSGQPAIATMSTGNYPSVLLKQIADRCHELKKDKPRLIWAFDNDKAGKDAIRKFHLRALQEKWASSAALPPHQVKGKNLDWNDLFMHDLLHSEERAKYRHYGELLIAETAEQAGLLIYNFKEGRTKTFFFNHNFRLYWFNLDYDKYAKRMNQIEEDPSFDALLDQQKREQALRDCAAVTEICNAQIDPLYFERNEVTGEAWYYFNVQSQWAEKKTQFTPSQIGSRSKFKDATMEVMAGAMWTGTDQQLEFFMKRKTERLKEVKTTDYIGYSSEYETYIFPKHAVHKGQVIPINEHDYFKIKRLELKSLAKSPVITLNPKKEFKPFWWKDFYRVRGSKGLIALAWWTGTYFAEQIRSIHSSYPFIEIIGQAGAGKSRLIEFLWKLSGRKEYEGFDANKSTNVAIYRNFAQISNLPVVLIEGDRNDAQGNSVKQAKFSWDELKDAFNGRAIRSKGLKTAGNETYEPPFRGAIMISQNSAIAASEAILTRTLHLSFDRKGQSLETKRIVDALDRIELEEACTYMTHCLRKENEILTTYQERLKSLEDQYHSVGITHTRIALCHAQIAALIEAIAEHVLNGYLDYEEVAPAQEMLMEMAQQRVDQLNGDCQEVEQFWEAFEYLQSGRSAPFSLNHHDNDAQTIAINLNEVYKVAAQQYQKLPEITLMKNLLKSSQKFKFIESNRAVSSSRFPTDAAKNLNADNEMSDRRRTVKCWIFSNPNYGAPQA

SEQ ID NO: 5324 - protein, 314 aa, Acinetobacter baumannii
AGLFKYSPFNWICLMSVDFNSLPKPNFVDVIDYEAIFSERKEYFISLHPEDEQEDVRKTLSRESEPVTKLLQENAYREMILRNQINEKALATQLAFAKGNDLDVWGANFDVKRLVITPADNSVTPPAPAVYEEDEDFRYRIQKKLDALSTAGPESAYEFHTLSADSRVSHVKCSSPAPAHALLTILQRDTENNASTEELNKIVYNYVSAEKKRPTGDRVQVQSAEIVSYEIEAVLVTKNVPETDPVLSAAQANTVAYTKEPKRIGKGVFFSDLYSILKVSGVERVELISPTAEIHLNNFQAASCTAIRLSVRNE

SEQ ID NO: 5325 - protein, 121 aa, Acinetobacter baumannii
DKDMNIQIKRIYEDVSGDDGKRILVDRLWSRGISKENAHLDLWLKEIAPSTELRKWFHAESAEHWDEFKQRYLKELETNPAVKELLEIVSYHKVTLLYSAKDVEHNHAIILKEYLLEKSKN

SEQ ID NO: 5326 - protein, 165 aa, Acinetobacter baumannii
RICICATISIFQARSIAVSEISFERLHQFFCKVPSVQEARIMAYGADGEHAWWFKFSIDVEHPLAWQTVQELGHVLNYLSTNERLPTLFFPVSPPPYMNGEAKDFLSWVIQCNHPEFSPDVVCDWLEARLPNPVDDESQWKIKTDLSEIEKLDDKALDQLIPPTA

SEQ ID NO: 5327 - protein, 99 aa, Acinetobacter baumannii
IDFISVLLQHIRDILMSDKNSSESAILGWKFVLIVGVLSAIFLGFFYLAMSNEPDYMPGAQRKAQQHEMQQKAEKSTDQQTQHDNMPEMDMQEHQHSHQ

SEQ ID NO: 5328 - protein, 216 aa, Acinetobacter baumannii
GFIMTLRLGDTAPDFQQESSEGTINFYDFLGDSWGILFSHPADYTPVCTTELGYTAKLKDEFEKRNVKAIALSVDDVESHKGWINDINETQNTTVNFPIIADKDRKVSELYGFIHPNASETLTVRSLVIIDPNKKVRLIITYPASTGRNFNEVLRVVDSLQLTDKHKVATPANWQQGEDVVIVPSLKDEEEIKQRFPKGYTTVKPYLRLTPQPEQD

SEQ ID NO: 5329 - protein, 157 aa, Acinetobacter baumannii
GQIMKGSVNTSLIANMDQQELQHLITVSTGFIDAYIIECNDQVPMLLPQNIVLSAMDVKNGVKHIEWHDVKLPVYSVHNAIDQHAAALVIEGEDISQRFALICKTMPVSTRLRISEIVDEMDEHEAEQYPAVFKYVRMQDQRYYIPNLKYIEKSLGL

SEQ ID NO: 5330 - protein, 489 aa, Acinetobacter baumannii
GISMSETHAPEKLQRKLGARHLNMIAIGGSIGTGLFLASGSTIANAGPGGALLAYSLIGIMIYFLMTSLGELATHTPTSGAFFTYGSRYVEEGFGFALGWNYWYNWAITVAFELVAVQFIMKFWFPDVPGFYWSALFLVIIFMINAMTVKGFGESEFWFSMVKVIAIVAFIIIGIAMIIKIMLTPGVATFGNWTYKEAPFVGGLQAMIGVAMIAGFSFQGTEMVGVAAGESKDPKKTIPLAIKQIFWRILLFYILCIFIIGTLIAYDDPNLLQAAATENIALSPFTLLYEKVGFAFAASLMNAVILTAILSAGNSGMYSSTRMLFDMAQQGRAPKWFAKLDNRGVPMNALYATTFIAAFCFLTTFIGEKQVFNWLLNMSGMCGFIVWLGIAISHYRFRKGYIAQGYKLEDLAYRAKFFPFAPWFAFILCSVIILGQNYQAVLGGKIDWIGLLSTYISLPLFLVIWLGYKWKNKTKLIPYDQMDVKPEQD

SEQ ID NO: 5331 - protein, 487 aa, Acinetobacter baumannii
KNVLKFKERLKMKLKHLSTAMILATLPATGVFAAALDRSGQSMSAFFQPGNYFEAGISVLDPDVAGKEAGSSATRRDIGDMANDYYFPSAALKLQINDQFSFGLLYDQPFGADAEYSGNNVFVSQPGSDSVLSATAIDGIVTKKATEALQAQGLPVNDQTLALAKGQVLASPQFKQLAGALAAANNYLGNGGTKVKVDTQNLSFVFGYQPTKNFNFYAGPVLQTVKGNVSLRGQAYSLYNGYDADIKETTGAGWLAGAAYQIPEIALRASVTYRSEIDHKVDINENLSLLNFPGLTSVLTGLEVPASKLQAINSSGKTTITTPQSVNLDFQTGIMADTVAFANVRWVNWKDFSIQPYKFGKVSEAVGGLVGRPNGFNLVEYSDDQWSVNAGVGRKLNDKWAGNVSVGWDSGAGNPVTTLGPTEGYWNVGLGVQYSPTPQTFIAGGVKYFWLGDAKAQTGAQAGSDQYVADFSDNDAIAYGLKLGYKF

SEQ ID NO: 5332 - protein, 167 aa, Acinetobacter baumannii
GNPMSQSNRLLKLVKATSKFPKGIRSTLWSKAFGRIVPMVGTANIRYLEVNVNHVTVRLENQKNMQNHIKGVHAAAMALLAETATGFLTGLHIPDNRILLIKSLHVDYLKVVEGGLTATATLSTEQQKYIADHEKGELVIPVTVIDDAGNEPIQCQMLWAWLPKRKK

SEQ ID NO: 5333 - protein, 550 aa, Acinetobacter baumannii
PYAMYLYTDFDQQLINQRVAQFRDQTERYLAGKLSEDEYRPLRLQNGLYVQRYAPMLRIAVPYGLMNSKQLRKIAEVSTQYDRGYAHVSTRQNIQLNWPALEDVPEILAELATVQMHAIQTSGNCIRNTTTDQYAGVVAGEIADPRPTCELIRQWSTFHPEFAFLPRKFKIAVSALEEKDRAATAFHDIGVYIVRNEAGEMGYKIMVGGGLGRTPIIGSVIREFLPREDLIAYLEAVLRVYNLHGRRDNKYKARIKILVKALTPEVFAQKVEAEFEHTRETLKIQPEILKKLDEEFTPFDYQDLEDEDFTALFAEHPKFKQWFNINTHAHKVKGYRIVTISLKRAGIAPGDMTTEEMNFIADLADKYTFGELRTTHEQNIALADVPQKDLFDVWQALEQHNMARAHIGFITDIISCPGGDFCSLANAKSIPIAEAITRRFEDLDKVYDLGHLDLNISGCMNACGHHHVGNIGILGVDKKGAEFYQITLGGNSDHDASIGDILGPSFAAEAVPDVIEEVLNTYLDLRIEGERFVDTYRRVGIQPFKERAYA

SEQ ID NO: 5334 - protein, 340 aa, Acinetobacter baumannii
EMYMDPRSEVILRQQDYLKGRVLLINAPNDALVSQLSTEIDASVWTWNYADYQGFINAGATAHFSVEFPSQEFDQALIFVPKSKELLNYILHVVMSHLKTDQSVFLVGEKKGGVERAAKQLQGFGKILKLDSARHCQLWHLKIEKIEKIKPLESWLKTYTVQVNEQELTICALPGVFSQTHLDVGTAVLLPYLNQVKSGRIADFGCGAGIISCYLAKANSSNIIHALDIDAFALQSTEMTFSRNGIGSDQLRLQPVTGIADAPTELDAIVSNPPFHQGIHTNYDASEGLCQNAKKHLKASGELWIVANRFLNYPILIEKHFGQCEIKTDLQGFKVLYACA

SEQ ID NO: 5335 - protein, 249 aa, Acinetobacter baumannii
LSDIPLKTNLIFKSKDTMNILIVHAHPEPLSFTTSLKTTAQQTFKKLGHQVEISDLYAMQFNPVASKEDFLELNQPDYFNYALEQRNATKQQLLATDIQAEIDKVKRADLIILNFPLYWTSVPAILKGWIDRVFVSGLFYGGKRFYNHGGMAGKKAMLCLTLGGRTHMFGENSIHGPIEHYLSPIQRGTLAYTGFEVLPPFIAYHVPYISQEARETILEDYVTYLTHLDQLEPLKFPKLEEFDEKLYPL

SEQ ID NO: 5336 - protein, 254 aa, Acinetobacter baumannii
GLCMMWFLYVAVGLLALAALLYVLGNYTFWLPFRSSKLPRIVMLHQVTPKDAASGMNMPPEKFEQLLTLLTRKGAIFCFVSELEQYRNQKNVVALSFDDGFMDNYLYAYPLLKKYNAKATIYLATQIEGIEKLTHEQIHEMANSGLIEFGAHTQHHVNLLKLDDQTAYDEMLQSKRDVEALVGKCPSFAYPFGRFNEKHQKMAQEIGFKNAVSTRKKIEAYEAVNQFNIPRVSTHGAMNALQMRIALAKGRYKL

SEQ ID NO: 5337 - protein, 493 aa, Acinetobacter baumannii
GECIMAEAQKLKLIDGWEVVIGIEIHTQLATNSKIFSGSSTEFGQDPNTQASLVDLAMPGVLPVLNEKVVELAIRFGLGIDAYIDQASVFARKNYFYPDSPKGYQISQMDNPIVGLGHIDIQLEDGTTKRIGVTRAHLEEDAGKSVHDQFEGMSGIDLNRAGTPLLEIVSEPDMRSVEEAVAYIKAIHTLVRWLGISDGNMAEGSFRADCNVSLRRPGQPFGTRCELKNLNSFRFIEQAINVEIERQMEILEWGGEIDQETRLFDPNKMETRSMRSKEEANDYRYFPDPDLLPVIIPDEQIEAIKATMPELPAARRARFIADFGVTEYDAHVLTLSREMADFYEAVVAAAGGAKQGKIAANWVMGEFSGALNKAGLELTDSPVSAEQLGGMIARIVDNTISGKIAKQVFGFMWESEGKSADDIIAEKGLKQETDTGAIEAIIKEVLAANEKMVEEYKSGKEKAFNGLVGQVMKASKGKANPAQVNELMKKLIG

SEQ ID NO: 5338 - protein, 174 aa, Acinetobacter baumannii
GFLMFKSPGFTIVELTITLVILVIMSVIAIPLYHQFMASVELKNTPRILTIHIQKAKYDAIIRHKNVVLCPSSDQLVCNTNWDNRVISFVDNNRNLQHDLNEELLTSIDLNHHYGSMKLQRFGKKQNSIIFQGSSGLPIESNGSFIYCSYDQLKNFKLILSKMGHVRLEELKNC

SEQ ID NO: 5339 - protein, 331 aa, Acinetobacter baumannii
MDLIQENGQPRYGRFESVPSTIHVQRYIYKTPYGKVLKGWRKQLKYKKFKFCGIQHKHYSIGLAIADIGWVGHGFFYIYDHETGQVIEWNAIQPLGHKTYLDEQPLFNQSYFSKSPYQFDIQHANGVRYIRVTKYGEICLSARIFCAGTDILSLCTPTGINGWTYTQKQTTLAVEGMFINKQNQVVQFDEKTFASLDDTCGFLRPETAWFWLSCNFWDEQGRRIGLNLASGVNESFGNENCLWINGVLFPLTDVLFEKVNDELWQISSLDQKLNLQVHIGWCRYENINLRMIGSQFNQWQAKISGTIEHETTDIINCKEQYGLLEQHYAKW

SEQ ID NO: 5340 - protein, 64 aa, Acinetobacter baumannii
GGIIRMRSGRDGDSIWMTSAPISAKYIVAKGPGKSVEKSRTLSPFNAVVIVFLTTIIRIFFYIS

SEQ ID NO: 5341 - protein, 113 aa, Acinetobacter baumannii
SPVLPKNPDTCSGLSVIGSKASPVLLLIEAKHSSIELNFALIICGSGSFEQPTKLSEQIIKHKNFFINFLPKLSQNHLQSKYEYLHHLFATSMLVQTYAHNSYVPNEDYPYYI

SEQ ID NO: 5342 - protein, 819 aa, Acinetobacter baumannii
SPPMADLKLEVLFNAVDKLSGPIKTIVGGSKTLSDAFKKTSSELKALEAQQRKISGFRQLKEQSEKTAQAIEQNKETLKQLKTAMNIGAPTEQMVKDLARAEAAQKRLKAAQKNQGTEMTALVRELNQAGISVDNLADDESELKNKIHLTTMEINKQKESLERHQKAQKQYEQMQGRMAKASDLAKKGLMVAGAGAAAMAIPVHLAIDYESAMADVKKVVNFETPQQFKIMGDDIIRLSTKLPMAAKDIAAIVAAGGQSGIAKNELLGFAESAVKMGVAFDISAQESGQAMAEMRTAFKMSQTEVVSLADKINYLGNNTPAAAKGIMDIVQRIGPLGEVGGFASGSIAALGATIRGMGVAEEIAATGIKNMMLALVAGESATKGQRAAYKDLGLDAGQVAKDMQIDAEATTLKVIKSISKLDKYKQAATLKELFGSESLGSIAPLLTNMEALEKNLSMVGDKSKYAGSMQAEYAARAATTANNIQLAKNQVAGLAINIGNVLLPPINTMLGKFTAVMTVVQDWASRNPALASTLVKIAVGGIAIIGIISALSLGVLALLGPLAMLKMTFSTLGIGFSALGAIFSPAGLVILGVIAAVAGAAYLIYKNWEPIKGFFVGIWNTVKTAFNGGITGVSALIINWSPIGLFYAAFAKVLSWFGVELPAKFTGFGAMILTGLKNGIMSKIGEVKAALSGAVTGVIDKARNILGIHSPSRVFMGIGDYTMQGMALGISQNHNLPVRATQQATQNVIGTGTTAKVTPVTPIRAQRGGSYISNDTIQITIKAEHGQPVRETARALRAEMVRLQQEERDARRRFLTDTE

SEQ ID NO: 5343 - protein, 173 aa, Acinetobacter baumannii
EDTMPSLFMVMLGGRHARANTEVHDVVMAVGDTLEEVYPQLKQAWFGEAQGLHIDAWAKLSGVSSQGQNYQIHFTDAAPQPDDLKLYLINLGGYNAREFGELHRYEFVVAPNAVVAKQLGKQFIDRQWQKAHTDRVIDIDDCLAIDCVAGRYIHLIKGDFAATIWENTYLTVG

SEQ ID NO: 5344 - protein, 112 aa, Acinetobacter baumannii
EIKMSLFISTAHAAPAAAQSPGLLPNILMIVVFVAIFYFLIWRPQAKRAKEHRSLIESLGVGSEVVFAGGLMGKVTKLEGDYAVVELNRGVEVKIQRASVISVLPEGTLNNL

SEQ ID NO: 5345 - protein, 372 aa, Acinetobacter baumannii
ELKMAKLFETINFDSLQLVNRIVIAPMCQYSATDEGEITYWHEQQWANYALSGAGLCIVEATAVQAEGRISYADLGLWNDQQRDQIKTLLGKVKTLSPMPFGIQLAHAGRKASTEKPWLGKGQIAKDQPHGWQTVAPSTSTFSVHDAAPHALTIAEIKQIQQDFAAAAKRAVEAGFELIEVHAAHGYLLHQFLSPIANQRTDEYGGSLENRMRMTLEVLQAIKLAVPEGYPIGVRLSATDWMDGNEQWDIESTVGLSKALEQLGAAYIHVSSGGLHEHQNITIGAGYQVPFAEQVKKHVAIPVIAVGLITDPQHAEQILENQQADAIGLARAMLYDPRWPWHAAATLGAKVKIAPQYLRCQPHGLKQLFDSF

SEQ ID NO: 5346 - protein, 120 aa, Acinetobacter baumannii
RIKMFALISKINPGAWWLIFAIATDVLSTFYSAKGNGLVNKTAQGIALVLYIISFACAAIALKYMQAGILYVLWSGVGVLATAFLAKIFLGQNIDVAGWIGIGFITVGLMIIAQYSNIDV

SEQ ID NO: 5347 - protein, 714 aa, Acinetobacter baumannii
IKEISMSLLRLDRLHYCILMSMGCISSPLVWAEDLNSDVAKLPTLHVEATRTDTGYLQTPASVFRIEAPQVDSSSQVNLTEVVKGIPSLQIRNRENYAQDLQLSMRGFGARSTFGVRGIRLYVDGIPATMPDGQGQTSNIDLSSLDHVEVLTGPFSSLYGNSSGGTILTSTKEGQGKDSIELSYSGGSHDKSRVGLVLQGGAKGANEPSYIISSSYFDTDGYREHSGAEKVLNNAKLSWNLDDGSKINWVTNYVKIHADDPQGLTHDQWNANPKQQVPFLKQFNVRKDIEQTQTGVTWSKPINDKNELYAMAYLGNRQVTQYQSIPKSTQDASINHAGGVIDFERNYYGADFRWTGKELLPNTTLSVGVALDAMDEDRKGFENFNLVNGQPSYGVKGNLRRDEDNTLWNIDPYLQASWQFLPTWRLDTGVRYSNVHYKSEDNYLSNGDDSGKTDYDKVLPSVALSWQILPELMAYVSYAKGFETPTFTEMAYRPDGQSGFNFDLTASTSDTYETGLKSQNQLGDFTLAVFQTKTKDDIVSAGNSNGRSTFRNADKTLREGVEFAWNKKLWRDLIATASYSYLDATFDADIPALGNIAQISSGNAIPGIAKNQAYASLAWQPSHGLYGGVDVQYMDKVYVNDTNSDAAPSYSVTSANVGYAWVMGDWKVNSFARVENLFDKKYAGSVIVNDGNSRYFEPADGRNWSAGLRVIKQF

SEQ ID NO: 5348 - protein, 616 aa, Acinetobacter baumannii
AFRIFMSDIKNLRNIAIIAHVDHGKTTLVDKLLQQSGALGDRAGEIERVMDSNALESERGITILAKNTAITWLDKRTDTTYRINIVDTPGHADFGGEVERVMSMVDCVLLLVDSQEGPMPQTRFVTQKAFARGLKPIVIINKVDKPSARPDWVIDQVFDLFDNLGATDEQLDFPIVYASGLRGVAGPAPEELAEDMTPLFETIVDIVEPPAVDVDGPFQMQISSLDYNSFVGVIGVGRIQRGSVKLNTPVTVIDKEGNTRNGRILKIMGYHGLERIDVDSASAGDIVCITGIDALNISDTICDPKNVEALPPLSVDEPTVSMTFQVNNSPFAGKEGKFVTSRNIRERLDRELIHNVALRVEDTDSPDRFKVSGRGELHLSVLIENMRREGFELGVSRPQVIIKEIDGEKQEPYENVTFDVEEQHQGAVMEQMGHRKGEMTNMEVDGKGRIRIEATVPSRGLIGFRSEFLTMTSGTGIMTSSFSHYGPLKQGTVAKRQNGVLISMVQGTCLGYALFSLQDRGRLFAKPQLEVYEGMIVGINSRSDDMVVNPTKAKQLTNVRASGTDDALTLTPAIEFTLEQALEFIEDDELVEVTPKSIRIRKRYLTENERKRNRDK

SEQ ID NO: 5349 - protein, 335 aa, Acinetobacter baumannii
FGRIKMNAQVSVTDLFSREEIQELTEPSDAYGAWAVASTWAVIGGTFASLIMMWDYLPSWGKLLACMLALAVLAGRQLCLAILMHDASHKSLFKNKKINDFVGDWLCARPIWNDLQKYRVHHVRHHAKTSTPDDPDLSLVAGFPVSKKSLTRKFLRDLTGITGLKFSLGRVLMDLDVMKWTVANDQIWLDRSDKNFVDYAKSIAKNSTGAIATNLLLYGVFKACGQQRFYWLWPLAYLTPFPLFLRIRSMAEHAGMQTSNTALTNTRTTRAGWIARSFVAPIHVNYHMEHHLMSSVPYFKLPRMHKILRERGHVPTPPSYFEVIHTLSSKQELTN

SEQ ID NO: 5350 - protein, 148 aa, Acinetobacter baumannii
QLLILRMAPFFGGQIRIKVNLIIRSGRGICPNEILEALLELGLTPIDWVDASQFSKLTGIEEQKLFHRRKNWPEDLVWAKQDGNIYYSIRGYNKWLTEQAQSRYQKACGLDQEQSKSILSETSKPTTSRYHTPRLRKVLAQPLKLEAN

SEQ ID NO: 5351 - protein, 446 aa, Acinetobacter baumannii
IIMIISTFFKRAVPTNNDKICEAGMTQRLELHQVEQLTACKISLLLGLNAEQNYIEQFFRFSLRLLKCQKALLTFNQEPYFWHHCPDGMTAISFKPSRHLKQCFAKQQVIHHNHPSYQNLINYLKELNIECGRALAVHLVQPDQTSMGFAVFFDDDETCFEDDQIQLLLDYCSSFMQQVELKFNYEELNELYEQQVALNSSKTKFFSIISHDLRAPFHGLLGFSEVLAKERETLDESSIQNIADYLYDTSQSTYNLLESLLTWAMAEGGRFVYHPINFKLRQVSNIVCDVLHTLALKKNIELVNAVSEDLKIYADINMMTSVIQNLVSNALKFTDVDGSGKVFIEAKQVGTNVEITVRDTGLGMTEQQMANLFHPRITASFKGTAGEKGAGLGLSLCKRFVEINQGKISVTSQKGVGTTFKVLLPSAQEVPEHHVEQQNTSEAKLV

SEQ ID NO: 5352 - protein, 305 aa, Acinetobacter baumannii
NKMIVREQPSIFKVLFSWRGTILPKILPSLGVVMLISAIIGGVEYINLYRFPEIPLVGFTLIGVVLSIFLGFKNTACYDRWWEARKLWGVLIATSRHFDRDCRILTQARRERVIQHVIVFANVLRDRLRRQTANPTELIQTSGMSQQALTQLYQQNNAPQYTLSLIQWELLQALKEGEISDIIYAQMNKNVADLSVVQTGCDRIANTPIPFAYSVLLNRTVYFFCFMLPFSLGSLLGLATPLLVGILAYTFLGLDALSTEIEEPFGTQSNDLPLDAMVRSIEIELLGTLGKPTPPPIQAQDNNLL

SEQ ID NO: 5353 - protein, 115 aa, Acinetobacter baumannii
TKALIFASCCCLFFAICSAVSGCVEVGAVVVAGLATVAEVGAGLSFCVDAAVGSVAGVAAGSTAPAVEHIKHKPRKLLVASCMRLPFWKCFIKWFDINMTIDAFFQKWFFFQPFI

SEQ ID NO: 5354 - protein, 223 aa, Acinetobacter baumannii
FRQIMSQSNQKRTRAKICGITRTQDVQAVVAAGADAIGFVFFPPSPRHVTVEQAQELAKVIPPYVQMVGLFVNASATEIQDVLDCVPLDVLQLHGDETPEQCQEIARHCKRRWYKAIQVKPDLDVVAEIQKYQAAGASAVLLDAWHPELKGGTGHQFDWSKFPKLDIPLILAGGLTPDNVIDAIHTTGAFAVDVSGGVESAKGIKDQQLIERFMQGVQRGSAK

SEQ ID NO: 5355 - protein, 69 aa, Acinetobacter baumannii
MKEIYAIQYDTVDAICWREYGRSTGVVERVLEANPHLSEFGPFIPMGTKIQLPDIPTPQNKVQSVQLWD

SEQ ID NO: 5356 - protein, 255 aa, Acinetobacter baumannii
IDYFLKMKKLNFLLWTTLVSLNSTVYAEVKSFTPHFPKFYSSAATRKAANQFYALGEAKFLNGVAVPFYGVTAQNPIEDGLLKSFEKCTPKSCSFNFKLDAQHAKQLKLLALPEVGVVLVPRNWQDVQANAGANGTGFALIMSPDQKQAIKLYDSLFCVGCGLPNATLYFPELLKESLENEYGGLKDPKNLINIVHPSKKVAFFSYQIPQVNNKTHGIAKYDDEDTFNYKEIQVTLDKSQQSLVGPILNFYNATH

SEQ ID NO: 5357 - protein, 667 aa, Acinetobacter baumannii
VNYFENKMVLIPRSSGRNMPRPTLQQHTPITGLGSIGKAVDDVLEARKEEKDKKEKADFALQSSKIGADINVVDSDLTLKIQTGELPYEEAVKQRQQSLESIKTQYKTAVPKQFEQSFNNYFEQHSYQSASKYLPIAQKSERQQAIVQLKDMRENYLKNPNASEKEVWNGLALYAQSKGLPLAHVQDTFNEYKNNRASNDVTTFYQANKSDNEKLTELSTPEAVIAKHPDLTQEQAVYWSGRALTQMDQNKRAAALQQKQLDDDAKDAVNEMKADIETGLIPSEAVIKARLARVQGTQKESEFVQYSGALVEVQQFMRLGADEREAYLSKKRSEAQNTAQDNAKDVSWKLNLLSRTHDNMLGYEKNNSALAYSIKTGQDLTVVPTNAILSGSPEAIAALSKNIKSIHANNILDGTVGSLNPFSTQQQSELKQFWEKARPGDKLSLLTSLHKSSAGNANAARDMINSIAGESGAYRLSASLNSRGLQDIAGQIITGQDLLDKNLVKVDDNALRTYTATYLAGITSPGKPDFQIYLESVKANYAYLVQKSEKVADSKGSILNKTIDEDLFNKAILNVTGGKFTSGGFFGSKSVVLRPHTVSEKAFREQLESFNSRNARTYGGSDKDFFLDLPLEQDPKNPYVYYFKNGTKYIMDATDKKRQTRLTFKVR

SEQ ID NO: 5358 - protein, 217 aa, Acinetobacter baumannii
RLVLLCRFVFLPCITRFLGALPDMTSAPLKAPINWTASITLIGLPILAAIIIPIYAYYYDFSVSAWVSLFFLLALSSMGITAGYHRLWAHRAYEASLPLKILLMIGGTFAVQNSILFWASGHRTHHRHVDDVDEDPYSIERGFWYAHMGWMIRDHSPSEPDFKNAPDLLNDKLVMFQHKYYALMVVAVHVGILGLVGWATGDLWGVVLPWWSITFNH

SEQ ID NO: 5359 - protein, 308 aa, Acinetobacter baumannii
SVVFQVILPILILLLMGYCSVLIKLVTPEQIKALSAFVIKISLPAFLIQSLANKNLQDIWHPAYFIAYGGGSLILFFLAFILYRKYFKNSLTHSAVISMGASMSNTGFMGTAILTMLMGSHAAIYISLTLIIENLLIVALMLILAEAGLHQQQRLLPLLKKTFINLLKNPVIIAILVGMSCILLDIHLPSKLGQALELLGRTASPLALFAIGGSLVGIGITAVNFQSILLAGFNVILMPVVIFGLFLLLPNVSQEMLYAGTLLAALPMPIAFGIFGQAYGLNERALTPLMISTIIGFMGVSGLIALWW

SEQ ID NO: 5360 - protein, 145 aa, Acinetobacter baumannii
MIIVCASCGAKNRVPEEKLTAQPSCGQCHQPLLPLEPIELNEQNFSNYITNSDLPILIDLWAEWCGPCKMMAPHFAQVAKQNPRVIFAKINTEESPRLSQAFNVRSIPTLVLMNKTTEVARMSGALRAPELQQWLDQQLQLNFGS

SEQ ID NO: 5361 - protein, 774 aa, Acinetobacter baumannii
RWAVCSDITIFHFSIICIQTSLHCLSYDLCNIGVEIRKSFITQVDQQGLHLKSWFKRLKRATYNTSFMYNVRMLIAFSGTAFVPYFLGHQLATIPLTLGVVAAGLSDIDDRFSVRIMNLIYTYIGFFITAASVQLLFPYPMLFALGLIASCIGWILLGSLGRRYATISYGCLVVSVYTMLGVHLFDQWYIQPALLVAGAAWYGLIATISFLLFPVRQLQDKLAASYASLGDFLFAKSNLFDVDMTPASYQQSMIDLSLENGKLITIFNDLKTALLTRLKGDRGQKGTRRSLHYYFVAQDIHERADSAHIDYQKLAKIFQHSDILFRFQRILAIQGKACQELNECILQRKPYIHNKRFKQSFENLRLSLVKLRDDQQYDLLWVNALFALYRNLKSIDSQLLNLETEQHIQSDKVKQAENQLKDDDLKGWNDIVVRIKQNLTPESVLFRHAIRVSIVLFIGYVFIQMTHIEYGYWIMLTALFVSQPNFNATKRRLRLRIVGTLVGIIVGLSIVFLVPSVEGQLVMLILSGVLFFELRSKQYAQATAFITILALINFNLDGSAVAAAIPRFIDTLIGCALAWFGVTFIWPDWKFRRLPRSIRRSLQAQCNYLAEVVKQYHEGHNHALNYRIVRRAAHNTDAEVASLISTLATEPDFDPTRKSDIFEFLCLNHTFLSYIAALGAHREKIQDQAVLNVLDQALDDIQGALLRDEMPDLTAQNMLQTIRQRLSQNDEDDQKSLIILQQLSLMLSVLNRFSMLKQRLSHDLDNDASELASL

SEQ ID NO: 5362 - protein, 61 aa, Acinetobacter baumannii
FENVPLAINPDIFILGLVRGGDLSQKQNIRMFVFGQICPSVGAWHSLRRMKHQVALIIDDL

SEQ ID NO: 5363 - protein, 108 aa, Acinetobacter baumannii
LGDVMSTSDAQHSADLNAQTVSAIANLARLSLNDTQSAEYAQSLNKILGMMETLKGIDTEGVEPLKSPFDNPQPLRADVVTESNHRDEYQAVAPATQDGLYLVPRVIE

SEQ ID NO: 5364 - protein, 349 aa, Acinetobacter baumannii
ERTVILKRLIGLFSPDLAIDLGTANTLIYAPGRGIILNEPTVVAIRHSGSQKIVAAVGLDAKQMLGRTPANIFAIRPMKDGVIADFEVTETMLNQFIGKVHEKRLFPPAPRVVVCVPCKSTLVERRAIREAVFNAGARDVRLIEEPMAAAIGAGMPVEQACGSMVVDVGGGTTEIAIISLQGCVYADSLRIGGDVFDEQIINYVRKAHGCVIGETTAEIIKKEVGMAVSDGTTLEIEVRGRNLAEGVPRAITVTSDEITQAISDPLQSIVSAVKSALEQTPPELSSDIAERGIVLTGGGALLRNLDKLLAQETGLPVVVAEDPLTCVTRGGGKVLEFFDNPNHDMLFVG

SEQ ID NO: 5365 - protein, 62 aa, Acinetobacter baumannii
DLNVKAWWALTGSNRRHSACKADALPTELSALNVFIVCEVHYRESLTGVKRFSTTFQKNANE

SEQ ID NO: 5366 - protein, 296 aa, Acinetobacter baumannii
IRGVMELDLNRINYNANQSKLGNLFLGFFEGLFLDGRVRLQEIEALIKWVEQYPDAVTVPHFEPLYQVLLKAAEDPQFLLANHQEVQTHLDLFKNSKYFKEHTCDVQRLHGVLAGLACDSDYTDDEVLALNAWLDRYDYLKDDPIYKEIIVALNHVRILNRVSGDTKEVLRLTLGKYIQLNNFGLPQVRVSSTEDNKNPDFYHGNVELIGKTICLTGASARYSKAEWKKVIESQGGIFKDDLTKTVDYLVICNKGNPHWAHMSYGRKFEQALKWQKDGANIRILTEDDFVKVLEEN

SEQ ID NO: 5367 - protein, 387 aa, Acinetobacter baumannii
VLLVNLRFNPASIIKIKIVLVFLFISFNLKDNLELALYDNQLITLMPIDTIQQTLHIRRKKNSQVFRNIARLWDAGQKSQTDQELLNALHPWGEDHNLRFVNTLSYLLSICSITTLLFGYFFHPHIQYIWSLLWAFLTGFLAYLLYEPQKPLTEVIHYLEQRMTALRYGLKFQQLPAYLPIQAQPILVLSKLKQHFPLFNRGNEANEITEFASVTWNDGITDHQVLLFKYHYVNNLPILQDQNSDKKIVKEIHKDLWGAFIFQMPALGIAASNQRSRFFEPYLSEWQSSDILINQELSIFGTDQHQLAKEMSPSLTLKLHDFFQHFNGDLIYHHEEQILCYLGEQDLFQTTSKRSEIHDIPALRGHLRTMTMPQYEKFQQFMLNLIK

SEQ ID NO: 5368 - protein, 64 aa, Acinetobacter baumannii
HRGLINMNAVTASQGRKHFTVAIDWNEHPIEWHLEQYGSWLLLDGKADTHFFLQRRPPSKQYSQ

SEQ ID NO: 5369 - protein, 331 aa, Acinetobacter baumannii
LEKVEHLRRSMMTKVTQQPSKQYGRPDDAKIIPFMKIAKPAAIFSILITLASIFFIATKGLNLGLDFTGGVSAELNYAQPANQAEVIQALDKAGFKDAVVQTLGSNKDLLVRMPVQDIKVEDLNNAITKAVQLPNNAAEVHKVDSVGGQVGNELYVRSAGAVALALILMLIYVTIRFEFKLAMGAVMSLFHDIIIIIGAFALFQWPFDLTVLAAVLAVIGFSLNDNIVVSDRIRENFRKIRGATPREIVDIALTETLRRTIHTSMTLLLVVLAMMFLGGDGLHWFSVAMFVGVFVGTYSSIYIGTAFALWRGLNRQDFIVQVKPEFEDEIP

SEQ ID NO: 5370 - protein, 78 aa, Acinetobacter baumannii
KYMVVIMLQITPIRIQFSTVCQLLDVTRESLRHTIRKDPTFPKPMKMGTTKQAPVFFDYQEIVEWHNSKKTVAAEMEA

SEQ ID NO: 5371 - protein, 157 aa, Acinetobacter baumannii
RCAVYASVFSANIVWIIFIMMRTHYCGSLTEAQIDQTVTLCGWVHRRRDHGGVIFLDMRDRDGLVQVVIDPDTPEAFATADKARSEYVLKITGRVRRRYEGTENPNMVSGQIEVLGKEIEVLAASETPPFPLNDDTINVSEEHRLKYRFLDIRRPQM

SEQ ID NO: 5372 - protein, 198 aa, Acinetobacter baumannii
ASAVPNMKNFSLIAFAVCLSLQGCMQHESIAHEHRPHDWGTLVSQTHNFYQISNDVFRSEQPDVAMIPELKHHQIGTIINLRAKASDDLVFKNENFNLVHIPINTWAIDRQDLLEVMQQIQLAKQNNQRVLLHCYHGSDRTGASVAMYRIIFENWAIDDAVKEMKQGGYGYHIIWKNIDRLFTPENVKWIQQQLSNPS

SEQ ID NO: 5373 - protein, 87 aa, Acinetobacter baumannii
LPFFKVINYSLITTKLPFIILVFVYIKHKVKYKIRQPITFITLFRYQRILFLIIRFCPSFHCRYISDKNHHKTYLFHLFSTCFDSLP

SEQ ID NO: 5374 - protein, 249 aa, Acinetobacter baumannii
RNILNLRLIMSLLAFSSYALNGVDAQKFLQGQVTVDTERLAENETRYTAICDLKGRIHFGLWLKKNNAESFDIIVTQDQAEEFAKHIKKYGAFSKMTLSEQGAVFPKVVNGHTEFSSTETDISEWQKQAIMTGQAWIAQATEHEFQPQELRLHQREGVNYDKGCYLGQEIVARLWFKAKPKHWLHLVQGTGDAPAPATQLHNDVEVVNSTQTTDGYIALVVAKPAALQELGLQVLDLPEALSGDVARPQ

SEQ ID NO: 5375 - protein, 342 aa, Acinetobacter baumannii
MKILHIANFGFNKQGAHFYCTDRKISAGLIENGHFVYDFSFRDMARMGTIFKTKKLGAKWANKEVLKVVNNIEPDLVLIGHSDLMSPDVLRQIKESYPNTKIAFWYVDPLYLENKLDFVKAFSPYLDAIFCTTGGEYLQKLKQPHLSVAYMPNVGHRNVETLQQFSNSKTDKTFIFCGVVYKEPEREKFLKDLADALQQGHVNYQYYGCFEQPGVYGKAYYKVLSETKMGLNYSRRNDVTLYSSDRIVQLTGNGLLTFSPRIPGFEKLYTEQEVVYFDDQFDLAKKIQFFDQNPEQAEKIAKEGWEKTRKSFNAKRITQFMVEVTFKQPLSEDYEWSHEVYA

SEQ ID NO: 5376 - protein, 104 aa, Acinetobacter baumannii
VLSFYSPIHLFNNTIEPVAFFSHFVTYEVLNAYPQPPNLYHRLSFVFLFKIHTHAECEILPLQSTYQNKDTNGDILTNTPTIKPYILKTTENSSSPAGRTLLVN

SEQ ID NO: 5377 - protein, 70 aa, Acinetobacter baumannii
YSQFWDFERSRFWDFECTRFWDAEPINEPINESIISLLREHRLNSRSNLLPYSKNKLQKQLDICTNFALA

SEQ ID NO: 5378 - protein, 467 aa, Acinetobacter baumannii
ELKLQEYKDPLNLNQSYSFEVLVRNNDTNFAGKLNLSPEGCTLRIMGEREFTSDYYTIETFECYTSRNHFLLSEVKFKSGRFASLRLNNPRDRGRFFELEFTVGFVIKANTNTSLKKEAIFSGFSIEADMIRKWTGITNKQEDLLLQNSGSSFPSNADDDLKLFEIPLENIGFLYLAYSLNLHTDIDSMSSGVKLTPQLGAHFFECKNISLLLKEIRKIYALLSFFWGDDFTINNLKITLPHVRGGGASGYYASNYITNNKMSPILPLGFDVRSRYNSYEGLPLDLFQKYYNLEDSKVEYFIKYLRYKRMKSNEEKFLGYFRILERLVHTTGTYVDEEILKILLERSKKYLIKKLKSRSSDIRSLCNKIIKGNQGKYVTHDCISRFFDEIPEEIKVTMSFKRSDIQGICKLRNDMTHANDYIVSEEDLYQYTKFIHQLLIFALVNKLLGISLDILIPLSDRFKFSNI

SEQ ID NO: 5379 - protein, 475 aa, Acinetobacter baumannii
EGFSIYSIYLSLKNSPLRMFDLIIIGAGTAGISAYKEAVKYTNNLLIINDGPWDTTCARVGCMPSKVLISTANRMHDIQNAQEVGLSASADINTDQVMEHVRTLRDRFTKATVKDVEQWPTEHKISGKAHFIDAKTIEVNGKRYQSKSFILAVGSTPNYDQSWKQELGDRLITTDQIFELNTLPKSIAIIGSGVIALEIAQAMHRLDVETTIFARSKRIGIFTSPKLQQLAQEELSKELNFLFETLPHEVKSTSDGVILNYKIDEKEESIQTEYVLSATGRSSLLDTLKLENIDKSFKDIKLLPVNAKTKQLDDYPIFIAGDAYTSTPLQHEAAHEGKKVVYNCLNYPQVNAVKTLTPLGIIFSHPEMAIVGQSYKQLKDNGVDFVTGEASYERQGRAIVLGKNKGAIEVYIERESQKLLGAELFTEATEHMAHLLSWIIGEKLTLNDILEKPFYHPTLEEGLRTALKHARRQLK

SEQ ID NO: 5380 - protein, 230 aa, Acinetobacter baumannii
KPFSQAPIAENKKTLTQSVGMNADINRRLENLIRFGTIKTINPSKPIPLVTVDLDDIVTPEIRFFNARSGNDSTWDPPSEGEEVIVVSPCGDIGPTSIVFYGLYNNEYPAPSDDLNKKIRVFADGCVIAYDVAAHHLSAVLPSGGKAIVTADGGVTVNGDTTINGNLQINGSTAMTGNHTVMGSQLVQGSSHSTGAFSTEADVKAGDISLKNHKTSGVQPGDGESGGPIP

SEQ ID NO: 5381 - protein, 311 aa, Acinetobacter baumannii
ANISISKAISPDGFFYINEYTWFLLLRSVITSQEFVQKTKIMIHKIHHLKCGSMCPVCAPLFGQKGWKAEIVCHCLLVETDRGLVLIDTGFGLQDYLHMQQRLGSLVKRLGKIEPNLEFSAIQQIQKLGFHPKDVQHIFVTHLDFDHAGGISDFPHATVHVLATEYNAAQLPNFKGKLRYRTNQYKQHRYWNFVEYQQGEKWFNLEKVKGFPLFQDEILMVPLLGHSAGHCGIAIKQQNQWLLFCGDAYYSHLELNPANKLRSLSLLEKTFAEDNEKRLINLKKLQHLAQHEPTIEIICAHDPHELRRYQT

SEQ ID NO: 5382 - protein, 364 aa, Acinetobacter baumannii
TMISFFIEFYLVNYCIYLDRCLMQPIDFVMIWVDSTDTKWQQQYIYYKSKETKTKIDELVDQCRYRDWNNLHYWFRSVEKFCPWVRKIHLVTCGHFPEFLVKNHPKLNLVTHDQIIEPHCLPTFNSHAIEINIHKIEGLAEHFVYFNDDTFINSPLEPEFFFKNGLPCDGIQLQPLMVVGEENFLGAVALTDVAIINKYFDKRKLFRSNPSALFNHRYSISNNLGNFLSLYNRKFSSFYSTHLPQPFLKSVFEEVWRNEESYLKEVSSHRFRQPLDVNQYLFRLWQLCSARFYPVNIFQRGQNFNLRIQNLPEINHVIKYEQLPQICLNDDEHVVDFEKLKTEIIQIFEQKFNTVSSFEKKITH

SEQ ID NO: 5383 - protein, 163 aa, Acinetobacter baumannii
TMPSFDIVSELELFEVNHAVQNTQKEIATRFDFRGHDVSIELNEKNKEIKISTESDFQCEQVYNMLENHFYKRKIDVQALDPQKATASGKNFVQVIKLKDGLDSDTAKKINKAIKESGIKVQSSIQGDKIRVTDKKRDTLQQVMAFLREQQFGLPLQFNNFKD

SEQ ID NO: 5384 - protein, 337 aa, Acinetobacter baumannii
NCNSKINVIVQRWAMKQLKLWVLGLSMVLAGCQTTSHLSALKPQTAEAYSRFVDQPFAQLKKQHKKPVVALVLGSGGARGYAHIGVIEVLEQHGIRPDFIVGTSAGSIVGAIYASGKTPDELRDTALKMKAADVRDISIGLKGFFDGKKVEDYVNQQVNNLPLEKMKIPMYVVATELKHGTKTVFNYGNTGQAVRASASIPSMFVPTKIGKSEYVDGGLVSPVPVEVARDLGADVIIAVDILAQPIYTETSNVWGLFNQNINIMQGRLAAEELQYADVVIQPDLREKAHIFDVKGREATMKAGIDAANAKLSDIQFAIDEKIAEQNLSTDGLSAQTQ

SEQ ID NO: 5385 - protein, 280 aa, Acinetobacter baumannii
TQDSEMKKSKFFRVAVAGSTTDGRVIEATWIQQMAKNYSQDIYIALGNLEHFRSINPDSTFGTYAKVIALKAEEVEINGAKKWALFAQVDAYDELIELHKRGQKLFTSIEVNPNFADTGEAYLVGLAFTDTPASLGTQIMEFASKNPEANPFVGKKQDKNNLFTAAEEADLQFEDGQDAPAKGLFSKVLDWLKPQQEQQENQNKDQFKEVADSLEAIAKTFGENQTKLKKVDTSYSELHNKHSKLEKEFNDLKAKLEGEENPSTPSAPENTGNFSEQIEC

SEQ ID NO: 5386 - protein, 297 aa, Acinetobacter baumannii
KETSTMKLNGIIGYPVTPFSDDNNINLPVLKQMLDLLIENGCNAIAPLGSTGESAYLEWDEWCLVAKTSIESINKRVPVIIGISELTTNQAIKKAQIAQSYGADALMVIPVSYWKLTDQEIFEYYQAIAQETTLPIMIYNNPATSGVDMSPELIVRMFNNIANIMMVKESSGDIQRMHKIYELSKGELPFYNGCNPLALEALCAGASGWCTAAPNLLGQRPQQLIEHVKNGELEQAQKSFYQQLTLLRFIVSGGLPKTIKAGLQLKGVAAGAPRKPLTKATDIELNQLKQLLSEIEN

SEQ ID NO: 5387 - protein, 73 aa, Acinetobacter baumannii
NLKSEVKMKELSVYPVIYDQKVAWGDMDAFGHVNNVQYYRYIESSRILYMENVNILTPNIGRVKLEVRHKPPN

SEQ ID NO: 5388 - protein, 316 aa, Acinetobacter baumannii
GVLFDQPMLEFMKTLKIATRQSPLALWQAEHIRARLQELHPDLTVELVKFVTQGDKILDTPLAKIGGKGLFVKELEAALLDGRADLAVHSMKDVPMALPEGLTLAVICEREDPLDAFVSNQFEKFADLPQGAKVGTSSLRRKSQILKQRPDLQIIDLRGNVGTRLAKLDDGQYDAIILASAGLKRLGLAERIRHCIEPSVSLPAVGQGALGLECRADDQEVLALIQPLLHPETDVCVRAERAFNAYLEGGCQVPIAGYATLQDGKIHIEGRVGSVDGQTLLRAELTDEANNAQQLGENLARNLLDQGAGDLLKALY

SEQ ID NO: 5389 - protein, 310 aa, Acinetobacter baumannii
RKLFMINKKPRIPSPVQIPEHLSFLQGFRDYLVAQTVSPHTRNAYLSDLIQCSELHKKNRLPDWTSDDISDVLIELTKVGKSPRSIARCLSALRQFYKFLREQKLRSDNPVATHHSPKIGRALPKDLSEEDVEALIQAPDITTALGLRDRAMFEVLYACGLRVSELLNLRLELINLKQGYLRITGKGNKERLVPLGQYACDWVERYLNEARPQLYKSSTDYLFLTQHGGIMSRQNFWYAIKRYALQANIQAELSPHTLRHAFATHLLNHGADLRVVQMLLGHSDLSTTQIYTHVAQVRMQQLHEKHHPRG

SEQ ID NO: 5390 - protein, 261 aa, Acinetobacter baumannii
RPFTNAMLFINTRPDSRAAELTHALQKKGFQVESLPLLELVAQPFSESLSQLYQQLTGAQAIVVVSPTAVDVGMQYLTQSGLKIDELKHIQWIAVGQATANRLHDYGIEAHVPEVETSEGMLNLPLLHRMQKSGSVAFWRGEGGRQFMMETLQQQGIQILNFVLYRRQCPQASYSTFKHLTQNSNYNLDKWLVLITSEASWKYWLELCLKNKAQPDCVYLVLGPRLFQLVKDYRDQQQAHFHIIQLENLSPSGMIHHIQAL

SEQ ID NO: 5391 - protein, 220 aa, Acinetobacter baumannii
AMFTGIIESLGKVESLQSVGGDVRLRIQTDLDMSDVHLGDSIATNGICLTVIEWGDNWYAADVSRESLNRTTLGNWKVGQRVNVEKAMLPTTRFGGHIVSGHVDGVGEITLVREDARSIYFEVTAPVELAKYLAEKGSVTVDGISLTINHLRGNILSLNLIPHTAERTNIGTWQVGSKVNLEVDVLARYIERLLLGDKAAEQKTESNISMAFLAENGFLK

SEQ ID NO: 5392 - protein, 444 aa, Acinetobacter baumannii
SRYTLKVNPYARESMNSEPSVYHKRRHAARTTDEYLFHQLVPYLGNKRRLLHLILEALEITGTLNSKKKNPPIFADFFAGSGVVSRLARQNGYRVIANDWEPYSHALNHAILACVDAPAFKELGGYQKAIDYLNRLPEVKGWVTHNLCPRNDDVYDPSRDRLFFKRRNGMRIDAIRQQIATWQAQGAINDVEMSALLAPLLYSASFVSNTSGVFKSFHQGWGGRTQTALERIESLLWLTPSRFCEIGDRKRPAAEMWCVDAQHLANQMSGFEVDVAYLDPPYNQHAYSSNYHVLNALTLWDQVDLPPPDTKGYKSGIDRAWRKERPSPYNSSKHAKDAYEKLLSTINARYILTSYSTDGNIEPKDLLMANLERGKVTLLTQDVPRYRVSKQRQSERARVLEFIVITDTHAKPGPPLRQLLGQLYHFAELGGVDTSGNSTQLALW

SEQ ID NO: 5393 - protein, 222 aa, Acinetobacter baumannii
NVNTVEQRRTVVALNVGQDFKKRWLNAPEAVRHAYQQDLARICDLLEPQTPIQLWVLNDEKAQLESQQNIEKAYADLKAELIEQARIRRQLALEKALADKRAKEAAYAAELQADEVRKFSEQTEALQALRSHLEQEVAEHTARYQKNPETPAIDYSSGAKLSITDDQILSELESVRVRLELEAESLIEQAVTVFRAKLHAAAQEEIEYILKNSNFSDEKIEK

SEQ ID NO: 5394 - protein, 152 aa, Acinetobacter baumannii
FKGFMEYIKLSYHHLNFEDRTALMLESRKEGFSARKFAELIKRHPSTIYRELKRNSINDVYQAQYASDNTFARRRRGHRKLKIDSILWKFIVEAIRCLWSPQQIAKRLKTFPDLDQTMNVSHTTIYSTIRALPKGELKKDFLSVFTTSAASD

SEQ ID NO: 5395 - protein, 287 aa, Acinetobacter baumannii
LIKTGCIDPSSCFLFCLHLLNLVNWTGEEMKTASVNKHDLMQHAQQDMQKWISDLDLTDRQKLALTCRILFDHGHDAGLAGQITCRSENKETFITQRFGLGFDEITASNLLEVNQDLEPINQEGMANPANRFHTWIYKEHPEVNCIIHTHPTYVAALSMLQIPLMISQMDVCALYEDCSFVGHWPGVPVGNEEGILISSALGKNRAVLLSHHGQLVTGKTIEEACNLALLIERAAQLQLLAMSSGQIQPIPHALAAEAHDWVSTDKRNKVNFAYYARKALKKHSDCI

SEQ ID NO: 5396 - protein, 479 aa, Acinetobacter baumannii
ATMTTSSNPPNSAAPNQTSGMWGGRFSEATDAFVAEFTASVQFDQRFYKQDIAGSIAHATMLAKVGVLTEAERDDIIEGLSTIRAEIEAGTFEWRIDLEDVHMNIESRLTQRIGITGKKLHTGRSRNDQVATDIRLYLRDEIDDILGLLERLQKGLLGLAAKNVNTIMPGFTHLQTAQPVTFGHHLLAWFEMLVRDTERLQDCRKRVNRMPLGSAALAGTTYPIDRAYTAELLGFEAVSENSLDAVSDRDFAIEFNAAASLIMMHLSRMSEELILWTSAQFKFVNIPDRFCTGSSIMPQKKNPDVPELIRGKSGRVFGDLVSLLTLMKGQPLAYNKDNQEDKEPLFDAIDTVRGSLMAFADMIPALVPNVEIMREAALRGFSTATDLADYLVKKGVAFRDAHEIVGKAVALGVAEEKDLSELTLEQLQQFSDLITADVFDKALTLEASVNARDHIGGTSPKQVEAAIARAHKRLEQLYA

SEQ ID NO: 5397 - protein, 470 aa, Acinetobacter baumannii
GWGTRMKKMLMALSLTGALLGGTAAWAEETVTTPTSEVTATSTSEAPATIAAAPAAEETPAAPTPTAKLDTGDTSWILISTALVLLMTIPGLALFYGGMVRKKNVLSTMMFSLSAAILVSLLWVIAGYSIAFSGTGAYFGDLSKAMLNGVAFDALSGTIPESLFVIFQMTFAIITVAILSGSIADRMKYSAFMAFIAIWVLVVYAPITHWVWAADGWLFKAGALDFAGGTVVHINSGVAGLVAAYMLGKRIGLGRESMAPHNLTLTVIGASLLWVGWFGFNGGSALGAGARASMAILVTQVAAAAAAFSWLVVERMIRGKASVLGGASGAVAGLVVITPAAGFVGVGGALVMGLIGGVVCFWGITALKRLLKADDALDAFGLHAVGGIVGAILTGVFYSDEIIKAANVALAPTFAGQLWVQVEGVLATMVYSGIATFIILKVIDLIIGLRVNSDDERMGLDLSQHGERIE

SEQ ID NO: 5398 - protein, 306 aa, Acinetobacter baumannii
IENANMISLIKNSSYGGTIAILVASFLWGTTGTAAAFAPTLGPLAIGAVAMGGGGLLQALIASQAIREHRQFIGRNISIILLGVVAVGIYPLAFYSSMHYAGITIGTVVSIGSAPLIAAVLERFFDRKVLSKTWFLSFVLGVVGVSLLSMGESHAAQESTNEWNKIFGIFLGLVAGATYSLYSWAAKRLIDRGIAAKAAMGMIMGGGAVILLPTLLITGGGLLQSSTNLLVAGYMMLIPMFLGYLLFGFGLKTVNASKATTLTLFEPLVAAIFAIVLVGESVSWIGWVGMFLIFICILMLSKPENT

SEQ ID NO: 5399 - protein, 297 aa, Acinetobacter baumannii
KFIAFGDDSSHSGIIRIRMRKLVSIIILLGIAWVAKLSYDMWQISRTVPELQQSLLQSEQQYANLNDQLVALQRQIQNQPSHNSKTTPLATTEIVQTGIAPTVLIKQKLELIQFAIDQQQFIYAVDHLTQYQQTLPQYGIAPALQHSLNQALEQDKQAIQQFVLAQNQRHQLIDDLLQNIDKNIQQALKQPKFEMDQSEAVSWWKKWFRIEKVETPSINLMNRSVVLKEVQLRLLIAEQALNQGKMAEYQNELQTVMQKLNELPDATSQQLKTRIAKVAHLSVVPVPKLSTLGLIGS

SEQ ID NO: 5400 - protein, 72 aa, Acinetobacter baumannii
LASAADQFKLAVPVLPEDGLLTSSAKLVELKLSKIDMLSTCIKDFLEFFTAQYSTQGDTHLRLLSLCLTFEI

SEQ ID NO: 5401 - protein, 77 aa, Acinetobacter baumannii
KLSAVIPSEHSFPAMRLASQPVHPKVGHSGPLVLGADPFKIPTPTVEWDRPALPSFKPSLATFLNGQQPFPWEPALT

SEQ ID NO: 5402 - protein, 75 aa, Acinetobacter baumannii
YWSASHITMLPHPTYQRPSLERLFRGHKVLGKSYLEVGFPLKSFQRLSLPNIASRRCDWRHNRYTQRSATLGLSS

SEQ ID NO: 5403 - protein, 137 aa, Acinetobacter baumannii
VRMAKVSFYLFETSEERQVDSACRLCRKILLKHSQIWWYCPDVQLQQTLDEKLWSFDPTSFIAHGVDQVDAAVCISAKQPSEQGWLVFNFNNHALEQVNHFSHIIEIVENNEAAKQIGREKFKMYRRLGIEPRTFKL

SEQ ID NO: 5404 - protein, 487 aa, Acinetobacter baumannii
AITAAMKFTTYTTFPEQTSNESLWILVDSEQLQSNLNTYQINNLESILTATQFKANFNETLPLFGQLSTQPHSQLLGLGKAAELQAAKLAKLAQTIIKSAQNKFKHIAIDIAALPVEYHYLFALSLTQAAYGYDEFKSKKNEFVLQQVDLISSQTSLDENQLALVHAVQSGQSYARDLGNRPGNICFPEYLAEQALALAAEFPDLLKVTVLNEQQMADLGMYAFLAVSKGSERPGRIVTLEYQAQLEQAPVVLVGKGVTFDTGGISLKPGLGMDEMKFDMCGAASVLGTIRALCEARLPIHVVGAIAAAENMPSGKATRPGDIVTTMSGQTVEILNTDAEGRLVLCDTLTYIKRFNPAVVIDIATLTGACVVALGKVLSGLFSPDDTLAAELQQAGEQSFDRVWRMPVIDDYQELLDSPFADIANIGGPHGGAITAACFLERFTRDYRWAHLDVAGTAWLSGSAKGATGRPVPLLMQFLANRVSTNG

SEQ ID NO: 5405 - protein, 379 aa, Acinetobacter baumannii
CNLFKRYNLSNINFDKNIKMKKILMMSMCSALLLAGCNKTSQQDQTVSKEQKSTAQKATEQRDSSCLQIMVAMHTINQNSKIEDLNQINEKLKNCVPSLKNEEQLKLIDASTTMYQRFLKQDYTDKTARAFEAFGYAVLDQKQRDPKKVIQSQKKLFDQLSPRDQYLIQHEGQAYIELLYQGEGMFTYRRQPNYLVDVFSKALPADQKEFLSRMAKDNQDIFYNDGALAVSWKELTERALFWEKFIQKYPKSYFINDAKLLFNEYRYFIFFGLDNTPVSDEYASNTWFDPDALQQIRFLSTQSQSSLAKPAQQFLKFIATPVDERNKQFKIDLTDENGQKKSTYQIMHEQLEQLLKFDSPWNTQSYRDCHIDAVCIDTN

SEQ ID NO: 5406 - protein, 87 aa, Acinetobacter baumannii
RRLYMLQYLIIAVLVIWSAVVVFKKVFPKTANSAFSALSVFCEKQGWATLAKWLKPKMTFGCAGGCGCSSEDKPTNTVQEIKPVKWQ

SEQ ID NO: 5407 - protein, 262 aa, Acinetobacter baumannii
CELHINTEFCMTKLAKTFSAPRYNTLIGIVLACVMGVLTYFGLFYQQKAIAQDYPIQGFDVSHHQENINWKKISPQKFQFVYLKATEGGDYKDPKFQENWLKAREHGFHVGAYHFYRLCRDGKTQAENFIATVPNKADALPPVIDLEYDSNCINSHTKEQLLKEIGIMHDSLKHHYGKQPIFYISKTFYHIVLIGSFPNTPLWVRDYEGKPELKDKRKWLFWQHSNQGKIEGMTKPVDLNVYEGSVKEWHQFLQQQGIVKAQ

SEQ ID NO: 5408 - protein, 471 aa, Acinetobacter baumannii
KSIQNSKVLTFLPFCRLINCGAKMLIQRGGLKVVAGLGISGVSAVNFLHEQGYQVAVTDSRPTPPGHDQIPAGVKTSFGQLDQELLLQAEEIILSPGLAPQLPEIQAAIAKGISVVGDIQLLRRATDVPIVAITGSNAKSTVTTLIGLMAKDAGKKVAVGGNLGRPALDLLKDQPELLVLELSSFQLETTSHLNAEVAVVLNMSEDHLDRHGNMLGYHQAKHRIFQGAKKVVFNRDDALSRPLVPDTTPMQSFGLNAPDLNQYGVLRDADGTLWLARGLQRLIKSSDLYIQGMHNVANALACLALGEAIGLPMESMLETLKKFKGLEHRCEYVKTVHDVRYYNDSKGTNVGATLAAIDGLGAAIEVKKGKVALILGGQGKGQDFSPLRSSIEKYAKVVVLIGEDAPVIEQAIQGATKILHAATLKEAVELCQRETQAEDVVLLSPACASFDMFKSYNDRGQQFVACVNSLV

SEQ ID NO: 5409 - protein, 394 aa, Acinetobacter baumannii
MLQHNIYKAFFVSVLMCCSQLAFAAPVVKEKLSPLHADAPESEESYAEVPIESIQQFVQIYGIVRDNYVDEKSDDALFLQAIKGLVSGLDRYSRYLSAEEYRQLIQYTEGDLASVDFVLSPESHVHKWMIRDLKTGSDSYKLGLRNGQTILKIDNQELKNLTHDQVLGLLYGSIGSTLQVQTEESNSPISLVRNKKIETDIEPVMLHNQVLVLKIRVFQQDTANEIKRLIEENSSSRLKAVLIDLRNNPGGLLSAAVESADLFLNHGIIVSTKSRSEGNQQFQALPGNDFQNIKVGILINHRSASAAEVFTAAMKEHQRAWVMGEKSYGKGVVQKLFPLPSGAALQMTVSHYYTPNGNMIEGQGIQPNQTYPLPPEMKEEVYLDRVADLLLKRK

SEQ ID NO: 5410 - protein, 88 aa, Acinetobacter baumannii
TGEHKVIQQFGYLMLETLLQAILEQIDEPKKDLEKNLRALLNETVEKLDLVSKQEIERQKTALHLANQRLEALQKQVSLLEEALKNKK

SEQ ID NO: 5411 - protein, 229 aa, Acinetobacter baumannii
LYLKIRPPFGLRERAMLLTVIYIIAITAEAMTGALSAGRRSMDWFGVVLIACVTALGGGSVRDVLLGHYPLTWVKHPEYLVLTCCAAFVTIVIAKWMRHLHNIFLVLDALGLIGFTIIGCQIALQMGHGFVVSAVAGVLTGVSGGILRDILCNDVPFVFRRELYASISFVAVICYWVCLDLGLSLELTVISTLVFGFTLRLIAIYFGLEMPKFIYKDDDAESASSTDEH

SEQ ID NO: 5412 - protein, 753 aa, Acinetobacter baumannii
YTLKITTDLEDKLTMTSLAHHATENRSVAEFTEQAYLNYAMYVIMDRALPHISDGLKPVQRRIVYAMSELGLKSSGKPKKSARTVGDVLGKYHPHGDLACYEAMVLMAQPFSYRYPLIEGQGNWGSPDDPKSFAAMRYTEAKLSAYSELLLSELGQGTSEWQDNFDGSLKEPITLPARVPNILLNGTTGIAVGMATDIPPHNLREVVKGTIALIRNPQTSDEKLAEYIPAPDLPTKAEIITPPEELLKIQTTGRGSYRMRAVYTIEKNEIVITELPYQVSGSKVITQIADQMQAKKLPLVVDVRDESDHENPTRLVIVLRSNRIDAEAVMSHLFATTDLESSYRVNLNMIGEDGRPQVKSIRRILLEWIEIRKKTVTRRLQYHLNRIEKRLHILAGLLIAYLDIDTVIRIIREEDQPKPVLMEHFNIDEIQAEAILELKLRHLAKLEEMEIRHEQDELSAKAAIIREQLENPESLKNLIISELKEDAKKFGDERRSPIVARAEAVQIKEQDLMPAETVTVVLSEAGWVRAAKGADVDAENLNYRAGDQYLSHAVGKTNQRVYFLDETGRSYALPISNLPSARGLGDPLSSKLSPASGVSFIQVYLDDDESELIAASSAGYGFKTQTKQLDTNAKAGKTFLTVPDKAKALPLISAQNMTHLAVLSSAGRLLILDLAELPNLNKGKGNKLIQLEGKEQILSMTTLNLDEIIQVVAGQQHLKLKGDDLQKYMGKRASKGQLLPRGYQKANKLLIQR

SEQ ID NO: 5413 - protein, 529 aa, Acinetobacter baumannii
SSPNQIYMQFPLNSSLSHTIFRLGTWYGLYRLIIAVSLNIILVLTDAQTDNSLQQPALYSYTLLGYSLLSLVQLLCFKFIATQATRQLILFFIVDIICLSLLTFSVGEPNLQLSLLYVIAIFTSAILLSARMSLLITLLAVIAVIYQRFVGSLFDYNNLNTISNSALLAFLFFVVHRIGQIAVQRFKLLEALTFHQSIELYQLQNINRYILEQIEEGYLVLDENYDIVVSNPAACSLLGIPPQFANEKYPLAKWHADLFEILKFGDLKEGDRFIFESRLSAYSINIKVQHLLVPQQTLTLLILQDAQQINQQAQQLKLAALGQLSASIAHEIRNPLAAIVQANELLKDSDPEQQNTLRHMIGKQTKRIDSIVQDTLGLARSERTHPIQIDVRHFIDTLLEEDLFDVKHSIQLKISDSSLKFLFDEKQLRQVMINLVRNALRHNAPDSPYITINIHSQTNKIYIDVIDYGEGVSKRDISQLFKPFFSTEINGTGLGLYLSHSFCEANHAKLTYVEQKQGACFRIECPIIY

SEQ ID NO: 5414 - protein, 355 aa, Acinetobacter baumannii
KHNNMRKIIHIDMDAFYASVELRERPDLRHLPVVISSHHPRAVIAAASYPAREFGLRSAMSMSQARKLCPQVVIIEPNFEKYRAISAQIHSIFQQYTTLIEPLSLDEAYLDVTENLKQIASATEVAMHIREDIFRQTGLTASAGVAPNKFLAKVASDWNKPNGLFVIKPSQVASFIQDLPLKKIPGVGKVTQEKLQQLELHTLGDLQKIEEAVLVHHFGKYGQQLYLYAQGIDNRPVQAERARQQISKETTFDSDFTLAQCQPYWHGLAEKVWQSLEKKQLNARGVNIKLKLKNFQTLQHSKSFKNPIHSQQDLIQVLFLLLNEMHIPENFQFRLIGIGVYQLQTKADDFQLSLW

SEQ ID NO: 5415 - protein, 499 aa, Acinetobacter baumannii
WNNKMSFSKIYTRGLLGLHAPLIEVEVHVSQGLPSLTIVGLAEAAVRESKDRVRSAIINSGFQFPTKRLTINLAPADLPKDGSRLDLPIALGILIASGQLPENCTEDFEFIGELALDGHVRPVSGALTLAMACQQAQHKIVLPVDNSQDISHLPNLECYPVNHLKEVCEHFLGTQKLAHAQPSAHSNEMPYKFDLADVKGQLRPRRALEIAAAGGHSLLFKGPPGTGKTLLASRLPSILPPLSTQETLEVASIYSISNTPHTFGQRPFRAPHHTASAIALVGGGSHPKPGEITLSHLGVLFLDELPEFDRKVLEVLRQPLESKEIIISRAARQITYPANFQLIAAMNPCPCGYAFNQDSRCQCSPESIKRYQNRISGPLLDRIDLHIDVPPLKAQELQDPTPAEDSTTVRQRVIYAYEQQMQRQGGLNQALSPKQLEQHAVLDSTSQRMIEMAQQRLNLSARAYHRVLRVARTIADLAQSEVIQSPHLTEALSYRGNHS

SEQ ID NO: 5416 - protein, 212 aa, Acinetobacter baumannii
GENKAMNSVLTMAVNDSPITSVKTTQPLIALYCGSRAGNNPIYREKAIELASGIAEQGFGLVYGGASIGLMGQVAESVLAHGGEAVGVIPEFMLDYEVAHAGLTELHVVETMHERKAMMAERASAFIALPGGLGTFEEILEIATWGQLNQHQKPMILYNVNGFYNALIAQLDHAVQEGFLPLQHRAKLIVCEEIDQIYNVIKNLKMPKRFVV

SEQ ID NO: 5417 - protein, 291 aa, Acinetobacter baumannii
SLSNKICLSHINRAFIVGEIKMMKFALKAVTFGVLTAGSTMVMAEDAPSFYGITATGSVAATTDYRFRGITQSSNNPAIQGGFTFSHKSGAYVALWGSSVDFNTPGVSTETDISLGYTNTLKLSDTLAPTYDVGVIRYGYIGSDSKFTNPYNGDTGFDFTEFYGKLTFADSLFKGDALSVGVNYSNDYWGHSDEFWYFNVGYSAPIADTGFTGLASVGYNKLKNKDSLLVVAGGPGEDDSYIDYKVGVNYNILGIVAELDVVGTDISTSGMTDAQKKPYDTGLVFSLTKTF

SEQ ID NO: 5418 - protein, 63 aa, Acinetobacter baumannii
SLFNTNKFSSLLEHVAIYSVFMLPDASFISESTVYLLFDIHVVRADLSKHVYPCIFVDHHLLI

SEQ ID NO: 5419 - protein, 442 aa, Acinetobacter baumannii
GSLNMLKAQKLTLAVLISAAIISSAQASEQSEAKGFVEDANGSILFRTGYLTRDKKQGAKDTSSVAQSAIVSIESGFTPGIVGFGVGVVGDGSFKIGENKNAGNQMIPKHNDGSAYDHWARGGGSVKARFSNTTVRYGTQVLDLPVLASNTGRMVPEYFTGTLLTSHEIKNLEVVAGKFTKDQMSDQINTDADASGRGLDRAIVWGAKYKFNDNLNASYYGLDSKNALERHYANVNFKQPLANDSSLTYDFSGYHTKFDANAHTYSATGTVAPNYAADGIAGEEKTNNIWAISGTYATGPHSVMLAYQQNTGNVGYDYGQNADGFQSIYLPNSYMSDFIGNHEKSAQIQYNVDFGKLGVLPGLNWTTAFVYGWDIKVRNVTDDAQEREFFNQVKYTVQSGFAKDASLRIRNSYYRASDAYQGAYIGDTNEWRIFLDIPVKLF

SEQ ID NO: 5420 - protein, 219 aa, Acinetobacter baumannii
DEINRFRPDRIMSIVERPSYTSKDVEVTSREPLFSGFIQVEKVSLRHRLFNQSEYTPVLQRELVHRPEAAGVLLYNDQKQQFALIEQFRVGALDDSHSPWQLEIIAGVLDGNESPESCIRRESLEESGCEVQDLEHLFSFYPSAGACSELFHLYVAETNLPAVGGVFGVDNEGENIQLHLFSYSEIQTLLDSGRLRNAPVIMALQWLAQHSKTIINPKR

SEQ ID NO: 5421 - protein, 61 aa, Acinetobacter baumannii
HDQKHPYLPMLLSGRILQGRQTVLSFLPQILNFKKFASFSKIRFNCLINSSSSFKVDLIRK

SEQ ID NO: 5422 - protein, 383 aa, Acinetobacter baumannii
GDLKMWSWWLSKIKKSISLAEAQQTKLFSTAYRNQNSSYFFTKIDRWQHLLELIIASNVLALVLALAEAQSWHALNGSRLLQYIVFINWVILSFFALVEHFQDFFSQLQQKYALVIGFVMLQAIVVVTTIISNFFQFGVLKKTSVIAQEWSIYFTNVPLYLSYGILLGAFCLRYLYVREQWLHQQYAELNARIQAMQARIHPHFLFNSLNNVVSLITIDPDKAESMLISLSRLFRASFQELKLVSLHEEIELSKQYLMIEQIRLGERLKVEWKVEIEPLQLKQVTIPLLTLQPLLENSIFHGVEPMMGKATIGVLVEILQNQVSIVITNPYTHDTINSRKGHGIALENVKQRLKAYYGNSVRFQVYKGEALYTTIMSYQYQSK

SEQ ID NO: 5423 - protein, 521 aa, Acinetobacter baumannii
TKEKLIMTDATAGKIPHVLVIMDGVGHREAIEDNAFLAAKTPNLTAMKAKHPNSLISGSGEDVGLPDGQMGNSEVGHMNLGAGRVLYQDFTRITKDIRTGAFFEHEVLVDAVEKAKAAGGAVHIMGLLSEGGVHSHEDHIVAMCELALKRGAKVYLHAFLDGRDTPPRSAQPSLEKLDALFAKYPNQGRIATMIGRYFAMDRDNRWDRVEQAYRLLTEGEAVRTANTAVEGLELAYAANENDEFVKATRIGEIAKVQDGDSVVFMNFRADRAREITRAFVEKDFAGFERKVVQNLSKFVMLTRYQASIDAPVAYMPEELKNSLGEYLSSLGKTQLRIAETEKYAHVTFFFSGGREDEYPGEKRILIPSPNVATYDLKPEMSAYEVTDELVKAINSGEYDLLVVNYANGDMVGHTGVFDAAVKAVEAVDTCLGRVYEAVMAKKGHMLITADHGNVEQMQDYESGQVHTQHTTELVPFIYVGPTQATIAEGGVLADVAPTILNLMQIPVPAEMQGRNLITLSA

SEQ ID NO: 5424 - protein, 83 aa, Acinetobacter baumannii
GNLDEHVRRLGPSRFEMDLKYLKVHLSFEAYGGQSILISWQMGGDDKPAKQDDLQIVQVNSLNFLIVPKTDDHLLFPLLRYLA

SEQ ID NO: 5425 - protein, 187 aa, Acinetobacter baumannii
YVYDEECPIMANDNHNQVLDEHTEVVVEGDKASAKRARKVKPKTSDVGSTASLFGIAPYQPKKNEEYMSEGQLEHFRQILQAWKAELMSEVDRTLNTMQDESTALPDVNDRATQEEEFAIELRTRDRERKLIRKIEQSLEAIKNEDYGFCETCGIEIGLRRLEARPTATLCIDCKTLAEIKEKQNNG

SEQ ID NO: 5426 - protein, 441 aa, Acinetobacter baumannii
FNDDMECDVKPVRLAILGLGTVGGGALKLLQENAAEIKRRTGREIQITHVGTRRPRPDLELEGIKQSADLLDIVRQPDVDVVVEVMGGIHPAYEIIMEAIKHGKQVVTANKALLAEHGNELFKAAEDNAVQIAYEAAVAGGIPIIKVIREGLAANHIEWLAGIINGTGNFILTEMREKGRAFDDVLKEAQELGYAEADPTFDVEGIDAAHKLTILASCAFGIPLQFDKVYTEGISKITAQDVKYAEELGFRIKHLGIARRAEKGIELRVHPTLIPDEQLIANVNGVKNAVLVQANAVGPTLYYGAGAGAGPTASAVVADVIDIVRDISYTEDGAGTIPQLAFEALTNMPILSREEMTTGYYIRLNAEDQTGVLADVTTILSRAGISIDAIMQQSRLKDLIPIVILTDPIVESKMDDALAQIQALPAIRGEIVRIRLESLDS

SEQ ID NO: 5427 - protein, 164 aa, Acinetobacter baumannii
AIFLFEKYQMTQQTCPCGKGSYAECCEPLHLGTAKALTAEQLMRSRYSAFALQQIDYIVQTTALGQQTALDKEAIAEWSKQNQWLGLEVVNAKEKLDKTHAQVEFKAHYHDGKSAQIHHEVSHFVFHQQQWFFLDPTVDMQVTMKQPCICGSGKKFKQCCAQFL

SEQ ID NO: 5428 - protein, 477 aa, Acinetobacter baumannii
VFGEMAEQQPLVLLVDDEEDLCLLMQMTLARMGIKTHLAYRVEQAKQLFTQFHYDACLTDLNLPDGSGIDLVKHVSQNYTNTPIAVLTAYGNMDIAIAALKAGAFDFVSKPVNQVHLDQLLQKALNRQKVEHDATENALENKLLIGRSLPIQQLRIAIKKIARSQAPVFVTGESGTGKEVVANLVHRLSNRSEGPFIAINCGAIPTELMESELFGHKKGSFTGATQDKQGLILSAHGGSLFLDEIAELPLSMQVKLLRAVQEKKIRPVGSDQEIDVDFRVISASHQDLDLLVRQGKFRQDLFFRIHVMDLILPPLRERGEDVLLLANHFIQKICMDWETPPKQLTEAAKTYLLQQHFPGNVRELRNMIERAITLSEDATIDVSHLHPAPLRANISNPFASAAQSIQTTVAAPQVVKKLPSEGLERYLENIEKDILLNALNMTHWNRTLAAKKLGMTFRSLRYRLKKFGLDTETEQEV

SEQ ID NO: 5429 - protein, 353 aa, Acinetobacter baumannii
VEYCAVKNSKKSLMHVLSMSILLSLSSTSFAELVNNPSSGSTGTASLNWSAADASQLLNDEDDEPTPQGSTSVTTTLRGSNAPRVITSAPKVAPIRDTVGYNAQPSVSARAALVMDAQTGEVLYSKNTNASVPIASITKLMTAVVTADARLNMSEEITLEQIDFAGAGGKNSSSTLRVGDKMNRAEVLLFALMKSENPAAAALARTYPGGRAAFVAAMNAKARALGMNATHYYESTGLDPRNVSSARDLGILASTASQYGLIRQFSTTPTYDFNLGYRVLKSNNTNALVRNGGWNINLSKTGYINEAGRCVVMHTTVNSRPAVIVLLGEPSTQARNNDATNLLGWLSNLPKRI

SEQ ID NO: 5430 - protein, 256 aa, Acinetobacter baumannii
SFYRHNCAQLFAHYRRIGLLILSFHCKLILLYVTKNLFFERKEVFLITVLVVDDHELVRTGICRMLEDHADVEVIGQAESGEEAIAIVRQQHPQVVLLDVNMPGIGGVETTRRLLQTAPETKVIAVSGLAEEPYPSLLLKAGAKGYITKGAPIAEMVRAINKVMQGGKYFSADIAEQLASSYLSDTQQSPFDSLSEREMQVAMMVVNCISAQEIADKLFVSVKTVNTYRYRIFEKLGIDSDVKLTHLAIRYGLIKP

SEQ ID NO: 5431 - protein, 246 aa, Acinetobacter baumannii
MKVLICDDEPLAVERLSRLVSKMGHEVVATAHHGQDALEQARLHHPDVILLDIQMPGMNGLVCAEQLSQLNPRPAIVFCTAYDQHALEAFKSQAQAYLLKPIDPQELEQTFKQLTQLTQAQLSALPKPELLQDLKTQRHQIAAKTYRGVELIPVENIYYFLADQKYVTVRHKNGSVLIDETLKELETEFADQFIRIHRNALVSIAYLDGLELVSSGQYQVRLRGLDERLSVSRRHLSTLRERIHQL

SEQ ID NO: 5432 - protein, 112 aa, Acinetobacter baumannii
RHSRSLKGSLSNFTCSYQAWLKFSHPHIIYKHRLSNNQVQLVRFLGFIIFHYTFYIKNAQKSHHMIYPLTLKIKKALKQSLFYRYPRAFDFGLLLPPNGLFSPVSRGGRPVC

SEQ ID NO: 5433 - protein, 539 aa, Acinetobacter baumannii
NPPSTGAGSMIFEWMSDPSAWVGLATLIVLEIVLGIDNLVFIAILAEKLPPEQRTKARIVGLILALGMRLILLASIAWVVTLTQPLFHIFSHPFSGRDLILLFGGVFLLFKGTMELHERMEGKQLHKEDNPVHAAFWMVIVQIVVLDAVFSLDSVITAVGMVKELSVMMVAVVIAVGIMLWASRPLMDFVNKHPTVVILCLGFLMMIGFSLVVEGFGFHIPKGYLYAAIGFSILVEMINQTMRRNQEKLVTTTDLRYRTASAVLRMLGSKNSGSTSDAQTADKEDVLATQAFADEVFDEENGAYHSVLVQGVLGLSERPVKSVMTPRPELEWIDLDEEPEVLKERLMSMTHSRLIVARGELDNIEGIALTHKVLNGFIETGVIDFQKHLREPVIVHENAQVLMVMEQLRQAPLQMAIVLNEYGSIEGIATPIDILEAIAGEFPDEDELDAAAESLEDGSLILEGSTDIRHVSLLLGRDLVDESEQYSTLSGYLLFHLGRLPENGETVEADGYRFEVVTMEGHKIEKVHIVSIEQDESKD

SEQ ID NO: 5434 - protein, 812 aa, Acinetobacter baumannii
NDRLSSLDVSPPSASRDSQAMSTAYTMQTAPKALFDYDKYWASCFEPAPFLPMSREEMDQLGWDACDFILVCGDAYIDHPSFVSGVIGRVLEAQGFRVGIIAQPDWTNVESFRVLGKPTIAWGVTAGNMDSMINRYTADRKIRSDDAYSPNNEPNKRPDRAATVYCQRCREAFPDVPVLLGGIEGSLRRIAHYDYWSDKVRRSILMDSKADMLMYGNGERAIIDVMHRLAKGEKIHEITDVRGTAFIINKHNKAAKAKFVEIASNDVDTIGRVDPIINPYVMTEDIDGCEIEKDKGNTLAQYQGFQKEIVANPIVREGDQLDENTQIVQLKPAQSKAIKHKLPPRELAVIRLPSFEEVANDQVLYAHANRILHLETNPGNARALVQRHGERDVWINPPPIPLTTEEMDYVFDLPYARLPHPAYGDARFPAFDMIKFSVNIMRGCFGGCTFCSITEHEGRIIQNRSEDSILREIEKIRDTAPNFTGIISDLGGPTANMYRLHCKDPEIEKNCRKPSCVYPGVCQNLHTDHAPLVQLYRKARAIKGVKKILIGSGLRYDLAVLNPEYVKELVQHHVGGYLKIAPEHTEQGPLSKMMKPGIGTYDRFKQMFDRFSKEAGKEQYLIPYFIAAHPGTSDYDMMHLAIWLKKNGFRADQVQTFYPSPMATATTMYYSGKNPLAKVARYTENVDIVKGEKRRRLHKAFLRYHDPNNWPLLREALKEMGRADLIGNSKQHLIPTYQPKGAEGEYKSARKKNSTVAGDSVKRSGQTVQNKNQHKRPQKGQVLTQHTGLPPRETGEKRPFGGKSKPKSKARG

SEQ ID NO: 5435 - protein, 132 aa, Acinetobacter baumannii
FIGLCMQQPDQKELFEVLEKQKKNQLQVDRIFKIVLPIVAFLLSVICANFNWQSTLGTFVILTVTFIAVGVKRLPLWHWLIVITIYCLVDNYLSYGQLDVTHLRLQLGTMLVFVGMVGIGRPYVDRWFMKNH

SEQ ID NO: 5436 - protein, 372 aa, Acinetobacter baumannii
PFGSINLIIRRYLVKQVVSTSLVVIALLTLIMMGGRLIKYFGVAAQGRLDASILFSIIGYRLPEFLTLILPLGFFIGLMLVFGRLYVDHEMAVLNGSGVSRHQLARLLIPMTLVYMVCQSVLMLWMTPWGLREFEKLTTTQAVRTGFDLVRPREFISSGPYTIYAGSLSEDRKNLKDIFFYQRAAKEGKPDVMILAKEATRVEVANDTANVVDLVQGRRYEIFPGQPKYTQAEFQSYRLRLENDKDVKFESGDVEALSTSKLFSKANDPVVRSELGWRLFGPFTIIIALMLSVALSEVSPRQGRYYRLIPSIFIFASLIVLMIAIKTRISKGELDIWAYPVALLVYAIAAALFSRKQKLGPKIKKQIKRVKL

SEQ ID NO: 5437 - protein, 124 aa, Acinetobacter baumannii
NLTGEKKPKETNMKLVTAIVKPFKLDDVREALSDIGVQGITVTEVKGFGRHKGHTELYRGAEYVVDFLPKVKIEIAISDEMVDAVIESITRVASTGKIGDGKIFVTNLEQVIRIRTGETGPDAV

SEQ ID NO: 5438 - protein, 491 aa, Acinetobacter baumannii
KTTGWINTSSFYKLYGPDGANMLRPWQIHFRIDEREEKTVFLKLTNLISQEILSGRLVQGTMLPGSRSLSKELGINRKTVQAVYEELEAQGWLVTRPRKGTFVADVLPEKKPQIEPRADRKVSDKPIIQQVAQQPHNDGVPDPRLIPYELFSRAYRHALIKITQNQYMGYGDPRGMAELRQALKQMLSMERFMNVAEDEICVVRGSQMGIFLASRALPNRQGVIVVEELYYPSAFKAFQSNGFQVVSVKLDEQGIVIEDLERILKEHSVAAIYTTPHHQYPTTVTMTMSRRLQLLELSKKWGFYIIEDDYDHEFRYDSRPMPPLASLPHSELVIHVGSLSKVFAPGIRLGYIVAAPTIIQTITEDILLIDRQGNNITELALADLMQRGEIKRHIRKMKKIYQLRRDHALAEFQRVFAESIEIQPPAGGMALWVKFQKSFTQDQLIKLKELNIDTEQKFKQKECANHCIRFGFAALSEKEITSLIETLNEAL

SEQ ID NO: 5439 - protein, 633 aa, Acinetobacter baumannii
SRSGKNRNSSRRRSTRMSDALRIALVGNPNCGKTSLFNHLTGTRQKVANYAGVTVERKVGHFQLPSGRSVRVLDLPGTYSLNATSPDEAITRDVCLGKIAEEGQQDAFLCVVDATNLKLHLGLVLEMIELGRPILLVLNMMDEARRRGIQINTQKLSQRLGVPVVETVAVRNAGIENLLHALDQEKYSVPQTELSGLTGTHHQKIDMIFKDVVHYVDQEDKRTDFLDRIFLHPVLGLLSLAIMMFIVFQAVFAWAAPFMDGIEGFFGWLGEVVGSVITQPLLHSLVVDGIIAGAGGVVVFLPQILILFFFILVLEESGYLPRAAFLLDKLMFQAGLSGRAFIPLLSSFACAVPGIMATRSISDPRDRFTTIMVAPLMTCSARLPVYALLIAAFIPEKMVWGIFNLQGLVLFGLYMAGIVSALCVSFLMKFFQKDKSQHALLLELPSYRFPDLKSVGIGLLDRAKIFLKRVGGIIFALSILLWFLCTFPQPPEGATLPAIDYSFAGMLGHLIQPLFAPVGFNWQICIALIPAMAAREVVVAALGTVYALSATDEDAVAQGLSHLISADGTGWSLATGLSLLVWFIYAPHCLATLATVRRETGSWKHVAAMTAYLFGLAYFASFVTYQIASHYWG

SEQ ID NO: 5440 - protein, 276 aa, Acinetobacter baumannii
IRRGRTVTFQVSTLSQKNHVIIQITDTHLLEYPQLEFVGMNPEESFHAIIQQILKQHPEADAIIHTGDLAQAPTPITYKRYINFMQTLGLPFFQTLGNHDNVDHFPLHNENHQQPVVVGLGNWRVIMLNSAVKGKVDGHLSSEQLENLANLLEQFADHPVLLACHHHPFAMKSKWIDHHKLQNSNALLDTLSPFQNVKALVCGHVHQDSLNIWQGIEFFYTPSTSVQFKPFSNDFALDQNAPGYRYIRLNNDGSFETKVFRLENFKTRINTDISGY

SEQ ID NO: 5441 - protein, 80 aa, Acinetobacter baumannii
LCLGFNAAAKVYFKLDAIYFKYLILLFLYLFIFNVNSIFYFTSLFLLSCLTDKPIMIQNYSKSNKDITCLLIHNSQHPII

SEQ ID NO: 5442 - protein, 139 aa, Acinetobacter baumannii
SQEGIMDISEVAKKAKVTTATLRFYEEKGLIKSIGRQGLRRQYGKQVIDQLALIALGRAAGFSLNEIATMFGQDGKLDLDRQKLKDKAEQLEQMAKRLHFISQGLEHAAVCPAENHMECPTFQKFLKAAIAGEYQPTKL

SEQ ID NO: 5443 - protein, 120 aa, Acinetobacter baumannii
SIFMTVKRLHVTSRYCEVAISGNLVHLAGQLADDTSVDITAQTQQTLDNIDRLLAEAGTDKSHILSVMIFLKDIDKDYAAMNTVWDAWISKEHPPARTCVESKLYAPDVLVEMTVVAVLP

SEQ ID NO: 5444 - protein, 274 aa, Acinetobacter baumannii
GLSMSFTRSQIFLACALASSLLFSACSKENKPQKEDALTATAPATGEASTIIERNAKQRLIETLQKQFKNANINVKILDIKPTEVPNLYWVNLEGMTSVYTTSDGKYLIQGDVIRLGGKELHNIGDSLQASENKKHLAALKNEDLIVYPAKGGKAKHVIYVFTDASCPYCHKLHEHLAEINEKGIEVRYIAWPRGEQFMPTMEAVWCSADRKAAFNQAVQGISIPPAQCKNPVREQYQLGLNMGVNGTPAIYNVDGEYLGGYLTPDELIKRLDK

SEQ ID NO: 5445 - protein, 196 aa, Acinetobacter baumannii
VKAMNDRTARQKILDAAATLFYNDGITATGINTVTAKADVAKMSLYNNFSSKGELVDAYIAARHQEWLDLYQKRLEKTKTAKEAILAVFDAYQDHAEFAYEKGFRGCGLLNAAAEFPANSSGRNAVRQHKEQVEAIVAEHLNHLLKDSQRVSYIASQLSFLLEGSMARAGLEGSSRQLQLARQMAEDILDRECQHD

SEQ ID NO: 5446 - protein, 456 aa, Acinetobacter baumannii
QFYIWSCPPILSSRVNPMDLVSRIQNLPIGKFHYTLLWVVGLGWMFDAMDTGIIAFIMTTLVKDWSLTPAESGWIVSIGFVGMAIGAVCSGALADRFGRKTVFAMTMAIYSIATALCAFAPDLKWLLIFRFIVGLGLGGQLPVAVTLVSEYVPAHVRGRFIVLLESFWGLGWLVAALISYFIIPKFGWHIAFLIGGLPLIYILVIWKKVPESIPYLINRGRIEEAHALVQKLEAEACVQIVHHIEVVPVAMRQKVSFKQLWSGQFARRSLMLWLIWFGIVYSYYGIFTWLPSLLVKQGYDIVKSFEYVLLMILAQLPGYLAAAWFVERLGRKITLAAFIGFCALSAYFFGQADSVNSIMFWGCLMSFFNLGAWGVLYTYTPEQYPANIRAFGSGWASAMGRIGGIVAPMVVTHMMIAKNGFNHVFMMFTVVLLAVALVILILGEETQGKRLESIGL

SEQ ID NO: 5447 - protein, 400 aa, Acinetobacter baumannii
GGHMKHLLWVYFLISLVLFAALALFSYGYGMGYVYIYWRQLQLQTNVWGLVFTFIVMSFIAQVIWLWIKRYSSREQRKRENIFQFKNLHPYEQLGIVWLLEAAEDQRVFIERVFTQSGLLKNIIDAKFLVLSGDYQKALEALDQSPPMAFELAELQRIEIFLAQNEAERALTHLEFLYQHQLSPWLEEIETAYQQRLTALWGQLALQQPWVYLRSMKYGLLDAEHRDLWLQQLLQQFDQASIDDLQALQQRYLDLESEIQTRPYSSKLLWLKLLARMPEMSIQHEVLTLHLLKEQFDPDVFYLWFQQQLLKQVPDYADVEEKINQFESQYMNLPVLTFAKWHVYMATGRQAEAEILLSLYPDNILMSYLRIKSTLKEDDELIKQLNLIFENDANFLKFKI

SEQ ID NO: 5448 - protein, 401 aa, Acinetobacter baumannii
ECSMAGLAQTTIQKINHWYERILPKWPAEVTPRNVLIFCVVALLCIGSVMVASASMPYAEYMHENPFHYVIRHGISIVAAGVVAYLTYRISLNTWFKNTFPLWLLTMVLLLAALAVGSEVNGSTRWIKIGGFTLQPTEVAKVMMAIFTADYVVRRAKEVRTHWKGLLRLSGVMAITVGLIIAEPDLGATVVIVMMMVGVFFLAGAPPTQFLIMLGAIVTGIVFLILFEPYRFQRLISFTDPWADPLGVGYQLSNALMAFGRGEWFGTGLGHSVQKLSYLPEAHTDFMLAVLGEEFGFFGISIVIGLSFLMLACCIKIGHRALKHHYLRAGYLAYGISIIFLLQILVNAGMNMGLMPTKGLTLPFISYGGTSLMMCAAMISLILKIDASTQEVNPEREESNF

SEQ ID NO: 5449 - protein, 180 aa, Acinetobacter baumannii
RKSIDMSYSNIPAGKDAPNDIYVIIEIPANAAPIKYEIDKDSDALFVDRFMGTAMFYPANYGYVPNTLSEDGDPLDVLVVTPHPVAAGSVIRCRPVGKLNMEDDGGIDAKLIAVPHEKLSPLYKDVQEYTDLPPLLISQVEHFFSHYKDLEPGKWVKISGWEGADVAKAEVLKAIEAAKK

SEQ ID NO: 5450 - protein, 335 aa, Acinetobacter baumannii
GYNMSTDPQFPTPNNLGIAVYSNNAEAIGNTPLVRINRLIKTDATVLAKVESRNPAFSVKCRIGAALIADAEKRGALKEGMHIVEPTSGNTGIALAFVAAAKGYSITLTMPASMSLERRKVLKALGANLVLTEPAKGMKGAVDEAVRLATEQPEVYFLPQQFENPANPQIHVDTTGPEIWQATGGQVDILVAGVGTGGTITGISRYFEQVQNKPLYSVAVEPAESPIITQTKNGENITPAPHKIQGIGANFIPKNLDLDLVDEVLPVSSEEAIQWARKCATQEGILVGISSGAALAAVAKIAERPENAGKTIVVILPDSGERYLSSVLFEGLFDE

SEQ ID NO: 5451 - protein, 73 aa, Acinetobacter baumannii
EMDIPHQISTQIEQLNQGEQWTFSAQELYMSHNDFNSLSILLTRASEKGEFSITRTQHNKPWVGTHSVTLTKH

SEQ ID NO: 5452 - protein, 258 aa, Acinetobacter baumannii
CVLMLNHFIPAPSCWRLPLSPSNPVLSHHISSQFNEDLQDVNTKFMTMGGLVEQQVANAIHSLLDTDANLAIDVQFKDNAVNQYERDIDEGLTLILARRHPAAIDLRMVIAMSKANTDLERIGDEAAKIARIAQNLCEEGGSPRGYMETRHIGNQVRVMIHDALDAFARLDADQALRVLLADADIDREYQSATRTLMTYMIEDPRHIARVINVMWVLRSLERIGDHARNIAEQVIYMAKGFDARHTKIEEIEAKVHEK

SEQ ID NO: 5453 - protein, 430 aa, Acinetobacter baumannii
ICLIFYQLYKIMSKKTLIALLCCASLGLTACNDDNDQDQTSPTENVTEPTLISFAKLPVETYAAGPDSGAYVKGANGIYPPFKGQPVQGFSAALKNEDGSYMAMADNGFGTQDNSSDFLLRIYKIKPDFKTKTKGTGQVTVQSFIQLRDPYKLIPFNIINGNTPERLLTGADFDPESMQRTSDGTYWIGDEFGPYLLHFSADGVLLDAPIPLPNPLNPTQELRSPQNQFNKAQINFVEPLVQQSGGFEGMAISPDGQYLYPLIEKPIKSIRETERQLLISQFDLKKKAYTGKYYWFQLDSKATNIGDFQLFNNNEGIIIERDATQNNLGGYKKLIRIKLNESGQLVSREDLVDLIKIANPNMLYGTARAGDIGTGQVFAFPFETIEDVIIENGTTLTVFNDNNFPGSTGRNAKLADDNEIIQIRLPKALF

SEQ ID NO: 5454 - protein, 162 aa, Acinetobacter baumannii
VKVIDPIKSAMHCPFCNAADSKVIDSRLAAEGCQIRRRRECVSCGERFTTFESYEVVMPRVIKSNGKNEPFDEAKLRRSLMHALQKRPVTQEQIETVLSDIQLQIRRLGERDVKSRTIGEIVMQSLFALDHVAYVRFASVYQDFQDVEAFRRQIEQMQQREH

SEQ ID NO: 5455 - protein, 188 aa, Acinetobacter baumannii
IVQIEFSSMQFKIIAAQDLDRNQRHQIAELCFSAFDEDPWSQYTFMQKAIHVVGILNNQIVSHALWTDRVFTINGRSDVKTAYVEYVTTDYTMRGKGLATQLLKYLVETLTHLEYGLAALQPEDEAFYEKLGWTVWKGNLSIKQNTCSYLTDEYEIMLYPLNIQMKDQLSNSSEEDTICADWREGELW

SEQ ID NO: 5456 - protein, 92 aa, Acinetobacter baumannii
GYKMSRQVFCRKYQKEMEGLDFAPFPGAKGQEFFENVSKQAWQEWLQHQTTLINEKRLNVFEPEAKKFLEEQREKFFNNDESVEKAEGWKPE

SEQ ID NO: 5457 - protein, 179 aa, Acinetobacter baumannii
SSKIIIKNLKDGPMYYLITILLLFLTVVMAAKSLSRKHQQDSALKRRAVLSSHEQMTLTRLQTVLPKFTVLAHVSFDALLTTKYAHTRRKYQNMTADFVVLDQNYQVVVVVMLEESGLRRAHQQYERRLLQLAGYRVLSYSTVPDYHELRRDLLTPESEMATLHATPQLERISNAFVKS

SEQ ID NO: 5458 - protein, 449 aa, Acinetobacter baumannii
TMKIKLMLVAGLWSFTSSSFALDLVETYERAKLNDPTWQANQQQFEADQLNLGLATGALLPTVTLSGNITRNRQTVKRSNFPGVDQEGLSDALVSNTSTTKQATLSARQPLFRMDAWEGYKQVKTSVALSEITLKLQKQDHVLNVAEAYFNVLRQQALTAAYLQEEKALLEQLNMMNAKLKEGLVARSDVSEANAQYQNARANRIATNVQLLLAQEQLSEYIGPYQDKLAVLRGDFIFQKPYPAQLDEWLGLAQQQNLKIQQARLQKRYAEDQRRVEKAALYPQIDAVASYGYTKQTPETLISTDGKFDQVGVEMNWNLFNGGRTRTSIKKASVELNKAQAQLDAAIRRANVDVKSAFMQVDTDRAKLEARKAAMDSSALVSQASKASYNEGLKSMVDVLLAQRNAFSAKQDYLNAQYDYLLNVLRLTAAVGQLGEKDLVELNSWLTYQ

SEQ ID NO: 5459 - protein, 361 aa, Acinetobacter baumannii
ASEIIMLARRIVAKYVTKTTALAMFGTTIVLSVLQILFTYLGELGELKPDYNAWQAFIYVLWGAPRYLYEILPISALIGAVIGLGALASNSELIVMRSVGISLWRIVGWVMRSALLLIVLSFALSEWVVPYTNEKAQSVKSHRSVAALGEVKGYWSREGQRFIYIDYANSQGNLRDIQVVDFNKDYHLQSLINAEQGKFIQDGQWTLQKASQMDILTDGNSILNNHDQQSLGLALQPKYVHMVTLDPEDLSPSQLISFMRYMDEYSQVPKTYQLAFWQKVASPFSLITLVLVACSFIFGPLRQQSMGFRLVIALFIGLGFYYLQDFLGYASLVYAPSPAWFVLMPIILMFGAGSYLLYRAR

SEQ ID NO: 5460 - protein, 568 aa, Acinetobacter baumannii
GLRIGDNGIMEKIWFAEYQKTGIPETVALPAENTSLVDIFERNFQKFGSRDAFIFMDKAMSFNELELASRKFATYLQNLGLAKGTRVAVMMPNVLQYPVVALAVLRAGLVLVNVNPLYTARELEHQLNDSGAEVLVIIENFASVYQSILGKTPVKHVVVASVGDMLGTLKGTLVNFVLRKVRKQIPAWNIPGHVKFNSALNKENPSNYKRPTLTLSDTAVLQYTGGTTGVSKGAELTHRNLVANLLQCDGIFQSKFGANDGAKGDRIVCALPLYHIFAFMVCAMYGMYKGQANILIPNPRDLPAVIKELRKYQPSFFPAVNTLFNALVNNEEFKQLDHSNLKMAMGGGMAVLPSTAEAWKKITGTTIIEGYGLSETSPVATANPPASTEFSGTIGIPLPLTEVAILDDDGKEVPLGEQGEISIRGPQVMKGYWNRPDETAKVMTADGFFRTGDIGVMDSRGYVKIVDRKKDMILVSGFNVYPSEIEEVIAKHPKVLEVAAIGVPDEKSGEVPKLFIVKKDPSLTTEEVLNFAKENLTGYKRPRYVEFMDELPKSNVGKILRKDLRKPA

SEQ ID NO: 5461 - protein, 403 aa, Acinetobacter baumannii
NRSIVNQVEGKIPSPASPHNWNTIMSNANRYTGLVDRYRDRLPVSATTRAISLGEGNTPLIKLENIPRIIGKDVEIYVKYEGLNPTGSFKDRGMTMAVTKAVEDGSKAIICASTGNTFAAAAAYAARAGIKAFVLIPEGKIAMGKMAQAMMYGAITMQIRGNFDDGMRIVKEVADQAPVTIVNSINPYRLQGQKTIAYEIVEALGRAPDYHCLPVGNAGNITAHWMGYTEAVANQPADQFEQVIYDAATDQFTGPKPEGLPTMVGYQASGAVLFLRGAPVEKPETVATAIRIGNPQSWNHAKAVVRDSKGWFDELQDSEILEAQRLLSMYEGVFVEPASAASIGGAIRDIKAGKIAEGSVIVCTVTGNGLKDPDTAIKQCADAVMLSIDATMDQVKDSILSNM

SEQ ID NO: 5462 - protein, 366 aa, Acinetobacter baumannii
SFEIFMSELKQDQYWMQQAIELAKRGLYSTKPNPNVGCVIVKDNQLIGEGFHPKAGQPHAEVFALREAGEHAQGATAYVTLEPCAHYGRTPPCAEALVKAQVKKVVVACPDPNPLVAGKGVQILKNAGIEVEIGICEDLAAQLNQGFLKAMSTGMPYVRLKVASSLDGRTAMASGESKWITGSAARQDVQHWRAISGAVITGIDTVIADDCQLNVRSLHNIDIETVAQPKRVILDRRGRLPLTAKILENPETVMVMGPYRQELADLGVIQLEIQPLKTLLQTLSKQYQIYDVLVEAGATLSTAFLQEGLIDEMISYVAPTLLGQSARAMFNADFEYMAQQLRFKLLDVTQLDQDIRLRLIPTQEKV

SEQ ID NO: 5463 - protein, 313 aa, Acinetobacter baumannii
RLIVTVKNSPAELSSALANQRNDVPLIRYSGRFAPSPTGPLHFGSLITAVASYCDARAHQGRWLVRVEDTDIPRIYPGSEDHILASIEAFQFDPDAEIIFQKDRLDIYESVLDQLKKEGLVYACQCTRKMLGSNTIYAGTCRDLQLDFQHQAIRVKVQDQPICFDDRLQGLHCSNLEHDLGDFVLKRRDGIINYQLAVVVDDYLQGITHVVRGADLLDNTERQIWLGQLLGYPKLSYMHLPLAMNDQGQKLSKQNLAHALDLTKAPELLQQAIQALGQPNVDLDRPEVMLKQAVAQWNVDLIPHGQQLCGTYL

SEQ ID NO: 5464 - protein, 80 aa, Acinetobacter baumannii
NRDFTPYHSILPISACLFPIRCFLMFSLYFTQTKCSYFIVIYKNNYLEDFYFSRCISFLVSKLMKCSDTKYELGTAIAKA

SEQ ID NO: 5465 - protein, 467 aa, Acinetobacter baumannii
FSNVMNATPTHQALQPEYRLLVLLVSIGFFMQALDTTIVNTAIPAMAHHLNEDPLRMHSVVVAYVLSVAACIPLSGWLADRFGVRNTFLSAIIIFTLASLGCGLSQSLNELLFFRVIQGVGGALLLPVGRLSLLKIIPRTQFLAAMSLMSLAGLLGPLAGPTLGGWLVEVATWHWIFLINIPMGVLGILMTLKVMPNVKEPTVKTFDLIGFVLLVVAMIGWSLGIEHLASPEYSKWFSISLLVVGIVATLWYAYHSHTHQNALFRSRLFRNKIYAIGILGNFFARFGGNALPFVLPLMLQVAFGFEPFIAGLMMIPLVLGSLFSKPIVRPIIQKMGYRRFLLINTTLVGLCIASFAIMTVDTPTWFRALHFFLFGTLNSLQFVGMNTLTLKDLPQQDASSGNSFLSMIMMLSMSIGVALAGTLINVFTDYYGTAHVTTAFHVTLICLGCINIITALIFWQIPKNTPV

SEQ ID NO: 5466 - protein, 635 aa, Acinetobacter baumannii
FVDVIHKDHVMNQLTNLSSAEISAQHEQDAKDLTRILPASKKVYIEGSRPDIQVPMREISLTDTPTGLGGEHNPPIMVYDTSGVYTDPNVQIDLNKGLPSVRQKWIEERNDTDVLSGLTSKFGQERLKDIRTADIRFAHIQNPRRAKAGKNVTQMHYAKQGIITPEMEYIAIRENQRQREAVDMRQHPGQNFGAKNLKEITPEFVRQEVAEGRAIIPANINHPELEPMIIGRNFLVKINANIGNSALGSSIDEEVAKMTWATRWGADTIMDLSTGKNIHETREWIIRNSPVPIGTVPIYQALEKVDGVAENLTWEIFKDTLIEQAEQGVDYFTIHAGVLLRYVPLTANRLTGIVSRGGSIMAQWCLAHHEENFLYTHFDEICEIMKAYDVSFSLGDGLRPGCIQDANDEAQFSELKTLGELTHRAWEHDVQVMIEGPGHVPMHMIKENMDLQLEVCKEAPFYTLGPLTTDIAPGYDHITSAIGAAMIGWYGTAMLCYVTPKEHLGLPNKKDVKDGIITYKIAAHAADLAKGHPGAQVRDNALSKARFEFRWDDQFNLSLDPDTARSMHDETLPKEAHKSAHFCSMCGPKFCSMKITQNVRDYANNLTNSDSEVEEGLKAMKEVYQEQGQKLYHKV

SEQ ID NO: 5467 - protein, 166 aa, Acinetobacter baumannii
KQGVKMNTSTLFFQALCLGIGATIVMDIWLLILKIFKVPTLNFAFLGRWVGWIFQGKLVHQSIAKSTPMKGEYLLGWIAHYSVGIIFALSFLLIVGSTWLDHPQFYSALLFGLVTVLIPFFIMQPAMGSGFASSKTPHPFLNCLKSLLNHSVFGCGLYLTAKLFQI

SEQ ID NO: 5468 - protein, 71 aa, Acinetobacter baumannii
TVLVGLSSLEQPQPPAQPKVIFGFSHFAKVAQPCFSQKTDSAEKAEFAVFGNTFLKTTTALQITKTAIIRY

SEQ ID NO: 5469 - protein, 108 aa, Acinetobacter baumannii
PYLVIILIYMYTSKKGLGSDAVRLSALKVKQAATITKVNRIEVESEEQDLVAIRLESLGFVPGTRVEVITKGVFGGDPILIQIGFTRFALRKAEAEKIEIQVEEGVPA

SEQ ID NO: 5470 - protein, 142 aa, Acinetobacter baumannii
STVFSVMDGTMHGISSIIYIILVACLLPYAFTVIAKFTGGFQPVDNQNPRDFLANTKGIAARANAVQQNSFESLPLFLTAILMAEYMVVPEYFILRLGWAYIILRVIYGICYLSNWATLRSIVWFLSLLCPIFLLIVTIKLT

SEQ ID NO: 5471 - protein, 207 aa, Acinetobacter baumannii
IPSFHLKFDYWFCILLTSSLAQDHFAPSQLQRLSLRFFIIALMTIMTGCTSLGPNSGSFSWRSSKLSSGLQKAYSVPPSTANRLSPMIIQSADRYNVPPLLLAAVIRQESSYNSNARSPTGAIGLTQIIPSYWQQTCAGNLYDESTNIQCGAYILNHYYQTADSWFKATAYYNVGPTGYERSFWTRHKAKKYARSVKRHQKTLKSAL

SEQ ID NO: 5472 - protein, 192 aa, Acinetobacter baumannii
RETSMKTVAIIYHSRQGHTQFIAQQIQIGVLSHHNIKADLLNAEDLIESSGILIQYDGLIWGSPTYLGGVSSKLKQLMDATGPLWKKQSFKGKLAAGFTVSSLPAGDKQSTLISIFTFCMQHGMLWVGNPILPEQHQGVAYTQAANRLGSWSGLMAQAEHASNADGFDEGDIKTAQQFGENFALTLNAYQGT

SEQ ID NO: 5473 - protein, 180 aa, Acinetobacter baumannii
NATSCNPYVVNQWFLIMKSNLITRSGHDKLVAELKQLWHEERPEITKKVNWAASLGDRSENADYQYNKQLLRKIDRRVRYLGKRLEELKIVDYSPEQEGKVYFGAWVDIENEEGEQKTLRIVGVDEIYDHHPQHISIESPMARALLSKEVDDEVEVHTPLGKKLWYINAIRYEKPKNDEI

SEQ ID NO: 5474 - protein, 1039 aa, Acinetobacter baumannii
LTTSYRAAMLSKFFIQRPIFANVLAIIVMAFGIFSVMNLPVERYPDIAPPKITVSANYSGADAQTVEQSVTQILEQQIQGIDHLLYFSSSSDSSGRSRITISFDNGTNPDTAQVQVQNSISGVIRRLPDEVQRQGVTVSKSLGDTFMVIGLYDSTGKTGNIELSDYLTTHVVDNLNRIEGVGETDVFGSQYAMRIWLNPDKLKQYNLMPSDVANAITAQNTQVAAGAIGDLPVIDGQYLNTKVTAGSRLKTVEDFKNIVVKSNKTASYVYLKDIARVELGAENYQSFNTINGYPAAGLGISLSSGANAIQTSKLIHQTLDQLTTKLPAGYKIVYPRDNTPFVQESIKEVVKTLVEAIILVILVMFLFLQSWRATLIPSITVPVVILGTFAVLYVLGFSINTLTLFALVLAIGLLVDDAIVVVENVERLMHEQHLSPKEAAIESMGEISGALVGITLVLTAVFIPMSFLGGSIGVIYRQFSITLVAAMALSLIVALILTPALCALILKPNPQPQRWAVWFNQKIEQLKNQYIKLVQTSIHYSKSVIVIFVALIAVFTLFYNGLKSGFIPKEDQGILSVQIKLVDSAPISQSQKIGEQVRQYFLTQEDKNVDLVLIRYGRNYSGTGQNLAQGFIALKPWDVRTGKENSAEAIQKRAMKYFSHFNNAQINVTLPASVNGLGQTDGLDLWIQDLNGQGQDFLDSAFRQLQAQSKNYSTFENFDKQSTNSKANLNIKIDQKQALANGLQLSAINNTLSSAWGGTYVNDFIDRGRIKRVMIQGDAEFRSKPEDLYNWSVRNDQNEMVPFSSFANFSWGGAPEIVKRYMGYSALQLQADVASGSSSGQAMKDVEQLVNQQKDIGLAWTGLSFEEQKSTNQAVWLYLISAGFIFLCLAALYESLSIPAAVMTSIPLGVGGSVIFSYIFGLPNDVYFQIALLTTIGLSCKNAILIVEFAALAQEKGKNAIQAALEGASLRLRPILMTSLAFGAGVIPLVFAQGAGAVSRQEIGISILGGVMFGTVLVLFFIPVMYVLLRSLFKSKAST

SEQ ID NO: 5475 - protein, 211 aa, Acinetobacter baumannii
IMDTPLINTPVRHWCEFEFISKTVKNPNIHIKGNYSYYSAYWDQGFERCVVRYLHDKPSTPDKPIDQLYIGNFVCFGAECVIMMGGNQLHRPDWISTFPFDTRSFLAAGDTIIADGCWIGSRAMIMQGVKIGEGAVVATGAVVTKDVPPYTIVGGVPAKIIKYRFPQEQIEKLLALKIYDLDEKQVLKMREYLQTDDIDALTAYLKKLQSE

SEQ ID NO: 5476 - protein, 614 aa, Acinetobacter baumannii
IGLTMTTVNAPEFVRHPKLIAWVEEIANLTKPAKIEWCDGSEEEYQRLIDLMIANGTMQKLNQEKHPGSYLANSDPSDVARVEDRTYICSQNKEDAGATNNWEDPAVMREKLNGLFEGSMKGRTMYVVPFSMGPLGSHIAHIGIELTDSPYVAVSMRKMARMGKAVYDVLGTDGEFVPCVHTVGAPLAEGQKDVAWPCNPEKYIVHYPETREIWSFGSGYGGNALLGKKCLALRIASVMGREQGWLAEHMLILGVTNPQGEKHYIAAAFPSACGKTNFAMLIPPAGYEGWKIETVGDDIAWIKPGEDGRLYAINPEAGFFGVAPGTNTKTNPNCMATLHKDVIYTNVAVTDDGQVWWEGLSKEVPANLTNWKGQPHVNGEKAAHPNARFTVAAGQCPSIDADWENPAGVPISAFIFGGRRADTVPLVSEAFDWVDGVYKAATMGSETTAAAVGQQGIVRRDPFAMLPFAGYNMADYFDHWLNLGAKVSEKAEASGNKLPKIFNVNWFRRDAEGNFVWPGFGQNMRVLEWIIDRCEGRANAVETPIGFVPTYEDLNWEGTEFTKEQFDLITNQDKDQWVTEIESHTELFNKLGERLPKALKERQAALLEAVKTGF

SEQ ID NO: 5477 - protein, 61 aa, Acinetobacter baumannii
HSLTGFLLVCWKYSITLCFCLNYIYCLILLVFFIPLVDHHKVSKRHLLLLINDIIPSSHAI

SEQ ID NO: 5478 - protein, 114 aa, Acinetobacter baumannii
IMSTFMDSILTTQYELHRQILEVIALIPYGKVATYGQVARMAGLPKHARLVGYVLKHLEADHQVPWHRVINSQGKISLSKFNEKGENIQQLKLEAEGIYLLNGKVNLKEFAWQP

SEQ ID NO: 5479 - protein, 217 aa, Acinetobacter baumannii
VMATRITNQKLSKSSRAWMREHLDDPFVKKAQKEGYRARAAYKLLEIQEKYKLIKPGMTVVDLGAAPGSWSQIAGKLVGSKGLVIASDILPMDALPDVTFLQGDFREEAVFEKLLNILNGRQVDIVISDMAPNTSGNRAVDQPRQIYLCELALDFAQKVLGPNGQFVVKVFQGAGFDEFRKQVVDSFDVLKTAKPAASRARSKEVFLVGQGRKKALQ

SEQ ID NO: 5480 - protein, 345 aa, Acinetobacter baumannii
FKGFMEYIKLSYHHLNFEDRTALMLESRKEGFSARKFAELIKRHPSTIYRELKRNSINDVYQAQYASDNTFARRRRGHRKLKIDSILWKFIVEAIRCLWSPQQIAKRLKTFPDLDQTMNVSHTTIYSTIRALPKGELKKDLLSCLRHENKKRKANGEPKKDSILQDIKTIHERPAEVQERKIPGHWEADLIKGKDNKSSIATLIERNTRLCILATLPDAKAESVRKALTEALKYLPAELRKTLTYDRGREMSEHKILEEDLGIDVYFCDPHSPWQKGTCENMNGLIRQYLPKGIDLNQADQHYLNQVAMSLNTRPRKALDWLTPLEKFAQLVDYHMAFETVAPHV

SEQ ID NO: 5481 - protein, 129 aa, Acinetobacter baumannii
FKGFMEYIKLSYHHLNFEDRTALMLESRKEGFSARKFAELIKRHPSTIYRELKRNSINDVYQAQYASDNTFARRRRGHRKLKIDSILWKFIVEAIRCLWSPQQIAKRLKTFPDLDQTMYSPRRGRSESR

SEQ ID NO: 5482 - protein, 298 aa, Acinetobacter baumannii
SLLAKIAADFEPELFMQLISLPKQILQCGQLQLDLSQPHVMGILNVTPDSFSDGGKHNQLDQAVDHALSMIEQGATIIDIGGESTRPGASEVVVEEEVRRVVPVVEALSHHNVILSIDTSQPEVIRAAKAAGAHIWNDVRALTRPNALKTAVELDIPVVIMHMRGEPTTMNQLDQYTDVTLDVMQELQQRIDEALAAGVKKHNIIVDPGFGFAKNAQQNLKLLKEFWKLNELGYPILSGLSRKRFIGEALQGAPADQRVVGSVTGHLLSIQQGASIVRAHDVKEMHEAILVWKAMQQV

SEQ ID NO: 5483 - protein, 180 aa, Acinetobacter baumannii
LLMASYELSAFDRFHAVSVVGAIEQQAPYTLNVGFWIRDPNQLIIWPQEVAAHPRQDFLWEETCFEIFIGVHYEDFYREINLSPSQAWQTYQFEEYRYPESMPPLVAYDIELNHLKRTHYGLNVSLDLSQFMQQHRLKWANLYLGLTAVLKTKDGMQYYAMQHSGKHADFHNKRDWLHEF

SEQ ID NO: 5484 - protein, 168 aa, Acinetobacter baumannii
LCFLNLRGTEMQRYPMTPEGKIALEKELQHLKTVERPRITQAIAEAREHGDLKENAEYHAAREQQGFCEGRIQDIEGKLGAAQVIDVKDLEQNGRVVFGVTVTIENLDTEERKTYKIVGDDEADFKINKISVNSPIARGLLGKNEGDEVKITTPQGEVEYEVVSVEYL

SEQ ID NO: 5485 - protein, 310 aa, Acinetobacter baumannii
YFIYKRIFSMMRIGLFLLTNLAVLVVAGIILSLFGVGSYHGAGGLNLGNLLVICFVFGMVGSLVSLFMSKWMAKKTTGTELIDPNAPRNQAESWLLQTVAELSQRAGINMPEVGIFPSYQSNAFATGWNKNDALVAVSSGLLERMNKDELRAVLAHEIGHVANGDMVTLALIQGVVNAFVMFFARVVGDFIDRNVFGRQDNEAPGMGYFIITMVLDIVFGILASAIVMWFSRYREYRADEAGARLAGKQAMISALLRLQAETELPDQMPKEMKAFAIAEGKEQGFSLAALFQTHPTIEQRVAALHQLDCP

SEQ ID NO: 5486 - protein, 3290 aa, Acinetobacter baumannii
VSIYLNILEKLNNYLKFHGGKMVQVSLMANNASKNNTVDINVGQTKNIVIDPKVIAKIDINPERIASITRDGNSAVIHLKDGTEIVLENFFISENPQILLNEGQTYWTANLAEDATGQTTVNYLELKEIPKYIDASSSVPIWSWVVSALAGAGTVALLSQQDAKDKTPPEPGKLSFQNLLDSGELTQDQITNDNKFNLKLSGQEKGSSVTYLISTDEGKTWQETTLNQKDLADGIYLYKAVVTDAAGNTSETAVQKVVVDTTTPQAGELTLSDLNDTGVSVTDQITQDKNFNLKLEGQESGSRVTYLVSTDNGKTWQETTVAQKDLTDGVYQYKAVVTDAAGNTSETAVQKVVVDTTTPQAGELTLSDLNDTGVSVTDQITQDKNFNLKLEGQETGSRVTYLVSTDNGKTWQETTTAQKDLTDGIYQYKAVVTDAAGNTSETAVQKVVVDTTTPQAGELTLSDLNDTGVSATDQITQDKNFNLKLEGQETGSQVTYLVSTDEGKTWQETTVAQKDLADGIYQYKAVVTDVAGNISETAIQKVVVDTTAPQAGKLTLSDLNDTGVSATDQITQDNSFTLKLVQPIVIGEQAALLDHYEVSKDEGKTWQETTADQKDLADGIYQYKAVVTDLAGNISESAIQKVVVDNSLNVESTTVIVKPITEDNTISLVEKDQVISIRLEIANLPTDLNSSLTSVNTTLENVTYNFHFDEVTQEWVTEIPAEFLWSVEPQTNISIDISLTDQAGNTAIITHTQNYNVDPTPNSPTLDSLTFNNIDGAIISGSAYKGSKVDIYNKNGDWLASTITNEEGKFTLQDLSINTNQEVYAVATYNGYSSENSSIGLVTEVPAISITRISPEGVISGYATEGSHFIVKDQNGNILQEFNSNVFDSSGITPFSVMALGEVRPFILSLDQPLEEGAQIIISTDKDNISGHPQYITADYTPAVFLETPQFDISGETLSVHVNEPNSFIRAFSGEGNLIATGFTDEQGFASLQVFQFLKEGETVTVQVVDKNQNTSETLIEVPNFAYIPHVERITQEGLISGVAEDNSTVIVRDADGNELGKVTLGDDNSWSDFSHFSLSVNRPLIDGEKISVQIIDNKGLMSPEQNIIVDLTPPPAPTELNFNDAGDLVYGHAEPFSEILVKDGQGNILNKWFWNNWTDESGSFSIELGTFLTNAETVYVTATDVNGNVSLAAQIQAPNYAFAPYVDSFTSDGVISGQAENNSTLVVKDAKGDVVAEIKVGEDNGWNGSSYFKLQLDRPLVDGEQFFLSIKDARGQVSADTVITADTVAPTPASNLVFSEDGSYLTGVAELNTTIQVFDHNGQLVNIWNNTINSDGTFTIYLGSNNLHGEAFTVTVKDQAGNVSEAISINAPLDDIAPNPIKNILLDANGQNFTAQAEANSQIEVFDSLGNQTGWGSTDSAGNASGSFNQTYLHGEELTFVVIDRAGNRSIEFKQNALIDTIAPNPIENIIFNENGQSFTAQAEAGSSIDVLDQTGNKIGFGYTDSSGNVSGYFQQVYLHGEELTFVVIDRAGNRSAEVKQSALNDDVAPNPIENILLDLNGQNFTAQAEANSQIEIKNNNGDVVGYGSADSAGNVSGYLYQVHLHGEELTFIVVDRAGNRSTEVKQNALIDDIAPNPIENIVLDINGQNFTAQAEANTQIEVKNAVGEIVGSGYVDGAGNVSGYLYQVYLHGEELTFVVVDRAGNRSTEVKQNALIDDIAPNPIENILLDANGQNFTAQAEANTQIEVKNAAGEVIGSGSTDSMGNVSGYFYQVYLHGEELTFVVVDRAGNRSTEVKQNALIDDIAPNAIENIIFNENGQNFTAQAEANSKVEVKNAAGEVVGSGYVDSAGNVSGYLNQVYLKGEELTFVVIDQAGNRSIEVKQTAFLDNTAPENATNLVFSEDGSYLSGMAEPNATIQIFDQYGQLLNQWNNNVNWDGTFNIYLNSNYMHGEVFKVVVVDQAGNLSGEVTVKAPLDDIAPVAASDLVFNEDGSSLSGVAEPNTFIQIFDQNGQQMNTWSQSVNADGTFTIFFGTYNLHGEEFTVIVKDLAGNVSEAVSVKAPLDDIAPNPIKNIVFDANGQSFTAQAEANSQIEIFDSFGSQIGWGSTDSTGNVTGYFYQVYLHGEELTFVVIDRVGNRSDEMKLNALMDTIAPKPIENIIFNENGQNFTAQAEANSFISVKNAVGEFVGYGYVDSTGNVSGHFNQVYLKGEELTFIVIDKAGNQSIEYKQNALTDDIAPNPIENIVLNKNGQNFTAQAEADSQIEVKNTAGEVVGSGYVDSIGNVSGSFNQVYLHGEELTFVVVDRAGNRSTEVKQNALIDDIAPNQIENIVFDLNGQYFTGHAEADTRIEVLDQFGNRAGWGYVDSQGNVIGYFNQVYLHGEELTFIVVDIAGNRSVEVKQNALIDDVAPPAAANITLTSDGLLFGEAEPNSTVEIIDQYGAVITTTYVWYDGTFNQWINLSQYQTQNLSIVVKDQAGNRSEVVHELVPVFTNSPIAATELKLDIDGHILTGKATVGMSVVVTSTDGQTINGGWNNAVNEDGSFAIQLNDYYLQGQTLQVRVYDQNTNQYSLISEIIAPLDNIAPIINDVVINNDGYSITGHTDPKVIIKVMDEDGDFRAEFQSDEAGYFNASIYPPLLRGEQLFITATDLAKNISTPFNITFNADINAPPSANHVVVSENGFFIEGTALPNSVVRIYDVYSNYIGGGFVDETEHFNIQLYSPQANGQTLRVVVEQNGYQSAYTEIKAPIDTVAPNAATQLVLEDGNVLSGQAEAYSTVNIFDANNNLVGQTTVGSEGSFLTQLWSQYWHGETLTVKVVDANQNVSVGTTITATNDTTAPKVVTQLAINGWGELTGHAEGKATLEITYYFADQEPSVTSTTVMADGTFSTYVYGTATSFDLTVIDRAGNRSETISKAINDLPTITVDQFKGDATDNTYIVDHISDFVEEYTVEPYAIYKDVWIDNSYMYPEWVSEGHYEQIWFVDGYYDSQWITSGYSTVQNVYQDQNGITYIDNGTADSDYSRYEQQYYDFVNGQWQEGYELTYIRSEEGWVDTSHNEDVYIDTSHYEDVWVDTSHYEDVWVESGYWENQLVESGYRDFDFGGHDKIVSSVSYSLVGYSDWSTGLESGRYVEDLELVGSAHLNATGNALDNLLTGNSGNNILNGREGNDTYITNEGTDTILFQLLNSQDATGGNGHDTVLDFTLGDIRTNLQADKIDLSELLIDYSKDVSALAKFITVEQDAGNTTISLDRDGEGTMFNSVSLLTLNQVNTTLDELLNNQQIIV

SEQ ID NO: 5487 - protein, 124 aa, Acinetobacter baumannii
MDSYSPYKGKSGLKRILNATSYSISGFKAAYQNEAAFRQIVLINLVLIPVSFFLDVTRGEHALMIIVCLFAIIVELFNSAIEAVVDRVSLEKHQLSKNAKDMGSAAQFVALSIIVTTWLIILFG

SEQ ID NO: 5488 - protein, 151 aa, Acinetobacter baumannii
DTSYKKIRTILMNKSILCLALSSMFILTACQTTPRQYNGSTGYQIENQTKTSATLAYTLAGRSNQQLDERKLQRACQNVLGAQKVYKLSILSINEIPNPAKDEHYGIQLGETRASFGLSNTPSLNNGEDYATRQALEARPSTLKVVRYTCS

SEQ ID NO: 5489 - protein, 322 aa, Acinetobacter baumannii
CDSHPNHIKLRGIFIYGYISSMYAPVESNEGFNFKPELPTSSAYYRLLKKLRRQVGHAIRDFNMIEDGDKVMVCVSGGKDSYTLLDILLQFKRIAPINFDIVAVNLDQKQPGFPEDVLPRYMEENNIPYYILEKDTYSITKRLTPEGKTYCAVCSRLRRGSLYGFAQEIGATKVALGHHRDDIIATFFLNLFHGGSLKAMPPKLLSSDKKNILIRPLAYVEEKDIIKYAELRKFPIIPCNLCGSQENLQRAMINEMLREWDRQYPKRLHSIFGALQNVSPSQLADRDLFDFEVLDSQRELDFKDPEELKKRLDVVNLSFAAE

SEQ ID NO: 5490 - protein, 594 aa, Acinetobacter baumannii
SGTQPFWLYCLRKRFRRGGDMTYPLFELKLLAALDHAQFEEAIWAFEIDGDISTLLLIDYALEQFHQKKVQADEIYRVPEQKIKKIGEQNLGLEKNESYTFAELLQFLIFTQANDVKDALSNMLLGSVEQTQLILSKRAEYYQLALRAPNQLKNLFLLVKHIYSYPAELKKLFFIRTLSFKNKVYQPITPLLAHPVLTSVLYISHTFRQIYITYSKHNRSIGFFSFLDDIHRLEHLVPYYHYFQEGHVEAKKYSSQTGIINILGDTYFGEMYTEKRKSRGQTDALQQYGYHYSFEKIQPFLGKNDINIANFEAVFSLENQSPLKDKKPFILKADAKKTLEEFKSIHLNYLVLANNHLKDYGEQGLAYTLQQLDQASISYIGAGLNQKDAHNYFEITFETKHYAIFNGYWHRDTAYLDYDFYALGSRSGVACLNGVLLEQIMRYKQAHPERKIIVICHWGVDFKPITKDQTKLATILTQAGADLIVGHGAHTIQPIQIINQKPVVFNIGNAVFNSDGEYEQQNALPFGCIARLDLAKDLLRLYPIYTNNLQTFWQPYPVDTEDFSKASIYMTSLLTPENYMASQDKLGRYLEVKF

SEQ ID NO: 5491 - protein, 125 aa, Acinetobacter baumannii
AGFFMPDENNAMIRILIFISALLFFIPFANAKDIFNGTILFKNNDWHFVRCSITQDDYLIEAPQEIFTQFKELQQQQKNYWVSVLAEVNEQQNGNLILKIEKIDEVHLDETCHLIDALKNFENRE

SEQ ID NO: 5492 - protein, 314 aa, Acinetobacter baumannii
AKMHIKTTSRIKLSKLSCIIGTLNSCLPWRCAVALVLDGRALAKQIEENLLVRVEALKAKTGRTPILATILVGDDGASATYVRMKGNACRRVGMDSLKIELPQETTTEQLLAEIEKLNANPDVHGILLQHPVPAQIDERACFDAISLAKDVDGVTCLGFGRMAMGEAAYGSATPAGIMTILKENNIEIAGKHAVVVGRSAILGKPMAMMLLQANATVTICHSRTQNLPELVKQADIIVGAVGKAELIQKDWIKQGAVVVDAGFHPRDGGGVGDIQLQGIEEIASAYTPVPGGVGPMTITTLIRQTVEAAEKALG

SEQ ID NO: 5493 - protein, 1083 aa, Acinetobacter baumannii
TVIKERIMPKRTDIKSILIIGAGPIVIGQACEFDYSGAQACKALREEGYRVILVNSNPATIMTDPSMADATYIEPITWQTVAQIIEKERPDAVLPTMGGQTALNCALALDENGVLEKYGVELIGATKEAIEKAEDRKLFDEAMRKIGLECPKAAIAETMEEALEIQSRFGFPVIIRPSFTMGGSGGGIAYNREEFLEICERGFDLSPTHQLLIDESLIGWKEYEMEVVRDKNDNCIIVCAIENFDPMGVHTGDSITVAPAQTLTDKEYQLMRNASVAVLREIGVETGGSNVQFGINPKDGRMVVIEMNPRVSRSSALASKATGFPIAKIAAKLAVGYTLDELKNDITGGVTPASFEPSIDYVVTKIPRFNFEKFPQAEPVLTTQMKSVGEVMAIGRNFQESVQKALRGLEVGVSGFDEKIEAGATNVKETILKELKVPGPERIWYVADAFRHGFSLDDVFEATKIDRWFLIQIQDIVNTEAQVKTLGFGDLTAENIRSFKRKGLSDLRIANLMGISQKQFRKQRWNLGVYPVYKRVDTCAAEFESGTAYMYSTYDEECEANPSNRDKIMVIGGGPNRIGQGIEFDYCCVHAALAMREDGYETIMVNCNPETVSTDYDTSDRLYFEPVTLEDVLEIVRTEKPKGVIVQYGGQTPLKLARALEEAGTPIIGTSPDAIDRAEDRERFQQMIQRLQLRQPNNSIVKSAEEGISEAAKVGYPLVVRPSYVLGGRAMEIVYNEDELKRYLREAVQASNEAPVLLDHFLDDATEVDVDCVSDGKDVVIGGIMQHIEQAGIHSGDSACSIPPYSLSKEIQDEMRRQTIAMAKELGVVGLMNVQFAVKGNDIYVLEVNPRASRTVPFVSKCIGESLAKVAARCMAGQSLESQGFTKEIIPNRFAVKEAVFPFAKFPGVDPMLGPEMKSTGEVMGVGQTFGEAFYKAVLGSNDRLPGLPTEGEVKHAFLSVRESDKKYIADIAKKLVEYGFKLVATGGTYQVLKEAGLECESVNKVTEGRPHIVDRLKNGEIHLIVNTTEGKQAQYDSAMIRRAALQGKVYYTTTINGAEAVCQAFAVKLPMDVYRLQDLTVG

SEQ ID NO: 5494 - protein, 249 aa, Acinetobacter baumannii
TYSKMSSRENRMKKILLLISGTLLCVSCTTRPPLLSERGPSISADGRPIVPVTFVFTTNTPQATKFDNYQQMRKEIKILNKYYVDDKNNKIFKFKLHRYIPYEEFSKLHCDLKQQINQPYPISTETIPASVNTCFPKRTASKEVIVFIYDAYSTKWKFEDVTSRAFRNNGKPFILLDWNRLNYNIQAGSVHEMGHVFGLKHVCAPKATKRTPTNIMTSAECKLGSGGLRNLGFTPVQLQTILSTYNQYP

SEQ ID NO: 5495 - protein, 636 aa, Acinetobacter baumannii
YGNKALSDYFKNAVLWLIILGVLILIFSNISDRNKPTAMKYSDFVAAVNAGQIKQVTIDGLNISGEKTNGSQFETVRPQVEDTELMPSLNKQNVVVEGTAPQRQGILMQLLIASFPVLLIILLFMFFMRNMGGGAGGKNGPMSFGKSKAKMLSEDQIKVTFADVAGCDEAKQEVVEIVDFLKDPAKFKRLGATIPRGVLMVGPPGTGKTLLAKAIAGEAKVPFFSISGSDFVEMFVGVGASRVRDMFEQAKRHAPCIIFIDEIDAVGRHRGSGTGGGHDEREQTLNQMLVEMDGFEGNEGVIVIAATNRVDVLDKALLRPGRFDRQVMVGLPDIRGREQILNVHLKKLPSVTGVDVKVLSRGTPGFSGAQLANLVNEAALFAARRNKNTVDMHDFEDAKDKIYMGPERKSMVLREEERRATAYHEAGHAIVAEILPGTDPVHKVTIMPRGWALGVTWQLPEQDQISHYKDKMLNEIAILFGGRIAEEVFIQQQSTGASNDFERATKMARAMVTKYGMSDKMGVMVYEDENQNGFFGNVGSRTISEATQQQVDQEVRRILDEQYKVARDILGNNKDIAHAMVKALMEWETIDRDQIRDIMEGREPQPPKVYIAENPVSAFEPPKDGPSTPPPLPAMN

SEQ ID NO: 5496 - protein, 317 aa, Acinetobacter baumannii
LYDNKMRPLKPLSIIYNEKSGFHASKHEDVYEQLMTVFTEYGFEIQVFELNENILFDDLINNVIHRHSQNENTGVVVAAGGDGTLNAVATKLKNTSIPMGILPLGTFNYVAKVLEIPLDLLEAAEVIATGKPRSVHVAVINDHIYLNNASLGLYPLFIKKRELYNKYLGRLPLHAYTSALDVLLRENKSMKLSITVDGKKYPVKAPLIFFGNNQLQLCDMKLRIAECAAQGRVAGVVITKSDKLSLLNMLWQWVQGKVEDAQDVYSFCADHVIVECAKKTKLTVALDGEIIEMKPPLNFTVEKNALNIMVPNVTTSV

SEQ ID NO: 5497 - protein, 462 aa, Acinetobacter baumannii
IICKNGINLLFFSIQPKRNMERIMVDQPSTATTPHSNLDTKTRLKSILGGSAGNLVEWYDWYVYAAFTLYFAHAFFPKGSQTAQLLQAAAIFAVGFLMRPIGAWIMGIYSDRKGRKAGLTLSVTLMCIGSLLIAVTPSYESIGVFAPLLLVIARLIQGLSVGGEYGASATYLSEMAEKDRRGFFSSFQYVTLIAGQLTALCVLLILQMILTEEQLHDWGWRVPFFIGALLAIVVFRIRRGLLETQSFKNAQAETDQPKSGMFALFKHYPKEAFTVLFLTAGGTLAFYTYTTYLQKYLVNTSGFTKPEATQITTLALFIFMCLQPLAGALSDRIGRKPLMIAFGVTGVLFTYILFDTLANTHNYWTAFWLCLGGLIMVTGYTSINAVVKAELFPAHIRALGVALPYAIANTLFGGTAEFFALSFKEAGHESWFFIYVSIMIFISLLIYIFMKDTKHHSKIKEH

SEQ ID NO: 5498 - protein, 233 aa, Acinetobacter baumannii
SNSNYKLLSLFMSCTFQLSKAPEHLLQALHEVIPHCELMAQQLPETPISLWLIPPVFQTDRLDDEVIRRIWNDTPYWIFCWASGLAMAQWILAEPHHVKDKVVLDFGAGSGVVAIAAKMAGAKRVICCDIDQVSLNACRENALLNDVELEYLDDLYKAEQVDVLLAADVLYDQCNRFFLDEFLKFAPEVWVADSRVKNFSHPKYEKIEERSATTWPDLDEAKEFRNVSFYKTL

SEQ ID NO: 5499 - protein, 592 aa, Acinetobacter baumannii
NLGNFMSEKISRRELIQKSLLGFGALSIPVAFTGCNDGSDDESPEIQADFLHGVASGDPLQDKVILWTRVTPTDSGVRLKVVWEISTDNQFKQNLKTGMVETSKTDDFTVKVDAAGLQADTVYYYRFKFGNKVSPVGQTKTLPTSTNKVSFAVCSCSNYPAGYFYVYREMAKQNVDVIIHLGDYIYEYGADGYATEDAIKLGRNLPADNNKEIIKLDDYRKRYALYRQDKDLQAAHQRHPFIVIWDDHELANDAWREGAENHQSNEGAFSDRKLAALQAYFEWMPIRPVSSTDHLNIYRQFNFGSLVQLTMLDTRIIARDKQLAYADYMTTTGLDIAKFQGDLTNPVRTLMGYTQRDWLVDKLKQSTATWNVVGQQVLMSKMWIPAELLASLGQITSGGTSPDALAKMNAQITELVALKLRLQQNDPTLTAQEKARIMTVAPYNLDAWDGYYAEREFVYDKLAEFNKKIIVLAGDTHNAWASYLYSQKGKYVGVELATSSVSSPGLEKYLSIPLAQLQQFEFAFTTLIDELVYCNLNQRGYLLVTLDQVQVHSEWRFVDSIKNTEYQIDSSRQNDIVLDLNLMPLKQGQKTA

SEQ ID NO: 5500 - protein, 1336 aa, Acinetobacter baumannii
ESIKMNQFVTNTKNVIRGNYHPEFLQNEVLSDIFTHTAQTLPDKTALIEADKTLSYGELYQQALIMAQHLALKGVKPGHIVGLWLPRGIELLKAQLAICLSGAAWLPFDMDTPADRIAVCLEDAEAVGMITIDEWYEHLAEVPQTKWTNTELQKPLSESVSLAKTTPDQPAYIIYTSGSTGKPKGIVITQKNICHFLRSENSILGIQEQDKVYQGFSVAFDMSFEEIWLSYLVGATLWIAPKSLVSDPERLCQTLKQEQITVLHAVPTLLALFPEDVPNLRIINLGGEMCPDSLVDRWALPHHQMFNTYGPTETTVSASLELLERGKPVTIGKPLPNYGMLVINSERELLEQGETGELCIFGPSVAQGYLGRPDLTADKFIENPWAMSIEEELLYRTGDLAKIDEFGQVHCLGRADDQVKIRGFRVELGEIEAALCDIDGIGTAAVILRPEDGIDQLVAFIAPEIDAKQAIEIKELRHNLSQRLPPYMVPNRFEIIEEVPRLLSGKIDRKALKARPLTSVVDRSESDQPQNPAEEILFEILNRLFPNMPIKLDSDFFDDLGGHSLLAAVLISNLREHAEYSHLTIQNLYQARRVGAIAALMLEQPEPTLFDSQIGQDNPRNQTYKWLCGIAQLVTIPVLISINILQWLAPFFTYHYFTGGTRDSIPYAIALSLLVYVSVIMSSFVLSITVKRLLMLGIGAGRYPLWGLTYFRWWLADRISNISPVYLLSGSTLLNLYLKALGAKIGHDVTISSVHIRMPSLLTIEDGVSIGSQVNLENAKVEHGHLVLGSIHLKQDSYVGSYAVLEENTVLEKQAHVNALTSIEYDTVVPEGEIWDGTPAQKIGHIDEQAKLPERPKLSFIRRIAEYGYYGVSALVIACLFFIPFFPSFLLVDWLDVNVFNINPNNHLQIALYYFILAIPASAMMMMITAVISSGLRKIALPRLETGTYAVHGSTYYRKWFAAQILETSLQTLHGLFATIYAPTWFRMLGAKVGKNTEISTATGVIPEMLTLGEESFIADAVMLGDEEIKSGWMSLKATKIGNRSFVGNSAYIADGTVLPDNVLIGVQSKTPDNREMYDGQTWFGSPALLLPAREVAEKYPDHLTFKPSIKRRLMRGFIEGLRIVLPAALAIGVGYMIVLDVIDVINNYNIETGLVALTLAGLLYGVGCFLIVALLKWILIGRYQPRSAPMWTMFVWLSEGITSLYESVAIPNFLNYLRGTPMLPFFLRILGVRIGKDVYMDTADITEFDCVSIGDRAEFNSFSGPQTHLFEDRIMKIGQVNVGHDVVVNARSIILYNANVSNHAVLGPLTLVMKGENIPAKSAWIGSPAVPWVHK

SEQ ID NO: 5501 - protein, 289 aa, Acinetobacter baumannii
HKMKNSVQYLFSCLLGMTTFSVGITPTSAGQMYIYQDKNGSTLLTNRKSYDHSLKKVKVTYYPDSNIHSYSNWGTSEASVLPSYSKNKNAFDHIIKQAAQQHGVSEGLIKAVMHTESGFNVNARSPVGAQGLMQLMPATARRFNVSNAYDPQQNIFAGAKYLSWLLKRFNGNTQMALAAYNAGEGNVDKYGGIPPFRETQDYVRRVTSRYQNLYSSGVGLSSFSNSSISAQAINQPAIPHSTSTQVSAQPVKYSSSRQIVTLPDGTYTDAPTGTYVTNNATAVAHIRIE

SEQ ID NO: 5502 - protein, 568 aa, Acinetobacter baumannii
CIENFIEQQITDRDLIRVAVFLDFKRQLKLWLEHIVHHVSDLQEETILFISFGPKDHRCSVWHSEKTVLTQANLQLFDFIDDQFSPDQLPDYIKIDVAYNLEKQSWNQIEQQVHHQFHNNHYRRGIGFDDSCSVAFLEQEIYGKAIIRGLSYDKPNFFDETNLNYAIKQKYRATKPEIKLQSLQEVWTFDTYATFYENGQFINLASRYDANGIRAIASNKKQHFRDLIEKNAAFLHSQIQENGKFIYGYFPAYDRDIRNYNTVRHCTSLYALLETFEVQDKPEYWPKIVAAIQYALTTFYKEKDPITAFMIDGKEGELEIKLGANAAAILMLTKYQEITGKDDYLKYAEKLAHGILELVDPDGLTTHVLNYPNYDLKEKFRIIYYDGEAALALLRLYQINQDKRLLDTVKLMFENFIHKRYEKYHDHWLSYCTNELTKMCPEEKYFIFGLNNYLKHFIFIRNRKTTYATLLEMLMAAYKMVNRLKEQGHNALFEQAYMSELKKLITFRAEFQTTGFFYPEIAMYMARPDKILHAFYVRHDRFRVRIDDQEHNLSGYIAYVKDFEGGEI

SEQ ID NO: 5503 - protein, 3892 aa, Acinetobacter baumannii
YKRNIDMPEIQIIAKDNHKTLVTTEGTSAKLSEASVVLVKVAASDVLVVNREGTNAVIRLKNGETIVIEGFFSGTAEPKDNSLVFQDENGQLIWAKFKDAENDADADSDADADADSDVEPQALLGEDLPAALPAEAPQELVSDVIYQPISSIEPLLYHDAGVNPWLWAAIPLVAGGIIAAASNHDSNDDSSAPADTTPPSTDGVTFSVDPVTSDNVINASEASGNVTITGVLKNIPADAANTAVTVVINGVTYNATVDKAAGTWTVSVPGSGLVADADKTIDAKVTFTDAAGNSSSVNDTQTYTLDTTAPNAPVIDPVNGTDPITGTAEPGSTVTVTYPDGSTKTVVAGPDGTWTVPNPGLNDGDEVTAVATDPAGNTSGPATAVVDAVAPTVALDDVLTNDSTPALTGTVNDPTATVVVNVDGVDYPAVNNGDGTWTLADNTLPTLADGPHTITVTATDAAGNVGTDTGVVTVDTAAPNTAGVTFTIDSVTADNVINASEAAGNVTITGVLKNIPADATNTAVTVVINGVTYNATVDKTAGTWTVSVPGSGLVADADKTIDAKVTFTDAAGNSSTVNDTQIYTLDTAAPAAPVIDPVNGTDPITGTAEPGSTVTVTYPNGDTATVVAGPDGSWSVPNPGLNDGDEVEAIATDPAGNPSLPGTATVDAVGPNTDGVNFTVDSVTADNVINASEASGNVTVTGVLKNVPADAANTVVTVVINGQTYTATVDSTAGTWTVSVPGSDLTADADKTIDAKVTFTDAAGNSSSVNDTQTYTIDTTAPDAPVINPVNGTDPITGTAEPGSTVTVTYPDGSTTTVVAGPDGTWTVPNPGLNDGDKVTAIATDPAGNPSLPGTATVDAVGPNTDGVNFTVDSVTADNVINASEASGNVTVTGVLKNVPADAANTVVTVVINGQTYTATVDSTAGTWTVSVPGSDLTADADKTIDAKVTFTDAAGNSSSVNDTHTYTVDTVAPNAPVLDPINATDPVSGQAEPGSTVTVTYPDGTTATVVAGPDGSWSVPNPGNLVDGDTVTATATDPAGNTSLPGTGTVSADITAPVVALDDVLTNDSTPALTGTVNDPTATVVVNVDGVDYPAVNNGDGTWTLADNTLPALTDGPHTITVTATDAAGNAGTDTAVVTIDTTAPNAPVLDPINATDPVSGTAEAGSTVTVTYPDGTTATVVAGTDGSWSVPNPGNLVDGDTVTATATDPAGNTSLPGTGTVSADITAPVVALDDVLTNDSTPALTGTVNDPTATVVVNVDGTDYPAVNNGDGTWTLADNTLPVLADGPHTITVTATDAAGNAGTDTAVVTIDTTAPNAPVLDPINATDPVSGTAEAGSTVTVTYPDGTTATVVAGTDGSWSVPNPGNLVDGDTVTATATDPAGNTSLPGTGTVSADITAPVVALDDVLTNDSTPALTGTVNDPTATVVVNVDGTDYPAVNNGDGTWTLADNTLPVLADGPHTITVTATDAAGNAGTDTAVVTIDTTAPNAPVLDPINATDPVSGTAEAGSTVTVTYPDGTTATVVAGTDGSWSVPNPGNLVDGDTVTATATDPAGNTSLPGTGTVSADITAPVVALDDVLTNDSTPALTGTVNDPTATVVVNVDGTDYPAVNNGDGTWTLADNTLPVLADGPHTITVTATDAAGNAGTDTAVVTIDTTAPNAPVLDPINATDPVSGTAEAGSTVTVTYPDGTTATVVAGTDGSWSVPNPGNLVDGDTVTATATDPAGNTSLPGTGTVSADITAPVVALDDVLTNDSTPALTGTVNDPTATVVVNVDGTDYPAVNNGDGTWTLADNTLPALADGPHTITVTATDAAGNVGNDTAVVTIDTSVPVVSLDDLTTNDTTPALTGAIDDPTATVVVNVDGIDYPATNNGDGTWTLADNTLPALIDGPHTVTVTATDPAGNTATDTATLTIDTVPADLIGAITIPEDLNGDGILNADELGTGGSFNAQVALGPDALDGTVVNVNGTNYTVTAADLANGYITAAIPVTGEGPVAIHAEAVDAQGNVDVADADVTVTVDTVPADLIGAITIPEDLNGDGILNAAELGTDGTFNAQVALGPDAIDGTVVNVNGTNYTVTAADLANGYITATLDATAADPVTGQIVIHAEAVDAQGNVDVADADVTVTVDTVPADLIGAITIPEDLNGDGILNAAELGTDGTFNAQVALGPDALDGTVVNVNGTNYTVTAADLANGYITATLDATAADPVTGQIVIHAEAVDAQGNVDVADADVTLTIDTTPQDLITAITVPEDLNGDGILNAAELGTDGTFNAQVALGPDAIDGTVVNVNGTNYTVTAADLANGYITATLDATAADPVTGQIVIHAEAVDAQGNVDVADADVTLTIDTTPQDLITAITIPEDLNGDGILNAAELGTDGTFNAQVALGPDAIDGTVVNVNGTNYTVTAADLANGYITATLDATAADPVTGQIVIHAEAVDAQGNVDVADADVTLTIDTTPQDLITAITVPEDLNGDGILNADELGTDGSFNAQVALGPDAIDGTVVNVNGTNYTVTAADLANGYITATLDATAADPVTGQIVIHAEAVDAQGNVDVADADVTVTLDVTPPDITTTVLAIDPVTADNILDATEAGGSVTLTGTLTNIPTDAVTTGVVVTVNGIDYTATVDAVAGTWTVDVAGSGLAADSDLTVDATATFTDLAGNASTLQDTQTYTLASSIIAFDNTDTAVLAPQPLLVQDDAALGSNTYLALVSLAGLDLQLGSESIGFTVGAGQEGNATFTYSALIGVDALSDYSLVVQKFDTATGQWTAIYGGGQADILDLTLLGSTPGVVIDGLEEGQYRAFMTYNGLAGIGLLGTLTGTMDVYDTTQVGGYYTEVAEGNVITEINDAGEVDVVTPTTVISEVNGQPVVADGTSITGTYGTLVINLDGSYTYTPTASAAGVGQTDQFTYTLTDPVTGDTAQANLNIQLSSVKAVDNVVTAEINPEPLLVADDVALGSSTYLAAVSLAGLDLQLLGNDAIEFTVDPNREGTATFTFDAVITADLLSDYAIVVQKFDEATGQWVSIGGTNPEASLIDLSLIGGTPTAVLEGLDAGQYRAFIGYEGLLGVGLGGTLTGTMDVYNPYIVAGYSVEPISGNVIKDASLTGEVDAASSSAVISQVNGVAVDPVAGATITGTYGTLVIDQDGNYTYTPTVNGANLGQVDQFTYTLLDPVTGNTSEATLYVRLDSDSVDMTWNDADPSQPAVITSPLPVDAMDNVASAEIDMVYPVTTEVLDNAISYNWLLGVGGIVIGSKEGTATFTVDPGNLTDAIIAVNFGSVATVVDGLHVVLTRVNPDGTRTVVADSSDTGVIDLLGIFGSEVQFKIDNLSAGTYELFMESNTLLTALGSVTADITLNHGDITQPPVLVVDPVTGNVLADDNSAVYGTNYVPDYITTTSVVTAVTAENGNTTTVVVGTPATVVGVYGTLTINADGTYSYQATADMANVGKVDSFTYTVSDPVTGRTDTATLHVQVGSPDVDVTWNTADPSADATLPTPSVTADTDDATISMAPVVDPVVDVASGNVTIGNLAGFPPLPVLSSTVTSSQFTVAANTVSDVHVQLNYTASLSLSALPTTGYTIQQLVGTTWVDTAYSGSATALAGVLGAPAFSADVPHLSEGTYRVVFSLSSLISLGTVTLDSVVTTTATHLDQYTPDGQTDWITGNVLTNDVVEGTQLYVMNSTTGTYELAAGQGVNTGEGTLYLYNDGSYFYKPLDSAANATVDVIDYKLVSVIDGSEYTSSLTINLSQELNSLAVSTAANDTFALGNGSDTLIYNTLTAASVTNATGGNTTAGGVDVWTDFHVGNTATDDQADKIDLSNLLIGSQTNLTIGQYVTVSYDAATQTATISVDRDGGLLVEGTYTETPLLQLTNLTGPVTLNDLINNGQIIF

SEQ ID NO: 5504 - protein, 414 aa, Acinetobacter baumannii
VTSEQTSEEGHVFLEHRLSFLGLLAFLQPKFRSFGLSTPAILALADGTIFKGTSIGATGSTTGEVVFNTAMTGYQEILTDPSYAQQIVTLTYPHIGNTGCNEEDVESGRIHKVWANGLIIRDLPLLHSNFRSEQSLSEYLQAHNVVAIADIDTRKLTRILRDKGAQNGCILAGENITEEEAIAKARAFGGLNGLDLAKECCDPTGFEWSEGSWVLGKGFTQPELKYHVVAYDYGVKTNILRMLADRGCKLTVVPAETPAEKVLALNPDGVFLSNGPGDPAACDYAIEAVKTIVETTTLPVFGICLGHQILALASGAKTVKMNHGHHGANHPVQNLEDGTVMITSQNHGFAVDAETLPANLKATHKSLFDGTLQGIHRTDKPAFSFQGHPEASPGPHDCAPLFDHFIELIEASKQ

SEQ ID NO: 5505 - protein, 127 aa, Acinetobacter baumannii
ITSDTNSCGASAGRAAGKSSPKSACGSTSLSASASASLSASASFSASLNFAQINCPFSSWKTRLLSLGSAVPLKKPSITMVSPFFRRMTALVPSLFTTNTSLAATFTNTTDASESFAEVPSVVTKVL

SEQ ID NO: 5506 - protein, 326 aa, Acinetobacter baumannii
LHREEEMKKLFVALGLIMGSLHISYAEPASAQQVPGYYHHQFGNYRITSLLDGTIYLDPKLFKNLSPAEKTKILTKYAAVNEKGIQTSVNAFLVDDGKSLTLVDSGAASCFGPQLGSIAKNLELAGYQLANVKTVLLTHLHPDHVCGIAQNGKAVFPNATIYAHEREADYWLNPANEKTVPADKKENYLGTVKNVKAALAPYQAKKAFKTFKDGDVIQGFEVINTQGHTPGHHSFRLKSKGQQIVFVGDIVHSHSLQFDAPKTGVDFDVNSEQAINTRLKMFAEISNKQQWVAAPHLPFPGIGHVYKVNAEQYQWILLYFNNSLDK

SEQ ID NO: 5507 - protein, 512 aa, Acinetobacter baumannii
MCVENERDIQMSNCPKKYIVAFDQGTTSSRAIVLDHDANVVSIAQREFTQIYPQPGWVEHDPMEIWATQSAVWVEALAQAGIKSEQVAAIGITNQRETTIVWDKKTGRPIYNAIVWQSRQTTEICNQLYKAGWQEYIRKTTGLVIDPYFSATKIKWILDHVEGSRERAERGELLFGTVDTWLIWKLTNGAVHVTDFTNASRTMLFDIEKLEWDEKLLQALDIPRAMLPEVRSSSEVYGYTHTISGQEVGIPIAGIAGDQQAALFGQMCVESGQAKNTYGTGCFLLMNTGKKIVRSEHGLLTTIACGASGEVNYALEGAVFNGGSCVQWLRDELKVIKNAKDSELYATRVKDNNGVYVVPAFTGLGAPYWDPTARGAIFGLTRGASIEHIIRATLESIAFQTRDVLDAMQQDAEEELRTLRVDGGVTENNFLMQFQADILTTPVERPIMKETTALGAAFLAGLATGFWQDLHELRNKSAIEKVFEPKMPSEQAELIYKGWLKAVKRSQNWAED

SEQ ID NO: 5508 - protein, 550 aa, Acinetobacter baumannii
KDSEFNMSAKDVKFGDSARSKMIAGVNVLADAVKVTLGPKGRNVVIDRSFGAPHITKDGVTVAKEISLKDKFENMGAQLVREVSSKTNDIAGDGTTTATVLAQAILNEGIKSVTAGMNPMDLKRGIDIAVKTVVENIRSIAKPADDFKAIEQVGSISANSDTTVGKLIAQAMEKVGKEGVITVEEGSGFEDALDVVEGMQFDRGYISPYFANKQDTLTAELENPFILLVDKKISNIRELISVLEAVAKTGKPLLIIAEDVEGEALATLVVNNMRGIIKVCAVKAPGFGDRRKAMLQDIAILTGATVISEEVGMSLEQATLQDLGTAHKITVSKENTVIVDGAGDAAAIAERVQQIRAQIEESTSEYDREKLQERVAKLAGGVAVIKIGAATEVEMKEKKDRVDDALHATRAAVEEGVVAGGGVALVRAVNALEGLKGANEDQTAGINILRRAIEAPLRQIVANAGDEPSVVINAVKNGEGNFGYNAATGEYGDMLEMGILDPAKVTRSALEHAASVAGLMLTTECMITDIPEDKPAAPDMGGMGGMGGMM

SEQ ID NO: 5509 - protein, 115 aa, Acinetobacter baumannii
AASFCCCVNFCMFEDLLLPMFDDEYYPDILVAELKQLIEQFAKKVQKPALAEQDIYRYAHQTVNEINEMKPQFEDLDSSLDDSAADYIAEAMMMVVQDAGYLDLEMEELVMNREW

SEQ ID NO: 5510 - protein, 106 aa, Acinetobacter baumannii
SKRLSLMELIMSNIRPLHDRVVIRRVEEETKTAGGILLPGSAAEKPSQGEVIAVGNGQITDNGVRALDVKVGDKVLFGTYAGTTVKVNGEELLIMKESDILAVLEG

SEQ ID NO: 5511 - protein, 257 aa, Acinetobacter baumannii
ILWCRMLLHLSDLHFGTEKKECLEAIRDFCIQQQPEVIVVSGDITQRAKYEQFFKCRQYLDSLNIPYLVVPGNHDIPLYHVWNRFFSPFTRYRYFFGELEPTLETEHFYIVGVNSIRRRYHTRGHISIEQIQATFERLDRGPKNKIKLVVFHQPFYTPPDNKHGIKDCPVLGKIALEKWSTTGLFGMLHGHLHKTAIYDLTQIYSLKIDHPIFDIHAGTATSTRLYHHNPNSFNTISNEGKIQHYWFNYDLKIFQLI

SEQ ID NO: 5512 - protein, 117 aa, Acinetobacter baumannii
RNLLSLLIIIWLLKLSHLMFEFAIYTVVASSQCKYLKPVFYPDVLKVGVRVEELRKSAFRMAYILWSESQQQIVATGEAVMVCVNKMTGLKCEIPSEVKSKIIELEKSVGHDLIHLA

SEQ ID NO: 5513 - protein, 348 aa, Acinetobacter baumannii
KFLRSALCFFPFHSINAGKTLQYNTVVNTNTLTVVAVESPTTVFKEDQFLHGFGYDLARNYAQSLNVKLDFKIVTDNATALKWVQQGKANLAMTTASLSSIENKGLMSFSASCGDIVNLQKNGLNPNLSWVFKQADDPLTQTASGFVCQSKQNGLTQQLASFYNRNVVKPEAWSTIQRDLSARIPIYKASFKQSAAQYDLDWHLLAAIGYQESYLKPESVSPTGVRGLMMLTNSTARAMGVSNRNDPAQSIQGGAKYYDLMLSEYDDIPFPDRNWYALVAYNMGPGAVNQIQKRLQAQGKDPNQWVNLYNYLQSNKTRNGRYKQAVQYVTRIRAYLEHIKTAQTRINI

SEQ ID NO: 5514 - protein, 386 aa, Acinetobacter baumannii
NNMSRIMFRKALLCLSLISLVGCNDDDKTETTPTTPEYQLPKILVVGHRGASALRPEHTLASYQKAIDDGADFIEPDLVSTKDGVLVARHENEIGGTTNVSTLSQFADRKKTKNIDGVDLTGWFTEDFTLSELQQLKARERIPEFRPANTAYNDLYPVPTLEQIIELAEANYKKTGKIIGLYIETKHPTYFKNQNLAMEDTLLKTLAKYKYTRDIAPVYLQSFEVQNLKDLKRELDLHKTLKHAQIIQLYDSKTSRPADFVESGDTKTYADLATAQGLKDVAKYANGVGPSKGYILTFNNDGSYKTSTFISDAHTAGLKVHPYTFRPENNFLPAPLKCSPDKPAERCPTGALKEFEAYFKAGVDGVFTDDPALGREAVTNFEKAAK

SEQ ID NO: 5515 - protein, 208 aa, Acinetobacter baumannii
TIRGNSMSDNQVSKDIAENTSAVAENTSAVAETVKTEVAEAKEAVAKTTIRAKKAVGTKATQVKEVVAEKTEQVKEVAHEATSQVKEAIAETQEQVKAVINETEEKIEAETQELNQNIHNQFAQIKQDILQRLDVIKAQFNTSQEGLNELKNTLKAEINALIEDLTKVTKELKGDISQISLKHKDSLTESLKRTKNNAVEAWNKVRDH

SEQ ID NO: 5516 - protein, 199 aa, Acinetobacter baumannii
LFFLYLILMPQEKKLTQQQVIALERDLAKFATMMDSAVRIPFTKQGIGADAALSTIPIAGDVAGFALTCYAIYKAKQIGVPQHKLTPVIKLAVVDAVVGFVPVAGTIFDIFIRPSRKALDVVHTHIREEYAIQSDIHVVHPYLHEKLEKKQQQSAFWRNPVVSWLWLHIPDLLGAFVLLLIGLAVWWGASYLWGLYQTV

SEQ ID NO: 5517 - protein, 155 aa, Acinetobacter baumannii
ITIITIRNKPMLYQHILVPIDGSETSMVAMKEAIKIGKALNSKITVVQVMALDPIIADLYVKTGQTNELIERTRTYLLDILEQAKQQFLQEGLSVETKLLEGFVVHEEIIQAAQELNADLIVMGSHGRTGVRKLVLGSVAQKVLGESHIPVLIVR

SEQ ID NO: 5518 - protein, 130 aa, Acinetobacter baumannii
GRIMPAFLTDDWFATVEKLTAEAGDLNLPPALANLAINLVVTDASGNTELALDGGKIQKGLSSNAKTTLNMDAETLRKVFLEFDMAAAMQAFMTGKIKVQGDMSQLMALQTAKPSQEQKDLFKKVLEQTA

SEQ ID NO: 5519 - protein, 78 aa, Acinetobacter baumannii
GRGILNPLCLPISPPGHVRNNRGQVRDWQEKNREFALFSISSYQYFYKLTNLCHDLFIKLRSVVHLLYLSLRHSLLKT

SEQ ID NO: 5520 - protein, 302 aa, Acinetobacter baumannii
KEVLKMSLEFEKKEYEERLRYRLKILSEKLSEGKVKFASHLVEDFKESMRKIRYDKNGEIILDSVDGRIRSMALGIEQIDTRDKLKKQISLFEIQNLYFELIEQNFGQFYEKMNELRENPHNIADFLSRKEDFVDGMVEQIPSFMEAILEFWRNVGDVGYWHLEDSFDNITGVFGGDLFPTHDENIASKCGIYTDTIVLPDPYVRSIHVFKHYPKESKVYFLIKHALNLLKYKKLACTDAGNPAVVILPDLSNLEENGRDFIYEFSQQDALIHGSKIFGRKFENIDEFDEFCLSLNTGQSKT

SEQ ID NO: 5521 - protein, 124 aa, Acinetobacter baumannii
ILSVLFELSVRLEYLLMKPDISELSVEELKRLQEEAEALIASKKDQAIEDAYNQIIEIAENVGFRVEQLIESCAHKRKKTTPKSVEPRYRNKNNAEETWTGRTKQPRWLVAEIEKGAKLADFLI

SEQ ID NO: 5522 - protein, 269 aa, Acinetobacter baumannii
TFIVTCNKMNITYILPNTPYKSRNISKNLTNIYCLHCKSEIKHEFLVGLQTYESTEDDSYYAEYDLLKCINCDSITYRTDFYSNYDMEEVPNEFGKTEWVRTTRPNYYPTRDKELGNINHVIDLLPDSIQDTFNEVVVALNNKLEILSGLGLRTLLEQICKHFIKDDDLGEILKNFENEGYISTKQRELLDDIRYIGNDAAHRAEPNSIKKHKLSLNILINLIQLLFAYYKYDEPQKKIETGVPLRRSPKGETPKVRETTSKRKPQKKL

SEQ ID NO: 5523 - protein, 506 aa, Acinetobacter baumannii
EMKVQPNDYSKIYDLAVIGGGINGVGIANDAAGRGLSVFLCEKDDLASHTSSASSKLIHGGLRYLEHKEFRLVREALAEREVLLAKAPHIIKPMRFIMPHRPHLRPAWLIRAGLFFYDHLGKREKLLGSNLIYFKEDSPLKPAITRGFEYSDCTVDDARLVVLNALQAKEKGAKVVTRTRCVKAYRQQELWHLELQSGAEFYQIRAKAIVNAAGPWVEEIISKNLGLSSPYQIRLIQGSHIVVPKLYDCHKAFIMQNEDRRIVFAIPYLEKYTLIGTTDQEYIGDPQKVEITDVEIDYLLTVTNSHFKKQLTRADIISQYSGVRALCDDESDNPSAITRDYTLALQAEDKTTPLLSVFGGKITTYRKLAEAALEHLAPFFNDMAEEWTAHEALPGAENWTTLEDLINQIKTRVSGISDSLANRWAHAYGTRVWNMLKERNAIEQLGQHFGHDLFECEVRYLCEYEWAHTAEDILWRRSKLGLAFDEKQVKVLEAYLSERRLKDDAA

SEQ ID NO: 5524 - protein, 185 aa, Acinetobacter baumannii
VVWVKTKILLKGELRLPVSFKHDEVSLFIIFENGLKELNSGAGMSQHIINPKEIPLAFQTAWNKHDMQAFAALFDKDATFVNRFGHYVKGVDEIIAIHQPIHETIYRDSTLENELIDLIPMSEDICISHFWSRLTAGVAHPQGPHQIDTLILTVLTQKNHSWYIQALENVTLTNPRTGETILRNM

SEQ ID NO: 5525 - protein, 90 aa, Acinetobacter baumannii
ATSFTCSVFSATTSFTCVALVPTAFLARIVVLATASLASATSVFTVSATAEVFSATAEVFSAMSFETWLSLMLFPRIVYFLANITIRGIR

SEQ ID NO: 5526 - protein, 112 aa, Acinetobacter baumannii
NQVFLMAALSIHERKRLRQIGHVLNPVVMIGGQGLTDAVIEETLRALNDHELIKVKIAGEDREARAAVIDAIVEATGAEAVQKIGKIVLLYKKAAKQNQHLSNLVRHAHLAN

SEQ ID NO: 5527 - protein, 862 aa, Acinetobacter baumannii
ISSSRDIIMRILIGFVFSFFCLIIHAGQIDWAVAKTSFPSDQSIGDTGHEKTPNGYVDLMSGNLIYDTPEVILKGDRGLDFTLSKSYGKVNSGFRAMGNWELEVPRLVMNTGPSTILKGDIDGNGICEANGDATNNSSGRPSFTASLLNTSFKNKIEESYVNQVNLNLANQTLNSIVYLLGQFGTATGDSNAQYNNQQAQSALSKLQAQLYDAFKTNVNAISISSAEASTEKSKYKQSLINTLQTGQVKIQVNGISLTTGNISSVLDDLAINSNFTVKTNNVILDTVIRQVIVGYLYYHNIIVAKSNEVLNGIYSTVSLNTSSYVDSRQRVISLYLPGQKNIIFYPVNERVTGFPKSAKYVSQDNWFISCAESGKDFVVRSNNGVTYYFPNSNRENQTGFTSFFANEYIPGKVTVYASKIENQYKEAYILNYFSKQANTLIYSGFNTSNKFFLKSVQHTLDDKLINSTSPEIRIDYVKRLDTTENTDESQFDSVKGDILLKKISRFINGGYKDWVSYTYSSGAKAGTTYKLNDSILLNGNIGSFQDENAALFYLDTVSYISGDKVSYAYGGPYRIVGNISPSEIGGITAQDFLWFYSDLTAIKYYKNSKSGLVNALSVDWTYELVNSSRPGFTEEKSFKVTSSKYSIANANSYDVTYSYSRDDSTHEQTTVVTSKDSVTGLSKVYTYVMHAFLGGGAENFLHGLLKKITIGDREESYTWTTLSLIGQKPKTIDDNYTDYEDVRLVRLASKAISHFGEYKTTYSNFDQYGNAQSVQMTGLNGSSTVQFPATTATYFNANAASDDVNTGNLPWIIGLPKKKYQVVLRYKLLNMMHKEQYVVILKLVVLPNINMKRYHSQHVLEI

SEQ ID NO: 5528 - protein, 452 aa, Acinetobacter baumannii
MLGLAMTDNATILQHVPVGKKVGIAFSGGLDTSAALLWMKQKGTEPYAYTANLGQPDEDDYDAIPKKAEQYGAVKARLIDCRLQLALEGIAAIQCGAFHISTGGVPYFNTTPLGRAVTGTMLVTAMKEDDVNIWGDGSTYKGNDIERFYRYGLLTNPNLKIYKPWLDQNFIDELGGRAEMSQFLIDNGFDYKMSKEKAYSTDSNMLGATHEAKDLEYLNAGIKIVDPIMGVAFWKEEVEIKPEEVTVRFEEGVPVALNGQRFDNPVELILEANRIGGRHGLGMSDQIENRIIEAKSRGIYEAPGMALLHIAYERLVTGIHNEDTIEQYRINGLRLGRLLYQGRWFDSQALMLRETAQRWVAKAITGEVTLELRRGNDYTIMNTESPNLTYEAERLTMEKGDSMFTPMDRIGQLTMRNLDITDTRAKLGIYTDAGLLSIGQGSAVPQLDNKKK

SEQ ID NO: 5529 - protein, 106 aa, Acinetobacter baumannii
IYMLENLILIVFLGVTIGWVVGLCYEKVFVLTYGGMEKVFFKIFSINIFFKLISLLFSCLITLLFFLIGMLFLPVIPDALWNNFYISFFMGIVVGVAMKGVVFKNK

SEQ ID NO: 5530 - protein, 81 aa, Acinetobacter baumannii
GSVPFCFIHNKAAEVSRPPEKAIPTFLPTGTCCKIVALSVIANPNIYEKDPVEAVSRILNGGYCSTIHGAFFGKKALIHLF

SEQ ID NO: 5531 - protein, 83 aa, Acinetobacter baumannii
FAKFKFTWFTYDSSILFLNEVFNKDAVKLGRPEELFVASPLASQIPFPSISPFRIVDGPVFITSLGTSNSQLPMARKPLFTFP

SEQ ID NO: 5532 - protein, 139 aa, Acinetobacter baumannii
FKGFMEYIKLSYHHLNFEDRTALMLESRKEGFSARKFAELIKRHPSTIYRELKRNSINDVYQAQYASDNTFARRRRGHRKLKIDSILWKFIVEAIRCLWSPQQIAKRLKTFPDLDQTMNVSHTTIYSTKRALPRADQKK

SEQ ID NO: 5533 - protein, 164 aa, Acinetobacter baumannii
VMQTWNKAFFKFMTIILMGTCCIACDLRKKNEVTVVENKNIIIKKFESDAEYIFGNQILGKKIFSSYNAERLIFQVKDLEQNSDNFIDKIDGRLNKRGWNYKEKYKEAYIYCDRDMNQLELVPPIKIGTVMQSGEGQSLNQLVDYWNIGFIHSRHKRYVCNMNS

SEQ ID NO: 5534 - protein, 62 aa, Acinetobacter baumannii
LPTAQSGLLALPSTFTYTSPSESLTIILVIFPLAFPAHTLPPTTISNIKHKNFLYILYLVYF

SEQ ID NO: 5535 - protein, 233 aa, Acinetobacter baumannii
SKNHPAACRENAAMEKSVTQENSVPVIGQRFRGFLPVVVDVETAGFNAQTDALLEIACIPIVYDAQGQFVPGPAFHAHINPFEGANLDRRSLDFIGIDPFNPMRIAMAEDERTALRRIFKSVNEVRKQQHCTHAVLVGHNAHFDLGFLQAAIARSGTKNQNPFHSFSVMDTVTLSAVMFGQTVLAKACIQAGIEFDGKEAHSALYDTQKTAELFCYILNKLSPYLLDSLVAAS

SEQ ID NO: 5536 - protein, 1065 aa, Acinetobacter baumannii
VMFNNIFQILESFGFLSQHRSVYLQFSDASLNSQVFLQRIDGQHYLNQGMTAELICLSTNAHIPLKTFIGLQVAVDQVTDRGSFFRTTGIITGASQGQSDGALTLYKLTVSDPTYLWHKRRNSRVFMNKSVKEISEILFQEWQGKSPLFASSLTLDLSGLKQTYDVRPFVMQLNESDYDFLTRLWRSEGISWLIDEAELTVASNMDNIQPQKLRLIDDNNQYQALTRRVIRYHRSSATEQFDSMTSLMADRSLQPTSIFVQRWQPDVLQQTDGAGSVQSKHQHSTNYDNQSLSLEEAWHFSPAWMQDLNGEDGATSASNQQIEKFNQNLSAYYDAQSKQFIAKTTVRDTQVGYWFELNEHPEIDQHESTDKEFLIIGKNYYNQNNLPKDLNQQIQTLLQQSDWQASNTDERQANQLILQRRYIPTTPAYNPQTHSPVAHPQRAKVVGPEGEEIYVDEWGRIKVRFLFTRSDDHSHDGGAGTNNNDTDSAWIDVLTPWAGEGYGARFLPRIGEIVVIDFFNGDIDRPFVMGRIHEAQRHPTKFDNKGKLPDTKKLSGIRSKEVSGSGFGQLRFDDTPGQISTQLQSSHGASQLNLGKLSHPKDKAESEDRGEGFELRTDQWGALRAGQGLLVSTHKQDNAKGDHLDAEVAKKQLEGSQTNSKALSDIAKNQKTDEIESIEQLKDFASQIQQQIAKFEKALLLLSSPDGIALSSSEDIHISADAQINQIAGDSINISTQKNVIAHAQNRLSLFAAQSGLKAVAAQGKVEIQAQADALDVLSKLGITISSTDDKVIISSPKEVKITGGSSQITLNGSGIFPKTGGKFQVNAGQHLFMGGASANASAPELPKAKPMQGALELLRSYGGDNFFKQNSYKVIDSLGKQITGKLDGNGFAQVTGIAPGPAKVVFEKDNTSAWLQSSDFKRNYTWAEPVKSVQGLMKNALEAVGQNTMSQLQNNLLSTDKNSFKNLGKNTLDNLAGQTVAQIKNQVTNTALNTVSKQLNLNLSADQMKSLGQMATNPSQSLEMLKEQGGDFLSDQMTAKLFKTTNQESPIQQGDLDTFVRSKK

SEQ ID NO: 5537 - protein, 704 aa, Acinetobacter baumannii
MDLKLRLLSLSIAQLCCIPATFADTNNSSTTLATIKIKAQQTSDQTYKVDSSSSATRSEIALQDTPQSVSVVTQKVIEDIGATRLVEALDLAGGVTRANNFGGQGLTGFNVRGFTSGEFYRNGFPINRGYPNAPDSNTIERVDVLRGPSSSLYGRGDPGGTFNLISKTPKSEQQTTLGAQLNSEGLYRTTVDTTGTIPNAENIGYRLNVIAEGGDSYRDHVESKRYGIAPVIQWQATDATRVTFEADILRNQHPLDRGHTRYPTQKSFNSSPETYLWETGKYYNRLYNDNNMAQLRVEHDLANDWKLNAGVQYLNGKLHGYAVEANGIQNDGETLGRNYNYRELKWQDTDAQINLTGNFQLLGLAHTLVTGLEYENYDYKSYIIRSSGDIGSYPINIYNPVLGQPLPELNRVTTHDRENLKTTALFVQDQIDLNERLSALLGLRFEHYEHDYKNLLPNTTNWNTSHDAFIPRLGLVYKASDDLSLYGNAAKSFKPNTGASRNGEGFDPEEGTTYELGFKWQALDNMLSIDSAIFYANKENVLTLDPVDSAYKVAAGEVRSRGIELNIAGQITPAWKIIGGYAYTDAEVTTDNTLQKGTALANIPKNSFNLLNIYEFQVGPLQGLGLGINQKYIDKRAGQTANSTYTMKGYAVTDLVSYYQATPKLRLNLDVKNIFDKVYDESAFNLYAYPGESRTVQLGMSYTF

SEQ ID NO: 5538 - protein, 68 aa, Acinetobacter baumannii
EAYKNSDVFCNGKKYQLEVIQPKDYSKETINEENRLTFTSIEKEWNIGMYYQEQGTLYCGNELPIINI

SEQ ID NO: 5539 - protein, 269 aa, Acinetobacter baumannii
SQIKNNSWSSKIIKKVLKYYATSCKKILGRSMTSYANLLKPLHLGFTTIKNRVVMGSMHTGLEDRFFNYPKLAAYFEERAKGGVGLIVTGGISPNRQGWLAPAGGTMNSLFDIPQHRLVTHAVHKHGSKILMQILHAGRYGYQPFVVSSSAIKSPISPFKPRQLSEKNILSTIEDYAQCADIAKKAGYDGVEIMGSEGYLINQFLSRHVNQRTDRWGGEIENRMRFPVEIVKAIRAKVGENLLSVSVYRCLTLCMTVTLCKKWLRLRKL

SEQ ID NO: 5540 - protein, 354 aa, Acinetobacter baumannii
LRRKQMKKNINTALPNTWLSTVYLIVLSLVLLVSQLGFAKDRIQYHVQNFDGSTLKVINEQGVVSQSYQYAPFGQQLQLKKPSNLKNPRAFVGGIQDANDLVYLKQRHYNPVVGRFYQPDPITFISGGYGQTNRYQYGWNDSYTFKDSSGEIPLPIVTGAIGGVMGGGVSIFTQIYKNKGLTVNWREVGVATTVGAIAGAVSPWTATTTIGAIATGSTANVMQYGINQKLSNQMITQKDVIINAVSGAIGGGIGGSVVSKLKIPTASSPFISKSLANKINNNQLFYANVGDQTLYRNILANMASNDMFNWGSHINYNFLNNSQYGSYYKGNMGYDPELWTSGGLYLEISKPAPK

SEQ ID NO: 5541 - protein, 346 aa, Acinetobacter baumannii
TALNSITLLQPDDWHAHLRDGLALKRTVPDLAKQFARAICMPNLVPPVKTVEEALAYRERILAHVPEGNNFDPRMVLYFTDHTSPDEVRKIKESEHVNAIKLYPAGATTNSDNGVSDIRKVYAVIEQLEEHQVPLLLHGEVTHNHVDIFDREKRFLDEVLSPLLKQFPKLKVVLEHITTSDAAHFVLEQDRNVAATITPQHLLFNRNDMLVGGIKPHFYCLPILKRQTHQTTLLEVATSGNPKFFLGTDSAPHAQNAKENACGCAGCYSAPNAIELYAQAFDQVGKLERLEGFASHFGADFYGLPRNTSTITLVKEDNLVPESFDYLDNQKIIPLHAGKTLQWRKV

SEQ ID NO: 5542 - protein, 1596 aa, Acinetobacter baumannii
IKGFILMAKENTQQKEIKRQPAVELAVFNLNSVTDVADLQMIASQVQLYLQVCGNTTLEQIKSKANITTVANIFALTGSVLDLMLYATDKKTGDAAVQRGALLAANLIGLFSEPNNEAHARMALRPMFGLMAECLYRENGKIKETDIKRLGLHLNAMIAGDLENFLKETQAKLSSLLISATTLGVTILQSMATPATGINAGITTAAGASAEKRDPKLKFTNWAVPLIDLLGKPSQANLTPKIQPNITSRLQQEATQAIAALSQTLQQQANAGQKYTLAWLLQETLKAIQALENKGNASVPINQTGEYERHTKGDTLEFVSLQADALNAPPCEGADSQSGKSISYSIGAERVQHADFYLPKIGFSFIRQYNSQMDEFDQSMVGARWMMPFSNMIQQNAQGYLFIDSKGRKHQLPVSIIFETYEVPYEGWIIKPLKNGELILDFGGEWRSHFQSFDGGKNYYLVKKMNETSQEEILLEYLLLDHIAYLKVINFKLKQAEYELKFAFNEQVKIIAVFLDDKAEPLARYEYDTQGNLIKAIDQNGHTRTYEYNQFHQLTRYTDRTGRGQNIRYESTEAKAKAIEEWADDGSFHTKLKWHPRLRQVAVYDAYDVPTYYYFDLDGFTYRTRLADGRESWYSRDGKKRITRQIDFDGRETQQEYNDQDQLVKIVQPNGGIIRFAYNKQGNLVEIKDPEGSIWKREYDENRNVSKEINPLGHITQYKYNNDNQLVEVIDAKGGVKKIQYNELGQMISYTDCSGKSSTWEYDEDGALTAEQTANNKVVQYFYSTKGRDKGQLQSIIYPDGLKEYFEHDEEGRLLKHTDTKGLVTEYKYNQVGLLEQRIDANRHSVAYQWDKQGRIQKLINQNQAEYLFGYNPYGYLIREQAFDGEEKHYSYNENGRLFQIRRPNILTQFDYYADGQIASKSFTHLHTGQKQTEQFDYNLNSQLSRASNEVSQIDLYRNALGQLVREHQHYKIPELKPLTAVLHYEYDELGNLIKTIRPDGHTLNHLVYGSGHIYAIGLNNQEVVSFQRDDLHRETTRLLANGLMQTKQYNDVGLLSSQFNQPEQETQDYLQYQAHRKYHYDKNYLLSQVEDSRLGKLNYQYDPIGRLIAAQSLHKTESFNFDPAGNLIDSESVLSPAQIKNNLIKSYKGKHYQYDVQGNVTEIIQAGKNLKLTWDNQNRLIRSDNNGLVTEYGYDVFGRRLYKKTAKELTLFGWDGDLMIWESFKSAQTNYTKHYIYEPDSFVPLLQAGYKDFIQLIETPDYQEYQTKPYSIYKDPVWNRNLGKERTALEQFTFYHCDQVGTPQTMTNIRGECVWEILQDTWGAVSQIKALNQDNPFEQNNLRFQGQYYDRETELHYNRYRYYEPHSARYVSKDPIGLEGGMNTSSYVSDPNQWIDPKGLNSFNYGEMFGIPASAQSGLAYQGQRNYECYAETGELCKIKVPPLFDYVACSGGGLGIGVGFVKNPWTGEYYISGSKDSLLIPVAKSVAQNKQFSAKDLAGASCVGGNIHNIPSYTKTTMTMGEITNEFVSGASVTVGGGAYGAVANVVVPLVSKSSPVKGTWASELGVGTPGFNVGVSGTVSVDTILDAVKPSKK

SEQ ID NO: 5543 - protein, 428 aa, Acinetobacter baumannii
CRICRNRLVANRGNVHQLLKSKEEIEYLVTLHTHRYANMPLPKQLEKKFWCLNLDRTRQNISKFLASGVLTYLIFILLALPTDYLVIGVPYITLDFIHCLLSAMNIALALLLFWVFAKFTKLSEHFYLAACGIVFLTIIINAMLLLSVGNMALKNQSMLLLSFLYMLGFILSGIKPLHMLCVGLLAAFLVFAFLILLDVNCDYIALGRALFGSCILGFSISSMLISRERSLFLNNQLAEINEQILRIEASELLHLSQQDALTQISNRRTFDEMFDFFYYRANQEKRPLAVLFIDIDFFKNYNDFYGHQMGDKVISSIAAAIKNSIRHVDFVARYGGEEFVVLLPETPAQGAYSVAANIYKAIERQAIPHAASLVSKYVTISLGFTVYTGGLKMGQDRLIHAADQALYRAKQLGRNQIYYQPLQVAEIA

SEQ ID NO: 5544 - protein, 110 aa, Acinetobacter baumannii
SMYRKFLCFILLIVVGGSVWAGNARGKITSIIVRDSDGLVYVNVEGRANKPDCAVGNYMIIKNENSATGKRQLALLLMAQAANKVISVTGYGTCTRWPDGEDINYILVEK

SEQ ID NO: 5545 - protein, 804 aa, Acinetobacter baumannii
CKYRKFTLDYRITKKKISGSFTLQTTEYDAQGAIRSNTQAGRVTKYKYETVSFSTCLGNLASFQWSKFVSCLSNYVLGDQHVGLPIEVDVGNGKEITQFAGYKRGIPTQVKLANGATETNIVDDFGNITQHTDADGVISRKQYDDAGRLYIDTPIVGLNYSTFTYDGLTVSRVVTGGGQLSRIEKYNGDGLLISSEDKISNKSIINSNKYDAFGNLIFKSNPGFSAITSGTTSSYDVFDRPITVNDNGSVVTYCYQSCGGKTGAIVQTTDSFGTTESNLLAAGDFSADLKTLVARKGTDGSVFQTTTEFENALLKPKVAVSGSSTQSYTYNSNTTLATEKDNSISGQKTFKYDDTGRITSITHPDSSVETIKYFQLKDLIASRTWREVETTYSYSLAGRLKTTTNANISEAFDLDTYGRVISHTQKINANDTNNSYVVRYGYNQLNQVTSIQYPNGKSVNLSNQNALGEVTSIPNVIQSLNYNARQQLTTVQANTDTLWSYTYNDSGLLNNISATSLEKCVLNVDYGYDKLNRVNKLSDKCGSVYNATIDRYGTGLMSTVELDQARYQYSYNNDDITKVNITSKSSTVAPAIYTYNYVNNTSRLASVSGSTYSFTYDAMGNVTNDGVRTLTYDNYSRLNKNGNETYLYNADGLRVRAVRDDGLTDYIYDLDGNLLYDINYKSGYSRAYVYVAGKLVATLERYPDANKGFDFVNDFEAAELGLTDLLGSYTDTDNDGLPDYLERFIGSDPNNPDTDGDGHKDGYEYRLLGAKGVLSSSVKPDVADPNENLAAWMTPILALILEDD

SEQ ID NO: 5546 - protein, 150 aa, Acinetobacter baumannii
GQISMKLNKLSLVVFILFIFTGCGEIYSQPSDKYPFEVKMKALLGDNLKIVNSIRKAEVQISSFRFEKDPNKLKKVINQLEEDGWVLKGKGQGVDTYCLGRNNRINVVSPTMIGVFDYQGGKLNITDYNSDAISYSYNKWGDDMCEQSEE

SEQ ID NO: 5547 - protein, 478 aa, Acinetobacter baumannii
NCQSDPRKSWRKFIICFRLSLLDLVHDGNTMQEVVTVAKALEKAGVTLLNTGIGWHEARVPTIVTSVPRAAFVDYTAHVKQHISIPVIASNRINMPETAEEILATGKADMIQMARPLLADAFWVNKTATNRVDEINTCIACNQACLDHAFKNKRVSCLVNPRAGHETELVYLKTKQPKRIAVVGGGVAGMSAATVAASRGHAVTLFEANADVGGQFNFAKVVPGKEEFHETIRYFKVQLQKTGVDVRLNTRVNREQLEREGFDEVIVATGVVPRALKIEGSNSPQVLSYAQVLQGAEVGRKVAVIGAGGIGFDVSEFLLKPPHQPQPQPLAEWQREWGVDPDPNYVSEGGMQPPVVEPAIREIYLLQRKTTPLGIGLGKTSGWVHRAQLKKHGVRMLRGVQYKAVTDEGLWIEHNGQDQLLRVDTVVVCAGQESVKDLMPKEGESTIANYHIIGGAKLAAELDAKRAIKEGAELAAQL

SEQ ID NO: 5548 - protein, 239 aa, Acinetobacter baumannii
SPVGFSCFKSLRLKKLVLTIKLEMCQAQSLWLCCAFFSPKKVSHLETTRIYNGKTMPNLETSSKKLHIIRTAIRLFTTYGFHTTGVDLIVKESEIPKATLYNYFHSKERLIEMCIAFQKSLLKEEVLAIIYSSRYCTPTDKLKEIVVLHVNSNSLYHLLLKAFFEIKGSYPQAYRMAIEYRKWLIRELFDLIFSLETRALKPDADMVLNLIDGLIFGFLSTNSLSERDEVLERFFMPVR

SEQ ID NO: 5549 - protein, 294 aa, Acinetobacter baumannii
DIFMKKLFSVLFSASVLTLTACNKQPAQTENTAAKDKTESVRTIKLVSTGSDTDVWKYVATLPETAQAGIKLEVTNLTDYVVLNTSVASGEQDVNAFQSFNYLAAYNASNKAKVAAVATTYLEPMGIYANKVKTVDEFPQGATIAIPNDTANEARALTLLQSAKLIKLKPGFDPVKGTVNDIAENPKNLQLKPIQMTTAVRVKNDVDAIVLGNTLALEGGLNVMKDAIFREPIDQSTKLYVNLLGVAEANKNDPIYTKLGELYHLPKVQKFVNEKFGGTKVEVNKPVSEFADIK

SEQ ID NO: 5550 - protein, 110 aa, Acinetobacter baumannii
GIIMKKQMKFTLSFFSSLFILAISTSTFAATNSDQNVIGTIERIYLSGDTYFFRLNGNDTCAKKTNGYNEYYTFKVSQPHSKNWYALILTAAQTRKPGRVKLEVRHKPPN

SEQ ID NO: 5551 - protein, 73 aa, Acinetobacter baumannii
EGVMIKINCLMLITGLSLLLSGCKKDVEIKPQFKSSNEATPHDYSSVPAEQFKGKLSFLKNNWIKSLLIKRLF

SEQ ID NO: 5552 - protein, 63 aa, Acinetobacter baumannii
YSTISQGSFSPNLKVIIFMNLLLSFEVGAEGIVNISKSRQNARIRLSSIKLLFLLSIKTLEAI

SEQ ID NO: 5553 - protein, 116 aa, Acinetobacter baumannii
PNSIYESIVMKKIVLSLSICFFSTSALAVTNCGPYKVKSIQTQANDVLVEFLSSDGKSYFKQIGLWSSPSTRPFLATVMQAFGMNKPVSIRYAQDNYLCASTEYTVPIIMIRIANS

SEQ ID NO: 5554 - protein, 72 aa, Acinetobacter baumannii
LDKIFTNQKIILRDEGIAFAPTQSFLVVQIPVERLNEETYQRNIVPRIRENGWILEKHIKIQMFFVMVRNIS

SEQ ID NO: 5555 - protein, 88 aa, Acinetobacter baumannii
IKKIFRLMIIMRLKNKLLSGKWDFVDSYDNYYNFCKTNNYSIDILNPIHDRNYTRESDEVDFKSKDYWYFALYNDKLGVNNCMEYYGK

SEQ ID NO: 5556 - protein, 87 aa, Acinetobacter baumannii
IIMIVRKFIFSLFIFSLYCSLIACSTNPTSLQELSKELFSEYLYEVDTDRNKSSTQLIVIKINKENFSINDYNEIKKQTIKWKMGFC

SEQ ID NO: 5557 - protein, 102 aa, Acinetobacter baumannii
SACLILGPSVKTILEEDLGIDVYFCDPHSPWQKGTCENMNGLIRQYLPKGIDLNQADQHYLNQVAMSLNTRPRKALDWLTPLEKFAQLVDYHMAFETVAPHV

SEQ ID NO: 5558 - protein, 75 aa, Acinetobacter baumannii
SSCFKFLSCVVIAYGNECQEIMDVQSQLLFIGSSAKTFKLWWQNERGLADWPKKPSTPEGVPLPFRRRGGTRVRH

SEQ ID NO: 5559 - protein, 271 aa, Acinetobacter baumannii
LTLSYVLIMAQSFHSKQLQTHQLAKGFLIKASIVVCSSFAVALTGCSTLPKHSPEPIQYARDIDTSQTSLSKIITPLREKNPNLTGYHLLNDPLEALAARLRLIDKAEKTLDLQYYIWDNDKVGALALHAIIRAADRGVKVRLLIDDNNAKKMEGVLLALSQHKNIEVKLFNPYRFRKYRAMDMILDLKRINRRMHNKSFIADNQVALIGGRNMTNQYYNVSDSYQFSDVDVMLVGAAVDDIVNSFVDYWNHEYAYSVQSIVRCSTTRFAL

SEQ ID NO: 5560 - protein, 144 aa, Acinetobacter baumannii
CDMSEQTIELTPTRPYLARAIYEWICDNQLTPYLLVDATQPHTDVPQQFVKDGQIVLNIVPHAVHQLLISNDAITFSARFGGVSKDIYVPIQAVLGIYARENGQGLFFDPEEYANVAPVEDKLDSETQETSEPTKKKPTLRILD

SEQ ID NO: 5561 - protein, 399 aa, Acinetobacter baumannii
SIFTVIKKINRNNTMKFTAEHEALRRTARQFVENELNPNIPEWEEAGRFPIHDVFKKMGDLGLLGICKPEENGGLALDYSYNLVVAEEIGRAACGGVPLAIGVQTDMATPALARFGSKELRDEFLTPAIAGEYVASIAVSEVHAGSDVAAIKTTAKKDGDDYVINGSKMWITNSLQADFFCLLANTSDDKPHVNKSMIIVPAKTKGISFSEPLNKLGMRSTTTAQVYLDNVRVPQRNLVGVEGMGFMMQMMQFQEERLWACANAIGGLENLIQKTIAYTKERTTFGQPLINNQYIHFRFAELMTEVEALKALTYQACEQHIAGEDVTKLASMAKLKAGRLSREVADSCLQYWGGNGFMWDNPASQLYRDGRLGSIGGGADEIMLGIICKLMDILPKKQK

SEQ ID NO: 5562 - protein, 107 aa, Acinetobacter baumannii
FMNTRSLKLSFIALLCIALAGCLSFGPLKYRQVKMLKKEGFVLTNEGWTLGLPERLLFDFNDATLKQSHEAELTRLANQLNKYDLNKLKIVGHTDDVGNPEYHQKLL

SEQ ID NO: 5563 - protein, 226 aa, Acinetobacter baumannii
PIHTTIPCDMSVENTSIQGITLYSHADDFRSHWIRFLLAEKQIKYQLIVTDHEDEDLASLNPYNQLPMLVEQNLKLFSAPIIAEYLDDRYRQNKLYADAPMARAEQRQYIWRLENDWFKLADHMLRHADTLNIEQKQKAQKELRDTLISLTPLFQHFPYFMSENFSILDCMLAPIFVRLNSMGIDLPKQQCRPIFLYCKRIFSRPSFVKSMTPQEKTRYNELLNME

SEQ ID NO: 5564 - protein, 104 aa, Acinetobacter baumannii
FDATRRTLPGLDILETFQRWIGAFGNLDTGAAWLSSARVVRCWVKSRNERNPFPYLPAFRMGTLRILPVTNWRKAGTTSSHHGPYGQGYTRATMVGTKGCYTAM

SEQ ID NO: 5565 - protein, 308 aa, Acinetobacter baumannii
MDETKMSYQSIFRPDAFANKVIIVTGGGSGIGRCTAHELAALGAQVVITGRKIEKLEKVSQEIIEDGGLVHFIVCDNREEEQVKNMIAEVIEKFGKLDGLVNNAGGQFPSALENISANGFDAVVRNNLHATFYLMREAYNQWMAKHGGSIVNMTADMWGGMPGMGHSGAARSGVDNLTKTASVEWGKSGVRVNAVAPGWIVSSGMDNYSGDFAKVIIPSLAGNVPLKRMGTESEVSSAICYLLSDAAAFVSGVTLRIDGAASQGTRMYPLAEATNSQSYNGFHRAFIPEIFKKDKTEKVEQSNNSGSE

SEQ ID NO: 5566 - protein, 271 aa, Acinetobacter baumannii
NFMTQTQSIVNSTLKKFSKIGLYGKKVTSATAAISEGFYLVYRHGLYKDPNNPVNTRYVQYFCRRLCQVFNLEVQVHGTIPREPALWVSNHISWLDIAVLGSGARVFFLAKAEIEKWPILGNLAKGGGTLFIKRGSGDSIKIREQITEFLKQNIPVLFFPEATTTDGHSVKRVHGRLLGAAIEAQRPVQVCLICYVNRHGELDTVAPFIGEMSFVEHIQRVLEMPKVTAHLLTLPPISVEGHDVKSLTQEVQEKMVEGLAQLHKKVLKPKS

SEQ ID NO: 5567 - protein, 152 aa, Acinetobacter baumannii
KDFLIMGKFFVGALLLVGINTATFAADITGLWQTIDDKTGTPKAHVEIRKEANGTYAGKIVKITPRPGYTPKEICDNCPAPYTNKPILGLDIATGLKQTDNSTYTGGKILDPNTGKVYGLKAKLSANGKRLHMRGYLGVSALGRNQIWIRLE

SEQ ID NO: 5568 - protein, 63 aa, Acinetobacter baumannii
VNNLFQTQFCQSVNELMCLRQITLITVIMKSQKLINQDLNLYLLISVIRTYLKFWWRLGESNS

SEQ ID NO: 5569 - protein, 245 aa, Acinetobacter baumannii
APLYPCGSMQKWQNIGYKENKMFMILYGFLITLVGYLCAKPLNRRFPQVPLLVFGMFIVIGLLSILKVPYEEYRLYVNDLFSHLLGYVTVALAIPLAAMRYDDLPLKSVIGILCFASISAVALPMGLAYLLHMSEPTILAFATRAVTTPIALNIATLLHAPETLVTLIVILSGVIGAAFSPFLLKHIHDERASGLALGLAAHAIGTAQAWQRGPVAGRYAAFGMALNGVFTAIWLPTFMLSFGIH

SEQ ID NO: 5570 - protein, 326 aa, Acinetobacter baumannii
SNQYHIGLTIYSDFGRSWYCSVFSWDRIGKKLKFKCRCRFSFIFGSELNFSCWKCSMYQINALNPKDEGHKARKRFGQNFLHDQRVIAKIVRSVNPRTGDNIVEIGPGLAALTSPLIGECDALTVVELDRDLAAGLPERVPHPERLTIVEADALKYDFSQLVKDGRPLRVVGNLPYNISTPLLFHLLEFGSQVKDMHFMLQKEVVERITAEPNTKEYGRLSVMIQYYCQPTFLFEVPAGAFNPPPKVTSAVFRLVPYEQKPITAKDEKALARLVAHVFTQRRKTLRNSLKGMLAEDGFEKAGVDPMARPETLTLAEFVALADQMVA

SEQ ID NO: 5571 - protein, 142 aa, Acinetobacter baumannii
MKTLSAKPAEVQHDWFVVDATGKTLGRLATEIARRLRGKHKTSYTPHVDTGDYIIVINAEQVQVTGNKALDKKYYRHTEFPGGLKETNFEKLVAHKPEEIFERAVKGMLPKGPLGYAMIKKMKVYAGSEHPHAAQQPQVLDI

SEQ ID NO: 5572 - protein, 206 aa, Acinetobacter baumannii
IKEQTEHMIATSIEQIPNIPCFDDSPRGRLLHGAAYLFHKQGYDKTTVRELAQFIGIQSGSLFHHFKSKDDILAHVMEQTIIYNLARLNDAVTQSTDPEQQLRALIKSELISITGDTGAAMAVLVYEWFALSKEKQDYLLKMRNEYEQIWLDVIEKLRTQGKVKHDAFIWRRLIGGAISWTVTWYKSEGKVKIDELTEMVWEMALK

SEQ ID NO: 5573 - protein, 132 aa, Acinetobacter baumannii
GIQHMATNYGTGRRKTATARVFLSAGTGKLVINNRTLEQYFGRETARMVVRQPLELLEATEKYDLYITVKGGGIGGQAGAIRHGITRALIAADETLKPVLRQAGFVTRDAREVERKKLGLRKARKRPQFSKR

SEQ ID NO: 5574 - protein, 96 aa, Acinetobacter baumannii
FLDKIMRNRMANNQQDDHRVVKIGCASGFWGDTNTAAFQLVHLTDINYLVFDYLSEITMSIMAKAKMVEPKHGYALDFVSRVMAPLLKKLLKKRLK

SEQ ID NO: 5575 - protein, 408 aa, Acinetobacter baumannii
LMVNMTRYVLELNKNIRTFLKMQLNPIYYNEQHIAFADNVRRFVQKEMAPFVNEWDEAETFPRELYKKAAEIGLLGLGFSEEYGGIPDADPFYSLLAGIEMAKAGSGGVHISLMVHTIGAPPIQHFGSEELKARVLPGIISGEKISALAITEPGGGSDVAALQTKAVRDGDYYIVSGEKTFITSGIRADYYTVAVRTDPTKTGAEGISMLLIDAHSEGITKTSLKKMGWWASDTAHLHFDQVRVLASNLLGKENAGFKVIMNNFNMERFFLGVVAYGYALVCYEEALEWAQQRKTFGKRLIDHQVVRHKLVDMATQLTSTRALLEETAWKMTQPKLQGPELVAQISMLKNVATRTMQFCADAAVQTLGGMGFMRGTKSERIYREVKVNMIGGGAEEIMKDLISKQLGY

SEQ ID NO: 5576 - protein, 334 aa, Acinetobacter baumannii
NNSNFRDVSGVIVLPLYVTSGEPAGIGPDICLSLAKRVDERPVVVLADRNLLQQRAQKLGLDIKFLEYSGQAESSLQGELYIEHVALKAEVIDGQLNPANAAYVLEQLRRSADYAMSGKSVGVATAPVQKSVINDAGILFSGHTEYYQEFAGVECVVMMLATKTLRVALATTHLPLRDVADAITKERLHQVIDILLHDLKTKFKINDPRVLVCGLNPHAGEDGYLGREEIDTINPVLESYRSQGVKLSLSLPADTLFTPEHLKNADAVLAMYHDQGLPVLKSQGFGEAINITLGLPFIRTSVDHGTALSLAGTGLAKSSSLNVAVDLALSLAAS

SEQ ID NO: 5577 - protein, 124 aa, Acinetobacter baumannii
KIRNRKNKMEYKGSCHCGQVKFAAEGELTEALSCNCSICQKKGSLLWFLPTNQVTVTLDSPDILANYTFNKHVINHHFCKNCGIHPYAQGIDAQGNSIFAINVRCIDDIDLEKIKINYFDGRSV

SEQ ID NO: 5578 - protein, 291 aa, Acinetobacter baumannii
WISCQKNKNKESAMTLSASLQALDIDDSIQLEQDGSILYLWLNRPESRNAMNLNMVNAIQQVFNAIRDDLSIRAVIIRGEGGTFCAGGDIKDMAALRVEATNVGSLQPYTNFNRRFGAMLEQVEAAPQTVVVILEGAVLGGGFGLTCVSDVAISRDNAQFGLPETGLGVIPAQIAPFVVKRIGLTQARRLALLGMRFEGHTALSVGVVHQIAHNEIELEQALEETIQHIKRAAPLASRVTKALLHRTLNEPLNQLLDDAAQQFAQAVGSAEGQEGTMAFIQKRLPNWADES

SEQ ID NO: 5579 - protein, 169 aa, Acinetobacter baumannii
LTMWHSAKKVLFCILVVFATSGPAYANSKHNFYVLTLSILSYSKWENVSTPTLCVIDNASITSTFQSYIQQLSYNYRVQTVNAKDFSKSHCQAVYFSTTPPQQQQNLIQNYPYRSLLSLSINNPECEVGSIFCLYNQNNYTTFKVNLDALSHSKVHIDPRVLLLAKNAE

SEQ ID NO: 5580 - protein, 558 aa, Acinetobacter baumannii
LFVRDYHVDYGKSEDGRTETWLRFRFCQPSHGTLTKKIAEKKIKVISNAGGVNPLACRDALQKIIKEYGLDLKVAVVLGDDLLPKHEQLKSQNIQEMFSGEALPEQVASSNAYLGAVAIRDALDLGADIVITGRVVDSAVVLAPLLHEYQWPLDDYDKLAQGSLAGHVIECGAQCTGGNFTDWQLVQGFDNMGFPVVEVSEDGSFVVTKPQGTGGLVSTATVAEQIVYEIGNPQAYLLPDVIADFSHVHLEQVGEHRVRVTGVKGQAPTTQYKVSATYPDGYRVLVSFLIAGREAPQKAQVIADAILTKCERVLAMRSVPPFSEKSVEILGIESTYGDHAQTLNSREVVVKIAVKHMFKEACMFFASEIAQASTGMAPALAGIVGGRPKASPVIKLFSFLIDKNQLNIEIDFEGKRYPVEIPQGDSTEQLLTLTAGENAVYQGDEIEVPLIEIAHARSGDKGNHSNIGVIARKADYLPWIRAALTEQSVASYMQHVLDAEKGRVIRYELPGLNALNFMLENALGGGGVASLRIDPQGKAFAQQLLDMPVKVPAHLLEK

SEQ ID NO: 5581 - protein, 279 aa, Acinetobacter baumannii
MTKRYNYVIGDVQGCFEALKALLKEIRFDPDQDFIWFAGDLVARGENSVGALRFIKKLADRGAAATVLGNHDLTLIAGARGLKEIKEKDRTQDVIDAVDGDDLIDWLRKQPLCLFPNEQTILTHAGVPCIWDAQKTAVLAKEVEAVLAHDDLSVLDAFLAEMYGSKPDLWTDDLTGNERLRCITNYLTRMRLTNAEGALEFSFKDTLDAPMPEGYLPWFEFPSKAAQTHQIFFGHWAALEGRTISEHIQNVDGGCVWGKNLIAYRLEDQQAFSVSNPVM

SEQ ID NO: 5582 - protein, 134 aa, Acinetobacter baumannii
NLMSKLLEIKNMDKIKSIDWAAWVGTLLLIIGFREGSVVVMRAFGHPELGNLVGLISLLIVLLIWRKFKKIPLRLVDTNNKVMKESGFAFLPICAGSLIMLVHMGKEIPLFLFVLVVSTLIPLWVYAKMAKHWL

SEQ ID NO: 5583 - protein, 342 aa, Acinetobacter baumannii
DKSRIVMWNPNSIIFCFYLIFSILALWGIIEAWVHQSRTETIHPFKAFVHLLAFYLSYLLVPLWFFNLYAGWIGYYSIHETIFIFLLSGILIYARFIEPHMVRVDVHQYRLNPDRHFAKPVKVALIADLHIGLFSGHERQLKIIVKKLNEQQPDLVVVAGDWTYEPEDKLVQELSVLKDIKAPVYSVPGNHDEQYPGPPIQQLLKDALHYNDVMDIEGKIVEFDEFRLIGIGDLWAGKTDMRSMPDLPQDKPWLILSHNPDTVDMVPKLPNRPLMLSGHTHGGQVELPWVTNYIMKKVSILGHKRGFYSHEHADVFVTVGTGMVGIPLRFRVPPTIDIIELV

SEQ ID NO: 5584 - protein, 546 aa, Acinetobacter baumannii
FRLGVRNKKMTILQSEITVGSEQYQKNKEALLAQLSEVRAIQQKSIDKSYAAKPKFDKKGKILPHERVRLLLDADSPFVELCGLVGYNMHDDKDGSEAGGGVIAGIGFVSGVRCLVSASNSAIKGGTMSPMGVQKTLRLQKIALEQKLPLITLTESGGANLNYAAEVFTYGGMTFANQARLSAAGIPQLAVVHGNATAGGAYQPGLSDYVIVVRKQTEMLLAGPPLLLAATGEVATAEELGGAEMHAQVAGTAEYLAENDADGIRLAREIFEHLNWKEQIKPVDVTYKEPRYDTEELLGVIPSDPKQPFDMKEVVARIIDDSDFLEFKQEYDDLTVCGWAKIGGLHIGIITNNGPITPQGAVKAAQFIHLCEQTNRPLLFLHNTTGFMVGTDAEQNGIIKHGSKLIQAVANCTVPKISIVVAGSYGAGNYAMCGRSLSPDFIFAWPNSHVAVMGAAQAGKVLRIVAEGKQKASGQEPNPQMLDFLEQSTAMKLEQQSTALFNTAMLHDDGIIDPRDTRKLLIFLLETIYEAQQRGLNPTRFGVSRF

SEQ ID NO: 5585 - protein, 454 aa, Acinetobacter baumannii
SFTLFRIYSHVEYVDRHQGGERTILVSVSVQLLDDLDAEEFALLAQSAGADILEHIKVQRNKPDPKFFIGSGKVDEIAEQVQDLEASLVIFDHALTPAQERNLEKILKCRVIDRTGLILDIFAQRARTHEGKLQVELAQLKHLSTRLIRGWSADFEQQKGGIGLRGPGESQLETDRRLIRVRITQLKDKLEKVHQTRMQGRAARQKASIPTVSLVGYTNAGKSTLFNILAKSDVYAADQLFATLDPTLRRLEWDGIGTVVLADTVGFVRNLQHDLVESFKATLEETLEATLLLHVIDSSSHDMLDQIEAVEGVLKEIGADAPVLRVYNKIDLSGEEAKIIYSEPHVPDRVYVSAHSGLGLDLLRQAVQECLMGQLQHFSLVLKPAYGKLRTQLYALNVIQSEHYDDEGLLHIDIRIAPHKLEQLIRQAKLPIDEILGERASHFKRPLEEFEIKH

SEQ ID NO: 5586 - protein, 202 aa, Acinetobacter baumannii
IILMGVLFNNYKVYSMMTKKQLTSKQIDMLLELLKNRFEKNIHRHKEIDWTNVRAKLIESPDKLWTLQEMENTGGEPDVITYDQQKDEYLFIDCSVESPKGRRSLCYDREALESRKDHPPKNSAIDLVQEIGAELLTEEQYHQLQQLGEFDLKTSSWLATPEEIRKLGGALFADRRYGRVFIYHNGAQSYYVARGFRCCLRV

SEQ ID NO: 5587 - protein, 652 aa, Acinetobacter baumannii
EIRIKIMKFSKILVANRGEIAVRVMQTAKAMGYQTVAVYSDADRNARHVQEADEAVYIGASKVSESYLSIAKIIEACKKTGADAVHPGYGFLSENTDFAQACIDNQITFIGPTASAIELMGSKRLSKIAMIEAGVPCVPGYEGDRQDLEYLATQAEQIGFPIMVKASAGGGGRGMRLVQQASELFEALQTARSEAENAFGSGELILEKAVIAPRHVEIQVFGDTHGNYVYLFERDCSIQRRHQKVVEEAPCPVMTPELRQKMGEAAVAAAKTCAYVGAGTVEFLLDASGAFYFLEMNTRLQVEHPVTELITGLDLVEWQLRVANGEQLPLKQQELTLNGHAIEVRLYAEDPRQDFLPQTGKILRWKPATLPNVRIDHGMLATDEVSPFYDPMVAKVIAYGKTREDAIRLLARAVDDSVLLGVNSNKQFLVNLLRHPVVVTGDTNTAFIQQHFQNDPSLHHQVLSLETLAIAAALFSQSKGTTVWQTGLGVPLPLKLQTADQQIQLQLSSVNNTFTVELCEQTVSIEVVEKTAEQLIYLLDGVRHRVQYVLDGDQLYLDRDNGNVAIRNVTYAAPEIADVAGDGKIRAPMDGAVVNILVNKGDQVIKGQTLLVLEAMKIQQQIKSDVDGVVDEILGQQGQQVKKRQMLFSIQI

SEQ ID NO: 5588 - protein, 117 aa, Acinetobacter baumannii
LQPVKVMVGLTRLELVTPRLSSVCSNQLSYRPSDTSMKNNLLWILTNLQSFVKEVIQPQVPLRLPCYDFTPVIGHTVVTALFAVRLATSGATNSHGVTGGVYKARERIHRGILIRDY

SEQ ID NO: 5589 - protein, 413 aa, Acinetobacter baumannii
ERGVRIMISKLYQSTSLHALFRKSQFTIFAITFFICSFTFVSISVFTMETYAKQNLQLLSHTLLERIQPAVVFNDKITIEQILNEYTNDHSIRAIHIYDSEHHLIAQSFKLSSQTSVLEKWFDHWFLNEPVHLTIYHHQQNVGELTLFGSSEKILQFLKMIMVGLAIAMLFIVCALWWSVNLTYRQIMQAIYPLTNIAQIVSEQKAYNLRFPYNRIKEFQDLNTVFNELLEEIQIWDNQLQKENRKLSFQAHHDQLTLLPNRHYFYQILLDMFEDKDFDNKSALLFIDNNNFKSINDQFGHLAGDEVLKEMAKRLQTRLRHQDFIARLGGDEFAVILHSITHADHLISIAENLLESCKEPLHLNDQTIYFSFSVGIALSQFASSPEDFIMQADQAMYKAKTSEQHWFIYKPEN

SEQ ID NO: 5590 - protein, 219 aa, Acinetobacter baumannii
SMAFDLVQYFAEQIKIQKPQLLNQYPANEKNKLIDEVNILTLGKLISLWRQDDNKIYHEIKTADPLYIQEVARHLTTSKHNKSVLKNAELEQSISEILALQLTELNQLDETGGFGQSGLKELILGQVEHLSGQAEDWVWSTNHLTELIGSKPVEQEELSLDATMKEFNQMVHQAQPHHEDLHVEEQPIETFIPGWSKIIAPLVALAILGYLYCMYTQLV

SEQ ID NO: 5591 - protein, 275 aa, Acinetobacter baumannii
KQQFDVHIQQATDQNSMNLTFRSHAFDKWLDRNIKFDWVKAEVVKDSPDKIRSKAKKEEHLNFQLINHLEKPESNVDLISAYFIPEKQGAKILSTLAKEGVEVRVLTNSFKANDVAVVHAFYGKYRKELLKNGVQLYEFLPTPDKRDLNKNTDELATKAKVNMKGLSRSSLHTKLMALDEQVFIGSFNFDPRSAYLNTEIGVILDSPSLAKTIHHTMDENLNKYAYKLKLDPNNHIYWQQETPKGPVIYKKEPEMKWWQKAGMKLLSWLPLEGFM

SEQ ID NO: 5592 - protein, 243 aa, Acinetobacter baumannii
LYGSYSKDRCMMKAVLFDLDGTLIDTAADFIRIIQQMCRDARRPVVEADLIRTQVSEGARAMVKLVYPELDVTNPIFLAHRQNFLDLYGNNIVVDTDLFEGMYPLLEELEAQRIPWGIVTNKPRGLSESLLEKLNLTDRCAVLVCPEDVSKTKPDPEPMYLAAKQLNIPANEIIYVGDHPRDIDAGRNADMYTILAAYGYLPIEHRDDLNAWQADSIVNTVTELHELLRQKLPALQENQRMIS

SEQ ID NO: 5593 - protein, 178 aa, Acinetobacter baumannii
ENMPNSQAKKGLFQFYPHNLIWLGLSVLAIVLDQWTKWIASTHLNYADPVPVLPFLNWTLLHNYGAAFSFLSDAGGWQRYFFTSLAGLVSILFVFWLLRMPKKMVVLPVAIALILGGALGNLIDRITLGYVVDFIHVYYQNHHFPAFNIADSAITLGTILLLIDTFFLEKQRPKNSDA

SEQ ID NO: 5594 - protein, 162 aa, Acinetobacter baumannii
MIFTVSLHFARTVFNMRDIRCKRGCIMKKLFTILALCITVLTTSMASFADPPFDRGHGPKGPKGGPRGEWNDRGHKFDRDDNGDRVRDERRMREERGFERLKQHRWQPGYVMPQHYRGNGYKVDYKDNNLPKPDRNQQWYKINNDYILVDTDSNSIVSIRGF

SEQ ID NO: 5595 - protein, 145 aa, Acinetobacter baumannii
FKGFMEYIKLSYHHLNFEDRTALMLESRKEGFSARKFAELIKRHPSTIYRELKRNSINDVYQAQYASDNTFARRRRGHRKLKIDSILWKFIVEAIRCLWSPQQIAKRLKTFPDLDQTMNVSHTTIYSTIRALPKGELKKDLLSCL

SEQ ID NO: 5596 - protein, 75 aa, Acinetobacter baumannii
YWSASHITMLPHPTYQRPSLERLFRGHKVLGKSYLEVGFPLRCFQRLSLPNIATRRCDWRHNRYTRGSSTLVLSY

SEQ ID NO: 5597 - protein, 244 aa, Acinetobacter baumannii
KKKAKISRKVFFFLQEVNYSLGQTGVGIPMNLDRHTQFLMRKEKILSVAEKLLLENNQEITLDELVAELDIAKGTLYKHFRSKNELLLELIIQNEKQILEISQKYNTDFKEYAPRYMLHHLLTPGKTILLHQLEENLTMTESKLKHLFEELYEVRQQRILAIKDITESYLKSLNYDMSIRDYLSYIWSLTYGASLLLNSTYYQRSIGSRQKLINLYINQALSLPTQTTNFDALNFQIEDENSQN

SEQ ID NO: 5598 - protein, 145 aa, Acinetobacter baumannii
ISSYFIENFHIYYSSPSRFICNFSLIFNYRNLIDHSRFTMKKITTAIVLSMSGLIATTAMAAPHDHYHHQGYETKTVKVIHKDDHANIWRAGQVVPHQYQHPRYVIDYRSHQKLTKPGRYQKWYKVNGNYVLVNEQSHKIIKVIR

SEQ ID NO: 5599 - protein, 733 aa, Acinetobacter baumannii
RQDFKLMNQNTNTEDTIDLKELFFSLIAQWKLIALCIILSLVCALLYLRVTPDTYSVDALVQVEDSKGASAALLGDLSDMIEQKSPAQAEIEILKSRLVLGSVIKELHLDIHVSSTENTLTHRLLSDTEYKTEYTKNSVLFKDGTKNFDIRRFEVPAYYLDKQLVLSFDQKSFKLVDPETDEVVLTAPINQNNQITGAYGVWKVAIFTKDQLDSKYNIKKLSIPAAVDNISSNYSVAERGKLTGILGLNYQGYDKEHITQVLNAILVTYGAQNVERRSAESAQTLKFLDEQLPDLKKQLDDAERQFNKFRQQYNTVDVTKESELYLTQSITLETKKAELEQKQAEMAAKYTAEHPAMREINGQITAINKQIGELNSTLKQLPDVQRQYLQLYREVEVKTQLYTALLNSYQQLRIAKAGEIGNVRIVDTAVEPVEPIKPKKLQVLILSLFLGGFIGTLIALLRNMLRTGIKDSGQIENELDLPVYATVPRSPIQESRIKILKKKKSIPILAVKNSDDIAIESLRSIRTAIHFALANAKNNIIMIAGPSPEVGKSFISTNLATIFAQGDKRVLLIDADMRRGYMHKYFDVDVKPGLSELLSGQADLQKVLHKTQVTNLDVITRGKSPTNPSEILSSNQFKELLEQLQSQYDHIIIDTPPVLAVTDGIIISQYTGVNLIVARYAKSQIKELELTLNRFEQAGVKVNGFILNDIQRASAGYGYGYNYAYAYKAQKED

SEQ ID NO: 5600 - protein, 390 aa, Acinetobacter baumannii
KELQRINPMNMALKVSMASKSAHLTPEQIEEFGHRVEQIRQDVMQSLGEQDAKYIYKVRNFVRYTEIASRGMLMFGGWIPPVWLLGTGLLGISKIVENMELGHNVMHGQFDWLNEPSLNGNTYDWDTIASGDDWRETHNYVHHTYTNIVGKDHDVGYGILRVSDQQKWEPRHLFNIPLALQLMFFFEWYVGVQNLHLEDALVYKTKSWKQVWEDAAKVRKKATRQVLKDYVFFPVISGPMFLPVFAGNVVANIIRNLWSSAVIFNGHFTEDAETFEPDNTDTETKAEWYLRQIRGSSNFSGTEWLHFMSGNLSHQIEHHLFPDMPANRYKEVAPKIKALCAEYGINYNEANFMRQFWSVWVRLAKCSLPNHTTAKVMQTLEKLKAKFKFA

SEQ ID NO: 5601 - protein, 289 aa, Acinetobacter baumannii
GHRQNGNRMSIPQSLLEQSIQINIQQALQEDIGDGDITAMLTPEDEQATATIISREDMVLAGQPWVNALISAYDNTVQVTWLKQEGDRVAANEAFLKLTGSARSLLTVERPALNFIQTLSAVATKTAEYVQHLEGLNTKLLDTRKTLPGLRIAQKYAVTVGGGQNHRLGLFDAFLIKENHIMAAGGIAQAIAKAHQIAPGKPVEVEVETWDELNQALEAGADIVMLDNFSQQQMIDAVKHVAGRCKLEASGNITIENLREVATTGVDYISMGVLTKDIKAVDLSMRFNA

SEQ ID NO: 5602 - protein, 73 aa, Acinetobacter baumannii
YLQHASQHTFIGLQNAPLPRIQSIHPQLRHIVLAPLHLPRRPTRLVSYYAFFKGWLLLSQPPSCLCLPTSFPT

SEQ ID NO: 5603 - protein, 207 aa, Acinetobacter baumannii
FMQQMEQKKSTQKRNQLLAAALDVFSLYGFSGASLDEIAQLADMHKSNIFYYYENKESLYVEMLTTVLQKWLAPLQTLEAELEPAEALSHYLIQKIELSRSQPKASRLFALEIIQGAPHILPILKGPLKKLFKRKAKVIQTWQEQGKISPDIDPELLILNIWGLTQNYADFATQMEMVTGKTLRNRSMFQRSIEHTVHMMLYGVLPR

SEQ ID NO: 5604 - protein, 338 aa, Acinetobacter baumannii
PYFKFMKLLRLNALSPNFQLPQTAVTIGNFDGVHLGHQAMIAQLKKIAAAQGLKTLVMIFEPQPLEFFKGYDAPPRINSLREKVEYLAELGVDYIAVAKFDQHFRSMSASEFADLLKDKLNAQALVLGDDFHFGKDRQGNSEFLKNYGFQVTNLHTIELEGERVSSTRIRQVLQVGNLALAAKLLGRPYSITGRVQYGDQIGRTLDFPTINVRLNRHKPCLNGIYGVEVICETTSLTQKVLQDNPEKPGIAGYHENSLYGAGHVGTRPAIQQEHPEWRLEVHFPDVSANLYGLFMRVTFLHYLHGELNYPSLEALKAGIDNDVQQLRQYRNDTTQFPF

SEQ ID NO: 5605 - protein, 407 aa, Acinetobacter baumannii
AFLKLNHMLSLLNKAKWLIGGNFVFAFSQWVILIFLARMTTQENLGQYSLALAIVTPVFAIFNLQLRPLYILDLNGEQKYRYSNFYYLRLITSIVALFVCLFVCLFSNVSFFVVVLVAFLKFFEAYSDIIYAYYNAHDQTKLISKSLFIKGVFSVGGMLIGLYFFNFYIALILFLLIYLFVWLGLDNSYIVRTNELKKIRIDYSIMNLAIPMGISLGIVTLQSNIPRLFLGHYIGVKAVGVFTVLSYFIIVGSIFINSICQYLSPRLTRAWNSNKNEFRKILFLAITIAGSLGVIAIIVSYFFGEFFLNLIYGEIYKEYTYEFNLIMVAGFILYVCTVLGYTLTAIGFIKKQAFLFSIVLIFSLLISYLCIPEYGVLGGIYTLIGSYSIQCILSIFVILFLSKEKLK

SEQ ID NO: 5606 - protein, 358 aa, Acinetobacter baumannii
REIKMKVMLFITGLGMGGAEKVVCELADKLYELGHEVCIVYFTGEIIRRPKNNINIIYIPLKISSLIFSVYSVMKLVDQWKPDVIHSHMFHANIIARLAKIRRKNIRIICSSHSNYEGGALRMMMYAMTEKLCDVHTNVSSNAATALMHAGAVRKRKIKAVYNGINIKDYHFDEVENKYLHKAFNLKNEAKTILAIGRIDTPKDYPNLLKAFKIIYEIDNSVHLFIAGNGPKKEEIMLLANNLGINSNVKFLGIRNDIPKLLNSCDLFISSSAWEGFGLAILEAMICKKPIVATETDGAKELLNNENLVEIGNPELLAKKALQKLNSNLGLIEYSGIESFDWNEISKTWLSLYEGKDF

SEQ ID NO: 5607 - protein, 127 aa, Acinetobacter baumannii
IPPKELGLENAPLNGMEKPNEKFIKVIIKKVNLTGLSKKSKQALFKLKIEKLITNKRNKRTPINKSTALFNAADININTKENINKIQIIPLLSKIKLFLFPVNANTKKMNIHTPNTPKEITFKKSIE

SEQ ID NO: 5608 - protein, 249 aa, Acinetobacter baumannii
NNNNPGESLYSPVFLENDMKKISLVIAASTMSLSVFAAAPITNKSPAKDQFSYSYGYLMGRNNTDALTDLNLDIFYQGLQEGAQNKTARLTDEEMAKAINDYKKTLEAKQLVEFQKQGQQNAQAGAAFLAENAKKSGVVTTKSGLQYQVLKEGSGKTPKATSRVKVNYEGRLLDGTVFDSSIARNHPVDFQLNQVIAGWTEGLQTMKEGGKTRFFIPAKLAYGEVGAGDSIGPNSTLIFDIELLQVLPK

SEQ ID NO: 5609 - protein, 348 aa, Acinetobacter baumannii
PETKEERMNATLNYQPHWVREDFVDFVLQKINATWAWKRVLAEVTAVQPLHTDMVLIKLKPNRNFNFEQVCAGQSILLTLLIDGVYQQRSYSIIEVTTQGEIALGIKIQGLVSRAAQLLHVGECVEISQPQGDFTLHQGQQPAILIASGSGITAIYSLLQQALKQQLEQIHVIYFNRAEIFHAELKALAEQHPQLQYHFFNTTEQKQHLTESLLQKLVPDFAQTATYICGHHGMMQQANEIYAQKGAQSQLHQEYFQPLQVTGTHAAQPVIFRRAQHEFLAETNLLSSAEQAGLRPQHGCRMGVCNKCSCTKVSGVTQNLLTGEIEDQPNRPIKLCVSQALSPVTIDL

SEQ ID NO: 5610 - protein, 267 aa, Acinetobacter baumannii
NMTNLNLNINQNDVELIPENHPESQEPVVGAEILIEQLYKFYGEVKVLEDLNLHIQPGEFLAIVGRSGCGKSTLLRLIAQLEKASFGEIKFKSARHLREGITNDDIRVMFQDPRLLPWRNILQNVQLGLPKSQHALAEELLEKVGLKEKAGQWPSQLSGGQRQRTALARALSHTPRILLLDEPLGALDALTRLEMQSLIERLWKEQGFTAILVTHDVSEAVQLADRIILLDKGQIAQSFQVNLPRPRKKSITFAQLEQQVLDAVLAT

SEQ ID NO: 5611 - protein, 952 aa, Acinetobacter baumannii
LNWKTTCMSDKQTTENAVDYKATLNLPDTQFAMKANLAVREVKWLEEWYTDNIYQQIRATRIGKKKYILHDGPPYANGTIHLGHAVNKVLKDIIVKSRTLAGFDAPYVPGWDCHGLPIELKVEEKVGKVGEKVDAATFRKHCREYALKQIDLQRTDFKRLGILGDWDNPYLTMNYKQEADIVRALGLIQKNGHIQPGLKPVNWCMDCGSALAEAEVEYEDKKSDAIDVGFGVVDLKDLSARVNVDVQDPTDIVIWTTTPWTLPANQAVALHAEIEYQLVQVTTERGKQNFILAKDLVASAIERYKLENPIVLADFTGSALENLTLQHPLLTDRQVPVILGEHVIATSGTGAVHTAPGHGADDYKVGLQYNLKVENPVGGNGVYLPTAPIFAGEHIYKANPKIIEALGAVGRLWAHQPIKHSYPHCWRHKTPIIFRATPQWFISMDQKGLRDGALNAIENDIEFVPNWGKNRIESMIEGRPDWCISRQRTWGVPIPFFVHKDTNELHPRTPELIEEVAKLIEKEGIDAWFNRDAKDFIGEDAEQYNAVRDTLDVWFDSGTTHYAVLEQRDELESPADLYLEGSDQHRGWFQSSLLTSMAIHNRAPYKALLTHGFTVDENGRKLSKSLGNYIPLEEIIKQLGADGLRLYVASSDYRYEIAASKEIFSRVSDSYRRIRNTLRFLLANLNGFKPSTDALAVDDLIALDQYILQRANEVQQTIIAAYEEMNFHVVCSALTSFCINDLGGFYLDIIKDRQYTTKADSQARRSAQTALYHIVQAFVRWMSPILSFTAQEAWPLIPEQTEKYVFTAEWYDLPVSSKANLLSEADWQTLISVKSAVNKQIEAARNAKLVGSNLSAKVELWANESLQTVLNQLADELRFVLITSQVVVHPFAEQGEATEMEGLRVQVSAAEGEKCARCWHVLPDVNTHADHPGLCGRCIVNVTGRGEVRKYA

SEQ ID NO: 5612 - protein, 188 aa, Acinetobacter baumannii
MNTDTALIMALPNESKGLFEQAGIEVHYSGIGKINAAFKAFEVIQKTGCKTLINLGTAGSSSFNRHDLVEIKTFVQRDMDVSPLGFEVGVTPLDDHLAAEIHLQTHFADLPKGICGTGDSFETGQPKVACDVVDMEGYALAKVCHKLGVRLISVKYITDGADDTAHLDWEENLLLGAQKLLALYQNHF

SEQ ID NO: 5613 - protein, 246 aa, Acinetobacter baumannii
LFLEPFMSKALPIAVAVVLGGAALVPVYYATQHPTTEVGRKADKNASPIQKISYVLGYEVAQQTPPELDTKAFVQGIHDARNKQPSAYTQEDLKAAVAAYEKELQQKMQHQDKPEQAGTATDSADAQFLAENKTKAGVKTTASGLQYIITKEGTGKQPTAQSVVKVHYEGRLINGQIFDSSYKRGQPVEFPLNQVIPGWTEGLQLMKEGGKATFFIPSNLAYGPQELPGIPANSTLIFDVELISVK

SEQ ID NO: 5614 - protein, 333 aa, Acinetobacter baumannii
GNKDINMQHQSLFNKSQWTQLVKRFSAVAVLGLTIAAPAWAIDPTVKELRIGFQKSSINFAIAKQQKLFEQEFPNAKITWNEFPAGPQILEALAVGSLDVGVTGDTPPVYAQAAGKPLYYIAYEAAKPLASAILVPKNSQLKQLKDLKGKRIALQKGSSSHYLLVQAVRKAGLKWSDITPIWLTPADARAAFQKGAVDAWAIWDPYYASAQLEDQARVLASGKGLSPNYTFYLAAPNFVKQYPKAVPGLIKQINQADKWVQSHQAETASAIGQSTGLKTATSDLFIKRRPRPSSAAPLNSKVIAEQQQLADIFTQQGIIPKPISIKQAVWGAK

SEQ ID NO: 5615 - protein, 149 aa, Acinetobacter baumannii
IDWDNNFMQFKNILVVCIGNICRSPMAEYFLKQQYPQLNIESAGISGLIGHQADEKARLCMQRLGIDMQPHVARKLNAEHIKKADLILVMSQNQQKHIEQTWPFAKGKTYRLGHWQNRNVPDPYRHDQAVFDETCQLIQQCIADWKPYI

SEQ ID NO: 5616 - protein, 62 aa, Acinetobacter baumannii
YCPLHSNKCLLNAGCPDSSRKKIKKHRKIVELCMFNLYQCFLSYISSNFLHNSRNKKTGYIR

SEQ ID NO: 5617 - protein, 183 aa, Acinetobacter baumannii
VPFCYSSIHSSLRSKDLKIRMHNMTEIIQPNEEIRITDGSKVDLHFSVAIENGVEIDNTRSREEPVSLTIGDGNLLPGFEKALLGLRAGDRRTVHLPPEDAFGPWNPENIQTFDTVKFEQRPIPGHMIEFEDKAKATLFGVVKSVNDDITEIDFNHPLAGKNITFEVEIFKVTPAGQQGIKIM

SEQ ID NO: 5618 - protein, 137 aa, Acinetobacter baumannii
CNYCCSTEKIAQMDSVGQQRMAALHGGNRDKLEVSPNLWAGIGLVRGGAGTALVGDPETVAARIQEYADLGIDTFIFSGYPHLEESIRFAELVFPLLPIETRAKLAQPNLTGPFGEIIANNYVPDEKKQNSSVKEPA

SEQ ID NO: 5619 - protein, 81 aa, Acinetobacter baumannii
RLSWHTDLESTAKRYKEDSKQKSSKSHVLDKKTPKLALGVRCFMNLTNYFNNFMALLIYEYIISVHFIPFLITTWLSQFLV

SEQ ID NO: 5620 - protein, 63 aa, Acinetobacter baumannii
AHLRTPPLLFRRRPPQSNYPPDTVLVPDHGTELEPQHYQGGISRTAPLELAFQLQSLPPILHK

SEQ ID NO: 5621 - protein, 63 aa, Acinetobacter baumannii
AFIFIIHLYDSIFPHSILYKHPIPFIYYRDVDISFLYSAYAAESYRLEFFCQQLILLLWFCPK

SEQ ID NO: 5622 - protein, 244 aa, Acinetobacter baumannii
PKFRGDTMSQLNVDLQEIAKFEALAAKWWDQHSEFRPLHQINPLRLNWIDERAGGLAGKKVLDVGCGGGILAESMARRGADVLGIDMGEAPLAVGRLHAQQENVQNIEYRQIPVEELAQEQAGQYDVVTCMEMMEHVPDPASIVKACQTLVKPGGHVFFSTINRNPKSYLFAIIGAEYVLRMLPKGTHDYHKFIRPSEMAHDIRNAGLTLKEMTGLHYNPITKRYWLAPNVDVNYMVHTVKTGA

SEQ ID NO: 5623 - protein, 66 aa, Acinetobacter baumannii
LKLRDFSWKHGINHFAVQVQLAIRSQHRVPRICLRYMPTSFHLDNQRQADLAFSVLSSHYTEVMEY

SEQ ID NO: 5624 - protein, 430 aa, Acinetobacter baumannii
GIRLTFMQLADLRIAIIGLGYVGLPLAVEFGKKVPVVGFDIYQKRISELKSGQDHTLEVSPEELKQAAQLSYTTNLEDLKDCNFFIVTVPTPIDNYKQPDLTPLVKASTSIGKILKKGDIVVYESTVYPGATEEVCIPVLEEISGLTFNKDFFAGYSPERINPGDKLHRVTNILKITSGSTPEVADYVDEVYNLIIEAGTHKAASIKVAEAAKVIENTQRDVNIALINELALIFNKLGIDTEEVLKAAGTKWNFLPFRPGLVGGHCIGVDPYYLTHKAQAIGYHPEIILAGRRLNDSMGAYVVTQLVKGMIKKKIQVEGAKVLVLGLSFKENCPDIRNTKVIDIVKELQEYHMDVDVYDPWIDSEETQHEYGITPVKQPTAGQYDAVILAVAHNEFKEMGIEAIRSLGKTSHVLYDLKYVLAQSESDIRL

SEQ ID NO: 5625 - protein, 346 aa, Acinetobacter baumannii
YLLRINMNRYEEVLEQLKSNPKTWLITGVAGFIGSNLLETLLKLNQKVIGLDNFATGHQYNLDEVETLVSSDQWKNFTFYNSDIRNLEDCQKACANVDYVLHQAALGSVPRSIADPILTNSANITGFLNMLVAARDAQVKSFTYAASSSTYGDHPALPKVEENIGNPLSPYAVTKYVNELYAEVFARAYGFKSIGLRYFNVFGKRQDPNGAYAAVIPKWTAAMIQGDDVFINGDGETSRDFCYIENTVQANILAAVANDEAKNQVYNVAVGDRTTLNDLFKAIKSALKENGISYDKEPGYREFRAGDVRHSQADVTKIKTLLGYDPKFRIFEGISQSMVWYKHFLN

SEQ ID NO: 5626 - protein, 455 aa, Acinetobacter baumannii
FEIGMPTKSLEKSHNNTQHYVHWFRHSAPYINAHRDKTFVLMFGGEAVRDPNFEHIIHDIALLHSLGIRLILVHGARPQINHNLKEKGIETPFYDNCRITTRESLSCVMSAVGSIRLEIEALLSMGLANSPMYGARIDVVSGNFVTAKPYGIREGMDFQLTGEVRSIDTDAIERHLDNNNIVLLGPTGYSTTGEVFNLRAEEVATKTATYLKADKLIFLGEQQGLPNEDGQLLRELSPHQLDYYIQQYQTTHPTLTLHLQEAKKASLSGVHRVHLISYSYDGALIEELFTRDGVGTMITDAHYEEVRMAHIQDVGGLMNLLRPLEEEGILVYRSRERLEQEINQFAVIERDGMILACAALYPIPTEFNETRSAEIACVAVHPSYRKSNRGSQILQFLEEKAKQQGIRQLFVLTTRTAHWFLEHGFHQVSVDDLPNARQALYNYQRNSLVFKKLLP

SEQ ID NO: 5627 - protein, 85 aa, Acinetobacter baumannii
ILSGKLARAAVPNIVFVEFKRNSRRFISSILSSYYGAQCILQLLVGGVVGDELSESLSSLQALSMSAKDVINKIESFRIGFSQTV

SEQ ID NO: 5628 - protein, 244 aa, Acinetobacter baumannii
ENLGRIMRIDQRALDQLREVKITRNYTRYAEGSVLVEFGHTKVLCTASIDNSVPRFLKGQGQGWVTAEYGMLPRSTHSRCDREAARGKQTGRTQEIQRLIGRSLRAMVDLKKLGENTITIDCDVIQADGGTRTASITGAAVALVDAMNVLLAQKKIKQDPLKGLVAAISVGMYQDEVLLDLCYEEDSNCQTDLNVVMTQAGEFIEIQGTAEDKPFTRAQSNAMLEMAEKGIAELIKKQQEALGW

SEQ ID NO: 5629 - protein, 271 aa, Acinetobacter baumannii
FRQGACMSKDINIVSRGTKQVGQRLLPWIFPIVLLVVWQIASSSGLLENRILPAPTAVVSAFWHLLISGELWQHVKVSAGRALLGLFIGGGLGLLLGLLNGSSRFASTLLDTTLQMIRNIPALALIPLVILWFGIDETAKLFLVAVGVFFPIYINTYHGIRSVDPQLIEMGKSYGLSRWQLYKEIILPGAMPSILVGLRFALGLVWVLLIVAETISAQAGIGYMTMNAREFLQTDVVLVGILLYALLGKLADVLAQLLERYLLRWHAGYQK

SEQ ID NO: 5630 - protein, 372 aa, Acinetobacter baumannii
IHKGLRVKYCQFFSVLALSLSAASCAVTSGLQTYDIPSEGVYKTDLGTTVNVVKISQDTLPAIQPAQVDYQRDYATLFKNQQPIYRLSPGDVLSIQLWAYPEITPPVNNVNNEQSVQASGYPIDQTGYIQFPLVGRYKAAGKTLAQVNRELHSQLARFLKNPDVIVRVLSYEGQRFSVQGSVIKGGQFYLSDQPVSVYAALGLAGGVTDKGDNTYIQLIRNGITYNLNTIELEKAGYSLHKLLVQPNDTIYVSTRENQKIYVMGESGKNQALPMRDQGMTLSDALGESLGLNPLSASASRIYVLRTNPNDHTTELYHLNLMSIGDFGLANQFKLRSNDIVYVDATGLTRWQRVVNQIIPFSSALYNIDRLGQ

SEQ ID NO: 5631 - protein, 213 aa, Acinetobacter baumannii
QLRGKAVTMKKLVLGGLSAAIMAVSGSAMAADFVAGKDYTVIANPGKVEVPGKIEVREFFWYGCPHCFKLEPHMQTWLKQIPSDVRFVRTPAAMNKVWEQGARTYYTSEALGVRKRTHLPLFHAIQVNGQQIFDQASAAKFFTRYGVPEQKFNSTYNSFAVTAKVAESNKLAQQYQLTGVPAVVVNGKYVVQGEDGKVTQVLNYLIEKERKAK

SEQ ID NO: 5632 - protein, 254 aa, Acinetobacter baumannii
KEGGLPMKYSEYQPRPDLLKDRIILITGAGDGIGRAAALSYALHGATVVLHGRTLNKLEVIYDEIEGLGAPQPAILPLQLSSASDRDYDFLVSTLEKQFGRLDGILHNAGILGERVELAHYPAEVWDDVMAVNLRAPFALTQALLPLLQKSENASVVFTSSGVGREARALWGAYSVSKVAIEAVSKIFAAEHTYPNIRFNCINPGATRTAMRAKAYPEEDPKTLPTPESIMPAYLYLMGEDSLTLNGQSIDAQD

SEQ ID NO: 5633 - protein, 71 aa, Acinetobacter baumannii
QFYILHKPFKLIRWFMSHFKFYSALIYKTLFFLKEFKFTIIKKQKKIVLLIILSEIDKKRKEKHIKLGVIP

SEQ ID NO: 5634 - protein, 183 aa, Acinetobacter baumannii
EKHMLVYIIVGSVREGRTAIKIANWLETTIPTFNLKDFQTEVIDLKEWNLPLFSGSHPPATGIYDQPKQQEWADKIAQADAFIFISPEYNHGYSPALKNALDYVGKEWSGKPAAFIGYGSTNGSRSISQIRQVTSSLSIVDPNAVIEIRDIFKRNKDEKFEANEFEVKGLQSIVEKLQKYHLS

SEQ ID NO: 5635 - protein, 354 aa, Acinetobacter baumannii
RLNIYFLRNKNPFRVSAHPIIFLFLFRGARNHMALFNSTSWAKYSVIAASLAGVMMLGGCAKKEEHTTTTLNIGYQKYGILPILKARGDLEKALKDQGVQVKWVEFPAGPQLLEGLNVGSVSLGEAGEAPPIFAQAANPNLVYVANQPAAPKAEALLVQKDSPIQSIKDLKGKRVALNKGSNVHYLLLKVLEANHLSLSDIQPVYLPPSDARAAFEKGAVDAWVIWDPFFAAAEHQIQARVLATGENLVSNHQFYLADRKFAENNPKVLNTVVQTLNQTTEWVSTHQDEAAKLLEKPTALEFDVLKTSISRMGFGVQPISDKVAQEQQYVADAFYAQKLIPNKLTIQEAILKLK

SEQ ID NO: 5636 - protein, 300 aa, Acinetobacter baumannii
VMHMKIFWFIPTHGDSRYLGTSKGARQVDHAYMKQIAVAVDNLGYEGVLIPTGRSCEDPWITAASLIDATQHLKFLVALRPGVTTPALAARMAATFDRLSNGRVLLNLVTGGDEAELRGDGLYEDHSTRYQTANEYVKIWREILTRSHTGEAFTFHGERLEVDDAKLLYPPVQKPYPPLWFGGSSDVAVELAAEQVDTYLTWGEPPAAVKEKIEHVRAKAEAKGRKLTYGIRLHVIVRETNEQAWAAANELIQYLDDATIAAAQKKLHKWTQWVSNAWRLYTAVIETNLKYPQIFGQVSV

SEQ ID NO: 5637 - protein, 215 aa, Acinetobacter baumannii
VFLMSIRDERKQQSRQALLDAALHLSTSGRSFSSISLREVAREVGLVPTAFYRHFQDMDELGKELVDQVALHLKSVLHQLGQSYLQHKSAKTQTSIELFVQAVNHSPKQWQFMIAERWGGSETVRAAIAREIEFLIEDLTTDLTKLENFKHIQNPQDLNVLSTILTNMSFTWAMTWLNLAKQYQGEQLKQQQTAFIENASTQVRLLFRGIANWER

SEQ ID NO: 5638 - protein, 201 aa, Acinetobacter baumannii
TKTIGKQFIGISMKQITPYEVIDGQLKGARQVPSPNFNQRPAGTEIQMIVVHNISLPPSQFGGGYIEQFFQNKLDWSVHPYFQTIEGMQVSTHLLILRTGEVLQFVNFNDRAWHAGRSSYLAKVECNDYSIGIELEGSDDLPFEDVQYEVLTDVVTAIRQAYPEIKSHIAGHSDIAPGRKTDPGPYFKWQHFRQLLAQKKT

SEQ ID NO: 5639 - protein, 516 aa, Acinetobacter baumannii
VSTMALWRSTFIVSAMTMLSRVLGLVRDVVLLNVFGAGKDFDTFVVAFRIPNFFRRLFAEGAFSQAFIPVLTEYKTGRAHAEVQILISRVFGCLLTVMTLLTFVAMVLAPAIIYMYAPGFHNDPEKFDLAVSMFRLTIPYLMFMSLTAFASSILNSYGSFASPAFSPVLLNVAMIAGAWWLTPYMAEPIKALGWSVVAAGILQLAIQIPELWRKNLLIPPKVDFKHEGVERILKLMLPALFGVSVTQINLLLNTIWASFMQDGSVSWLYSAERMTELPLGLIGVAIGTVILPSLSARHAEQDQAKFRSMIDWAAKVIVLVGLPASIALFMLSTPIIQALFQRGEFDLRDTQMTALALQCMSAGVISFMLIKVFAPGFYAQQDTKTPVRVGLMSVAANAILNVVFIGFFKLINWHAEHMALALASSGSALVNAGLLYFYLHKRNIFRFGAHWKKLALQYGLANLAMIAALWFGLKWYNGELSQWIRVAEVVGLCVVGVIAYLIGLLLTGFRPRDLKH

SEQ ID NO: 5640 - protein, 380 aa, Acinetobacter baumannii
RLKMKRPFYQLNQSKDVIRHFTPNWFTATMGTGVVSMILIQLPFAKSFLFMLATLLWQFNIVLFSVFSVLYLLRWFLFPHEAKQIFNHPNMSLFLGAIPMGLATILNGFLSFGIGLYGEVAVHIAQALWYIDVFLALAIAWIVPFCMFSRQNHQLHTMTAIWLLPVVACEVAASSAGMLVAHLPADVHSFHLLLTGYVLWGISVLPAFAILTILMLRMALHQLPEKEVAISSWLSLGPIGTGALGLLLLGEQAQRVFVNVGFPELAHVFQALGVVGSLVLLGFGLWWLGLAILTTLRHAKTGIPFNLGWWGLTFPFGVFILALFNLGHQIEVVFLQYVAVAFSILLLVMWSVVMKKTLAGAYSGKLFFSPCLVALQQRMQ

SEQ ID NO: 5641 - protein, 385 aa, Acinetobacter baumannii
MIKISSTLYILASLLVLSGAFYSIDFLKVISLGVFGVCIFIFFVFALTGNKNNLILDKSGIICILFIFSFVLMLISAALNNAVDLFIGVLLFLLLVINFSIFNLNKACFDFFDKPVKLTFLIITLINFSFGFSIPFNGAFSNPNSLGGIYAMLSFLSTGILLDKAYNSKGKKIDYYLLLIILLSTFLTLVSNSRISFISSCLCLIVLFLYFMINSFNLKKGISIKISFFKKMLATLVVGISAILILWEEIEDIFVKKVMYKMDDGGGVTGGRNEVWDAIIDNSLMFGHGRFSPHLEYFDLAAHNTFLSIYDQFGWLSCSFFAITVVFVAFNVFNPKNIRSYGITPSFICFSFLFLSISESMINKTIFFCFLMIVNLNSFKKNSVL

SEQ ID NO: 5642 - protein, 728 aa, Acinetobacter baumannii
ELRIELMNRREFLLNSTKTMFGTAALASFPLSIQKALAIDAKVESGTIQDVKHIVILTQENRSFDNYFGTLKGVRGFGDRFTIPMTEGRKVWEQYDANKKKVLPYHLDSRLGNAQRVSGTPHSWSDGQAAWDNGRMSDWVAYKKPQSMGYYKKQEVEYQFALANAFTICDAYHCAMHAGTNPNRKFIWTGTNGPTGAGVASVVNEFDGIGPSTEGYEWTTYPERLQQAGVTWKVYQNMPDNFTDNPLAGFKQYRRANEQSGQPVSNDTLTCPAYDEKIDATQPLYKGIANTMPDGGFLGTFKADIAQGKLPQVSWLVAPATYSEHPGPSSPVQGAWYIQEVLNALTENPQVWSQTVLLVNFDENDGFFDHVPSPSAPSKDINGVVYGKTTLTDQQVSYEYFNHPAVATSKSQPKPDGRVYGPGVRVPMYVISPWSRGGWVNSQVFDHTSILQFLEKRFGVQEPNISPYRRAVCGDLTTAFNFKTPNLLPVAELDGKKTKAEADAIRVAQALLPQVPVPSQQQFPQQEMGIRPSRALPYILHTSAKVDATQKTVKLMFSNTGKQAAVFHVYNRLDLTAIPRRYMVEAGKQLDDVWNTTNGQYDLWVLGPNGFHRAFKGNLSQANQTQALPEIRVCVEECDANLYLKVRHDGNKSVKLTVKANAYLPNKTWAIETNSSEKELVWDMSEFGGWYDFTVTLADDATFSRRFAGRIETQEDSISDPYMGYLES

SEQ ID NO: 5643 - protein, 94 aa, Acinetobacter baumannii
DSISLRLPYTVNLATEYKSLTHYTKGTQSHHEGAPTACMHAVSGSISLPSQGFFSPFPHGTGSLSVSQEYLALEDGPPIFRQGFTCLALLVIIM

SEQ ID NO: 5644 - protein, 139 aa, Acinetobacter baumannii
RIHSIKNYLNIELQIIFGCLLGSMDIMRKFFIFGVPVKINSFSPIPEDDEELPLPELIYWASLGDLEQVKQLLIDGEDPNQNDDEGYSALQAAAENDHLEIVKLLVEKGAHVTYKSEYTALQLAEMAGNTDIVNYLKSL

SEQ ID NO: 5645 - protein, 182 aa, Acinetobacter baumannii
KKMSVAQLSKRDLILFDLDGTLVDSAADLYRSMNLSLQSLSWPLVTEAQIREWVGKGASKLCESVLLHIFGKLDVEQHKVLLQKFVEVYGAELCVNTQIYPGVPEFLKHCQTLNIKMACVTNKPVKLAQGLLDALELSSYFQVVLGGDSLPERKPHPLPLLHCMESLKISASQSLMIGDSSN

SEQ ID NO: 5646 - protein, 64 aa, Acinetobacter baumannii
LNTLKWCRHTDSNCGPTDYKSVALPTELCRRFLVFRTFRIGTVCSLAKLPNDASGFFKKTAKNS

SEQ ID NO: 5647 - protein, 95 aa, Acinetobacter baumannii
LLLFELPFRLIAGVEIEVPLEPDVFEPEFWLLPIKLLIGFDELDELLLLFDEDTACPVTKPCKISDKFLALAYFKRKTFKPPKRSAEGTSSISII

SEQ ID NO: 5648 - protein, 247 aa, Acinetobacter baumannii
MKKKSKQWKWWFFALIVFLIFIILQIPATWLISKFSKNNQTVHNVSGNIWQGQADWHRGALRGTIHWKTRPLDLLLLRFAADVDIHSGNTQLTGIMAYGFGKKVIVRDMNGQIAPETLKQIVNWQWPVNSIQLKDIQFNYKKEQGFAAVDGQLHWGGGALIYNIGDRQDRMNMPSLSGQLTDQNGQLQVDIRDQRNQKMANLLLDANMMLDVQLTQRLLLNVPSYDGKAGLDTFVISSRQPLLQGGN

SEQ ID NO: 5649 - protein, 104 aa, Acinetobacter baumannii
YPTLLVIKLKRLEEESEALIASKKDQAIEDAYNQIIEIAENVGFSVEQLLEFGAQKRKKTTRKSVEPRYRNKNNAEETWTGRGKQPRWLVAEIEKGAKLEDFLI

SEQ ID NO: 5650 - protein, 761 aa, Acinetobacter baumannii
EISRVMALLNHQRPLWALLAAAPLIATVSSSAYAQTWKINLRDAELTAFINEVADITGKNFAVDPRVRGNVTVISNKPLNKDEVYDLFLGVLNVNGVVAIPSGNTIKLVPDSNVKNSGIPYDSRNRVRGDQIVTRVIWLENTNPNDLIPALRPLMPQFAHMAAIAGTNALIVSDRAANIYQLENIIRNLDGTGQNDIEAITLQSSQAEEIITQLEAMSATGASKDFSGARIRIIADNRTNRILIKGDPQTRKRIRHMIEMLDVPSADRLGGLKVFRLKYASAKNLSEILQGLVTGQAVSSSNNSNNSSNSSNPINSLIGNNQNSGSNTSGSSGTSISTPAINLNGNSNSSNQNNITSFNQNGVSIIADNAQNSLVVKADPQLMREIESAIQQLDVRRQQVLIEAAIIEVSGKDADQLGVQWALGDINSGIGLINFTNAGSSLASLAAGYLTGGAAGLGSAIGAGSSIALGKYKEGADGSRQLYGALIQALKENTASNLLSTPSIVTMDNEEAYIVVGQNVPFVTGSVTTNSTGINPYTTVERKDVGVTLKVIPHIGENGTVRLEIEQEVSNVQASKGQAADLITNKRAIKTAVLAEHGQTVVLGGLVSDDVEFNRQGIPGLSSIPYLGRLFRSDTRSNTKRNLLVFIHPTIVGDANDVRRLSQQRYNQLYSLQLAMDKNGNFAKLPEQVDDIYNQKMTPPSIASKPKNYQQVPSGGKSSTITTPVAVEPTVQKQTLQLPDPEINRTKNTVTTTTLRPSTAP

SEQ ID NO: 5651 - protein, 500 aa, Acinetobacter baumannii
RRFMTTLAQFEQLKAAGYNTIPVYRQRLADTETPLSVFARFKDQTQAYLFESVEGGENWARYSMIGLGESTVFSCNAGVLSIQHGDGSVTQQNCLDPFQYIREFQKQFKVPTAKLLPDLPSFTGGLVGYLGYDAVRYIEPRLKNVPTADPITLPDLWLMLSKTVIVFDNLKDTLFLIVHADTEQSNAYEDAQQKLDQLEQLLATPVSLQAQPHTPPHFESITGKAKFLETVEKVKEYIRAGDVMQVVPGQRMVSDFDGEALQVYRALRHLNPSPYLFLVQGQTITDKKPFHIVGSSPEILSRLENGIATVRPLAGTRPRGKTKEEDIALEKDLLSDEKEIAEHLMLIDLGRNDVGRVSKIGKVQVTDQMVIERYSHVMHIVSNVQGEVRDDIDALDVFKATFPAGTLSGAPKIRAMEIIDEVEPVKRGVFGGAVGYLGWHGEMDMSIAIRTCVIRDKKVYVQAGAGLVADSNPESEWNETQIKARAVIKAVELSSNGLIL

SEQ ID NO: 5652 - protein, 212 aa, Acinetobacter baumannii
DIGMTWKLQAITGEFTGQEINVDRDMLVGRHQDADLLLQAAEISRRHAALLLKDQALWVQDLNSSNGTFVNDMRIEQEKQLHDGDIVQFASLKFSVFAPAQENTDLPEIEVEPVQAAPTQDLSDQGMPSIAERAAETEVSRDGMPQRVSVPKPAPIPEGVDIHAQPEQTPVAIEEPVSRVTEEKEQQKNASIGLVTIIILVILAVLAWLFFK

SEQ ID NO: 5653 - protein, 279 aa, Acinetobacter baumannii
LMKVWIDKLQQLQWQKLDRLSVVVLAILILWLCWKLASFFWLVIAPPQLMQFDRVELGSQQPQIPNISTFSLFNEPSANAAQESVNLELQGVMVGYPNRFSSAVIKIDNTAERYRVGETIGSTSYQLAEVYWDHVVLSQGNGSTRELQFKGLPNGLYQPMTPDASQQSATPSQPTEPMNTAQQALGQAIQQMQGNREQYLRDMGVSGNSGEGYEVTERTPTALRNKLGLRPGDRIVSLNGQTVGQGQTDVQLLEQARRAGQVKIEIKRGDQVMTIQQNF

SEQ ID NO: 5654 - protein, 80 aa, Acinetobacter baumannii
NFCSNPIDKSSSSSLSVASASRYFCVGFGSGRLLGLGLGSFFRVSQKYSVKSIILTHKKTALRRWLKIETTNYYFLKVAL

SEQ ID NO: 5655 - protein, 163 aa, Acinetobacter baumannii
LVVSIFSHRLRAVFLWVRIMDFTEYFWLTRKKEPKPKPKSRPLPKPTQKYLEAEATLKEELEDLSIGFEQKFQPIHTKNWRFDFHIVKLRLLIEITGGPWSGGRSGKLSNKAWSLDRYDHAEEMGYKIERFHPDSVLSGYVINWIKDELARIEDGADQTISTD

SEQ ID NO: 5656 - protein, 69 aa, Acinetobacter baumannii
SLTSSGGFGISIFKNISSGILRRLSTLPCILLLYIFLRELDLKIKSKYSTLTSRFNLKILYAGLTAAAS

SEQ ID NO: 5657 - protein, 61 aa, Acinetobacter baumannii
DNGSATEKNIKSIPIPAENSMADQLSKLNSGFECLGPSLISPYREQAMKITNTIYSVAASK

SEQ ID NO: 5658 - protein, 288 aa, Acinetobacter baumannii
NCLSVRSKNQMSAQLFVVATPIGHLDDMTFRAIDILKSVSVVAAEDTRQSAQLFKHYNIATPLTACHDHNESNKIEQLVQKLLAGENIALISDAGTPLISDPGFKLVRAAQENGIRVVPVPGACAAIAALSAVGLPSDRFSFEGFLPSKASQRISQLEKLKNETQTLIFYEAPHRILECVKNMAEVFGENRPVGFAREITKTFETIKKMTLKDLVSFIENDHNQEKGEIVLVVGGAPEKTDLEQEKLDELLKRLLQDLSVKAASQLAADLTGIKKKVAYQRALELTQS

SEQ ID NO: 5659 - protein, 173 aa, Acinetobacter baumannii
AYISDGGVMEVNFKNAKILDPCCGSRMFWFDRQNPNVVFGDIRKEEHKLCDGRTLVIEPDVLMDFRKMPFNDEQFSLVVFDPPHLLQAGKKSWLAAKYGKLSQDWREDIQKGFSECFRVLVKGGVLIFKWNETHIKVKEILALTDQRPLFGHISGKRSNTHWITFMKAESKEK

SEQ ID NO: 5660 - protein, 92 aa, Acinetobacter baumannii
IAVSLVYLTAKINNTMEHQTLLDELNSQIEYYSKRTDCPPTRIRIGYKTYYKLMQNPKFADEVSNSALDPNKRKYKKLKIKVTKDDNQLELE

SEQ ID NO: 5661 - protein, 84 aa, Acinetobacter baumannii
TRTSLFALITGRLMDNSKRPINQIIARINDAAKHGEALVLTAEEVKILSKDIGDKVFIPVLTNEQVVQLVKEGKLGQKINNTKD

SEQ ID NO: 5662 - protein, 611 aa, Acinetobacter baumannii
ILGLCNMSNIEQDTRFIVNNNLINKGWILDIQDPNKNVFFESDILRIVNNEFLKKSKKRPDYVLFDSQNKRPIGVIETKSGGKSLTKALDQATEYAEMLDAPLIFAMNNGFCETRHLYTQKPLFIDENEVNELIRVNEAKEFILQETNGIYITPKEILVSRKELINVFKKLNNSLRGEGLRAGIERLSEFANILFLKLYTENANTGIWNSLKSLDNDLLINTTNNILQDIDRQYGASVFTNLQLTNPVAVKEMIKELDKLKLSSIDTDIKGDAFEYFLQQATATNNDLGEYFTPRHITKTIVNLVNPKYGEKIYDPFCGTGGFLTEAFDHIKDNTLIANNSSEEIKLKHNTIFGREITSNAKLAKMNMILHGDGHSGICQIDTLQNPIESEYDVVITNMPFSQKTSYSHLYENKLAKNDGDGVCVLHCFKATKKGGRMALVVPEGFLFKAALAPVRKYLFENAQLKAVVSLPKEVFLPYAKVKTNILYFTNCHNGRTNSDVFYYNVTNDGLSLDSFRRKIDENDLKNLDFADLNKSDFDKYYNELGFLKVNPELIRSNDYIYNYAHYSNSHIKSKFPTIKLKELLSLSGKVKVGEDTNIPIMSITMETWLN

SEQ ID NO: 5663 - protein, 62 aa, Acinetobacter baumannii
KKRSLYVKNKRIFMKYSSNDHDIEIFHAQYAEILQLLCMKNRHMGHFIYFFAVKISTKGAHN

SEQ ID NO: 5664 - protein, 337 aa, Acinetobacter baumannii
DLMSTQPMIEKLIEAHLDFLDEQFAQTQVIQQEFEQFYHWLGSRQLQHLWTFEQVQQLIQKQILDTPASDFLIEQIAEHIRFALIHPANDTATVEDIIPVLTIDRIAQYVASKEEHRKKLIKTIVNNPAFSALLTQLIQQTIHDYLDESMSKRVPGVGRFMKMGKSVLETVTDSNLDDTINHYLQKNILKLSQMSERVLNQHFDNDKLYHFQANVWHKVKTSPLSVLKNYIEVQDLTKTVGLGHEIWDHIRQTDYLKQQVHDGIYTWYVRNQERNFDLLLRDLNIDENLVKHELTELLVPVLQQLVTTGHLRRRARVYLEKFYYSEKALEILNNKGA

SEQ ID NO: 5665 - protein, 74 aa, Acinetobacter baumannii
INMSCMLTLEEIEIKRQELERHLEDVMSVELKKWQSENKLCVSDVNIRLANVVSLGGPKHNVVTGVNVDLDYKP

SEQ ID NO: 5666 - protein, 681 aa, Acinetobacter baumannii
YTMSSASQLNNKQEEAMKYTQGPLLVLAGAGSGKTSVITRKIAYLVQHCRIPAHRITAMTFTNKAAREMKERVTKLLSREEAKGLSVSTFHTFGLNLLRLELKNLPLKANFSILDADDCKRILMDLMHRDNLSGAESKELIAKAMKKISDWKNDLILPEQAHSTCETPEDVQFAHLYQLYERNLRAYNAVDFDDLIVMPTRLLQENAEVRDKWQNRVRYLLVDEYQDTNTAQYILVKLLVGVMGQFTAVGDDDQSIYAWRGAKPENMALLKQDFPNLHIIKLEQNYRSTSRILKAANCVIQNNPHIFDKKLWSDKGHGEVIRIITCRNDDDEAERVVKDLLTHKLMNGKNWKDYAVLYRGNFQARVLETQLRQMQIPYKLSGGTSFFARAEIKDVMSYLRLIINPEDDSAFLRIINTPKRAIGPVTLEKLGLFAQENNLSLLGASSDQRLSMVLPKKAETQLHEFADFISTFTRELLEDDEPVPKVRQMMNEAGYIDYIREQSATPAQEKSKLDNIENLFSSIQNLINRAEDVDEKNIESVIRKLVLLDMLEQQQEEEDTDKVNLLTLHAAKGLEFPYVYIMGLEEELLPHKNSIAAETIEEERRLMYVGITRARQGLTLTLAEQRKNGGQMKQMTPSRFLDELPQDELEWLGRKKKIAANVDPKEQAQQYLANLKALLKR

SEQ ID NO: 5667 - protein, 423 aa, Acinetobacter baumannii
QNPSSGEACLTGIALQGRKAMEKIVIVGAGQAAGWAVSTLRQNGYVGEIHVVSNEDQVFYERPPLSKQVLSKEASYESLNLFSPEQVQEFNIQWHKPEIATKVDREQKQVHLESGQILPYDKLLIATGSRARVPVNTWQFIPNVVTLRNVRDCERLAEILKNAKNVAVIGGGWIGLEIAATARKQGKDVHIFEYGDRLCARSVSPEVSAFLKNMHEAQGTKIHLDSKSLHLVEAPDQKVEVVNHPQHSQLFDCVVVGAGAEIAKELGVHAGLDVKDGIVVNCFGQTSDQDIYAAGDVAIHPGLGYCIQSWANAQNQAIAAAKSMLGIETEYTDIPWLWSDQYHFNIQILGTYQPEKTKEVVIRQGGEDQVSYLYLGHENRLLNMIAINDSKLIKLAKRWMQANTVLDPKLLADAEFNVMKLKP

SEQ ID NO: 5668 - protein, 68 aa, Acinetobacter baumannii
RLQSIIYPLFIYISYDGKVISKIIKRLLCMCANYEPINKDRVHLLDLFEPTFDYKNGVYPGYDCPLIF

SEQ ID NO: 5669 - protein, 221 aa, Acinetobacter baumannii
CEQSYIFSIRVETQMYKSYLSGSKSLLLIALSMLPMLVSAKTILILGDSISAGYGIDPKQGWVQLLQKRLDQQYPKQHKVVNASMSGETTSGALARLPKLLQTYKPEVVVIELGGNDGLRGQPPQMIQQNLSQLVHLSQQQKAQVILFGMKIPPNYGTAYSKAFETNYKTVSQKYQVKLLPFFLDGVVGQKQLMQNDLIHPNAQAQSKLLNLAYPYIKGAL

SEQ ID NO: 5670 - protein, 442 aa, Acinetobacter baumannii
IRESYMLEYVSGLWQTFLHRPDFWAVLSIIPVTAFVTWAHVWMALKMVFYPIKFWGFHLGPLPVGWQGIVPRKAGRISGIITDNTLSKLGSLREFLEAMDPEDMARIIGEQVGFELEHLIDEVMIDRNAVLWENLPYSIKRRIYAQAHKQLPGVLRELVTELTMNVESLVDMREMVVSQMEGDRRLMVRMFLKVGQKEINFIWHISALIGMFFGVFQMVVWFVVPWHWTVPFWASIWGFLTNWIAIWMVFNPIEPHYIRYPQIFRLTKDRKFPWIVPVLRIGTYNVQGAFMKRQEEVSEVFSSVVTEDLITLKSIMTEMMYGSRKDKTRRIVKRHINEIMETPLVRTSLQLSLGPREYARLKTDLIDRSIEITMGPVCDPALNASRAQKIFQMFKERIRELTPKEFQNLLRPAFQEDEWILIVLGGVTGFIAGTIHLFVAFL

SEQ ID NO: 5671 - protein, 60 aa, Acinetobacter baumannii
YGESGSITILPSGVCTAQADNDIVKIAAAQRSKVFMLFSLFYHSPFYYRNVLITFRSVFG

SEQ ID NO: 5672 - protein, 416 aa, Acinetobacter baumannii
FTWSFLYITNHRFKLKILILEKKMHPIVIIGSGMAGYTLAREFRKLNPEQELVMICADDAVNYAKPTLSNAFAGKKAPEQIPLGDAAKMSAQLNMRIEPFTWVKEILAERHELVLEKDGVISQQPYSKLILAVGANPIRLAIAGDGSDDIHVVNSLIDYRSFRENLAQRKDKRVVILGAGLIGCEFANDLLHSEYDVTVIDLAPQPLGRLLPSHIASAFQQNLEEAGVKFALGTTVEKVSKINNGEDYAVTLANGQTLVADIVLSAIGLQPNISLAQSANIQTSRGVITNSLLETNQADIYAIGDCAEVNGTLLPYVMPIMQQARALAKTLSGQQTNVHYPAMPVAVKTPAAPLTVLPAPVDVDVNWETEEFDDGMLAKAIDNEGTLRGFVLLGATAGKQRLTLTKLVPDLIPAQA

SEQ ID NO: 5673 - protein, 384 aa, Acinetobacter baumannii
GRLPRRLKNTRAKRTLTAAIATICAKTYGGEAKDYSQIDSAPEEKARGITINTSHVEYDSPTRHYAHVDCPGHADYVKNMITGAAQMDGAILVCAATDGPMPQTREHILLSRQVGVPYIIVFLNKCDLVDDEELLELVEMEVRELLSTYDFPGDDTPVIRGSALAALNGEAGPYGEESVLALVAALDSYIPEPERAIDKAFLMPIEDVFSISGRGTVVTGRVEAGIIKVGEEVEIVGIKDTVKTTVTGVEMFRKLLDEGRAGENCGILLRGTKREEVQRGQVLAKPGTIKPHTKFDAEVYVLSKEEGGRHTPFLNGYRPQFYFRTTDVTGAIQLKEGVEMVMPGDNVEMSVELIHPIAMDPGLRFAIREGGRTVGAGVVAKVTA

SEQ ID NO: 5674 - protein, 283 aa, Acinetobacter baumannii
MTMLNVDKAGQIAELQQRAYHIRQHALRMGQVQGQGYVGQALGAADLLAVSYFHAMKYQPENPEWEGRDRFYLSIGHYAIALYAALIEAKIIPLEELETYGADDSRLPMSGMASYTPGMEITGGSLGHGLGIAVGACLGLKQKKSDAFVYNLLSDGELNEGSTWEAVMSASHWKLDNLIAIIDVNNQQADGHSSEILAFEPIVDRWQSFGWYTQRVDGNNMEALLEAFDQARNYEGACPRVIICDTKMGKGVSFLESREKTHFIRVDEHEWDDALNILTHYGQ

SEQ ID NO: 5675 - protein, 222 aa, Acinetobacter baumannii
MRMFFMRIILLGPPGAGKGTQAQLICKRYNIPQISTGDMLRAAIREGTELGLKAKSVMESGGLVSDELIIGLVKERIAQPDCVNGCIFDGFPRTIPQAEALEKEGISIDHVIEIDVPDEEIVKRLSGRRQHPASGRVYHVVYNPPKVEGKDDETGEDLVQRPDDQEETIRKRLASYHTETEQLVGFYQGRAASGENAPTYDKLDGLRTIEDVQKDLFNILDK

SEQ ID NO: 5676 - protein, 372 aa, Acinetobacter baumannii
SEVLVSLGESRILFYKIMTYFDLLGEIMDITELLAFSVKNGASDLHLSAGMPPMIRVDGEVRRINLPALEHKDVHRLVYDIMNDKQRRDYEEKLETDFSFEVPNVARFRVNAFNQNRGAGAVFRTIPSKVLTMEDLGLGQIFKDICDYPRGIVLVTGPTGSGKSTTLAAMLDYINENRYDHILTVEDPIEFVHQSKKCLINQREVHRDTHGFNEALRSALREDPDIILVGEMRDLETIRLALTAAETGHLVFGTLHTTSAAKTIDRVIDVFPAEEKDMVRAMLSESLQAVISQTLLKKNGGGRVAAHEIMIGIPAIRNLIRENKVAQMYSAIQTGANHGMTTLDQSLKGLVARGVISPQTARTAAKQPESFL

SEQ ID NO: 5677 - protein, 130 aa, Acinetobacter baumannii
RTGPEDSGRRRQGQGFNSGKVMELYKYQKTYASKTPHEIEQIKFLGGRIPDPPEYSYAADSILSAFSTICRSRRYEQSIPLSLDQQAINVYAEHNDLPVAAHIFNDCIFALDNLFLEECHKKISTKSKGK

SEQ ID NO: 5678 - protein, 320 aa, Acinetobacter baumannii
IRIPSMSARHSRLIILGSGPAGYSAAVYAARANLKPTLIAGLQLGGQLTTTTEVDNWPGDPEGLTGPALMDRMQAHAERFGTELVYDHINEVDLNVRPFVLKGDMDEYTCDALIIATGATAQYLGLESEQKFMGQGVSACATCDGFFYKNQNVMVVGGGNTAVEEALYLSNIAEHVTLVHRRDSLRSEKILQDHLFAKEKEGKISIVWNHEVEEVLGDNTGVTGVRLKSTKDDSKQEVQVQGLFIAIGHKPNTSMFEGQLNLRDGYIQVQSGTSGNATATSVAGVFAAGDVADSIYRQAITSAGSGCMAALDAEKYLDNL

SEQ ID NO: 5679 - protein, 578 aa, Acinetobacter baumannii
TLQPKSHMPSSLYRLLRQTVSKKRIVMNIKEYDYIIIGAGSAGNVLAARLTEDKDTTVLLLEAGGPDYRLDFRTQMPAALAYPLQGRRYNWAYLTDPEPHMNNRRMECGRGKGLGGSSLINGMCYIRGNAMDLEQWATHKGLENWTYADCLPYYKKAETRDIGGNDYHGDSGPVSVATPKNGNNVLFHAMVEAGVQAGYPRTDDLNGYQQEGFGPMDRTVTPKGRRSSTARGYLDMAKGRPNLTILTHATTNKILFNQKQAIGVEYIIGADQNNLQRALVKREVLLCAGAIASPQILQRSGVGQSTFLKSMDIDVVHDLPGVGENLQDHLEMYLQYKCKQPVSLYPALKWYNQPAIGAEWLFNGTGIGASNQFEAGGFIRSSDEFKWPNIQYHFLPVAINYNGSNAVKEHGFQAHVGSMRSPSRGRIKLKSKDPFAHPSILFNYMSTEQDWREFRDAIRITREIMHQPALDPYRGDEISPGKHLQTDAELDDFVRNHAETAYHPSCSCKMGEDEMAVVDGQGRVHGMNGLRVVDASIMPLIITGNLNATTIMIAEKIADQIRGREALPRSTAPFYVAS

SEQ ID NO: 5680 - protein, 221 aa, Acinetobacter baumannii
PWEPSIIPRSTSLRGICMVSPYLHSFALFFSLLNPFLMSIYMIGLIRHSETKVFNKALIQGSLIAYIVFMLFAWGGEAIFSKYLNVRFEAFQIFGGLIFLVIGYRYVFQGADTIGEMRGAPEHLAGTIAMPFMIGPGTISAAVVTGIEMSIGAAALVIGFTMFLTCSILILMKFSHDHLRYKHAKYIDRYFDIVGRLSALLIGTIAVDMIINGVTGLIHKV

SEQ ID NO: 5681 - protein, 160 aa, Acinetobacter baumannii
CIRPSKNSFVGRRSYLHIIFSFLRIYSIYLHLIRISIFKDEYENVKSMKLKILTMMLCVALLSGCTKQAESEAPQIDYKAQFEESDRKIGEFLDQLDNPNTPQEVKVKILCHDYPEVYKKQYMPALIKVSPKPYTEEKLLSDLKSATDYYKGTLGIKCNE

SEQ ID NO: 5682 - protein, 276 aa, Acinetobacter baumannii
QEGPIMKSYHPKSLLNDLQYYITPPHDCSYLENKSARMVFLDPIHRIDVVTLSELSRLGFRRSGDFVYRPECHLCRQCLSCRVPVADFQMNSMQKKAWKRNQDLTMTVLPTRQASQIHYDLYERYINERHADGDMFPPSLDQFEKFLVHSCTDSFFLELWKDNRLISVSTCDLMDDGLSAVYTFFDPDEHRRSLGVYSILNQIEYVKTLGLEYVYLGYWVPHSAKMNYKSQYTPLELLLDGQWRRLNRSLSPEEINQLGNSLMTTLPSEWNNLIIK

SEQ ID NO: 5683 - protein, 287 aa, Acinetobacter baumannii
SIMPQFEPCFIYRKTTRMSLEIEEDSQESETTKNDDRYLVPGLVRGLAILQAFNQQAQEMTITEIAEILEVNRSSAFRLIYTLEACGYLRKASQKTYALDSKVMELGFNSLSKLSLLDLSTPLMKELRDQTKLAVHLTVLEGTHIVFVNNVQSMGTFTSNISLGTRWPAHATVIGQMLLSDLPEAEVRQRYRNFNDWDSYSELTPTSLKALLQKLNYVKTQKSMVSWGHYNHDMAACAAPIFKQSNGKMVAVLSVSCPITTYDEKTFKEDIAALVIATADKISKFIY

SEQ ID NO: 5684 - protein, 411 aa, Acinetobacter baumannii
TYSPKEQNSMQQQVIIVGGGMVGLSLSLMLAKANIAVKLLEAVKYPNYDDQNVAPYHSSFDARNTALSRRSVQIYQKLGLWDALQQHATPILQVHITEQGSFGKARLIAEQEKVESFGQVIENAWLGRVLLTQVRQQPLIELIDGVQVTALTQDAEQVHIEAQRGDELLKLESKLLIAADGRDSFCRQAIGVGVDVHDYDQVAIVTTVQTSKPHEHVGFERFSALGPLALLPLPGEYRRSVVWPVKKGTEGEWLGEENDQHFLDALQKTYGDRAGKFEKTGKRFSYPLSQVLAHKQAVGRVILMGNAAHTIHPVAGQGFNLCLRDADVLLRYLVNQLSASDDIGNPDNLLAYEQARLSDQQRVIKFCDTVVRGFSNQNPLLKLIRNTGLIAFDVIPGVKPLVANYAMGLKA

SEQ ID NO: 5685 - protein, 182 aa, Acinetobacter baumannii
ENTPLVVCIETPMFEQSPESLSDIEILDILQSMKKDKLDTEANEIIRNGGKAGRQEAHKQALVALNTNFEEKFVEAVTLALGLNAAQAKKIRYKKDRIRILKARGIDYLAIDGAETAQVLAQISQAIVREDAIVTHDLHNIFPFWKEGFPMVQFDNAYKILQEDISLHFHAFLDAMIEYVNK

SEQ ID NO: 5686 - protein, 67 aa, Acinetobacter baumannii
KAALSKLISAESLMKKYQCIVCGWIYDEAEGWPQDGIAAGTKWEDIPDDWTCPDCGVSKADFEMIEI

SEQ ID NO: 5687 - protein, 257 aa, Acinetobacter baumannii
YTAFTEAYQHLTLGEKQKSFLKMRTLSMNYLQDARQHVLQQIRTACELAQRAPETVQLLAVSKTHPSERLREMYAAGQRAFGENYLQEALDKIDALQDLDIEWHFIGHVQRNKTKHLAEQFDWVHGVDRLIIAERLSNQRGDDQAALNICLQVNIDGQDSKDGCAPEDVAELVAQMSQLPKIRLRGLMVIPAPDNTAAFVDAKKLFDAVKDQHAHPEEWDTLSMGMSSDLEAAIAAGSTMVRVGTALFGARDYSQKG

SEQ ID NO: 5688 - protein, 440 aa, Acinetobacter baumannii
LFKLWMRVKKMPNINPTLNVPQANFLQMEKKFRAFVAGFGSGKTWVGCSSLCNKAWEFPKVPLGYFAPTYPQIRDIFFPTIEEVAFDWGLKTKVYETNKEVDIYYGRQYRTTIICRSMEKPATIVGFKIGHALIDELDVMAKVKAQQAWRKIIARMRYKQAGLLNGIDVATTPEGFKFTYEQFVKEANKSEAKRKLYGMIQASTYDNEANLPDDYISSLYESYPPQLISAYLRGQFVNLTSGAVYPDFDRVLNHTDEEIKKGEPLLIGMDFNVLKMAAVVYVIREGKPRALDELVGVRDTPTMCQLINERFPDHDITVIPDASGQATSSKNFSESDHAILKKNGFKVEVNGVNPGIKDRITAVNAQILNAEGERHLKVNTNKCPNFTATLEQQVYDDFGMPDKSAGLDHVGDAGGYPIAKRFPVIIQKIFKRRAIAGFSR

SEQ ID NO: 5689 - protein, 307 aa, Acinetobacter baumannii
LSFTDGNHKFRAIGEINGNYELLTDSEDAPRYVQKKSVKWLKLFKPSLNVEQLFDKVLSQQTIYNLANSINISKLKNLLDSHQKEDNDKKFVLIIDEINRGNISRIFGELITLIEESKRQGAKEQLSVTLPYSKYELTVPNNLYLIGTMNSSDRSLTGLDIALRRRFTFIEMPPKPELLAKVTVDEVNIQKLLTVINQRIEILLDRDHCLGHANFMSLEQQPTLENLSNIFKQKVIPQLQEYFFDDWAKINLVLNGNGMLKPKPVDTSAIFPNVDSEELGYFEDKKIWELVPNSFNSIESFKKIIQY

SEQ ID NO: 5690 - protein, 103 aa, Acinetobacter baumannii
SRFTSINCLGKTMTKRKPKKDASITIHMPTDHKEQLASLAEMLRAGQGASEYVYETLIKPHLQQLKAETKIKQKIFGLTENDKNHELHSDLSVRSETADIKKA

SEQ ID NO: 5691 - protein, 172 aa, Acinetobacter baumannii
VMPTLDEMTTVTDDQSELTMSVLMTPDMANFSGNVHGGTILKLLDQVAYACASRYSGSYVVTLSVDKVNFKEPIYVGELVTFLASVNHVGRTSMEVGIRVEAQNIQKRTVRHTNSCYFTMVAVDEHGKPREVPKLNLDTEWKRCRFEAAEHRKVLRLQENHNPSCSMYKKTS

SEQ ID NO: 5692 - protein, 174 aa, Acinetobacter baumannii
KMTTQQFESWKQPEGASLEDWLNTRIARFETRKYDFEALKFQADYDPKYRRAQMRYMGTGATGVANDSNTVPAENFTFSTMVLPPQCEGPLHIHHDVEEVFFMLRGEIDLFIEHNGEKFQTRLKERDLISIPPGIYRGLFNPGQEDALMCVMLGTGKPTIPNYPPEHPLSQIKR

SEQ ID NO: 5693 - protein, 363 aa, Acinetobacter baumannii
KLNTRLRIFKKESTFMQNSSGKQTKYHRVDSSSLSFKLFLVYDIFMVFIIIFNLFCLAANFFLMSSIGAWFFEHIHLPQVLSFYRTHLHPWVITSEAWFIGFLIIELLVRWGIAIVYKHHKRWFFFPFIHWYEILAIIPQLRFLRLFRAGIIAYRLHELGYSVIPESWRKTGLFYYRVVMEELSDRVVITVIDGIRYELETSSSHKQIIHDLVNHHREQFTVTLTSLLQESLATALKEQKPAITRAVGQIVDQAIEDTPELTQLLRLIPLVGGRIEQQIQSIGQRLGENISAGLIEPLIEGSATHPNSTYQLISQKISHINIDNHELEQLVESVVFETLEAVRKQVKVKQWQQTLAEYDRIKE

SEQ ID NO: 5694 - protein, 448 aa, Acinetobacter baumannii
RINTMSAAKIGLLSLTALVFSSMVGSGVFSLPQNMAQVANGSALLVAWLITGVGIIFLALSLLHLTRQRPDLDGGIYNYAREGFGDLIGFCSAWGYWLCTTIGIVGYVVIAFSGVGMFTDSKDHVIFGEGNTLYSLIGSSIFVWLVHWLVSRGIKEAAIVNLLATIAKIIPMVVFIFFTFIAFKFDLFKLNLNDFSLKVPLWQQVKDLMLITLWVFTGIEGAVVLSSRAKNRHDIGKATILGVLLALSFYVMVTVLAYGVVSREALAGMHNPSMATILQQLIGLPGTIIITIGLIISVSSSYLSWTLFATEIPYLAAKNGAFPKLFLKNNQNNVPISSLWLTTLVVQGSLIAVYFFNKNYTQLLLISSVMILLPYFLVSAFYLKESIRHKRTPHIAIASVASIYALWLLYAAGLDLLLLSGVLYLVGLVIFSISYFEHKKSLKQNQLN

SEQ ID NO: 5695 - protein, 135 aa, Acinetobacter baumannii
MISTNYVPLWHISPFQHVQYTLARNQIHMDLLFEDMNNVDTFLSVEGAAAQVDFYSNGAYAAVQLGDTSERKLIEIYGLLLHEAVHVWQKVKKLMGEKEPSSEFEAYSIQAIAQDLFKMYEESELNDGMEGEKAD

SEQ ID NO: 5696 - protein, 166 aa, Acinetobacter baumannii
QISTPPLPRSDVLLQTARSIMNVKATPFNSFAFVSMAALAISGGSLVACQLQPAFQTKEAPTLFTPKTQPSTYGVLTAKITGKHSGVAVIKLDSFRLNVSFDFEAHPDSYGVPGSEFTAVDITQLTVNEITDVNGKSYNDFTEFEDIRNINVLLKGFIERNKLVEA

SEQ ID NO: 5697 - protein, 475 aa, Acinetobacter baumannii
NYGTSSRGAFIMVKYQKYTEYKVSGVEWLGEIPSHWRLFALKRSVDKCTNGFWGAEPDGINDLCVLRVADFNRDNFEINLDKLTYRSVLAKEAESRLLKKGDLLIEKSGGGEKTLVGCVVQFDKDFPAITSNFVAKMTPNRNMDSRFLTYSFAHLYAGRVNYPAIKQTTGIQNLDSEAYLMENFCFPPRVEQTQIALFLDHETAKIDTLIAKQEKLIELLKEKRQAVISHAVTKGLNPNVPMKDSGVEWLGEVPEHWKIKENKYLLDFITSGSRGWAQYYADTGALFFRIANLTRDTIEPKLDSLQFVEQPQGSEGERSKIKIGDLLISITADLGSVCVANSSIQNGYVSQHVALCRPQKLCEPRWLAYYILSDTAKEQLLGSGYGGTKIQLSLEDIRELVIAVPPKKEQMQIANYIDEKLSQFEYLIKKADKLVGILKERRTALISAAVTGKIDVRNWQNPNKNNNQDKMELSA

SEQ ID NO: 5698 - protein, 109 aa, Acinetobacter baumannii
KARFTKSLNWMLWKKEPAMSEFKVGDYIVIDQKYDKTFMPVLQIISEGKNYFYCNDGQVHKSQMEQWRKAEPEEIAAGRRIDKPSNPRELETLDKPENHISPNCEVKNG

SEQ ID NO: 5699 - protein, 262 aa, Acinetobacter baumannii
IVLTLVNVFGIFVMSLHSRIRQKLEEKKLRAADLARATKKSPVAVKKWLDGTSVPTAENLKVIAKFLGVSDDWLLYGGPVEQESNNLPQLNVINIEAFKQKYNIPDSEDAVKFVQTSDKPFPIQKRYVPVKAYSKMGMDGYFTDMGYEGNAGDGYVPTHTAGPRAYGIKGTGDSMFPAIRNGWYVVCDPDADLVPTEFVQVCLKDGRCTIKEFVGINGGVLSLLAVNGGERLSFDMDEVGSITAITDIVPPSQHRQEHPYSH

SEQ ID NO: 5700 - protein, 418 aa, Acinetobacter baumannii
KRLTMSQIAQPITIRNTTFKNRIIKGAMSEALANYEGQPNELHLGLYSAWAKGGLGCAITGNVMVNVEAKNEPGVVVIETERDLERLKEWAAVGKQYGMVQLIQLSHPGRQCPKGLNKETVAPSAVPFSPALATMFGTPRALTHEEILDIIKRFANAARICEKAGFEGVQLHGAHGYLISQFLSPLTNKRTDQWGGSIENRTRFLLEVYKAVREATSDNFIISVKLNSADFQRGGISEQDVISVFKAVDEAGIDLIEISGGTYEAPAMAGAKADKRKASTIAREAYFLDFAEKIRQHVKCKLMVTGGFRTVEGMNAALASGACDFIGIARPLAVETDLTDRLIAGQDVRYAVKPIKTGLPFVDKMAIMEIIWYAAQFKAIGQGKKPNPKLSPLIVFLNYAKGNIKAVVQGRVNSRKSA

SEQ ID NO: 5701 - protein, 66 aa, Acinetobacter baumannii
LGVTMKISDLMTYHGCKNRKELSEKTGYSTVTLWKWENNGIPARTQAVLQVKTKGKLKADLQALTA

SEQ ID NO: 5702 - protein, 134 aa, Acinetobacter baumannii
ILATLPDAKAESVRKALTEALKYLPAELRKTLTYDRGREMSEHKILEEDLGIDVYFCDPHSPWQKGTCENMNGLIRQYLPKGIDLNQADQHYLNQVAMSLNTRPRKALDWLTPLEKFAQLVDYHMAFETVALHV

SEQ ID NO: 5703 - protein, 266 aa, Acinetobacter baumannii
MHQTVSRCRKKLMANVALLQGKKVLVTGAARGLGRDFAQAIAEAGAEVVMADILSDLVQQEAQALQQQGLKVHAVTVDLANADSIENAVAKSMEVLQGLDGLVNCAALATNVGGKNMIDYDPELWDRVMNINVKGTWLITKACIPHLKQSAAGKIINVASDTALWGAPNLMAYVASKGAIVAMTRSMARELGKFNICVNTLSPGLTLVEATEYVPQERHDLYVNGRAIQRQQLPQDLNGTALYLLSDLSSFVTGQNIPVNGGFVFN

SEQ ID NO: 5704 - protein, 1233 aa, Acinetobacter baumannii
RSGFSMSTLATLKALLAKRILIIDGAMGTMIQRHKLEEADYRGERFADWAHDLKGNNDLLVLTQPQIIQGIHEAYLDAGADIIETNSFNGTRVSMSDYHMEDLVPEINREAARLAKAACEKYSTPDKPRFVAGVLGPTSRTCSISPDVNNPAFRNISFDELKENYIEATHALIEGGADIILIETVFDTLNCKAAIFAVKEVFKQIGRELPIMISGTITDASGRTLTGQTAEAFWNSVRHGDLLSIGFNCALGADAMRPHVKTISDVADTFVSAHPNAGLPNAFGEYDETPEQTAAFLKEFAESGLINITGGCCGTTPDHIRAIANAVKDIAPRQVPETVPACRLSGLEPFNIYNDSLFVNVGERTNVTGSKKFLRLIREENFAEALEVAQQQVEAGAQIIDINMDEGMLDSQNAMVHFLNLVASEPDISRVPIMIDSSKWEIIEAGLKCVQGKPVVNSISLKEGYDEFVEKARLCRQYGAAIIVMAFDEVGQADTAERKREICKRSYDILVNEVGFPAEDIIFDPNVFAVATGIEEHNNYAVDFIEATGWIKQNLPHSMISGGVSNVSFSFRGNEPVREAIHSVFLYHAIKQGMTMGIVNAGQMAIYDDIPTELKEAVEDVILNQNQGESGQAATEKLLEVAEKYRGQGGATKEAENLEWRNESVEKRLEYALVKGITTYIDQDTEEARLKSKRPLDVIEGPLMDGMNVVGDLFGSGKMFLPQVVKSARVMKQAVAWLNPYIEAEKTEGQSKGKVLMATVKGDVHDIGKNIVGVVLGCNGYDIVDLGVMVPCEKILQTAIDEKCDIIGLSGLITPSLDEMVFVAKEMQRKGFNIPLLIGGATTSKAHTAVKIDPQYQNDAVIYVADASRAVGVATTLLSKEMRGAFIEEHRAEYAKIRERLANKQPKAAKLTYKESVENGFKIDESYVPPKPNLLGTQVLKNYPLATLVDYFDWTPFFISWSLTGKFPKILEDEVVGEAATDLYNQAQAMLKDIIDNNRFDARAVFGMFPAQRTDADTVSVFDEAGQNVTHTFEHLRQQSDKVTGKPNLSLADYIRADREQQDYLGGFTVSIFGAEELANEYKAKGDDYSAILVQSLADRFAEAFAEHLHERIRKEFWGYKADEQLSNEELIKEKYVGIRPAPGYPACPEHSEKAVLFDWLGSTDKIGTKLTEHFAMMPPSSVSGFYYSHPQSEYFNVGKISQDQLEDYAKRKGWTLDEAKRWLAPNLDDSIV

SEQ ID NO: 5705 - protein, 140 aa, Acinetobacter baumannii
FDKTVLQTEIRLFCQENLMGLRDEIQADIAEAFNADLADAVHSFTCERISKTNWDPKTETYVEVKENYSGRGVLFGSYSQYEIQTLGVLATDKKATVLQNEVSMTPKIDDEWITNLGSFRVIHIKQDPAATIWKCQLRKV

SEQ ID NO: 5706 - protein, 475 aa, Acinetobacter baumannii
NNKTTRNVVIRRYKMTNLADVEQISHHQKNAEIIARLERLPVTGRLQFMRITIGIATFFDAYTVLAIAFALPQLITEWHLTPAYVGAIIAAGYVGQLVGAIFFGSLAEKVGRLKVLSFTILLFVAMDISCLFAWSGMSLLIFRFLQGVGTGGEVPVASAYINEFIGAEKRGKFFLLYEVLFPLGLMFAGMAAFFLMPIYGWKVMFIVGLVPSLLVIPLRFFLPESPRWLASKGRFKEADQVVKSFEDGAIKSGKTLAEPVVKEINPQGMAKTDWRELFRGIYRKRTFTLWGMWFCVYMVNNAMVTWLPSLYKQHFGLSLQTSLGYGWITSGVGVIASIICALMIDKVGRRPWYSAAFFLAIIPLMSLSVLGAKSAMEVVIFATISYAILQTISFSLYLYAAELYPTRLRAMGIGFSTAWLRAGSAIGPVMVGLVVGGYGIQYVFSVLAVVALIGGLVTFLFAIETKGQVLEKLSP

SEQ ID NO: 5707 - protein, 72 aa, Acinetobacter baumannii
KIKTDDSSDERIVGQKLHQGFRLLTKPNPKEERVVMKGHRNNFADAVQRKYSVAATLLTYITSRDQDWLTEK

SEQ ID NO: 5708 - protein, 207 aa, Acinetobacter baumannii
FCSTVRKSLLDFSMNELSFIRKNLRSRRRALTQFEQKQAQLNVLHYLNHLPIFHSSKKIGLYLHAFGEIHTDLLIKLCFKKNKQVYLPMICSMNQRLVWVKINKNQYLSRRFSHHPLGMKEPMATRGKHVSQLDLLLMPLLACDHYGTRIGMGGGYYDRTLASAKHKPYRLGLAHQFQFIEHTLERQSWDQPLDGLLTPQHFYYFKR

SEQ ID NO: 5709 - protein, 800 aa, Acinetobacter baumannii
CWRTRVQLPPSPPRFEKPQILIIWGFFIDELKLTVVHKVLVNMTNTNFSQVAAFIWSVADLLRGDFKQSQYGRVILPFTLLRRLECVFESSKTSVLETNEKVKAMPLPEEAKEKILLKATKGLSFFNTSELDLSSLGQKNIRANLGNYIQHFSKDAREIFEHFKFDEFTGLLDDANLLYKVIQKFASTDLSPENISNHDMGLVFEELIRRFAESSNETAGEHFTPRDIVRLTTGLIFSQDDDALNKEGVIRTIYDPTAGTGGFLSSGTEYVYEHNPEAVMRVFGQELNPESYAICKADMLIKGQDVRNIKLGNTLSNDQLTYEKFDYMLSNPPFGVDWKKIEDEIKDEHEQKGFNGRFGAGLPRVSDGSLLFLMHLISKMRDVDSTGQGSRIGIILNGSPLFTGSAGSGESEIRRYILEADLLEAIIALPTDMFYNTGIATYVWVLSNKKDAERKGKVHLINASNLSSKMRKSLGSKRNYLTESEIRTITQNYGAFEAVDTLTLDGESEQQKPFSSKIFNSYEFGYRRVTIERPLRLSAQLSDDRIATLRFAPKPFNAVMQKVYENYGKDWTETSYGQLSDDAQVEIRALIKAEFSELKEKDIKTVLEPKLWLEQRALMRKAQSLQTKIGTAQFDDFNIFDELLKQALKDGNIKLEAKEKKQFLDAVTWKNVEAEPVINKVIKAQENPLYGQFNYKGKVVEFVQDGDLRDAENIALDPSQSTTDLIESYFKREVQPHVADAWINADKRDAQDGEIGIVGYEIPFNRHFYVYEPPRDLAEIDADLDAVSREIMALLQEVHS

SEQ ID NO: 5710 - protein, 237 aa, Acinetobacter baumannii
IYRTVHIMPQPIIAAHQVTQTIQINQNQFTILKNIDLEIYKGEQVAITGRSGSGKSTLLGILATLDQPSEGEVWLCGQAVHELTEEQRAQIRMQHIGFVFQSFQLLPQLSALENVMLPLRLRKDFDYKIAEQKALDWLHRVGLSRQAEQTPKVLSGGEQQRVAIARALIAEPQIIFADEPTGNLDGQTAQEIERLLFDLNEELGTTLILVTHDRNLAGLCQRHVELNDGRLKTVQGG

SEQ ID NO: 5711 - protein, 183 aa, Acinetobacter baumannii
SFYFRFFFPSLSVLYIYFFEVLFIMKKSLLAIALMSTLLVACNKHENKTETTSDASTPVQTAQSNNNEAVDTAHTAENSLDWDGKYKGTLPCADCEGIKTELELKDDKTYELTETYLGKGDANPFETHGKFTFDKDNTSVITLDDKAQNRKFFIGENTATALDMEGKKVEGSLAEHYVLKKED

SEQ ID NO: 5712 - protein, 136 aa, Acinetobacter baumannii
SAIAPPPIAAAFLPVALAPPPTAAAFSFVASAPLPIAAELSPVACAPLPIAAELFPVAFAPSPGLLPEPIAVEFVPDANELIPIADAPSPVACATAPNAAAPLPEAFDMTPKAEEASPVALEVIPNAEENAPVPTA

SEQ ID NO: 5713 - protein, 159 aa, Acinetobacter baumannii
KMSAVLKTQQMDWSKYTIDGWLEQFGAWCETVRMKGGDLPDGLHINQIYWLMREAGKEVQKSKSYIRCEISDYEADQIQALLRSLLNSDKTDFTTKFALICLIKNKVENKGLLKVAQETNQSKAQVAIMVSCARFYLLGHDKRLRQNGGSNENIHCKTI

SEQ ID NO: 5714 - protein, 268 aa, Acinetobacter baumannii
ISGAVMKKLMMIGFGAMAAEVYAHLPQDLQLKWIVVPSRSIEKVQSQVSSEIQVISDIEQCDGTPDYVIEVAGQAAVKEHAQKVLAKGWTIGLISVGTLADSEFLVQLKQTAEKNDAHLHLLAGAIAGIDGISAAKEGGLQKVTYKGCKSPKSWKGSYAEQLVDLDHVSEPTVFFTGTAREAAMKFPANANVAATIALAGLGMDETMVELTVDPTINKNKHTIVAEGGFGQMTIELVGVPLPSNPKTSTLAALSVIRACRNSVEAIQI

SEQ ID NO: 5715 - protein, 235 aa, Acinetobacter baumannii
CFAALCHAEHETRNSIFTVIQILSLGKRIKIMTERSPLRVGIGGPVGSGKTALTLNLCRALRDKYNMAVVTNDIYTKEDSNFLTRNEAMSPDRIVGVETGGCPHTAIREDASINLAAIDDLCEKFDGLELIIIESGGDNLAATFSPELSDLTLYVIDVAGGEKIPRKGGPGITKSDLLIINKTDLAPMVGANLDVMDQDAKRMRGEKPFLFSNMKTQDGLEEIIQFIEKQGLFKA

SEQ ID NO: 5716 - protein, 61 aa, Acinetobacter baumannii
FFLAQIAYWVQLTYKWPRISKIHRKLFNYNYREMKYNGILDNNEEIVMSAHLKVHQNITKK

SEQ ID NO: 5717 - protein, 701 aa, Acinetobacter baumannii
IEYFIFLLFLEDCMATDNPRAVDDLTLSKSKKDPLNRVVFYISALIILIFSLVTFLFNDFANRTINTVLAWVTSTFGWYYLLAATLYMVFVIFIACSRYGEIKLGPKHSKPEFSLLSWSAMLFSAGIGIDLMFFSVAEPLSHYMQPPVGVGQTYEAARQSMVWTLFHYGLTGWCMYALIGMALGYFSYRYNLPLTIRSALYPIFGNRINGAIGHSVDTAAVIGTIFGIATTCGIGVVQLNYGLHVLLGLPENIWMQFALIAIAVGISIISVTSGVNKGLRILSEINIYVSIGLLLFILFLGNTEFLLNALVQNIGDYLTRFPTLALQSFAFEQPKDWMSSWTLFFWAWWIAWSPFVGLFLARISRGRTIREFVCGTLIIPLLFTLTWLSIFGNSALHSVIFEGNQTLAATVLSNPAHGFYDLLAQYPGFTFIASVATVTGLLFYVTSADSGALVLGNFTTKLTHIDNDAPRWLSVFWAIAIGLLTLAMLMTNGITALQNATIIMGLPFSFVMFLVMAGLYKSLRLEDYRHASRSMNAAPVVGNVDILNWKQRLTRVMHHPGTTETRRMLDTVCKPAVQAVADELIKQGMNVDVQQTPLEDEEALYHLDITIHLEEEQNFVYQIWPVRYSAPNFSQRVKRGKQFYYRLETYLYEGSQDNDLVGYSKEQVINDILDKYERHMTFLHINRISPGNRPLFPDPQA

SEQ ID NO: 5718 - protein, 187 aa, Acinetobacter baumannii
KYVAKMNTKITYTAFTGSTLIASDSLVELAKKLKALPKTTENILIFNDQTGQQIDLDLSGSEQELQQRYAEPEEIKKVGRPKLGVISREITLQKKHWDWLDQQSASASAVIRKLIDKELNNPNSEGNIMLAKQAIDRFMSAMLGNMPNYEEATRALYQGDRDIFLKMIQSYPKDLREYLTLKAQNVF

SEQ ID NO: 5719 - protein, 69 aa, Acinetobacter baumannii
IAQADVDVLKGPYLIQHIAEFGSAAVVNEFCSAQAVQFAVVPRFAAVVVGLGFVQVPVFFLCTFYIHRQ

SEQ ID NO: 5720 - protein, 304 aa, Acinetobacter baumannii
DTMAALPSLRQLSYLVTLSETLHFTEAARRSFVTQSTLSGGIMELERLLGGVLVERDRQNVRLTPLGEQVVARARVLLADAQDLMRLSREMSEPLTGDLHLGVIPTIAPFILTRLLDEVHQQLPKIQLHLHEAQSEKIVERLEHGNLDMIVLALPFDTRSLKVAEISKENLYLVCSKQDTNALQANSLDDLDLSRLILLEEGHCLRDHVLSACPIGERKNDNRLKASSLPTLVEMVSSDLGFTLLPEIAIENSMIKFNDQITAKPIEDAPSRTLALVTRKSTPLQSEFDVLLQIMQKITTNLHE

SEQ ID NO: 5721 - protein, 318 aa, Acinetobacter baumannii
SLMAETKIADVIVPELFTPYVLNKTAERSALWQSGIVGELDEKVAFGTEGGTTVNIPFWNDLSGESEVLSDGKALGVNNITAGKDIAILHARGKAWGANDLSKALSGDDPLGAIADLVADYWAREFQGFTVNTLKGVFGSASMAGNTHDISAGTGAAAVIDGHSFIDASYKLGDAVDKLTAISMHSFTMAALAKQGLIETVRDADGVVLYKTFMDRRVIVDDGMPVEGDVFTSYLFGYGAIGFQDIGAPVGVETDRDSLAGTDILINRRHFVLHPRGIKWAGDTGIAPNNAGLATAANWERVYDPKQIRIVAFKHKIK

SEQ ID NO: 5722 - protein, 314 aa, Acinetobacter baumannii
ILWAKWIEKGVFMTESRLTHLKQLEAESIHIIREVAAEFENPVMLYSIGKDSAVMLHLALKAFYPAKLPFPLLHVDTGWKFKDMIAFRDNMAKTHGFDLIVHQNKEGREAGINPFDHGSSKYTDIMKTQALKQALDKYQFDAAFGGARRDEEKSRAKERVYSFRDSKHRWDPKNQRPELWNLYNGKVNKGESIRVFPLSNWTELDIWQYIYLENIQIVPLYFSAVRPVVERSGTLIMVDDERMRLKEGEVPQMKSVRFRTLGCYPLTGAVESEADTLPEIIQEMLLATSSERQGRMIDHDEAGSMEKKKQEGYF

SEQ ID NO: 5723 - protein, 1088 aa, Acinetobacter baumannii
GLWADPKKYYASCLEVFMYKPTTFVWQPSAASLFKITVLSSALAALGITTGCSSTPQSAKTSKTKQVSGAGYLDASSLDSLEDLLSATDMRAVEGDRLLILKHGDVWKRMAVGFKMDLNHWDPRIEAQRSWFISRQPYLDRLSARASRYLYHTVKEAERRGLPTELALLPVIESSYDPAATSSAAAAGLWQFIPSTGRIYGLQQTGMYDGRRDVVESTRAAYEFLGSLYNQFGSWELALAAYNAGPGRIQQAINRNQAAGLPTDYWSLKLPQETMNYVPRFLAVAQIIKNPRAYGVSLPPIANRPHFREVTLSAPLSLNEIASVTGLSRAELYALNPGYRGETVDPASPMRILIPADISPSVDNKLKGMKAGGSSGWWASVTSPSKPTTTTSTSVTVRTTPSTPAQPVRPSTPAKTSSSSVTVKTATPRGSDALAAFAASADVPSAPRIPVAVTPAANIKPVRTEPPISATEREKILAAVRAEGEKETVDQALEPQATQAEKDQVVAELKALAPQGTEIVDPYDGKIKLTAIQTSQSVAEQQGKEVSKGFAYPKTLAEDATLANSEDAQRNKDKPYIKTDTDVVVVQPKGKRSTYTVQPGDTLAVIAMKNGVNWRDVAKWNQIDPEKTLFVGTSLYLYDAKPQEAETTAKSAAKPDVYVVQANDSLTGVANQFNLSVKQLAEYNDLSVTDGLFVGQKLQLKEPKGNRAAKVEPKAIQASTRRIATKSYTVKRGEYLKLIADRYALSNQELADLTPGLSAGSSLIVGQKINVPAKEITVDEVDDSKASGKYEKLAAGPSYKTESYKVQRGDTLSSIATKSKISLAELAELNNLKANSHVQLGQTLKVPAGALVPDQYVVQSGDSLNAIAAKYNLQTSYLADLNGLSRTAGLRAGQRLKLTGEVETTSKVSAKNTKEETPETYTVKSGDSLGNIANRYHLQLDYLAALNGLSRNSNVRVGQRLKLTGDLPTVETAKTDTAKSSPKAVVAGKNTEKYTVKAGESLNAIASRAGISVRELAEMNALKANANLQRGQNIVIPKTVVEYKVKRGDTLIGLASKYGLETTLLAELNNLTPSTQLRIGDIIKVPNL

SEQ ID NO: 5724 - protein, 474 aa, Acinetobacter baumannii
LIHFIKSLPNHSVRQRAYSCLKKEFKMNKYLLWGCIGLGSVSNAYAELPQEFGKLELKLNTRYWNDEGTAHPTLANPSPSSSEYEQSALGLELNYQSPYMWDWLGVDGSLYAVTKLFDSGKPSAQLLEVENNGKLDQNFATLGQLYIKAKLGDKGEIKLGRQLQDSLLLKSTNNRAVPDTFSGASGQFQLNDQLQTYIAYYDRWKPRSMDSFEKLVTENDERIDYVGLLGAKYQYKNWSVNAEYLNSKDYLKKYGAIAQYKLPLHGLVWTFNTGAFFSRDDGKLFKCGAESELDCVKGQDINNRGNGYFIDVNVAQNNLEGGIAVSKFDGFWIEDNFAVHSARNSVLTQDHGTNPFPTSATIGPDFTNNDETAVALRLKYNWKDYVKGLKTEAKYIYGFGAHQSNISSDIEGKERYFDLTLSYALPWVKNLDVRYSFLHYESKFENADLGEKINGMTRKDWDQHRVFINYRYTF

SEQ ID NO: 5725 - protein, 467 aa, Acinetobacter baumannii
MMHFKMYCTNLIHYYAEDRALKYNNLNEFLNYVQARDPHQPEFLQAVEEVMTSLWPFIEKNPEYAEQGLLERLVEPERVIQFRVSWMDDQGQTQVNRAFRVQYNSAIGPFKGGMRFHPSVNLSILKFLGFEQTFKNSLTTLPMGGGKGGSDFNPKGKSDAEIMRFCQALMIELYRHLGPNTDIPAGDIGVGAREVGYMAGMMKKLSNDTACVFTGKGISFGGSLMRPEATGYGTVYFAEEMLKTRGQSFAGKTVSISGSGNVAQYAAEKAMFLGAKVVTLSDSNGTVYLKNGFTDELLAEVMELKNIKRGRISEFASKHGFEYFEGKTPWHIPVDIALPCATQNELTGEDAKTLIANGVICVAEGANMPSTLEAVEHFIEAKILYAPGKASNAGGVATSGLEMSQNAIRLGWTHAEVDERLHAIMKDIHANCVRYGTKEDGTVNYVDGANIAGFVKVADAMLAQGIY

SEQ ID NO: 5726 - protein, 160 aa, Acinetobacter baumannii
MKIYTQRLEDISPDQAFETVELTFDTRQKSRFRAALASGVDIGADLPRTGILRSGSYIATQEGDVLRVDAKPERLMQVTAQTEFDLLKAAYHLGNRHVPLMLTPTALYFEPDHVLAEMVEGLGLAVTETDHPFEPESGAYAQHSHDHRLSPIKALHHVHS

SEQ ID NO: 5727 - protein, 550 aa, Acinetobacter baumannii
GPPYMKKFLKYLLVLIILILIAGIVFLFRPIASKQVQTAKDEPVVDAVLVGGGIMSATLGTYFTELEPNWQIRMFERLDQVAQESSNGFNNAGTGHSGFMEMNYTEEKNGKMEIAKAEKVASQFEVAKQFWSYQVKQGVLAEPKTFINPVPHIAFVWGDNVKFLEKRYAAMIQSPLFKGMKFTEDPAVIKQWAPLVMTDRDPTQKVAATRMEVGSDVNYGSITKQLVNHLNQNPNFKLQTSTEVTGISQNDDKTWTVSFKNLKTGKTDHVKTRFVFIGAGGAAVKLLQLTGLPEAKQYAGFPVGGEFLITDNPAITAQHTAKVYGRAELGAPPMSVPHIDTRYIDGKKYVLFGPFATYSNKFLKNGSQLDLLASTNKSNVLPMTTVGLENLDLVKYLVSQVMMSDEDRLNELRKYYPDAKAEDWRLSQGGQRVQIIKKEPGKPATLQFGTEIFASKDGAVTALLGASPGASTSPYIMLNLLEKAFPQQTEGKWNQKLHEIVVSYKQDLSKDPVLLDKVRQYTSSTLGLNYTSPFKAANDETAAAPVAKAN

SEQ ID NO: 5728 - protein, 250 aa, Acinetobacter baumannii
STYYFGFMKTLPLSQYIFPDPEESDPDGHGLICIGADLSPSTLYEAYTHGLFPWFNEDEPICWWSPEPRCIIYPQNYKPSKSLIRNMKKYDYTITVNRAFEQVIRSCSLPRSYANETWISEDIIEGYCGMFDAGYGYSVEVWQEEQLVGGLYGVTIGKGCFGESMFSTQTDVSKMAFYTLMLIGQENQLPWVDCQLVNSHLISLGACTLSRQEYLKSLQDVIIHPSINWKKYQERVFSSKTIALNAKLME

SEQ ID NO: 5729 - protein, 63 aa, Acinetobacter baumannii
TDNYKKRSTNVMNKNVELINYIDVAETVYERVYENNKISNNLIVNLNLIMAEIKNQAAQKRSN

SEQ ID NO: 5730 - protein, 321 aa, Acinetobacter baumannii
TTFYGFWIFGAIYMSTAPNKQSALKKITRGLTVGTVITGSTFFHGPPVLALGLTKLFKKSSKIDETNIQITNSWLGVNNWLIDHVLPNLKWDISIDEGLDLNMQGRYLMTCNHQSWVDTTVNQYFGLTRMPLTRFFTKWELIFIPFVGQAFKILGFPMMKRHTKEQIAKNPELKDRDMMEARKACEQLLSQPFTLLNYLEGTRFTQEKHDQQKSPYKHLLKPKAGGLALALNILGDKIDALVDMTIVYPDGVPGYGDFWLGDVSKIAVNLRKIEIPDWVLGGNYEDDPVYRERFQQWVHELWTEKDQLIEKMKAQYATTNL

SEQ ID NO: 5731 - protein, 197 aa, Acinetobacter baumannii
AASLMSPLEIFAVLISLIGVGLTVIRNMWCWLFNFFAFVLYAYLFYEFKLYGETILQFFFMVVNFYGFYYWLKGKQQDHDIRIEPIAVQTAIIQMIIAAVGGLVFGLVLKNFTDAAVPMLDSQLAAFSLLATYWTSRKHIATWILWVFVDIVYVGMFIYKDLFLTSALYAAFVLMAAYGWYQWEKVKRKQNLGAGQL

SEQ ID NO: 5732 - protein, 528 aa, Acinetobacter baumannii
LFIYKKYLSYRKLNTPLKNVIAQFNNCKFAIKKINVLLINNFENCADMFLRKTLSIALLATASSAVFAQGLVLNNDDLRTDLNWLNQQGVISISTSTWPLSGDEIQRALSQAKVTHPAQQKVINSVLNALKADNNTVKVGAFAETDIKNIPQAFGDNQKAQYQGSLEFNAGGENWDAKIRVNAEKDPQIDSGHDVNVEGSYVAGKLWNQWIVAGQIPTWWGPGHDGSLIRGDASRPVYGVTAQRAVQNAFETKWLSWIGPWQYQAFAGQLDDYKAVPDAKLIGLRVTAQPLPYIELGASRAIQWGGDGRPESLSSLWDAFVGNKDNGGTGEPDPSNQIAGFDGRLLLQPLFQVPVSLYGQYVGEDEAGGLPSKKMYLAGVDYSSSYNNMPYQLYAEWADTRTNGDVRGISYAHSTYKDGYYQHGYPLGHAMGGDGQMYSVGGDIRFDVMNRLSGRAMVVKVNQSNLAINKAFPKDDEIKALDLTWTHFIKPDLPLKINGWVSDSDLEGNDAGASIGIEIPLERKMFGF

SEQ ID NO: 5733 - protein, 131 aa, Acinetobacter baumannii
KYDLNNMNNIAYFEIQSSNPARDAQFYQAVFGWQFKLDESLPIEYYRIETPSIMGGLLKRPAQTPPMEYGTNAFTCSVQVENFDEVAAKILAQGGIVAMDKFAIPGRAWHGYFVDLDHNVFGIFQVDENAA

SEQ ID NO: 5734 - protein, 115 aa, Acinetobacter baumannii
NLKYSGLFFLIEISPNHHENNMKFYKTILVLGLVVGDYSVSGCDLRTQQEFEKICLSGGHTQASCDCIYQRLEQVYSPQLMQRLEHVSLQSPALPQDFAPTFFSVMRRCDKSDMG

SEQ ID NO: 5735 - protein, 201 aa, Acinetobacter baumannii
VGGYSITVNRLLYCSPIMLDLYKIMGVYHAFKFRQRMSDEKKNWTGNIQLGAKTDLNVVLNQLCKAFNSCPFFKHSGMIMRVVDGHIEGYVEMQPDLIGNLAFQVLHGGVAATLLDSIGGIVAMEHLYRRSTPETLPETIKQVTRLATVDMRVDYLAPGRGKYFIARAEVLRLGRKGCTMRMTMVNDEDKAIAAGIASYAY

SEQ ID NO: 5736 - protein, 134 aa, Acinetobacter baumannii
LMAYCCTYRIAAFNYCGNDCCNWTKYLMERTQQVWVAFAVPEQQFLISVPFEEGMTAAQAVQASGLSNQVDLPEPLQLGIFGVKVETDAVVHAGDRVEVYRPLTINPKDIRRKRAAKNPVGRYIKGNRFKQSAQ

SEQ ID NO: 5737 - protein, 211 aa, Acinetobacter baumannii
FPHLIFFCLMVMLSLSVFFKGLGIGSGLIVAIGAQNAFVLKQGLKQQYVFWLCLICALSDSILIACGVLGFAEIMTASPILITVAKYLGATFLFVYGAKAFYAAFKTNQGMELDSSQKQTLTQALITCLAFTWLNPHVYLDTIVLIGSVATQLEDKISFALGSILASWIFFFSLGYGARFLKPLFINPKAWKILDFMIGCVMWSIAISLLI

SEQ ID NO: 5738 - protein, 278 aa, Acinetobacter baumannii
VFLHYRIVLSKLFSSMNPSISLIREIDALLPQTQCGLCGHRDGCLPYAKSIAEGEEANKCVPGGQPVADALAQLLNRPLLPAETSVWPVQADGRPQRMKAIIREDECIGCTKCINACPVDAIIGSGKLMHTILTDLCTGCELCIPPCPVDCIDLVEDTQALPSEQQRIAEQNDLRQRYYAHIQREEKRRIHRKGPVVRAEIDTQLFAQFSQALDDLPSIQLIEKPKEAIVSDAKTTIELAKIRTQIKKLEKQLSVREDAKKRLQLDELQQQLIQLQEV

SEQ ID NO: 5739 - protein, 322 aa, Acinetobacter baumannii
VFLQGMNNMNSALQFSISPYTPFMQETKVNLGNGIELHVEVGGKPEHPTILLIMGLGAQMLFWPDFFCKSLIDQGFRVIRFDNRDIGLSSKVRHQGKRLNTMKLMGRFALGLRNQGAPYTLYDMADDVSMLLDRLGVSKAHVIGASMGGMIAQILAAKYPEKVEKLGLMFTSNNQPFLPPPFPKQLLSLIGKPESRDEEGIVNHSLKLFQLIGSPGYINHIEAVQTARKLYQRSYYPAGVLQQFLAILCTGSLLQLDREIKQPTLVLHGSRDRLLPPSHGKAVAKAISGAKFELIDGMGHDIPAHFIPQLSGLFAHHFKSSY

SEQ ID NO: 5740 - protein, 166 aa, Acinetobacter baumannii
IILHLNSIAYSNLRFVERPFFMPISNQDLRKAGLKVTLPRIKILELLENSKQHHLSAEDIYKTLLEQGEDVGLATVYRVLTQFEAAGIIQRHHFENNHSVFEIMQEDHHDHLVCQNCNKVIEFTNDVIEKEQHSVAEQHGFTLTGHSLNLYGYCNEPECQEALRKK

SEQ ID NO: 5741 - protein, 538 aa, Acinetobacter baumannii
AMSHQSDLISQDILAYLKQHEQKDLLRFLTCGNVDDGKSTLIGRLLYDSKLIYEDQLQAVTRDSKKVGTTGDAPDLALLVDGLQAEREQGITIDVAYRYFSTEKRKFIIADTPGHEQYTRNMATGASTADLAIILIDARYGVQTQTRRHTFIASLLGIKNIVVAINKMDLVEYSSERFNEIQVEYDAFVSQLGDRRPANILFVPISALNGDNVVNPSAHTPWYKGQTLMSILESVEINRESSKHEFRFPVQYVNRPNLDFRGFAGTVALGEIKVGDEIVALPSGKRSTVKEIVTFDGNLEQAVAGQAVTLTLNDEIDISRGNILVRAGEQPLISRSVRASVVWMNEHPLVKGKLYNIKIGTQTVPAKVTNVNYRVNVNTLEHTQVEELELNAIADVVVEFDAPVVFDRYQDSRYTGSFIFIDRLSNVTVGAGMVKAAVEWTAHSNPVTAEDRAARLGQKPAVIGVSAQLIEKAQALESLLIQQGVVAIAKTNLTAEQLVLLRETGVIIITTAVDGTDTEITAETVEEAVEKIVELVRL

SEQ ID NO: 5742 - protein, 262 aa, Acinetobacter baumannii
VRTQEIKRKRGFNMLLQGKVALITGAASERGIGRATAEIFVQQGAKVIIVDLDLAQSQNTAKALGEGHMGLAANVANEEQVKAAVEQALQHYGKIDILINNAGITQPVKTLDIQRNDYDRILDVSLRGTLIMSQAVIPSMKANGGGSIVCLSSVSAQRGGGIFGGPHYSAAKAGVLGLAKAMAREFGGDQIRVNSLTPGLIQTDITGGLMNDDRRHDILAGIPLGRLGKAQDVANAALFLASDLSAYLTGVTLDVNGGMLIH

SEQ ID NO: 5743 - protein, 61 aa, Acinetobacter baumannii
CQTQQYHQNQNDFQIILLHLMKEKSPHKEGSVLQIILNYLSKMLNKSFCTSSIVRKPSSLS

SEQ ID NO: 5744 - protein, 153 aa, Acinetobacter baumannii
IMYHYEECGLSNIWLRNGFTIENDEDYGELVSIESVHELHNAIGLFLITQKPDLNGEEIRFLRKELNLSQKNLAGLLGVSETSIRHWEADRGLIGKPTELLLRALYKEHVQGDGKLRSMIESLNHQERTLVPSEISFSYGNNHSWHQTNCEIA

SEQ ID NO: 5745 - protein, 87 aa, Acinetobacter baumannii
FENHFDFGGIAESGTIVIFTVSKLQNAEKSTKTSERRKKTAKAFKVTKLGISYTQLLFCLNIFNCNLFLSTKFKAVRPVAYIGNHTL

SEQ ID NO: 5746 - protein, 433 aa, Acinetobacter baumannii
KMDQDLTLQDANYLNKEDKRTLTLSSLGGALEFYDFVIYVFYAKIISDLFFPSTLSPFWAMLNTYGIFAAGYFFRPLGGVVMAHFGDLVGRKKLFSLSILLMALPTLFIGILPTFENIGYLAPLLLLLMRVVQGIAIGGEIPAAWTFVSEHVPERKIGLANGLLTAGLSLGILLGALMSLWISLNFSEGQIHDWAWRIPFIVGGIFGLVALYLRTYLKETPVFKAMQARKEISKEMPVKQVLKTHKTAVAIGMLFTWFLTGCVVVVILAMPNLLIGSFGFERAQTFEMQSAAIVMQMVGCILAGYFADRFGCGKVMMVGALAVALTAAAFYNSLGHAAHSTIFGLYMLLGLCSGTVGMVSSSMVKMFPAPVRFSGISFSYNLSYAIVGGMTLPLVHWLSQYSDIGAMYYIFALTILAFVTAFVFWNKFEKNRY

SEQ ID NO: 5747 - protein, 667 aa, Acinetobacter baumannii
SPIQAEPKLFRHSFTGIMMGGEIHSIKECTMTKSSHYLVLTIMGLLSGCQVIHLKESNLSSALKSKNESILTDNTLSHQTQNLLYLVKESETSCLQNFNVCLNKIQGLSENSSREERYAALSEIYLAKALDVGRSSQCNATLKSNSCVEQELALFDKSLRYSYVYLFDSEESPFDRVFDHRQNQVRIFYNVALSKLMTTYFNHLNTLHFPPLLKADGHEYHVNFDHAVDVQHIEVDTFRSSYNMNFSGFNTVNRKDGLGAEFIVGRKEHDVNHGFILDPDAFYAHQSNPNIHLPRFFPVTAIAYPKQKATADQVIDGAELEIAMFDPYRQDRVKVEGVDYPLTANYSAPYGLWLSKYNLGAAGYWSLINKEANLIMPHLYMLEPFNPNKKIIVFIHGLASSPEAWVSLTNDIMGDAELRQNYQVWQVFYSTNMPIFESRFQIYSLLNQAFQNVAKDSYAAHDAVLVGHSMGGVISRLLVSDADVSDLAMQKMNEAQLKRLKENPVIRERFQFKDLPYFKRVIFVSAPHHGTDYADRWFTQIARRIIRLPADFFIAVEMRDEKNTKLRKGLIENGASNLSRSSNFMQLTQAIQPSSNVVYHSIMGNINGTTDKSKMSDGIVPYQSSHLGGEQSELIIKGGHSIQTSPEAILELRRILRLHLKQSQPSK

SEQ ID NO: 5748 - protein, 442 aa, Acinetobacter baumannii
FVSLFQNIIIIVLLIIAAGFLSLTEIALAGARKVKLKILAEAGEERAQKVLDLQEQSADFFAASQIGLNAVAILGGILGEAAFRPFFVNLVDRFYEGPWTQTIGFALSFTLVTSLFILFADLMPKRLAMIAPEKIAISVINPIQIFIKICKPLAWGINAIANLLFRLFKVNTTREDNITFDDISAVMDAGAQAGVLQKQEHHFIENVFELEERTVPSSMTTRENVVYFTLNEHEDSIRQKLAEYPYSKFLVCNENIDQVIGYVDAKDILVRILNNQSLTQLNESTIRTVLMIPDTLTLSELLDRFRSTKEKFAVVINEYALVVGVITLSDIMITVMGDWVTPMEEEQQIIKRDNNSWLIDGSTPIEDLKHALEMDELPDEENYETLAGFMMYRLRKIPRPADFVEFGGYKFEVVDVDHFKIDQLLVTRVLEKNDLPSPPDEN

SEQ ID NO: 5749 - protein, 1028 aa, Acinetobacter baumannii
NVGLHISKPIIKWVTGQYMTAVSSVYAQRLLMTLFLVSFGIYMFLATVTYTPFDPGWMHISSDTQQVSNASGIAGAWIADLLFGFLGWASLLIPIFLFVEAIQVWWPHSFLNRPFRYAAQFFLILVVSSLLYLHWNVPADTLDNAAGGIIGYELGQSLSQLLTIYGATLFLLVFGVVLFTLAFGVQWSKTWVTLKAMPGYLQDLFYKNVSPNESAYDLTTQPANKAATVKVAEMPKAEEVTDEVELNAQPEKAQSKASSTRHDEIAERLFADVLAKEQSQPETIEEKPTPQPENFERTLEQAQQLKKDSERLVATGEVWRALQRDDVSHKQEIDALLRAADDSSEQPSTHEQFQQTVYQAKQNQPSNTHQGLDWNDDEIFDELLAAVPNSKTATDVHTPFVQDHHVEPEVTPQAPQTLVESSVPVSNLNQSPKNLSNEEVFDDFDDLLIDEDIPPATQPIKASSYAQSSAFVKAPIQTTIGAEKLSKEEFIEAWQETAGKPQDDLEDEFDFDAPLTDASGRPMSRAMQVAKKRLDLPTLPGFELLDKVDPNKKVNFTEEQLSRLSELLEIKLQEFNVKAQVVEAQPGPVVTRFELDLAPGVKASKVTNISRDLARSMSMASVRVVEVIPGKPYIGIEVPNSAREMVRLIELLETPAYRDPSALISMAMGKDISGNPVLTDLAKAPHMLVAGTTGSGKSVAVNSMILSMLLKYTPDQLRLILIDPKQLELANYNDIPHLLTPVVTDMKDAVSALNWCVNEMERRYKLMSFLKIRKLSDYNRKVEEALANGEDLIDPTWKPSDSATQERAPRLTPLPSIVIVADEFADMIMQVGKKAEEMITRLAQKSRAAGIHLLLATQRPSVDVITGLIKANIPTRVALRVNSKIDSRTILDAGGAEDLLGHGDMLFLGPGKIEPERVHGAFISDDEVNRICDAWRERGEPDYVDEILTPFDEEPASRGFEEGDGGSDRDALYDQCVSFVLETRKASTSSLQRKFSLGYNRAARIIDQMEENGIVSAMGANGKRDILV

SEQ ID NO: 5750 - protein, 559 aa, Acinetobacter baumannii
FFLQRGIFMSEHNSIQFDPTALLIIKNEIDNSIKLVEGAVSTLIEEQALPFGIDDALEQFKQCTQVLRLIDIPYLAKITQYSTELMQKIMANPERINTDDVVALSEGTTMVKRYIEFICLREVEVPQFLLDTLNNLEKALNKPLTSSGQQIASKLSTVSLELPLPEVLIEVLINERTQFIHQLYKLSLHQFLNKTESARDFQAFKLIGGYLVSMAQGQPSQQYWQLVNSAFSHIDELVLNDARLRVFINLENAISLFLASPEGFEANLTALADILSIVIGQEDQLAQQIRSQLNIGHEFLTDTQLKTLSQHLYGPDFDTMQTVSQLILSEMNKVRNDIEYNYQNMSPEKAHQLQSNLMQLAHTFKLLNLNEAASELSQQASSLSQINILSNENYAQQLMKSILSAMNAIGILVRHYSSNRLQIRVNNTNISLDRLDEAHQTLLNETKNLTDFVCQSLTLYANDQTQNIEAIAGSLKELAGAAEFLGSTVQQNALLETAKFVQQQIDQNQPFNHDQIHCIFNVLAGLDMLVDNLKNKQPVLQSMFDVALLSSQQLQKKAA

SEQ ID NO: 5751 - protein, 151 aa, Acinetobacter baumannii
QQLQTGNVSTILNRSVLWHSSTRSNNKKAGYTALFFGDPQMGLSSFNRARERQQMTETKIAELEEQLATVKGEFIAFQNDPEAMKARIAELESGNNGQKPEDVQKPSDTQPQPINYAGLKVDELRAVLTEKGIAFEAGAKKDELLALIPKE

SEQ ID NO: 5752 - protein, 613 aa, Acinetobacter baumannii
YFMQKLYSQLSLLVGLSVFSQVIFSAQQTTPYIAIHSKPKYLAMAAMPYANPNAPKGGVLSQAAQGTFDNLNSMNGKGNATEGVNYLFDTLMTQSLDEVGVLYPLLAEKVSYDPIKTQSVTFYLNPKARFSNGLPVTAEDVKFSFDTYQTKSNFGLQMYLADLAKTQVINPHQVKFTFKSSHNPKMPFVVASLPIYSKVDWQKRDFTRISLQPIIGSGPYVVEKIDAGRSISYKRNPNYWAKDLPINKGRYNFDHLKYVYYRNWDIAFEGFKSGQYTLHEETNPKKWVTDYHFPAVKAGLVTQYKFRHHNPIATESYVFNTRRKPFNDIRFRQALTYAYDFEWQNKALFYGQYQRLQSYFENSDLAATGRPSNNELAILKPLLPKLSPIMQKAVLADWKYPASDASGFNRQNLLIARQLLIQAGYKIKEGQLYTPEGKPVKIEFLIQQDGKQRTLMPFVRNLKKLGININLRQVDAPQYLERTRRYDFDMTTMNLPQSLNPGNEQAQFWGSAAAVQNGNYNYAGIRNPVIDEVISKLVTAKDREQQITYTHVLDRLLRAGYYQIPTYGKGDYWYAYWNMYQQPKVKPVLSAGIEYWWSNANQAKKVAQYLHQQ

SEQ ID NO: 5753 - protein, 373 aa, Acinetobacter baumannii
HCMHIAIIGAGISGLMSALELVEQGCTISIFDQQQAGQAASWAGGGILSPMYPWRYVHAVNQLAQFGKASYQAWNQKLYPVTGIDFEIHDTGMLIFDEEDFDVGLSYAEQHQEPMQRCEYLQRDALEQVNPHISDQFQEAIYFPELSNIRNPRVLQSLISYLKQHPNVEFFEYTPVKKLIQQGDVIQALQTEDGRKHTADHFVITSGAWSHYWNSQLQLEIPVEPVQGQMLLFKTPAHWLPTMCMNRVMYLIPRMDGHIVCGSSMAHRGFDTSTDETTQHNILEACLEMVPELADFPIVHRWAGLRPSSPNGVPYIGKMPEMDNLWANFGHFRNGLCMGAGSAQLLRQLMLGQPTLVDAKAYSPERLQNKILA

SEQ ID NO: 5754 - protein, 822 aa, Acinetobacter baumannii
KTWQPRCHSLGVPMSELIMNEKTDLEPQVPSVLPLLALRDVVVYPHMQIALFVGREKSINAVDVARNSDNLVFVVAQKDSLTEEIDHDNLYQYGTVAKIVQVVNHENDENCIKVLIEGLHRSKLKKIIDEDSYLTAEHELSPMTINVDKATQETRLQELRNLFAQYAEAKLRNARELVAAANKIEDLLQLMFFVATRVPLNIEIKQKFLEYDEFEAHLQELMNYLMNQSAEQQIEQTLHDSVKRQMEKNQREYFLNEKMKVIQRELSDMNGGAEDDVAEIEKRLAEADLPEHVRKKAEAEFRKLKAMQPASSEAAVVRNYLEVILDTPWNKASKVSINLNKAQEILDADHYGLDDVKDRIVEYLAVQSRVKKLKGPILCLVGPPGVGKTSLGESVAKATGREFVRMALGGVRDEAEIRGHRRTYIGAMPGKIVQSLTKVGVKNPLFLLDEIDKMAQDYRGDPASALLEVLDPSQNSKFNDHYLDLDLDLSEVMFICTANSMNIPEALLDRMEVIRLPGYTEDEKVNIAERYLVPKAIKNNGLRPKELTIHEEAIRDIVQRYTREAGVRNLEREVSKIARKVVKEAVSKKSKNLQLDVTSANLPEYLGPHKFDFGMAEDEAQVGRVNGLAWTSVGGELLTIEVAAVKGKGKFITTGSLGDVMKESITTAMTVVRTRADELGIEASRFEETDVHVHLPEGATPKDGPSAGLALTTALVSAFTGIAIRPDIAMTGETSLGGRAMRIGGLKEKLLAAHRGGIKLVFIPQDNVRDLAEISDNVKEGLEIKAVKSIDEILPLALTSMPKPLPKTPIVKPVEGSKAARH

SEQ ID NO: 5755 - protein, 421 aa, Acinetobacter baumannii
LMWQKLKRSLFLQVLCALFLGIAVGLAFHDFSLALKPLGDGFISLIKMLIAPIVFCVVVLGIYGANDIKKMGKVGAKTILYFEVVTSIALILGIIVAYVFKPGVGMNIDITHLDAKDLSTYTERAHDMHTGSEFLLNIIPKTFTAAFANGDILQVLLIAILFGVSLLLIPKHLAELVRQALEAFSEVFFKIMGLIIRLAPIGVFGSVAYTTAKFGLDSLLQLGYLVLLFYATCILFVVIILGSILKLTGLNIFKFVGYFKDELAIVLGTASSDSVLPQIMKKLKNLGIKDSTVGLVIPTGYSFNLDGFSIYLTLGVIFIAQACNINLSMHDLLAILLVSLITSKGAHGIPGSALVILAATLSVIPSLPAIGLVLLLSVDWFIGIIRACTNLIGNCVATVVIAHWEKDIDHAQAKQVLNIKN

SEQ ID NO: 5756 - protein, 66 aa, Acinetobacter baumannii
KLFKSFSARLTSLDWPKIHPVKNTNGTNTKKIFMGKIYKSEDGRYCINNSMLYCGFMLDIDDFLTH

SEQ ID NO: 5757 - protein, 369 aa, Acinetobacter baumannii
MKIKYLILALLPFSLMACQTVSNTQAPIVSEQQQNLATTLSEYAWTYQNIKASKPLILNFNADGKLAINTGCNGQGGTWKVEGNQLVTSPLASTMMACQDDLMKQEQLSNSIFSEAKLPIEISNNNGQVILSVTDKAGQKHIFQGEKATNTQALTDYSWSYQPENTKKPIVLNFTNDRLSIDTGCNRQGTTWKVENNTIVTTDVMSTMMACEPALMKQEQFSSSLFQKRAIPFELNTTNVDQPTLTVTDAQGQKYTFTGKMTPEAKYQSEGKTVFLEVAPETKSCTGVAPQTCLQVREVKYDDKGVKTYADKNWSLYYGQIEGFEHNPNQRVILRVKRFEVKNPAADQSSQADVLDMVVEQELVKKPKK

SEQ ID NO: 5758 - protein, 1091 aa, Acinetobacter baumannii
NGVKCMRSDATLETIFQKDILEQMQSHGWQVGSPQGYNREKALYEQDVLDFVQKTQAKEWQKFKSIFPNDTERHFLDTVVAQLKKADINATDIESRSYGTLGVLRHGLKTRGTRFSFCQFKPEHGLNPHLNEIYKQNICRVVPELVYSPYANKAELEATGKQAKKWRIDLVLFINGFPVATLELKSEFKQAVQNAMAQYKKTRLPKDPETNKPEPLLTFKRGALVHFAVSQYEVYMATHLNGDNTYFLPFNKGTKEQGAGNDAPEDVNEYATGYLWNEVLTPDSLLNIIGNFIHLQIEEKEDWEGRKYKKESLIFPRYHQWKVVTKLVEDSLAEGTGQKYLIQHSAGSGKSNSIAWTAHQLSSLYDANNKKMFDSVIVVTDRTILDAQLQDTIYQFEHADGVVGRINNKEGDGSKSEKLAKALEMAQPIIIVTIQTFPFVLDAIENSTSLKERKYAVIADEAHSSQSGKTSVELKKVLMSDEFDEDKSTNEKISETMAARIGNYNLSYYAFTATPKDKTLQLFGRLPNPSLPPSKTNKPEAYHVYSMRQAIEEGFILDVLKNYTNYKVIYKLKQKIEEKDDQVDVKKAKIKLNQWVRLHDHNISQKVRVIIEHFKKNVMGLLGGQAKAMVVTSSRKEAVRYKQAFDKYVAEQNYANIQAMVAFSGEVEFAENDADSRHLLGQKFTESNMNLNLKGREMRKAFDSDDFQVMIVANKFQTGFDQPKLCAMYVDKKLGGVECVQTLSRLNRIYPGKAESGTFVLDFFNEPQDILDAFQPYYQTAELADVSNPDIVYDLAEKLKAARIFLMTEVEQFVDAFYSKNKSNAALANICKPAMQRWQQSYTKAINDYDVTKNRLEITKRTGEPVLIANAENEFAEAKKARDALEIFKKDLGSFTRFYEFMSQIVEYNDKELEKISLFARNLRPLLREQAADEDVIDLSNVAMSHYRLSKIRQQDIQLKANSTEHKLEPANDLGTAKPKNKNEEFLSVILQRVNEVFITDKLTDQDMINYVYTVADKMSENTKMMKQIQNNTREQAMLGEFDSALDDAVLDSNTAHNEQTMQLMSDPSKMRQFANIIYDVLASKENKSVN

SEQ ID NO: 5759 - protein, 182 aa, Acinetobacter baumannii
YLSKIGGYMEACNLNWDLVIKFIQIIIPLGIALFVYHIWHEQKGKEVVANEVKELLKNILEEMTIISLLRYETQKDLKLIEEKIERLNNLTQINMRSALFIENCLHEKELGMLFTNYNMVSTDTYVLLRNNALKAKDPKEYMNFNIQSRINLDAYNKPTEAIIKKLSPFAIYTKKISLKKFK

SEQ ID NO: 5760 - protein, 325 aa, Acinetobacter baumannii
IIYKIWLDQMNDFITRYLNNLGQWHEVALTMTKAIVAIGVLCLVAYLITIGYIPSELSFGDTFIFLLIFAACSIVYAGLSIVLFLFGISLMPVTYIILNIVNKYLPSHEKIRDDLPFPKISIITFIASIWFIYILRNLLLTYWQVSLYVGCTVSWIAFLYYAFYVNQKDIKIFSKKFKNIEDIIDDIGASEHLKIFARDKLKKLETNIKNSIHVAIFLIVTPVAPMFFIPDIGDTFLNYAMQKTGVRIEKATLYIKEPYANLIELPKTTTKELNQYKTFIFKDVKVLFQGIGKSTLVSYKVKDMEKQLVIPNEYITVERSKKIEE

SEQ ID NO: 5761 - protein, 142 aa, Acinetobacter baumannii
ILHNNIKDKNKSIDMTGSLGKLGPHEGQELELLLSGKKPIAYFYELLPIEFIKHLEQGSLSMLSKDIETSLPFPFSIMLIYKDASLADLNELMLCIERSLKATQLEERLELDRRIGQLLGYSVQDIEFYIQHISNRHLKTKI

SEQ ID NO: 5762 - protein, 274 aa, Acinetobacter baumannii
FWHNDYYSAFQLRCNEMELQTLPGLFISHGSPMLALDPEQVGPALHRLSVNLPTPKAIIVMSAHWESKALEVSSSTRPETWHDFRGFPPELYEIRYSAPGQPELAEEILKLLADAHFVAHANSTRPRDHGVWMPLLHMYPEADIPVVEISLPMGLTAQEIYRIGQTLAPLREKQILLIGSGSITHNLAELSWQGDNSKVPEWASTFRNTVVSKLSHQDYDGVLEWQTLPFVKRNHPSLEHFAPLFFAMGTGHRFTIVHSSFTMGSLGMDIYRFD

SEQ ID NO: 5763 - protein, 187 aa, Acinetobacter baumannii
EVNKMKNYLIGLVITLGISGCVSIPSIDFSQQKVERFNPVKNWISVDTAPVKDMPNGKEILKLKGGSEVYVFWYQDEWALLNPNMDRQQWIDTKYLCSFAGCYTPPVTYRYSKGSFDNRQPVYSTPQRESKGYNNTRTRSSTTTRTPRSYSKTTNNSCYCTSGTYCVGPRGGHYCLNSTGSKRYLPR

SEQ ID NO: 5764 - protein, 215 aa, Acinetobacter baumannii
RLDKRMQDDISGWTEWNAHFEGIEEISSPSELHGLLTGIVCVTEAPTREEWTQILTTLNVPELNEEALALLTDEAEDVAHALSEDELDYLPMLPDDEHLLQDRVQALSDWCAGVVLGFGLASGHVRTDERELIEHLQDVAAVEFEDSDNDEEGESSYEELYEFVRLIPVSLSIGRKKVTVAESSLLKNFYAKSKTSTVGTADQNIVEMFTPHRPS

SEQ ID NO: 5765 - protein, 70 aa, Acinetobacter baumannii
GCRKMKLAKTLLATTLALTAASTFAASKHDQAHNTAGEEKVVVSTQEQANTANAASDAVGSASEAAPATR

SEQ ID NO: 5766 - protein, 820 aa, Acinetobacter baumannii
TMRNLLKPLLLQSFRTGGLYLLIIALSLAISATTALKFSNDQVKNAVSLQAAQMLAADLVLSNNEPIDAKWQKRADQLGLKQTNVTMFSSMAHTQDQFVMVNVKAIEPAFPLRGKLEIEPIARGIQPGEVWLSQRAADLLKVKLGDMVSIADAAFRFSGVIVRDSNQELGFSGFSPTVIIHQADIAKTHAIQTGSRIDYRLLMSGQPEQVQSFSRQFKQQHQPANEQEETIGLRLRDASESNSRLLRPLENLDTFLQLANILTILLCGIAIALTSQRYVQQNQDHIALIRCLGASKFQILWAYIGLLCVVSAISIVIGSLLGIMMGYGLLELMLQLIPQLELSFSVVGFLLGPLPIAIFTSVIVLLGFILPSIWELLNTPPIRVIREQAKSRKSLFFMFFAGITSLVIFSLVLSENLMLSIWVLTVIILLCILLYTVVWLLLRALKKMKTRLSFYIRSASQSALQITALALGLSLITVLSVLRTDLLERWQQQLPEGTPNQFVYGLPPFDLKAFEQQLKQNGWQSTPLYPNIRGRLVAKNDVPFSEEAIKQNNALRRELNLTQSSALPNDNVITKGQAEFNAVGQVSVESKTAESLGIQIGDRLTFSLPEGSLQAKVINFRSVEWESFSPNFFFIFSPKTLDENAGSYLGSFYVPKQDQPKMIHMIQQFSNTVFIDVDRILDEVKRLMNVLVKIVTVLAALVGFSGILVLIACLNLLMDERRREVALLRSFGLSKNKMKQMLSLEIGFLGLLAGIVACCFAEVISAIASYKMNMALQWHIEIWLILPLVMMLLCALIGRYRLGYLCNLPPLQSLRELNQI

SEQ ID NO: 5767 - protein, 185 aa, Acinetobacter baumannii
APSKTRIKFFTLNFALLLSGQTMNFENKMAIHKYEVKIQWEGNTGTGTSSYRSYKRDFSIQHPQKMTIQGSSDPAYLGDVTRWNPEDLLVASASACHKLWYLHLCAVNHIHVVSYVDHALGFMEDTDPVKRGHFTQIILRPEVVLEKGADQELAAKLHEEAHHECMIANSVNFPITCEASFSFAE

SEQ ID NO: 5768 - protein, 408 aa, Acinetobacter baumannii
HMSNEEKSGLKHWVPAFVLMVCVVLAFFDKISIAVLFSDPHFQSSMGIAEDKAKLGWLMTSFLLAYGFSSVFLSFLGDIFNPKKMLFWSVTSWGLLMLCMGFTTSYSGMLILRVLLGLAEGPLFALAYTIVKQTYTDRQQARASTMFLLGTPIGAFLGFPITAAVLAHHDWHTTFFVMAALTLIAILSIVFGLRNLQLKKTVELEGESKRTNFKGHIANTKVLVSNSAFWLVCLFNIALMTYLWGLNSWVPSYLMQDKGFNLKEFGVYSSFPFIAMLIGEVVGAFLSDKLGRRAIQVFSGLLLAGIFMYVMVIMTEPLLIIAAMSLSAMAWGFGVAAVFALLARVTTSNVGATAGGIFNGLGNFASAIAPVLIGYIVMQTHSFNLGITFLAAVAVIGSLFLVPLLKRY

SEQ ID NO: 5769 - protein, 297 aa, Acinetobacter baumannii
GAFNMNAKVNITNRAGASFPVRRMNFDFNDVPEYWMNGSAGLTHFMTALSALFPAGEKFFIDSVRAVRYHPAIKDNEELQKEISAFIGQEAMHTQEHVNFNASAQKFGHDVETLEKFTDTAIQTARKTFAKLVKPFGMTQEMVDLTATTALEHFTATIASQLLVNTYIQELMTDKTMSTMWYWHAIEENEHKAVAFDVYEGVFGKGVKAYALRTSSLVFAMALIFAIQSSFVVRLLKQDHKLNLDELFVIYKYGYSPSKGIITGMAKEMLAYFKPGFHPNDLDTVSLLKTWKSKLGL

SEQ ID NO: 5770 - protein, 230 aa, Acinetobacter baumannii
MAVKNMTKKQIQIFFERLREQRPSPQTELKYSSPFELLIAVMLSAQATDVSVNKATDKLYPVANTAEKIYNLGVDGLKEYIKTIGLYNSKAENVIKTCKILMEQFNGEVPSNRKDLEALPGVGRKTANVVLNTAFGQPTMAVDTHIFRVGNRTGLAIGKNVLEVEHRLVKVIPKEFILDAHHWLILHGRYCCIARKPKCSECVVADVCNWPDRFEFGAQKQIAVKNIEAE

SEQ ID NO: 5771 - protein, 539 aa, Acinetobacter baumannii
IQDNIMTTYQTAIDAVRELKAKFGNTWADISPEDAARMQLQNRFKTGLDIAKYTAAIMRRDMAEYDADSSKYTQSLGCWHGFIAQQKMIANKKYFGTTSKRYIYLSGWMVAALRSEFGPLPDQSMHEKTSVPALIEEIYTFLRQADAKELNDLFRALNKAKEAGDSAKVAEITAQIDNFETHVVPIIADIDAGFGNEEATYLLAKKMIEAGACALQIENQVSDAKQCGHQAGKVTVPHEDFIAKIHALRYAFLEMGVEDGVIVARTDSEGADLTQKIPVVKEPGDIASKYISYLDTQEIDISEAQEDEILIKRDGKLHRPTRLASGLYQFREGTQIDRVVLDCITSLQNGADLLWIETPTPNVQEIAHMVNRVKEVVPNAKLVYNNSPSFNWTLNFRQQAYDRWVAEGKDVSAYDRAKLMSAEYDNTELAAEADEKIRTFQADAAREAGVFHHLITLPTYHTAALSTHELAQGYFGDQGMLAYVAGVQRKEIRGGIACVKHQAMAGSDIGDDHKEIFAGENALKAGDDAKNTMNQFSAH

SEQ ID NO: 5772 - protein, 71 aa, Acinetobacter baumannii
ASSKTSTSLKHNDKRRGDEVKGVIASLNISTEVLKKQKDESKFILLIFYLYIIKLSLLLQRGQQQFHRLQL

SEQ ID NO: 5773 - protein, 552 aa, Acinetobacter baumannii
WFLKMALNVFKFKKICKDVTLLNFNLLLSIWLGLFLNIGFFKKIHQLTPYNGIKSVLFLGATLVILIAAYNLIFQLINWKWTAKIFAILLIFIGGFSSYFVNTLGVIISPDQIQNMVQTDVSEFTDLISLRFVLWTVFFVILPIFLITQVKFKQEKASRLLLKKVFSLVASFAVVGVLLFTYYVDFAAIFREHRDLKGMISPQNSISSLMSYYHKKAPKKNLPFVIYGQDAHQVQRVQKNLPKLMILVVGETARAESFSLNGYAKNTNPELSKQDIFNFSQVSSCGTATAVSVPCMFSGMPRVDYDEQLASHREGLLDIAKRAGYQVTWIDNNSGCKGACDRVEQYQIPENLKKKWCKDGECYDDILIDSLKQYLATIAKDDDRPRLIVLHQVGSHGPAYYKRAPEAYQPFKPTCDTNAIQGCSQTELLNSYDNTIVYTDHVLSQMINTLKEISKYQTGLWYLSDHGESTGEHGLYLHGSPYAIAPSQQTHVPMIMWFSESWKQHNLAQVNCLSQQTKQKLSQDNLFPSLLSLLDVKTQVVNNKLDMLSQCK

SEQ ID NO: 5774 - protein, 252 aa, Acinetobacter baumannii
FYINHIRHTMTEFKWQIDSIRTVLFFNGEINFKKKEWSKNITGLEISNEMTQSEENGRLIQYVEITNLDSNKQFNLVYLKDQSLIDLQLVFERDENFYTFNEIIKEVDFFYEKISVFFDQLNEKIIRIGNVVELSIPVDNEKIGCDLLRSNVSYLNNMQEDLEEISYRTNKSYFIDNIKINQVVQYSNGQKMSLVIDPNIGIPKAKVQKNILMNIDVNTDASHRSELDFLKFIPLLQDSVKKLIRNGGTYVS

SEQ ID NO: 5775 - protein, 259 aa, Acinetobacter baumannii
SASKYYKKITKLFIINKISMFYTSFLFHYSFNNKTLKVRRHAMRALVISTVVGAAVVLSGCQTTGNNLGGVEYDKAALGTLIGAAAGYGISKSNANSSRQNNRAAAIGAVLGAAGGLYLDQKEKKLREQMAGTGVEVGRNPDGSVQLIMPGSITFDTNKSNIKPNFYATLDKVAQTLAEDNKSAILVTGYTDNTGNDSINIPLSQARAQSVKNYLAGKGVPSSRIDAQGYGSSNPIADNSTASGREQNRRVEISIYAKQ

SEQ ID NO: 5776 - protein, 228 aa, Acinetobacter baumannii
VQSKLYTMSTHNAAQLLQLLTLSSTALPVGAYCYSQGVETAIDIGLIHDESSAIAYFEEVLEMLLVRFELPVLKRLMQHYDDPDQFLIWAHLYKASRESKELLAESQQLAFSLNAWIKDVLKKTVEVKKQFGFVPVYAQLCGRLELKDVDVITAYTFTVLENQVLAAVKTVPLGQMAGQRILWHLHGRVPQAVEKALKLKDEQLSSALPRYAMLSMKHETQYSRLFRS

SEQ ID NO: 5777 - protein, 451 aa, Acinetobacter baumannii
KFQKDYSVLIGAKMSDLITVREYAYISVVHTGCPESTIDHAYISASAFDHLCELSATFSKHGAKVFELAGRRKLRLDQYVGVIETKCGTRIEILPKHVDINLNESNETAIEKERELLKKMLKVSLHLPYRDAGQASLSRFKQPIHEWIIDQFLCNFEKLIQRGLRFDYHRVQEEQKYLRGQLQHVKHMRQSPARKHIFPIEHDIYEVDRPENRLIKTALDVVCKKTRNSKNWKLAQELRLMTGEIPKSQNIVQDFKQWQSGRLLALYAEIKPWTELILSEYMPVSTQGGWRGMSLLFPMEKLFEHYVAYHLRRELKEWDVKTQVSNQHICTFNEKPLFRLKPDIYIQHKCSPYKIILDTKWKLLDQNDRNRRFGLKDSDVQQMFAYSHYYLDHASEVILIYPYQKNKFEDEICFKFNVQNDQAMLRVIPFNLDKPYDFIKSISSSNFESEI

SEQ ID NO: 5778 - protein, 287 aa, Acinetobacter baumannii
KFKNNMCQLLGMNCATPTDITFSFRGFSQRAGITSDHSDGFGIAFFEDKACRLFVDNQSAVESPIADLIRNYPIKSRNVIAHIRKATQGKITLENSHPFIRELWGRHWIFAHNGDLHDFNPPLSGRFTPVGNTDSERAFCYLLDQLVEVFGYEEPTLEQIFEVLEKISPQIAEYGTFNFCLSNGQALFSYAITKLHWLVREYPFNNAHLIDLDVEVDFSQVTTPEDRVAVITTEPLTHNETWIAYQPGEMILFQHGKPIKKAITQVERLIREEKNPELKRITRADQY

SEQ ID NO: 5779 - protein, 163 aa, Acinetobacter baumannii
IMKKIFLAALATIGLQACTTPYQEMGASGGVEATIIDDNVFQVRASVNGYTHKSIANQYALRKAAEVSKSLGCSYFSAINNTSQSYNQNISKVDAGLKTTPNGVYYVSSAGTQYKLIKPSRNNTYVCFNEKPNTVLPGLIYNVKYVLGSPMPTGKFKVPNSWR

SEQ ID NO: 5780 - protein, 184 aa, Acinetobacter baumannii
IMKNQLRIIGGEWKRRVLPFASIEGLRPTPDRVRETLFNWLMWDIQNAQVLDICTGSGALGFEALSRGAASIYMIEPDKTQARFLKDNIQLLKAQNCHLINATAQQALPRLKEQFDVVFLDPPYSLNLWQELAHLADSHIKNNGYIYVEADRDLSQLHLPATWQQIKSTKAGTVHAGLYQKVSE

SEQ ID NO: 5781 - protein, 684 aa, Acinetobacter baumannii
RPENKEACMAIAWIGRRIYWSYHVNKRYSFLFSSLLAVGLLQGCGDDSSSDQPKDDSNTTPPNLIVDNDPTSCSKLAQDGSSVVVGSNQNGDPAAPEGASGYRLGNTVKYADKYMVVANTPLAVKAGCDVLKAGGSAVDAAVAVQAVLGLVEPQSSTIAGSGFMMYYDAKTKQVTAYDGRETAPAAANEFYLIRQNIYDPNSPPPVPSARRSGRSIGVPGVMRLLEQAQKEHGKLKWNQLLGEAIGLADNGFRIPGRLADAIASNASNLALDANAMATYFYPDGSPRKVGETMTNKAYARTLEALASQGANALHTGPIAQAIVAKAGQTVGDDPARTPITPSLMTLQDLSNYQVKKRDPICTTYRDRYYVCTMPPPSSGGIAVAQTLGILENFDMSLYPPKNPENEGGVPDVMGVHLVSEAERLAYADRDKYVADTDFVALPAQGIPSFIDKNYLKQRAALINPNQSMGIAPAGNFNTAAGVDTTVEHGTTQFTIVDAYGNVVSMTSTVESSMGSFHMVDGFLLSNQLTDFSANPYDSTGAPVANRVEGGKRPRSTMAPTLVFKGTTPDEFYMATGSPGGGTIIQYVVKTLVGALDWNLNAQQATSLVNFGATNSKNTNVDSSNVQLSLVDLIEGLKAKGHGISNTAQTSGISTIMKVNINNQSKYAGGVDPRREGIVLGNGAL

SEQ ID NO: 5782 - protein, 448 aa, Acinetobacter baumannii
KSRNRNGGLVMSNIHNIPMEQAVLTALMTVDKSFDVVSNDLDVECFFPERHKQIFQAIADLANENKPYDFVMVEQQLKQKNVIHLMGGSEYLLQMSSEAPSSFYNLESYVAELNKFKAHREVEHIGQSIAEIAKDLTIPDVHIAAESILDGKKTSNDVEKTSFTFEEAMNRATDRLIQKAEAKANKQYTGVKFNLTHLDNLVGLIQKGHFCIVGGRPGSGKSTLAQMLVIQTAVRYNEPVLVVSAEMDVETFTNRCISALTKIPYDNIHNAELFDGMLAQFADAQRRFSSLPIHIEDKQKPTIAEIHSWARKAKRKYKRLGCIVIDYLQLVRDPSKKDRYQEVSSISRDLKALAKEFDCPVIALAQLNRESEKGKRPKASDLKESGQIEQDADQIILANPIIGEDDLPSGVTELIVAKNRHGKKGVVRVMDRLDICRFVTIREEGMAA

SEQ ID NO: 5783 - protein, 155 aa, Acinetobacter baumannii
FLGNPMKVQVKLLDPRLGKEWPLPSYATAGSAGLDLRACLDEAIEIEPGQTVLVKTGMAIYIHDVNFAGLILPRSGLGHKHGIVLGNLVGLIDSDYQGELMVSVWNRGQTTFRLEPGERLAQYVLVPVVQAEFEQVEEFEETLRGAGGFGHTGKQ

SEQ ID NO: 5784 - protein, 217 aa, Acinetobacter baumannii
RELKMEQIRPFPPTDFIDQADEEEAIRLTPAPDLKKWVVANYLTIGGPLHNPDHNHIAELLHDNEEFLAFAWASSAYKSKQAMVLGQCEKVMFNVGGWRKARQEQQMRDWFGFVPTYLITIDATFCDKANDREFCALLEHELYHIGVERDEDGEMIFSSSTGLPKHYLAGHDVEEFVGVTKRWGASQSVKRIVEAAKNPPFVSKLDISKCCGNCVIN

SEQ ID NO: 5785 - protein, 509 aa, Acinetobacter baumannii
TLMKTQTPFAELSGGRLLLAAFVIALSNFMVVLDTTIANVSVPHITGNLAVSSTQGTWVVTSYAVAEAICVPLTGWLAGRFGTVRVFIFGLIGFTVFSFLCGLATSLEMLVFFRIGQGLCGGPLMPLSQTLLMRIFPQEKHAQAMGLWAMTTVVGPILGPILGGLISDNLSWHWIFFINLPVGIVCVLAAMRLLRVAETETISLRIDTVGLGLLILWIGALQLMLDLGHERDWFNSTSIVVLALTAAIGFVVFLIWELTDKHPVVDVKVFRHRGFAISVLALSLGFGAFFGSIVLIPQWLQMNLSYTATWAGYLTATMGFGSLTMSPIVAKLSTKHDPRALASFGLILLGIVTLMRAFWTTDADFMALAWPQILQGFAVPFFFIPLSNIALGSVLQQEIASAAGLMNFLRTMAGAIGASIAVTVWDDHAKVARSEMVSNLHTTEVQNTLLQNGFTADSTLGIISNLVDKEAITMSANHVFLLFAIVFVFAGLVIWLCPKPKQVSGMPSH

SEQ ID NO: 5786 - protein, 442 aa, Acinetobacter baumannii
IIMKLPQADFQHRRNRLAEKMGPNSIAIIATREEMYRNRDADYKFRADSSFFYLTGFAEPEAVAVIETFDDVTDYSYSLFCRERNREMEIWNGYRAGIDGAIEEYEADEAYAIDLLDEEIIEKLLNKERLYYRIGHNAAFDARVSQWIKKANAEHRHEAAPAQLVQLDRIVDEMRLIKSPQEIELMQIASTISAKAHTRAMQTVRPGMMEYALEAELNYIFGQNGCVPSYNSIVGGGANACILHYVENNQALKDGDLVLIDAACEYEFYASDITRTFPVNGKFSPEQKALYEVVLASQYAAIDAVRIGNSYREPHEVAVKILTEGLVDLGLLKGEVSELIETEAYRQFYMHGTGHWLGMDVHDVGSYKKDDDWRQYEEGMVVTVEPGLYIAPDDETVDKKWRGIGIRIEDDVVATSKGPRVLTADVVKDIADIEHLMAQAKA

SEQ ID NO: 5787 - protein, 337 aa, Acinetobacter baumannii
RQMKLKLVLSTTIGLLFITGCSKSEHNADAKTVLPKHAIQSAALGSIEQCKSYTGLPTGWLKNTTAGMVFIPDGHFNFGSEKAYPDELNFGKKQREVKGFWIDQTEVTVAQFASFVKATGYITDAEKQKQAAVFSPDPHHPQQWWQLKTGYTWRTPNGKNGALPNPHEPVRYVTKNDAEHYAVWLGRDLPTELEWEYAAKANSPTDTPLHQAPTDEHQHPQANYWQGAFPFENLNQDHFTGIAPVGCFKPNGFKLFDMIGNVWEWTSSPYQGAHDQHMGNYSALRQQEMSSTQYVIKGGSFLCAENYCSRYRNSSRYPQDFDLAATHVGFRTILRSP

SEQ ID NO: 5788 - protein, 293 aa, Acinetobacter baumannii
AKMNRIQQTFQTSSAPFWYAQLELGFCYENSRTIMSHRKHYGPVRVQKMLWPEKTGVCHAIIVHPPAGIAGGDHLTFQIETKDQAHAVVTTPGAGKWYKTNGKQAFQHIHLHVRDRSILEWMPQETMLFDGALAHSETDIHLEQTASFIGWDMLVLGRQARAENFVQGSYHNQFKLWRKNKLLVADTLYFEGGDRWLSSCLGMNNQAVMASFWAVPPEKFRSSFYLEQHIELIRELIMRMDVPVTLTLLEDVLCARFLGNDVRRCHDAFAAIRAKLRRYWFDLDEEFPRIWKT

SEQ ID NO: 5789 - protein, 141 aa, Acinetobacter baumannii
REMKTNSLIIDLRRQLPWHKRYASTTSTAMMWAAWLLLWRPFVFIWVLAELQKTHLVHRLFSAFGVGIEHGITALIACAVGLLLWSHVLPERRVEGSELNMKQTDDYARYFDLPVQEIEQGRSQKITVVHHNEFGKIIRVE

SEQ ID NO: 5790 - protein, 231 aa, Acinetobacter baumannii
QTVKFMKKILAAGLIGLGLVGCATPAYNYQAIPKNISKPPIGSVNKAFVGDQMLEQGMVVDREVLNVPENIKISFAYSLTSGIYLKTGKNEKGQYFQPFNTVSGGGMVQKNPLADPFKVVMLDTEGKLCVVTVFNAKNCTDKHQATMKTVAIASDNSFQQTLIYSGKFGNKINVGYREFSSNQARPAFNNDVEYDLSQSKQIGYKGALLEVIDATNQDITYKVLKNFNKVD

SEQ ID NO: 5791 - protein, 163 aa, Acinetobacter baumannii
TNQKTTFRRIARSKMDKCREEFEKQRYWIGLFRADVDFDVTLGEFGRYVSNGSRRVDAMCLESFNEKWEAWANAWQSQQAKVEELEGKLKQAYEDVDTFAEAYERECGFKAQLAKDKAELQKRVDQQGLIIANVMSIASDLQKSWSMFEIGKKLEQALKVGKN

SEQ ID NO: 5792 - protein, 102 aa, Acinetobacter baumannii
LIKKTTTTRRNMSLYNFSVFLGGLLFVSIASAGYKSNAHRDFYLKCVAAGHSRATCLCIYHRLERQYSPKLMHKLGKLSLQSPEVPRDFVKTMLRTMQQCQS

SEQ ID NO: 5793 - protein, 1454 aa, Acinetobacter baumannii
LKKNYPLIEWVFYCLEESKMAQESRLVIVIDSQNAERNARNLGNELVSIERKGEFASKSMDSLSVATRALAGHMAGLLTVGSAISKMDTYTGLQNRLKLVTNNQVELNKATEDTFRIAQKTYSAWDSVLQVYQRFSDNAKTLNLTMDDTARLTETVSKAVAISGASAEAADAALVQFGQALASGTLRGEELNSVMEQTPALAKAIAKGMGITVGELRSVAAEGKITSQEIVKALRNVESDVDALFAKTDITIGQSLTLLNNEITKFVGEAGKGSGAAQVLAGSVQTLASNLDLIADGALVVGIGYITRAILMKSAAIKEGMASTLASRQASVLNAQAEYAEATAALNAAKAHLANVRATNAETQAKFGATAAATRYAQAQAAVTAATNAQTAAQIKLNTATSIAGRLAKGAFGLIGGWAGVATLGVMGLAAAYSYFNNKAEEAKQKLAEQAKVAEKADEELKKLTGNDKAKAVNDLTTAFNAQNKALEKSSRAVGSALIDIENYARGNREVEKISQEARTGTISYTEAIERLNKIKLPTDLYENLKKQAAQYDDNASKASLSAEKLKLLRVEVKLGGNEAQNAAIQHQKQADALGNTATEAEKATKALQDYQAKQKDSVIDSIYKSGWLDKGYTVAQANAILELQKAKGMSAILSKDEIDSALRNLKIIEEQQEREDKLTEAKRKQTQEIEKQAKLTKRLVGISGQSGIGTGPHLDVRYGGSLSGQKVSNEHLARLQAGGKPLTSYKISSNYGPRKAPTKGASSFHKGIDFSMPEGTPITTNVAVKDIKTWYDSKGGGYVSEVIFEDGVSLKLLHQSPKMQSKVKGGASKGSDKAAGDIQSQLERQQDLQRSLENEVASEVGRINNNRKARLEDVDKANFSPERTAEIKAEINRRADNDIAIAKQALRTKLEDYKEFQKTEEQLLEESFNRKKFNAAHDLELSKFEQKQAVELLEQQKQQELGLLKLAQEQRLFQARLSLLSETQAMQERYRLEREEILKNTKLSIEERQKLIALSKANQDKETRDKVNNAAQNWGGIQADMNGTGEFFRQDQERFSRLNAANDLADSQFAATDLNEQNSLDGLNAQFEAGLIKQQDFENQKTAIIQAAQDQRNQIAAEYAQNAQDIEDKYQQDRLNTQIAFGGQMMGSLTSMFGSMFGEQSKAYKIMFAADKAYAIAAAGIAIQQNIAAASKAGFPLNLPLIAGAVAQGASIIANIRAIKDQGFAEGGYTGRGGKYEVAGAVHKGEIVWSQEDIKRWGGVGLVEKMRKSTNPEAFLNNNASADSVMRRAMMSSSAFIESQKQADIFNQPVQDSQIIYKGNRSVPIASSSASSDLYHDGKVYFSSNGLVLDRSNLDDVQDFTSGRASRPQAEIKPSIEPASSIINFKIEVINQVSGATVEAEQLDEQTVRIIVKDEMDKQLPRTVPKLVSDQIGNPNSTISRSLTENTTVRRNR

SEQ ID NO: 5794 - protein, 118 aa, Acinetobacter baumannii
TNGNIMITELEIIDLKVGEGKEAVKGALITTHYTGWLEDGTKFDSSLDRGNYFECVIGTGRVIKGWDQGIMGMKVGGKRKLMVPAHLAYGERKMGKIIPANSNLIFEIELFDVKTRDD

SEQ ID NO: 5795 - protein, 530 aa, Acinetobacter baumannii
CIHLYINLIVQARYFMSSQSSAEGLQFPIHASIKKQSTSLTGQEILSEALSIVDNKTAQQILAEKNWRKNYPIYFKALVKHGITNSNNPITIAKQGLHKAHHLFDYYRDGKHYLLKDALHIPTSTPLNTVRFKGESEAAPEWYVPYKGQKLSGQSLLDQIQKWENAGIIEPSHAKALREAAAHPEWFDLSDRTMVLFGAASEAGPLPWLAKWKANIVAIDLPNPRVWGKILNTIQQGNATLIAPSIEKIDSSAKASALRDKLGANLLTQIPEIAQWLVQFPQKLDLAAIAYLDGEKHVRVSMAMDSIMQYVSEHKPDTSLMFMCTPTDVYAVPKEVAEAAQEKFKSRSQLQKMAVKGVSTLSLKRFFQAPYQDLITSENGKTYGIADCLVVEQGPNYALAKRIQQWRATLARHQGQRVSINIAPSTTTHSVTKNPLLKAAFNGAELFDVEAFSPETTNAIMAALWIHDLRNDSSVANPETVLDHPLELMMEGANHGGLWRVAYLARTALPFAAIYGFAAEKLPFRKFSKK

SEQ ID NO: 5796 - protein, 459 aa, Acinetobacter baumannii
SMHLLRCFFIGVFMAVTDKHPQYIAAQKSWEIMRDAVAGEEQIKQAQTKYLAKSAGMIEAEKQGDTTGEIYKAYLSRAQYPLWVQDSLRTMIGLVSKLEPNIVIESSLLKGLIENATNDGFGLKQLFIRICLELLEYGRCGLLVDVDGAGVPYFALYDALSIINWKENSIGGRKDLKLLVLEEQFENSEDEFGHDTKTVHRVLSMVDGALTVRLFDGSVEEDKTPDLGGNQLSFTPFVFCGTTDNSPQVGTVPLLTMAKAALKYYQLSADYYQSLHHTAHPQPWINGLEGDEDISVTGVMAVWSLPGESQCGYLEISGSGIELTKKEMDAQKNAALEAGAKVVDTNTQESGEARRARQDDQQASLHSIVTCAAAAIEQAIKYAAQWLKLDPSKYTFTVEPEFIVQQYDINLAKQLYEGAIAGKNSFQTYWEYIATGKLPAHDFQEELKRVESERDSMPL

SEQ ID NO: 5797 - protein, 288 aa, Acinetobacter baumannii
NMNLIEQLQSKIEQARTLYKEFRLYDLGSFALNRFTPKDGFEQVLNVRYGLKPRHRLDIYRSTKRLAHRPLIVFVHGGAWQHGNKRDYLFIGEAFTKEGYDVAVINYQLAPKNIFPSYVDDLTQALNYLHQNQEKLEISTENIVLMGHSAGAFNVMSAVYHPKPNTIQCLGNIKAIFGLAGPYHFDYKGDPLAEDAFDQSISYKEVMPYYFVNQNHIKHYLLMAENDQLVKKENTFDLDQALRQSGNHSHIAVIPKTGHITILASLSSFVSHYFRTKRTILHFLDEVF

SEQ ID NO: 5798 - protein, 63 aa, Acinetobacter baumannii
RGAESMIEFADYTSMMKLRRAYNLGTRNKETRAAANLYEKLRKLKMLDQLKQEAMTKRYKEAV

SEQ ID NO: 5799 - protein, 280 aa, Acinetobacter baumannii
FFNDCLKDNERQIKERENMSNQEGKVSRETRGHIFLIGLDRAAKRNAFDSHMIKDLSLALTEYENNDALRCAIVFAHGDHFTAGLDLVELQPKLATGVFDFSENEINPWGTIGRKLSKPLIVAVQGYCYTAGIELFLNADIAIASENTQFAQMEVQRGILPFGGATARFTQAAGWAKAMRYLLTGDSFDAKAAFDMNLITEICSEGTELKRAIELAEHIAQAAPLAVKATLASAREAVNEGYKVAFNQLQNHLQPLLTTEDVQEGVFAMLQKRPPVFKGK

SEQ ID NO: 5800 - protein, 87 aa, Acinetobacter baumannii
MSRLTKLDRMTHAEKEAAKKEFWEAADNQTFPPETVAIVMHVSLPWLQKKRCEGGGIPFSKPHKRQVNYVKADVLAYIEQNKMAHTA

SEQ ID NO: 5801 - protein, 263 aa, Acinetobacter baumannii
FMSDSLIQSDLSELVIGLSSEHSYREITPTHTHTRAQFLYASTGNIQVFTPNHVWIVPPMCALWIPANVEHSVISLSHVKLNTALVEVNAAALMGQHCFIIRVSNLLHELLIRLNEIEREETPNTATSQELSRSLQILIFEEIHRANLLPIQIPWPKDKRLLKICQELLHTPDSSKDLTDWADDIGASSRTLMRMFQKETGLSYRAWVQQMHIALALSKIANGESIAQISESLGYTNPSAFSAMFKRHLGKTPQQFRSAAMSL

SEQ ID NO: 5802 - protein, 155 aa, Acinetobacter baumannii
GAAEMPQYLMFAENIYNKIKDEELFSHDCIENMNLLMTCIRREIEGTEFKLKYNFIDFVELFSKQLDECKVKIDVSLIPPHNSEGEYILWLAGFIEKITEGGPKPPPPIKKFIPEYMSLKYELDFLPLNEEKIQTEGKEITDYFNSKLYKATFKK

SEQ ID NO: 5803 - protein, 363 aa, Acinetobacter baumannii
NLSENGDDSMKNILTAQEAFAALQKGKTVLCRPIGDMLDFSDLDQFPASVFGKPGFEFCIKIETIELAGITFTKPLTIDEYEEGQDVFVITTYSPSIYVVNFRTTALIESINSGFVQRDAENAKLQLKALSKALGFEVSDDFSVIRLGDEPKKQRAKKSKGAQTVVVEKTSEIVDEVKQPTIVITEQTNVTTSEDSLVQSEDISENIGSALDSAIVITEQPYVSSPEDFLTQPTPEQEKNNEYQQTLDTLLQRVKESKTPAEVNAVYRYTRTWDDEQMKPILLATHKRLEELEKEKASANEPPSLMVQIQTAPDLTTLDALEIDVAARDPQIQPRLMDFVKKRRFELENAASNEPDYLLEEPF

SEQ ID NO: 5804 - protein, 379 aa, Acinetobacter baumannii
QNSENTIMDFNDLLNLMVEKKSSDLFITDGVAPSMKINGQIVPISKNSLSGEVIGQLLHSIMSEKQRKEFADTRECNFAIMNREKTARFRVSAFQQRDMPGMVLRRIETKIPSIDDLQLPPVLKDLSMTKRGIIIFVGATGTGKSTSLASMISHRNHNSKGHIITIEDPIEFIHEHAGCIITQREVGIDTDSFEIALKNTLRQAPDVILIGEIRSREVMDYAIGFAETGHLVLATMHANNANQALDRIIHFFESDRHSQLYMDLSLNLKAMIAQQLIPTPDGNSRRAAIEILINSPLISDYIRKGEIHEIKDLMKRSRELGMQTFDQALFDLYKAGQITYKDALKHADSPNDLRLTIKLADEGPDQLSDGKQHLTFDRQ

SEQ ID NO: 5805 - protein, 140 aa, Acinetobacter baumannii
VAPESSLMSLSIGQLSKKADVPIDTIRYYEKVGVLDRIQRSENNYRVYTEQTLADLLFIKHCRELDISLSDIKTLKEMKAQPKRACTEVDNLVNKYLIEVSEKIERLLLLKETLIDLKQHCSTDRTVDECGILKELQNHP

SEQ ID NO: 5806 - protein, 115 aa, Acinetobacter baumannii
KKAELRCWAALVGRISMLLSLDAYKQQQFDQIAAKIMVEPEKYIDFNSVSDFYNAAWLKDFPQGTQASATGLDDGAEEFYAVVQFKQQYLKFDIKENHSTLSFQNMNGETFKCNF

SEQ ID NO: 5807 - protein, 448 aa, Acinetobacter baumannii
WSQEDTVAKCKGIRMMDTVFSSEVDTTVRKSAYRKIAFRLMPFLMLCYFCAYLDRVNVGFAKLQMMSDLQFSEAVYGLGAGIFFIGYFLCEVPSNIVLHKVGARRWIARIMITWGILSGCFAFVQTEWQFYTLRFLLGVAEAGLAPGLLLYLTYWFPSYRRARMTVLWFIAIPISGMIGGPLSGLIMDRMSGVHGWFGWQWMFVIEAIPTVLVGLLVLAVLKDSVQDANWLTQDEKNLVKQELAQDNQHKEGHASVKEFIADKRLWLLAGIYFCVVMGQYAITFWLPTLIRNSGISDNWHIGLLTSLPYMCAIVVMILAGRSGDHFQERRWHLIIPMCAGALALTFATLFASNLTLSLICLCIAASGVLTASSLFWMLPTNFLGGVSAAAGIAAVNSFANLAGFCSPYLIGWVTTNTGSNAIGMFLITAVLIFGASLVLRVPAKLVNR

SEQ ID NO: 5808 - protein, 255 aa, Acinetobacter baumannii
DWQEVRASAQGREKLIFYVEAIGGPDDGELIATELDVYFAMPPQEEWDWWSQKDPVNTILPTINYYHERVPTIPLNSPNVGTRNLSKNLSEESKNKKTWLSLKKLGEEILLATDQETYEQIKNATWFDRELRAFELYNAEKNLCDELMNYHFADWLINACGKYQAREQSKKTNSGTQVRVPQGESNTLSSKQIYSFAQKLSVHPEFASKYAEGNESYEQLAARVAVKLADPEQQQKLMPYLIQVGFQQKGKGEAA

SEQ ID NO: 5809 - protein, 101 aa, Acinetobacter baumannii
GLEDHSDDAIQIIVGSVKMTDINDYEDAEDSAVDEDEAKAAESGAADEEAGNLTDADLAEAETLTVTAKQKQRQALEDEVAAFLARGGRITEVPPDEHSDR

SEQ ID NO: 5810 - protein, 296 aa, Acinetobacter baumannii
  UNSURE (251): Identity of amino acid sequences at the above locations are unknown.
NFSLLSKSPKNSPFKGVCMTIIGVDSVAKIVVVTSGKGGVGKTTTSASFATGLALRGHKTVVIDFDVGLRNLDLIMGCERRVVYDFVNVINNEARLQQALIRDKDIENLYILPASQTRDKDALSDEGVARVIDELSQEFDYIICDSPAGIERGAILAMYHADEAIIVTNPEISSVRDSDRIIGMLDSKTKKVEHNEGRIRKHLCITRFNPERADRQEMLTIDDISKDILRVPTLGVIPECPSVLQASNEGXPVILYSETIAGQAYDDLVARFLGEDRPYRHITAQPKGWLARLFGA

SEQ ID NO: 5811 - protein, 107 aa, Acinetobacter baumannii
KYLEKLMEPVSTSGFTALLKLYGIAIMVTLAVGLVAAVVLMTRMPRSPQEWAVGLICTVVSSLAGGSFIIVKWGLHEWVTDVWGMIALRWVFLCLWFTRLGFSPLDF

SEQ ID NO: 5812 - protein, 90 aa, Acinetobacter baumannii
DKMEVQMKTYTVKLYEGVSREKVNETLKYYPDYFGKISIITNVINNKLQLTLKAFEGIDVITANDLMIKIVERLKASQLVEKHNLDLLTV

SEQ ID NO: 5813 - protein, 249 aa, Acinetobacter baumannii
ASSEAFLWLKIIITTGSLRFYQIVKNANVCFSINNNETNLEDNMLVALITLAFIHFCALITPGPDFFLVSQTAVSRSRKEAMLVVAGITVGVMFWASLALMGLNIIFEKMAWLKQGLLIAGGLYLCWLGYQMLRSAFSKNQQEEVTTVELPKAPYLFFMKGLLTNLSNPKAVIYFGSVFSLFLANPQLDQVHWLLFIIVSVETILWFCFVTFIFSLPSFRAAYRNFSKWIDGISGGIFTVFGIFLIGNR

SEQ ID NO: 5814 - protein, 343 aa, Acinetobacter baumannii
PTTDSKEYTMSQLANPPKKKLTTSAMIASIAAEGQPTKPAPFGHALNALAKERDDIVGLSADLSKYTDLHIFAKENPDKFFQMGMAEQLLMSAAAGLAREGFVPFATTYAVFASRRAYDFICMAIAEDNLNVKIVAALPGLTTGYGPSHQATDDIAIFRAMPNLMVIDPCDALEIEQAIPQIAAHNGPVYMRLLRGQVPLVLDKYNYQFKLGKAQVIKPGKDLLIISTGLLTMRALEAAEELEKEGIEVSVLHVPTIKPLDEQTILEEVAKGGRPVLTAENHSVIGGLGEAVGSLLLKNGQHPRFDMIGLPDAFLDAGALPTLHDRYGISTEAVKEKIKSHLK

SEQ ID NO: 5815 - protein, 421 aa, Acinetobacter baumannii
KRSFTGKTNKVPAGRWNSIKDVEMKKTSLIMAFIAPLTLGVSVNAFAKDSLLEWKSDDGTDSLKLGGVVRLNQRYEDWEGPNRGFGKLYFDIFRVDLKGKFDDAYINASYLFQDQQKTSIEKAYVGYNLDANNSIEAGLVYKPFTIYPYPQNGWTYHIPFFLGYGNNIAPGLNWNYHDKDWDVKLGYYPQMLETNLRYSPESATYDDLAGNAFPSQKAYQNEKRHQFNTRIVRKLETDFGKQEFGVSGAIAQLHNKVTDKDGKYYAVGLHTENNYKRFNLQSSVIHYQYDAKNPDGVNSDMTLMGNNGFTPAYFIASEGTIASLNLAYTLPVTNMGKLKAIKFYNDYSYLDKKRDDWSDSQMNTTGMMFIASPFMVWADYTWGKNSNIIGGATNSTGYTSATSPNSDKWLYRINFNIGFTF

SEQ ID NO: 5816 - protein, 77 aa, Acinetobacter baumannii
NLVLKMNICVGGELDGQVIEKEGRLLKASDIDPSFKTEYYKQVFNRDNINYHFWLPIGSNLHEMSKRVLDILRASKT

SEQ ID NO: 5817 - protein, 268 aa, Acinetobacter baumannii
WVSLGAFIMLEKFNQYRQTWTLPLNRHKANNQTQFRFEWVDNLKELQDVQRFRAQQFSKQFGIQFEDNLDQDIYDFGCEHAVLREKWTGEIVAYTRLKLFQGHEIGQSYSANEFDIVPHLSHLPNVLEIGRTCVHPRFRNGKALSTLWLNLAPKVLWSMRAKYLMGCVSIHLQDNLARAYYTHRQIQQLPDIKTIDIRSKKIYEPEYPEFSFPQDERMPKLFQMYLSMQSKLSKDAFFDAEFNCLDYFVFLEVNKIATSFVMNKMAQR

SEQ ID NO: 5818 - protein, 521 aa, Acinetobacter baumannii
AMPLHFYLTEAEMTQQNAQSTSEPTISENDLIAQRHAKLKQIQDVAKETGKSPWPNTFKREHYAADLQEQFKDQSKEQIESAEHVYVKVAGRVMLNRGSFMVIQDMTGRIQLYVDRKGLPKDTLETIKGLDLGDIIAAEGYIGRSGKGDLYVHLEGFELLTKSLRPLPDKFHGLNDTEVKYRKRYLDLIVNEETRKTFEIRAKVVAGIRAFLTNERFMEVETPMMHVIPGGASARPFETHHNALDMPLFLRIAPELYLKRLVVGGFERVFEINRNFRNEGVSTRHNPEFTMIEFYQAYADYKDLMALTENMLEKLALDILGTTDVPYQGEVFSFKGPFKKISMFDAILENNPQFTPENVGDREFLAKFVREELKEEVKPGFGLGKLQTIVFEETVETKLRQPTFITEYPAETSPLARRNDDNPHITDRFEFFIGGRELANGFSELNDPIDQAERFQAQVAEKDAGDDEAMHYDAEFVEALEYGLPPTAGEGIGIDRLVMLFADAPSIRDVILFPHMRRKEG

SEQ ID NO: 5819 - protein, 395 aa, Acinetobacter baumannii
RGKLSFRWFAFFIVQTLIFMHETGKISIDFFKECIMQDIPMSRWLSPLMAFCLSFVIMATLAPTMGIQIDRQIDFWLLWFGTMLLLALPVCYLEIALAKRSKTTALNALSSLTREADSSPKWRVVGWLAVVFIPFLAGNVLSTASNILVAQFAPSISGQIIFAGLAVAALVLSFIPRQILILLMTLGVIASIVLANMMGSTLQPWHWTSVEFKEWGNATVLALVASGLGLGLYWQNSVGAVQAQEGATKTVLPIWLAQLIAVVAFGFFSLQAQLPVLTWIFTGVMTSALFVQLAREQLAQRQLMPVLQWVIIVVAIVVWAVPEVHNLFTLILMLWGLLICLIYAIFAGWIMKISHLRKSMNFSNELFYNLWRIAVRIVLPLSIIVAMIAVIGQSI

SEQ ID NO: 5820 - protein, 300 aa, Acinetobacter baumannii
FRFCMLDSKQCEAFLAVAEVGSFDAAGEHLCITPSAVSLRVQALEKYLGQILIIRGRPCVLTQAGQILLQHLRHTRLMEQNLLQGLMGKSSESEFYKIALASNADSLATWLLPSIQQTLFKEKIVLELKIDDQSHTHTLLETGQVNACITAEEQVMAGCLAQPLGKMRYKMLASAEFVNRWFSGGINREVLRKTPAVIFNHKDLMHSEVLLKGYGLPMQSYPYSFIPATDAFVKAIQLGLGYGMVPELQVQPLLENGTLVDIMPEAQLDVPLYWHHWKRQSKQLDVLTETIVESAKQILR

SEQ ID NO: 5821 - protein, 2504 aa, Acinetobacter baumannii
KCICTFLLVVEFGICLRSFMNKVYKVIWNASIGAWVATSEIAKSKTKTKSKTLNLSAAVLSGVICFAPNAFAGTNTEGGVGQGTSISGATSCREGSANTANQKDIAIGCGAQTQDRTGSNIANRNNPYNNSTGAYAGAMKQGGAISVGTGAVVEKGLGTAIGSYATTQGISGVAIGTGALSSGNTALAVGRQSAATADFSQAIGNVAAATGKGSLAIGHSATAEGYRSIAIGSPDIENADPVAGQAGAAYQPKMATKATGKDSIAFGGGAVATEENALAIGAFSESKGKKSVAIGTGAKAQKDNAVVIGDQAEASFEGGVAIGKGARSEAENSIALGKDSKASQATGESFLTKQSAPTGVLSIGDIGTERRIQNVADGAADSDAATVRQLKAARTHYVSINDNGQQGGNFENDGATGRNAIAVGVNASAAGREAMAIGGSAQAIGSGAIAMGSSSQTVGRGDVAIGRNASTQGAEGVNSNQSVAIGDQTKAIGDQSVAIGADVIAKGNSSVAIGGDDVDKIARDTELSNTYTEITGGTLQAGKYPTTEANHGSTAVGVQAVGTGAFSSAFGMTSKATGDASSAFGVMSNASGKGAAAFGAVAQATGDGASAMGINSLASGTNSTAIGSGNKPGEGAKATGNSSAAIGSGAQATGDNSAAIGKGAEATNENAAAVGGGAKATGKNAAAIGGGAIADQENAVAVGQGAQSLVEGGVALGARSKVEAKNSVALGQDAVATEATGTSFLTNRDASQSNGVISVGSAGKERRITNVEDGSADSDAVTVRQLKNVDSRVNQNTSNIGKNTQNITNLNQKLDDTKTNLGNQITDTNKNLNDAKKDLGIQITDTNTKLNTTKDQLTTQINDTKTELNNTIGNTKTELNTKIDNTKTELENKGLNFAGNSGADVHRKLGDKLNIVGGAAASTPAAKTSGENIITRTTQDGIQIELLKDSKFDSVTTGNTTLNTNGLTIKEGPSITKQGINAGGKQITNVADGINAKDAVNVDQLTKVKENLNGRITDTNNQLNDAKKDLGNQIADTNKNLNNAKKDLGDQITDTNTKLNNTKDQLTTQINDTKTELNNTIGNTKTELNSKIDSTKTELENKGLNFAGNSGNDVHRKLGEKLNIIGGAAASTPAAKTSGENVITRTTQDGIQIELLKDSKFDSVTTGNTTLNTNGLTIKEGPSITKQGINAGSKQITNVADGINAKDAVNVDQLTKVKENLNGRITDTNNQLNDAKKDLGNQIADTNKNLNDAKKDLGIQITDTNTKLNTTKDQLTTQINDTKTELNNTIGNTKTELNSKIDNTKTELENKGLNFAGNSGADVHRKLGDKLNIVGGAAASTPAAKTSGENIITRTTQDGIQIELLKDSKFDSVTTGNTTLNTNGLTIKEGPSITKEGINAGSKQITNVADGINAKDAVNKSQLDNLAAKQNATDDAAVKYDDAKTKDKVTLKGKDGTVLDNVKAGHISSTSKEAVNGSQIHKISNSIKNSIGGNTVVNPDGSLTTNNIGGTGKNNINDAISEVKNTATKAKTTVTEGDNIVVKETVNKDGSTNYEVATKKDLTLNSVTTGDTVLNNNGLTIKDGPSITKDGINASGKQITNVADGINAKDAVNVDQLTKVKENLNGRITDTNNQLNDAKKDLGNQIADTNKNLNDAKKDLGNQITDTNTKLNTTKDQLTTQINDTKTELNNTIGNTKTELNSKIDSTKTELENKGLNFAGNSGNDVHRKLGEKLNIIGGAAASTPVAKTSGENVITRTTQDGIQIELLKDSKFDSVTTGNTTLNTNGLTIKEGPSVTKEGINAGGKKITNVADGVNAKDAVNKSQLDNLAAKQNATDDAAVKYDDAKTKDKVTLKGKDGTVLDNVKAGHISSTSKEAVNGSQIHNISNSIKNSIGGNTVVNPDGSLTTNNIGGTGKNNINDAISEVKNTATKAKTTVTEGDNIVVKETVNKDGSTNYEVSTKKDLTLNSVTTGDTVLNNNGLTIKDGPSITKDGVNAGGKKITDVANGVIAQNSKDAVNGAQVHHISNSIKNSIGGNTVVNPDGSLTTNNIGGTGKNNINDAIKSVDEKVTNGVNDLTQKGLNFGANDQKTTQGKAVHRKLGDTINIVGGADAKTAEDKTSGENIITRTTEDGVKIEMLKDVKFDSVNVGGHVLNQQGLIIKGGPSITVNGINAGGKQITNVADGINAKDAVNKGQLDKQINEVKDQIGKDIGKLSDHAVQYDKDKNGNVDKNSVTLGGGEKGTNLKNVADGKVAEGSKDAVNGGQLWNIQNQVDKNSNDIKNIQNNIDNISNGKAGLVQQQKPNGEITVGKDTGGTSINMASKEGDRVVQGVKDGEIKAGSNQAVNGGQIHKISESIKNSIGGNTTIDPKDGSITTNNIGGTGKNNINDAIGTLNQSNQELGNKITNLGDQLQQVFYDTNKRIDDVEKKANAGIAAAMALENAPFVAGKYTYAVGAAYHGGENAVGVTLRKTSDNGRWSITGGVAAASQGEPSVRVGISGVIN

SEQ ID NO: 5822 - protein, 583 aa, Acinetobacter baumannii
SIPCFDCKNHLIKLKHNSFNNSDDTMKYKALLSSLSIALFSLSLAGCNDNDSQETAVSTPKQPNILFIMADDLGYSDLGAFGGEIHTPNIDSLAQEGRILTDYHTAPTCSPTRSQLISGTDHHLAGIGAMAELTPDHLKGQPGYEGYLNERSLSIAQVLKDNGYRTYISGKWHLGLTPETNAHAKGFDHSFTLLQGLDHHFKQAPSAFKRNSTYTEDGQIIPVSALPDDFFSTNYFTDKLLSYLESGKNSGKPFFAYAAYTAPHWPIQAPAEYREKYRGVYDVGYDAIRNARIARQKQLGIIPVNFEAAEPIATQNAPQKYGKWNELTAEQKALEARKMEIYAGMVENLDANVGRIIQYLKQNNLYDNTLIFFVSDNGAEGFVRGSYGSESGFDNSVANVGTPTSYHYIGPRWAEVSAAPFHLWKDTAGEGATTAPAIVKLPNQKKAEETNHSFASVLDVFPTLLDYAHIPVPQGQYKGRTINTPSGYSWKSVLENKSQTIRPANFSFADELHGSKYAKQGEWKIALQGRPELRTGSWELYNIATDRGENHNVAQLYPAKVQELLAVYQKYTEQNGVQEYNAK

SEQ ID NO: 5823 - protein, 505 aa, Acinetobacter baumannii
KRNCNLRTSLCRRDKMSDVQVHQLYIHGRYVEATSGKTFNSINPANGEIIATLQQASEQDIEAAVKSAQQGQKIWAAMTAMERSRILRRAVDILRERNDELARLETLDTGKAYSETSTVDIVTGADVLEYYAGLATAIQGEQVPLRESSFFYTRREPLGVVAGIGAWNYPIQIALWKSAPALAAGNAMIFKPSETTPLTALKLAEIYTEAGLPDGVFNVVQGAGREIGQWLTEHPVIEKISFTGGVETGKKVMASAAGSTLKEVTMELGGKSPLIICEDADLNRAADIAVMANFFSSGQVCTNGTRVFVPKSRLADFEKAVVERVKRIRVGDPMAEDTNFGPLTSFPHMEKVLSFIESGKQQGAKVLIGGGRATEGELAKGAYVLPTVFSDCTDQMAIVQEEIFGPVMSILSYETEEEVIQRANDTTFGLAAGVVTQDISRAHRIIHQIEAGICWINTWGESPAEMPVGGYKQSGVGRENGLTTLGHYTRIKSIQVELGDYQSIF

SEQ ID NO: 5824 - protein, 278 aa, Acinetobacter baumannii
ETGWEGNALLARQIKEIIEMNKTIQSLVVAAFAGFAVTTYANEQAQPQEIHFPAIEKSYLKQVKRYEYQDIARLDTGLNKDQIRALLGNPQFSEGLFAVKVWNYVLDVRVPNTNQYQRCQLRVDFDKHYLAERLSWRGEACEGLVAWGENNQAPERSTVIADRTASVLFAFDRFDASAIEEGTNSVVKIAEQIKKSPTTTPIIVSGFTDPLGKFSYNQELSSKRANTVAKLLVRQGVEPSRIQIQANSQTDVYKQCSDNNSSQLIQCLAPNRRVNISW

SEQ ID NO: 5825 - protein, 355 aa, Acinetobacter baumannii
RKSCYMGSYILKRLLLMIPTLFIILLINFVVVQIAPGGPVEQAIHEVDRGLGAGRILGTEMYYQGAKGLSPEMVEQIKAQYGFDHPPVERFLLMLKGYLTLDFGQSFFKDKSVVELLWEKMPVSISLGLWSTLLIYLISIPLGIKKAKQQGTWFDRSTSLLLVVGYAVPSFVFGILLIVFFAGGSYFQWFPLQNLVSDNFYQLSWFGKITDYLWHMTLPLITMVLGGFASLTYLTKYSFLEELNKPYVLAAYAKGLNSQQVLYKHVFRNAILVVIAGLPEALAGIFFVGNLFIEIIFHLDGVGLLGFEAIVQRDYPVIFGVLFFFTLFSLLLRLICDVLYQWIDPRIHFDAQGGK

SEQ ID NO: 5826 - protein, 370 aa, Acinetobacter baumannii
RGDCIMANLVFKYSWDHRPFPYNSAQGKRQFMLPFASGIPNLTPDWTQVTGLGTAATRGVGVESGNVAAYGSYGLSNLGYGGSPTSEAGNDIDAGYKAGGQKTRFKNAPTSIYTNPYIAAYAPSIVVTRGEFTGTELFLPYYTSTRANCMAVIAWNYVPSTDTLSKAEQIVYTSKNNIVYTTDNSATSGKLVTVETSGELRSKGFTVDSNGVYKAASPIARLFADSLELNEDASKQPINFEKLGTGDYLIKGSLGFAKEGWYIEMPKDANGNVLVAVSYEQHEDGDIAVKTYKKKFDIETASIIPDFDNPVDIPETRWIDIRLHEEPEPEPEEPLSETPLEFQPTNLSQAVAAALNGVEPPVISDTDATH

SEQ ID NO: 5827 - protein, 74 aa, Acinetobacter baumannii
ESSCTKKIKLKYSSIDFEHCLSLPLADRKIKVDLSLIPHFEDREESILWLTNFIGKICEPRKMQRQKKNFIKYL

SEQ ID NO: 5828 - protein, 159 aa, Acinetobacter baumannii
VSLWKHGLIDQHEKFKKRVASSDISGYKKVFKNELVMGFPIDEGVLGFQKYYDAAAVSPAYKIFRLKREVNVEYLDLILRSNSLRKIYKSKMQGSVERRRSIPDEMFLNIEIPNPPEEVKDQIVKQHKLIKEIENSLKENQKKLRLKTEALWELPQNYN

SEQ ID NO: 5829 - protein, 111 aa, Acinetobacter baumannii
IQIWIDNNGLILNICAVLLVVILHQSPIDIQKGVLITGSLFTQLLKENQKAIIILELEVLLLHGLQEVIVKRLITLVTAHLELIVLGLEVDITALIAQVQKDIFHDKLYKL

SEQ ID NO: 5830 - protein, 115 aa, Acinetobacter baumannii
KSSWQERRSSSYGPLRYLPFCDYSRRRNGCMKTLNRTKKLNFDDQLSLLVFGCHASAPFSVKDVKESVFDFNRGTIYSNLQKFVEWKYFERVGKNHYKATQYAKDILNVKGELKA

SEQ ID NO: 5831 - protein, 123 aa, Acinetobacter baumannii
MMGWKGKKPTSFSLEVSKAAEDHVKHIVMDAVQSLVNLSPVDTGAYRASHMVSVGSGDYGIRGLETNPIQDAAIQAVKIKLGNLVYIQNNQPYAERLENGWSDQAPQGIYSTTFTYITQKYGG

SEQ ID NO: 5832 - protein, 212 aa, Acinetobacter baumannii
NFIFIIILNESGLLSLIKNICILLLSFLLASCLYSPYTKPDAIYVFSAVTKTPEGVVFFNKNKRHQGMIFYKKSLSLLYNLGLFSKLNFNFRGCSEYAEITRCVWSADIVLNHSEAASYGSLLLNDYWEVEDKEGLFYIRTIDAAKRFKRLLNTNQSYIKFFYTAPDGNSENVGRFVSAKNIKNNYIEIIPQKVLIFKKPSRVSRILHVDMR

SEQ ID NO: 5833 - protein, 337 aa, Acinetobacter baumannii
GFIFGIFFMNLERVDLNLLIYLDVLLREKNVTRAAEQLGVTQPAMSNILRRLRNLFNDPLLIRSSEGMTPTERALELQPRIRDALSDLSMILEPRTEFRPYTSNRVFRIMTSDYAEATLVPRLVKALRSEAPNVVLDFLTPSDVSYRDMEQGKVDLAINRFNEIPQSFHQVLVWRDSFSCILNDKHPAVTHLNLKSYLDAQHIWVSKTGMGVGFGVNPDKQGGLGWIDQALERIGQRRKISVFTRHYQMPALLAQNVDLIATLPTRMARLQAQNPKLVIKDPPFYIPEFELKMAWCPLLHHHPAHRWLRQLILFVARQMIEEENREFLTNNSQFSHY

SEQ ID NO: 5834 - protein, 673 aa, Acinetobacter baumannii
SILLLRRYFMITRFASPLLNLTLGLALAGLSGMALANPPKIDASTLTVIGYHEITDTKNALIPQYAVTTQQFTEHVDWLQKNGFHFITVDQLIRAHQGKAALPTKPVLLTVDDGYQSFYQNAYPVIKAKKIPVVLAVVGSWLEPKAGQKVDFSGEEIPRDKILSWGELKEMQDSGFVEIASHSYHLHRGITGNPQGNSEPAATTRFYDVKTKTYENDSQYQARIYNDLKKKNQLLKEHGIRSPRIMVWPYGRYNMQTVQIAKKLGMPITITLDDGADHAKQSLQNMSRILVEGGMSTNDLAQEIKNRELNLTDNNRPQKIMHIDLDYIYDPDPQQQERNLGHLLDRINAMGVNTVYLQAFSDPDANGSADMVYFPNRHIPMRADLFNRVAWQIQTRTPVSRIYAWMPLLAWELPKTDPVSKDLVVTEQAKAGEHLNMGYIRLSPFSPQARQTIREIYQDLAKSASFNGILFHDDVTLSDYEDASPDALKAYAKQGLPTDLAKIRENDQDLQKWTAYKTKYLDDFAMQLVEDVRQYEPFLLTARNLYAQVALKPYAENWYSQSLEESLRRYDFTAIMAMPYMEQVDNADQFYKDMIDRVKKYPNGIKKTVFELQATNWRNNEKVPSTEMAATIHSLYQQGAMHVAYYPDDPIKDHPDVNVMHKAFAEKSSRLVP

SEQ ID NO: 5835 - protein, 346 aa, Acinetobacter baumannii
  UNSURE (50): Identity of amino acid sequences at the above locations are unknown.
VNHRWALLRKKQFLLTLTVVLTVLVNYVVVRLYRFNNGVMLQTLLRKDLXPYKNVVIDTVGAMLECIKTHLLLTANNRQKDGSLKLKAQGLANQTFKQYINTLISLGKDVVFIAHASEDQNGDQIIYRPDLGGKNRNELYRIADVMGYLTTVTTGEGKNARVINFKPSPTHHAKNSGALGGETGEVWVPDLKAHPTFLADLITQAKDHINTLTPAQLAAAKAQEELENWKQSCEEAEHAGDLNQLTESLDKEHMYYQNMRQAMLMRAKALNCTFDKQRGTWISPPEFNGISDQQRDELQNFIAERGLDVKTVCEHLGIDALIQIEAAKLKAVKQEIETLAKTGMTA

SEQ ID NO: 5836 - protein, 292 aa, Acinetobacter baumannii
VFNRNLASLGAIFYCLEIRLYPNQTRGLNMSLPFIVDSLDAIKEEHRALYVEENGKFRLDLEGYEDPKGLKSALQSERDAAKNAKLELQKLQKQFEGIDPEIVKKVFAQIDQDEEAKLIAEGKVNEVIQKRTEKMREEHEKLLKAEKERADKAEAYAQKFKQSVIQSQIVQAAIELEALPEATPDIAFLAQTKFALDENGKAVAVDENGDVVIGKDGQTPMTPKEWVESLREQKPYYWPKPNGMGAPGSNNSKGQPDILKADGSVNMTKLAQLRNENPQLAKELAAKHGIKL

SEQ ID NO: 5837 - protein, 126 aa, Acinetobacter baumannii
RWLLLGSSLLQKSFGHFFMAFHLKPMVMGAIGVIALIANVSVALMLYAFRDGDANMRSVWLCSRNDSIANIAVVLAAVGVFGTGTIFPDLFVAFVIAYLGVSSGYAVIKQSLQERKQSKLMLGSEA

SEQ ID NO: 5838 - protein, 336 aa, Acinetobacter baumannii
FEPLVKLIAQKTVPTHIISGFLGAGKTTLLQHLLSQKPKYEVWAVLMNEFGQIGVDQQLLPQDQGYAVKELLGGCLCCSSQLPMHIALARLLSEQKPDRLFIEPTGLGHPSQLFDQLTEPHWQNSLAMRALVTVVDGSRLHDTNWVKQNLYEDQLKAAQIVVVSHADTMTFEDEQALVELKEEYQPYQQQWLKTEHGQLELAQIDVSARLTARSIQPLLKLQKQMTEAEVAKEIHQLPYHYVESAQGYIVAGWKFPKRWKFEFYALLDVLCAQQDWLRIKGIFNTDQGWKTFNFNPEQFNYKSGEEGIDNRIEMISQHEHDWLAFETELLACRIEE

SEQ ID NO: 5839 - protein, 455 aa, Acinetobacter baumannii
NFARCCKSPHLRLLTMKTPLPDYLANVIEACDIDNSGHLADYIPELANANPNRLALAMSTVDGEIYSVGDDDVEFTIQSISKPFVYAYVLQQLGIDAVLAKVGVEPSGEAFNEISLGKDGRPKNPMINSGAITVHSLIQVKHGLHSAEILRRFMSELAGRELSFDESVYDSEVKTAYRNLSIGYMLRTVGILETDPVDIVNGYIRQCAIMVTVKDLVRMGSVLANGGVDPKTGKRLLNRSVVRQVLSVMMSCGMYDAAGDWLSTVGIPAKSGVAGGILGVLPGQVSIAAFSPRLDEHGHSVRGIDILERLSRDMGLHLMEGTPSAQTIVQSHYRTGKDASLSVYVLRGVLKFTEAEMLLRILQDETTDQGTIVIDLTQISLIHDVGKRMFLEGVDRLIDDGHTLVLVDPEQRLDHARTAKDRELHVYHDFDDLLEKHEIPAKKKTYSDIAALLNC

SEQ ID NO: 5840 - protein, 687 aa, Acinetobacter baumannii
NKQLFFSPYVIKSIRMKQHFPLKDIQQEKRIYRGRIFFAVGLVIICLLVLASRYAYLQIFHYDEFSTASDKNRIRLQPLPPARGYIYDRNGVLLADNYPVFTATLSKADVENVDTVIEQLQPILELTQEDVDRFKSRIKTARKTERVAIKLNLTETNIAKFSEVKYKFPGVRIETQMTRYYPHGDLFAHVIGYVGRINDKELKSIDKDLYAGTNLIGKIGVEKSYEDLLHGTPGYESVEADAHSNILRHLGRKDPTRGNDLYLSLDYGLQVVASQQLAGRRGAIVAIDPRTGEILALVSSPSFNPNLFVTGINHKDYSSLRDNIDQPLYNRAVQGVYPPGSTIKPMEAMGGLHYGIVDWATAISDPGYFHLPGDSHKFRDWKKTGHGIVNMHKAIIMSCDTYFYILANQMGIDQMNQWMRQFGFGQKTGVDLPSESEGLYPNPEWKMRTRKSKWMKGETISVSIGQGAFTATPLQLAMATAITANHGSHVVPHVLRATHGAKPFTVRNAPDGKINFNGTDEDWIKMREAMIDVIQSGTGRGIRTPLYQIAGKTGTAQVKSIAQGKRYNEAALSERQLDHGLFVGFAPADKPEIAIAVIWENGRHGGSAAQLAKPVFDYWLLTRKKNPIRPANHQVNGGLMTAGIKPGELPSGNESASSTPATSAPTSAAASTPQATPTRPATNEVDE

SEQ ID NO: 5841 - protein, 101 aa, Acinetobacter baumannii
RLVSTTIWSVDMAGFWSKLFSSEEKPSSAQTAKDRLKVIVASEQGLGRRLSQDKIDQMKKEIMQVVSRYVSGVGEQHIQMQVRSEANIEMLEMNINLPEER

SEQ ID NO: 5842 - protein, 178 aa, Acinetobacter baumannii
LLFFFTRFFYLSFYNTFTLKSKNVLKLMIRTMQASDIDSVAQIEKLVQTHPWSRQQFVESLNSYQCTVIELNNKVVGFCILQPVLDEANLLLMAIDPQMQGKGLGYQLLDASIERLENHPVQIFLEVRESNKAAIGLYEKTGFHQIDVRRNYYPTQEGGRENAVIMVKSCTDDFASLF

SEQ ID NO: 5843 - protein, 273 aa, Acinetobacter baumannii
QKHSMTQYQPPHINRKLNVQAWWLTALLISINVGLFIWQIISGVDISDPAIKDALHWGADFTPLTFSGQPERLFTSMFFHFGIIHLMLNMWALYIFGNVAEALFGRLYFIGLYLLAGLFGSLLSSYINIQNGHELLQHFDQSLLPHVSAGASGAVMGLGAALTVLSLFSPLPHQAYILDKKSLLMIMAINLIFGFVATGINNAAHVGGMIMGALLALIWYLSYRTPLKNFLKFLGLLGGLLMTVGFYVYCNQLNSPLLPLWHEILIQNPEILP

SEQ ID NO: 5844 - protein, 479 aa, Acinetobacter baumannii
SLNRRYAMNVRHSFPKNIFRAYDIRGKLSYLTTDVVRSIAYGLAQQYKQAEQTQLIIGYDARLTSPAYAHLIEEILVQHGLNVTNIGCCSTPMMYYIAREFGGNGIMVTASHNPKSDNGIKWILRGEPPSPEMIQQVGEFAQTYVPTHTISLLELSTPQFNSEFCKKYQQAIFNDIQLKRPLKVVLDGLHGSAGHCSKLVLEKMGCEVIALRTTPNGEFPDHAPDPSHAAHLKELRKTIIEQGADIGIALDGDGDRVVLLDEKANILTADRLLSLFAQMCLEQQPDKEIVFDVKCSLMVQRTVERLGGKPKMIRTGSSFLRAYLSQSNGNAIFGGEYAGHYVFNDGRGFGYDDGLYAALRVMEYFTESNATTISDLFSNYPERCCTEDTYIGTHQSDPKHVLQDIEILSHRLGARISKIDGVRLDFNDGFGIIRASNTGEYFTVRFDADNPLRLKEIQQKFIDMLQERYPQIAQELSEA

SEQ ID NO: 5845 - protein, 543 aa, Acinetobacter baumannii
FMNSNELYQLWDEFLESWPVQRVEAMTLEEYTKAGDPDSFMNWVEFRTKPLATISGTSSFIFGIYSRKDQTAKSNTKNNIYEDQYAWRVAYGRTKESAFQHVKTQILAVIKAIQNNDLHKIEEIDLIKTVKWKIAFLYQDRNNLKIIPTFAEQRLRYLTGVGLKDKDFTIEKAYQQLISEKGDQDLFDFNSALTQKYLEANPKDKFNTQIAYDYMHERYPEFEKNTEYLFVIENKYNYELALETTNFDKSSPRLFLKCIPPKYIKGLQVNSILKGKSPNSNLESTKTLTRDDEFVQVIVTNMQQLEALCNWWDELNESNQDSSEASKLEVSQMEEIAQPLNRILFGAAGTGKTFNTINHALSIIEDKSLEELEKEERKDLKNRFDEYKNKGQIKFVTFHQSFSYEDFVEGIRAETVEYSDGKKNIEYPVVSGVFKLLCDTAQSKVILESQKINFDSNTNEIWKMSLGRAGEDEDIFDYCIKNHCVLLGWGDELDFSNAVNRKQIEEIMDKNGYEAYRKEYPSASRFVNDFKNKTKVGDLIIIY

SEQ ID NO: 5846 - protein, 314 aa, Acinetobacter baumannii
LRSSQMITGIEILKFGVEDRAASNKFLADFGLSKSASDIEGTDLYQTQNGSKIYLFNCDDDRLPAAIEQGSTLREVTWGVESTQDLDDLAARLADVDGFKRSENTVQCLDPNGMTIRFEQSFVKEVPELKTEGINQYGNIQRVNAASPVYEKGQPVAIGHVVFFTPDLATTENFYIEKVGFHLSDAYKNRGAFLRCRGEGYHHDLFLLSVPNKPAGLNHVAFVVRDIHEVIGGGLHMNRSEWSTFIGPGRHPISSAYFWYVNSPLGGAFEYYTNDDYLTEEWQPRVEEHRLELFTEWAIEGGLDDKTRRQVKPV

SEQ ID NO: 5847 - protein, 498 aa, Acinetobacter baumannii
KQYRFKKDLIMAKEIYIAGEWRLGRGAVIQSLFPADQSVNAELSTATLEDVNEAIEKADQAWRQPSWRNSLPHERARILYKVADIIEARVDELSKLQTRDNGKPLTETRGLVMSAAATARYVAAACETLNDELTTQRAPDFMTMSVHEPVGVVAAITPWNSPIASEVQKLAPALAAGNAVVLKPAEATSLIALELAKIFEEAGLPKGLLSVLVGRGSVIGDAIAQHPLVRKISFTGGTTTGRHLAHIAADKLITTSLELGGKSPTIVLPDADVELAAKGVAYGIFSSAGQACIAGSRLFIHSSLYDQFLTRLVEITKGLRVGHPEQTGVHLGPLVNDKHLQSVDRYVQLAKSEGGQVLIGGEALTTGDYAKGSYYLPTIITGLNNSAQTCQEEIFGPVLVVMKYDNEQDLIAQANDSCFGLAAGIWTESYRKAWRIARALEVGTVWINTYKKFSISAPFGGFKDSGIGREKGRLGILSYMQQKSIYMGLNEQPNPWCD

SEQ ID NO: 5848 - protein, 99 aa, Acinetobacter baumannii
ISRLSMSMLSIMICQWLLIFLMTVFLRWIICFWRSAIRRYQPKAKVSDQIRYCQGLKSLIWSKRQTIKQLLLNATQNNAVDVTKYLIWIDRKLPLRCCA

SEQ ID NO: 5849 - protein, 269 aa, Acinetobacter baumannii
ERLRIMSFQVEGKVAVVTGGSSGIGLAAVEILVAEGAKVAWCGRDEERLNASKHYILEKFPHANIFTKACNVLKKEEVQQFAKEVKLNLGNVDMLINNAGQGRVSNFENTQDEDWMKEIELKYFSVLHPVRAFLDDLKQSANASITNVNSLLALQPEPHMIATSSARAALLNLTHSLAHEFTQYGVRVNSILLGMVESAQWKRRYETRSDLNLSWEEWTGNIAKNRGIPMQRLGRPEEPARALVFLASPLASYTTGSAIDVSGGFNKHL

SEQ ID NO: 5850 - protein, 309 aa, Acinetobacter baumannii
GLIRRGAMPQDQHLGVDKAKILIEALPYIQRFSGKTLVVKYGGNAMTDPELESSFARDIVLLKTVGLNPIVVHGGGPQVDSFLKQLGRESDRIDGMRVTDEATMEVVEMVLGGSVNKSIVNLINKHGGRAIGLTGQDGNLLRARKLLMEKQEEDGSIKHIDLGMVGEVTGVKTDVLEMFTQSDFIPVIAPLGVDEKGNTYNINADLVAGKVAEALGAEKLILLTNISGVLDENKNLLTGLTTQEVDRLIETGVIYGGMIPKVGCALDAVKGGVVSAHIVDGRVPHATLLEIFTDHGVGTLISNRTQTTH

SEQ ID NO: 5851 - protein, 152 aa, Acinetobacter baumannii
RRIRKSNMETLIYEVEINAPIEKVWDVLWNSETYNAWTKFFAPDSSMRTDWKVGGKTYFLDGEGNGMVSTIEEMKKPEVLIFKHLGMIKDGKEDLESEEVKGWSGSLEKYFLSQNGDTTTVKVELATLPEYIGMLKSGFVQGFEAVKQMAEK

SEQ ID NO: 5852 - protein, 84 aa, Acinetobacter baumannii
  UNSURE (82): Identity of amino acid sequences at the above locations are unknown.
MRIRIMALPIITADQTLLVQAIIVYLYADPGLGKSSMGFTAEKAISFDFDRGAHRTGELRRGAVVQIQQWSDVANLTPQGLXTI

SEQ ID NO: 5853 - protein, 80 aa, Acinetobacter baumannii
GVGLMSESRHLVLKRHPTLKGYLVICDEETGQPLAGQRAVQMNSDALNGPATITVTFEAYGAHGVRLVSDAPRPNQTKEM

SEQ ID NO: 5854 - protein, 164 aa, Acinetobacter baumannii
EIQRMSVVLPVAKRGEDILKLIAAPVSANELNSNWLYQLADAMHATMLERNGVGIAAPQVYISKRVIIVASRPNPRYPDAPEMNAVVMVNPEILEFSSETCLGEEGCLSVPDERGQVERAEMVKVKYLTLQGEAVETIFHGFPARIVQHEVDHLNGILFVERIS

SEQ ID NO: 5855 - protein, 180 aa, Acinetobacter baumannii
NIKRMNFDSSFCFFKTSVEIFRLAMTPLTSSPRLLSLCFKLVLVLLLAYLLLSGFYMWMIGGTAIYVSSAVLFVITAYSFKLGKYQKPCSVLNVLMSALALYFSTAHLFFSPIQFFIFLPALFFVVLAFTQVSKVRSLSKVLILISLLIWSGVHFTQLEQLKAYYQTQHTGESWQQYGAL

SEQ ID NO: 5856 - protein, 62 aa, Acinetobacter baumannii
MLRRCRCMSLPLNPKVQGGGDAYLLGFLLGVGIRSKYAEHHPKEMISAQGNQTGWRTSQRQL

SEQ ID NO: 5857 - protein, 108 aa, Acinetobacter baumannii
NKMRTQGMSWISVCQQGDVSEDEPKAIEVEGKKIGVFFVDENYFAIENVCPHAYALLTEGFIEDQTVECPLHEAIFDIQTGELKSGPGCRNLCTYPVRVEGQDIQIQL

SEQ ID NO: 5858 - protein, 89 aa, Acinetobacter baumannii
IKMSAPQYKPMRESEVCNAIGWVLIALGFIAGFLFILAFGRIEVASYYGKETVWSGVMIATGIGIIFNGFLAGYLFQKVASILRYHENK

SEQ ID NO: 5859 - protein, 191 aa, Acinetobacter baumannii
LKSSILSAKFLDILTMALKATIYKADLNIANMDDHIYGDYQLTLALHPSETLERLMVRVMAFARFASDSLEFTKDLFETDEPALWQKDLTGQLETWIEVGLPSEDKVKKASARCKTVAIVAYGSQVEDWWKRNSKIKTLSNVQVWQLASESTAELEQLCERTMQLQLNVMDNEWTLLSDKGQANVVWTQLQ

SEQ ID NO: 5860 - protein, 413 aa, Acinetobacter baumannii
KYWSFSGMTSSIQLKDGIANTVANDQSQGMIIKIVGAVAVAHLLNDLIQAVLPAIYPMLKANFSLSFAEVGLISFVYQITGSLLQPWIGLYTDKHPKPYLLPLGMVVTFCGIILLAFSPSFAVLLCASALIGVGSATFHPEASRVARMASGGRFGTAQSTFQVGGNTGTAIGPLLAALLIVPFGQHAVAGLVIFALLAIWVLFGVSRWTVNHAKNQVAARATQAHTKLHGRKLIIALGTISVLMFAKFTYIASISNYFTFYLIQKFHISIQTAQLHLFAFLAAVAVGTFAGGPIGDKIGRKAVIWVSFVGMAPFALMMPYANLFWTTVFSIIAGLVLSSAFAAMVVYAQEAVPGRVGMIAGLMFGLMFGVSGIAAAGLGHLADINGIEWVFGLCSLLPLLGFATALLPNTKVK

SEQ ID NO: 5861 - protein, 342 aa, Acinetobacter baumannii
RTRRQIMSFIVRSRLQKFRQHKLGWSSFVLFSLILMMSLAAELIANDKPLLVKYEDAYYLPVFKTYPETTFGGVFETEADYKDPAVQELINHKGWAIWPLIRFSYQTPNLDLAVPVPSPPSKQNWLGTDDQGRDVLARILYGLRVSLLFGLALTACAALLGIFVGAIQGYYGGWVDLLGQRLVEVWNGLPMLFMVMILVSMFTPNVYWLFFIMLFFSWTVLVGIVRAEFLKARQLDYVRAAQALGVTDRAIIFKHILPNAISSSLSQLPFILTTNIIALTALDFLGYGLPPDAASLGELLLQGKNNLDAPWLALSGFFSLAFVLSLLIYIGEAARDAFDPRK

SEQ ID NO: 5862 - protein, 159 aa, Acinetobacter baumannii
KTVGPIKHRRAFIARRLLTLLKSTVAKMAMTLEQTRQAIIDRMQAFTGITQDRIQYPNLPGFNVPKDGVWCRLTIAGGPSFTSGIADKPCTRRTGNIMIQCFDRLHVGEKALTVLGDALLAHFEYFTIEHLECLNGQSIYAGKDADFIQYNVSIGFKVN

SEQ ID NO: 5863 - protein, 66 aa, Acinetobacter baumannii
IASGLVYGEYKHDANKKLNNKMHIFLIKLNRPLSFNIIIKIKFYTIKISFNNRIYIKQSYTLHSTL

SEQ ID NO: 5864 - protein, 106 aa, Acinetobacter baumannii
LFTGGTFLMSKQTTPEFLFEPKLLPMQLFEKFIVFNVNAGYRGKGTPHGVNLIKGNKPTLSLTDKGVMNKAAQERYKLMLLKYFKEGRSAMDELDHEVKRIYQMVA

SEQ ID NO: 5865 - protein, 114 aa, Acinetobacter baumannii
QVGGGLMMSNFKKHPDGYKSFLGRDDKGLYSVRIGWQVYASNANGSVLYKVKDGFKTPLNVFRFQTDYPKVWNELTQEIDFQRRKQLAIKLRETNIPTYDRKAYKTKRGFTGSR

SEQ ID NO: 5866 - protein, 239 aa, Acinetobacter baumannii
ESGGVLKRIAVTALCVASLSGCASFISGGTGTAPVGTDSGVRSLGQVFIDSSIKRTANINLYKLDQRFKQSRINIESFHSTVLLTGQVPDPYLKQLAEDNVKAMSDVKAVHNYITVGNKVSYNTIMQDAGVTANTRALLMKAPVVSDSKVLVHTEDGVLYVMGRLNTAEINDLNNVLQNVGNVTKIVTLIDNIDLAPAPAASTASATTTPVINNVLAQPTVQTPVAIDPDQTDPASSAQ

SEQ ID NO: 5867 - protein, 428 aa, Acinetobacter baumannii
CHSGCEATGSKLCNGVKSMSEVLDVVIVGGGLVGGLTALLLAQGGVQPTVLDAAPVLDVEKTLSVMNPRVLALSQATIHLLKTVNVWDDLARQMPYTGMQVWNLNGYGEINFGHESVQRPMPEQALGSMVEPSVLNVAIQQKMIEQLTDYRTQVRVTRIEQGVGCWHIQLADGTTLKTKLLIGADGANSFVREQAFIDLDVLDYKQAAISCAIKTSKPHHYVARQIFLPTGPLAYLPMASLEESENGYWQSIVWTLPDDYADEYSALSDAEFMQLLTRESQHMLGEVLDVRSRAQFPLKARAAKQYVKDGLALIGDAAHVIHPLAGQGVNIGCLDAAVLCDALLHDLGRGVWAHEQTLMRYEHRRKGQNDAMMHSMSAIGWLESSELFPLIWARNVGLKQVEQISFLKERFMQQANGLGALQNTQYSR

SEQ ID NO: 5868 - protein, 305 aa, Acinetobacter baumannii
MSSGAKIRLYACEEAVLGTTPANPIWYTVRRVSDGLSENVSTEESSEVVDSRFRQGGVVTEAEVTGQLEFELSLGTFDLFLSALAFNNWAANALSFGGTVRKSLTLVKVFEDIGQVFIYRGVQVNTGEITIQTTGKITGNFGLVGSSFTRQQVNPVTNPIAATTRPLVSMPNVENLLVNGQTIQGKACLQSLTLSINNNLEAIRCIGSGKYTPEFYIEKMMDIEANASFMFSATAAGWIDAIKTRDVFTLTFDIKDSKGSKYSFNFPQLEVMEANHPDDGGDDIITLDINFAQVRTAPTIVRALV

SEQ ID NO: 5869 - protein, 108 aa, Acinetobacter baumannii
TLQGGGMKPEQFIREFGPNTFRISMSFVNTAKYLVVHEGEIDFTDEIKPHHGERVFERDVVNRLIESLDLVKKLGGLQGAKAYVPDGYKSDRLKQAIKDHESIYGGGE

SEQ ID NO: 5870 - protein, 177 aa, Acinetobacter baumannii
LDKGGGMAALKEQVKIFIVQALACMDTPQQVANAVKQEFNIEIDRKQVQLYDPTKAAGKNLSKKYKDLFHKTREDFKKNVYDIPLANKAYRLKELQKIYEDWKNNRLMKQGVIKQVREEMQGYDLMLLNLELKQLEIEKLREGEGDEDPTPVKVTIQVVDASKKDAEHQSDTECTSG

SEQ ID NO: 5871 - protein, 126 aa, Acinetobacter baumannii
WFEGGYMKSHDHLLDKQYDDEHYNCVHFVHEAAMDLYGIDRAEALELFMQPKGKITFLSSRLKLLNPLPMPKEGCIVAFHPRQRNKPPHVGLFRGQKILHLMESGVTYLPEEVVMGMGFNRVSYYD

SEQ ID NO: 5872 - protein, 246 aa, Acinetobacter baumannii
RLEGRLMADIRITGRMVNFSRITFDTNDHDVIRQQLSNILNEGSYQGTVVIIDSTVEQELIALIQLLVSMGLQPMAVIDGILGDEARAIQFPVLPADQPLQRIKPTAEQVAIVEKSTSAQASVETKKPLNNNAVAHITSYHDEILRTGQSLVQDQGDIILKAGMNSGSEVIASGNIHIYGTVRGRVIAGAGGHAAARIFCQSLEAELVSIAGTYCVADDIPKHVVKKPVHIYLNEKQELEFEALEL

SEQ ID NO: 5873 - protein, 555 aa, Acinetobacter baumannii
EYRGFYYPLTVCMNSNLPPVSDSKLAANLQAKSTNVHVPTPKFFMPVFLTIIIATLIYIGFQVSADLAHVPPLSLYSVILLSTALLIALGFEFVNGFHDTANAVATVIYTNALPAPVAVMWAGFCNFLGVMVASGAVAYGIIALLPVELIMNMGSGAGFAMVFALLIAAILWNLGTWFLGIPASSSHTLIGSILGVGIMNHLLSASTGVTTSGVDMDQVIKVGKALLFSPLIGFAFAAIVFLLVKTIFKRQLELFQPPEGNKPPPAIIRAILIFTCTGVSFAHGSNDGQKGMGLIMLILVGLVPLAYSLNKNLDTQQVQSFHQLSSQTAVLLNQNQPELTDEKARAVLTKYIQTKQQTPEVVPALASMTDHLGERVSSYSNLKDIPEAAISEIRNDMYLSTTTFKRLDKAEALPKMDDSQKKLVKDYRSSLDSFLQYIPNWVKVAVALALGLGTMVGWKRIVVTVGERIGKHHMTYGQGMSAELVAMSTIAAADGLGMPVSTTHVLNSAVAGTMVANKSGLNFNTVKTILSAWVFTLPATICLSGGLYWLFLQFV

SEQ ID NO: 5874 - protein, 173 aa, Acinetobacter baumannii
GLGGLMDNEYAKFFFNRKVDVYQLECIELSHPSFMNTYRIVRNDDRGVYVQHKEGSGQVYYEFLPASIQRSGMLGDLDQTLTVSISGLGDVMPDEFERVIEGQYPDVKPTVNYRIYSSDNLNSPMFYLLGLQLSSVAMNHKAVTFKAESPRLNTTKTGDIFALDRFSGLKGAI

SEQ ID NO: 5875 - protein, 537 aa, Acinetobacter baumannii
FILGRRHVMHLTQENNLNVDARLLNIENLSISTQDQILLEGLNLHLQARDTLAIVGESGSGKTISCLAMMGLLPEKLKTSGRIIIDSKNILEIDEKTQTHIRGRQIAMIFQEPSTALNPLHRVEKIVGENFILQGGSKAKAQQQVIQLLKDVGIANPEYILKRYPHELSGGQKQRVMIAAALALQPKILIADEPTTALDVILQTQILELLKSLQSKYGMALILISHDLNVVRRYADELIVLHKGQVVEQGQLQQIFKNPASIYTQQLLDHDLGFAEQRSTSHKILSVQQLNVKYPIRRGFFNRIQGYTNAVENVNFELAQGEALGIVGESGSGKSSLALALVRLIKSEGQINFLGQDINHLEQKALRKIRSDLQIVFQDPFGSLNPRMTVGQIIAEGLKVKAIADKEIKQQVESALIKVELAEGFQHRYPHELSGGQRQRVALARALVVRPKLLILDEPTSALDRSTQKAMIQLLRRLQQTEHLSYIFISHNLNVVKALCHKVMVLRHAKVMEYQPTEQLFNAPKTEYTKQLIAASC

SEQ ID NO: 5876 - protein, 1151 aa, Acinetobacter baumannii
WEWGLIGSVIMIKVIYKKDALSEEKTIEQAQTIGQWLTSKYEHMPEHVRIFHTTSNMDHAEISFANEVTPKNAYDLKQLDFLPGTFIVVENPKWVAAIVSIVISIAIAFLMPTPSIAQTTQNTNQSSSANNELSNRENKIRVNGRIADNYGAGWNTPDLIAVPYKVYENNVEVEHVVGCIGRGHYKINGAYDGETNIVDIAGASVEVFRPGVDIVSGEPYFSLGTEITTPPLTVQHQTSVNGQVLRPADTQSLEGTNYLHFAYPNEILRATANNTDLTTKFVSNDRVEITNASFTFNGQTFDLNGTYSVLSVADDRMTLSNPAAVNANWLKLKELNNQQTAALSPKISSIGEKWIGPFILDNVERSRVLCNFVATNGLYTVSSGGNQAAVNVTIEVEVTPVNESGAAIGNPMLKQIILKGSAKSRQTVGATLDMVTFQGRCSVRARRLTPTPTVTTVVDEVKWQALYGAYPLQSTVYEHETVFRARTYATTGALSVKSRKINFDLQRMLPTYKNGAMTTELYPTSSFADALVSMALDDKIGRRSIDEIDLENIYRTYNDVVDYFGTPLAAEFCTTIDDTNLSFEELVTNLCDAVFCTAYRQNNKLKLYFERPTDNSVMLFNFRNIIPDSYKHDLTFGVMDDYDGLIYEYTDPTDDSRINIYLPDKGAKNPKEVKSVGVRNKWQAHFNAYRIWNKMRFQRKSITFDAAPESELLVLRDRIAVADYRNGIHQSGEVVQQEGLILTLSHDVDFIAGKSYVIYLQMGDGTVDLIPVTPGSAKNKVVLGRLPNGALKLSPDDFVNTIYTVVNDDTKGSLPYLVAKREPADQFSNTITAINYDERYYLNDKDFIDVPVDDSPIYIRYDQLDINLVRLYQMQRGDLPTTGEISFVVEAGALVSSSSSYRPETRFVYKFDYNSSPPKREYIVPAASELPAIDTGEFPPDLVVNLTIKGAVVGRGGDGGLPHLAFGAWSTDPDYNFTKTRRDGFQGAPGLLNRHSKLNLIIDGGTLARGGSGGGATPSGIYTELTYGVQGIPGGAGAPFGRVMTGQPISNDSQDWRWYLNGDFMVVKVTDAEAAVPGKGYRTQNDRYGSPLSGDGGNWGERGTKSTNDETWNWQYHGTTEGQPGLGGPAIVGVAPLTTKLMNGGKILQTL

SEQ ID NO: 5877 - protein, 121 aa, Acinetobacter baumannii
NLIFNLSAFGCFFCEKKMIKEVTEQELAEKSVAPRVTKAQIDSLMERVTYTVEQRPGGTTSTFVHAFLDGKFFLATGFSACVNAENFDAEIGERMARGNAEKSAENKLWELEGYRLFATNI

SEQ ID NO: 5878 - protein, 461 aa, Acinetobacter baumannii
LKIFMKGYKMKTVQLDQLKQQFPLIQTLQDYQETFWFNPHHYPLNEALAKVSLTEQDVKEAEARLARFAPYLAKVFPETQDQHGKIESALVEIAEMQQALSLQKHKTLTGKLWLKKDSHLPISGSIKARGGIYEVLAHAEKLAIEAGLLKLEDDYSKLDQDSFRTFFSKYQIAVGSTGNLGLSIGIMSAKLGFRVSVHMSADARQWKKDKLRSLGVNVVEYASDYGVAVEEGRKAAEQDPFCFFIDDENSTTLFLGYAVAGLRLKQQFEQKQIKVDADHPLFVYLPCGVGGGPGGVSFGLKLAFGEHVHCIFAEPTHSPCMLLGVYTGLHDQISVNDIGLDNITAADGLAVGRASGFVGRAMQQLIDGYYTIHDECLYELIALLNQTENIQVEPSAAAGMMGPYYVQTTPDYLALHQLSAEKLQHATHVVWATGGGMVPPDEMQKYLMYSQNNYLHKKAQF

SEQ ID NO: 5879 - protein, 151 aa, Acinetobacter baumannii
AIFMNHPNSILKFSLDLNSLSFDVDSQHIHLEQGLGFINSKSISNGVIDELAIEKMIYFIEEIIESQPLRNLNINGVAVTADTAMTQLSELFFSAKKQISRIELEHGFNDFIERLSYYINQVASDQVYVFTYFVFVREMMHHLRVEQIQII

SEQ ID NO: 5880 - protein, 208 aa, Acinetobacter baumannii
IFLMLHLPFNHTITLIIITVILSLLAFSNQNVMNRLIFWPPAMQRGQFDRFITHGFIHADGTHLLFNMITLFFFGSIIESFYRQYFYDMGFVLFYLGGLIFAILPSYLQHKNDANWASLGASGAVSAVLFAYILFQPWKLIFVFFIPVPAIIFAVLYVAYSIWAGKRGNSHINHSAHLWGAAYGVIITILIEPRVIPHFLDQLTRLPF

SEQ ID NO: 5881 - protein, 119 aa, Acinetobacter baumannii
ESLMSNFVFKRGDTFNLNLQLVDMDDALQYPANDVRRAIDLTGYTFTSQVKTLDGTAVATLTCAALSQSTQKGWLNIKSGTSTATWPLGLCQMDIKAVVGGVTQHTETLTFQVIDGVTA

SEQ ID NO: 5882 - protein, 316 aa, Acinetobacter baumannii
RRIIINIKKINKDISEFLIRLKESDMNAKVNISNRAGASFPVRRMDFEFAQVPRYWANYDAGLTHFMTALSALFPEGEQFFVNSTRAVRNDPKLADPALQKEISAFIGQEAMHSKEHLAFNASAQAYGYDVRKMEKQTGKVIKVGTAVVTKLMKPFGYTKEMIDLTGTCALEHFTSTIAAELLQNPEIQAMFQDDTMYHLWMWHAVEENEHKAVAFDVYTNMYGQGPKAYFMRSTALIIAMALIFATQSYFTAKLLKTDDKLTWKDTKYMLKFMYGRKGFMTRQIPELLDFLRPKFHPNDSDTTALLATWREKLGL

SEQ ID NO: 5883 - protein, 135 aa, Acinetobacter baumannii
RKVMYKLKLNPQTSGYGVTPGDDVKRQQMDGGRGRYYIDVKRNSHIVDVNWNLSKTDFNKMMAFWRVYQNKPASFYADLVIDQGARQQYLCNFIPNSFKTNEVNGNLYRVNAQLEVVQNQPNLTADIALIKDWEV

SEQ ID NO: 5884 - protein, 71 aa, Acinetobacter baumannii
VLPIDGHIFLISLDKLKNYVRLKIKPFKKRNLYLFKYEYLIFLIQSLLLVLKYYANMKLEIFPNRYFLFQV

SEQ ID NO: 5885 - protein, 192 aa, Acinetobacter baumannii
GVTMNFIKKWNVGLLSMLPALAMAHPGHDHVHSGFMAGFIHPFTGLDHLIMALGFGVLLWSAAKQWKIAGVSTLSITLVIGFLVGAQGSVPANIAEYGIVASLIITAIALWTKSNRILPIAAALLASFHGMAHGVELAHAGHIVALVTGMVTGMALIYCGGLALGAVFTRYVPYGKKIVGACAAVVAVIGLS

SEQ ID NO: 5886 - protein, 199 aa, Acinetobacter baumannii
VNNMQGFIKSLFIRIFLGLMPVTAYADQKCYGDIIVFQKFDDQMIYPYFIHPSREKNKKNETQNKTIVIQKRKLTQEELLAQKKIDDNQLKKIEEKKNIEKKKQLDAAVAKEILENGEKKWMVQVALAPNQNKANMIQSQLQAKGYKVVTSPTTKGIRVMVDPANDYAIAQIIREKIIADDSLDLRSAWVFKWASLTAQ

SEQ ID NO: 5887 - protein, 103 aa, Acinetobacter baumannii
ERDMELNPTEKDKLLIFTAGLVAERRKARGLKLNYPEAVAFISAALLEGARDGMTVSELMHFGTTLLKREDVMDGVPEMIAEVQVEATFPDGSKLVTVHQPIV

SEQ ID NO: 5888 - protein, 108 aa, Acinetobacter baumannii
DRDMKFKILLLSFIATSCYANESTADPDICNIVKKVAYNVMEARQQKVPAQDLQQIADGLADEKAKQLYQDLISSAYAAKVFKTSFFKRQAIEDFQAGWYDECLRRNE

SEQ ID NO: 5889 - protein, 322 aa, Acinetobacter baumannii
LHCIGSTIMSLDLRGLTPAPVTPFTRDGQVDHNAIQRLGSWLGSIDGVKGLVVLGHAGEGTFLSQKEQMQVIESFVKSVDDKIPVIAGITLEGTSVAAEEAKRAVSAGASAGLIYPSHGWLRFGYQKGAPQDRYKAIYEESGLPSILFQYPDATKATYDLETLLDISAQPGVFAMKNGVRNMRRWDVEIPIIRRERPDLQVLTCHDEYLLHTMFDVDGALVGYGNIAPELLIEMIKAGKAKDYAKARAIHDQLLPVTRNVYHRGSHMEGTVALKHALVARGILDHATVRSPLLPLADGAEQEIHDAMRQAGIGKVDLTQAVA

SEQ ID NO: 5890 - protein, 1201 aa, Acinetobacter baumannii
GYVMKILSIRIKNLASLADEHFIDFESAPLAHAGLIAIVGKTGAGKSTILDAMCLALFNRVPRLKDSDGKLKDVDGSELLTNSPLTVLRRGTGHGFAELCFIAQDQKRYLARWEIKRARENPNGKLQSVQRHLKCLTDGVVLADKAKAVDEKVKQITQLSFEQFTRAVLLAQSEVTAFLKARDSERGELLEYLTNSSIFAKIGELAFRKTADIAKQRKQLEEFLGHIEILSDEEIAAFTEQYQQAEQNYQQLEQQKHVLDKQQQWFERKAKLEQEVQAKQQQFQTQQNHHQQLASEREQLKRLEVFSEIRPQVFQQAQNLQTLQQLEPQIQQAQTKFNELVQIFETGQKKYQLAEQQLKQTLDFEQQHQHALNQVRQSIQERAFIADEYKKCKEKRQVLEQNLSPLQQQQNAVQQQIAQLEQNKIHLQQQLIQTQQYAELDKGLSAHLHQLGQFIQNYQTIEEQLGNPTLARQKLSEAKSELEQLTVSLGTVEQIELKLEQQRKDKDQKLAQVTQLDLIQQKIKIYHELYAELQQFTEKHTQASAQEDQLKTVCQLAEQDYQTAKTEREKLQHILQQQRLLHTENIEQLRANLKEGEACLVCGSTHHPYRIDDSAVSKALFDLQQQQEHQAVALEQTKFNVWQTQQHALTQCRAELEQVQKYLAQLQVKQTHLQQELEQAFNLNQLHIELNQAPEQILQTLNELRQATQTAISLFDSENLRLTQAIKQHNQLVQTIQRNESLLNTAQQWQQQVQHIVECLSETEQHAWQQASSQTAKQTWAILDARAKQLELQEQLSQRFEQQQQELKMLSASLEQMTKQIDEIDQNLQEITLKGQQNNEKAVSLIQQMTGRSDIKPHEWLIEHDAKRQHQQTAYHEAKQRFEQTRQHFEQQKQALDQLKHQHQHTEQHQQQIDGQIQNWLKAHTDFQASDLTALIQINSAQEQDIRNRLNHAERLLSEASSALKTMQEQLSEHLQTQPDIEYEKLVTLIQDNIAKLKAQLEVRDGLKLKLELHHQNLAKQQKYAEQIQNIQQEEHRWSKISGLIGDAKGKEFRDYAQQYHLDILVEHANQQLAMLSQRYTLKRLDQSLSLAIIDHDMDGETRSVASLSGGESFLTALALSLAIANMASGSMKIESLFIDEGFGTLDASSLHMVMNALDQLQNQGRQVILISHIQEMHERIPVQIQVKPLGAGASTIEIVG

SEQ ID NO: 5891 - protein, 502 aa, Acinetobacter baumannii
YNVICMEMLQEIKKSLLCNDGTELFAYTIHQIQLFFFQFRFRFMSQTITLYVDGACRGNPGLGGWGAYVITEQGEHKLFGGEPDTTNNRMELTAAIEGISFCPPDAQLIVWTDSNYVKQGITEWIHGWKKKNWKDVKNPDLWQKLDAVCAGRNIEWNWIKGHAGHAGNEMADQLANLGADKTAQELKQPQSATVSQDIKKPEQDWLLDDPFGFDLVETTEDETVTLEQTQEVKMIVVDEEMNVVEAVEQEEQQQNTNIHPQIVMTEAKLKLQGPRQLILDTETTGFYFQDGDRIIEVGAIEMINRKLTGSSIHIYINPEKPVGDSVQVHGITDEFLVDKPKYAEIADTLFEYLKGAEIIAHNATFDMNFLDMEFKRVGLPALSEVCEVTDTLALAKNKHPGQKNSLDALVRRYEIPARDRTFHGALLDAEILSDVYLAMTGGQVSFDMDALSQSESDQQKTTKARVQIELPVIYPSDEELNIHETWVKEFEKKHGEPCLFAK

SEQ ID NO: 5892 - protein, 110 aa, Acinetobacter baumannii
IFPMKIFFVLVPFVFLTGCIFGQSSEVKRAEKLLNNFQCKNIETSEISTSSINSYYQQSLAVSKEKATSYVESYKNGEELFAMPLDEVVEQQYQLYKAACDSLGGVSAQP

SEQ ID NO: 5893 - protein, 61 aa, Acinetobacter baumannii
EHTMTDAQINVQETVPTTSASDDNMQNIAQKNSWFLCADFIDRRYFICNLGIIFKSLGEYG

SEQ ID NO: 5894 - protein, 162 aa, Acinetobacter baumannii
IDNMKIRILTIGQKMPAWVLTGFEDYFKRIQPFVQTQVIELPMAKRGKNDSEADILKYCQIEGESILNALKPNETLIALEVGGRELSTEKLADTMKQWMLEGNDVALAIGGPDGLSDQVRKAAAWHWSLSKLTMPHPLVRILLIEQLYRAMSINHNHPYHRA

SEQ ID NO: 5895 - protein, 90 aa, Acinetobacter baumannii
WHDIHLFFQARAFFAPERGHNAFCDSLWCASFHNKTPVLTGHTKMVLKKSEKFVEFDSFWLIFDNGFFDKQNMHQKQKVAITNLETIFLF

SEQ ID NO: 5896 - protein, 549 aa, Acinetobacter baumannii
GTDMTERVNVGEAIARVLEAHQVDSIYGVISIHNLPIADAVGRREKMRFVAARGEAGAVTMADAHSRFKGLGVALTSTGAGAGNAVGSLIEAMNAGSPVLHLTGQVEREYLDRDASFIHETKDQLTFLRASSKAAFRITSPDNAVGVIREAIRVATTVPMGPVSVELPIDVQAAEIDLPLNLGPVKALELPQAEQAEIDLLVSEIKKAKRPIFWIGGGTLNSVAEVKAIADLGIPVVSSTHARGVLADDHPRSLGAFHNSAGVEQLLKDADLMVVVGSRLRSNETKTYSVEFPENIIQVDANPVAQQRNYKIRNFICGDAKDVLTRVLEQLQGTSKIDADYDAAVVAAKQAAIDALRKQIDQYALICDHLRAALPQDGIFVRDITMSGSTWGSRLFPVQAPNQNIHSLAGAIGLGLATAIGASVANPDKKVIGLVGDGGLMLGIGEIATMVQENTNMVLMIMNDGGYGVMRGIQNNYFGGRQYFNELHTPDYKLLGESMGVKSWKVGSAEEFKTVIQEAVAFEGPTVIELDMNSIGPLNFAGPPQKKLY

SEQ ID NO: 5897 - protein, 285 aa, Acinetobacter baumannii
FSCICIERCLMGALKQAEIIPISKGRDKMTDKFEKGYVMSSRLYRSDVRPFLSDAARNVYAELEDRINGFKDKTTDFVSYSQLQGGKLEGSKKLSTTTVRKGLKELTDLGVVTVVSSDSRKGNEYRINEVSLVEHFKNCNTTLESKALQKVKREHFTNESASTLETKDTIELYKNIYREESTQENPVDEVLNIWKPDLQQLNSWMQRSGLPKINQAQVEELLLEINPHYENKIITGAVTSTQMYSNFVKWVKRDFKLVEKLFKQAEQNNTQAINPENLETEMGDW

SEQ ID NO: 5898 - protein, 741 aa, Acinetobacter baumannii
CKCIKRKKIMWWTKKKVESSNTIGDALKNITGIQSTSFGPNAGAPVIRSLSGNRVGVIENGEFINGMNAFSGHINIPFDPIFIEKVIVNKNTDNIRYGGNAIGGSVQIESGLIPKKIEEKPNKLDIVFRKGFNDFDVKGFNFNINDQKNWSTNIRYSEYEISSYKIPGNSKAKLCEDQIFSNSGGINSALAASCQKDSRVQHIYNKSSQPYIDKFMTENPDWADGDFSFYTDKPTSIWGGKTYINPKNPEYIPNTPQNTIKKINTDVTPNYFKKLGNSYAQNENIGFGTTYFFDKGFIGLSADKKKSEYGVPGFSLQNQSFADSYETLPVGVKIDQNRFVLNSNFIQPISSAEEISLNFQQLSNKSGEYVGTAKANEYKIDNQLIELIMKQSSFKGLDGILGFSLKNRNIEGSGTQRYLPNVSTISKAIFLQEELNIKQFTLNTGYRFERIEHELQDNDFKLARNASNSRIENRKYNLNQYFIGGEYKVNNFINLKVDYGISERAPEVNELYSSNVHYSVMAQEEGDQNLKPEKSKSLELGMFLNWNNWVMQLVGYQMDFENYMYLSHSGVAVQNRLPLKYWKQTDTDVKGFEIDLIYDFNLAHIGNIKLGGLADFVKNKAVNPTDIRLANDGVYLPNMPTNRYGMFLEWRNDSWKGKISSIYYDEPRYLGKNVIQEVPLSGYNLLEFKIDKKLKIKNASFDIFLNGTNLLNEEARPQNSPLKYIAPLPGRAFQLGITMHI

SEQ ID NO: 5899 - protein, 115 aa, Acinetobacter baumannii
RFSILLLFPRTLVFACMCLTLTEAKQKLRAFARDTSKIKLTAHAKERMKERCISMKQIICCFEHGDITEGPYPNTRGDCQLNVSVRTAGEYITTAVAIKQSENGEFSVVVTTFRE

SEQ ID NO: 5900 - protein, 710 aa, Acinetobacter baumannii
FCSILFCRDFGWKEIRLDMNTAITATTPTEYSYNDRYINRELSILDFHLRVLEQAVDPLHPLLERMNFLLIFSRNLDEFFEIRVAGVMEQFALGNESRSPDGLTPRQVLQKISETAHTAIERQYRILNEEILPKLREEDICFLRRGELTPAQSAWVKKYFQEQVAPVLTPISLDPAHPFPRLVNKSLNFIVTLEGKDAFGRQIDLAVVPAPRSLPRVVRLPDELTGGKEHHVMLSAIIHEHVSDLFPGMTATGCYQFRVTRNADLALNEDVEDLAKALKGELSSRRFGRAVRLEVTQNCPQHIYEYLLEEFDLNEEQLYKVDGPVNLARLVSNFKRPHLRYDSHTPVVPKVFKKTESIFSAMQKQDILLHHPFESFAPVIQLLREAARDPQVLAIKQTLYRSGADSEIVQVLAEAARNGKEVTAVIELRARFDEESNIEVANVLQEAGAVVVYGIVGYKTHAKMIMVVRRENNKLVRYVHLGTGNYHAMNARIYTDYGLMTTDKDLCEDVHRIFQELTGMGKMAKLKKLLHAPFTLHAQLINFIDEEIANAKAGRKAQIIVKVNALTEVQLINKLYEASQAGVQVDLIIRSICCLRPGLPNLSENIRVRSIVGRFLEHTRVYYFSNNGDARIYCSSADWMDRNLFNRVEACFPIEDPALKKRIYQQGLLNYLQDNQQAWLLQGDGTWVRAQPAEGEKLHNAQRELLETFK

SEQ ID NO: 5901 - protein, 384 aa, Acinetobacter baumannii
SISMKKLAILGVTVYSFAQLANAATLNVKPYGTTQNGQKVDLYTMSNNNGVSVSFISFGGVITQILTPDAQGKQNNIVLGFDDLKGYEVTDTKEGIHFGGLIGRYANRIGNAKFSLDGKTYNLEKNNGPNSLHSGNPGFDKRVWQVKPLVSKGETVKASLKLTSPNGDQGFPGKLDVEVIYSLSDQNEFKIEYKAKTDQPTVVNLTNHSYFNLSGAGNNPYGVLDHVVQLNADRILVTDQNSLPTGEIASVAGTPFDFRTPKAIVKDIRANNQQLAYGYGYDQTWVINQKSQGKLNLAAIVVDPKSKRTMQVLTTEPSVQMYTANHLLGNIVGANGVLYRQADALALETQHFPDSPNQPAFPSTRLNPNQTYNSVTVFKFGVQK

SEQ ID NO: 5902 - protein, 222 aa, Acinetobacter baumannii
YKGISLRNIVMSTENTNTAVAEEIPNLLITPSAQEYLHELLAKQNTPGIGVRIFVEHPGTPRAECCMAYSAPEEVVPTDYKQDYPDFPAYIDAPSIPYLLDAVIDYNKDRFGGQLTFRAPNSKVPRVGPDASIEERITYVLQAEINPGLAGHGGNCSLVEVQDDPEHGLTAVLKFGGGCQGCSAIDVTLKQGVETTLKEHIPELQRVVDQTDHTQAEGAYFK

SEQ ID NO: 5903 - protein, 60 aa, Acinetobacter baumannii
RQLMCGVNLTIKSKEHYLMQRKGALLTIVLVALGAHHQYNTISTLQLINMEVTQTNNYHF

SEQ ID NO: 5904 - protein, 238 aa, Acinetobacter baumannii
AFIMNAKFQLIKDINYKPKDSQLGVIIKKVTSEQNHTGFVFIEDNKLVLAHFGWHETYFFQRRNDSDGYAMYWFDLEKIPERTLVHIINELEQISHNKDLNNNEVFYFPAPYGIVNFGGSRISGGDFLSTPNTVGDSLTCSVFVNCIFEQSGFPILDLDTWKTTEQDIEWQTSILDKLIGKLSPEFMRIQRENVGKVPRLRPEQMVGACCVFDYELVDFDTADSAAIIVLEQLEALGC

SEQ ID NO: 5905 - protein, 375 aa, Acinetobacter baumannii
TPIILYKSSIMGLQYSSRLTVMEYPPTYPSVIPNIEIVMTYTFNRPAFPATRMRRIRKNDQLRAMVSETQLTTNHLIYPVFVLPGQNQTQDIPSMPNIQRLSADLLLKKAERLLELGVSKLALFPVTPQEDKSLTAEAAWREDGLVQTTCRLLKKELPEMVLITDGALDPYTTHGQDGIIDETGYVLNDETVESLIKQALSHAEAGAEVIAPSDMMDGRIGAIRQALEANGHIYTNIMAYSAKYASSFYGPFRDAVGSASNLKGGNKYNYQMDFANRAEALHEIALDIQEGADMVIVKPGMPYLDVVREVKDTFGIPTFIYQVSGEYAMLAGAIQNGWLSDSVILESLMCCRRAGADGIWTYFAETAAEKLKEMN

SEQ ID NO: 5906 - protein, 98 aa, Acinetobacter baumannii
GDTIMSEQVMVELRLIEQTFRLATTSDKREELERAAELLNEKFNDMRRSAPRVEHNKLVIMVALQLTQEVLSLNKSLQEYAHCERLLQTILEDVEQIV

SEQ ID NO: 5907 - protein, 420 aa, Acinetobacter baumannii
NMTIFAAIWSHALKFVFYYPLFMSYLWMIGAIIFYWKERKAPPYDQPAPLESYPKVAVLITCFNEGDNAEETITHALKLDYPHFEVIAINDGSSDNTGEVLDRLAEQHEKLRVVHLAQNQGKAMGLQAGSLMTDAEFLIGIDGDALLDPHAAKWMVRHFLQNPTVAAVTGNPRIRTRSTLLGRIQVGEFSSIVGMIKRAQRTFGRLFTVSGVITAFRKSAVHQVDYWSPNMLTEDIDITWKLQRAGWDIRFEPNALVWILMPETLNGLWKQRLRWAMGGAQVLIKNIDVFTKPKLNFLWPLMFELCLTLVWSYLMLAMALLWLVHFILPVPALAVVSSPFLPYGSGILLGATCLIQFALSKWMDSRYEPHLGKNYFWMIWYPLVFWLITISATIVAFPKVLRRGDEKRARWVSPDRGIRG

SEQ ID NO: 5908 - protein, 128 aa, Acinetobacter baumannii
GNKMAGCGCASTCSPTKKVSPRFRRALWIALIINALMFVVEIVGGYKAQSVSLWADALDFAGDAANYALSLVVLSMSLYWRATAALVKGITMAAFGFFVIAKVVWSFFHGVSPETDGHGGNWGNRFNC

SEQ ID NO: 5909 - protein, 135 aa, Acinetobacter baumannii
CSKMQKLVLTLFVTSLLAGCSIFGVYKVDIPQGTPLTKAQASQVQVGMNFQQVRFLLGSPTVTDPLNPQRWDYIYNYIPGTYAKKAKIPAAHGQHLKIYFDGTGTVTKIEGLETIPESQPGLPASKEAILTAPPL

SEQ ID NO: 5910 - protein, 358 aa, Acinetobacter baumannii
RKKILGFFALILLIAAILYAIWALFLNHSVSTDNAYVGAETAQITSMVSGQVAQVLVKDTQTVHRGDVLVRIDDRDAKIALAQAEAELAKAKRQYKQTAANSSSLNSQVVVRADEINSAKAQVAQAQADYDKAALELNRRAQLAASGAVSKEELTKAQSAVETAKAGLELAKAGLAQATSSRKAAESTLAANEALIQGVSETSTPDVQVAQAHVEQAQLDLERTVIRAPVDGVITRRNIQVGQRVAPGTSMMMIVPLNDLYVDANFKESQLKKVRPGQPVTLTSDLYGDDVEYHGKVVGFSGGTGSAFALIPAQNATGNWIKVVQRLPVRIALDPKELAEHPLRVGLSMEAKVDLSAK

SEQ ID NO: 5911 - protein, 293 aa, Acinetobacter baumannii
FMKILDGGLGRELARRGAPFRQPEWSALALIEAPETVKEVHLDFINAGAEVITTNNYAVVPFHIGQERFETDGVRLIKVAIEQAKNAVKESGKNVKIAGCLPPLFGSYRADLFQPEQAKNLAEPIINTLAPEVDFWLAETQSCLKEVETVHALLPQDGKDYWVSFTLQDEIKQEQALLRSGENMQQVADFIKQSNAKAVLFNCCQPEVILQAINEIKELIPESVQIGAYANAFPPQDESATANDGLDEIRKDLDAPAYLAFAKQWQQAGASLVGGCCGIGPEHIAELSQFFKE

SEQ ID NO: 5912 - protein, 567 aa, Acinetobacter baumannii
VMKMSRRAYAEMFGPTVGDRIRLADTELFIEVEQDLTTYGEEVKFGGGKVIRDGMGQSQLLADEVADTVITNALIVDWWGIVKADVGLKNGRIWKIGKAGNPDIQPDITIPLGAATEVIAGEGQILTAGGIDTHIHWICPQQVETALMSGTTTMVGGGTGPAAGTSATTVTPGPWHIATMLQAIDDLPMNIGLLGKGNLSLPDPIREQIKAGVIGLKLHEDWGSTPAAIDNCLSVADEYDVQVAIHTDTLNEGGFLEETLAAFKDRTIHTYHTEGAGGGHAPDILKAIGQSNVLPSSTNPTRPYTINTIDEHLDMLMVCHHLDPAIAEDIAFAESRIRRETIAAEDILQDLGAIAMMSSDSQAMGRVGEVILRTWQTAHKMKVQRGPLEGDNEFHDNNRVKRYIAKYTINPAITHGLSHEIGSVEVGKLADLVLWKPAFFGVKPSMIIKGGMIAAAPMGDINASIPTPQPVHYRPMFGAYPRGVHNTCITFLSQVAIDEKVAEKLNLKKLISPCKNTRSITKADMKHNTYCPVMQVHPETYEVRADGELLTCEPADVLPMAQRYFLF

SEQ ID NO: 5913 - protein, 152 aa, Acinetobacter baumannii
CMKMKWASEYNTGIDVIDEQHKRILDYINEIDDVKDDEDRRRIKDVLDNIIDYTQSHFTFEESLQEEADYKYRVPHKRVHDLFIKKIELYRERFEMGHTIEAELQEILAKWLINHIQHDDADYVGAVKENMMGIIREKEKKKGKNWFARFFS

SEQ ID NO: 5914 - protein, 163 aa, Acinetobacter baumannii
IMKILFLHGLDSSRESTKFHAILHPEKFCIDVDYRNLSYASVKDFYHQAIETIKPDLLVGHSLGGYWALKTAAQHKLAVIVANPSLTPNFRNDYPHLCDEDLDHSNPKMAYLELGDEQLDMYQVQEKLSPYMTIETYDGGHHRLAYPSRLNDLITKIHKKYFA

SEQ ID NO: 5915 - protein, 119 aa, Acinetobacter baumannii
WFEISHCSSAHCIKGILMIPGEVITPETDIELNVGRETLKVVVANLGDRPIQIGSHFHFYEANDALQFDREAVKGFRLNIAAGTAIRFEPGQSREVELVALAGKREVYGFAGRVMGKLD

SEQ ID NO: 5916 - protein, 215 aa, Acinetobacter baumannii
FLTLKKQWKYKMPTAQEVLDRLKAGNQRFVNGNTSLAKTLSHHERAEMAKDQNPFAIVLGCSDSRVPAGMVFDQGLGDLFVIRVAGNVVAPSQVGSVEFAAERYDCPVVVVLGHSHCGAIQATIDTLMNPDHPPSSNLMSIVNRVRPSVEILMQTDLKNDLKKLSCHAVRSNVFASVNQLRHGSAVLENLIAKGELIVVGAEYSLETGEVTFFDF

SEQ ID NO: 5917 - protein, 299 aa, Acinetobacter baumannii
EKSMNYELWKIFLDAVELGSLSKVAMLHNTNQPQISRQMNELEAQCGGRLFNRTGRGVELTDLGQHLLPKIRSWLNVTDQLNNEILHSTDTPIGTVRIASLPSTAHPLLSTLYKVLQEKYPLIKLSVREGQGVHLEKWLEDGSVDLAILYRFNPTPKHGDVYLTQADTYLVGCEGDVLTQASEVDFKDVSQLPLVTFCRPSNWRNFLDHMAYENGVELNIVFEADSISLQTHLVSESRMYTMLGPQALKKASQYTSIQAAKIINPALKRYISLSISKHGYLTPACKAVMEEIRSLADLL

SEQ ID NO: 5918 - protein, 232 aa, Acinetobacter baumannii
IQEIRTNMKAFIVRVLLIFIGAILLIQLWIFSSLVWWRTHEVDTTMFMRIDYWSDPSEPIIHEWLDYDDISDNFKHAILAGEDAKFIHHHGFDWDGIRFALERNNEEGEVVAGGSTVSQQLAKNLFLYNKRSFIRKGQETVATWMMERMWSKRRILEVYMNSVEFGKNLYGVEAAAQYYYGKSAKSLTREQAAFLAALLPDPKYYQDHRNDRKLQYRKRVILRYMNSTQIPE

SEQ ID NO: 5919 - protein, 100 aa, Acinetobacter baumannii
NEEIVMALSQPATFNEEWSDERVFAYLNQLPPNGVNADFHVLYHAFKHMRPNDYERLLTKFVADGRDINATNPEGERIHDVIAKFPRQSAPFLEVLAKFA

SEQ ID NO: 5920 - protein, 241 aa, Acinetobacter baumannii
KNRMLLMPETSIQQETQSTWVICRDPVLLTMVGGAIDTIGFIALFGFFTAHVTGNLVLAGAALVKGGAGLWIKLAAIPLFIVTVVITKLLIDRSQTKHKTLSYLFLFEAIFLFAFMAAGLYFEPFKNADSITVAITGGLGLIALAIRNTSSKTLIKNISPSTMMTGNTTQLGIDIANLLKNNNAANRASLLKSASIVIGFVIGALMGAVLYVYFDFWSVAPFILPILYFSYLASQQKFKQA

SEQ ID NO: 5921 - protein, 347 aa, Acinetobacter baumannii
ASRMKSMTRLSASIKASMKKTATALTLACSLLSVMSISQAQAADNIDVSFQTILQQERNWAGLQSKSLKVGDITWSYSEGGSSTKPTLLLIHGLAGSRDNWNRVAHYLTTNYHVIIPDLPGSGETIVSQDFDYSVPNLAEKLRRFVEAANLKGPIHIAGHSLGGSIALLYAGQYPFETKSLFLVDSGGIFRSANTIYLKDPTYLKQLLVSKKGDFNYLLKQTMFNPPFIPKEFLQAQEKLMINQAPQTQKLVDQLIALNKVYTPDSFAVLTKTIDAPTLILWGKQDKIINVEVANELKRLLKNAQPPVILENVGHMPILEAEQLVIQQYVPFLLKVETNQSSKTTTP

SEQ ID NO: 5922 - protein, 451 aa, Acinetobacter baumannii
RQRIDCMLTLLGVGMILCFMYLIMSKRLSPIIALILIPFIFSLIAWGLGHYFESLSHIELKGLSEMMLDGIKKLAPTGVMLLFAILYFALMIDAGLFDPPVKWILKKVKGDPLKITLGTVFLTTLVSLDGDGSTTYMICVAAMLPLYQRLGMNTLIMTALMLLCSGVMNLTPWGGPTARAASALQVDPSHIFVPMILPMVISIGWLFFLAYLYGRYEQKRLGVIELESHHGDNITVSKDPEATRPHLRKVNMVLTILLMIALIKGILPMSVLFMLAFCIAMLINYPDVDMQKKRIAMHADSILAVVGLIFAAGIFTGILSGTGMVEAMSKEFVTMIPTSMGPYLAPITALVSMPLTFFMSNDAFFYGVLPILAEAASHYGISPEAIARASIVGQPVHLLSPLVPSTYLLCGLAKVDFADHQKFTFKWAFITCMVLMGTALVIGVFPLFSTM

SEQ ID NO: 5923 - protein, 310 aa, Acinetobacter baumannii
VLGIKTDHFMDSSENNFNQMPSIKTLQAFEQTARFGNVAKAAEHLNLTPSAVSHQIAKLEEMIGQSLFIRGARGVTLTPSGERYFQDVTTILHNLMLATEKAADKSPKDSLYIHSSPSFGLLWLLPRLESFKEKFPMIQVNLSCSYENLHFTRDKIDIDIRHGLPNWTGVEIRTIRNEKLEVLASPKLLERSPVHKPQDLLKKDLILSRSTLVTWPQWFAHQGLSIPEFPYTLSFDRSYMSLEAATHGLGFVLESNLLTQNYLESGKLVRVFADELSIPISAHHLVYPRTHQFIPKIELFLNWIHDELAG

SEQ ID NO: 5924 - protein, 559 aa, Acinetobacter baumannii
VRYLSRYFGKNTPIARSNKMVLKSDGYSSDHIRLNRFVFWSSAVSIGIFGLLFVLFPEKSQFWLTYVQEQVNHFFGWYYMLVIVLCLGFVAWLAFSKVGQIPLGKDHDKPEFGYLAWTSMLFSAGIGIALLYYGVAEPVDHFLRPPEGEAGTIQAARNAMTYSFLHWGIHGWVLYALLGVTLGYFAFRQDLPLALRSALYPIFGERVHGLVGDFVDGFGILATVISLVTNLGIGALVLVSGICYLIPEIPDNSATLITAVLIMMFVATVTTVVGIEKGLAWLSRINLRLLYALLLFVFLTGPTNHLLNGLVQNTGDYLNNFMGKSFDMYLYNQKASGWLGSWTVFYWAWWIAWAPFVGMFIARISKGRTIREVVLGVCLIPLGFTLAWISIFGNTAIHLILNQKQKVLGDMVLSDPALSLFKLLEYLPFNPYIAGIVVVICFVLFLTPVGSGTLMIANLSSKGGTSDSDSPIWLRIFWSVVITIVSIGLLLAGSFNSMQSAVVLCGLPFSVIILLYMFGLAKALKQDDFDPNVAKKQLAISKDISIPSNCDQNKVTEVL

SEQ ID NO: 5925 - protein, 123 aa, Acinetobacter baumannii
RRHLTKRRSLMRRAQKMDSRWIEAQRREMEKLISPELIKSRDLARQSYFDHMEKEMADHVSRSIEPLSGKKQSTLVELRESIEKLAQKYKQDAHSSSLFGDQDKARVYNRFANELEHFLKGGA

SEQ ID NO: 5926 - protein, 116 aa, Acinetobacter baumannii
KKIVHLKFNISKRAIPMSIEDFFIKDSPSKRYLLMSLALFMLIMALIAYFKGKLGFEYVFSLIAGYALIFFILKNAALPLFPPLTEKSSDANAMARTTIAIVYIFAFIALTISYSL

SEQ ID NO: 5927 - protein, 187 aa, Acinetobacter baumannii
NRVVLTIRLGKMEKIMRKIYPLLAVLTVSSWAHAQDYSFLPEAKLADHKASTWNVGAGFTQKLLHLNGEWVNPYGIAYAKVGAFLNGDKTAGGQVGFRYPYYLTGTDKNGYYIGFYAGHLDSKSVDGDYKSRLGAGVDLAYVLLNSERINTFSVGIGAAEKLTDQNGDVAADTKPQIQFSYSLSFGL

SEQ ID NO: 5928 - protein, 95 aa, Acinetobacter baumannii
WQDLMTDQDVLAYNAEKASPAVGWHVQLKYLGDIAEHSHGTLYLWHHQSSLKFCSSDVLLVECFEFAQHIFAVWQGFDDVIQASALARHALQAVL

SEQ ID NO: 5929 - protein, 89 aa, Acinetobacter baumannii
IFYVQNFILIQFNFFILMNELIYIFEIVIRIINLTFNIKLFKNNNYLKRNKLFIEKISYICRIFCTKINQFSSGGDGKSFFSNTRVTNS

SEQ ID NO: 5930 - protein, 108 aa, Acinetobacter baumannii
SSHVQGSRTMKTFNEKLASWIHATPATEAGINNIQVPGQSELLVWQTRYKEPTLYEQDFVKNLIQAFSAGATELDDVVSALNQQGFRSESGDEWTSESFTEEMQRLGY

SEQ ID NO: 5931 - protein, 430 aa, Acinetobacter baumannii
RICVYFGLISVSMSVHFLHTSDWHLGQFFYNHSRHYEHQQFLSWLLTQIQEKQPHALLIAGDIFDVINPGSQAQKQLYQFLADAHRIAPHMQTLMIAGNHDSGYRIEQVEPLLEKYNAKTVGVVRWNEDKTLDLDRLLLPIYNQNQDIVAWCLALPFLRSAEITGFNEHTTNSKNAIAYLHQQLIAEAKRRKTPDQALILMSHAHMQGGETSDSERPIIIGNEEALSTTLFEDAVDYVALGHLHKPQKVGQPHIRYSGSPIPLSFSEINYKHQVVEVKIDPAQDTDSRLQFEAVEIPRCIQLHRIRGELNEVLQQLKALPHGVIENIDHREYVDIEYYSLTPPQPNLRQQFEAALPPDRYRLVRISRQYVNKDTTNSNATQHIALEPPTPEKLFQNIWEKQGYSADDAVLKDFLSLVQEAQKHLENDASH

SEQ ID NO: 5932 - protein, 62 aa, Acinetobacter baumannii
GVTVNYVRPPNGGAFHYLYAVFDLLSNDMYKVFLTFDTLCFIYLRYLNVYQDDVIWRVVFLK

SEQ ID NO: 5933 - protein, 127 aa, Acinetobacter baumannii
FMSFITEQEAIEHVEGFDALSASDKAQYLQMSEAYLLARNVKLYEDATQVPEPLKTASYQIIKGIMKGDLYQGQEQALKRKKVKADTVETEKEYQDGSVKLSAIEQFILDLIKPYCKRKSVFFVRKI

SEQ ID NO: 5934 - protein, 92 aa, Acinetobacter baumannii
LSVVVIQDIYKDFKMTIITLLDVETKKKVIVRSVIDPIARIDKKGNIQIIQIHKWLYDESGDFVDEDLYEALNNGEVGIYLTLQYMIIDIEN

SEQ ID NO: 5935 - protein, 174 aa, Acinetobacter baumannii
TMSVGFLFFETSAFDLFNSKIKRYRTSINSIYIFNWGNKKIMLVAQQLGQWAEQTALKLLKEQNYEWVASNYHSRRGEVDLIVKRGNELIFVEVKARGQGNYGQACEMVTLSKQKKIIKTAMRFLQRYPSYQDFYCRFDVICFDFPQKIAKTVQQDFSKFHYDLQWIENAFTLD

SEQ ID NO: 5936 - protein, 63 aa, Acinetobacter baumannii
RGPVMNKPLETFDIDAAKARYEKLRGRYNRSGLSNTDYNELLQLEKALDQAKKFNAEGAKNGQ

SEQ ID NO: 5937 - protein, 62 aa, Acinetobacter baumannii
RVQVLPPDLCRIGPLQLHEQSEHSCSVRHRIAYQANDHDFSYSPLQTTKAIQCKNVPSFSGI

SEQ ID NO: 5938 - protein, 60 aa, Acinetobacter baumannii
RVLVGVLIQYCLNDLFVGPKQLGSFLSHARQRIQPQGVWGVFKLSIHCHVNWRSGWCVFI

SEQ ID NO: 5939 - protein, 176 aa, Acinetobacter baumannii
KSEVVMALKVGIIKSSDVSKWCEYKDSDGQVQAEFKVRGIAYKPFQVAIERAGNQISSKGYDVMVKDENAKLYHELLMDACAAHLIEDWKGVVFAEIVDGKTVESEKPYTPENASKLLNLGDIGISIWLFIKEQAQKIQEDADKDKALILGKSWSSTNTKKRMRRKRRTKSSKSSS

SEQ ID NO: 5940 - protein, 219 aa, Acinetobacter baumannii
EMEVLMLVDTYSSSLSLPSFSSNTLNSINRSTTVVSNYNGVANRVNKSVENFIDHTESMRVFFKSFLNNQSDFLAFFLCLCVIGSFQSYDLRLDSKDNIISPEIFKDSKNSFWWDKKHYFEIYKLEATNRGREASAYMTVLMHQAVQVEDLKFLNNFFQELNKSSLTSWSLIALLRSTNVYKNQISLWKEMYLYTQNVVINEGLNPKREMYGLDRGLNI

SEQ ID NO: 5941 - protein, 81 aa, Acinetobacter baumannii
RLLLNDELNTEMEGSSPKLDGMKLENYGVKNHHIPKIFKRQSYVVFYLVSPQFFLISFDFSNHLIKKSSFYSSLYLFIDTF

SEQ ID NO: 5942 - protein, 761 aa, Acinetobacter baumannii
INILGILMSKRIIQSVLSVSVLASMMSMAFAAQNEQDQAEKTLEKPAEPVKLETIFVTAEEQVKQSLGVSVITQEDLEKLPVRNDISDYVRRMPGVNLTGNSATGQRGNNRQIDIRGMGPENTLILVDGKPINSRNSVRYGWKGERDTRGDSNWVPAEAIESIEVLRGPAAARYGSGAAGGVVNIITKKVTNETHGSVEFYTSQPEDSKEGSSNRVGFNVSGPLIKDVLSYRLYGNYNKTEADDVDINKSIGSTAAGREGVKNKDISGRLAWQATDQQTVLLDISSSKQGNIYSGDSQLNANAEADAILSQLIGKETNTMYRDSYALTHEGDWSWGKSKLVAQYDKTHNKRLPEGLAGSVEGKINNLDDKATSRLETLRFNGEANIPFEYYLPQVLTVGTEWVEDRFKDNVSTTQGKDSSGSGYGDQLAKGDRSKMESRIASAYIEDNLKVTDSTDVVLGLRFDDHSKSGSNWSPSLNITQKLNDYFTLKGGVAKAYKAPNMYQNAEGYLLSTNGNGCPANIESRCLLQGNGDLKPETSVNKELGIQFQRDIVNASLTWFRNDYKDKIVAGTHVVGTVDGSSTNANTGAVTNTKWNILRWENTPKALIQGFEGSLGLDFGDIRWTNNFTYMMDSKDKQTGNPLSLVPIYTINSIFDYDITDQLDVNFVFTQYGRQKSRQFAENRLESGIGSGGANSALKPSTVKSYSTAGINVGYKFSDQISTRVGVSNLFDKQILRDSNSISQTYNEPGRAYYASLKYSF

SEQ ID NO: 5943 - protein, 65 aa, Acinetobacter baumannii
AHILLTVVYRTQHYLKSLQITGLVRLFLTVHKQLTKPYYFLLKDHAKWSFFMPFNFGHFFVMSFD

SEQ ID NO: 5944 - protein, 77 aa, Acinetobacter baumannii
LAVLALPSRHEVAPEMDVPWPTPPSVFVPAKAFGAKQITPDKTAADRFKVFDLVFVLLFAISEVATHAPIEAFQMTL

SEQ ID NO: 5945 - protein, 81 aa, Acinetobacter baumannii
LLSFNSSHQLQSASSCCMFVTITCTNSSSLVSVFVLSKLLLGLFPLRIEFTCNPFIYLGGIHLRNSRGLDLSKFVVSKANS

SEQ ID NO: 5946 - protein, 70 aa, Acinetobacter baumannii
ADTLKAIALSNQLNKQNPSSISLEGFLFIRKNDYSGGAVKIASLEAGKPGCDSGIVSKPSILVTVPVPSK

SEQ ID NO: 5947 - protein, 143 aa, Acinetobacter baumannii
VGTFSERWCLMSSVSIAEYRKLFPINKNKKRRSAKQVARQPSVGEMVLATHLRACKISFEQEYKFHPERKWRADFLITGTKILIEVEGGIWSGGRHTRGKGYIGDMEKYNSAAMMGFTVLRFSTEQVKAGVAIKQIEQLVGEK

SEQ ID NO: 5948 - protein, 315 aa, Acinetobacter baumannii
LYQLKTAVLGFGGNMNKNVLITGASGFIGTHLIRFLLQKNYNVIAVTRQAGRESDHPALQWVQKFEDISTRQIDYVVNLAGANIGEKRWTESRKKQLIESRVNTTQKLYAWLNQSQIFPEVIVSGSAIGYYGIDAQEKWAEVCTEQSSPQPIFMSQLCQEWERAALADSQQNTKIIRLGVVFGQGGGILPKMLLPIRLNLVGQIGHGRQPVVWVHIEDVLNAIEFIFKHPQSAQIHNVVAPESVIQKVFVEQAAKVLNKKPLLSAPSTVFRCLLGEQSQLILNGQYVKPAALQAEGFEFAYPQLKMALENILASG

SEQ ID NO: 5949 - protein, 65 aa, Acinetobacter baumannii
VAQLPLMMRRPLKKISPLWSSQRQIKFQNLSIKKSDVKSLFLILLFLQLKITLKSFTIHILKTQC

SEQ ID NO: 5950 - protein, 476 aa, Acinetobacter baumannii
TSQLLYCIVRYCFVLLNLKMAQHIKFTKSVIDSIPLSEEKQIFYRDTVTIGFGLCVGKTKSYFAEKKMPNGKSKRKVIGKHGVYTLEQARTEAKRLLILMDEGVDPVKQKRDLRASAIQNDALQKLVPTLSEAYQYYKLRKKLAETSLIAYDGCIENYFSDWKDLKLDQITSAMIIDRHLKLSKASPSRANLASKFLHALFNHTISRYKDESGNKILNIKNPVVIVKEEKAFNKIKRRKGHVRADQREAWALAVATTYWMGEQNNDFRAYTNQDFLFLLALTGFRRSEAESVEWKNVDLQFGTIKIINTKNHEDLLLPMGDTLWHIMRERKKRAGDNKYVFTDRNGVSHISDRRAARDKVTENSGIEFTFHDLRRTFGTIANSLAIGSYTIKRLINHTTDDDDNDVTDGYIQVSFDDLKKAMNMIEDVIISEPVKALIKSRLYFEKNESRNQAQELINHHIQVLDNFKMAGQILDF

SEQ ID NO: 5951 - protein, 157 aa, Acinetobacter baumannii
THKLGKNMTKLPSYFLWFFALCIVLTLIVGVIAALLPASVGGILTAVPYLGAMIFVLFRFLKKERRAPTVPEKKKFTLGFTLIFWGYNLCGVLFGLFLFSRKDPEILQNFMLYLKQPQFLSIMVIMLLMLAIPLYLITYWFYGKQAQRMANKMFNVS

SEQ ID NO: 5952 - protein, 195 aa, Acinetobacter baumannii
CRLSGGFLHLKETEMNIEQYLDELIKREGGYVNNPADRGGETKYGITEAVARTNGFKGNMKDLPLDVAKAIYKKQYWTDPRFDQVNVISSLVAEELLDTGVNCGTGFAKPLLQRALNLLNNQGKAGWPDLTVDGIYGPATLNALKTYLAKRGKDGEKVLVRVLNIMQGQRYIEICERNPSQEQFFYGWIANRVVI

SEQ ID NO: 5953 - protein, 84 aa, Acinetobacter baumannii
STVSFSPSARTAAKIFSRSVAEIGGSVLTGLIFAAGVTATGIRGALGTSADAAKAASASEPRGVAVFTVTELLLVLAGVDGLTG

SEQ ID NO: 5954 - protein, 222 aa, Acinetobacter baumannii
HAEFKAPIKVLMWTIMTKRRVKPEHVRREEIMNAALDVIYEVGLSNTTIAQIAKKAELSTGIVSHYFGDKQGLINTCMQEMLNVLRRKTEQYRAEADSHPESQIKAIIDSNFDISQVNEKAMRVWLDFWSASMHVPDLSRLQKINDQRLYSNLKFYFLKLMDEQQASVAARGLAALIDGLWLRGSLSRHNEFDSELARSIAYDYVKTQLQFANKPLQERQNE

SEQ ID NO: 5955 - protein, 68 aa, Acinetobacter baumannii
EATSIRPNARINKKPAIKPRAINTHPIALQTSLSLIGLYCGALILIYLVKVLQNFVSNILISGINYFQ

SEQ ID NO: 5956 - protein, 256 aa, Acinetobacter baumannii
STTSKKGSLMSELSLAYIFHHQQLLVDQNLQLPKVEKLASDLLFTHDEQVIARDLLSEEAIPEGLQLVPIRQLISNWSKEQFLQASRAVQLLEWRRNHKFCSHCGHATEVHPTEYAMVCPSCRYHQYPRVNPCIITIITKGDDEILLAKSIHNKTNMYGLIAGFVEVGETLEEAVQREALEEVGLKLKNIQYMSSQPWPFPSNLMIAFRAEYESGEISLQEDEIADAQFFKFDQLPEIPFKGSIAHAMITQITQAK

SEQ ID NO: 5957 - protein, 369 aa, Acinetobacter baumannii
RMASKEDKSLIEILTQHQAYLYRVSSQSVNELLKIFNDESTLMLARLRDLLDELNDSEKVALASGQYTTANLKEIRDLISQWFLGLNTSLPEAFAVSATAMAVYEANYTAKLYGGKIKKPNGEKLFTAAKKVPLVGGALVDDLLSKIAESARQKVEYAIRDGISSGKTNQEIVQRIRGTKRLNYEDGLLTSSKADIDRTVRTVRSHVANQAYLDTFNKIGFEYVRFVSVLDGRTTKLCASLDGSVWEVNDPAKRVPPLHPNCRSILVPVEKDGKLVGERPFVMDERRVKDIPKEERSQLIGQLDANTTFKEFFKKTDDFFQREWLGPKRYKLYKKGKFDFDKFFDPEGRLYTLDQLRKLDEQTFKELGL

SEQ ID NO: 5958 - protein, 279 aa, Acinetobacter baumannii
REELKMMTLIEKLAEFPVKTVNVQGQQQAYREAGQGEYLVLLHGISSGSASWVNQLEVLSHHFHVIAWDAPGYGKSDELLTDQPNATDYAKRLAGLFDVLKIEKAIVVGHSLGALQGSAFAALCPERVKHLVVANLAQGYQRHDEQTQIQVFEKRPKMLKELGAKGMAQSRGPHLIYKQEPQALALVSEVMQQLTLQGFTHASYLLAYDEIRNYLTDLKVPCTVIAGQQDQITPALGIQELAQELQLEQRFVIEDAGHLSYVDQPQAFNQIMLTIQEQS

SEQ ID NO: 5959 - protein, 220 aa, Acinetobacter baumannii
AFHSVQPEISSCIRLSNLYTSYILPLIAILCDLVMLEQLQRLQAHIGVLKTRLHHLESENSALSEAKELAETEHHAQVVQKNSIITKKQEEIETLTEQLTQLQGQFQQLNQDANTLAERYSRLEKSTTDLKNRFQEILAERNELRVTKEKLQSQQRQTQQELHDLQQDRDRLLQKNELAKAKVEAIIQRLAILGTAQDQHAQEIQQLAHPNAEAGEETQS

SEQ ID NO: 5960 - protein, 137 aa, Acinetobacter baumannii
ERNSPMKLTKQQRAELKQKFGGHCAYCGELLGEKWHADHIEAVKRDLIHVGGGKLITGEMTRPQNDTLENMNPACVPCNTNKSSMPLEGWRRMLTHYRDVQLLRDSTHARHLLRFGLIEIKSEPVKFFFESYKEGQS

SEQ ID NO: 5961 - protein, 363 aa, Acinetobacter baumannii
VIDSGKNKMNAIVSTSQSAEEYLELGLRDQWHPVLASWEVAANPVGITRLGENIVVWRDAEGQVHALEDRCPHRGARLSLGWNLGDRVACWYHGVEVRADGVVADVPAVHECPMTGTKCLKSYPVIEQHGAIFIWFGIDANEQPAPLEFPEQLASEEWSSFLCQADWKVNHQYAIDNVMDPMHGTYLHCTSHSMAEGERTAEMKHRTTENGFVFEKEGQTGVNFDWVEYGSTGASWLRLSIPYRKQFGPGGEFWIVGYATPIDANNTRVFFWRCRKVSGWQRNVWRFLYRNHLEQLHWDVLEQDRIILENLAPNARAREFLYQHDVGLARLRRLMKKEAEKQLKKIAALNASNRIEMQEEAHG

SEQ ID NO: 5962 - protein, 74 aa, Acinetobacter baumannii
IEYTYVLPRVCCPHSTANDCTYYPQSFFHLTFLSLVLLVSSSFINQVLNCFYFSHIFLNLAYLAQNLDIFRRIA

SEQ ID NO: 5963 - protein, 268 aa, Acinetobacter baumannii
RLLTRLRQEFSDHVFAMWIRPLVAEEVEGILRLYAPNPYWTRYIQENHLELISILAEQLSEGRVRQVEILVDSRPGSILSFSEQPATTTAALQTAPIPQHAKVKREPEPVANTAVSSKSSQKKLLNPQFTFSLFVEGRSNQMAAETCRKVLTQLGASQHNPLFLYGPTGLGKTHLMQAVGNALLQAKPNARVMYMTSQSFVQDFVSSLQKGKVEEFKKNCRSLDLLLVDDIHLLAGKEASLVEFFYTFNALLDESKQIILTSDRYPKE

SEQ ID NO: 5964 - protein, 127 aa, Acinetobacter baumannii
GLFYFERHSKIRGTIIMNAQALVLTDNAANKVRQLRDSEGNDDLMLRVYVTGGGCSGFSYGFNFAESVNEDDAEFVNGDVKMLVDSLSYQYLVGSVVDYVEGLEGSRFIVQNPNATTTCGCGSSFSI

SEQ ID NO: 5965 - protein, 79 aa, Acinetobacter baumannii
LYNHFRVRESFIWFLFLYKLFYSKESKESKESKESKESKESKESKESKESKESKESKEILEQILYPTLYFFLFFNLFYS

SEQ ID NO: 5966 - protein, 341 aa, Acinetobacter baumannii
NQTKESQMKKRLGIVSAVICCAMGTTHAGQNVCVFDLLGKSGESYKMMEEWALAAKSWQADITLIPFQDEALVDRRLREGKCDAAYMTSMRARNYNKFAGSIDAIGGVTSNAIAQKAISYVLDQRNKHRMLTTQNGTNYEVVGIVQIGLAYLFVRDRNLNSIEKVRGTKFAILQYDAAQKIMVESVGAQPIPSEITDFVKKFNSGQVEAIAAPAYAYKPLEIGKGIGANGAMFTFPVVNVTGDLIARSDKFPANFGMKSREWFIKQLPQNFAMVKRLETGIPPKIKLNFSAEDKLKYQKILREGRLGLTKQGVYDATMMSVLKRARCTIERTNFECTLTGE

SEQ ID NO: 5967 - protein, 411 aa, Acinetobacter baumannii
LMCLGFVMSNFLPAEEQLALIQRGTHEIISEEDLLKKLKENRPLKIKAGFDPTAPDLHLGHTVLINKLKTFQDLGHEVTFLIGDYTAMIGDPTGKSATRPPLSREQVEANAKTYQEQVFKILDPNKTKVRFNSEWFNQKSAADLIQLASQQTVSRMLERDDFTKRYNNHQPIAIHEFLYPLVQGYDSIALEADVELGGTDQTFNLLMGRTLQSRYGQESQVCITVPILEGLDGVNKMSKSLGNYIGVFDAPGAMYQKVLSMPDSLIERYFDLLSFKSLDEIKALLDEIAAGRNPQEVKRILALELVERFHDAEAAANAHKSAGNRITEGEVPADTPEVTISRGEFGGEIFIATILRVAGLNPNAAAAKDAVARGAVKVDWNVVDASFSVKENGTFIIQSGKKAIARVTFTD

SEQ ID NO: 5968 - protein, 201 aa, Acinetobacter baumannii
RQIDILKNKQNLILDWFLVFPWGLSVGVEPPDIDTRIEILLKKAENSGVDLPRNCALFIAQQVVANVRELEGALNKVVAISRFKGAPIDLDVVRESLKDVLAIRARTISVENIQRVVSEYFRIPLKELVGPKRTRIYARPRQLAMGLARELTGDSFPEIGMAFGGRDHSTVMHACEKVVSLREEDPIFDEDYKNLLRLLQS

SEQ ID NO: 5969 - protein, 383 aa, Acinetobacter baumannii
IVRLKIAKESLLNVLSHVVGAVERRHTLNILSNVKIQTNAQALTITGSDLEVELVASTALSEGACLEAGETTVPARKLMEICKSLPTAALIDLQITEDQRCILKSGNSRFVLGTLPAEDYPLLTTENSQGTQVQVTQRELKRLFEKTAFAMAVQDVRFYLTGTLLEIDENQLRAVTTDGHRLALCEILASSTSSQLVQAIVPRKAVGELQRLLSIEDEQLTLLIGRELLNVTINTPSRDKEQGDITVRFTTKLIDGKFPDYRRVIPRGGDKHVLIGHDVFKQSLQRVAILSNEKLRGVFLNFNQDSLQLRANNPEQDEAIEDLAIQYQSAPLEMSFNAQYLLDVLGVLDGDDVNMSMTEANQSVLVQDPAHPDQTYVVMPMRV

SEQ ID NO: 5970 - protein, 376 aa, Acinetobacter baumannii
PDLCSYADACLIWFNYMHLTRLNIERVRNLKTVALHGLQPFNVFYGANGSGKTSILEAIHLLATGRSFRTHIPKNYIQYEADDAIVFAQSATEKIGMQKLASGEQLMKVNGDTVATQGQLAKLLPLQHIDPQSTDIIDHGAKPRRQLLDWLMFHVEPEFYFAWQYYSRALKQRNTLLKTRRNLSLADLEPWNKMLSDYGEILHSQRLSIVEQWNVYFQNDLSQLLPDLEIELEYSPGFHTEQGLMQDLLNQHQKDIERRYTEYGPHRADLRLKTPFGHADDVLSRGQKKLLIIALKLSQIAMLHASNKETVVLLDDLTAELDLTAQQRLIERLSQLGSQVFMTTLDHASVKKHLHDLSISYQLFSVESGQVSLAAP

SEQ ID NO: 5971 - protein, 386 aa, Acinetobacter baumannii
HFFSVLQGKLHMSTIYIGVMTGTSMDGVDIVAASFEPLQLHATLTVPFEPELRDELMALTLPDDNEIDRMGKADVALAKMIGHGINSLIEKHQLDRSQIKAIGSHGQTIRHRPEHGFTLQIGDPNIITEITQIPVVSDFRRRDMAAGGQGAPLVPAFHQALFQHPSIHRVILNLGGIANVSMLPANNPDGVFGFDTGPANILMDAWCHRHTGHPYDENGDWAAYGHPIRSLLDRLYAHEYFSKEPPKSTGREDFNIDWLDDQLIDWRNDLTYDELEDTPENIQATLLKLTVRAIQKAIYRSNMETGEVYVCGGGAYNSYLLEQLRWRLRKHNWSVQTTDVLGLSPTWVEATAFAWLAMRFVDGLSGNLPAVTGASDFRILGTITAV

SEQ ID NO: 5972 - protein, 78 aa, Acinetobacter baumannii
YIWLFFRHFYYFLLVFIFSYIIILELGSLLYGFYSSISFFIPKNPKNPKNPKNPKNPKNPKNPKNPKNPKNPKNPKKY

SEQ ID NO: 5973 - protein, 185 aa, Acinetobacter baumannii
MNFIDFITNFEQFLPILIQEYGAWVYAILFLIIFSETAFVFMFFLPGDSLLLTVGALCSVVELMHLGYMITLLTVAATLGYIVNYSIGRHFGNRIFEAKSRFIKKEYLNKTNRYFLQHGGKTILLARFIPFARSFAPLAAGSSNMSYGKFLIYNVAGAILWICILLTAGYLFGHALIQVTDFVEN

SEQ ID NO: 5974 - protein, 825 aa, Acinetobacter baumannii
GETMSSESQSASQTEQTNEKAYDSSSIKVLRGLDAVRKRPGMYIGDTDDGTGLHHMVFEVVDNAIDEALAGHCDEIIVTIHEDESVSVSDNGRGIPTDIHPEEGVSAAEVILTILHAGGKFDDNSYKVSGGLHGVGVSVVNALSSKLHLTIYRAGQIHEQEYHHGDPQYPLRVIGETDNTGTTVRFWPSAETFSQTIFNVEILARRLRELSFLNAGVRIVLRDERINLEHVYDYEGGLSEFVKYINEGKNHLNEIFHFTADADNGIAVEVALQWNDSYQENVRCFTNNIPQKDGGTHLAGFRAALTRGLNQYLENENILKKEKVNVTGDDAREGLTAIISVKVPDPKFSSQTKEKLVSSEVKPAVEQAMNKEFSAYLLENPQAAKSIAGKIIDAARARDAARKAREMTRRKSALDIAGLPGKLADCQEKDPALSELYLVEGDSAGGSAKQGRNRKMQAILPLKGKILNVERARFDKMISSQEVGTLITALGCGIGREEYNPDKLRYHKIIIMTDADVDGSHIRTLLLTFFFRQMPELVERGHIYIAQPPLYKLKKGKQEQYIKDNDALETYLISNAIDELALHISADAPAITGEALAKVIQDYQVSQKSLQRLTLRYPASLLDALLEVDAFKADQNHDQAYVQQWADQVREAVQRLQPSLRPEITLETFERENAQGEKSAHYWPRVTVYVHNLPHAYLLDAGLLNSAEYARLLKNSKSWFKLIEDGAYLQKGDRRIQVANFHQVWQHILQDSRRGMMIQRYKGLGEMNAEQLWETTMDPENRNMLQVTIDDAIEADRMFSCLMGDDVEPRRAFIEENALNADIDA

SEQ ID NO: 5975 - protein, 350 aa, Acinetobacter baumannii
NFLMPKTKNLQGKEKNMRFSKTLLLAMGLTTISFAAEAKQTICVFDFVGKNGDVYALMKDYQLAAKNWGADIELKVNQNEAVIAEDFKAGKCDGISVSGMRGRQFNSFTGSLDAIGAIPDLKLAVKVMQGLASQTFSKYMVNGRYEVVGVIPVGDAYLLVNDRSINTVAKAAGKKIAVLDYDEAQKIMVQQVGAQAVSADVTNFGAKFNNHQVDIIGAPAAAFKPLELQKGLGTKGAIVNYPILQVTGNIIIRPDKFPAGFGQKSREWVAGQLPRAFTILGKMKADIPQKYWMEVPAADKPGYQKLMRESRINLTQRGVYDKRMMKLLWQFRCKQDAKNFECGLQDENYK

SEQ ID NO: 5976 - protein, 645 aa, Acinetobacter baumannii
DKMIQFDQVSLRRGGRVLFQKASMQLHPGWKIGLTGVNGAGKSTLFAALLGSLGADEGSLTRPSVWTVAHMAQEVKALDIPAIDFVLSGDEEYWDIQNKLAQPEQLTDSDLAKLHGRFDEIHGYSAPSKAAQLMAGLGFLEHQLRLNVASFSGGWRMRLNLARTLMSRSDLLLLDEPTNHLDLDAILWLEDWLKAYEGTLILISHDRDFLDAITDHILHIENQELTLYTGNYSTFETTRSERLAQQQQAFEKQQEARAHLQKFIDRFKAKATKARQAQSRIKQLERMQQLAPAHVDTPFTFSFREPTKMSSPLLTLENASIGYGDKKIAEKIKLQITPNSRIGLLGMNGAGKSTLIKSLVGDLPLLAGERKASELLNIGYFAQHQMDALDGQASPMLQLARIADKQISEATLRSFLGSFGFSGERMDTPCESFSGGERARLALALIVWQRPNVLILDEPTNHLDLDMRHALSMALQDFEGAVVLVSHERQLIASVCDELLLVHGGKCTEFEGDLQDYAKWLREARQQQINAQTAVAQNNSSSAAPAPAKVDKEAQRKEAARRREQTRPIRKNIEKVESQIEKLQPRLAEIEEALADTSLYEANRKDDLLKLMNEQTELKAKLEQYEEQLLELMMELEEMEASFEN

SEQ ID NO: 5977 - protein, 133 aa, Acinetobacter baumannii
GEKMMSQKILASMLISCAALVSHSAFAADLEADMKTLAKSTKAFAEAKDIDNAKQQLVIMRQAALSSKLSLPHKLEGLPPENVQVKEYQAGLDQLVAEIDRVTVFVDKGQLDQAKTEAINLVNIRNENHKKFR

SEQ ID NO: 5978 - protein, 356 aa, Acinetobacter baumannii
LISVFERKLQTKNLFRGRMKKMKKIVLAMAAASVVGFSASAQAASTVCVFDLLGKAGDSYKMMEEWALAAKGWGTEINLVPRQDEAVADNDFKAGKCDAVAMTAMRARQYNKFAGSIDSLGGVPNNQIAQRAITYVLDARNAAKMTTNLGGKKYEVAGISPLGSAFIFVRDKNINSVEKAAGKKFAVLGYDDAQKIMVQRVGAQAVLSDISNFAAKFNNGQVDMVGAPAYAYKPLELNKGLGANGVMWNFPVLHVTADLVLRADKFPAGFGQKSRDWFVKQLPKSFAMINRLEAQIPGKYKMNLSAEDKLKYQKMLRDGRMDLTKRGIYDAGMMSVLKKARCSVDKANFECSMPGE

SEQ ID NO: 5979 - protein, 284 aa, Acinetobacter baumannii
VRHVVMDLTNRIHQYTRGAWTFDVIDSGPIDGPLVVLLHGFPETAHSWEQTSELLHEHQFRTLAIHQRGYSLNARPQSRFQYSLSELVEDVASLIKQLGQPVYLIGHDWGSVIASSVAMKYPQYIQHLTLVSVPHQAAFLKACLSSNQLLKSYYFAVFQLPILPELLFKKMPKAGRKFLKTSGMTEQQIKIFETEFIKENRLTTALNWYRGFFWDKPENPFKAIDVPTLFIWGKHDIAVTEKSAKLNSGYFKNNYKAIFMDASHWIPYQNAPELVQCFLESIHD

SEQ ID NO: 5980 - protein, 60 aa, Acinetobacter baumannii
SPPVLGGGGAPPFFFWEKGGPFFLKILGAPAKSPLKTRAGKLKRVLRKTPGPPLGGGGKV

SEQ ID NO: 5981 - protein, 233 aa, Acinetobacter baumannii
PGHPPMSKPYLIAPSILSADFARLGEDVDKVLAAGADVVHFDVMDNHYVPNLTFGAGVCKALKNYGITAPVDVHLMVSPVDRIIGDFLEAGADIITFHPEASHHIDRSLQLIKSGGAKAGLVFNPATPLHYLDYVLDKVDQILLMSVNPGFGGQKFIPMTLEKLREARKIIDASGRDIRLEVDGGVGPANIREIAEAGADMFVAGSAIFGQPDYKVVIDQMRAELAKVGSVDA

SEQ ID NO: 5982 - protein, 463 aa, Acinetobacter baumannii
TMPPLPKSHMFKMSHLKKKISLESYYSAADILKKLEELTGLVYLQDDNNPIIGFLPKNYLITQNNQNFLFTKTDLNKYKFSSYIENLLDFTQFQSQELKNSNREKISFKGGYIGFISYDFSAHQFINNQSHKQPSLFIGSYYSFIKKINNEWYFFSDENNALEIFNYLLALLNKPSNKIQKNNFKLEENIYPRWSKNTYLTAFHKIQEYIKAGDCYQINLTQEFKANFTGSLLNKADELWNLTNAPYSGYLKLTEFELLSCSPELFIEFNVNKQIKTRPIKGTMPRYENKEQDLLSKQTLKNSKKDQAENVMIVDLLRNDLSIYANTGSVKTTKLFEIESFNQVHHMVSEITATLKNDINPMQMLLTALPGGSITGAPKIRAMQIIEELEGAPRGAYCGTLGYFNFDGTGRWNILIRSFQQYQNQLSIWAGGGITIASEAEAEYQESLDKISAMLNLMNSTAE

SEQ ID NO: 5983 - protein, 231 aa, Acinetobacter baumannii
ASKLMNDVRNDDPNFNVMGNFDHGLTLALSKGRILKETLPLLATAGINLLEDPEKSRKLIFPTTHKQVRILILRASDVPTYVENGAADLGVAGKDVLMEHGAQHVYELLDLQIAKCKLMTAGKVGMERPKGRLKIATKYVNLTRQYYASLGEQVDVIKLYGSMELAPLVGLGDYIVDVVDTGNTLRANGLEPLEEICKVSSRLIVNKASFKRKQVLLNPIISQLEQAVQSR

SEQ ID NO: 5984 - protein, 226 aa, Acinetobacter baumannii
ILRLCMKLLALETANEQCSISLIDETQELFFQLDTRAKAQTQTILPMIEQGLQQTGLDVAGLDAIAFSRGPGSFSGVRINAAVAQALAWSQDLPVIPVSTLQALAQAAYRLEGLEQVTAVLDARMNEVYIASFVLDEQGIMQCIDEEKLMNYEQAAAYAKHCLIGSGAKLLQTDAEHQTITATAQDIASIARVYAAQKQWVDAEHALPVYLRDDAWKKIADQGKAN

SEQ ID NO: 5985 - protein, 196 aa, Acinetobacter baumannii
KFSYAEASLYSMIIMSFCVACGHKTEQKIPLGDHKVRRVCTHCGNIHYENPKVICGALALWEDKVLLCRRAIEPRYGLWTLPAGYMELFETMEQGAARETREEAEAEIEIEQLYCMYNIPRIGQIYVLFKAQLKDGIFGAGEESIECRLFEEHEIPWGELAFPSVEHTLRHYFEDCKQQVFPTHLETLGTRLDHTG

SEQ ID NO: 5986 - protein, 177 aa, Acinetobacter baumannii
IMMYSYQGQHPKALHEPWDGWVAPTATLIGQVELGRQVSIWFGAVVRADNCVVRIGNFSNIQENSVLHTDAGLELNIGEYVTVGHKVMLHGCTIGDNSLIGMNAVILNRAVIGKNCIIGANALIPEGKVIPDNSVVMGSPGKIVKTLDEEGAAKIRLSALHYAEHFKSYVDLKEFHF

SEQ ID NO: 5987 - protein, 558 aa, Acinetobacter baumannii
GDMQVKYPKLCPLTAAIVISGFSSFANAQLGQNLAVDIRSLSMGNAVTADPPGISAVHFNPAALAKIDGLQTDVQGILANFDIQREFSAPPGYNVFGYSDDPIVCNDGPEVSANICTDFKDSVHGDVEYASLYVPILKKMVDLGAGYPLVAPTAGIAYKPPGSKVTYATAVYAPLVAGFGAENGNPGNYMGQQVAVERITYLSPSFGYQVNDHLSIGASVGMSYNALALKTDLRFPNEMIGVLRMVDEVVCKPFKNNSDMITDLLLFGICNTQEGMNPFGKMGALQVSLEQSLSPSYNLGLLWEPTDNFGFGMVYQSSAKMRLKGKYMIDNAKAPQQLVSGLNSSATGQILARILGLPGYVPDIESGLVAMDLEYPAHFQAGIKYKILPDLQLNLDVGWTDYSAWDKFKFEFDRQISLLKVAKLLSNNVTDNSLALPLKFTSPWSWGIGLEYSATDRLKLRAGYEPRASAIPDDKRNTMVPINNAQLFGLGVGYRFDADTDLDLSVGFLRSRDNIPACTSTLSNKCGVDNILLNPYAGLDVKTNTKVTVLGLSYRTKW

SEQ ID NO: 5988 - protein, 282 aa, Acinetobacter baumannii
DFSKRPRSLMTVKILAVDMDGTFLNSKKQYNKARFLKQYEQLKQNNIRFVVASGNQLAKLVTYFPEINHEIAFIAENGAHVVEAGQELAFAHLSKEQFIEILNAIDPVYTSKMVICGKQSAYVHSSMNGEDYAKVARYFEKLMVIDDFYALDDLVCKITFTAQENESFTIFEHFQKQSFVKDKVLVPVSSGFNFIDLILPDQHKAHGLKLLLQKWQVQPDQVVAIGDNNNDIQMIKAAGYGFAVENAVEALKAVAPYTTANNEQEGALQVIDLVLQHQPPFA

SEQ ID NO: 5989 - protein, 278 aa, Acinetobacter baumannii
LLLKSTMDNNPLSPSQLFNLKMRKELVMRITKLFSQMICCGAFSGISVFAFAQEPLTHDHLREHGGQVYQATKIDTGWTQNEEGESSFSSELESWVGTDENKLFIKAHVEKAESEEANYGGSLLYSRNVADYWDVQAGVNYERLQREDEKQDRWAGVVGLHGMAPYFFETDAYLYVGEDQLWKLSLETERDLLFTQKLIGKPYLKADVVLQDESCYASKTGLSSLQAGFQTRYEINKKVMPFVDFGYGYEKGLKQTAWQTGTDSEHGWYYGAGLTLKF

SEQ ID NO: 5990 - protein, 641 aa, Acinetobacter baumannii
MNKKILWPFALTTIALMLNGCGGGSSTINENPSNGSGGASSSGSCSVTNSDCLQFFLDYPIAGLNFTCSSTGSQSFITKASGNIVIGSCKVGDTATFYLQGAKNPRKVELGSVKLDSVSKIQMTVPPRLKVINMAIGLTGQTPTSLSPSDPTIRVAMALVKVFQSIGLERGDNVVGDLQPTQFTEDKKNTLNVVLQNITATEWKNGAYVNLLKPWLDVSQISDEQAFNLITQLANLSLVGLYQSDYITLAKPNLVAENFYGCNLTNLKDCSKNSANTQHVFGNLFLLSDRQGYTFGYGLQWKGTSTTSSQLAIGAVLEVLTKAKPTQMIANAQTTWLDPIKTEIRSTQPFRLKTSNNTNEDLVIYQGKLLNDSLIAGHDSSYLALTNTETPNPQHYALWRQSVGTQNYNGSMDIYKVSPASFLLKDIFKTSKNVATGQTYIFPLYATLRFQFNTAGIAPIDLGIVVDEYGDIRTDIKPNATATDMSGQCGVVSDNTMIDNNGVQQYRIGTTGGTESSTNDKSVTVRMILAEPQLGNLNGIVVGLNSNVIQAIKETGSQSLTVSGAKINVANLLQGQASGANLTTYDNKTVNWLNPYAFYQQVYNNIENVSPAPTEAEKALGQRMAGTVTLRTADCYQIKTK

SEQ ID NO: 5991 - protein, 280 aa, Acinetobacter baumannii
CMEKNCGSGQSKLKALRMHMYFEVDFQEQAQHYQAVLHSRGVTVDLQPIEKLNARFLRLNPDLALCVDENGLWLSANGMKMQPDWKAEIPRLKRASLKSEMIARACQLGEKPVLVDATAGLGHDSLLMAYLGAQIQLVERHPILFTLLEDSKAQAQHDPFLSQFMDRIQLIFADSASYLQQLDQEEKTVDVVYLDPMFPQRDQNQQAIKKQAQVKKQMQLLHLLLPEDGEMDLGDHLLELAKKVAKRVIVKRPRHAIFLANQEPAHQWQGDACRFDAYFQ

SEQ ID NO: 5992 - protein, 111 aa, Acinetobacter baumannii
KLVNVMAWAILILAGVFEVIWAYSMKMSEGFTRLTPSIITVVFMILSVVLLSISMKTLPLGTAYTVWTGIGAIGSFLVGIFFLHEPIGAMRMIAAVLIVSGLVLMKISSPS

SEQ ID NO: 5993 - protein, 352 aa, Acinetobacter baumannii
RRRFMSDATLIANDAKNIVQAHLDRLGEPKDNRLSEEAKQQKFAQIEAELKKRDAVLVAHYYCDPDVQELAEKTGGCVSDSLEMARFGRDHAASTLVVAGVKFMGETAKILSPEKTILMPTLEATCSLDLGCPVDEFTAFCDQHPDHTVVVYANTSAAVKARADWVVTSSCAVEIVEHLDSLGEKIIWAPDQHLGRYIQKKTGADMLLWDGACIVHEEFRARGIANMKALYPDAAVLVHPESPESVVEIADAVGSTSQLIKAAQTLPHQRLIVATDRGIFYKMQQAVPDKILVEAPTAGEGATCRSCAHCPWMAMNELDGILEVLQKGDQEIHVDLALAERFSPRAGDPQWL

SEQ ID NO: 5994 - protein, 90 aa, Acinetobacter baumannii
VVSEVFAMNSEQLTQILKEAFPEAEVVVSGQAGKFDLRIVDDQFEGKRTVARQQAVYAPLNTYIASGEVHAVTIRAMTKDEWRKASLFGA

SEQ ID NO: 5995 - protein, 450 aa, Acinetobacter baumannii
CPQELRKRVNLVFLFRLVGKLMRRLSTQDQNFKQVFAELLAFETVNDPNLVQTVDQIIADVRQYGDDHVLKLTQQFDRHPAHQFSDLELSQQQLKAAFDGLNQEIREALQLAADRIRTFHEAQKQDSWTYVDDLGNTLGQKVTPLDRVGIYVPGGLASYPSSVLMNAVPAHVAGVPEIIMVVPAPNGELNSLVLAAAYLAGVSRVFTIGGAQAVAALAYGTQTVPRVDKITGPGNRFVAAAKRAVFGQVGIDMIAGPSEILVYAEGVNNAEWLAMDVLSQAEHDTVAQAIFITPDEALLEAVESAIEKHLNELPKAEIARTSIENRGALVLVKDRAEAVDLINQVAPEHLELCLDDAEAMSQDIRHAGAIFMGRYTPEAIGDYCAGPNHVLPTSGTARFSSPLGVYDFQKRSSLIMCSKDGVKTLAKTADVLAVQENLDAHARSARYRYQ

SEQ ID NO: 5996 - protein, 413 aa, Acinetobacter baumannii
QTLEVLKMAVGDVTMPQMHVVKGVKIGSTEAYVRYPNRRDLVIFEFAEGSNVAGVFTQNAFCAAPVHVSKAHLAEGNPRYLVINTGNANAGTGPTGLKNAQDTCAKLAELAGVNSFEVLPFSTGVIGEQLPMERLLAGLQPALNSVQDAAWSDAASGIMTTDTVPKGASEQFELDGMTYTMTGISKGAGMIRPNMATMLSFVATDAPIHRDLVQKLLKTTVEHSFNRITIDGDTSTNDSCIFVATGQAGGAEITSESDARYAKVLEVLARVMNRLAQLIVRDGEGATKFITVAVEGGANTQECCDIAYSIAHSPLVKTALFASDPNWGRILAAIGYAGVKDLDVSKIQVWLDDVQICKDGGAAEDYTEEAGARVMAQTEITIRVDLGRGQAKDTVYTCDLSYDYVKINADYRS

SEQ ID NO: 5997 - protein, 420 aa, Acinetobacter baumannii
ILMDKFLITGGVKLEGEVRISGAKNAALPLLAAMILADSPITLTNVPNLKDVNTLVKLIGGLGVTISYENDTVKADTSTLDNQFAPYELVKTMRASILVLGPLLARYGNAKVSLPGGCAIGSRPVDQHLKALEALGAHIEVENGYVHATVDGRLKGGEVVFDMVTVGGTENILMAAALADGVTTIRNAAREPEITDLAQMLIKMGAKIEGLDTDTLVVTGVESLHGCEYAVVADRIETGSYLAAAAITGGRVKTTHTDPSLLEAVLDKFEEMGAEVTRGDDWIELDMLGKRPKAVSFRTLPHPEFPTDMQAQIMAVNAIGRGFATISETIFENRFMHVPELSRMGANIQVEGHDAVVTGVEKLQAAPVMATDLRASFSLVLAALVAEGDTLIDRIYHIDRGYEHVEEKLQGLGAKIKRVS

SEQ ID NO: 5998 - protein, 132 aa, Acinetobacter baumannii
MMTLQHLRKYAWFVFLMTLVIGWSGVFIAQTPMQHDLHTMPCHSEQMKHHSMHIQADEQTTCHQSMAQVSHQHGEHCQDCNPVHCQMVNLALQQAVPNIESSFIPIPSQFSSIYQAQHLAGYWQEILRPPKA

SEQ ID NO: 5999 - protein, 343 aa, Acinetobacter baumannii
NSNCRTKSKLNDMPLVYTDGIVFCVSYGAKMALEKQENQINVNKSCSSCGCSNVAAQDFSVASEPRVNKTQWVSYYHIPRMDCAAEEQMVRMALASYAEHIQELHFDLPARHLAVYHSTQDEKITQCLQRLGLGAELQQTQPHYEPVEKPKKVRASSSTNATQKQVLQWLLLINGVMFVIELMAGIIASSTGLIADSLDMFADAAIYGVALFVVGKNLDAQLKAAHLSGWFQFGLAIIVLIDVLRRFIYGSEPVSILMILIGGLALAANISCLYLMSDHKESGEHMKASYIFSANDVIVNLGVIIAGILVAITGSRYPDLIIGLIIVLFVLNGARKILQLKNE

SEQ ID NO: 6000 - protein, 190 aa, Acinetobacter baumannii
AYWCDENDCRCTDCIWTGSNENFISILRGSSMLLSYKYINSPVGQLKLVANENALVAVLWDNENPKRVRLAELVEQLEHPVLLKTEQQLQEYFEGKRREFTLPLDFEGTAFQKQVWAALLTIPYGETRSYKDIAVQIGNEKAVRAVGAANGKNPISIIAPCHRVIGAGGALVGFAGGLDKKDILLRLEQK

SEQ ID NO: 6001 - protein, 63 aa, Acinetobacter baumannii
ILHRLHRLHRLHRLHRLHRLHRLHRLHRLHRLHRLHRLHRLHRLHRLHRLHRKKLRKIQKLFQ

SEQ ID NO: 6002 - protein, 293 aa, Acinetobacter baumannii
ILLRHKQRLKTMQLLQKNRCFEGEQRIYQFDSQLLKGSTKFGVYLPPAALEGKPCSTLFYLAGLTCTEETFAIKAHAQHMAAQLSLILITPDTSPRGGQVAVGDNWDLGQGAGFYINATEAPWSEHYQMESYLIDELYPLILKSFPVNAQQVGIFGHSMGGHGALTLAFKYPEKFKSVSAFAPICAPTECAWGEKAFSHYLGADRDSWLAHDATALVSKNGAVFNEILVDQGLDDQFYEQLHPEKFKQACLKAGQPLTLRQHAGYDHGYYFIQTFMDEHLQFHAIQLEKVTGE

SEQ ID NO: 6003 - protein, 671 aa, Acinetobacter baumannii
PDTGKKSYVHQKLNPFLLIFLVKRIKAMSHKTISSLVAVFGLLVSPWTLAAIKEYHLNINEQQVNVTGKPLKRITVNGKFTAPLLEFEEGDEAVIHVHNQLKNQDTSLHWHGLLLPGLMDGVPGFNNFKGIAPNGDFVYRFKVKQNGTYWYHAHSKGQEQDGLYGPLVIYPKGKIPVAAHEKTDRDYVVMLSDFHNSSSDSIMKNLKKSAEYYQNRRETVSDVLKQVKAQGLKATWQDRSMWNQMRMLKTDMSDVTGYTFLVNGNTPQQNWTGNFKAGDKVRLRFINASAMSFFDVRIPNLKMTVVSADGQPVKPVAIDEFRIGTAETYDVIVEPKQPNYQIEAESIDRSGFAIGTLHNENTQAVGPVQMPIPRPRALLTMDDMGMSHGGGSNEHAGHQMNMQHDMSAMPEMKKETTQANHDHTMMKMDHDMKNMSSDGHDHSMMHMTHDMSAMSEMNHDMQAMSASEHDHAMMNMNHEMPAQSENKPKKDEPVYGWANASTPAGMKALQYSDLQSLTPQPDTRAPERELVIRLGGNMERYIWTINGKKFSDTTPLQVKYGERIRLKFVNDSMMAHPMHLHGMFMQLENGQQAENLPNKHTIIVPPGKTVTALLTADALGEWAIHCHLLYHMSAGMMNKLIVAQVNDGQQPAQSQPTVQSENEKGASHAHH

SEQ ID NO: 6004 - protein, 86 aa, Acinetobacter baumannii
VFCGAVGAVGAVGAVGAVGAVGAVGAVGAVGAVGAVGAVGAVGAVGAVGAVGAVFNFSWTCCSSFFGKFLVCSFSLDVFCTTSTIG

SEQ ID NO: 6005 - protein, 288 aa, Acinetobacter baumannii
GQLGYHLDQVLMLEIALGSALIYYFATEAFEIEKKPPGTVYYTETADSRNLSFHRNHIEPVTIKPAVEDQFRGIVRQAYDYSCGSAALTTLLNGYVGTSLTEQQTMSGLLQYGEYQRIIERRSFSLLDMKRFVTAIGLESGGYRGEFSDLVKLGQPAIVPISYAGFKHFVVYKAYKDGRVYVADPALGNISFDENRFKEIWDNNTLFVISVPESQRKDLLALKDSDMRHVEDATVNRYAFVDVQYPTYKYDRLANKASTMRRVLDTDTHSSTYNQPIDTYMRLYYKRK

SEQ ID NO: 6006 - protein, 302 aa, Acinetobacter baumannii
MLLGECSMKMFTKLALVSSLAISANAMAMQSMDDAALSAATGQDGINIGIALGTSGISIDKLYLHDNDGLATTTGITGATGTAGALAISDVTLKQTGTGNLLDLAIDTNGASSTNGAFLNVAATVGAVDIHVGSIGVGTSGTVNETTALRGITETAPTEIISGLDLSLGQITANVQLGSTPQGAMIKVDSALKGGLTISNLGINDAAGGGSILLDKVMVRGAGNATGDLDVKADISVTGNGLQVKSTSAQDMNVYVGGVHLGTNTKASDGTWGTGAVKAASIGDLEIQGLNVANTTITISGH

SEQ ID NO: 6007 - protein, 486 aa, Acinetobacter baumannii
NLFMIDLKPSINFWHDFKSNQLAGMWLFLGSRRSLQIVHPSILQLIVWGILGGCTNSLYSWLVAGQIGDFNSQGLIGYALWPFIALIVGIFLSQRINQPRLMLVPALLWLVLDTNILLIQCLIQYLGSNGYLNFIPDAIYNGILPGLFVALFVWQSLAVIWVFSRELKWPWWERALVMVATIATMVVWQLSVKDQPIWKVEDSPPTFAEDAFYAQSKLLHDALEQVQYGELAKSHWYFLGVAGDSYQDVFKSEVVRIKEQFDTRFGTVGRSMMLVNNPDTRTEIPIASKTSIELALRRMGQQMNRDSDVLFLYMTSHGEQNHFEIENAPLDLGQVDPKWLRETLDKAGIRWRVIVISACYSGSFIPALQSPDTLIITASAADKTSFGCNNEADYTYFGRAFFDLAMREQSSMKDSFNAAKQTVTKWEVAQGVEPSEPQWMIGKNMELMLPQLEKYLFPQPNTGSVNIAQTQTEAKNDATPAKKPLL

SEQ ID NO: 6008 - protein, 364 aa, Acinetobacter baumannii
DKTMTVSTAQMRFWSPEVRELEPYVPGEQPKIQNLLKLNTNENPYPPSPKVVEAVQAVLHEQADVLRLYPDPDATALKQAIAKQQNIDVSQVFVGNGSDEVLAHIFKAFFLQDEPILYPDITYSFYPVYSQFFGTKTKEIPLNENFEIDVRDYTQPNGGVIITNPNAPTSIALSLAEIEQVLQANPDRVVVIDEAYVDFGAESAVSLINRYENLVVCQTTSKSRSLAGLRVGFAIAQTHLIAALEAVKNSFNSYPIDRFAIAAAVASFEDEVYFEEQCQKVITSREKLVRDLTELGFNVLPSKANFIFATHSQHDAGQLAQKLREQGIIVRYFNKPRINQFLRITVGTDEQNARLVQTLKQDIL

SEQ ID NO: 6009 - protein, 208 aa, Acinetobacter baumannii
VNGMEEHLLTQKLQQRLRFSTRIQEAQAAVLIAITNENNPKVLLTRRSIHMNNHAGEVSFPGGKRDPSDTSNIVVALREAQEETALNPFDVQLLGDLPMQRARSGLSVKPIVGLIPPEVTLIPQPTEIDRIFFVPLQQLIETRPTPYEVRYAHQSLYFPSLQIDNEIIWGLTARMLIALFKYGLGYQKEWPFLLNAPTFGMPKFSHKK

SEQ ID NO: 6010 - protein, 93 aa, Acinetobacter baumannii
ELIMKSTTHLLTNDGKRIAKRLVNHWKHKFEVHETEQDFKILMPTATITLAPETEQLNVAIDSQLDDHDHLEKVVLDHLNRMAQQEFQVEWQH

SEQ ID NO: 6011 - protein, 492 aa, Acinetobacter baumannii
FLLVFWKEKYMKLSVGLKVANSLSLTPQLQQAIRLLQLSSLELEQEIQIQLDSNPLLEKVEDESLAESLSTLEHKETDDLTTELNADHLPDDLPVDTEWDDIYTHQSTALGTPEFEEREDNRQVHLTLKEHILEQVNLLHFSKIDQLIAYCIVDALDDKGFLDAELEEIILAVQHLLSEMDIDEEVEEDEVLVVLKHIQRLDPIGIGARNLAECLKVQLEFLPRETEYLKEARSLLQYYQLLIANDLNKLLKQTGLSKEQLKFAVDLLKTLKPYPGMDFEKQESEYQIPDVVVAKKDLHWQVQLNPDVMPKLRINSFYSSMIRRADQSDDNLYLRNQMLEAKNFIKSIDERHKTLLKVATCIVEHQKAFLEIGPEAMKPLVLRAVAEEVELHESTVSRVTTNKYMLTPRGLFELKYFFSSHVGTTTGGEASSTAIRAMIKKLVSNENPRKPLSDNAIAALLKEEGIEVARRTVAKYRESLHIPSSSERKVLI

SEQ ID NO: 6012 - protein, 451 aa, Acinetobacter baumannii
NEMVRLYKWIFSPKFAITTLCVAIASISVSYADGFYTIIGPDGRPMIVPSKRIDQKKQPIPKIEERKPQTQQNQPIVDVVQKTSKEKEQTKNLPKKLEQHVQEKLNTAPTAPTAPTAPTAPTAPTAPTAPTAPTAPTAPTAPTAPTAPTAPTAPTAPQKTQKNTKTVSVVSDDLKTSTEKNKIIESGNAPSVSNNEWQKKLVLVPPPIKSTPQAAPSSDSSLDKSKFTTIDGVEYVNNEYLEDQEFNIEGKKRFYLMPDGLGRTESVERKKGVSRSTLDQLFNRQTQDQDSTVVLAPTYMRLSSQELEAAFEQDKCFIKDYKKSIKTLSTNKEVNLWPRKPLKEKFEYELVQLNPSVQHLKVMSFASSNEKPLYYWPLVVFLDDKGCILEGVSGFKSKSYPSTMLQHASIQGVLKVPPSAHYIMMTPLSSAVDVTEKELTNQGQIQISVLR

SEQ ID NO: 6013 - protein, 120 aa, Acinetobacter baumannii
PKKVRDRIMQITIRGHHLAITPAIEENIKAKFNQLTKHLDQVNSMQIKLTKDHQIDKRSHKGSSNHVAEAIVRLPGIELFAQATADDMYTSIKKLTEKLKKQLLKYRKMQCTYSQVAVSI

SEQ ID NO: 6014 - protein, 408 aa, Acinetobacter baumannii
INWVGRNMDNRWIKMSVLALSMSAITGTIYAEDQVQQTQVESSNQSTEAGVEVNSLATEATNSSSVSTDAGTQASETSSTENVPENNSGANQAASALQKKEGDASQETNLQEVFTSNERQYSLIKKGVISSYYDLDYTYYRDTRIDLALDSSSTRLNRLRVEEDANHTLTNSFTVQYGVLDNLTLSATLPFVAKSEIIRDTTTAGLGDISLGARWEPFPLKQGRLPLVLFGSLSTKTGDSPYEIGLDELSTGKGYYSVGVGASTRKYIDPVVLFASASANYGFKETGLNQNRGGGDDETGPRILKSFDPGISGGFSFGFAYSFNYDVSLTMSYQQSFNMDAEFQFENGENYKSPDQSSAMLSFALGVRVSPETIVNGTVGIGLTEDAPDISLGLSFPLDILGFNKKQK

SEQ ID NO: 6015 - protein, 65 aa, Acinetobacter baumannii
FTCSPYRSFCIVPDQSYNKDSNVELNSLFILNREDLWPTPLDHSNLKRHFMTPSVFHWIKFKNAK

SEQ ID NO: 6016 - protein, 573 aa, Acinetobacter baumannii
YARLFCRVLRCIGFSIEESCVAQYIYTMNRVSKMVPPKREILKDISLSFFPGAKIGVLGLNGAGKSTLLRIMAGVDKDFSGEARAQPGIKIGYLEQEPPLDPTKDVRGNVEDGVREALDALERLDQVFAEYADPDADFDALAKEQEKLESIIHAWDAHNLNNQLEIAADALNLPAWDADVTKLSGGERRRVALCRLLLSKPDMLLLDEPTNHLDAESVSWLERFLKDFPGTIVAITHDRYFLDNVAEWILELDRGHGIPYQGNYTSWLEQKNARLEQEQKQEESFAKALKKELEWVRQNAKGQQKKNKARMERFEELNSREFQQRNETSEIYIPPGPRLGNKVVEVENISKSFGDRLLYENLSFTVPPAAIVGIVGPNGAGKTTLFRMMTGEQKPDTGTVTLGDSVKVAYVGQIRDTLDDNKTVWEEVSGGLDILKVGDYEIASRAYIGRFNFKGQDQQKRVGELSGGERNRLQLAKILQQGANVILLDEPSNDLDVETLRALEDAILVFPGTVMVVSHDRWFLDRIATHILSFEDEQPEFYTGNYTEFEAYRRAKLGDDAQPHRKKYKKISG

SEQ ID NO: 6017 - protein, 646 aa, Acinetobacter baumannii
IIRFSYYLLCRFCRCLFVFIKNGAPFGVELSMSKTFAEFSLHETLQQALEGLGFTNPTPVQEQSIPAALEGKDLLVSSQTGSGKTAAFLLPTLHNLAGQDTFVPFKERMKAVTQPSILVLCPTRELAQQVSQDAIAFVRHMKGVRIAAIMGGMPFGKQIQQLKGAQVVVATPGRLLDLVNRRQLKLDKVDALIVDEADRMLDLGFSEDLEAISDLAANRGQTLMFSATFADRIIRLAERMMNEPERIAIETGHSTNTDITQTLHWTDGFEHKKKLLTHWLADETLDQAVVFASTQEDTDMLAEELAEAGHSVVALHGAMPQTVRNRRLRSIREGRAKILVATDVAARGLDVPTISHVINFGLPMKHEDYVHRIGRTGRAGRTGQAITLATYRERGKIRALEDYLEARLNVSEIEGLEPSPPPARPRREGGRGGNGGRDGRRGGGFGGGRRFEGEGNFKRREGGRDDRPRRSFDDKPRGERPAFGGEDRPRREFNSDRPRREGGFEDRPKRSFGGEDRPRREFNSDRPRREGGFEDRPKRSFGGEDRPRREFNSDRPRREGGFNDKPRFDSNDDNRGNRVDYKPRRENGFGDRPQRSFGGEDRPRREGGFGDRPKRSFGGEDRPRRAVREEHFNQESRGERRRKFDR

SEQ ID NO: 6018 - protein, 732 aa, Acinetobacter baumannii
FSLSNLLFALFRPPMTQRFAFSTSKTLLAVTIFTSMTTSHAEEPAEQQNSTNVLPTISIQAQKENPTSYVATKANSALKSDAPLFKTAQSVSVVTREQLDQKQARTLADALEGVAGVEAGKLGRRGWDDFIIRGQTSSDSVYVDGLRVGQNTYVATELSGMDQVQILKGPASINFGLVAPGGMVNLVTKRPEAESFARASMTYGSYSLKEGTFDLNYSPNNSEKGAFRLNGRISDQDDPTDYVYFKNFYISPSYNFDLGDNTDLSVIASYQHREYIRQQGLPVIGTLKDNPNGPIDRSLYIGDPNFGKYEADVYRTGYTFKHTFDNGWNFNQNFAVQKTEMDGKAVFARTGSNFWAKDKQGEIDYTTISRKNNSRHQVIDNLSFAIDNRLNKQFDLYGMQHDINIGVDAFQEKSDYTNDKYDIGDLNIYNPVYGQNVTLKQNVRDINRLKYLGLYLRDRIQLNDQLLLSLSGRQDWAQTQTTSLVTGNASKQSDNAFTGSASVMYTLNDIVAPYVSYATSFTPNSGTDVNSNPFKPEKGKQVEVGMKLQSPDQRIQGAIAWYDLKRQNVLVTDTANNGYKVQRGEQLTRGIETELSAEILEGLKLTAAYTYTIDAEISKDANASNVGKALDNIPEHAYSLSARYKFNPSSKLGWYVGGGFRGETYKTVDGLDVHVPGYTVFDTEAGYDAERWGAQLAIRNLFDKDYYAGALNENLVTLGNPRQINFTVKFNY

SEQ ID NO: 6019 - protein, 76 aa, Acinetobacter baumannii
YQLSHLYLGITPMYVCLCRGITDQDIKDAIENGAESYREIRDLLDLGTCCGRCAPEARAIISEELAEIAARISVAA

SEQ ID NO: 6020 - protein, 483 aa, Acinetobacter baumannii
CPTSYGRCCLPCTIGKIMHTSTTSTVPLEPWTAQQLQQATQGYWHKDQIPQTEIKRILTDSRHAESGDAFLALKGERFDAHNFVAQVAANGCQVAIVERPIDAEIAQLVVADTRLALGQLGAYRREQNAQLKVIALTGSSGKTTTKEMLGSILSRLAPTLITRGNLNNDLGVPMMLLELRKEHQYAVMELGANHQGEIDYTSKLVQPHVAGILNIGTAHLGEFGGRDGICRAKSEIYRHILPQGVAIVPQQDDFTAEIREAAKSHQIMSFGAGGDVFATEIELLPQSANFQLHTPQGSSFVRLPFAGEHNVQNATAAVAFALALGVSLEDIVKGLEQAQGAKGRLNFIQKAPHLFIDDTYNANPTSMRAAAQVLLQQNGIKVMVMGDIGELGDSSWQEHHDLGRDLAELPLDHIIAVGQFASAALEGAGLHSTKLKAFQTQAEALPFLINLIQTHQPQSMSFLFKGSRFTHMETLMADLMEKL

SEQ ID NO: 6021 - protein, 659 aa, Acinetobacter baumannii
HGGFMPSKQASWFANVNPNVFLGTVIIIALFLAVVVIAPSSFELLTQQLKQWITDSFSWFYVLSVAFFLILLIYIACSAIGRIKLGPDHSQPEYSNGSWFAMLFTAGMGIGLMFFGVAEPVMHYVNPPSGEPQTIEAAQQALRVTFFHWGLHAWAIYAVVGLALAYFAYRHNLPLKTRSALYPLIGKKIYGPWGDSIDIFATIGTVFGVATSLGFGVTQINSGLHYLFGIEQSTTTQVLLIIFVSILASLSVFLGLDKGVKRLSELNLVLALILLVFVFIAGPSIYLLQTTIQNTGQYISNLFTMTFNLYAYQPNGWIGGWTILYWAWWISWSPFVGMFIARVSRGRTIREFIVGVLLIPTGFTIIWMGFLGNAALFSIIHEHQTTLIQAVQQDSSVALFEFLGHLPWSGVMNILATILVVLFFVTSADSGALVTDYLTAKTENSPTWQRLFWTVLMAVLAIILLLVGGLAALQSSIIMSALPFTVVMLLMSWGLIKALHLDVTKMIAIQEARITPRAIHNPRSWQQRLGLIMHYPHSEEEVKQYIEKQVSRAFENIQHEFRRRHLEVSISEVEDGMQLRVDHHHEINFIYKVVSRETVPPSFLIGRTEAEDGQYFQAEVFLREGGQNYDVMDWTQEDLIQDIIDQYERHLHFLNIVRS

SEQ ID NO: 6022 - protein, 333 aa, Acinetobacter baumannii
MAQSFISNKEQGFTLIELIVALALGLILVAAATQLFIGGLLSSRLQKANAEIQDSGIFGLEYMARDIRLLNYGNVVNPQLTDTTPWGGIVLTGSTATNANNINFIPKVDTNTYIPEALLSRGAGDTVSTVNNHWKGLSNIQNSSNAEEQSDQLTIQFIAPTNMTNCEGVNVLAGDLIVQRYFLRVDNNGSSQQDYALACDANTPEVSATAQPDIVNGLGDAGQIILPRIDHFHVLLGAKNAAGNFAYYTIPQYRVAAQAARDASPAVAAPRILSIQISVLARSTNNAQNKAIDPNQSFLMLDQTVHAADNRTRFLRRVYSVTIALRNAMGETL

SEQ ID NO: 6023 - protein, 468 aa, Acinetobacter baumannii
MLQSLLTLSYSPHFTGSVGENRIKTDADSLENWGKDHTKHFNPNPSVIVFPSTTEQVQEVVKLANQFNIAITPSGGRTGLSAGAVATNGEIVISMDKMNQILEFFPADRMVRVQAGVVTEQLQNYAEEQGMYYPVDFASAGSSQIGGNIGTNAGGIKVIKYGMTRNWVLGLTVVTGKGDILRLNKGMIKNATGYALQHLFIGGEGTLGLVTEAEIKLERQPQNLQVLVLGVPDFDAVMPVLHAFQKDIDLTAFEFFGELAMQKVLDRGHVQRPFETQCPFYVLLEFEAPYEPIIDKAMEIFEHCMEQGWVLDGVMSQSLDQVESLWRLREDISESIAPFIPYKNDISVLITHVPAFIREIDAIVQENYPDFEICWFGHIGDGNLHLNILKPENLTKDEFFAKCQVVNKYVFDTVKKYDGSISAEHGVGMTKKPYLEYSRSAEEIEYMKALKKVFDPKGIMNPGKLFDL

SEQ ID NO: 6024 - protein, 247 aa, Acinetobacter baumannii
KKRSFVLTKQSDLFIIMENRSLYHAMTTYALIRKLSKDITRSIFFVCLATSVVGMSLGSLAASYGLALWIPLCLSIFVLAGTAEFIFIGFLAVGGSPIAAAIAGLLVNLRHLPFGIAVNEMIRGKFSQYFGSHIMNDESVLFGMAQPDFETKKAAYWLCGIGIMLSWPLGVTAGYFIGSAIPDPKTFGLDAIFPAILIALTFSALKNKVTRKAAFAGSTLALITTPFLASGLPILISLFGLIWGRKK

SEQ ID NO: 6025 - protein, 214 aa, Acinetobacter baumannii
TDLSIHLFIRIRIIIMFASMFLFSFAMSITPGPVNTVILSTSLNHGLKRSLPYISGATIGFTLLLIFMAFGLQSVLTQFPVVLKILAVCGTLFVCYIGIKIILSAANISISSVPVEQMIIPNFKDGFLLQWLNPKAWLACVSGITMFTSIENPQSLPIFIIIYFFTCYACLFFWGLCGDKFSVVLNQGNRLKYFNILMGAFLILSALLILIDFF

SEQ ID NO: 6026 - protein, 262 aa, Acinetobacter baumannii
RGSSMNTIAWLGRLVIERIRGIGVAALMLLQIIFSLPSAGGFGRFVYQMHRVGVMSLLIITVSGLFIGLVLGLQGYSILVNVGSESMLGTMVSLTLLRELAPVVAALLFAGRAGSALTAEIGSMKQSEQLASMEMIGVDPLKQIVSPRLWAGIVSLPMLTVIFAAIGIVGGKLVGVDFLGVDEGSFWSGMQNNVQFGHDVVNGIIKSIVFALLCTWIAVFQGYACDPTPEGIATAMTRTVVYSSLCVLGFDFVLTAVMFGGI

SEQ ID NO: 6027 - protein, 289 aa, Acinetobacter baumannii
SLRSKLPLNSVTKIVKAKVRAALSRFIPHKYAIDASSLGDSEELAWTNLGFWKNTQTYREACRQLADHLAQAVNLNSKDHLLDLGCGQGASLLHWLQHYHPKSLSAVELQASYVNKIQKFIPEISQIFCGSFLNLKQFEFKQCFDVVLCIDAAYHSHLNSFFDSVTPVLNSKGRLGFHYLMRADSCQNMTAFQEQKHRYLLKAADVTWDALLTEEILRTTLEQQGFTDIKIEDLSEQVLLGFSQYIQNQQAQSHNRGLANFKIQMTAKLCQQLYQNGYVRYIQITAIKK

SEQ ID NO: 6028 - protein, 376 aa, Acinetobacter baumannii
RILFVHPYAPTLQRVLLFGLFFILIFLGFNILKYFIVPVLWAAIIAYMTWPIYLRIQHFFGENRNNLNATVMISLVILIVGVPFTCAIFILQHEGRNLYFDLQRQVFSGHLSVPDFIRNLPFIGKEISRTLNEINTDPNSTIQNIAAWVQSHLSYGRVLLNEISKNIVKLCFAILSLFFFYRDGHTILTQVSKALEMVIGPRIHHYLDTISETTRAVVYGVGLTAIAQAVLAGLSYFVAGVPNPMVLTIATFLLALIPFGTPVSYLGVGLWLFSQGQTMEAIGVILWGVLIVSSSDNVIRPLVISGATQIPFLLIMFGVLGGIASFGLVGLFIGPVILAVLLAIWREWLHETIDPEPMPKTTMIYDSDDDLPPSKN

SEQ ID NO: 6029 - protein, 307 aa, Acinetobacter baumannii
LCVPVKMTTKNQKISRRHISGVFLLNKPLGLSSNAALQKVRWLYRAQKAGHTGALDPLATGLLPICLGEATKFSHYLLDSTKRYQTTVRLGQTTTTGDVEGDILQERPIPVLSKELIEQTLEKFSGDIQQVPPMYSALKKEGKPLYELARKGIEIEREARPVTIYALELIEFTENSITLDVTCSKGTYIRVLGEDIGEALGCGGHLTMLHRIQTGHFELIPSYTIEYLESLTEEQREALLLPVYAPIDHFLKIQVPEGREKYFCNGLESNIDHSAEAEVLVFSDERCLGLAEITDKKRLVPKRILNL

SEQ ID NO: 6030 - protein, 68 aa, Acinetobacter baumannii
IETPAGFFVLSNNLFANSPIQAQPESAVVLDKPPEQLKSAPKVLPKAVDMTLAERVFVVLFGSPSDKK

SEQ ID NO: 6031 - protein, 259 aa, Acinetobacter baumannii
LISPIFFFRLRNQIMTGITSSKPLNIVAVSGGLNTPSKTESLVQAILDELSEAIDIKVHFIKLSEIGPLLGGAFYRNQLPQRVQDDLAAVEAADALIVGTPVYRASFTGLFKHFFDFVEQTALVDVPVLLAASGGSDRHALVLEHQLRPLFSFFQAQTLPIGVYATDRDFTPEYTVKSEQLSDRITLAVARALPILEWAPAKGKRAEVVKPKSQQANQELGINKQIEQEEVLPSAAVPNLDAAESRLHHKSGKSLTHVA

SEQ ID NO: 6032 - protein, 123 aa, Acinetobacter baumannii
IKMLSQVATPDECLRCGACCAHFRVSFYWAEAELMEEHLVEPLTPVYSCMRGTNQPEPRCQALTGEIGKEVGCSIYAVRSSTCREVQIADEQCNKARLAHQLIPLIQVSPADSENDHDYDQVS

SEQ ID NO: 6033 - protein, 284 aa, Acinetobacter baumannii
SEFPSSYFLSYDAIAFMKYLTKRVYSLKDIAMKMMKTAIVTASVLASASIFAQSAGVNAGASAQVNVQPGGLVSGVANTVKNTAHTVGNTAKHAGHVAADTTVKATKKTTGKVTELSSKAATGTKHVASEAVTGTKHFATEAATGTKNLATKAATGTKNLAVEAKADTKAHLDAVKTKVAEKQADQKEFTAEKQADAQARVDAVKARVAQNQAEQKEFVADTKADAQAKLNAAQPAHGVNAQTGVNVGVNVAGINANANVNAGAQATTQKGEKKSFIKGLFGTN

SEQ ID NO: 6034 - protein, 193 aa, Acinetobacter baumannii
NKMFAETPSSRPPQLPFKDSPFSIHGRFNRMSYLGGYGLIYLVTIVGYSILGSFLGNFQLSSDLFNFEFYSSLSGISALMVWAFWLFLIYLNIILVVRRLHDLNKSGWMGLLLFIPVVQFFFMLYLLLASGTAGTNQYGPVRPSTFIEKLMAWLILIAILISLISTAGFFYYFSGTDTIQTPTQILQKGTEYF

SEQ ID NO: 6035 - protein, 183 aa, Acinetobacter baumannii
PMTPTQNVPEDRIQIGQLRSAYGLNGWLWVYSNTEPMSNMFDYLPWYIETKAGWQIVDVKRWKPHGKGLVVALKGVSDRTGAESLVGANIWIAKSQLPKADVDEYYWSDLKGLTVLGLDDDEQEVNLGQIHELFETGANDVMVVRATPDSIDSEERMIPWHKDVVQRVDLEAGRIYVNWGVDY

SEQ ID NO: 6036 - protein, 182 aa, Acinetobacter baumannii
MSQPIEIIAKGLTRERQRAGLSLAEVARRAGVAKSTLSQLEAGQGNPSIETLWALCVALNIPFARLMEEPSNQVQVIRCGDGPTVSSEIANYKAILLATCPPHARRDVYLLIVEPGEDRLSEPHPVGSVEHIIVVEGRALVGLIDEAVELGVGDYICYPADQKHIFRALETGTKALLISEQN

SEQ ID NO: 6037 - protein, 906 aa, Acinetobacter baumannii
IMAFYGDSDAQETQEWQDAFDSVLQHMGTERAAFLLEKLYQQAIAKHVPIQRLNTPYLNTISVEEQPAMPGDQDMERRIRALIRWNALAMVLRANKTGDDLGGHLASFASSATLYDVGFNHFFRANSDNFGGDMIYYQGHCAPGIYARSFLEGRLTEEQLSNFRREVGGNGLPSYPHPYLMPDYWQFPTVSMGLGPIMSIYQAHIQKYLMNRGLIKEEDRKVWAYLGDGEMDEPESLGAISLAGREKLDNLIWVVNCNLQRLDGPVRGNGKIIQELESIFRGAGWRVIKVVWGRHWDPLLAKDTSGALKARMEEAVDGDYQRYQVKGGAYTREKFFGKYPEAAELVKDLSDEDIDNLNRGGHDPYKVFAAYAEAMKAKGQPTVILAKTIKGYGLSEEIEAVNKTHQIKKMQIDSLRYVRDRFNLPFTDEQLEELPFYRPSENSPEMKYMKARREALGGYLPARRRESESLAIPDLSVFDAVLKGSGGKEQSTTMVMVRLIAALLKEKAIKDRVVPIVPDEARTFGLEGMFRQLGIYAAHGQKYTPEDQEQLMHYREAKDGHMLQEGINEAGAMSAWAALATSYSTNNLPMIPMYMYYSMFGFQRIGDIAWAAGDAQAQGFLLGATAGRTTLNGEGLQHQDGHSHILANTIPNCVSYDPCFGYELAVIVHDGLQRMYVNQERVFYYLTVMNENYEHPAMPEGVEEGIKRGMYLFEKDEKATVQLLGSGVILREVIKAAKILRDEYQIHSNVWSVTSFNELARDGMACEEYNRLHPLAEEVKESWVSKQLRGTEGIVVSATDHMRAYSEQIRAYLPDGRPFVALGTDGYGRSDTRANLRSFFGVDAAHIVVATLKKLADEGEVDARLVKDAISNFELDTDRPVAWAPQAHPEVQPVAEYNETQTGEGN

SEQ ID NO: 6038 - protein, 262 aa, Acinetobacter baumannii
NLALFLQRSNQHSNNNRFKRMKSHLRVHYFQHIAGEGFGSCYSFLKAHHATITATEFFALPVDLPLEIEALPHIEDVDLLLIMGGTMSVNDEANYPWLKIEKRWIRRYLAAGKPAIGLCLGGQLIANALGAAVSRNRYQELGWSTVQRVPNLPKESFLLPEKINVMQWHSETFEIPKGAIHLAENSVCRNQMYQIGSNVLGFQFHPEMTPKVLNLLLENEQELSIFKGEYVQSLDELHHCDIQKFEQGNQLLNRAIEFVVNQ

SEQ ID NO: 6039 - protein, 233 aa, Acinetobacter baumannii
QMQFVHRHKSHKVYGMSDVIKDLSELRLSYEQGELYETQVASNPHEQFLGWFNHALAANLHEPYAMSLATASASGRPHVRTVLLRGATEAGYDFYTNYDSQKGIDLAENPYAELLFYWPSLERQVRVGGHVVKIPEQESTDYYHKRPRDSQIAAHISTPQSGKIESRELLQQRFQDLQQQVQSHEVLDKPEFWGGYRLQPDYYEFWQGRPNRLHDRLSYEKIDGQWTLHRLMP

SEQ ID NO: 6040 - protein, 69 aa, Acinetobacter baumannii
IYFTQFAIATAARMPPVSLRYMEVTSVKRMSFVTFAHSKVRHYLHNYNLSERCICGRAVNPYPQQPLYK

SEQ ID NO: 6041 - protein, 484 aa, Acinetobacter baumannii
IVVTVFYMQSLNYRNNDASQHGSSAPLKRAMSTRHLVMISLGGAIGTGLFLGSGDVISQAGPIGAIISYFLGGLIAYTVMLCLGELAVHVPESGSFGEYARRYIGPGTGYMITWLYWLTWTATLGTEFTAAALLVQEWFPSTSVWAWTLFFGALVFFLNVSSTRLFAESEFWLALVKVITIICFIGLGLLAIFGFIPYQGHETAPLFSNLTAHGWFPNGLFPIFATMLIVNFAFSGTELIGVAAGEAENPAKTVPKAINAAIWRLLIFFVGTIVVISSLLPYHLAGLSANDVSSSPFVTVFNYIGIPYAEDIIRFVIITALLSAANSGLFAASRMMWSLSAKNQLPKIFAKLTPSGTPIIAIIVTMFGAIPGLLSEQFAPETIFKNLLGVAAFTMVVVWIAICISQFNFRRQWYKSGKTVKDLRFAAPLFPLTPIVGGLFCIVTCISMVFDPSMQVGFICCIIFILLCYVSYFIFYRKKDIAQN

SEQ ID NO: 6042 - protein, 319 aa, Acinetobacter baumannii
CAVTFLRYDLTPMSHISVLLFETVESLLADRTTGVYIDATFGRGGHTRLLLSKLDENARVYAFDKDPQALEVATALAQEDPRFTIIHASFADIKEKMQEIGVQSVDGIMADLGVSSPQLDQAERGFSFMQDGPLDMRMDNSKGLTAAEWLLEVEEEDLANIIYQYGEERYSRRIARAIKQAGKLDTTAQLAEIVKTAHPKWEKHKHPATRTFQAIRIAINKELDDIEVFLPQAVDLLKPKGRLSVISFHSLEDRLIKQFIQKESTLAEDSGWGMPQQQVDTRRLKKISRVRASEEEVKANPRSRSAWLRVAERLEQKGA

SEQ ID NO: 6043 - protein, 214 aa, Acinetobacter baumannii
RYRTSYHQGLRGNTVNLKTVSGSAVELSEVAFGREFNEALVHQVVTAYLAGGRQGTRAHKSRADVSGGGKKPFRQKGTGRARAGSIRSPIWVGGGKTFAARPQDWSQKVNRKMYRGAMQCILAELVRQDRLVLVEEFAVAAPKTKELLAKLNDLNAARALIVTDAVDENLYLAARNLPHVDVVDATAIDPVSLIAFDKVVMSVAAAKKIEVELG

SEQ ID NO: 6044 - protein, 409 aa, Acinetobacter baumannii
QVFTFTVPDFSIGRFMNRSLFIIFATIALDAIGIGLIFPILPLLLQDMTHSTHISIYMGMLASLYAAMQFIFSPLLGALSDRWGRRPVLLISLAGSAVNYLFLTFSHSLILLLVGRIIAGITSANMAVASAYIVDVLHENNRAKYFGLINAMFGAGFIIGPVLGGFLSEYGLRLPFFAAAILTGLNLLSAYFVLPESRKVTLENKQLSTLNPFKIFAGISSIRGVLPLITTFFIFSAIGEVYGVCWALWGHDTFQWSGFWVGLSLGAFGLCQMLVQALIPSHASRLLGNRNAVLAGIACSCFALAVMAFAQSGWMIFAIMPIFALGSMGTPSLQALASQKVSADQQGQFQGVIASTVSMASMIAPMFFSTLYFQFQEKWPGAIWLSVILIYLLTLPIILYSTRPVVQQR

SEQ ID NO: 6045 - protein, 1295 aa, Acinetobacter baumannii
NHGTRFIMGNIMKLKLKNFKPNNLWYAVCSSSMIFTWLMTSSVVQASDLQIYASPTAGKKTIVMMLDTSGSMTNNSYGENRLAMLKNGMNAFLASNNPVLNDTRVGLGNFSANGDSRSGQILVAAAPLGDASTLNTVGSQRYKLKQAVANLTAGGSTPSAHAYAEAAAYLMGTTTYSETNYAIRKDSYIKRVRRSDNRTEYSYCTNYRDSQIDTANLWQPCRSNSYWSSWSTNNPGVDNATAYDTSSDWTYYYTYYYTTFNYAVANADSGIPKSKSNDTASNPNIVVDRNATNSNAVYQSPLPAVANRQSCDGQGIYFLSDGEPNNTTNTRSASVMSTALGSTFGADFNCSGGLSNTTADSGWACMGEFAKRLFDKTKNPAGVSIQTAFVGFGSDFSSLSSSDVKNACRLSSRTQSDRKGDDACSPNQSTNAVAAPGYGNGGFFPTQSSQGVTDSVIAFINNLDKVPLEPLTTGAISVPYDALNPKNLQEYGYLRAFEPNPANTYLTWRGNLKKYHVVLSGANAGAFEANSGGLVYNASGAFRTGTKDYWNSSTYTDGGKVFLGGSYANVPLPIAGQPETRDAEGNITKYYYAVQSKIRNLFTDVSAVAADGSLTKISTSGTNLLKIPAVPPEGTNPFDTVANTASYVLGKFDPSTGQNILKAFPISLKLKILNYLGYSTDINATTLPSSLVTSNEPYLSMGGSIHSLPVQLTYNGTLDDNGNLTSAREQSILYGTMEGGLHIVDASSGIEQMVFVPADILNDSVASKALVVGQSDASAPAHGMDGAWVSDPAYNITTVGSGSSAVSKVTAKQMNIYGGMRMGGSSYYGLDVLSPTSPKLLFRIGADQTDYSRMGQSWSKPVLANIRYNGSIRRVLIVGGGYDQCYEKPNITLTDACFTNGKAKGNAVYIIDAKTGQRLWWTSDTGSNTDNANMKHSIVSRISTLDRDADGLVDHLYFGDLGGQIFRVDLNNNQTKTNSTYSSFGVRVVRLANLATNDSTYDGTNDYTGGNVRRLMELPTVTIHDYGIHTFITVGIASGDRSTPLDVYPLTGREGMLPASALSGRPVNNVYGIIDRDFVKKNLMSLTDNQLETKDITRTGLRKNPQILRTGETRVAQIFFPTTGVGKGGWYRSLSSTSDGTEKANNSFRIKGGLKAFEEPMAITGNLIIPVYDPQGTGIVAADPCLPRVVGETDRQTYCLPFGACLNSDGSIDQNKENHSGFETQTGTNCPVGASECNKNVIGSGIRSVTFVPTEDNPPTTNSCGKLKLSGNEQGTGQWQCTSHLVPTRWYERYR

SEQ ID NO: 6046 - protein, 336 aa, Acinetobacter baumannii
IVLTANIYEKFPCFINFEAVMEIVLANPRGFCAGVDRAIAIVNRALECFNPPIYVRHEVVHNKFVVDDLRQRGAVFVDELDQVPDDSIVIFSAHGVSKAVQQEAERRGLKVFDATCPLVTKVHIEVTKYAREGTEAILIGHEGHPEVEGTMGQYDKLKGGDIYLVEDEADVAALEVRHPEKLAFVTQTTLSIDDTAKVIDALRAKFPNIQGPRKDDICYATQNRQDAVRDLAEKCDVVLVVGSPNSSNSNRLRELAERMGKAAYLVDNADQLEQSWFNDTCKIGVTAGASAPEILIKQVIQRLQDWGAQAPKELEGREENITFSLPKELRIHVTQA

SEQ ID NO: 6047 - protein, 200 aa, Acinetobacter baumannii
IRVTPMSNILVINGAKQFAHSNGELNDTLTTLATNHLTELGHEVKVTRADSDYNAEAEVEKYLWADVVIYQMPGWWMGAPWTVKKYIDDVFTTGHGSLYANDGRSRSDASKKYGSGGLIHDKKYMLSLTWNAPMEAFDDADQFFHGVGVDGVYLPFHKANQFLGMSTLPTFIVNDVIKMPDVDSYVEAYKAHLNTLFAAA

SEQ ID NO: 6048 - protein, 739 aa, Acinetobacter baumannii
GITTKNIFKDYLIGDGQTMNHVFRQFSMGAVAIAIMQAASAQVSMTNIVPMQIAGQGTEIRVMFNGLPPQPQAYQLENPSRLILDFDKAQQGLKQSKISVATNEASSVDVTSDDQRSRLTVNLKDAGAFTTRVEGNTFILKINSAQTSNKPLPVVSAQPQGVSNIGFQRGSQGEGLVVVDLLGSNTPVDVQQQGSKVVIRTIGTKIPTHLARRLNVNDFATPVSSIDAYNDKGVGVITIQSSGSYEYMAYQAENKLTISLKRPQDKNVTSLYKTPNYSGNKLSLDFQDIEVRRVLQLLADFTGINMVAADSVQGNITLRLKDVPWDQALDIILKTKNLDKRRNGNVIWIAPVAELIKAEEEEAKAVAQSVKLAPLQTEYIQLKYAKAGDIMGLITQGSNNSNGLQHTSGGGTSTSTNLNTGVDSLGNNVGSLLSPRGTITQDDRTNTLIINDTAQSIDQIRKMIDLLDVQVKQVMVEARIVRASTSFTKELGVKWGILSQGITNNNNLLVGGSETTLWNLREPKKDETTGGYKYTIERPDNLNVDLGVSNPAGSIAFGLISMSDFMLDLELSALQADGYGEVISTPKVMTADKQTAKVATGQQVPYQSTTNSAAGSTATTSFKDALLSLNVTPSITPDGKIQMKLDISKDSVAGAAPNGELILNKNNINTNVLVDNGETVILGGVFEQTTMNSQTKVPFFGDIPVVGRLFRKDVKSDDKQELLIFVTPRIVNDTLARNH

SEQ ID NO: 6049 - protein, 214 aa, Acinetobacter baumannii
LMATINLLPWREELREQRKKQFITLCFGVVVLGITTVFGGWFYFDHKLDDQEQANQLIMSTNQNLDQQLKTLNGLQEQRDAIIERMKLIQGLQSQRPVVVRLVDELVRVTPPAMYLTKFSRTGDKFTIEGKAESPNTVAELLRNLEASPWYRNAFMNSFLANEEKKDKAASSLLPRVEDHYGSFVVTVDLGEMGVATTDDSAKPSTGESVGAAK

SEQ ID NO: 6050 - protein, 213 aa, Acinetobacter baumannii
LVGFTHLCLNKKIRFIVIRISIMPVFNKNGAVCALTALLTVGCSTVSKTVSDTAHALTTMHTKKVVDVNEVTANGIGKKIGTISFQDSDKGLIITPALADLPSGTRGFHIHENPSCAPAVKDGKPGAALAAGSHYNPNQAPHHGTPTTGHLGDLPALVVDNTGVATTAVIAPRLKLADIQGRAIMIHAGGDNYSDSPLPLGGGGARIACGVIK

SEQ ID NO: 6051 - protein, 118 aa, Acinetobacter baumannii
TLGTKRRVMKSSDEIETTENKVVKKVVVYAVMVALVFISAMMVVFQVFEYRHDYRELSSYMRERDDLNAEWGRLLIEQQTFGATAQIGTRAVTQLRMFSPPAAETVVISLPMTSEQNK

SEQ ID NO: 6052 - protein, 243 aa, Acinetobacter baumannii
NRGTSRKYLQLKLFSLNARYTTIAKIFYHIRKNIMSGLLFVVSAASGTGKTSLVKALLDRVSNLHVSVSHTTRGQRPGELDGVHYHFTTKDEFLDQVNQGGFIEYAEVFGNYYGTSQATVKQQLAQGHDVLLEIDWQGAEQVRKLFPESKQIFILPPTQFDLRQRLSNRGTDSVEVIEHRLSCAVEDMQHYVNFDYIIINDDFNKALHELEAVITANRLVLSQQAKRHQNLIQDLITPQPKQE

SEQ ID NO: 6053 - protein, 684 aa, Acinetobacter baumannii
GDMTSVHQLQGVGSASAALLEKLNIFTTDDLLFHLPRDYEDRSTIIPMNQLVVGRSYLLEGEVKSVDFPPGKRKSMAALIQDEFGKVTLRFYHIYKNLTDKIKPGNRLRIFGEVRVGARGLELYHPEIQLINEHTPLPKTQLTAIYPSTDGLTQAKLREYVKQALKHHSDALPELLPKQYTKWVCPPKKLYFTFTEPPLDANMIQLAQGSHPAQQRLIFEELVAHQISLLTRRAYIRQIASPAFPSSKVLAKKLLEALPFQMTNAQKRVSKEILNDLKQHQPMLRLVQGDVGAGKTLVAAVAACHALEADWQVALMAPTEILAEQHYLNFKRWFEPLGITVAWLSGKQKGKARAHAEQQIKEGHAELIVGTHALFQDNVEFAKLGLVIIDEQHRFGVDQRLALRNKGAEQLTPHQLVMTATPIPRTLAMSAYGDLDTSIIDELPPGRTPIQTVTIPLDRREEVLQRIASNCREGKQAYWVCTLVEQSETLDAQAAEATYQEMKERFPELNIGLVHGKMKADEKQAVMQAFKNNELQLLIATTVIEVGVDVPNASIMVIENAERLGLSQLHQLRGRVGRGAKASFCVLLYKPPLSQNGQERLSILRESNDGFVIAEKDLELRGPGELLGTKQTGDMGFRVARLERDDHLLSQAHYVAQQVLKDYPEQADALLKRWLPKAPRYAYV

SEQ ID NO: 6054 - protein, 207 aa, Acinetobacter baumannii
PLMTRIALLDYGMGNLHSAAKALEYVGATVDVTNDPKLIAQADKIVFPGVGAMRDCMQGMREAGIDEVVRKAAFNKPVLAICVGMQALLQSSEENGGVDALGIFDGIVKHFPQMEGLKVPHMGWNQVHQMDPSHPMWNNIEQDARFYFVHSYYVEPKDENLVAATCEYGVNFCTAIHKDNLFATQFHPEKSHTAGLQLLKNFVEWNI

SEQ ID NO: 6055 - protein, 441 aa, Acinetobacter baumannii
NDVTKNCSNEKQAHVIFTKGLPTEKNNVDMNLNTQILIAAILGLAFGFLLTMYPDTAFVKHSLYGLGILSSVFIGLLKMLLVPLIFSSIVVGVSNLQAGGQLGPVWKITFLCCITTTTLALILGISCAHVFEVGRGVDISIFQASMQSYQTPDSLNPATFFTNFIQNTLINPFKAFSDGNVLAVVVFALFVGVALVHGGERFKSIRVLSHQFFEMMMMLVGWVMKLAPLGIFALLAKLMATEDISVLSRLAEFAAVVTGTTIFHGAVVLPLLLWIFGRMSPWTFFKGTRTALITAFATSSSSATMPLSMKCAQENLGVRPQTAGFVIPLGTQLNMDGTALYEAAAALFVANLVGLDLNLTQQIVVCLTAMIASLGAPGIPSAGMVTMIMVLQSVGLPAEAIAILLPIDRLLDTVRTVVNVQGDMMISVVVDRYTKDKDISI

SEQ ID NO: 6056 - protein, 276 aa, Acinetobacter baumannii
LNVTTQNLMCPVCRQRLELVSKTWRCEQGHSYDIAKQGYVNLHVVQHKHSKNPGDTPESVDARRAFLQGGYYQPLQQAVVHLLKQLKAKMVLDIGCGEGYYTSAMQQVVEQCIGVDIAKNAVQRAAKLNDKVTWVVGTGATLPVIDQSMDVCTSLFSPIPQTEILRVLKDDGYLIVVTPATDHLYAMREALFEQVNPHTPQKFVEQLQDLFELKEQQVIDAPLVLDQQALKNLIAMTPYAYKASPERRMQLEQKAHLQVTASFQIYLFQKRNKKAI

SEQ ID NO: 6057 - protein, 124 aa, Acinetobacter baumannii
KKVTKVGHYVRSLVMDQSQVEQILRNPKFQKMVKKKSALSWTLTIIMLVLYVGFMLLVGYNKEFLMSSFSGGVTTWGIPLGLGIIVLSFLLCGVYSYIANNTLDQLSEEALKEVEAITHEKGLH

SEQ ID NO: 6058 - protein, 344 aa, Acinetobacter baumannii
QITTRKRWLGMPQLKNYTGSVYGGLGHLLKAYCEANELTIPEQLEQIQNLERFDYVVWRDLLEVIYKLDPKPGLGLEIAKYVQPKHLGIIAYLALSCDNLGEALIRYHDFHRLIYDGSPLVVELQGRYGSIRWEAPELHPTQLTDEIAIALVIQFLRLFMSHEDVQLYEVRFLNAAPKNIRVYEQYFQCPVRFSQPRTELLIPITEIHKPLSSADHTLQQLLVQQAQALLEQLPNSTQLDQRLQHSILTGLQKNQYQIEYIAAQLGLSVRQLQRHLQQQSTTFQERVQQVRFMLATEYLKDPHLSLQEIALLLCYSEQSAFQRAFKHWTKQTPQQWRDQFLNKE

SEQ ID NO: 6059 - protein, 233 aa, Acinetobacter baumannii
LSYFKWNVFMLFSQELWQRNLNLYQKILDLPFNQELANGTLDKEAFCHYVIQDAQYLVAYGRVLAVAAAKAFDADDIMQFSDAAKIAIVVERSLHDDFMKNYGVTKEEFKNTPLTLAGHHYTSFLTATAWSESYPVVLAALLPCFWIYAEVGKDIVSKSVPNNPYQAWIDTYAGEEFHTAVRNVIATVDKVAARCDADTLEKMHAAYTMGAKLEWLFWDSAYHQRQWLGLDQI

SEQ ID NO: 6060 - protein, 144 aa, Acinetobacter baumannii
LLRAISNSHGVLLPRSAIFMSVLFCLLIFQSLWNIAAAFCAHENQEKALHHFGHHAALNVYQTSSHTHVEHTETLDAAHKAPLNLQDHHDHLPTCFHVVMTEVAKQAQTPVLHVHELSQIYHWSNSYQSPHLNALKPPPVLTPL

SEQ ID NO: 6061 - protein, 78 aa, Acinetobacter baumannii
VELATWTIFATESRTLTTRLIIKATTWTIITTTFTTFEVAFTLETTTTAETATTTTITTTVTTTTAFTTWTSWRWRWL

SEQ ID NO: 6062 - protein, 439 aa, Acinetobacter baumannii
ARLAQYLTHEDEVIMTYKDETLAIHAGYTPEATTKAVAVPIYQTTSYAFDNTQHGADLFDLKVQGNIYTRIMNPTTAVLEQRLAALEGGIGALALASGMAAITYAIQTITEAGDNIASVSTLYGGTYNLFAHTLPKQGIEVRFFDYQKPKSLRNLIDDKTKLVFVESIGNPLGNIIDLEEISKIAHEYGVPVVVDNTVATPALLKPFQYGADIVIHSLTKYIGGHGNSIGGAIIDSGKFPWGKYPERFKVLNTPDPSYHGVNYVEALGEAAYIARARVVPLRNTGAAISPLSVFLILQGLETLNLRMERHTENAQRIAEYLQNHPKVKWVNYAGLKDHPQHQLAQKYVKGKPSAILSFGVQDGREGGTRFIDALQLFTRLVNIGDAKSLACHPATTTHRQLNEQELKAAGVSEDMVRLSIGIEHVDDLIADLEQALSSV

SEQ ID NO: 6063 - protein, 116 aa, Acinetobacter baumannii
THYLQQPNPEKTMLTIIAEIRTQSGGQHRQNVLDAFQKIIPTVLAEDGCHGYEPLVDHISNASFQNKDPDIIVMLEKWESVAHLEAHLATPHMQAHHEAVKDDVVDVKIKILESGV

SEQ ID NO: 6064 - protein, 298 aa, Acinetobacter baumannii
NGYAFMHYSLSKSSNLYCSGCSMEPMVVMAARAAQTVGQELLKAHQNRHKLDLQVEEKGIDGPVTRVDRYLEQLTIDTLRKSYKNHSFLGEEFGLQEGKGHDADWCWVIDPLDGTQNFINGFPHFCISIAVQHKGVTQHGVIYDPVRDELFSASRGRGAVMNQRRIRVNVKDSLENTFLAVGHPYRAKRAGEIVSYAEQHFASLLAVTQAGAQIRRGGSAALDLAYVAAGRFDGFFELGLKPWDIAAGELIIKEAGGVVVDARGGNDSLENGQVIACSLKMLKPLMQTVVPAWDKAAK

SEQ ID NO: 6065 - protein, 351 aa, Acinetobacter baumannii
LIVAKHYGGIFDYDLKKERLEEVLRELEDPAIWNDQNRAQAMAKEKGELENVINVLDGLSTQLEDAKAMLDLAVEADDESLLEDVQSELSTAEEELAKLEFRRMFSNPMDPNPCYVEIQAGSGGTEAQDWASMLLRMYMRWIERHGFKAELMEVSDGDVAGIKSATIRVEGEYAYGWLRTESGVHRLVRKSPFDSGNRRHTSFSAVFISPEVDDNIEIDINPSDVRTDTYRASGAGGQHINKTDSAVRLTHIPTGIVVACQNQRSQHANRDHAWKQLRAKLYELEMQKRNEAAQALEDSKSDIGWGSQIRSYVLDDSRIKDLRTGVENSNTGAVLDGDLDRFIEASLKQGL

SEQ ID NO: 6066 - protein, 82 aa, Acinetobacter baumannii
KRLADLKRNFWSYCAVLLFARALENGLSKDSKLVMLCVLNNTFFDGVMVMADDTDLKANHLHLLAQLRNLFTAVADVSVLQV

SEQ ID NO: 6067 - protein, 436 aa, Acinetobacter baumannii
LFEANRLATPFWYNTALHLLKPFYRWRIKRRAESLELYQQECLERFGPFEAPKNVKAIWFHAVSVGETNAAQPLIEYYLKLGQPVLVTNTTKTGQARAKSLFLKEPYLDLFQAVYLPVDQKPLLKKFFELYQPKLLALVETELWPNLIDQAKLQHVPCLLLNARLSEKSAKGYGKVSGLTAGMLKQLDWVLAQDSATRQRYVELGLDEHKSQVVGNIKFDIHAPEAFVKQAAQLHQQWYLENRQVVTIASTHAPEEQQILEALVPYLNSDRELVCIVVPRHPERFDEVFEICQNLNLITHRRSMGQSIHASTQVYLADSMGELWLWYALSQVCFVGGSLNEPGGGHNILEPMVLNVPTVVGPRYFNFQTIVDEFIDENAVLIAQDAQQVVDIWLACLAEPEATEQLVVQAHKVLQRNQGSLQKHIGVINRYLAEKS

SEQ ID NO: 6068 - protein, 198 aa, Acinetobacter baumannii
NGFYTMNSICIFCGSSLGSNPIFQQIAQLTGEAIAKQGKTLVYGGGRSGLMGVVADSALQAGGQVIGVIPRALVDRELAHPGLTKLYVVENMHERKTKMADLSDGFIALPGGAGTLEEIFEQWTWAQLGIHQKPCAFLNVAGFYEDLLKMIQGTVDNGFSQARFVDKLIASDKIEDILQQFEQYQAPAPKWTNADVQP

SEQ ID NO: 6069 - protein, 305 aa, Acinetobacter baumannii
PQLYLLLMLEMIMKKLGLATAVLLAMTGAHAYQFEVQGQSEYVDTTANDKNFTGTAQGTYYFKNVDASKGPLAEAAFLNQASNVSVAYNYIKYDEKDTVNVESHTYGVKGEAYLPTPYLPVYASASYNHTINDFKDGVSDDNGDRYALEAGAMLLPNFLVAVGYTSVADQISLDAFGVNKYGIAKAVGESVAIDEKQDAVTARTKYVGNIDGTNMAIGFEAFGVFAEDNAYGMKTDLFVTPKLSVGASFADVSAFNSGYDHVWGGHTQYFITPAVAVGADFVKANAKDGNPRDTQTIGLNAKFRF

SEQ ID NO: 6070 - protein, 96 aa, Acinetobacter baumannii
DTPYRKTGERTMSEKTVRTLTGKVVSDKMDKSIVVLIERRVQHPLYGKSIRRSTKLHAHDENNVAKIGDVVTIKESRPISKTKAWTLVEVVEAAAE

SEQ ID NO: 6071 - protein, 1172 aa, Acinetobacter baumannii
GFTYVGHMNSWLIIGVLTLYIALLFVCAFFGEKHASRLSTRGRMFLFSLTLGVYCSSWTFYGATGAAVREGVIFLPIYLGPLLFVWFGYDIWRRLGRVRQHHAISSIADFVAARYGKSGVLASLVTILAVIAIIPYLALQLRAIALSTSVIMEQSSHIHTTTNSVLLLTSVLAILAMIFGTRQIANTEQHGGLMLAVAFESFVKLFALLCVALFFIFESPANLSQMTSDVNQTFQEVQLFGVPETFWIQTLLAGLAIICLPRQFHVAVVELRDEKHIRGARKWFAVYLILTILAIIPIASWALHAAPKFLTVPDVAVLSLPLSYNQEWLALLAFLGGFSASTGMLLVSSVALSIMLSNDLIMPALWRFKLLSRHDKHLPKVLKFSRRISIVAVMLLGFLFFHFFNDINQLSVFGLLAFSAVAQFAPALIGGLYWRGGSRQGVYAGLIIGFLMWSYTLLFPTILRSLPEAYQETAQSILLFGPFGINALRPESLFGFESFAPLTHGVIWSLGLNIVLYIWISKIYRPSVAEQIQAESFFYYETKPLPSPHTSTDLTYLPHDAARLKVGDLFALAKRITGEQPTTQAFENFCEQNHLTLNPNSIANGMWWRFTEQYLAGIIGAASARTLLTTAMINNGLALGQVANILDQASQWQRFNQNLLMTMIDHMTQGVSVVDKNMCLVAWNNQYLKLFGYPKDLVYVGCPIADLIRYNAERGECGPGSVEEHVRKRLHWMKVGSAHEFERIRKDGRVIQMRGNPIAGGGFVTTFADITAFRANEAVLEARVKDRTQQLADALTEQQLAREQADMANMSKSRFIAAASHDLLQPMHAARLFSTVLEQSISTEEDRQTLQQLDRALYGAESMLSALLDIARLEGGTIQPKRQPYPLHDLLSDLELQFKSIAAQRNILLKVHDVSFWIDTDPQWIRRIIQNFVSNALRYTAKGRVVVGVLRSAQQSGHIRIGVWDTGPGIAEEQRIKLFQEFERCGHLSPWGEQGLGLGLAIVQRMTGLLNYPVHVYSELGKGSCFMIEVPIVEPPKVATPAVQAVPLKTKAYRILCLDNDETILEGMSSLLGRWGYQVFKATEPEQALEIIQKENIQVWLIDQHLNHNQLGVDFITQNRQEDVPVALITADSHPELPQQLKELNIVLLKKPLKPASLRAWLSGLKIASTTD

SEQ ID NO: 6072 - protein, 317 aa, Acinetobacter baumannii
SLNFITLNKLIMHAGKDMETIHDFYRRFSLTRDSDYSVPSTSFGHFNVFQRDACSFLTPYSRRDYYKISLVLGTGELHYANRWIRVDHPALLFSNPMVPYAWEINSPEQAGWFCLFTEEFVNQESRQSFLKDSPLFKVDGDPLYFLNDQQVEEISFIFKKMMNEINSDYIHKYNVLRNYLHLIVHEAMKMQPTQQFEKHSNASVRICHLFFELLERQFPIDSPHFQLKLKTANDFAYGLSVHVNHLNRAVKEATGKTTSEHISSRITQEAKALLQHTSWNISEIAYSLGFEYSAYFTNFFKKNTGFSPKKFREDCVA

SEQ ID NO: 6073 - protein, 265 aa, Acinetobacter baumannii
YINYDFKREYIMSLVVPAEHPETVHNETDRVERILVVDDDVRLRTLLQRFLEDKGFVVKTAHDASQMDRLLQRELFSLIVLDFMLPVEDGLSICRRLRQSNIDTPIIMLTARGSDSDRIAGLEAGADDYLPKPFNPNELLARIRAVLRRQVREVPGAPSQQVEVVSFGPWSLDLSTRTLTREGQIVTLTTGEFAVLKALVQHPREPLTRDKLMNLARGREWGAMERSIDVQVSRLRRLIEDNPARARYIQTVWGVGYVFVPDGAE

SEQ ID NO: 6074 - protein, 223 aa, Acinetobacter baumannii
VRDYLKEWFQVNTLFKQTLTASILSTMIAGTAFAAPSEAPPDFIKRVADGLISRLKADHAKLQNNPALVKTIVRQNLDPYVDSQAFTRIVMGTYATNQYSTAAQRAQFETNFRNTLIENYGSAFAKYTNQTYTMRPYKATAGKNPVVTLDFNHNGEKIPVSFQLADKGSQWKIRNINVSGIDLGLQFRNQFAATVKRNGGDLNKAIATFQPDADAAVNQNKQK

SEQ ID NO: 6075 - protein, 64 aa, Acinetobacter baumannii
KLSYQLKKLKEFENKKESLTLSFLFIKVDTSDGYHLAQSIHELHDIQSRSTQHQLHPHRTQSMR

SEQ ID NO: 6076 - protein, 446 aa, Acinetobacter baumannii
AMSYFGTDGIRGKFGQMPITPEFALKLGFAAGKVLKRTSPKNKPLVVLGKDTRLSGYILESALQAGLNAAGVYVHLLGPLPTPAIAHLTRALHAHAGIVISASHNPYFDNGIKFFSSEGKKLPDSLQEEINKELEKDLFIEDTANLGKSVRVTDANGRYIEFCKSTFPYHFDLNNLKIVVDCAHGAAYSVGPSVFRELGAKVVALYNEPDGLNINENCGSTHPESLQKAVVEHGADLGIAFDGDADRVVMVDKFGNLIDGDHILYILATQAKNKPAGVVGTVMSNMALEVALEKANVGFVRAKVGDRYVLQALEENGWVTGGEPSGHILTLDKSTTGDAIIAALQVLTVMVEQNKALHELVNGFKLYPQVLVNVRLEQMLDPYSIPALVAEFNKAEEQLKGRGRILIRKSGTEPVIRVMVEGDNEQEVKTLAEHLANAVRSQAQVA

SEQ ID NO: 6077 - protein, 177 aa, Acinetobacter baumannii
EPLYKLVGFFNIKNKSAVIIMNTTSIKKFYRIDAYLVLCHILLLASGYGLWKLYPHIQTKPDMSGLFFMIISILGGFAGLIMLAITLPRLERSVRNLSVNKFILALLYWVSSTIIFVLFGISKFFFNNPLVLLVFVLVFFSSVYLSVIRLADMRKKDWLILSGIFGAIVLFFFLPEL

SEQ ID NO: 6078 - protein, 375 aa, Acinetobacter baumannii
ITAYPLRCTVSVIHPEWLQILKPNFKVLPLKERLLCGVGALCGLAISSLISWYVLGGINAWYIAPMGASSVLLFAVPTSPLAQPWNVIVGNTLAGIIGVACAQWIPDLTTAFSVAVGFAIFLMMTTDSLHPPSGAVAITAVLGGAAIHKLGFYFVFYPVLLNSLLLLGFAVFFNRLIGRHYPVTAHLNERSKDPTPTQKVSIQPKDIEYALEHHTELLDISQYDLEKIILEAQEHANERMVNQYTCQDIMSRDVIKLHENDDIHQALDKFKQENLMSLPVVNADNHLVGTLALYEVVEWFKGATDPRNSWQHYVRQIMSRRVVTVLPTQPIQDLVPYFVEKSFNYIPVVEERKLIGIISRADMIAALQQQLNRKL

SEQ ID NO: 6079 - protein, 334 aa, Acinetobacter baumannii
KMKYRTLGQTGEKVSALGLGCMGMSFAYGASDDTQSIATLEKALDLGINFWDTADMYGNGANEVLLSKVLEKHRDKVFLATKFGFRYKEDNLNPKNSLESYIDGSPEWIKVAVENSLRRLNTDVIDLYYAHRIDPNVPVEDTIGAMADLVKQGKVRYLGLSEASAETIRKAHAIHPIAAVQHEYSLLTREFEQTHLQTIRELGISLVPYSPLSRGLITNTLDVNNLDENDFRRQLPRYQGDNWKNNQSLAQAFSEFAQSKNATAAQLALAWILAQGDDIIPIPGTRKIERLVENAGAVDLHLTAADLAEIDAIIARYPNMGARYNAQQLAAVNH

SEQ ID NO: 6080 - protein, 61 aa, Acinetobacter baumannii
WMTLSQQFGRNIYLNWLMKSGNCKISKRATNVQEEKVLEVSKRSFVLKHKKDDKYIVFFIS

SEQ ID NO: 6081 - protein, 79 aa, Acinetobacter baumannii
SWDFWLGLDILLFDQLVYFSHDNVNTYKKATDNAVAFKFTVCIRTIRVRELCLQLHATYLKLLEKQKHLRPLQGNRCRL

SEQ ID NO: 6082 - protein, 314 aa, Acinetobacter baumannii
ISFQNLAHIPILACFAFVKITTRFPKFSVIVCGHKSAGMIAIMNNKTPLSTQSLIEVKNLSFNRGERVIYDNISLNIRRGQITAIMGPSGTGKTTLLRLIGGQLVPDHGEVLLDGKDIAQMSRQELFAARARMGMLFQSGALFTDMSVYENVAFPIRAHTKLSENLIAELVALKLESVGLRGTEQLMPTELSGGMNRRVALARAIALDPDLIMYDEPFAGQDPIVKGVLTRLIRSLREALDLTTIIVSHDVPETLSIADYIYVVAEGKIQGEGTPEELQAYASPFVKQFLTGSAEGPVEYQFSHQAYLDNEVRP

SEQ ID NO: 6083 - protein, 96 aa, Acinetobacter baumannii
RVVQYLNQELVVSGKIDFENAEQQYQAGLAIIKKQTSFPLIVDLKQLEHGNTLALAVLVQWLRQTPQKSGLHFKNVPEKMLKIIQACHLQEDLHLV

SEQ ID NO: 6084 - protein, 482 aa, Acinetobacter baumannii
RLSQILSMCNMQPSDKQLDAQHQNSTAPLKRAMSTRHLVMLSLGGAIGTGLFLGSGEVISQTGPIGAIIAYILGGAIAYMVMLCLGELAVHMPVSGSFGAYARKYISPSTGYMISWMYWLTWTATLGTEFTAAALLMQEWFPQISMWIWTLIFAVTIFGLNISSTRVFAESEFWLALVKVITVIAFIVLGLLAIFGLIPFHGAQTAPLFSNLTAQGWFPHGFLPIFTTMLIVNFAFSGTELIGVAAGETKDPAQNVPKAINAAIWRLLIFFVGTIIVISALLPFQLAGLGGDNVSNSPFVTVFNYIGIPYADDIIRFVIITALLSAANSGLYAASRMMWSLSEQKLLPGVFATLSKSGTPIVALVVTMFGAIPGLLSEQFAPETIFKNLLGVAAFTMVIVWMSICLSQFNFRRQWYRSGHTVSDLKYAAPLFPIVPILGFLFCFITCLSMAADPEMRAGFIGCLIFTALCYLSYFIFYRNKA

SEQ ID NO: 6085 - protein, 76 aa, Acinetobacter baumannii
LLTHFFLPHINPKSEIRIGSPEAKKGVVINAKVDPANAALRVTLFFKAEKVRAIKIAGKIASKPNVLGSGIALPIK

SEQ ID NO: 6086 - protein, 209 aa, Acinetobacter baumannii
KMAQDYVRLDKDNAAVLLVDHQAGLLSLVRDIDPDKFKNNVLAVANAAKYFNLPTILTTSFETGPNGPLVPELKEIHPDAPFIPRPGQINAWDNEDFVKAVKATGKKQLIIAGVVTEVCVAFPALSALAEGFEVFVITDASGTFNELTRDAAWDRMSKAGAQLMTWFGMACELHRDWRNDIEGLGTLFSNHIPDYRNLISSYNHNTSQK

SEQ ID NO: 6087 - protein, 197 aa, Acinetobacter baumannii
SIYQLFDKSVFIMKKTLVIVTHPHIVQSVINKRWVEELEKYPDQFTVHQIYQAYPDGVIDVAKEQALVEEHENLVFQFPVYWFNCPPLLKQWLDEVLAYGWAYGSTGDKLKNKKFMLAVSAGAQEKVYSEQGEYKLSLDQVFSSFQLTALYVGADYQPLHAFYGLDTNPSEDDDVPTHQDVANNAIEYVQKLLALSE

SEQ ID NO: 6088 - protein, 147 aa, Acinetobacter baumannii
YFCQNVSSIMMKKDLIKEKQMSRQVIHTENAPAAIGTYSQPILVGNTLYLSGQIGLDPYSMELVDGIEAQIRRVFDNLKAVCEAAGGTLADIAKLNIFLTDLSNFQLVNQIMGEYFAQPYPARAALGVASLPKGALVEMDGIVIINQ

SEQ ID NO: 6089 - protein, 524 aa, Acinetobacter baumannii
IKRQNTGLFRYNSSNFYFDPLTMKVRTRIAPSPTGFPHVGTAYIALFNMCFAKQHGGEFILRIEDTDQLRSTPESEKMILDSLRWLGLNWSEGPDVGGPHAPYRQSERMGIYKQYALELVEKGHAFYCFATAEELDQMRAEQQARGETPKYDGRGLKLSQEEVARRLEAGEPHVIRMKVPEEGVCKFNDLLRGEVEIPWAQVDMQVLLKTDGLPTYHLANVVDDHLMEITHVLRGEEWLPSAPKHQLLYQYFGWEMPTLCHMPLLRNPDKSKLSKRKNPTSINYYRDIGVLPEALLNYLGRMGWSMPDEREVFTLQDMMDNFDIQRVSLGGPIFDVEKLNWLNGQWIKGLTPGQLLDRLLTWKSDRSTLEDIAAAIQPRINLLSEAVNWAGFYFNHMPQITAEMFESKKLTQEQVRQSLQFAIWRLESQFTWNNDTVSQTLMDLANQMGIKLRDFMPTFFIAIAGSTSSTPVMQSMVTLGPDLTFARLRHALEIVGAPSKKEVKNWEKLNESLKLPKNEATSEA

SEQ ID NO: 6090 - protein, 666 aa, Acinetobacter baumannii
NNSHSLEMGCTRSRKLRMNEIYPVPEEFKKTARTVEADYFKRYQHSIENPDEFWAEQAKIVDWIKPFTQVKNTSFDKDNFKIEWFADGELNVSANCLDRHLKEHPHKPAIIWEGDHPSRHKIVSYKELHDEVCRFANVLKKYGIGKGDRVVLYMPMVTEAAIAMLACARIGAVHCVVFGGFSPDSLASRIEDSQAKLVITADSSLRAGKLLPLKENVDLALALPGTECVENVIVVYRNANPIEMKPGRDLWYHLIIMEVDANCPPEPMKAEDPLFILYTSGSTGKPKGVLHTTGGYLVYVASTFKEVFDLKQDDVYWCTADVGWITGHSYLIYGPLANGTTTLMFEGVPQYPTWARLGHVVDKHKVSILYTAPTAIRAMMREGDSYVRESNRSSLRLLGSVGEPINPEAWNWYYNVVGEGRCPIVDTWWQTETGGILIAPLPGATALKPGSATRPLFGIQPAIVDGEGNELEGAAEGNLVIKDSWPGQMRTIWGDPDRFIEAYFSTFKNTYFTGDGARRDEDGYYWITGRVDDVLNVSGHRLGTAEIESALVSHESVAEAAVVGMPHDIKGQGICTFVTLQAGVPESEELRKELISWVRKVLGPVASPDALHWAPALPKTRSGKIMRRILRKIAANELDSLGDTSTLAEPAVVDQLIATVYPDRQK

SEQ ID NO: 6091 - protein, 173 aa, Acinetobacter baumannii
SISLFFIDLCVLKALYGCRKGKVKRVDMRFSLYPQRKLRPLLTPHILEIPTMSGKHPLVQAIENSQLKTDLPEFAPGDTVVVQVKVKEGDRERLQAFEGVVIAKKNRGLNSAFTVRKISSGVGVERVFQTHSPVVAKIEVKRRGDVRRAKLYYLRDLSGKAARIREKLPARKA

SEQ ID NO: 6092 - protein, 145 aa, Acinetobacter baumannii
KLSLENNLKNYRNTIMKNIFASLLLVSTVIFSAHIYAEPTSTCKEVKFQKTDQAWSGHYYLHGVMEVGSELLLQPDGKFQWMLAVGALDQYAEGTWWKNGDCIGLKPEAKFKKDLSIFPESLTISDKSLDAIWEGGRQQGTYSKD

SEQ ID NO: 6093 - protein, 65 aa, Acinetobacter baumannii
VNLQIKQDLSRVRRHFSLLRKGEIVNVGFSENYVALVVGCIFIDGNMGQYFALPLGVDDLCCHGD

SEQ ID NO: 6094 - protein, 343 aa, Acinetobacter baumannii
KFLHRRYTFMEGRGILSNFTDVFCRFSMSVYTPLSLDEVRTFAAPYGLEVLELNPIQGGIQNTNYFLVDVNRKQYVLTVFEELDAQGAGELIPVLEQLGTHDVPVAVPLKHSGQAVHFIAGKPAQIAPRLMGHHPMQTTVAQVAAIADAQAKLHVALQDFPLEREYRRDHQYWTGVAEQLKPNMTQDDQTLLEQVYQAFNAKTAQYSNRPTGFIHSDLFRDNTLFEGEQLQGILDFYELNQDELLFDIAITINDFCTEYPAAHLNLDKVDAYLEAYQKVRALTSDELECLDVFLAMAACRFWSMRLQVAQKNKEEGRTGDDILQKDPQEMRAMMQDRLSHIKA

SEQ ID NO: 6095 - protein, 211 aa, Acinetobacter baumannii
TTGLIVVYDECMKRLNKSETTRQHILDTSFELVLHKGFVGVGLQEILKACDVPKGSFYHYFASKEAFGCALLEQYMANYKVRMEQLWQHSEQSAHARLMALWQAWIDDPVHGSWAENCLIVKLAAEVSDLSEDMRQILNDGVHKLTQRLALLLKEGQQEGSIPKHIDPLKTAQVMYQLWLGAALLTKLSQDKAHLHLALETTQQLLKPIEE

SEQ ID NO: 6096 - protein, 104 aa, Acinetobacter baumannii
GDEQKMKIHYGKALSLGLVLSFASQLSTAAVLKDTPSKSLSDKQSSLIEKALDQQKRNTIVLPSTDDELKVLNTIRVTPTQNFLAAQHERFSRFVQAIFQPHTS

SEQ ID NO: 6097 - protein, 423 aa, Acinetobacter baumannii
LLRHSGRYFEVYKLMKNIQTTALNRTTLMFPLALVLFEFAVYIGNDLIQPAMLAITEDFGVSATWAPSSMSFYLLGGASVAWLLGPLSDRLGRKKVLLSGVLFFALCCFLILLTRQIEHFLTLRFLQGIGLSVISAVGYAAIQENFAERDAIKVMALMANISLLAPLLGPVLGAFLIDYVSWHWGFVAIALLALLSWVGLKKQMPSHKVSVTKQPFSYLFDDFKKVFSNRQFLGLTLALPLVGMPLMLWIALSPIILVDELKLTSVQYGLAQFPVFLGLIVGNIVLIKIIDRLALGKTVLIGLPIMLTGTLILILGVVWQAYLIPCLLIGMTLICFGEGISFSVLYRFALMSSEVSKGTVAAAVSMLLMTSFFAMIELVRYLYTQFHLWAFVLSAFAFIALWFTQPRLALKREMQERVAQDLH

SEQ ID NO: 6098 - protein, 138 aa, Acinetobacter baumannii
SMLQPKRTKFRKVHKGRNTGLAHRGSTVSFGSIAIKATERGRMTARQIEAARRTISRRIKRGGKIFIRVFPDKPITEKPLEVRMGNGKGNVEYWVCEIKPGKILYEIEGVNEDLAREAFALAAAKLPFKTTIVTRTVM

SEQ ID NO: 6099 - protein, 216 aa, Acinetobacter baumannii
RFMHMAIGLVGRKCGMTRIFTDAGVSVPVTVIEVDPNRITQIKTLETDGYQAVQVTTGERRESRVTNAQKGHFAKAGVAAGRLVKEFRVTEAELEGREVGGTIGVDLFTVGQIVDVTGQSKGKGFQGGVKRWNFRTQDATHGNSVSHRVLGSTGQNQTPGRVFKGKKMAGHLGDERVTVQGLEFVSVDTERSVLVVKGAIPGATGGDVIVRPTIKA

SEQ ID NO: 6100 - protein, 1515 aa, Acinetobacter baumannii
ALSQKEVVCLTLERALLKEGYAMHMPSPNTVAPAQGLYQPDEFKDNCGFGLIAHMKGESSHHLVETAIHSLSCMTHRGGIAADGKTGDGCGLLLAMPKQFFRDEAKKLSDITLSEIFAVGTVFLNIDPALAQHSKNILTKEIESEGLRVLAWRIVPTNNDALGEIALQSLPAFEQVIVNCPMGVTEVEFNRKLFLARRRAEQQLQNDPLFYVTTLCSTVISYKGLMMPAAIAEFYTDLADERLKSHIVVFHQRFSTNTLPRWPLAQPFRYLAHNGEINTITANRNWALARTPKFENPLLPGLTELNPIVNRTGSDSSSLDNMLEILVGGGMDLFRALRMLVPPAWQNVETLDADLRAFYEFNSKHMEAWDGPAGLVIQDGRHAICMLDRNGLRPARWVITKNDYITLASEIGVWGYEPEDVVSKGRVGPGQILVVDTLTGKVLDTKDVSNHLKNMRPYREWLRDHAIRLNANPELEEQLVDKGLTGDALKAAQKMFMVTFEERDQLLRPIAESGQEAVGSMGDDTPMAVLSRQVRHVTDYFRQQFAQVTNPPIDPLRESIVMSLETCLGREQNVFEQGPEHADRIIISSPVLSNSKMQQIRSIERAGYEAVDIDLNYAETEGLQAAITRICEESAQAVRDGKTLIVLTDKNIRQGYLPANAALATGAVHHHLIKTGLRTDANIMVETGFARDPHQFAVLLGFGATAIYPYLAYDVINDLIAKGELLGDPIHAQANFRKGIEKGLLKVLSKMGISTVASYRGGQLFEAVGLSSEVVDQCFLGVPSRIQGATFVDLENDQKKLAATAWSNRKPIDQGGLLKFVFGKEYHAFNPDVINSLHKAVRSGKYEDFKEYAELVNNRPIATIRDLFKLKTTNPIPVEQVESVEAILPRFDSAGMSLGALSPEAHEAIAIAMNTIGGRSNSGEGGEDPARYGTIRNSKIKQIASGRFGVTPAYLTSAEVLQIKVAQGAKPGEGGQLPGGKVNGLIARLRYSVPGVTLISPPPHHDIYSIEDLSQLIFDLKQVNPKAMVSVKLVSEPGVGTIAAGVAKAYADFITISGYDGGTAASPLSSIHHAGSPWELGLSEAHQALRVNDLRGKVRVQTDGGLKTGLDVIKAAILGAESFGFGSTPMIALGCKYLRICHLNNCATGVATQQDHLRQEHYIGEPQMLINFFHFIAEETREWLAALGVASLKDLIGRVDLLEVLPGETEKHAHLDLSALLTSHPAAEGKAQYCEVEGNAPFDKGVLAERMVEEMLPAIESSAGGQFNFNVVNCDRSIGARVSGEIARRYGNLGMEAHPVVMNLTGTAGQSLGVWNAGGLHIRLEGDANDYVGKGMAGGRISIFPPKGSPFQTQNTAIIGNTCLYGATGGKLFAAGTAGERFAVRNSGAFAVIEGAGDHCCEYMTGGVVTVLGKVGHNFGAGMTGGFAYVLDLDNDFVDYYNHELIDLTRISTESMEDHKEFLLRIIDEHIKETGSAWAYKIRNEFDFYSRKFWLVKPKAANLQSLLKTTQADPQ

SEQ ID NO: 6101 - protein, 361 aa, Acinetobacter baumannii
SMKHFRFSIFFTVVCLALSAYWGFTHGPEAGVSTMLKALTITAILAVMEVSLSFDNAVVNASVLRNWDPFWKMIFLTVGILIAVFGMRLIFPVVIVAVTADMGVVEVAKMALNDPKTYSERLMAHHAEISAFGGTFLLLVFLNFFFDDEKETHWFRWLESKLASLASVPAMSVFLALIALIVMAGYVDDHQRLAVTMAGIWGIVVYIGVEVLSHLLGGEPEIDENGNAVLQDGSGAASGVVKAGLGGFLYLEVLDASFSFDGVIGAFAITSDVVVIMLGLAIGAIFVRSMTVYLVEKGTLDAYVFLEHGAHYAIGALAFIMIASGTGVHVPEVVTGLIGVAFIVWAVIASIQYSKREQQSP

SEQ ID NO: 6102 - protein, 296 aa, Acinetobacter baumannii
VLFKTNLLKLEILLGAFRAVQNDLDLLYRKSESYVWGNSNLSDVLNQPLPLAYCSLIFIKQGSADINILFKNYHVKSGDFLFLSEDSLAILQKRSDDFSCDYCIFNRDFAAEVASVLPNSLFTYLHLFPHFSPEMNYQSLIKTWINQTTFILQSTSEYQRILLCNHLQNFFLVLSETINREKLLSKNEYSRKEKICWQFWEMISLHCKEHRDVNFYAKALNITPYYLSKLSKQFFNDNAKTLIDRQVILKLKELLRTPSNSIQSIADQLNFEDTSYMCRYFKKHTGFTLLQYRKNA

SEQ ID NO: 6103 - protein, 304 aa, Acinetobacter baumannii
CRFNMAISLAAETQPPAFKLYLCIAVTVFCWGYSPIGVHSALHSYTPQHIALLRFLIASFFLLLLVIKKGIQPLKWKDVPALAVLGFFSVTLHHLLINTGQQYVTAVASSILSQSIPLFTFIISVLLFKEQISFKKWLCILLGLCGAVLVLSGDHGFGMPSPYSLLIVLAAIAWGLYFNLYKKFALNYDALSMMCYIIWFGTLPLLFYSAHLPSEILHATWQANMSVILLGIFPSAMAYVLWGYVLKNMPLTIASNFLYCSPIVAMSLAVIFLNEKPSMMVLLGGVIIVGSLVWMNWGNRRTIE

SEQ ID NO: 6104 - protein, 85 aa, Acinetobacter baumannii
QNFLYQLSKQCRWCRICTLFLQTLKSPNKLSKLKRGDLVYLKGDLVEIKDKDLVWKSSLTPTDTGDGACELFRVQSIHWVEKQNI

SEQ ID NO: 6105 - protein, 96 aa, Acinetobacter baumannii
LASKRLLSNKFDIDGAAISAIIAMTAIVTISSTKVNPSCGIIPLIPRTPNKTKIFYFLFKFYFYKLQNKYKTDKGYKKTDNCHVNNYLFNYLKSVC

SEQ ID NO: 6106 - protein, 64 aa, Acinetobacter baumannii
FVANVVSVSFNSPFEWANCLAPLMTKILLMGVTLIQFLNLSDTVENLLLKKNVVIGKILLIKNH

SEQ ID NO: 6107 - protein, 365 aa, Acinetobacter baumannii
WFYKFMQTLHVELGERRYPIFIGSQLDPKQLLEPYIHGQQVMIVSNVTVAPLYLSHYQEALESLGKTVATCILPDGEKYKDIQHLNLIFDALLEAGFNRDCTVLALGGGVIGDMAGFASACFQRGVYFVQVPTTLLSQVDSSVGGKTGINHPLGKNMLGAFQQPQVVLADMAQLNTLPERELSAGLAEVIKYALLGDEDFLVWLEENMDGLVARDADLLAEAVYRSCAHKARIVANDEKEQGERALLNLGHTFGHAIESYLGYGTWLHGEAVATGMVMAADLSQRLGWISNEDVARTKKIIQRANLPISCPQIPLDDFLGYMAHDKKVLNGQLRLVLLKQLGQAVITKDFDVELMKQAILANQHG

SEQ ID NO: 6108 - protein, 323 aa, Acinetobacter baumannii
KKYKKERDLGQEDDNKSKPTTTSTVSGNPDPIKLSFSRRLLHKTLQHAQDAVGFASDTTRNLAEVADAALDALDQVTSHTKRGVVGMTNLAAGTVRDMVSETSETARQVALIMARTFLGKSTLNLYLPEMLLNSQIRKRIDRSEIDDIKVQCGNDRFQVEIDGHYHRFLYRLSLDFRVLECRIGQEKFLRLRQMDESLDVQIRHGGTLSNWAVRRIGRVGFEVINMLPIPSLINHLIRDIPGIQRDGHRMWFIDLEQAGFIDFINNRSWMVEKLLNLTDFSILPGLNILRESRELVQQLVDQFEIKGLRVQSGRLEVQVGIAN

SEQ ID NO: 6109 - protein, 327 aa, Acinetobacter baumannii
LSHKCNNVLLILIYKLQLLRRKINLSSRKSYIYRRDQMKKFLGAYQNNHMHWVGDGFPVYNLFSYDRLGQTLSPFLLLDYAAPYNFSPTTEQQGVGSHPHRGFETVTIAYQGEVTHKDSSGGGGTIKTGDVQWMTAGAGVLHEEFHSPEFAEHGGLFEMVQLWVNLPSHSKMTPGKYQAIEAKDIPDIALDEHGSHLRVIAGEYADAKGAATTFSPLNVWDGKLVKGQKHTLYVPEGHTTLVVVLEGAVVVNDTNRLEGKTVAILSREGVEFSLNAEEDTKFLVLTGQPLNEPIEGYGPFVMNTKAEIMEAINDFNRGKFGSIMQEG

SEQ ID NO: 6110 - protein, 298 aa, Acinetobacter baumannii
SNNKMSSPSQKSQLHALGFLILAMLSVQSSASLAKVLFQNFPVLTVSAMRLCMGAFILAFIFQIWKINFSQVRWKAILSYGFALAGMNALFYLSLERLPIGIAVAFEFIGPLSVALYHAKQKYDFVWVTFAIIGLILLFPFNQAHSLDWIGVLFAMSAGACWALYIIAGQKPSGISGNHTVCLGMTVGACILLPITFFSGSIGQVIELPYFFYFIGLAVLASALPFSLEMLALRNLTPLSFGTLMSLEPAVAALSGFIFLGEYLLWNQWLALATIIAASVGCTITTQRARQQREKTVS

SEQ ID NO: 6111 - protein, 161 aa, Acinetobacter baumannii
LMNKYYILRFNQGFTLIELMVVIVIVAIFASIAIPSYQSYSRRATASAAKSEILKLAEQLEQHKSRNFTYRGFTTTSITLPRGGYTIQITDDTTTGNLLTNAAANGQTWVIKATTTDSRNFNFIAKNSGIRCQSLTVTAVDNDCGGTTTCNTCETNSEVWQ

SEQ ID NO: 6112 - protein, 308 aa, Acinetobacter baumannii
KYSKIKNLSLNNLITYITLEFLPMKKSKFLFAIFTAVSAFNANAYQTEVGTMYEFTDMDGGEVNSFGINGKYYFNPVETKNYPLAEAAFLNKASNIGAGYTYSKVEDDQDYAKLEYNSVGIVGEYFVPNTPLYLSGAFNRTKREVTVDDLGSVNDNGNGYAVEVGFLPTDGLLLAAGVTDLSESFDPVQASKYGFITSFANATTVTGEDDDTAVTLRAKYITQISGFYTNFEGQTYIGDETTYRLGADLYLDPTLSIGASFADSTAEDSDTIFSLRAQKFFTPQVAVGLTYTTVDDANSFGINGAFRF

SEQ ID NO: 6113 - protein, 83 aa, Acinetobacter baumannii
VHINIIFFSRQSFCKYDMSLLFIRAIFCHIVSIKNKKAIFSDGSSLFIEFQFPVNASNPLAPYYIRVGHFATYGQSLNREKPH

SEQ ID NO: 6114 - protein, 445 aa, Acinetobacter baumannii
VIIKKILEKWDIILDIAIIGSGMAGLAAARILKDAGHTITIFEALPGRGMDSHSIEFDGGIIDAPLRVMNPHLWKNTLSLAAHLGIKTFPVRTYMSCSWLFEDRTETWLTTSRSRIGNFPIINNRKGIQQYGWRLVKGMLQLKTAIHQFFKSKNQDITLAEFINQNDIEEVFWHGVVMPVLYTICTCNPKTIGDWPAKNLLEFLRHLTDGDMLLRMKGGTPAFVDSLIKGIDIHSGSAIKKVELQGEKVLVENEKGDQGTFDRVIVATPTSKLEEFLNPEQFAEDMNLLKQFRFEQGDLVIHTDATVMPPRRKDWSVLSYMMDRKFTRQQFTVWMNAVEPSLVGKNPVFQTWRPVVDIDPKKVISKVTLTRAVVDSQTIALNKELQQRHLEPNRKVFYCGSWSCDGLPILESAVTSAMHIAEILGAPLPFVGLKPKVEVAPELGY

SEQ ID NO: 6115 - protein, 265 aa, Acinetobacter baumannii
LLINTLLRCAQFHKHDEARSESMLIIPAIDLKDGKCVRLKQGRMEDDTVFSDDPVATAQHWVNEGARRLHLVDLNGAFAGTPIHKPVVEAIAKAQPELPIQIGGGIRSLETIEHYLEAGVTFVIIGTKAVQEPEFVEEACKRFAGHIIVGIDAMNGMVATDGWANVTDVKATDLAKRFADAGVSSIVYTDIARDGMMQGVNVEQTVNLAQYSGLPVIASGGVTNLDDVRNLKGQPGILGAITGRAIYEGTLNLREAQLLLDENRL

SEQ ID NO: 6116 - protein, 169 aa, Acinetobacter baumannii
IIHKLLLKFEFLFYLFNTSKQKVEIHMFIIRQFTNADLDDVVNLWESCGLTRPWNNPETDIFRKVSQQDDLFLVAIKDEQLIGTLMGGYDGHRGWINYLAVHPHQQRLGIATALVQQLEKRLMARGCPKLQLLVRKDNLNVLNFYEQLGYDEVEAVCLGKRLICDNPHD

SEQ ID NO: 6117 - protein, 88 aa, Acinetobacter baumannii
RYNNETIAMFKPFEKGTESSSIEDLTLENDVDRVSIYGNLQITKDKVGLEQAKALQSFLNDVVAALEKEELPEKIERPAEQEINNPFL

SEQ ID NO: 6118 - protein, 490 aa, Acinetobacter baumannii
CKSNGAICMIQNNLQYLLKHPDISLEAPASNDYIEVNDAATGETLAWVKTYDRAGVEAAINRSAKAQAAWKKQTALARADVLLAWYNLMLEHKENLAQILTAEQGKPLAEARGEIGYAASFIRWFAEQARRIDGEVLTPTLPNQRLLVIKQAIGVTAAITPWNFPAAMITRKAGPAIAAGCSMLVKPAEQTPLTAYALEVLALQAGLPADVLINISGDAVEVGKTLCESDIVRKLSFTGSTQVGRILMQQCAPTIKKLSLELGGNAPVVVFDDANLEQAVQGIMASKYRNSGQTCVCANRIYVQDGIYDALADRLVEAVSKLKVGDGRQEGSTQGPLIDEDAIAKVQSHIADATEKGATVRIGGKRSALGGTFFEPTVLTGVTQDMKVSKEETFGPLAPLFRFKTEDEAVAMANDTEFGLAAYLFTQSTARQWRVGEALEYGMVGINTGAISNEVAPFGGVKQSGLGREGSKFGIEEYVEMKYLCVDLSE

SEQ ID NO: 6119 - protein, 432 aa, Acinetobacter baumannii
YFLNDVINESFDMSDRIREKLQILADAAKYDVSCSSSGSDRKNKNKGLGDASHSGICHSYTEDGRCVSLLKILFSNICIFDCAYCVSRRSNDVQRAAFTVQEVVDLTINFYRRNYIEGLFLSSGIFKSADHTMERMLQVVKKLRLEENFNGYIHLKTIPGASPELIHEAGLYADRMSINLEMPTEIGLKTFAPEKSHQEVQKDLGLVRDRLIQLKDERQIIKHVPKYVPAGQTTQMVVGAHQESDQDVLFMADKHYKEFKLKRVYFSGYIPINTENNYLPAVGSAPPVLRENRLYQSDWLMRFYGFEVNEIVNEKHPNLDLDVDPKLSWALRHPEQFPVDLNRADYQMILRVPGIGVKSAKKIVQARRFGKIHIDLLKKLGVAYQRAKFFIRCEDSPKFQKELSSSFIRQQILTQGSSKYVQQLSPQLSLGF

SEQ ID NO: 6120 - protein, 251 aa, Acinetobacter baumannii
RILKMIKSIITGCAVLTLSALTVTHAEFSYEQELQQGCNKVKQYASLGKKFYDQKQYKKALENFQNQASWTAFCKANADETTVKFTDRDIEVANNNVGLAYAKLGQPLWARAWFMLDEKSKSSQFNLKQLPQPKASNDLSGEYVRYSGFGEWDHITVSRKQGQYAIGYSGVYMGLRSLIYGPNMGEFGTTMPTNAKQTIYKDQDCRIQLDFKSNAKLGNYIQVKQSEGESGCGFGHNVYADGTYLKVESGK

SEQ ID NO: 6121 - protein, 213 aa, Acinetobacter baumannii
VMLKGFIAGIAVANAFEWVAHKYILHGVHRAGQPRYSPVPKSMESHWAHHREVRKQQFHDDCYVEGVGNWRTKNELISLAVVATVSSAIFYPFSKGMALAAWYSAGNYYYIHRRAHLEPDWAKRKIPWHYDHHMNSNQDANWCVTKPWFDYVMGTRVVSSADLKEQNPLGIRLPTALARPLAHAVEKIFPAKWVEKKAQPKLISDVSAIEGAA

SEQ ID NO: 6122 - protein, 213 aa, Acinetobacter baumannii
KGIKMRDQGRLVEWFDEKGYGFIQPDDAEKERVFLHIKDFARPGPRPIIGCALEYLVILDERGRFRAQQVTYLKASQTRKASKPAKTQSSFQASPWSAMQMGIVFYFVLMGIMSFIHILPAYTLLFVLMMNVLSYWLYSQDKEAAQLGNRRVPEQTLHIVSFLGGWPAAWWAQQKLRHKTQKQPFRKIYFCTIFFHLLLILWLISPLNVLRGS

SEQ ID NO: 6123 - protein, 948 aa, Acinetobacter baumannii
LRCFMSQSHIRIRGARTHNLKNVSLDIPRDKFVVITGLSGSGKSSLAFDTLYAEGQRRYVESLSAYARQFLSQMEKPEVDSIEGLSPAIAIEQKSTSHNPRSTVGTITEIYDYLRLLYARVGTPYCPEHDLPMVAQTVSEMVDAVKNLEEGTALMLLAPVVRERKGEYSNLFEQLQGQGFVRARVDGEIIDIDTPPELDKKKKHTIEVVVDRFKVRDDLGNRIAESFETALRLGGDIAVLSWMNGEHPDRVFSAKHSCPECDRAVAELEPRLFSFNNPFGACPVCDGLGTRSHFSPEKLIPNPELAISEGAIRGWDRQRPYYYSMLQKVADHFGFQLDTPWNQLDKDTQKKFLQGTGKEKIDLSYIDERGRKHTRVQPFEGILPHLERRYRETESNYVRDDLAQYLSNAACDACGGSRLNEISRHVRVKDKTIADITRMSIGDAESYYQGINLEGAKGEIADKIFKEIRERLHFLVSVGLNYLSLARSAETLSGGEAQRIRLASQIGAGLMGVMYVLDEPSIGLHQRDNDRLLQTLIRLRDLGNTVLVVEHDEDAIRAADHIIDIGPGAGVHGGVVIAEGTYDELAKHADSLTGQYLSGKLKIEVPKQRTQPPKPEEKIKLSGAAGHNLKNVDLTIPLGIMTCVTGVSGSGKSTLINRTLLPLAATQLNGATTLTAEKFDSIDGLQHLDKVVDIDQSPIGRTPRSNPATYTGLFTPIRELFAQTPEAKARGYSAGRFSFNVKGGRCEACEGDGMIKVAMHFLPDMYVPCDACHGKRYNRETLEVGYKGKNISDVLEMTVEDAAEFFSAIPVIHRRLETLTQVGLGYIRLGQAATTLSGGEAQRVKLARELAKRDTGKTLYILDEPTTGLHFHDIAKLLDILHELRNKGNTIVVIEHNFDVINTADWVVDIGPEGGSGGGMIIAEGTPEQVAEVEISHTGRFLKPMLKQ

SEQ ID NO: 6124 - protein, 341 aa, Acinetobacter baumannii
KKSLTFFMDLCFDVSNLFRSSLRVIMQHPTSTDIQRVREFLLDLQARICAGLEQQEKAGGGTAEFIIDDWERPEGGGGRSRVLQNGTVIEKGGVMFSHINISKLPASATERHPQIAGAKAQALGVSLVIHPKNPNIPTSHANVRLFVAEREGQDPIWWFGGGFDLTPFYPDEQDVLNWHQAAYDLCKPFGDNVYAEHKKWCDDYFYLKHRDEQRGVGGLFFDDLNCWDFETCFKYIQAVGNGYLNAILPIFEKHREQPYTEAQREFQLYRRGRYVEYNLVYDRGTLFGLQTGGRIESILVSLPNLAAWSYRPEWGEDSPEKRLTDYYLKPRDWLGLEEKVA

SEQ ID NO: 6125 - protein, 62 aa, Acinetobacter baumannii
TTSKTYTSFTYNSNATVQPYCSGTISSLLQTLSAPKQCILVDVAFIDLNHLHILTIFSFMNL

SEQ ID NO: 6126 - protein, 367 aa, Acinetobacter baumannii
FKSKECRMRNTILLQPKQIRVFVITLIVLCCGVLFQNAAWSENNIATATDETDTVVAGKIIQQQQAQASKPQINSQAASSVTPQTQVANDMADGESIRGLPTLNQPVIDQANVLSETEKQQLSQKILNLYQQGKAQIGIVIVPTTGQEDIFDYALRVGEKWQLGSSKRDNGLLIAVAINDHRIQILTGYGLEGVLPDIVASRIIRNQITPYFKQAQYAQGLNAGLDEIGRILNLDPEVAQQAAQDLKERQHQAAEEQQAKQTTLTMALFILVAGVVGSFIVGRPLSASTAGVAAAVAGFVNGAGVIMSLLLGFGIFFLLITSIAQLILQAILSGAGGGGRGGGFGGGGGGYGGGGGRFGGGGASGSW

SEQ ID NO: 6127 - protein, 119 aa, Acinetobacter baumannii
DASKVILYIFGLEFTGMSNQRIRIRLKSFDHRLIDQSAQEIVETAKRTGAQVCGPIPMPTRIERFNVLTSPHVNKDARDQYEIRTYKRLIDIVQPTDKTVDALMKLDLAAGVDVQIALG

SEQ ID NO: 6128 - protein, 78 aa, Acinetobacter baumannii
ITQNNADTIMISIIKTETLQRKSPLFTLDSGLFITLLLNIIKYSLAIYPSCMIEPNFPRLKSLIASIISALVFMTNGP

SEQ ID NO: 6129 - protein, 268 aa, Acinetobacter baumannii
KAQNMTQSLHPAAQKGFSSAAELYQQVRPNYPVEIVSWLQDRLQIHENSTVIDLGSGTGKFLPYLKQTHANITAVEPIGEMLQQLQQAYPDIKTLQAFSHNIPVNDQQIDAVICAQSFHWFDNIETLTEIHRVLKPQGHLGLVWNQRDESTDWVKALADFLLPLEGDTPRYHSERWKKVFEEQDLFTFDNLNTFSQSQHGTVEQVVSKRLLSTSFIAAMTEKDQLQLKAQFEKIVYDFTGLGPQDQIVFPYITYAYHFQKSTSSNHRE

SEQ ID NO: 6130 - protein, 427 aa, Acinetobacter baumannii
IGKKMSDLSYVNEHSDAWQTYLAQIDRVAPYLEHLADYIDTLKRPKRALIVDVPIVMDDGSIQHFEGYRVQHNLSRGPGKGGVRYHPNVDLNEVMALSAWMTIKTAVLNLPFGGAKGGIRVDPRKLSNRELERLTRRYTTEIGHIIGPQKDIPAPDVGTNANIMGWMMDTYSTSQGHTVTGVVTGKPVHLGGSLGRVKATGRGVFVTGREVAAKINLPIEGAKVAVQGFGNVGSEAAFLFVESKAKITHVQDHTGTIFNADGIDLVALRDHVNANQGVGGFAGAQAIADEDFWTAEVDIIIPAALEGQITVERAEKLKAKLILEGANGPTYPKAEDVLVERGIVVVPDVVCNAGGVTVSYFEWVQDMASYFWSEEEINERLDKLMVQAMDDVWNTANKNACTLRTAAYILACERILKARKERGIFPG

SEQ ID NO: 6131 - protein, 708 aa, Acinetobacter baumannii
ATEKGWSMPGEEVSQAKQQLKLIIDPYLSASEVEKVLAACDFGDLAHTGITRKSGEPYILHPIAVSCILANMRLDPETLMAALLHDVIEDTQYTKDDIIERFGQTVAELVDGVTKLSQSSDKEYNKAASFRKILQATLQDPRVIIIKLADRYHNMTTLGALRPDKRARIAQETFDIFVPMARLVGMNEMADNLENLCYQNLDLDMFDNVQNALLQTKPERCKYQSIWEQNLAELLHNYHIQGRIKKKNNNIELLRHFVKNEMDLQELTHSHAFEIVLQSIADCDRLVAALKENFQVIQYQDHIRRPLPGGNQSLMIKLKGEKTTLSLTIQTELMRKAARFGVVLGENAPQTCRSAIQASMQNLNTLIDGECAKTTFNDLLDYLHQEKIWVYTPHGQLHELPQGATVVDFAYSASLFLGNHAVGAKVDGEIKPLSTPLVSGQVIEIITDVLATPNPDWLSFINTQKARRALQHVLKDQDIEEQRLVGAQALSRALKLFNRSINDLSDADWLDLLQWRHIDNKDALFEQIAVGDLLPQLVANHLFANDKHPRAENSDRLIQGTEGIDVKYAHCCNPILGDPIQGHLTRRGLIVHRIRCHNLLHEQHLHPENIMPLQWKADDVDDVRFTAYLAIYMAMNDEQVSDLIYQCRKNNAGVEMVHSNEQRTFVNIVVNNRKHIAKVIRDLRMHYGFPRIERLHAPAPQMEISKVS

SEQ ID NO: 6132 - protein, 349 aa, Acinetobacter baumannii
KKGKLAMMIVRHAEFRDLEDIYKLAGKSGVGLTSLPQNMDTLSARISRTRNTLNGNVHKSEQGYLFVLEDTEAQRVIGVSAIEVAVGLIEPWYNFHVGTQVHASKALNVYKSLPTLFLSNDRTGSSELCTLFLDPERRENQNGKFLSKIRFMFIAAFKQYFEKKLIAEMRGYSDENGCSPFWDAIGHHFFNMDFSTADYLSGIGQKVFIAELMPRFPVYVDLLPKDAQEVIGKMHPHTLPAYHVLESEGLRYQGYVDIFDAGPTIEANIDELRAVKESQLLNVKITNEATVGKTQYLVANDNYHDYRAMLLKLDLVDNTLNLTHEQAEKLGVQEGHAVRVLSLNPMEVS

SEQ ID NO: 6133 - protein, 585 aa, Acinetobacter baumannii
RKLKPSRMRKDYTNMKWNSLKAKALLAAASLYSTVAMASPDLGEAEQQATNWHAIIMFIIFVGFTLFITKWAAKQTQSAQDFYTAGGGISGFQNGLAIAGDYMSAASFLGISAMVFSSGFDGLLYSLGFMVGWPIVLFLVAERLRNLGKYNLSDVVSFRLEEKPVRTLAAFSSLVVVAFYLIAQMVGAGQLIKLLFGLNYNIAVVIVGLLMMAYVIFGGMLATTWVQIIKAVMLLSGATFMAFMVMKAVGFSFSNMFTQSIEVFSKVHDVSFEDAAKIMGPGKLAANPIDALSLGLALMFGTAGLPHILMRFFTVKDAKEARKSVVVATGFIGYFYLLTFIIGFGAILFVSNNPQFLDVAKMAMTGKLELVGGNNMAAVHLSDALGGDLFMGFISAVAFATILAVVAGLTLSGASAISHDLYANVFKKGQTTPASELRMSKIATLGLAIFAMILGILFEKQNVAFMVGLAFSVACCANFPILVLSMFWKGLTTRGAVIGGVVGLVTAVVLIILSKAVWVDTLKISDTPINPFNGPALFAMPLSFLCCWFFSVTDSSARAKKERASFDAQYVRSMTGIGASGASDH

SEQ ID NO: 6134 - protein, 182 aa, Acinetobacter baumannii
VRLKAMLKKTPHIILMSLLSSSLLLTACKKADEPAKTEQSHTSSSTDQVLEKLNERPVKKFPATADDAHDIALLEDYDRRFTEMSDEMENELAKMHEAGTLTAEFEQKRTLDNVRSALTMLKDLDLKTEQGRYIQGLLYQYWENQEKNFSDKQASKDEQVKQLADYLQAQNQLKYWKASQQH

SEQ ID NO: 6135 - protein, 218 aa, Acinetobacter baumannii
SLMNILIVDDHPLFRHALIQAVRYSLPQAQIHETASVDEFYERLENGAEPDLVLLDLNLPGASGFSALVYVRAQYPSIPIIVVSAHEEASIIQRAIAHGAMGYIPKSAHPSHIGEAIRQVLDGEIWLPPNLPSNINLDPRAADETALAERIQSLTPQQFRVLMMVAEGLLNKQIAYELDVSEATIKAHVTAIFRKLGVQNRTQAVLAISALNIEDKKI

SEQ ID NO: 6136 - protein, 398 aa, Acinetobacter baumannii
RPMKKHNNFQTQLIHAPRKAPQFIETVQPPLFRASTIIFKSTSHLFDRHWTDPYDYSYGTHGTPTTFTLGDNIAQIEGGLYCLLAPSGLSAINLVNSAVLATGDEVWVPDNIYGPNLEHLNYLKDQYGINVQVYNPIDISSFQPSDKTKLLWLEAAGSVTLEFPDLKALVKKAKAHGVLTALDNTWGAGLAFNAFDFSDEHLSVDLTIHALTKYPSGGGDILMGSVVTRDEKLHHRLFRMHAILGISVSGDDTAQIQRSLAHMSLRYEQQSNNAKTLLTWLKEQSQFAQVLHPSDKAAPGHQYWQEICSTGKSAGLVSVVFKSDYDISAVRRFCDALKLFKLGFSWGGPVSLVMLYDLKMMRKLENTHLQQGLLVRFCIGLEDPQDLIQDIENALKQM

SEQ ID NO: 6137 - protein, 141 aa, Acinetobacter baumannii
SKMKAIKILCITSSILVSSSLFAETPQPQQVNEATSKTMPYGDNPSLGRVLLYKTGKGIQNLGDSIQGASEKTSNKISEKWKDTKEFTAEKAEVVQQKADTAKVFTEQKIEQAKQNITSSRNGENIPIEQGELSKSSTTAN

SEQ ID NO: 6138 - protein, 298 aa, Acinetobacter baumannii
NAVNKKLEALFQEKVQGKVILVTGASSGIGLTISNKLADAGAHVLLVARTQETLEEVKADIESRGGQASIFPCDLNDMEMIDQVSKEILASVDHIDILINNAGRSIRRAVHESYDRFHDFERTMQLNYFGAVRLVLNILPHMIQRKDGQIINISSIGVLANATRFSAYVASKAALDAFSRCLSAEVHAHKIAITSIYMPLVRTPMIAPTKIYKYVPTLSPEQAADLIAYAIVKRPKRIATNLGRLASMTYSVAPGINNMFMSIGFRLFPSSDAAKGKKAEKLNWVQKAYARIFPGEHW

SEQ ID NO: 6139 - protein, 269 aa, Acinetobacter baumannii
ARALSFKKLFFMRRSEKSKDTKARLAPKQKISYEKKPDPAITAYAVQSLNWLRQAEFLMSAPKLALCVEDSGYEIAFAGRSNAGKSSAINALTNQKQLARASKKPGRTQMINFFSLGNPDQRLVDLPGYGYAAVPEDMKRVWQKELENYLIHRKSLQGLVLLMDIRHPLQHFDMMMLEWAYSRHLFVHILLTKADKLNRGPANKVLLEVKQQLKKMKLDFSIQLFSSLNKLGLEELASVMAGRLHFTLEQQPEFDVDAIPEASDEDAEE

SEQ ID NO: 6140 - protein, 255 aa, Acinetobacter baumannii
RSRKIEESAVFFAVITLFPEMFDAITAYGISGRAAKRDIVQVTCINPRDFAEGNYRRVDERPFGGGPGMVMMAEPLAKAINHAKQLASRAGCVHVPVVYMSPQGKTLNEQAVQQFVDYDGLIVLCGRYEGVDERLIQHYVDQEWSIGDYVLSGGELPAMVLLDSIIRRLPNVMSDEQSAIQDSFVDGLLDCPQYTKPDQFEGLDVPEILKSGHHANIEKWRFLQRYQRTLERRPELIEQVTLTKQQKKWLSDEQG

SEQ ID NO: 6141 - protein, 465 aa, Acinetobacter baumannii
MKFEFKNLGPIHQGEIELADLTVLCGKNNTGKTYVTNALYSFFQNWLDLIDWSLPDSIEAEIHHKGIASIDLEKDVISNIDTKQAMKNLSENLSNFFACSPDLFKNVEFNIQFEIKEDWQEYEFSSKTGSPSGEVFLTIKKPKNSKIAEIAWLDSDSAPPLFLLDEYIKKNLFEACFKTTFPEVFIASAERTGASIFRNELNFNKNQLVSLLAEMEKNGNKKFNPFDIARSFKRTYAQSVEHNVDFISYRIENLVKKGQSEFIKKNAYLLAKFQEIAGGVYKYHKDTGVYFQPNGARGVKLGLGEASSAVRSLMIIWFWLNHVAKPNSLLMIDEPELNLHPENQRKLAKFVAALVSAGVRVFMTTHSDYIIRELNTLVMLSCDKPHIQKVRDKFNYDDNDFIKPENIAVYNTTEDLFEVEGSSRRKKMGTIERWDVVQHVGIKIQSFDKEIREMNKVQDALRYGI

SEQ ID NO: 6142 - protein, 105 aa, Acinetobacter baumannii
KGFEVLPMVGAGIIRKNYKAFIMVVIRLARGGAKKRPFYQIVVTDSRNARDGRFIERIGFFNPTAQGQAEKLRLDADRFAHWVSQGAQPSERVASLAAQAKKATA

SEQ ID NO: 6143 - protein, 795 aa, Acinetobacter baumannii
SVLLNFILVGSNTMTDLVQQLASELAVRPNQVEAAIRLIDEGASVPFIARYRKEVTQGLDDTQLRQLDTRLAYLRDLYERREKVIQSLQEQNKLNDDLLARVNAAETKNALEEIYAPYRPKRTSKSFKAKEAGLGPIAEKIISEQIDPTEALAGFSHEDYPDVESQLDAIQHILIDDWAQNIPLTTELKATFAKTAVLKSTVASEEKKEVGKKFRDYFEFSEGLNKLPSHRLLAMLRGRQENVLGLKVDGEDDAPLARIETEYNLDQVQPQTRQDFLKQTAKLFWLGKVRPQIEHSLLTEKRLAAEAEAMQVFAENLRHLLLSAPAGSRTTLGVDPGIRTGVKLAVVSEAGDVLAHSTIYPFAPKEDKEGSIAELARLCREYNVELIAIGNGTASRETEAVVAEMMAANTDLKLTRVTVSEAGASVYSASELAAAELPELDVSIRGAVSIARRLQDPLAELVKIDPKSIGVGQYQHDVNQTGLAKTLDAVVEDCVNAVGVDVNTASPAILAYIAGLNKAIAQQIVEYRKEHGRFDTRQALKNVPRLGERTFEQAAGFLRIQNGSEPLDASAVHPESYGLVEKIVAAKATTVKDIIGNTEIIRQVKAEEFVDDKFGLPTIQDVLAELEKPGRDPRPEFRTAKFREDITEVAQLTEGMQLEGVVTNVTNFGAFVDIGVHQDGLVHISELANEFVSDPHKVVKPGQIVQVRVMQVDVERNRVNLSMRAEGAAPVKAQRPPRREQNNEQRSERKPQGKRPQPRKDQVERPQRSKQEKPQEQKIGGFGALLLQAGIKGSK

SEQ ID NO: 6144 - protein, 238 aa, Acinetobacter baumannii
FRVDCGHVRRDLMKSRTSELAVGIFVIIFGIALFFLAMKVSGLVGTNLSDGYTMKAQFDNVNGLKPRAKVTMSGVTIGRVDSITLDPVTRLATVTFDLDGKLTSFNAEQLKEVQKNALDELRYSSDYTQATPAQQKTMEQQLISNMNSITSIDEDAYIMVATNGLLGEKYLKIVPGGGLNYLKRGDTISNTQGTMDLEDLISKFITGGGAGKVAAGSSSAEEKAPASTDSSAQPSFVE

SEQ ID NO: 6145 - protein, 166 aa, Acinetobacter baumannii
LYVEKTVELNNDSLAKKYGTTTAKNSFKTSSSNPYSWLVSHPLPDTVRVSSNFGGRTMGGRAEHHGGLDMAAPSGTPIYATGPGIVTKSGWGTGYGQYVEINHGNGYLTRYAHASRLMVRVGDQVSAGDHIANVGCTGRCTGPHLHYEVVKDGQRKNPSTYLAMLP

SEQ ID NO: 6146 - protein, 410 aa, Acinetobacter baumannii
IDTEVSMEQPISVTRSNFNDWMVPVFAPANFIPVRGEGSRIWDQENKEYIDFAGGIAVNALGHAHPVAVNALTEQAKKLWHVGNGYTNEPVLRLAKQLTENTFADKVFFCNSGAEANEAALKLARKVGLDSGIAGKSGIVAFNNAFHGRTLFTVSAGGQPKYSQDFAPLPNGISHVAYNDLEAAKAVINEQTCAVIVEPVQGEGGVIPADIEFLKGLRELCDQFGALLIFDEVQTGVGRTGALYAYMNYGVIPDVLTTAKALGGGFPVGAMLTTDKFAPHFSVGTHGTTYGGNPLASAVAGAVFEFINTPEVLEGVKHRHQYFLDALNTLNGEYQVFDEIRGQGLLIGCVLKAEYAGKAKDITTWAGEEGLLALIAGPNVVRFTPSLIIPEQDIDEGIARLKRALAKLAK

SEQ ID NO: 6147 - protein, 112 aa, Acinetobacter baumannii
KMTDCLPSNTPLEETGFGYTLSLINGKYKMIIMYWLYGKTVMRFNELQRCIGNISFRTLSNTLKELERDELIIRKEYPQIPPKVEYRLSERGQSLIPLLDMMCQWGERNMNS

SEQ ID NO: 6148 - protein, 131 aa, Acinetobacter baumannii
HQGEVVVELSMKKIGLLMMCNLLILSACTPNTNPPTPQANSPIQAVLLDQPNLLNNASNLSISQQMNALEDPSNAQVTILQTEPSEDAVSKTRTEYLLKKDQTVWKIVNKKQSYQCTKGEETADFQVNPCP

SEQ ID NO: 6149 - protein, 200 aa, Acinetobacter baumannii
HFSEKSLIYFLMKAIEIGGALPSKAFETLPNIYLVGPMGAGKTTVGRHLAELLGREFLDSDHEIERKTGATIPWIFEKEGEVGFRTRETVVLNELTSRKALVLATGGGAITQAPNREFLKQRGIVVYLYTPVELQLQRTYRDKNRPLLQVENPEQKLRDLLKIRDPLYREVAHYTIETNQGAARDLAQKILQLILSNKLK

SEQ ID NO: 6150 - protein, 385 aa, Acinetobacter baumannii
NKSEISKLLVEKLRRKIMQSKTLFLLGLCTIFSTTVSALPLDSKGAKQRLSQAAKQKVFQGKIDLDALVSNDSNDLIVEYNIPSSSVPSGLERRSYIATNKKNLQTRFNRAGGVQVLRDYNNLPLAFYRISNREALIALLNDPNVKAVYPNRINRTTTTESLPLINQPQANTNGFTGEGSSVAVLDTGVNYLHSDFGCTAVNTPSSTCRVVYSFDSAPDDGTLDDDGHGSNVSAIVSKVATKTKIIGIDVFRKVRSQGKWVSTAYDSDILAGINWAVNNAQTYNIKAVNLSLGVPGVKYTSECSDSSYGTAFANARAAGVVPVVASGNDAFPDGISSPACVAGAVRVGAVYSSNIGGVSWGYPVKCSDPTTAADKVACFSNGGSL

SEQ ID NO: 6151 - protein, 348 aa, Acinetobacter baumannii
ITTEIPDEAVKLPIKIKRLKVKKFCLALFLSVTSVTSWAGDQVWCAYDPAGTQGDITRRLNDIRLYAQQYQVKFKVVSYQKEQQAIQAFDEGKCSGLAASNFNTYQYNHFMGSTSGIGLIPNNRTARNLLQLLNHPTIEKRLINKDYEAVGMIPVGTANMVMKTKKISKVAQLRGQRIGVLANNPPQQALVRSVGAQPVYVDLSNAIAQFQQNKIDIMPAPVYGLLPYNLQKDFGPDTQVINFPLAYFGVNIIIKPQAYPANFGRKIRAWFVQNSQLLTNRAIQWENHLPAYYWVDVSFYEKQSYDIMVAKIRNQYVRSGYYDAYFVELMKRLRCIDDPRYFECPMSR

SEQ ID NO: 6152 - protein, 246 aa, Acinetobacter baumannii
MSQDELQELSLEQLSAKKKKFNLDKFLQQFNTLDMNNYGSWPISVKITCWIFIFFAVLALGYFIVIQPKLQAIDNAQAQESNLLNEFREKDSKLRNLQQYQVQLQEMQANFNQQLEQLPKETEIPSLVEDINLTGVNSGLKFKNIRLEDEVKQEIFIEQPIAIEATGDYHAFGAFVSSIAALPRIVTMHDFTVDVSPAKDNKSDIPVLNYSIKAKTYRYVGTTDTSEQTGKAPAASASTNTTVQPK

SEQ ID NO: 6153 - protein, 207 aa, Acinetobacter baumannii
KYKEKLEDNVTMKTFKQLAIATTLASTLLFSGCGYNTLQVKDEAVTAAWSEVQNQYQRRADLVPNLVNVVKGYAKHEEQVLTEVTQARANVAGLKVDKEVLEDPALLEKYQQAQSQLTGALSRLIAVSENYPDLKANTQFQELQVQLEGTENRIAVARNRYITTVQDYNAYVRQFPQAVTAKVIGMHPKANFSAEASAQQAPKVSFD

SEQ ID NO: 6154 - protein, 190 aa, Acinetobacter baumannii
GRGDLLMHHYKQKAQAGVGLLEVLVALILLAIGVLGYVALQLRAMDASSEALSKSQAILVMRGLAENIRTNSTQASQYPTFVRSYSNYTSDTPAPTSCFNSLCTASQLAQFDAYQAARNANQLGMRITMSNCPGVTNTMVQQRQCLFVFWGKTAPVITTNGTNTSVDVSSCMNNNGVYVNNSTCLMMEAY

SEQ ID NO: 6155 - protein, 290 aa, Acinetobacter baumannii
LNMDITQLKMFQTVVECGTMAKASLQLHCVPSNITTRIKQLEEGLGAPLFYREGKSLKLTPSGEIFLDYCHKILALCDEAKQSIHPDAPPSGPLKIGAIESSATTRLPNLLAKYHQRYPEVSIQIITGTWKQLLVDISQHKLDGAIVAGNIEFPMLNKLSIYQEDMVLIASHSLGEIRYQEDLIGKEIFMWTEGCPYRAALEEWLKLKNISLPITSITSYATIIGCVSAGSGVALVPKSIYEQYKNLAHIQSYKFEYLAFMQNHFFWHKNVSNHKARDMFIELIKTEFSL

SEQ ID NO: 6156 - protein, 351 aa, Acinetobacter baumannii
KLKEDIFMQRMQKKIWWCVLGFFILSIIACVYWLSPDSENTSPQPNQDEAKSLVATSQSTLNSPLNENTYLSKSQQDTQVNCQLKINSSQHLVVNSQTRDCFEYFITQYGESNLQQVKTHFEKFIQDQYLEPARSQIIDLWTRYLKYREQLAQIQPPQSKQQDQNYFQKIFSSIQDIRKRFFSASEIEGLFSTEDIYQNYTLDRMKILEDSSLSEIEKAKNLKERFEQLPEDWQENLQELSKLDDLHTLTKQIKARNGSAEELRQMRTALVGAEATQRLETLDIQRNAWQQRVTGYLNQRDEVLHSNMSDSAKKQAIQQLRQQQFSSSQEQLRLRTFETVHDQGGELPFNY

SEQ ID NO: 6157 - protein, 123 aa, Acinetobacter baumannii
NKKENCMIGQILIALIAILHVYILVLEMFLWDKPYGMKAFGNNAEKAKLTKVMAQNQGLYNGFLAAGLFWSLLADAPFATSIANFFLGCVLIAGIYGGLTASKKIIYIQAVPALIALVAVNFL

SEQ ID NO: 6158 - protein, 120 aa, Acinetobacter baumannii
FIFLLTCERIHPNIALTQTGVIAQLVERYNGIVEVSGSIPLGSTKLLCVCLIKSLSSRGLGHRPFTAVTGGRIPVGTPLFILKIPLKTLSSPSCLFFDCFLIAHLSILSKIASFSNSLNV

SEQ ID NO: 6159 - protein, 456 aa, Acinetobacter baumannii
NKILRNHKLAKHLFCFIFDDVCGSKFSFGVSMDKQIIFEDEHIRAIFLQGDSNTLVLSFGDLITRASGLSINAEKSLIKYQYNVIGVMPKQKSWFPKASMVELAKVILPIIQRFKNIVGYGGSMGGYAAIKYSNLLNMNRIIAFVPQYSIDPEQVEDRRYAEFFDAVANKDMQIQPQDVDASREYIIVYDPYFSIDREHYLKIKEVLPSLHTIHLPFTGHEALSVLASSSLLHDFIEHEFDETYFYQQVRKIKKQSKFYYRNVLANVLTYHDSMLLKILRQNDFQLDERYLDNPLKQAVTRSLIKTKQATEQDFQKLGIKIQYSQQAENHKKGLKNQFEAILVFNLINLKLETYAVDVVLANPLYLIPIVAEHTGVVQIELNNELYLLGMNDRKIIKLFKQGDALTSDMSPFVIKQYSDFFALSYKQLNLNCDEQGVCDYVESSIQPSQQFVLTSY

SEQ ID NO: 6160 - protein, 90 aa, Acinetobacter baumannii
MLGFLKIMLPLLLVVFLLMGIWVSILHFPWEWMTYVVMGIEVFVATLILPLEYQTGTSNSHIGFISISACFAVLLGIARLFVWTWVKFFA

SEQ ID NO: 6161 - protein, 112 aa, Acinetobacter baumannii
TKLCSFTRRVEPMDIDAISKALANPLRRQILQWLKEPEHYLPVEECGGSFEKGVCAGHIERLGKVAQSTMSNHLSVLQQAGLIQVQKYGQWSYFSRNEALIQQYIEHLKQTL

SEQ ID NO: 6162 - protein, 615 aa, Acinetobacter baumannii
VRPCCMVDKRTKQTRKKQQSISEKPSLAFDMWRFYLLWAVVLLCFVVLIARAFYVQVINKDFLQNKANANILRTERIEAMRGVISDRHGVPLAISSPIMKIVIDPRDYFETKHLYDQITAELKQDPNNRKLKRQLPDKNLNLDELADVVGVDRADLKKQMNARPRSRYLVLKKEVPPQQADLIMKGNFQGVYAEKTYKRYYPQPQPNAQIIGLTNSEGQGIEGLEMQLNKQLSGVDGEQKIIRDKRGNRLKVSEVIREGEPGENITLSIDSRLQYIMYRELTAAGVANNARSATAIAVDVKTGEILAMTSWPSYNPNDKNGLSNKDAMRNRGAIDMFEPGSTMKPFTISAALETGQYTPNTIVNTSPGSMRLGWHTIRDTHNYGALTVSGVIIKSSNVGSAKIALSLPKETLPSFFNRVGFGKRSAVRFPGESSGLVLPVNKLNSSQIGTMAYGYGLNATILQLAQGYAMLANHGVKMPLSLHKLDQPPKGEQVLNPKIADQVLLMLEQVTMPGGTAKQANIPGYRVVGKTGTAHKLRADGKGYSNNEYRALFAGVAPISDPRLAVIVVVENPQGRYYGGLVAAPVFARIMQESLRLMNVPLDKPLNTPENPIRR

SEQ ID NO: 6163 - protein, 633 aa, Acinetobacter baumannii
KSYWFNYTMQNTAKKATLPATALAALGVVFGDIGTSPLYALKESFHAAHGLGIQRVNVLGILSIIFWCLMLIISIKYVAIVMRADNNGEGGIMALLALNLRKAKIADNKKIYMIAIGFIGASLFFGDGIITPAISVLSAVEGLSIATDVFDPFIMPIAIAIIVTLFLVQKHGTAFVGKFFGPITLVWFLSLGILGIHSVIQTPVVLGMFSPHWAIQFIYHHPIMTFFVMGAVVLTVTGGEALYADMGHFGPVPIRLAWFFVVLPCLVLNYAGQGALLLRDPAAIENPFYLLVPQWALYPMIIMATMATVIASQAVISGVFSLARQAIQLGYLPRLSIKHTSESEEGQIYVPFLNWLLLIAIIILILIFKTSSNLASAYGLAVTLTMLCDTILVAVFIYSAWKWSLPKVLLLIIPFFILESVLVGATSLKILSGGWVPLLIGAIAVTILMTWKRGRELTFAKLEHDTLSLDLFVKSIGNSVHWVPGDAVFMTGTPNVVPHAMLHNIKHNKVLHQRNILVTVVIEDVPFVAPEERITTETLAEHFFRIKIFYGFKDEMNVPKALMQAYEQLGLEYDLMHISFFISRDRIVHSVGDGMSPWREKLFISMQRNTSPVSDFYQIPTNRVVELGSQIEI

SEQ ID NO: 6164 - protein, 285 aa, Acinetobacter baumannii
RDNCFTQCNGGNTMTHLNYKNIKGRSKETGATLIVVLIILLIVISVGVLAIRVAIVSLKVATNSQVGQLNFQSSDTPLELIVQMNPTTLTNITNVIGAALKAHESNPGAEYNFCYKPTSTSVSFAQTRGASLLRAGSANNAVVEDGGVAGFCDLTSDYGSNRQAVVTQVAVNIPTDAMADIPGSNLPRDINLSEGTQLPKSMLSTQRIRVITTAFLPAYASNSLETLQSDCLSTSSAKISDNFDSALTDKQTLADCLANHNVPFSTQVQEFNYTNKLTEITAPGS

SEQ ID NO: 6165 - protein, 163 aa, Acinetobacter baumannii
GRNCFGVATMKGNRDVINQLNQVLYHHLTAINQYFLHSRMFNDWGIEQLGSAEYKESIRQMKHADKIIERILFLEGLPNLQHLGKLYIGQHTEEVLQCDIRKVKENIEAIQKAVALAETEQDYVTRDLVQEILEKEEEYWDWLDTQIDLIGSVGIENYIQSQM

SEQ ID NO: 6166 - protein, 1062 aa, Acinetobacter baumannii
SPNWKKERLSMDINKPELPKPEGLFDRVIQFAIQNAIWVMLFVLAWIGVGIWSYQKLPIDAVPDITNTQVQINTQANGYTALEVEQRITYPIENAMAGIPNLEQTRSISRYGLSQVTIIFKDGTDIYWARQLINQRLQEADGQLPESVDPIMSPVSTGLGEIYQWVVKAKSGAKKADGTAYTAMDLREIQDWIVRPQLQRVKGVAEINSIGGYNKTYIVSPDLKRLQQLQISINEFQTALQENNENRGAGFIEENGEQLTVRVPGMLSSVEDIQNITVSTKNGLPIRVADVANVSIGHDLRTGAATYNGEETVLGIAMMMMGENSRTVAQAVDTKIKEIQSTLPKGVEIETVYDRTSLVNKAIATVQKNLVEGAILVIVILFIFLGNFRAALITACVIPLSMLFTLTGMAEQNISANLMSLGALDFGIIVDGAVVIVENCIRRLAEAQHALHRPLTRSERFKEVFLAAKQARRPLIFGQMIILVVYLPIFALSGVEAKMFHPMAMTVVMALLGAMILSVTFVPAAVALFVTGEVKEKETRWMQLLKQKYQNILDQAYQLKIVVVSFALSILVLTGVLATQMGSEFAPQLSEGDFALQQMRSPSTGLEQSLRMQENTEKLILKNFPEVKAVFARTGTAEVATDVMPPNISDAVILLKPHDQWPNPKETLSELRSRMEAFLATLPGNNSEFSQPIELRFNELISGIRSDIGVKIFGDDMQVLNEQAQALAQKVQKISGATAVKVEQTSGLPVLSVEINRPLAAQYGLSAKAIQDIVAASVGGQNVGQILQGDRRFDFEIRLEDQQRTIQNLAQLPIQLPNGGLIQLQDVAKVECTSGLNQVGRENGKRRVIITANVEGRDLGSFVQELRATLAKEQLPAGYWLEYGGQFENLASAAARMKIVVPLALAMIFILLMAVFHNVKESLLVFSGVPFALSGGLIALWLRDIPLSMSAGVGFIALSGVAVLNGLVMLSFIKELREKFDIQTATWNGAILRLRPVLMTACVASLGFIPMALATGTGAEVQRPLATVVIGGIISSTILTLVLLPVIYRWMNEDKTKSVEHS

SEQ ID NO: 6167 - protein, 273 aa, Acinetobacter baumannii
TESCNKTFIKSFLEGRDSMKKLAIASALLSALAVSGAANAYQAEVGGSYNYLDPDNGSSVSKFGVDGTYYFNPVQTRNAPLAEAAFLNRASNVNAHVNYGDNSGTKDTQYGVGVEYFVPNSDFYLSGDVGRNEREIDNTNIDSKVTTYAAEVGYLPAPGLLLALGVKGYDEKDGKDGADPTVRAKYVTQVGQHDVNLEAYGAFGDLDEYKVRGDYYIDKTLSLGVDYYNNDLTDKDEFGINAKKFLNQQVSVEGRVGFGDNDNTYGVRAAYRF

SEQ ID NO: 6168 - protein, 496 aa, Acinetobacter baumannii
FHDCKDIGRCGQQGNPRLPTERDMAERLNNDFQFLDVPRQDPEKKDITVRKAEFVEIYKPFTSETVTNQTHRCLGCGNPYCEWKCPVHNYIPNWLKLIAEGQIFQAAELCHQTNTLPEVCGRVCPQDRLCEGACTLNDGFGAVTIGNAEKYINDTAFALGWRPDMSHVKWTGKKVAIIGAGPAGLGCADILARGGVKPVVFDKRPEIGGLLTFGIPEFKMEKDVMKRRREIFTGMGIEFRLNTEIGKDVTIDELLAEYDAVFMGMGTYTYMKGGFPGEDLDGVYDALDFLISNVNRCQGWEKDPSEYISMDGKKVIVLGGGDTAMDCNRTSLRQGAHDVTCAYRRDESNMPGSAREVKNAYEEGVKFLFNRQPIEIVGENGKVTGVKVVTTQMGEPDSRGRRSPEPIPGSEEVLPADAVLLAFGFRPSPADWFGSVNINLDGSGRVVAPEQQEFKFQTSNPKIFAGGDMVRGSDLVVTAIWEGRQAAEGILDYLGV

SEQ ID NO: 6169 - protein, 372 aa, Acinetobacter baumannii
MLLWLFEQLAGYHSSFQVVRYLTLRSLLSVLTSLTIGLVLGPIMIRKLQALKYGQAVSSFAPENHAKKMGTPTMGGILILLSIGISTLLWADLSNPYVWIVLGVMVVFGAVGWADDWIKIRYKDNAGLPARKKFFWTSVASLGAGIALYLIATQQSNAEYTANMLDLLIPFFKNLSIPLSIVPLGLAFIVFTYLVINGASNAVNLTDGLDGLAIMPVVMVATGLGVFAYLSGDIRFANYLHIPYVKYTSELVVICSAMIGAGLAFLWYNAHPAQVFMGDVGALALGAMLGTIAVMVRQEIVFAIMGGVFVMEAVSVFLQIGSLRMRNKRVFLMAPLHHHYEKQGWKETQVVIRFWIITIMLVVLGLMTLKLR

SEQ ID NO: 6170 - protein, 93 aa, Acinetobacter baumannii
ANGLVGTANKRTDEAPIGAMYQALIPPKTYQLINEEIAKPHSAPTPQSNRSFSGKTLKFGFKICNHSGCITLTVHLRGYAVIYNGQKYTPKAA

SEQ ID NO: 6171 - protein, 330 aa, Acinetobacter baumannii
IRGCYMSRAISHIDTFQGLILALQNYWAEQGCVVLQPYDMEMGAGTFHTATFLRALGPETWNAAYVQPSRRPKDGRYGENPNRLQHYYQFQVVLKPNPDNIQQLYLDSLKAIGIDTLTHDIRFVEDNWESPTLGAWGLGWEVWLNGMEVTQFTYFQQVGGVECYPVTGEITYGLERLAMYLQGVDSVYDLVWTKGQFGTVTYGDVFHQNEVEQSTYNFEYAPVDKLFELFDFYESEANRLMEAKLPLPAYEQVVKASHTFNLLDARGAISVTERQRYILRVRTLARAIAQSYVQARAELGFPMAEPHLRDEVLAQLKAQAESEAAKAEKN

SEQ ID NO: 6172 - protein, 68 aa, Acinetobacter baumannii
NLLCHKKLFVHGTISQLLTNIAFKTAKNTIFNDKKCQKNYNLSENSILFFLINTAKYLPSAFGAGICL

SEQ ID NO: 6173 - protein, 212 aa, Acinetobacter baumannii
IKLCNILHILRYSSVLCNILLKFSLFIYFMSQSSSVLQHVGTNIRSLRDERSLSQQDLADRAGVSRRTIAALETGQVNISLAKLDAIAAVLGVDFRTIVSAPELKEHGLVNALAWQGEKEESKATFLASVPSRSQVELWTWSLAVGESYVAEADAEGWQELIYVLEGELTIQFTDSSKTIAAGSSFIFASSVTYTYINSGSQVLKFIRNVVY

SEQ ID NO: 6174 - protein, 456 aa, Acinetobacter baumannii
NISCPIIKYIRKIPFKLLILIYRIFSMQHAFRHCSFFCHGHDMNSSSTPSTLNTEATSVLSREWIHKGTKAYKHAGFALFLVGFASFSLIYCVQPLLPAFSQSFQISPASSSLALSLTTAFLAISIVLSSAFSQAIGRRGVIFASMLCAAILNIVSMFTPNWHSLLIARALEGLLLGGVPAVTMAWIAEEIAPEHLGKTMGLYIAGTAFGGMMGRVGMGILVEYFSWRTALGLLGAICFICSIAFLKLLPVSRNFVQKKGLNLGFHMQMWRAHLSNTKLLRLFAIGFLLTSVFVTLFNYATFRLSGAPYSLSQTQISLIFLSYSFGMVSSSLAGSLADRFGKKTMMMSGFALMIVGSLMTLLSSLFGIIIGIAFITTGFFITHSLTSSSVGAESKQAKAHASSLYLLFYYMGSSIVGSAGGWFWLHGGWSAIVGLTVFLFFIGIFLAIYTSHAKAH

SEQ ID NO: 6175 - protein, 330 aa, Acinetobacter baumannii
FKKCSKKLHFFLLRDWLYIIYRCRFKFILKNNSLYTMKIIFIHGMNQQNYTAHRLKEHWLKVFKLGLKQLHCRVNLRDLHIHMPFYGDLMTKYQLSNQLDLNTLLPKTFNFHLPIHLHHQPSTPKEHTPFIPHLPLSPDQPAQSLSERLYLTSQLVKDRVLKEMVVLLNNFPKLHESLIQQFLIETYMYLSNPDFMYEVHQRILKQMHDDEDCIVVAHSLGSVIAYHLLSDPSYQFSVQRFITLASPLSFRVIQSKLPTPIERPKCLKGDWYNFYSKDDFLTAFPLSEAPFNFTPPIINQEIFTFANQPHEIVGYLQHHAVVKTIIEPFQ

SEQ ID NO: 6176 - protein, 511 aa, Acinetobacter baumannii
KTRCTRRSRCSCVITKSYGSILMSNSLFINGVWLQGSGTTFVKTNPVDNQTVWSGAEATASDVEKACQAARTAFPAWARLPFAERVAIVEKFAALLEENKKHLAEVISQETSKPFWETLTEVQSMIGKVAISIRAYHQRTGESSTEMADGVASLRHRPHGVLAVFGPYNFPGHLPNGHIVPALLAGNTVVFKPSELTPWTAEETVKLWQQAGLPNGVMNLVQGGRTTGEALAASHEIDGLLFTGSANTGYHLHKQMAGAPEKILALEMGGNNALIIDEIENMDAVVNLTIQSAFVSAGQRCTCARRILVKNGAQGDAFIQRFVEVAKNLKVGRWNDEQQPFMGGVISSAAATNMMNAQQKLLELGAKSLLPMTRPQEDSSLLTPGIIDVTGVAGIPDEEYFGPLTTIQRYDSFDEALKIANATRFGLSVGLVSPKRELFDDLLIEARAGIVNWNKPLTGASSAAPFGGVGASGNHRASAFYAADYCAWPMASLESESLTLPEKLSPGIVLP

SEQ ID NO: 6177 - protein, 531 aa, Acinetobacter baumannii
FSGCFTTTAYACNFARLMATDESHFLTVGESQLRSLLGDHLLQRLQQDTEGKLHQRLFRCLRGAIIDGVIQPKTRLPASRDLASEIHVSRNTVLSAYEQLQAEGYLEARTGHGTWVAEKLPESFLNTQNKKKVVSSPNIQSSYALSQRGSNLLGYAAASPHQWGAFVPGAPDVTEFPHHIFSRIQARLSREPDINRLIYSNAGGCIELRSALADYLRVARSVQCDADQIIITEGIHQAIDLVSRALSDMGDKVWIEDPAYWGMRNTLRINGLDIQPMPVDAEGIIPEENPAVPPKLIFVTPSHQYPLGSHLSLDRRRQLIQIARQHNSWIVEDDYDSEFRFSGQPYPSLQGLENNAPVLYMGTFSKTIYPSLRIGYLVVPKPLFSPLRIVAAELYRGGHLLEQKALAEFIREGHYEAHIRRMRLLYGKRRDYLVSLIQRYLGPEFIHEYDEAAGLHLVLKLPNSCDDVAIAATALERGVKVRPLSQYYMQSHAHAERGLLMGFACVNEKDMVMAFGVLLQCLREAGLPTLN

SEQ ID NO: 6178 - protein, 92 aa, Acinetobacter baumannii
LMPRSLKKGPFVDAHLFAKVEAAVASNSRKPIKTWSRRSMILPDFVGLTISVHNGRNHVPVIVTEHMVGHKLGEFAPTRTYRGHGVDKKSKR

SEQ ID NO: 6179 - protein, 110 aa, Acinetobacter baumannii
GRTRMNNERIYQVLKGPVFSEKAQVLGDTAGVQVFKVDINATKLEIKKAVEKLFGVEVVKVNTTITKGKTKRFGRTLGRRSDVKKAYVTLKAGQDVEMADLGDTAESAAE

SEQ ID NO: 6180 - protein, 75 aa, Acinetobacter baumannii
NHYRDSDGNVMKTKDLREKSVEELKALLDEQQLNQFRLRMAKATGQLGKSHEVQVARKTIARIKTLLTEKQGNGQ

SEQ ID NO: 6181 - protein, 323 aa, Acinetobacter baumannii
KGVRKMGGHHGHDHSHAVVTEGNAKKLTIALALTTTFLIVEVIAGLITQSLALLSDAAHMFTDAAALAIALVAIQISKRPADNKRTFGYQRFEILAALFNALMLFVVAIYILYEAYIRFSQPPEIQSVGMLIVATIGLVINLISMKILMSSANNSLNVKGAYLEVLSDALGSVGVIIGAIIIYFTNWYWIDTLIAVLIGFWVLPRTWVLLKQSINILLEGVPEEVDIEKLRADLLSLNGVESIHQLKVWAITSKNIHLTVHLFAPEADRNKLYQDAVEMLSHEHGIGEVTLQIEDDAEINCQHIAQHASHEHNDNDKTHSHQH

SEQ ID NO: 6182 - protein, 314 aa, Acinetobacter baumannii
WVERTLISSFDDFYYFYLVVKHGGFSAASEAENISKSKLSRRIIDLENKFNVSLIQRTTRHFKVTDLGQEFYEECCKVIAQVECAENVLLKQKSEPQGLVKVSCPPLMMHFQIRKILNQFLKTYPKVEISLELTSRRVDILHDDIDLAIRTNFEPNEDSNLIVRDVIKTDHCLVASPELLQGRTIKHYSELQDFPSISLGTQKQNYIWHLCNIRNGESVDVPYQPRIKSNDLAGVYYAVMDGLGIADLPFLTVEAEIRKGTLVHILPDWKSNIGMLQLVYVSRKGQRLVVEKLIETLIDELRRLPESHEGYLPT

SEQ ID NO: 6183 - protein, 85 aa, Acinetobacter baumannii
VIRRSCCIIGQFRVLFEPFEIVTGDARFWSRAMIQTETMLGVTRQQWVLAAYNGLKYLVGHIRRYASVGDFFKVSGKKTFSRARV

SEQ ID NO: 6184 - protein, 199 aa, Acinetobacter baumannii
PILRAENNLVLSYTNKSILMKQALLVIDVQNDYFKNGKMELVGPDQALDKIKQLEQYFNEKGLPIIYVQHINPPQASFFQENTEGVLLHPELSAGSNSLIVTKHYPNSFLETNLKELLKAHQIEQLVITGMMTHICIDSGTRAAKELGYQPILIGDATATRDLSHNGKTVKAEDVQTAFLAALGMFASVQNTAEFLAKF

SEQ ID NO: 6185 - protein, 614 aa, Acinetobacter baumannii
FKIRIKAMPAYKAPLHDIRFLMNEVLDYPAHYKTLSNGESADPDTVDMILEGAADYCENVLSPLNQSGDEEGCHFDNGEVKTPKGFKEAYDQFVMGGWQGLSYPEEFGGQGLPMSLNLIKSEMMGTANWSFTMYPGLSSGCMNTILQFGTDEQKQTYMPKLVEGTWSGTMCLTEPQCGTDLGQVKTKAEPQADGTYKISGTKIFISAGEHDLTENIIHIVLARLPDAPAGTRGISLFIVPKFIPTADGGVGERNTVSCGSIEHKMGIRASATAVLNFDNATGYLIGEVNKGLHAMFTFMNTARIGTAVQGIAHAELSFQGALPYAKERMSMRALSGKKDPDKVADAIIHHADVRRMLLTQKAIAEGGRSMIYYAAQLADKMTDALTRGDQAAFEDYDDKLGFYTPILKGFLTELGLEAANHGMQVYGGHGYIKEWGMEQIVRDARISTLYEGTTGVQALDLIGRKVLLSSKGKVVREYTAEILKFCAAHARNKYLRRFAWDLTKLCAQWNTLTVRIMLAARKDRDIVSSASVDFLMFSGYVMMAYFWAQQAVVASEKLEAGNGQETPEFYKAKIKVADFYFDRLLPRAQGHAESMVTTSRTLTSLPAEHFSFDY

SEQ ID NO: 6186 - protein, 87 aa, Acinetobacter baumannii
WGKLVTLLAPGAMITAGGYTMGGTSQATPHVAGAIALLRANSVSPTESIDQTISRLKATGKPITDSRTGLVFPRIDLLAATNGLTVN

SEQ ID NO: 6187 - protein, 268 aa, Acinetobacter baumannii
RLCRNFHQRRLFLEKAMLAKRIIPCLDVDNGRVVKGVQFLDIRDAGDPVEVARRYNEQGADEITFLDITATHHGRDTTYRTVERMAETVFVPLTVGGGVRKVEDIRALLNAGADKVSINSAAVFNPEFVQEASQHFGAQCIVVAIDAKKTGDNKWEIFTHGGRKPTGIDAIEWAVKMADYGAGELLITSMDADGTKAGYDIALMRAINDRVTIPTIASGGVGNLQHLADGILQGGADAVLAASIFHFGQYTIPEAKQYLAEQGIEMRL

SEQ ID NO: 6188 - protein, 90 aa, Acinetobacter baumannii
MSIFYTQKKSLMGSGIENTNNGGETQDRTGDTRIFNPLLYQLSYHAEVGVLNNVYRRTSSNFRIFCNKCLILNHKCRKNRFLAMQFTNMS

SEQ ID NO: 6189 - protein, 228 aa, Acinetobacter baumannii
GISRTSVLLNITEFMKTILIANQKGGCGKTMTAITLATALAQKGYKVALADSDNQKSSLQWLKQRPDNVAVIQSLDWRQEKSIGDAPKNLDYLIIDAPGALSGDHAEQLVSEAHAIITPLQPSFFDIDSTRRFLKHLQDIKRIRKGKVQILLLANRVKPNSASSKDIQQFFEKIEHEPIAWIAERSAYGSLAMQGLSVFDKPQKNFIAIQSQWQPLLNKLIEDKSEWF

SEQ ID NO: 6190 - protein, 266 aa, Acinetobacter baumannii
RVNSWRCGSGSWFCKWCWRNNEFTTGFWYFLFTHNFNCPTDFTGYSEWSWWRRTRRRLWRWWRRLRWRRWTFWRWRCFRLMVTTSETTQIITQPKIEESVEPSLKRWFKHFCYLPASSRYFSKQDKQAIAEAVQQAEHGHVGEIQVVIEGHIPCSQAYRQNTRLRAQQLFAELGVWDTELNSGVLLYLNLCERTVEIIFDRGIRNATTEQIWQQICKSIVEQLQQKQYQKAVVTGVQQIGEVMARFYDENMPDQLNELGNAPIIIN

SEQ ID NO: 6191 - protein, 375 aa, Acinetobacter baumannii
TIDRVFFCKIAYWQVFFGKSLSKIHPSISIRLRKEKRHMLEAFYATERGSLEDATINGGFDLHPELVWLDLIAPSQEEQQWVLDAYNQNLPTLKSLEDISSSARFYRDDDGILHISTYFLTKNKNYQVDGDAEDSSHMLAMVQTVAFILHKDRLFTLRGEKLVAFRAFRARARRNDYEMDYKDPTWILLGLLEAKLDELADILEDIHKDLEKYSTEVLNNHQREQILDLDDMITRLAQQEDMLGKAQLCLIDLRRVLTFLSRPRALGSHIYDADIRELSEDVRSLVEHDAFLFQKVRFLLDTTSGFINTEQNDTIRRFSILPSMLAPPMLIASIYGMNTDVLPFAHGTTSFIIVLLIIIGFFIGPIIYFRWKKWI

SEQ ID NO: 6192 - protein, 512 aa, Acinetobacter baumannii
ELGRTAKFLGDIFWLRRISETSRYPPYIKENDMAAHQNGSEANHSQSLKHGLKSRHLTMISIAGVIGGSLFVGSGSIIYNTGPVVFLTYALGGLLVWFIMRMLGEMAVLNPDSGSFSTYADRAIGRWAGFSIGWLYWCTLAMLMGWEAYVAGKILNNWFPFIPIWVYMTVVIVALVVVNLQNVKNYGEFEFWFALIKVIAIVVFLVIGSLAIMHLWPWGNPAASGISNLTSQGFMPNGGSSVITALLGVMFAYIGAEIVTVAAAESANPSKEIRKASNSVVWRIILFYVGSMFVAVCLIPHNNELLKDSTWGTYSVTLSALGIPGARHIVNFVVLTSVCSCFNSALYTCSRMLFSLSKRGDAPKSFGSVNSKSSPWVGVIVSCFFSVIAVILTATESMNVYDFFMLTTGAATLYVYLTIAYSQLRMRKKLEAEGVKIDFKMWMFPYLTYVVIFAIIGAILTMLIEGTYFKEVIYTTALFGIIVFFGLLSEKLGWGKERRATHLTHTHEEKLV

SEQ ID NO: 6193 - protein, 664 aa, Acinetobacter baumannii
GELSMQIKTPDIGVDKANVAEILVKVGDRVEVDDSIVVLESDKATVEVPSTSAGVVKSILINQGDDVTEGVALIEIEAEGAAQPAPEPTPAPAAEKPAAPAPAQQTQASAQPAAATSAATVEVTVPDIGVEKALVGEILVKVGDQIDVEQSIVVVESDKATVEVPSSVAGTVESIQVKEGDTVKEGVVLIQVKTAAASNAQAEAPTTTPAPAAVAEPVAAKQETVAAVPAQSGSVDINVPDLGVDKAVVAEILVQVGDKVDVDQSLVVVESDKATVEVPSTVAGVVKAIHLQAGQQVSQGVLLATIEAEGQAPAAAPAAKAEAAPAPQAAAPKAAAPVATQSAPAASTSGTDKLTKEQEAENAKVYAGPAVRKLARELGVILSQVKTSGEHGRVVKEDIFAYVKSRLTAPQAAPVAQATAAPAGLPSLPDFTAFGGGEVKPMTRLQQVSVPQLSLNNYIPQVTQFDLADITELEAWRGELKDGFKKQGVSLTILAFIAKAVAHLLKEEPYFAGHLADDQKSVLLRNEIHMGIAVATPDGLTVPVLRNPDQKSIKQIAVELGELSKKARDKKLTPKDLQGANFTITSLGSIGGTAFTPLVNWPQVAILGISPATMQPVWNGKDFDPRLMLPLSLSYDHRVINGADAARFTNKLTKLLKDIRTLLI

SEQ ID NO: 6194 - protein, 327 aa, Acinetobacter baumannii
QFKRYFSNIFNNGTRYVLYITMELRHIRYFLAVAEEKNFTKAAQRLNMSQPPLSMQIRDLEEELGADLFIRSPHGVELTEAGLAFLNAIQPVQQRVEDAANLVKQVANGEVGQLRLGFTGTSMLNPLIPKCVRYFQQQYPKVNLKLEEANTLLLIDLLLEDRLDVAIIRSPRNMPDSLILQELLAEPLIAALPSESFNLDDASQEIDLTALRELDFIVSPPSVSAGLFDAIKQACHERGFEPKIGQNAPQIVSILSLVSANLGVSLVPESTKQLQIQGVAYRSLKAPVPTVGLGLAYKKHAPSQMAINFASVVQVACHHANEINEIS

SEQ ID NO: 6195 - protein, 301 aa, Acinetobacter baumannii
IPKRIVFKFYSAADFNARLIEICAATLATIKSWVLVMFNEEVAYYFDGSMVGLLSCVFRAFQFKELQVRLCLNDTAQHGLFADKIEVVNNEQHAERVWAALQKKLSSSSLKQFYFAYLSESLDAYQHLFNYCIYVFSSHVSIEKDYSHPSVLAITQWTKKVGREKHRMEAFIRFKKTKDELFLSLVRPDFNVLPLIQPHFKRRYQDQRWLIYDEQRKFGLYYDLREIHEVSLEASDVDRNLKNGMSQSFQLELDEQEVLYDQLWKDYFKSVNITERQNIKLHVQYLPKRYWRYLNEKLIEY

SEQ ID NO: 6196 - protein, 325 aa, Acinetobacter baumannii
KMKRNLIFFCAAILSGLSVSATHATNAEQVKSSFVYSTYAQTKYPLVFNHGMAGFNRVGTDTLGLDYWYQILPDLARNGGNVWATRVSPFNSTEVRGEQLAQQVEEIIAITGKPKVNLIGHSHGGPTIRYVAGIMPEKVASLTTIGAPHKGSPMADVILNVEGTPLSGLATLVNWFSAAITWAGGLDPNSYPHDSLAGAHSLSTQGSAQFNAQFPMGVPTTSCGEGAYQEKGIYMYSFSGNKALTNPLDPFDIALTGSSLVVDPFGDNDGLVSRCSAKFGKTIRDDYNWNHLDEVNQVMGIRSIFAADPVSVYRQHANRLKLQGL

SEQ ID NO: 6197 - protein, 326 aa, Acinetobacter baumannii
SMRSIIHRNFGEPVEVLEQADMSKPEPKAGEVRIKTIMSPIHNHDVWTVRGSYGYKPTLPAIGGSEAVGIVDALGEGVEHVQVGQRIAVAAVHGSWAEYFIAPAQGIIPLNNEIDDETAAQLIGMPISALMLLDFVNVQPGQWLIQNTANGAVGKTVAMIAQARGLPVINLVRRSDAIAEMQALGIQHVVATDQPNWKEQVKQIHGDQPLIAGVDSIGGTASGEMLNLLSENSLLVSFGSMTGETMQISSGDLIFKQATVKSFWASVVNKEMPAARKKELIVELLTLATQKKLILPVEGVFSFDEIKTAAQRATQGARQGKVLLKP

SEQ ID NO: 6198 - protein, 68 aa, Acinetobacter baumannii
PLRSEFYAESWGRTALKECEISQNIFLAKTSVRKNGTAYIGLSAQNFFLRNIELTIVHRHYRKKKLFV

SEQ ID NO: 6199 - protein, 302 aa, Acinetobacter baumannii
KLGRIIRVNNLIIGTLFALCAAALNASIGVISKLLMHSGLNPQDIAFLKTIIAFFFLSVFLFKVPVSQKIAFISSTPSKLSVFSQIAICAFLGIFSLFFFETIAYNHGAAANVVVVLMASAAISALFFGRFILKESIYIHSLIGTLLAVAGISIISWKGENSLLMLINASIAGTGYGLFSVLVKRFKLNGGLFLTKYLLLFGSVYLAVPFLVNLHSITFNSDIILGLIGLAVLPTILGFFCTTKALSYMSAAKVQVTELSEPIFAALMAWVFIHEQPTLSFLYGAIFIISGIFLMNKAPKSN

SEQ ID NO: 6200 - protein, 204 aa, Acinetobacter baumannii
RFLRNVSMTQRISEVVRNTNETKIRVRLNLDGTGQGTLNTGVPFLDHMIDQIKRHGLFDIDIHCDGDLEIDDHHTVEDCGITLGQAFAQALGDKKGLRRYGHFYAPLDEALSRVVVDLSGRPGLFMDIPFTRARIGTFDVDLFSEFFQGFVNHALMTLHIDNLKGKNSHHQIESVFKALARALRMACEIDPRAENTIASTKGSL

SEQ ID NO: 6201 - protein, 145 aa, Acinetobacter baumannii
QYLRYKAMKKQRLMIALLATLGMGSAFASTSSEYNIANGLLPVEKDQSISVLQPFQGNFRILGSKIYHNDEQAKFSPIDYAVSWGLFAQPEIARHISVKQYDRYLNWKIAKLPVPAEQAMQMVSNMHIIPANPEIAQQIKQVKTW

SEQ ID NO: 6202 - protein, 304 aa, Acinetobacter baumannii
FNLSMSPISLSSSKAPQLALILITIIWGGTFLTVQYALSFSSPMFFVGCRFAVAALTLLLISLKSMKGVTLKDLGAGSAIGLVIVAGYGTQTIGLQTIPSSESAFLTALYVPLVPILMWLIFRKTPHIMTWVGAALAFAGLVLLTGNGFEQISLSFGQLLTILGAFAIALEIIFISYFAGKVNLRRVTIIQLGVASLLSFAIMPMVGEHTIPAFSWPLVLIAVALGLASALIQFVMNWAQRVVDPSRAAIIYAGEPVWAGIIGRIAGERLPVIALFGGALVVLGVLVSELKIKLPIKKAKRIRE

SEQ ID NO: 6203 - protein, 153 aa, Acinetobacter baumannii
LKMRKRMNIFEALRESHENQRNLSEQLIQTHGLTEERKELFDALKNELYAHSVAEDRYLYIPLMFDDVGLDITRHALSEHHEMDELVEQLEKTDMSSPSWLATAKQLSEKVHHHLKEEEHKFFQQAGKILKDSEKETLGNKYLKEYKKYKKQQ

SEQ ID NO: 6204 - protein, 109 aa, Acinetobacter baumannii
KKMSQQLLIIVGIALLALGTYSIRFAGFHLGAKFSFSEKYQVLLSNGATVLLCAIAVTTTFFEGHHFAGFARIFGVGLALFLVWKKAPLLLVICLAAAGTALVRLLGIE

SEQ ID NO: 6205 - protein, 287 aa, Acinetobacter baumannii
LIVRPAEYSVQALSASCHFKILDTRMTKQFAVIGNPIEQSRSPELHHAFAEKTGVELNYQKRLAPLDGFESSMRSFFAEGGSGMNVTVPFKEQAFALCDMLTERAQIAKAVNTLWMENGKLHGDNTDGQGLVAAIQALEWNLENTTILILGAGGATRGVIYPLVQAGAKKIVIANRTLARAEQLVDDLKTAVPQAQLQAISLNDLEGDFDIVINATSASLSGDALQLPEKLKFKYAYEMAYGKPSSFLDQAKQRNVPYAEGFGMLVGQAIEAFSIWNGVRPQLKDFL

SEQ ID NO: 6206 - protein, 487 aa, Acinetobacter baumannii
NRVSLEPIPPQTFTDYVAYSERKRTRWERFLDKIKPRSAAMRTTILVLLVVLFSLFMSLWFFWRTLYLPEIQQHARYLAVELELVNNPNIRIFHRDSEVDVDTWLRNRVGIEYVTNPKEYPSVRDKIIAEFFTNQVEQKLANEIGAKDVTVYFQFKPSPRIWIQTPEMHGNWVREPLKTYANYSPELLVGWVVGVPLVSAIIILILVRQMNRPLRRLQNAANEYSKSGTAPYLDTNHGPLEIRQVNQAFNRMVYTLEQTERERRIMLAGISHDLRTPLTRIRLTAEMLPDEFLREGLVYDVDDMDAILNQFISYMRDGSDEELKDTNINILLQELVVQFKPLDIRFNMQDVPIIPARSLSLKRLIANLINNAKRYGAEPIELSAKVENEHILITVADHGEGIPEDQIEELMQPFVRGNSARTIQGSGLGLAIVKRIVDIHQGEIQIHNREQGGLEVIISLPIPKPAPEENTTHNPLEKIKQTLSERF

SEQ ID NO: 6207 - protein, 211 aa, Acinetobacter baumannii
RNSRNEQSTRCSSLWNLVMPIEEIFTCLKREINPSICCVAKPAENGVEVILTEKVRRTDPNPPALNKLTLFGFDEVISINQDLVRAYYPILLPTKKAINKTCDGILLAAIKGKLYFLVTEMKSSLSNMDEHILKMQAGKNMVSYLKCILSEYLGIDTSSWNTYYCIFHIADPKRETNESLLISCDPKYPMYFCVENNDRFSALKLINESLI

SEQ ID NO: 6208 - protein, 242 aa, Acinetobacter baumannii
SLSGRKIMNIVLLEPEDVQSDTWSIHSKRQLQHLREHLDITVGQNLKVGIRNGARYITEIVSMNEYEVCIRPIREEPLPAKLPVHLIVALPRPKVLRRLIMDSVTLGVERISLIHSYRVDKSYWQTPFLQQVDNYVTLGLEQAGDTIVPEIQLYKRFKPFVEDILPSLITQETPAYVAHPYAEQRMPINISYACSVVVGPEGGFIPYEVDLLIKNGCQAMSLGNRILRTETSISYILGRLFS

SEQ ID NO: 6209 - protein, 283 aa, Acinetobacter baumannii
KRSGIRTKIMPIQKCKPTSPGRRFVEKVVHDHLHKGAPYAPLVEAKKRTGGRNNNGHITTRHVGGGHKQHYRIVDFKRNKDGVPAVVERIEYDPNRTAHIALLKYADGERRYIIAPKGLRAGDKVQSGNDAPIRPGNCLPLRNMPIGSTLHNVELKIGKGAQLARSAGASVQLLGRDGSYAIIRLRSGEMRKVHVECRAVIGEVSNQENNLRSLGKAGAARWRGVRPTVRGMAMNPIDHPHGGGEGRNKGIQPVSPWGQKAKGYKTRTNKRTTKMIIRDRRVK

SEQ ID NO: 6210 - protein, 648 aa, Acinetobacter baumannii
PSLGFARLIKALPHMLYTEIPTQRPVTPLLDAIDHPQQLRQLEHSQLLQVADELRQYILYAAGQSGGHFGANLGVVELTVALHYCFNTPNDRLVWDVGHQAYPHKILTGRREQITTIRAKNGLAAFPAREESVFDTFGVGHSSTAISAGLGMSLARRYQKDPCEVVCIVGDGAMTAGMAFEAMNDAVAHDADLIVVLNDNDMSISCSTGGFAKHLAAIWEKGHLVNVNEHGEAYIQPHPKWTYNSRLHQSATDAADNLFKAIGFDYFGPFDGHDVTQLVQVFNALKKRKGPRLVHVYTKKGKGFAPAEADPITYHAIGKINAASGGKTPPKYSDVFGEWLCDEAAQDERLLAITPAMCEGSGMVKFAKQFPQRFFDVAIAEQHAVTLAAGMACEGLKPVVAIYSTFLQRGYDQLIHDVALQNLDVTFGIDRAGLVGEDGPTHAGAYDYAYMRTVPNMVIMAPKDENECRQMLHTAYAYNGPAAVRYPRGAGVGVEIQKEMTVLELGKAEIVAEIKANSDEQITVLAFGSRVMVALEAAEQFAQKHDVSVCVVNMRFVKPLDEQMIRDLAEHTHLFVTVEEHAIMGGAGSAVNEFMAQEQIVKPIINLGLPDSFLHQATHNQMLQDCGLDAKGILNSIERAWLKVNQVV

SEQ ID NO: 6211 - protein, 115 aa, Acinetobacter baumannii
TLIGVMMEVTAKLRGAAISAQKARLVADLIRGKSVAHALNILNFSNKKAAVLVKKALESAIANAEHNNSLDVDDLKVSTIYVDEGMSLKRIMPRAKGRADRITKRTCHITVKVGV

SEQ ID NO: 6212 - protein, 697 aa, Acinetobacter baumannii
SSKGGEKLMSKHTVLFELGCEELPPKSLKTLRDALQAETVKGLNEAGLNFASVEAYAAPRRLALKIVDVDAAQADTQKRFDGPAVQAAYDAEGKPTKALEGFMRGQGITVEQLSTFQAGKVEKVCYLKDVKGQSLDTLLPQILQTALDNLPIAKRMRSAASRTEFVRPVKWVVLLKDDQVIEATIQDHKAGNVTYGHRFHAPEAVTLAHANDYLAALEKAYVVANFEKRQATIQEQVKKLADEVNATAIVPADLLDEVTSLVEWPVALRATFEERYLAVPQEALITTMQDNQKYFCLINAEGKLQPYFITVSNIESKDPTQIIEGNEKVVRPRLSDAEFFFLQDQKQPLASRKEKLANMVFQAQLGTLWDKSTRIAKLAVALSSITGANPADAEKAALLAKCDLTSELVGEFPELQGIAGTYYARIEGENTEVSEALGEQYLPKFAGDVLPKTKTGTTIALADRLDTLVGIFGIGQAPTGSKDPFALRRSAIGILRLIIENELDVTIEELVNLALQGYGDIVKDHDKTRADAVAFLEGRYRAKYEDQGVAVDVLQAVQALAPKSPLDFDKRVNAVNHFRTLPEAAALAAANKRVANILAKEAAPEGSVVEANLVEDAEKALFAELQAVTPVVEPLLAAKDYTTALSKLAALRAPIDAFFDGVMVMADDADLKANRLRLLAQLRNLFTAVADVSVLQG

SEQ ID NO: 6213 - protein, 187 aa, Acinetobacter baumannii
HYRGIKNMILTTERLILRPWQDSDASSLYEYASDDRVGPIAGWPVHESEAQSLKYIQTVFAKEEVYAVAKKEDNRAIGMVGLLIGKESNFKIADNEAEVAYWIGVPFWGQGLIPEAVKAVMKHAYEDLKLKALWCGYFADNEKSFKAQAKCGFKHHHTEESKFNKFLGDYRTEHISYLSYEDWKREI

SEQ ID NO: 6214 - protein, 517 aa, Acinetobacter baumannii
KYMGTPIVIAKNINDTSKEIVLLSQFANRHGLIAGATGTGKTVTLKVLAESFSRIGVPVFLADAKGDVSSLAKAGEASDKFNERLKLLQIDSVPFAANPVVFWDLFGQQGHPIRTTISEIGPILLARILNLNDTQEGVLSAVFRIADDQGLLLVDFKDLKAMITFVSEHAAEFKAEYGNLSPASLGAIQRNLLALADQGGEQFFGEPALNILDFIQTDANGHGYINILAADKLMNTPKLYATFLLWMLSELFEQLPEVGDMDKPKLVFFFDEAHLLFDNASQALQEKIEQVVRLIRSKGVGIYFITQNPLDLPESVLGQLGNRVQHALRAFTPKDQKAVKTAADTFRSNPDFKVDEAITELGVGEALISCLDEQGTPQIVERGWVMPPYSSFTPITPEERQTLISQSIIAGVYEQAVDRDSAYEMLQNKVAEREQQKQDAELAKQQAKEQETLAKQQAKEQERLAREQQKEEERAARERAKLTQDIVGTFAKSAARSLGGSTGQKLVRGLLGSLFGK

SEQ ID NO: 6215 - protein, 158 aa, Acinetobacter baumannii
GKFMSVWLAMLIGAGIGIIITTLILSNTRNGRIKAEYEQYIAELELEHQQALAQAQKRSVNTSRAVLKGKMAEQFAPVLPEFQYLPSDAKFMGDPVDYIIFDGYTDFRDGDGTADDIQIILLDVKSGGARLTKGQQAIAQAIKEGKVRFETLRIDFED

SEQ ID NO: 6216 - protein, 855 aa, Acinetobacter baumannii
SLLIMKKLSSLGFVRPIFLIIIIILVSLPMGFYGMYLYIAPTLPEMSSLKKAPLLKPLQVYTADNQLIAEYGGKLSIPVEYKQIPPNFIHAFLAAEDSSFFEHSGISFKGLGRALSESVTGSDVQTGGSTITMQVAKNYYLSPERTLKRKLTEIFLARKIEQNLSKEDILSLYVNKIFLGKNAYGIAAAAKIYYNKSINELSIAQMAMIAGLPKAPSKYNPVVNPERALERRNWILGRMLQLGYISQTEYQKAVAEPINLNMPNRDLNNIHPYAGEMVRSELVKHFGEQAIDSGYKVYTTINAKRQAIAEKAVQDGLEAYDRRHGWRGAEAHDKPLSEFRAYANTYPAQVTKVNSSSFEALMQDGSTVTVQWSGMSWARPYRNANNVGAAPSRASQIVKVKDIVRLRPNEAKTAWSLVQVPKVQGQLIAINPNDGSIEAIVGGYNFYQSKFNRALQGWRQPGSTIKPFLYALALERGMTPYSMVNDSPITIGKWTPKNSDGRYLGMIPLRRALYLSRNTVSVRLLQTVGIERTRQLFMDFGLQEDQIPRNYTIALGTPQVLPIQMATGYATFANGGYRVQPHFIQRIEDAYGKVIYEAKPEYACIPCINAPETTDDAQVTTPDDQVVEVTNKELEQKEKATKQLNLKQTDKNNSQYRQAQRILKSSSAYDMANILRDVIEHGTGRAALKIGRSDLGGKTGTTNDAKDAWFAGFNGKLVTVTWVGFDQPTTLGRREYGGIAALPIWINFMGQALQGTPAAWVRLEKDAQAPISRDKQEVTTEVGDKKTYRAAPPLARPLYRPAPPQPKTTNNDFDDLPGEEIVIPSKTTPPAMKPSQGAAPKREKDELENLINQIE

SEQ ID NO: 6217 - protein, 170 aa, Acinetobacter baumannii
NALMAYDMVSSTNLDKNIIGVHLMIHSKIIGIGVITGLCSMAALAEPAVQPGDTLESLSKVKVTTTVNGQPGSISDLVNSGQVQQVSAAPTSAAPTGAPIPADVPPAPPAGGEMAPPAAPTDAVPPAPNQAAPAPQDPNTPPPAANPNQSADPMAKDGALPADAPMPQAQ

SEQ ID NO: 6218 - protein, 230 aa, Acinetobacter baumannii
MRSIIEFWSSFRLLPSAWLLLVQFILLILAMLTFDNEAYRTLTWALGVLALLIIAKVIRQTPMFTFLGLAFVSGAIIASVFILLGYSNLTIQIFAHSCEALAYFSAAYGLFRYMFADRYLTRDELFAAAAVFTLLAWGFAFLYNICQLLIPNSFQNPNHIHHLQTWLDLLFLSFSLQSATGLSDLMPLSPPARVLAMLQMFCGVMYLALIVTRLIALQYIKHTPKKNSDK

SEQ ID NO: 6219 - protein, 128 aa, Acinetobacter baumannii
SMPITVHAYSSLDNSEIRDQLERLYDTSPEFGDGHDAIEQLEQDLQQYTTLYTAEFNTKIIGAIWCSGQGESKVLEYIVVHPANRGRGVAERLVEEACRIEEAKGVKIFEPGCGAIHRCLAHIGKLHS

SEQ ID NO: 6220 - protein, 201 aa, Acinetobacter baumannii
SVPIEFIATSKLPTAFGEFNISVFQDPVTGEEHVALSKGLENPPTGPVLVRVHSECLTGDAFASLKCDCGPQLQATQKLINEAGQGVILYLRQEGRGIGLTNKIRAYALQDQGHDTVDANLLLNLPADARRYDMCSIMLDHLKVKEVKLITNNPLKIQALKDQGINVVDRVPLTVGRNPFNEQYLKTKRERMDHLYQKDDF

SEQ ID NO: 6221 - protein, 545 aa, Acinetobacter baumannii
PVTMQVFFLFLAAILLGFAWLSPFHYNPWVMFSSEMSTFAAGLSVLAVLFYQNIKIPRAQLLLLPFTLIPVVQWAFGLVFDFSTALLSSLYLLGFWFMVLAGYNLSLDQKKRDQIFSGFSLLIIITSLFTSLIAIFQWLNIESHLIYTLHLIGNRPYGNFGQPNNMATFLIIGLLGCLYLYEKHKVTLWLLLPSALIILFTIALSQSRTSWIVFPFLLIYWMVKQFGKQKRFRFVQGLLWCLAFFLIAGLILPYITQFIEFSTNTEITETSSFVARAGSGHERIGMWIQILHAIAQQPWLGYGWSQTSVAVVDSIQYGTVHVWFNSAHNVLLDIIIWNGIPIGIVIIAYFACWFVWLNQQAKETISIIAIMMVCTVLIHAMLEFPQRYAYFLLTCGFLLGIIQAQTPVLKGIVLNKQVLRLIWGISVILLVAIWRDYNVYVTNSNLLFKNKQPNAEILGSNQIFILTQFEQRLKWIEMKPETTLSDADLAVWGNFVKNKATPYNLRKYAQLLAYNGKVEQAEQQIFILQHLYRQQITLAELLKNK

SEQ ID NO: 6222 - protein, 218 aa, Acinetobacter baumannii
MMYMSLKWSSLLMKHLGVAAILCMGLSACDVNHANSKDHSAVATTSRHEDSLIKSTTKVKTLDDAAGRTFLPEGVPDQTSKLSEADQQYAGRYHTRISCEDNFADCETGEAEYILNLLPDGTAYWNVVHFGRVGSKDGSKSAVINQLCPSLKWKVEPAAHELTIQCPLSDVNFYFDIDAKQRLVVNLEKLFYSDFGKNREFLEQNYFVPTKAYVLDKE

SEQ ID NO: 6223 - protein, 169 aa, Acinetobacter baumannii
RDHIALPKKHTLKKTYIHYKELGTCLMNSQKLLFSTLCCLALTACATTAPLSSYPQAQVLEQDTNIEAYPTTTGNVAKLIKHDKQACMIEFTGYLGGGQVTEHWIFNNKGLISAQSFTEQYPDSSGILSQATNSTTKSSTTFNIQDPEIQNNFKKLQSNFSKDNLAKCD

SEQ ID NO: 6224 - protein, 206 aa, Acinetobacter baumannii
KVNISFWKIMKKIKLYTIALGVAVATQLTGCLSVKSYVDPAYKSVTYSDIKRPVQPIPVVLTTEFQRNGTVIPKASKELQSAVERSLRATGIFSPTAQPNGGTQAKLYVTANNVADLGEAAGKGVLTGLTFGAVGNAIADKYEFKFNYVDVQGKQISQRYPHMILTTVGNKKAPIENVQPMSINEAFNKVVDDVVIRFSSDLQKQQ

SEQ ID NO: 6225 - protein, 298 aa, Acinetobacter baumannii
VLNMNIAGMTAEKSYLNRRKALGITVRRLEFNPQAIKRYYFANSPLMSHFLTALSSTFPVGEQFFVNSVRNVRDKVSDPQLQAQIAAFIGQEAMHSKAHGEFNEAWRRDDYNLDRFQNWLNERDKYLRTISPKLQLALTCAFEHFTALLGGYILQHPELLKTLDQDALKLWVWHAIEEIEHRSVAFDVYQQVYGDDRIRRLLMRSVTTGFASLAFYGTTRLFWQDKWKSLPKIGGNLFGLYLLAKMLIQLTPEYFAYYKKDFHPSQKDYGHMVDYWKSYLADEYQMTSFQEEKNSRPS

SEQ ID NO: 6226 - protein, 138 aa, Acinetobacter baumannii
KMNIELDPIDLKIIALLKQDSRLTNKEIGQRVHRTGQAVGARIAQLMDAGVIKNYTIAVQYRHKQFIHLHLNEQRSFEEIENLVKQYEQIDECFKVMGNACYMIVSHFEPAELNAFIEVLSKWCRYSVETVIREVEKA

SEQ ID NO: 6227 - protein, 253 aa, Acinetobacter baumannii
GFDMGQKVHPIGIRLGVVKRHNANWYANPKQYAEYLLKDLQVREFLTKKLKNAMVSNILIERPSGAAKVTISTARPGIVIGKKGEDIEKLQRELTNIMGVPAQVSINEIDRPDLDARLVAEAIASQLEKRVMFRRAMKRAVQNTMRAGAKGIKVEVSGRLGGAEIARTEWYREGRVPLHTLRADIDYATMRAETTYGTIGVKVWIFRGEILGGMKQVMNPAPAEERPAKRGRGRGEGQERRGRRGDRAADKGE

SEQ ID NO: 6228 - protein, 65 aa, Acinetobacter baumannii
ISFIRNFLDLVHPISRLWLLFYWILFVCLFSMMTLSKPRQCDFGHILITYSSIRNCEHFYKIKLI

SEQ ID NO: 6229 - protein, 289 aa, Acinetobacter baumannii
GTSMQNLPIIAVLYMILSMVSYQISASFAKQLIAALDPLTVTILRLCFAAVIVAVMFRSWKIWSRLPYLKWRDLLMYCASLGLMNILFYTSLGKLPQGIAVGLEFIGPLGLALVSIKQKSDYIWVAFAMLGIALMVPWQDPTQHHFSYVGAACALGAGLCWAFYIYFGQKVVTQNIGMHALTIGITVSALSLLPIGIWYNGPALLDTQYWGKALLIAVLATAIPYALDLMALKQLNKLTYGTLTSLAPALAALTGFLLLHEEISMLQWVALACVMLASIGVTLRSKTAS

SEQ ID NO: 6230 - protein, 65 aa, Acinetobacter baumannii
SIVLACKLRRNRPNASANTSCKISLSHTFNLSTPTGVLFYLCKLFTNYCSSSNFYFIFSIHQNKK

SEQ ID NO: 6231 - protein, 257 aa, Acinetobacter baumannii
GLAMTPQQIELVKSTVPVLREHGVTLTTYFYKRMLNNNPELKNVFNLDDQTSLRQPRALAAAVLAYAENIENPTVLAKAVERITTKHVSLDIQPDQYAIVGDNLLHSISEVLNVPFESELIEAWKQAYLQLADILIGVEKQKYEQLESLKGGWAGWRSFEITQIDPLESGKRFTLKATDHEDVLTSPANAFISVKVQVPNQQLEQPKAFKFTEAQEDNTYHFDVQPEEDHTEFSVSNILLEHYRVGDQVQVSAPLTL

SEQ ID NO: 6232 - protein, 186 aa, Acinetobacter baumannii
AIYMKNLEASFRALRVLHTAKDLFNQYGFHKVGVDRIIADSQIPKATFYNYFHSKERLIQMSLTFQTDALKEEVFSTIYSYRELMVFDKLKKIFFLHADSDGLYRLPFKAIFEIEKHYPLAYKVVIDYRNWLIQEIHKLLLTVKPAATVEDAHMFLFVVDGAMVQLLSSNQTDEREYLIDYFLSRV

SEQ ID NO: 6233 - protein, 62 aa, Acinetobacter baumannii
ILYINILQLIEKENCLINPYDGNHNFKSLVFSSYNTRDYFVASCDVLVFQLRSPAWPNIFIR

SEQ ID NO: 6234 - protein, 327 aa, Acinetobacter baumannii
GGDMQDFLALTLQGEQPATREGKQANFSWRWLGEGLLECTPHAQYDKAVVLSAGVHGNETAPIELLSHLCTDLFAGRLKLAVRLLLVLGNPYAMRQGKRYVHDDVNRMFCGGYKNLPVTEESKRAEVLEQTVATFFQESSSQAKRYHYDLHTAIRASLLPTFALFPYQTHSYDADLTASLEAADLDALVYHNAVGKTFTHFTSENFKAASATLELGKALPFGQNDLSQFASIDEVIRNVVSEQALPVRNKPKIRVFQVSDSLIKRDEEFHMNLSAEAPNFSTFTKGEIIATQPSGNYVVEQDQVWILFPNPNVKIGLRAGLVLTETI

SEQ ID NO: 6235 - protein, 116 aa, Acinetobacter baumannii
DQRMWALFLKCMLGAGVVLIISILSKSKAFYIAGLVPLFPTFALIAHVIVYQQKGAEALQKTALFGLWSLIPYAIYLAAVYVLATRMSMWSCLGVATLCWVVAAAGLIYGWQLFQS

SEQ ID NO: 6236 - protein, 202 aa, Acinetobacter baumannii
VIGIYASQRTDMQEFLISTSIVALAEMGDKTQLLALLLSARFRKPIPILIAILLATLINHGISAVLGQWITTVLSPEILVWVLAVGFIGMAFWMLIPDELDDETASINKWQKFGVFGATFILFFLAEIGDKTQIATVALAARYDSIFWVMLGTTLGMMIANAPAVFIGNKLAERLSIALIHKIGAAIFFIVGVSTLVQHYFF

SEQ ID NO: 6237 - protein, 259 aa, Acinetobacter baumannii
NMGMEWDVILSLIFFAFTAGAIDAAVGGGGLIQIPGIMSTFPNMSTATVIGTNKVSSIFGTASAAYTFAKKVKLQWKLLAVIAICALISSFAGAACLSLIPQSVLRPFVFVMLIVIAIYTLVKKNFGQVHTEQKITTKMLVLAGIGSLAIGFYDGIFGPGTGSFFIFFFIRFLQVDFLHASALSKIGNFMTNLAALSFLIPTGHAILHIGLMMAAANVLGSIVGVRTALKYGSGFVRIIFLILVSILICRLGYQMFVTG

SEQ ID NO: 6238 - protein, 70 aa, Acinetobacter baumannii
DVLMYRYNQLNVLSMALHGQFEPSKFAMHRYVRLRMKDLTSFFLSTYTDSDVINLQSLLFSNQNLAITMF

SEQ ID NO: 6239 - protein, 277 aa, Acinetobacter baumannii
KYLIFKVFLGNFMGFEKTTSQILFDNGVHKCISFTSLVKGEGIQANQFLIIDHERAAVIDPGGDLTYVPLTMELNKYTRLKNLDYVMASHQDPDIITSMPRWLVYTDAKVVASKLWARFLPHLNSSFMSERMKGNWEDRLIELPDRGQVIQLGESKLVIIPAHFLHSVGNFQFYDPVAKILFSGDMGASIVDDASQPLKDFDSHVMKMKAFHQRYMCSNKVIRLWVNMIRQMDIEMIVPQHGSPFIGKEMINQFLDWIETLPCGVDLMTEQIFSCPT

SEQ ID NO: 6240 - protein, 196 aa, Acinetobacter baumannii
RQLMRGVNKVILVGTLGRDPETKTFPNGGSLTQFSIATSEVWTDKNTGERKEQTEWHRIVLHNRLGEIAQQFLRKGSKVYIEGSLRTRQWTDQNGQERYTTEIRGDQMQMLDARQQGEQGFAGGNDFNQPRFNAPQQGGGYQNNNQGGGYGQNNGGYGGQVGFGNGGNSPQGGGFAPKAPQQPASAPADLDDDLPF

SEQ ID NO: 6241 - protein, 380 aa, Acinetobacter baumannii
IKIMKLGESTMTQLQQSIKFAYWVPNVSGGLVVSNIEQHTDWSYDYNVRLAQAAENNGFEYALTQIRFTAGYGAENQHESVSFSHALLAKTEKLKVIAAILPGPWKPALAAKQLATIDYLTEGRIAINVVSGWFRGEFDAIGEEWPEHDERYVRSEEFIRTLKGIWTTDNYSFDGKYYQFQNYTLKPKPLQKPHIEVFQGGSSRAARDMASRVSDWYFTNGNTVEEIQKQVEDIRAKAKANNHQVKIGVNAFIIARDTEEEAKAVLQEIIDKANTEAVNAFGDATREAGAASPEQEGNWAKSTFEDLVQYNDGFKTNLIGTPQQIAERIVALKNVGVDLVLSGFLHFIEEVEYFGEKVLPLVRQLELQQEKEVEIQAKSA

SEQ ID NO: 6242 - protein, 733 aa, Acinetobacter baumannii
MVVFMPALELKNRFHVNDLLSGVVVFLVALPLCLGIALASGAPIISGIIAGIVGGIIVGLLSGSHISVSGPAAGLTAVILVQLDQLGGNYAAFLLCIVFAGILQILFGVFKLGFFANFIPNNVILGLLAAIGAILIVTQLPYLFGLTDFSWKEVWTATPDTFIQKFDAGAALIGLLSLFLILAWDSSPLKKLALPSALIAVVLAAVFNFVLISIGSSWAVQSNNLIQLPNILQAPEEVLVFPDFSYLAEPLIYTGAITLAIVASLETLLNLEAADKLDPQKRSSPPNRELWAQGAGNIVSGLIGGMPVTSVIVRSSVNANTGARSKCSTIIHGVLLLLAILFFVPLMNMIPLSALAAILIVTGFKLTHPKLFKQLYQKGWRQFLPFIITLVAILLTDLLTGILVGLFTSSAFILYGNFNKGVRVYKEKHLHGIVTRIELPSQVTFLNRSALISALEHIHKDQQLIIDATQCDSIDPDIYQVIQDYQNETAVKRQVDLKLIGFKQHYEEVDDAVLDIYISTRDLQRKLSPQQVITLLKEGNERFVKNERLQRDIYRQIRVTADEGQHPIAAVLGCMDSRAPTEMIFDVGIGDLFSLRIAGNIAGQKVLGSLEFACQAKGSKVILVLGHTDCGAVTSACQLRLQQKQISDVKEMPHIQYVLGPLMHSVESVYDIMQPRELNKTFVNQVTAMNVHYNIQYIINNSTVLKDLLDRGEIAIVGAIYDVKTGHVEFLDA

SEQ ID NO: 6243 - protein, 64 aa, Acinetobacter baumannii
NSSMFIVIMRKSKRKESPLAWLSKFLFQRGLPYLFIALALCNGIYFAYALLTGHFVDQFQVLDQ

SEQ ID NO: 6244 - protein, 507 aa, Acinetobacter baumannii
GCPMSLSRIRLASLHDKVISAEQAAQFIENGMTVGMSGFTRAGEAKAVPQALVELAKKNPLKITLITGASLGNDLDKQLTEAGVLSRRMPFQVDNTLRRAINNGEVMFIDQHLSETVEQMRNQQLKRPDVAVIEAIAITEDGGIIPTTSVGNSASFAIFAEKVIVEINTSLSESFEGLHDIYIPTYRPTRTPIPLTKVDERIGTTAIQIDPSKIVGIVFNDTHDSPSTVTPPDDETQGIANHLIAFFEKEVAEGRLPKNLGPLQAGIGSIANAVLTGLKDSNFEDLIMYSEVLQDCTFELIDAGKMKFASGSSITLSAKCGEKVFGNIEAYKDKLVLRPQEISNHPELVRRLGIIGINTALEFDIYGNVNSTHVCGTKMMNGIGGSGDFARNAHLAIFVTKSIAKGGDISSIVPMVSHVDHSEHDVDILVTEQGLADLRGLAPRERARAIIDNCVHPLYRDALNDYFDRACAKGGHTPHLLREALSWHANFEETGQMLQPTPVAKSA

SEQ ID NO: 6245 - protein, 232 aa, Acinetobacter baumannii
VITMNKYFAEFLGTFWLVFGGCGSAVLAAAFPELGIGFAGVALAFGLTVLTGAYALGHISGGHFNPAVSVGLWVGGRFDVKDLIPYIVAQVVGATAAAFVLYIIAQGQAGFSGVGGFATNGFGDLSPNKFGLGSAFIIEVVLTAFFLIIILGATDRRAPAGFAPIAIGLGLTLIHLISIPVTNTSVNPARSTGVAFFAETAALSQLWLFWVAPILGAVIGAIIYKVVAGDKD

SEQ ID NO: 6246 - protein, 133 aa, Acinetobacter baumannii
VKTITVAAAVILNEQNELLLVRKRNTQAFMQVGGKLEPNEAPESAIQREILEEIGSPCVIEQFIGRFETAAANEPDHKLISHLYLVRLKQSPQIAAEIAEMKWVKFNDSETKLAPLTKEIVIPWCEQNLSITL

SEQ ID NO: 6247 - protein, 104 aa, Acinetobacter baumannii
SVQIYHSKTRTFMARVTVEDCLDHVDNRFELVLVASKRARQLARQGMEPTVEWDNDKPTVVALREIAVGHVTKEILKQREQDYQTSSLDLALSTNSLNLEGFSF

SEQ ID NO: 6248 - protein, 433 aa, Acinetobacter baumannii
GNQMDTQHSALNARKQQATPRGVGVMCQWYAEKAENATIWDKEGNQFIDFAGGIAVLNTGHRHPKVIAAVTEQLTKFTHTAYQVTPYESYVALAERINERAPIAGPAKAAFFTTGAEAVENAVKIARCYTGRHGIITFGNGFHGRSFMTMAMTGKTAPYKRDFGVMPAGVFHARYPVPAKGISVDAAIESVEDIFSEDIAPHDVAAIVLEPVQGEGGFNVVPAEFLKRLRAICDKHGILLIADEVQSGFARTGKLFAMNHYETKADLITMAKSLGGGFPISGVVGRAEVMDAPNPGGLGGTYAGSPIAVAAAHAVIDAIEEENLCDRANELGAELVATLKDIQQATGDVVTDIRALGSMVAVELETAEQAKVVQNYAMENGLLLLTCGKYGNVIRFLYPLTIPAEQFRQGLDILKQGFATLKAGSAKAMEQSA

SEQ ID NO: 6249 - protein, 110 aa, Acinetobacter baumannii
AWQILSWVKMGRSYNRMKSPSISHICERDHAKQSLIQYGYGWQIILNNLTIYQLLSSSLYKKENLSVQNDYDNSTNLPALRYTLNRFRLKDELICAYRVHCNIKTPDRFW

SEQ ID NO: 6250 - protein, 566 aa, Acinetobacter baumannii
MTKIQIKQRPLLTRPEQFQGVPPFIAEILARRGVQSEQELELKLKNLLAPELKGLDAAVALMDQAIDEQKKIVIVGDYDADGATSTALMMLVLRDMGAQVDYLVPDRFKYGYGLTPAIAELAHHTYQPDLLITVDNGISSHAGVDAAHALGMQVIITDHHLTTKETPLAEAVVNPNQLGCEFPSKALAGVGVAFYVLANLASLRNRQGKSTSKVTQYLDLVALGTYADVAVLDYNNRILVDAGVKRIQQHQCRVGILALLDIAGREATSIRAQDLGFVLGPRINAAGRMESMRIGIECLLADTMETAYPIAQQLNQLNIDRRQIEGEMKQQALSALDSLQLSQQDIPAALVLFEENWHQGVIGIVAGRLKEQFHRPTIVFAPDEDGIHIKGSARSIDGVHIRDTIEQVAEQHPELVSHFGGHAAAAGLTIRKENFEAFKTVFNDCVAAMDESIFQATLWTDGELPVSALQLDTLNWIEQLGPWGQKFPLPQFEGHFKVIDFRWLKETHLKLRLAIDQYSFDAIAFNAAGRFEFDPMRDHVHLVYEIDRNVFNGNVSLQLRIVHLNQ

SEQ ID NO: 6251 - protein, 103 aa, Acinetobacter baumannii
MMKIIASLLVIVGLIAVVLYFKPTSGASDVFNSALHETNSPQPDTSSSLSKLKEPTQPKNVSLNSNHSQSVSADTVPFYDTKSDPSIQPIDPEKDPANEIKAK

SEQ ID NO: 6252 - protein, 86 aa, Acinetobacter baumannii
LIEITSSNPNNVSLFNAGGLGSVRRTFSVKITSTPFSAGFATQQILGLISRFKQVKISSIGITKFHNEEHLVLCSFLEFLYQNSEF

SEQ ID NO: 6253 - protein, 333 aa, Acinetobacter baumannii
MKRIAIIAVATYMGLAVSAVQAATTFLNVSYDPTREFYQEYNQAFGKFWKQRTGQDVDFKQSHGGSGKQARAVATGLEADVVTLALANDIDEIVKAGFIQPNWQKEFPNNSAPYTSTVVFLVRKGNPKNIRDWNDLTKPGVEIITPNPKTGGAPRWIYLSAWGYALKQPGGNDAKAKELVKKLYHNVKVLDSGARGSLTTFAERGIGDVLLSWENEALLATKGLDKDKYEIVYPSISILAEPSVAIVDKTVDKDGNRTLAKGYLNFLYSPLGQELAAKHYFRPRNPQVAAKYAAQFPKIKLFTINDVFGGWAKAQKTHFANGAIFDQIYDVKQ

SEQ ID NO: 6254 - protein, 101 aa, Acinetobacter baumannii
KCTLNKAHFLIWYEHYKVVIAPTAGVPPPVHPFGKNSSVVAISVLQVHAPVAERESEIIFPAIFGFPFKVHVIALVAAPSLPKFVTPMAEHAPDEVAVKPT

SEQ ID NO: 6255 - protein, 190 aa, Acinetobacter baumannii
NQMIRINTMNSPFENQPISQDSPFKANGRFGRLSYAAWTFLFTLVLVTAILLIMFTFGFTNPEGAPDFSTPGLICIAILYIVGIYINFVFTIRRLHDRNNTGWLSLLMLVPIVNIGLAIYLFCAKGTEGPNDYGPKRPTPSWERVLGWIYIVLIPLALIFGVIAVIMAPTYEGYVEKSESIVIGSPSQSE

SEQ ID NO: 6256 - protein, 149 aa, Acinetobacter baumannii
FLVIMQLNKFTDYALRILMYVARPSDAPYTIAEIAQDLYVSQNHLVKVVHFMGKQEWIITIRGKGGGIRLNPKALDLKLGTIVRILQGDHQIVECNTPPCVLRSHCGLKGILDQALESFYQSLDQYTLGEVLQQPKSASDHSPIAFLQL

SEQ ID NO: 6257 - protein, 132 aa, Acinetobacter baumannii
SYAFCFLVMKMQRLFLISALCAGLMTGCATTSKLIPFVGSETPMQQVLKTQPEIVKEHNNTSVQQVFNRVESPTVSRITVIQTGLMDDSVSAIRTEYLFKLVDEKWQLQNKQKSYQCARGKGSRGFQTQLCS

SEQ ID NO: 6258 - protein, 356 aa, Acinetobacter baumannii
VEAIMAELNTPLTVGDFEIKNRLVMAPLTRARSGESRVPNDLMVQYYQQRANAGLILTEATVIGSKTVGYADTPGLWSQEQAQAWNKIIEAVHAQGSKIVVQLWHVGRISHPELLDGDIPVAPSAIQPAGEVSLLRPKRPYVTPRALSIEEIQEIVAQYKHSAELAKAAGFDGVELHAANGYLIDQFLQSNTNQRDDEYGGPVENRARLLLEVVDAFIEVWGAGRVGVHIAPRGDSHDMGDENPLATFGYVVEQLSQRNVAFIFSREYEAADSISPQLRKKFNGVWIANENLTPESAKRILREGQADAVSFGKAYIANPDLLQRLEQGLPLNELQPTTLYAKGAEGYTDYPALEAS

SEQ ID NO: 6259 - protein, 205 aa, Acinetobacter baumannii
GQQIHRSKQAKLQQHLPQRTLLFSRNRRVMMKIKQITLYVLACAVLVGCDSRIDAVNQEMANIRNQPPLPIEPAPIFTPVPQFNYAAHQLKSPFMPSSLAAELKIMAGKRVYPNFSRAPQPLESYALEALNMKGSMRNNRGQILALIQTPDQQIERVQVGNYMGMNQGRITHISPTQIDLVEIVPDGREGYVERPRTLVLIGPAP

SEQ ID NO: 6260 - protein, 69 aa, Acinetobacter baumannii
ILKIPHICAVILKSILVLPYFNIVKTPKPSRLGLPTLNLTQTTLTTSERTQSHYLLRLDESEHRHLLKG

SEQ ID NO: 6261 - protein, 97 aa, Acinetobacter baumannii
ENEMIVVTLTYKKPLAEVDAVLKQHIAFLDDYYEQKKFLASGRRENRVGGVILVLSSSLQEAEEIMKNDPFYIHDVADYDFMWFEPSKSLEEIKKFV

SEQ ID NO: 6262 - protein, 375 aa, Acinetobacter baumannii
KSRIVKLRVDSGIDRNMASKKRSKGTNSFSLSEHFGKIILACIAAGSFAIAFGSEKISQWFSPLSTNSTCLNQFYREVPPALNKESLKKDSYPLCFNGFNVLYSGISKTPLWSAEHLDAERLSVKIKREDNFHEETRVPQKHRALLSDYRGSGYDRGHMAPNGDMPNKESQSDSFSLSNMVPQAPKNNQEVWRKLEEATRAIVTKQKQDVYVVTGPVFEGKRLKTIGQGVIVPTAVYKAVYMPKTGAIGAYYAPNNNSQQVKVVSVCYIEEKLGINLFPQLTEQQKRNVYRLPLTASQVKPNQKLDYLHWDGESQCEQDLSAEQIQALQDQFKKQKTGSSEPMEAKVPSIDEETRNAIVKQLVEALVNYFLQIMK

SEQ ID NO: 6263 - protein, 261 aa, Acinetobacter baumannii
TQRITAMNISDNTPQGQLSSQQFYRQYSANALLPELDWQSIFPHSKLSEAHIKALNTIYQCAVPLALNVFHDLNFDVFAPAAYHPQGLGLFDKLAQQEENFLKVLTAESENLDHETRHQIWSMLLRGGAVLVFKAWLGHVKLGENQLDMTQFDELSDLLFIKTPPHQLAERLHVDEKAKLDHIFLMYGNDIFLDRFNSLETAALFVDLGVYDAAFLSLRDDRVAEYLKSKGYVTQEQIDDLQCALNPLYCDSLTPKQDCLA

SEQ ID NO: 6264 - protein, 72 aa, Acinetobacter baumannii
VYYFISKINLKTTRNDMSNLPSNLFQSLVIILACLIILVSKMPQLKFRKTILFLALGSLTLICALAIFGFFN

SEQ ID NO: 6265 - protein, 604 aa, Acinetobacter baumannii
SNFVAELLFSKVLGCGLITSFNSSDHGRTFTEYQLEMSGLRSEHISNRLFFFMLVIILSLLFMAVPLIVSSYQEYLKTKQALVEIKSLRSIAEVANKVSKERAPANKLMSSNAADFLKNQKNLKEYRLSVDRQLNETIHILKEEGYTDLANTLDTKFRDDLKQARAVVDYYVATPEQARSSIQFDNAILAMFGAWDSCREVLQNLMLQLKSKDSQINNYFTLIVVLTDMRDQAGRTASNVIAPVTFKETIPNDNRARSLQTQQQARYLWALVDTLQSEQAKTPEYHRLYSRVKTEFLDKGVPIVGQLLDESQKHQAYHLNGTELTDQIVDKFTTVIDLQKFLLNKSVLIASQENYLAKKKFFLTLLISSISLAAALLTLIYAKRRVFEPLIQARTLILDLSHSTDYPIDELKPKKGEFISLFEAIDRLQRMLKQRDAFEFQLKNIANTDPLTGVSNRLALSEYLKIVESYPQKFSQTCLMIIDIDRFKHVNDQYGHIVGDQVIRRIADQLKANVRASDLIVRYGGDEFLILLEQVQFLDARLLAEKIRIAISLEEIDLSSTQEKLHVSVSIGFAIGATSWMELLENADRSLLRAKARGRNVVEG

SEQ ID NO: 6266 - protein, 500 aa, Acinetobacter baumannii
AMTVSFQEIHPIEIDAQWPQQPFHGFSLDSRKVETDQIFIALTSYSQPEKTRTFAEAALANGALAVISETELGVANEWVCPDVRQRMGEWQKRYLQQADVVKPLRIIAVTGTNGKTTISRLIAELISSQQQRCAVMGTTGNGILPNLTPSTHTTLDALQLQNALHDYAKQGATFASLEASSHGLEQGRLNGCDIEIAVYSNLSRDHLDYHGTLEAYAEAKARLFQFNSLKVAVINLDDAHADLMIKSAQNNPAQPKILTYSLTQNTADYYITDLSYSLAGATFNLVSQQGSFAVESPLLGHFNVENLIAALIAAEQASFDLQALVNFVPKLIGAPGRMQVIRDDERLFVVDYAHTPDALIQVLKTLKRHVSNQLWAVFGCGGDRDRGKRPLMTQAALDGANPVILTSDNPRTEDPEQIFADMKQGIDFSGHRMHEIHDRREAIKFVAEQAQAGDIVVIAGKGHENYQEINGVRHWFDDVVEVRSAIDAQHHTVDAAYPAQ

SEQ ID NO: 6267 - protein, 292 aa, Acinetobacter baumannii
SMTVSRTLWQNVQQYIWLVGGIVCLFLAFIFWVITDNKKLVEVEKSADSDAPVQIQPEKVATTPNLGALADEVRPLDLTTRTVASGEHEPEFRGTKFINENKKQWTLELFRASDEDIIKNFLKSRTDRNKFIYFRLSGEQQAEQYVLAYGTFKRSEDAVQQLTQINLQLPDSVKPQPQQFSSYAPLVNDLGADEMKGGNNQLYEVRLRPAALPRIDESLLMSAPASGTLNTQPKPASTNSATKTTIVRRDAAGNVVDVQQSNSNIDQPNKPAQTRINENQPKNATNEGTRGN

SEQ ID NO: 6268 - protein, 116 aa, Acinetobacter baumannii
CGAVMQYRCPQCQSVKIMPVSQGVNSAKPVVPKSLVILVPAIFVLLLLVVISIFMWIFGNGAGSSLQIATVVAFVVTVGAGFMFWRDLPDFKLSMQAFMQSQKHWKCRDCNHEWEI

SEQ ID NO: 6269 - protein, 321 aa, Acinetobacter baumannii
LFHVQIVFYGTIDSTHLSFNTNFACNMKVSLMNALTQELVELLTLEKLEENIYRGISRNLVGKRVFGGQVLGQALRAASYTTDRPAHSLHAYFLYGGDINAPIIYEVDRLRDGKSFVSRQVRAIQHGRVIFSAMVSFANPEEGLNYQHPEPDYPAPEALKSESELKEGILNFVPENVRASFMRERHVEIRPIDPVNPFQPQPEAPFNAHYIRTHDRIPKQLDDISLHQAIVAFYSDFTLMTTALRPHGLSYISPSLQCASIDHAIYFHRPLRADEWMLYDMEATVSAASRGLNFGRMWQNGQLVCSTVQEGLMRLREIETQ

SEQ ID NO: 6270 - protein, 355 aa, Acinetobacter baumannii
DNSVLRLYRKPNKGLMGVDISSTSVKLLELSVKNGKYWVESYALMPLPENSVVEKNILNPEAVAEALERAMNLANPQTTHAAIAVPTSTVIHKTIEMDADMSDDEREVQIRVDAEQYIPFPLDEVSLDFEVLPDRLANPNRVNVLLVATRTENVETRVEVLELADLNPKLADVESYAVERAFSVFADSLPMGANTIGILDIGHTMTTLSVMQNGKIIYTREQVFGGKQLTLEIQSRYGLSLEEASRAKKDRSLPDDYEIEVLDPFLDAVVQQAARSLQFFFSSSQFNEIDHILLAGGNANIPGLAKLLQQKLGYRVTIANPFLQMGFSPQVDVQKIENDASSLMVACGLALRSFD

SEQ ID NO: 6271 - protein, 483 aa, Acinetobacter baumannii
AQIVILNKVSRIFRNESAYNLLSLITCIDMMNALERRSTFALSSIFALRMLGLFMIIPVFSVVGQSYQYATPALIGLAVGIYGLSQAILQIPFSLLADRFSRKPLVVFGLLLFAIGGAIAGLSDTIYGVIIGRAIAGAGAVSAVVMALLADVTREEQRTKAMAAMGMSIGLSFVVAFSLGPWLTSLVGISGLFFVTTIMGLIAIAMLLLVPKVTRHHRNYQQGYMAQLKQVIQMGDLNRLHVSVFALHLLLTAMFIYVPSQLIEFAHIPLASHGLVYLPLLVISLFFAFPSIIIAEKYRKMRGIFLTAITGIIAGLLLLIFGYQSKYVLLAGLGIFFIAFNVMEALLPSWLSKSAPIQSKATAMGVNASSQFLGAFFGGTLGGQLLMLHNTAIGWSVLAGIAIIWLLISFGLAQPRYLSSIVLPLPQVQQVNEWTTQLLAIRGIEEVVVMPDQQVAYIKVDKQSLDDASRRDLTQLFGKEVAI

SEQ ID NO: 6272 - protein, 329 aa, Acinetobacter baumannii
RLVVADEQKSLTDVAKNTGELLQEAGTKTTQTVLAHTEKYHDAYTTIDKIVDSFWERVPYICIAIVVFLIFWLLTKLFKFFVRKTLENRSYTRQNLVLVLNRVGSTAILFFGFLIALVIMIPGFTPGQLMSALGIGSVAIGFAFKDIFQNLLSGILILLSEPFRIGDSIVVNSLEGTVEDIQIRATFLRSPDGRRIVIPNATVYTSALTVNTAYQQRRCEFVVGIGYDDDEQKAKQIILDILNNDRNVLSQPAFSVNVTALADFSVNLTVRWWVDTTETDISSSISNIQAQVKQAFNENDIDIPYPIQELKMVSNPPALNPETSAKQTT

SEQ ID NO: 6273 - protein, 423 aa, Acinetobacter baumannii
STCLATSSNFSNSGRRIIMSANLKKNSQWLWVGVIAAITAILIGLLVLNSKNKSNSSEPSEGHGHAEEEGEEHHDEGEKPLLLTAQQMQEQNLKIEQAELGEVPQLQTYPAKLVVNTDRQAHVSPSFSGRVEAVYVELGQQVKKGQALASLLVPDLVDQQANLQIAQSNLELARQDYERERSLWSQGISAKQDYQRAYNAYQQAQIQVKASRSRLSAFGAGSGSAGRYTLTAPIAGIVSNKDIVVGENVQLADQLFIINQLDQLWLEFILPSNANINVQPNQQIEFKSLQTGNTFSAQVQSLITEADAQTGRLQVRAKVLANSSELRPNLMVNVELNAGSTQKVTRVKAQAVQQVEGKDVIFTPKIVKTGFEFEPVTVQLGQRSKDGQWVEVVKGINPSQRYIAEGSFLLKSELEKGEAEHGH

SEQ ID NO: 6274 - protein, 719 aa, Acinetobacter baumannii
KKAVNNLTQLFNRFKANSILIYCLQILIVLTGTTLGLLWLGHNELIVPVTLGAIAAALTDFDDRLSLRLRNLLYVCLLFFTVSTILGFLAPYKFLFILYLSISSACFILLGALGQRYATISFGTILLSIYSMFGLGEYAHWYQQPTYFVYGALWYGLTSILFFILKPTLPLQDKLSQIFEEISALLQAKARLFDPDNKENVEQLLFELSLQNTQVAQSLNQIRSSLLTRLKASRVSNKSIYWLNLYFFARDIHEQATSNYLHYEHIQQNFSRSDLIFRFQKNLRLQAQACHDLAQCILHNQQYQSSQESQIGLNHLESSLKDWIQQHPQNFEVKNLKLIFNNLKGMHEQFEQLQYAQPFNETLSQNKQEHLNLLDDDIQGFSDLVLKIRQQLTPQSALFRHAVRIAVVFAAGYAISLLPFAQHGYWILLTSLFVCQITYFATKSRLKLRTIGTLLGVLLGIPILYFVPSIEGQLILTIICGVSFFYLRQKKYALATLMATLMVLLIFNLKGAGYSIILPRLIDTLLGCFIAWLAVNFIWPDWNFRNIPNNIKKSSQATFDYFNVIVEQYQHGKNQDIEYRRIRRAAHNAQIELSNMISSLSAEPNPNPELIHYAFRYLVYSHSQLSYVAALGSQRQKIDDQQVLQLLLDCQQILKQSLFEQASVNFSFLEQTLKQIQSLITHEHFSENYTLVLKQMSLLLETLPELLSLKGKLLEHEIK

SEQ ID NO: 6275 - protein, 62 aa, Acinetobacter baumannii
VYRLSFKWLKRGHLFCNSNRFYVTVCWHYESLWLLNYANCVSFVEMHLWLMTWLAPQIWIKI

SEQ ID NO: 6276 - protein, 469 aa, Acinetobacter baumannii
KLDVARKIISRDCVALTLGKEKMKGYEVNFDGLVGPTHHYAGLSFGNEASTKNRNNLSNPKLAAKQGLLKMKALADMGMKQGVLAPHERPHVPMLRRLGFTGDDISVVAQAMRYSPELLSSLSSASPMWTANAATVSPSADSQDERVHFTAANLNNKFHRSIEAETTSQVLQAIFKNERHFVHHEALPQVALFGDEGAANHNRLGGDYAKRGIQVFVYGQQHLNNGLPGPKRYPARQTREASEAIARLHRLDDAHTVFVQQNPDVIDQGVFHNDVIAVSNQQVLFHHQHAFLNQDQAFAEIRQKMASIGEDFISIEVPENRVTVDDAVATYLFNSQILTRPDGGMTIVVPEESRQNAAVWSYLNDMIQMGTPIDAIQVYDLRESMRNGGGPACLRLRVALNETELNAVNPKVLMNDQLFMTLNQWVDKHYRDRLAQEDLADPHLLMESRMALDELTKILGLGSVYPFQK

SEQ ID NO: 6277 - protein, 169 aa, Acinetobacter baumannii
LKSLYKNIHTIFGEKAMNAQKGFTLIELMIVVAIIGILAAIAIPAYQNYVARSQATAGYSEISNMRTGYDTELNDGTAITSLSQVGFTATSSGACSAIGVTNFGNDGAATNAITCTLKGNPKIAGKIISLSRSATGAWTCSTDIATTDEFLPKGCTGGGTPAVGAITTL

SEQ ID NO: 6278 - protein, 167 aa, Acinetobacter baumannii
KILVLFGVLGMRGIIPQEGFTLVELMVTIAVMAIIALMAAPSMSNLLESKRLDANQRDLINTLSEAKSQAILGRQNVSVNLNSTASNTPTSLNWQTASNNTLELKNIAADGTQSSLTTTTLAFNANGVVANITQDTLLSICNSRINKKKVIILTKLGTLIFKAEETC

SEQ ID NO: 6279 - protein, 301 aa, Acinetobacter baumannii
KYLVFRVGLLKPIQRLVTDGLKSCPLNEFSMHILFIGYGKTSQRVAKQLFEKGHQITTISRSEKTDPYGTHLVQDIFTLDLSEIAPVDVVYILLSPDDSTVEGYQHTYVDSIEPIRQALKSHPVKRLIVVSSTRVYGENSGETIDDHSEIHPNDAQGHILHNMELLWQKYFPSQCVIVRPTGIYGASIDRLKRMAEHTQTYPNIHYSNRIHIDDLARFLVFLADFEKPHKSYLVANNAPVPLHEVLLWFQSQLDLPLLTLDSAHVSGKKIYAKHLFETGFQLEHPICFNDYLLCLNAHGTN

SEQ ID NO: 6280 - protein, 141 aa, Acinetobacter baumannii
AMSVKYQGSCLCGAVSYQSDAEPRYSFNCHCRDCQKATGSAYAPIAFFHQSELKISGELKYFETLGSSGRPIKRAFCPTCGSQLFGLPELVPEMISIRAGTLDDPSLYHPKAEVFVSQTYAWDMLNPNLKHFEKMIEKSKK

SEQ ID NO: 6281 - protein, 222 aa, Acinetobacter baumannii
SAGFLKLLDTHMFKFLNPQYLFQLLSPCLLCEIGTREKYSLCKECWEQLPWLKQTIQRNDQSVLVACHYAYPINRIIQQFKYEQKLHYQTLLAEVLQQLKFPKVQAIVPMPISKQRLTERGFNQSLLLANLLSKQLKIPVWQPVQRLNEHSQKGLSRLERFENIEQQFVALTQEKRRYRRVLIIDDVITTGSSIHALSQALKQLGCTSIHASCLAAASSTSY

SEQ ID NO: 6282 - protein, 429 aa, Acinetobacter baumannii
RCPVCYYTATKFGLCSGAVMSQHLSLPKDKIRFLLLEGVHQNAVDTLNAAGYTNIDYRKTALEGEALKEAIKDAHFIGIRSRTQLTEEVFEAANKLIAVGCFCIGTNQVDLKAAMARGIPVFNAPYSNTRSVAELVLAETILLLRRVPEKSAACHRGGWDKSAVGSFETRGKTLGIVGYGSIGSQLSVLAESMGMHVIYYDAVTKLPMGNARQVGSLDELLATADVVTLHVPDVPSTRNFFTKEQFAKMKEGAIFLNAARGTCVVIEDLADAIKSGHLAGAAVDVFPKEPKANGEEFQSPLRGLDNVILTPHVGGSTMEAQANIGLEVAEKFVAYSDKGMTLSAVNFPEIALPLTAGQHRLLHIHKNVPGVLSKINNLFAEQGINISGQSLMTKGDIGYLVMDVDASASQEALDMLHEVEGTIRVRVLF

SEQ ID NO: 6283 - protein, 144 aa, Acinetobacter baumannii
GLAVKNGFSLIEIMVVVAIVAILAAIATPSYLQYLRKGHRTAVQSEMMNIAQTLESQKIVNNRYPSDATIQSIYGSNVSPIQGQALYKLAFATLNDSTWVLTAIPISTSSQAGDGIICLNDQGQKFWAKGATVCALSASSSWTE

SEQ ID NO: 6284 - protein, 110 aa, Acinetobacter baumannii
MTKVAGLDQLSVINQKVVGEGEVLPQVVLKDGSQVQTGTVATMLHNIELYNAGQRGQIEEELKIAIPTLVKVGLFDLFEVDEWIKGTNAGRTFVGMHAKAYLQQKEQENN

SEQ ID NO: 6285 - protein, 236 aa, Acinetobacter baumannii
FLRVMFMYKTLTTCLLVTCLGLSGCATSILSTALPNETTEVQTTILKTDQIIALGQAVKNQQEQGVVFIGQDFNYLMTEGSSEFLNIIKNIPVNQRTLIIPSPLLLEMDDPTHFHGELKFQYNIPTSKLSDQQKENLKNLGFKNHFMVMENQTQLLYPYAIIRFKGQIYQTSPTLKVQQTIPTPYPIALQQKDEITKKHPFKRVTRMALYPLAMAFDIVTVAPSLILSDLRGDFTK

SEQ ID NO: 6286 - protein, 862 aa, Acinetobacter baumannii
EVGVLMSKSGFGQMYRRLSSKLLDLVVTPHVLGEVPTEPVSATTETEAKTERQKVVCYVLQNHSRSNALVVDGETRRLNLKPALDPLVIGTHQEKASVLFLQHNDENNLLNPPPHAFPPRLIKLIEVLQANPELDIELVPVTVLWGRSPDKEDSWFKLLFSDTWATPSTVKQLVNIGLHGRQSYLEFHEPQSLRDLVEYAQKHYPNLSPATYIVSTLNDYLDRQREVVLGPDLSDRRNVMQSVLKSRDVQEAIRRESIRGKISMLEAERRAIGYVNEIVSDYSHSAVRFADLALTRLWTQLYDGVEVHNFSTVRELAKDYEIVYTPCHRSHIDYLLLSYVIYKRGLMVPYIAAGDNLNLPFVGQLLRGGGAFFIRRSFRGNGLYTSVFKEYLYSILSRNTPLEYFIEGGRSRTGRLLPPKTGMLAMTVHSHLRGRAKPIVFVPTYIGYERLMEGSTYVGEMQGKPKEAESIFGILKTLRKIERIFGKVHVNFGEPVFLDDLLKQHNAENVYIEKNDDPVPPAVSEAVNSSANAILENINRAVVINPVSLLSIILLATPKHTLDEEICIKQLEAYRNLASNFPYDQRTEVTPLSGKEIIAYGLKLKLIKRVQHALGDIIAIEDNQAVLLTYFRNNILHAFVLPSLIASLVEHNGKISLADLSNVIYTLYPFLKAELFLKWKSSELKEQIEQYADALVQSNLIQQDDEGNLISSAPNTEEHNQLVVLATPVKQSLERYYMTLALITQRGSGNISAKQVEELSHLLGQRLSVLYEFNSPEFFDKALFQSFIKVLTQQNYIRTNDQGQIEFDDNFRQMAAGAQLVLDEVTLQMLQHITTFTDEELKEALEAMASQQAKRRLKRKKA

SEQ ID NO: 6287 - protein, 775 aa, Acinetobacter baumannii
SDKVLKKVMHLKYLSLCLFSLGLTACAQHGVRPQVASASLEQKAIQSVNAMYEYPSYDYRGNFKITVDPSQIKQNVKAENTAKLDAELQKKVDQYLREQKVALSKAQKQTLYAAIANEQGDLGLTSSARSEKINTVLFNLLNDLQFSYDGSIHYRQKMGSFNLTARYEKPTLLVQAKLPMVLDLENYKFYINYFGLMPYLVNKDNQNNLAYVDFSKYKAFFKNVDQKKFIEYLKASSAVSYRLAEPQNLQRVSLTEADRKAGAVERIRLKTTVEQLLLEVDLFGQVNEKYLQKSVLGLDEEKLAETLAAEIAASDAKKGTAGKEEQKVSSDDAAAVSQQLYSLVNAHLGNTSTSEDEEVESASSEEASDVAVAETEQTSENEEVVALTEDQCIELKSLKKPVALGDINYCQIYGIDVLDQSDTSIQKAQIKSRQDALKQTFEAYNQNQFINDEAFKALWLKHKDEIEQALPKQRNPITIDVALDDKGRAVKMDYDVDYTPAEFKHRFNIKADMQILNYGKATSIDQQQLKQAKSVAEASKGSMLENFIKGFSEKLGQSDVSEHPVGTHSDVQDLDANLAVLADKTYDATHAYDKTYKAVFIAKLTAEKPSYIKYYSVQQLQEIAEVYAYWFSDEDTYNPQGKALERITALQKQHHLEQDDQFDHELGRAVDHIVLTTIQGKTGREAWQRLQKQYKQPAQLFSKQYQLEFEKQNGVSAEEKHLLSETADILGNVYVAARKKQLSEKTIQNLKPEHNEFIDYEIFREVYKQMVAAKK

SEQ ID NO: 6288 - protein, 141 aa, Acinetobacter baumannii
IVLLNLRGIKMNSSIDQDPNRTLTLILYVLYIVAIFTGGLLAIIALIINYVKRSDVQGSIFASHFTWQIRTFWWYLAWNIIAFLPFIFLFFTGENTDLFAGVAISSTVFCVGVIGAAWIWIVYRAIRGLIALNDNRPMYQP

SEQ ID NO: 6289 - protein, 223 aa, Acinetobacter baumannii
IALFICTLLNMSEASALLDKTSIQQLPPFENLNHQNIVVIENGEQCKTIEEELKAATFLGFDSESKPTFQVGEVSTGPHLIQLATEHKAYLFHVNLSTLKFLQPILSNPKQIKVGFGLKNDKHIFHKKGIELESCVDLAKGFSHFGFKQQMGVQKAVALLLGQYLAKSKKVGTSNWARKPLTSQQISYAAADAYAALLVFLELKKRKVLPIHISEKIQTALQR

SEQ ID NO: 6290 - protein, 69 aa, Acinetobacter baumannii
NYSFLYLSSLIKQFTFMIPAKRLKEKLATKSKVNERIWYKNKSYEMVVFVFYVSVFVVPTTQLAIPLRN

SEQ ID NO: 6291 - protein, 86 aa, Acinetobacter baumannii
RATFYVIFTLKERLNFELSAVLNLNYSVQLDEADSAQTVAPFAQNFCPWSFKQIIPSPACELVEIGIAVSTQVESFRVAKANLYRA

SEQ ID NO: 6292 - protein, 81 aa, Acinetobacter baumannii
FYKFKVKLNMRHELREIFIKGCDEKIEKKGDNVGLSFYAFFKNKNDNPELLMEAAHWWIMVHKLDHFEKAVKIKELVLSES

SEQ ID NO: 6293 - protein, 85 aa, Acinetobacter baumannii
NRKFTELIRRFRMHTSNGFNLSFRHSRNESHFCNKRESQLQNLYAKLALSVEDAGKWLFVFILIRLNFFSFVQRLTTLLCLFPKL

SEQ ID NO: 6294 - protein, 316 aa, Acinetobacter baumannii
MMKLLSFLKNKALGSSIDYKILPRKVKFDWKDTPVDWIPNQPFASYFINEINNILPAGEFWFCRLYNKVLPRITDEKLKQDVQAFIRQEAMHANAHTSANKEYLSARNIDIQRNLDIMNYLFTTALADKPFDKEVPQFLQEQWDLFRLGVIATVEHMTCVLGKYALYNKRWEELGADPEMVDLVKWHGSEEIEHRTVAFDLYRHLGGGYIPRYYLSLAVIVLVLGLWVDGAAHIMKQDPRFADAAKSRFFPAWVALEWYKISRKDNQVLPNPIWLIAQQIDYLMPWYDPVKEGSTEDAVSYLSQSPAAKRAELQAA

SEQ ID NO: 6295 - protein, 70 aa, Acinetobacter baumannii
ARISLLPAPAYVFAVVELLWVSLCSFQKRLQVSSFWFYKPEFTAVEVKLVADFVSPSTTCFLDMLVNNTQ

SEQ ID NO: 6296 - protein, 472 aa, Acinetobacter baumannii
NMSSIFLNRVSHPDLLSCNVKITLKKVVTISSLSIVMLLAGQMANAATDFQQGSYTQKAAFSFEQALARAQSYQIQQGVWQAQQQMAEAQLKQSRLWANPSLSIEQTGLQSDQEKELAIGISQPLDIFGQRKAAQHLAKVEMSKVDLAEQRYKAELELIVKYFWSQVALLELEKSLIGEQLAVSQENLSASEKRYQAGSIAQVDVDRVRMSHLENQRLYQQVDLKLQVAKQQLANLWGGDSNQFQLSQSSNQLWVLAADVESGQDRQNNLLERSFQLDALAQQATIQQLKAKARPQPTVTLGVNNTRSPEQRTENQIRLGVEIPLNLFNRQQYGIKIAQAKQELSQRQQSFYRQQNQADIETLMSELKGLHIQFKQLNDQQVPLAVQVQQKTLQGFRLGKFAVTDVQQATMQLQDVRLRKVELLKQAWQNSIEIQSLRLGLEPEQIMAKDALMQLNQRAWQQAQTFPTQAGE

SEQ ID NO: 6297 - protein, 497 aa, Acinetobacter baumannii
LTEFTSEIVMLTIVQEALTFDDVLLLPAYSTVLPKDVSLKTRLTRGIYLNIPLVSAAMDTVTESRMAIAMAQNGGIGILHKNMDIAAQAAEVRRVKKFEAGMVKDPITVSPETTVRELIAITSANNISGVPVVKDGKVVGIVTGRDTRFETNLEQPVSNIMTGQDRLVTVREGESKENIQALLQKHRIEKVLVVGESNELKGLITVTDFRKAESYPNSCKDDLGRLRVGAAVGTGADTPSRVEALVEAGVDVIVVDTAHGHSAGVIERVRWVKQNFPQVQVIGGNIATGDAALALLDAGADAVKVGIGPGSICTTRIVAGIGMPQISAIDSVASALKDQIPLIADGGIRFSGDMAKAIGAGASTIMVGSLLAGTEEAPGEVEFFQGRYYKAYRGMGSLGAMAGATGSADRYFQDSKAGAEKLVPEGIEGRVPYKGPMGNIVHQMMGGLRSSMGYTGSAVIEDLRQNAKFVKITSAGMSESHVHDVTITKEAPNYRVG

SEQ ID NO: 6298 - protein, 84 aa, Acinetobacter baumannii
MANSGLYRSNRQSMIAGVMGGIAERFGWNANLLRIIFVLVSIMSAAFPGILVYLVLWLVIPKKQPEQVQGYQQPVRTVREEQIH

SEQ ID NO: 6299 - protein, 179 aa, Acinetobacter baumannii
FLMSRVAKAPVTVPNGVTVTQNGRQVEVKGSKGTLSFNLHALVELKQEEGKLQLAPAKESKDAWMQAGTARAVLNNLVKGVSEGFERKLQLVGVGYKAAVKGTVVNLNLGYSHPIDYALPEGVTAETPTATEIILKSANKQLLGQVAAEIRAYRSPEPYKGKGVRYSDEVILRKEAKKK

SEQ ID NO: 6300 - protein, 461 aa, Acinetobacter baumannii
SRVSMSPSSSGHVNMMKGQPFHVKYREIIRRMSFLIGALLVFRLGAHIPVPGINNAALENLFHANQGTILGLFNMFSGGALERMSILALGIMPYISASIIVQLMSTVIPSLEALKKEGEQGKRKINQYTRQGTLLLAVVQAVGMCAGLIGQGITLSSGLAFYIPAVTSLVAGTMFLMWLGEQITERGIGNGISMIIFAGIVAGLPKLIMQSVSSVDNGQTSLIGLVIFGLLSLGVLAAIVFIEKAQRRIPVNYAQKQQGRRIFTAQQTHLPLKINMAGVIPAIFASSLLLFPASLGQWVGSADPNAGLIKRSLQDLALVLSPGQPLYLVLFGALIIFFCYFYTALVFSPKEVSENLKRSGAYVPGIRPGEQTARYLDHILNRLTFIGAIYITVICLMPMILQSSFGIPFYLGGTSLLIVVVVVMDFMAQLQAHLTSHQYDNQTLMRKTTAQYSATGLEVPR

SEQ ID NO: 6301 - protein, 182 aa, Acinetobacter baumannii
VEKAMARLKARYNDELKAKFKKELSIKNVMEIPRITKITLNMGVGAAATDKKLLDGAVADMQLIAGQKPVVTLARKSIAGFKIRDGWPIGCKVTLRGDQMYEFLDRLISIAIPRIRDFRGFSAKSFDGRGNYSMGLKEQIVFPEIDFDKIDRIRGMDITITTTARTDDEGRALMRAFGFPFK

SEQ ID NO: 6302 - protein, 147 aa, Acinetobacter baumannii
AMTLRLNELAPAEGAKREHRRLGRGIGSGVGKTGGRGIKGQKSRKSGGVRPGFEGGQTAIYRRLPKFGFTSQIALKTAEVRLSELSKVEGDIVSLETLKAANVVRRDQIRARIVLSGEITRAFTVQGVALTKGAKAAIEAAGGKVEE

SEQ ID NO: 6303 - protein, 131 aa, Acinetobacter baumannii
MSMQDTVADMLTRVRNAQMAKKQTVSMPSSKLKVAIANVLQQESYISNVEIAQEETKSTLTITLKYFECKPVIEMVKRVSRPGLRQYRGKDKLPSVKQGLGIAIVSTSKGIMTDRAARAAGIGGEVIAFVS

SEQ ID NO: 6304 - protein, 60 aa, Acinetobacter baumannii
SIMKTIKVTQTKSSSHRLKNHKLCLQGLGLRRIGHTVEVQDTPSNRGMINKVYYMVSVEE

SEQ ID NO: 6305 - protein, 124 aa, Acinetobacter baumannii
EEIRREVLMNEKKQSRLRRAKSTRLHIRALGATRLCVNRTPRHIYAQVISADGGKVLAQASTLDASLRSGTTGNIEAATKVGALIAERAKAAGVTKVAFDRSGFKYHGRIKALADAAREGGLEF

SEQ ID NO: 6306 - protein, 172 aa, Acinetobacter baumannii
RRLGVLIMAKVEQNEGLVEKLVAVDRVAKVVKGGRIFSFTALTVVGDGNGRVGFGRGKAREVPAAISKALEAARRNMITVDLAGTTLQHPVNARHGASRVYMQPASEGTGVIAGGAMRAVLEAAGVHNVLAKCYGSTNAANVVNATFKGLRDMTSPEKVAAKRGKSVEEIQG

SEQ ID NO: 6307 - protein, 104 aa, Acinetobacter baumannii
EVDMAKKGMINRELKREKTVAKYAAKRAELKATIANVNASDEERFEAMLKLQALPRNASPVRLRNRCGLTGRPHGYFRKFGLSRNKLRDTVMQGDVPSVVKASW

SEQ ID NO: 6308 - protein, 216 aa, Acinetobacter baumannii
VVMSSINYDELMQPVLAFLGCQTPKEWLDEAVNNLDILMQDHANCEKKAAGTAMNLMFRYSFFTDLQVKLAQLVREEMLHYEQVLEFMTKRGQEWKGLSAGRYAGGLRKEIRTYEPEALIDVLVIGAFVEARSCERFYALAPRVDDELGRYYRYLLKSESRHFEDYLALALDVAKNAKMKDPEEDIQQRIEHIREVEKNLILTPDDTFRFHSGIPA

SEQ ID NO: 6309 - protein, 366 aa, Acinetobacter baumannii
GVKSSFCRAGSSGGNFKVIGAITCMSMHSDQINPDSNENQDPNNLIDQFFSSKGVTIPSDFKSGFVAIVGRPNVGKSTLMNHLLGQKLSITSRKPQTTRHKIIGIDSREKMQAVYVDTPGMHKKEVRAINKMMNRAAHSALRDVNLVLFVIDAQKWTQNDDLVLEKLKNADMPVILVINKADTFGDKREILPLIQERAKLMNFAEIVPVSALRGANLEHLSETIEKYLPYQPPLYSFDQITDRSERFLASEIIREKIMRQLGEELPYDLTVQIESFKTEEATVNEKTGRLKPACTYIDATIFVDRPGQKAIVIGEKGAKLKTIGMDARKDMEKMFEQKIMLTLWVKVKGGWSDDERALKSLGYSDI

SEQ ID NO: 6310 - protein, 196 aa, Acinetobacter baumannii
LFIPLMEMMMKSIKYLAFPLLSAALVMTGCASRKPATTATTGTTNPSTVNTTGLSEDAALNAQNLAGASSKGVTEANKAALAKRVVHFDYDSSDLSTEDYQTLQAHAQFLMANANSKVALTGHTDERGTREYNMALGERRAKAVQNYLITSGVNPQQLEAVSYGKEAPVNPGHDESAWKENRRVEINYEAVPPLLK

SEQ ID NO: 6311 - protein, 226 aa, Acinetobacter baumannii
TTLLIFRFSLWRIFFVMSVTGEFIKSEKLIMYTFDYLVFIGRFQPFHLAHMQTIEIALQQSRYVILALGSAQMERNIKNPFLAIEREQMILSNFSLDEQKRIRFVHVVDVYNDEKWVKQVKSLVNGVIEPNSKVGLIGHFKDESSYYLRLFPEWVMVELDSLKDSISATPMREAYYQGKIKTDAFPKGTIQFLEEFQNTPLYLQLQQKFLQADHSNIEETVSSHKE

SEQ ID NO: 6312 - protein, 456 aa, Acinetobacter baumannii
GGRPSVDFLLKQGVQFTLDEDEQLHLTREGGHSQRRIIHSADATGKAISTTLVERAKERKNITIFENYIAIDLITSHKLGHTEQANRAIGLYALDESTEKVHTFLAPFTALACGGAMKAYLYTSNPDIATGDGIAMAYRAGCRVANMEFNQFHPTCLYHPQARSFLITEAMRGEGAYLRLPDGERFMLRFDDRAELAPRDIVARTIDHEIKRLGIRHVWLDITHKSPEFIKEHFPTLYARLLELGIDITKDMIPVVPAAHYTCGGVVVDSNSQTDIEGLYAIGETSYTGLHGANRMASNSLLECFVYGMSAAKDIESKFDKNFKLPEVPTWDDSQVTNPDEDVVILQNWDELRSTMWNYVGIVRTTKRLERALHRIEMLKREITEYYQDYRVSKNLIELRNLVLVSEMIVRCAMHRKESRGLHYTLDYPETSSEIRKTVLTPPNFAVEQPLVNTSV

SEQ ID NO: 6313 - protein, 246 aa, Acinetobacter baumannii
RIGTRLKKQPAYVTMATNIESTLHISDLILQASPVVQLVMLILLLASIFSWYLIAKLHMSYKKARQDDEHFQKMFWSGAELNTLYNNAQLNSKRSGLEDIFYQGLSEFFKLKKRQAPTSQMIEGTERILRVGLSRDQGSLEYGLGTLASIGSVAPYIGLFGTVWGIMNAFIGLAAVDQVTLATVAPGIAEALIATAIGLFAAIPAVLAFNHFTAKSESVYSDRALFAEEMIALLQRQSVGSSQEDA

SEQ ID NO: 6314 - protein, 1294 aa, Acinetobacter baumannii
SHIAVRFTRPARGAKINMFIVAGAAAHSSFKKAQLLTRLSSISSVQSFDSQWVYLFDQALNEQQHQSALQLLNDGESFELRQPASDEIQILVTPRVGTISPWSSKATDIFKNCNTPVHRLERGLLFTLKGVSEISNEVKQVLHDRMTETVFAQIEDAKALFSETAPKPLNSIDILGQGKEALVKANNEFGFALSEQEIDYLTEAFTRLGRNPNDIELMMFAQANSEHCRHKIFGSEWTIDGEKQPLSLFQMIKNTYKESPTDVLSAYKDNASVIVGYDTMRFYPKADENGHFVYKYKSQAAHILMKVETHNHPTAISPFAGAATGSGGEIRDEGATGRGGKPKAGLTGFTVSNLNIPGFEQPWEENYGKPSRMASPLQIMIEGPLGGAAFNNEFGRPALNGYFRTFEQNVNGEVKGFHKPIMIAGGYGNIRPDHVEKDAIQPGDLLIVLGGPAMLIGLGGGAASSVDSGTMGESLDFASVQRENPEMERRCQEVIDTCWRLEDFNPIVSIHDVGAGGLSNAMPELVNDHELGAVLNLRKIPSLEPGMSPMEIWSNEAQERYVLAIRPESLEQFESICARERCPFAVLGEATEARHLTVEDPLFQNNAVDIPMQVMLGGTPRMQRSYETIERKGNEFDASKVDLKDAIFRVLKNPTVASKSFLITIGDRSITGMVARDQMVGRWQIPVADAAVTTTSLQGFTGEAMAMGERPPVALLNPAASARLAVAEAITNIACANIEQISDIKLSANWMAAAGQKGEDQALFEGVKAIGMEMCPALGIAIPVGKDSLSMRTTWNDNGEDKAVTSPMTGVITAFAPVADVRKTLTPELKNLEDSVLVRIDLSKGQFRLGGSILAQVYKAIGSVTPDVDSFDDFKAFFALIQDWNNRGLIQAYHDIGDGGLLATVAEMMFASRLGVALEDQTTAGLFAEEIGAVVQIKAADWEALQAEVAASSLKDAIAVVGRVNNTDQLSVNGLTLERAELQQAWSEVSHQIQRLRDNVETADQEFALITDKSHQGLIAKPTFDLNEPIEAPFINSRRPNMAILREQGVNGHIEMAAAFDKVGFNTIDVHMSDLLAGRVSLSDFEGLVTCGGFSYGDVMGAGGGWAKSVLFNAKLRDQFEQFFHREGTFSLGICNGCQMLSQLAPLIPGAEHWPRFHRNMSEVFEARSVNVRVEKSVSVLLDGMEGSILPIAVAHGEGRAVASEADIASLNAANQVALRYVDSHGNPTQHYPLNPNGSPEAITGVTSKDGRATIMMPHPERTFRAIQHSWKPEEWTEDGAWLRMFRNARKFIG

SEQ ID NO: 6315 - protein, 486 aa, Acinetobacter baumannii
TYCYAQFQSIVIQKFYSYSRRPIVGEHRMKSRYLQQGMYAAVFTVAAVQANAAVDFSNLVEQVSPAVVSVNVVKKMTQDELLQQQVPEILKRFFGNQVIIPQQQGPQEKTAYGSAFFISKDGYLLTNHHVIENASRISITLNDRREIDATVVGSDERTDVALLKVNGTNYPALRVGNVDRLRVGEPVLAIGSPFGFDYSASAGIVSAKSRNMSGETSVPFIQTDVALNPGNSGGPLFNQNGEVVGVNSRIFSGTGGYMGLSFSIPIDVAMDVAEQLKTKGKVTRSYLGVMMQDIDRNLADAYKLPKPEGALITQVSPNSPAQKAGLRAGDVILKLNGASVLRTSDLLYALNKVQPNQTVQFEVLRDDKTRNISATLATAPDETPATGNQASASKGPVLGMSIRDLAVPEKNALGIKGGIYVQDVRRGGLASLSNIIPGDVIIQVNNTQILNSQDFAKVVSNLPKNTVARVGIIRQGQRAMLGLRIQ

SEQ ID NO: 6316 - protein, 273 aa, Acinetobacter baumannii
KRIYALEYNFCHKLNKLKTEPFLKEKTMKVLRVLVTTTALLAAGAAMADEAVVHDSYAFDKNQLIPVGARAEVGTTGYGGALLWQANPYVGLALGYNGGDISWSDDVKVNGSTYDLDMDNNNVYLNAEIRPWGASTNRWAQGLYVAAGAAYLDNDYDLTRNVDATRSFRVNNQDFIAGADGVKINGQMSYKNDIAPYLGFGFAPKINKNWGVFGEVGAYYTGNPTVKLVSSGSAVTTGDQSLEEAVNAEARKIANDDKYKWLPVGKVGVNFFW

SEQ ID NO: 6317 - protein, 212 aa, Acinetobacter baumannii
FFVLTIRRTDMTHTVIVPGVGGSEHQHWQSWLQRQLVSSSRVEQKNWDRPVLSEWIEQFVNTVQAVQTPVQIVAHSFGCLTSVAALAEHPELQLQVKKLILVAPANPARFGEAGFARHSLTDYKDYFHQLKINVPATLLISENDPWLDFFDALQLAKSWQLTPINLGQVGHINVASGFGPFPDLLNHLLPEDSMCSHSSIDSVKTHFSLKFA

SEQ ID NO: 6318 - protein, 307 aa, Acinetobacter baumannii
MNFQQLRIIRETVRQNFNLTEASAALYTSQSGVSKHIKDLEDELGVQLFVRKGKRLLGLTEPGQSLLSIVERMLVDAENIKRLADDFNKVDEGTLTIATTHTQARYVLPPIVNQFKKLFPKVHLILQQASPVEIAEMLLQGEADIGIATESLTTEENLASIPYYQWQHSIITPQDHPLTQLDKIDLDALSEYPLITYHGGFTGRSKIDKAFEDAQIDADIVMSALDADVIKTYVELGMGVGIVNDVAYDAERDYRLKQIKTDIFGVNTTWIAVRKGHLLRGYGYEFISLCSPDADIKALKKIAYPDE

SEQ ID NO: 6319 - protein, 66 aa, Acinetobacter baumannii
IPLHTFLVVNSEISFGAHPQLVYENKNKTFVSQCFGIVRNNMFICKASSSRLFYTLQFFKLIAIFL

SEQ ID NO: 6320 - protein, 606 aa, Acinetobacter baumannii
PMAQAKKSVDIKNIRNFSIIAHIDHGKSTLADRFIQMCGGLQDREMQAQVLDSMELERERGITIKAASVTLYYTHPNGQEYQLNFIDTPGHVDFSYEVSRSLAACEGALLVVDAAQGVEAQSVANCYTAIEQGLEVLPILNKIDLPQAEPERVIHEIEEIIGIEATNAPTCSAKTGLGVEGVLETLVDVIPAPTGDREAPLQALIIDSWFDNYLGVVSLVRIKDGRIRKGDKMLVKSTGQTHIVTSVGVFNPKHTETGVLEAGEVGFVIAGIKDIFGAPVGDTITLSTTPEVASLPGFKKVKPQVYAGLFPIDASDFEPFREALQKLQINDSALFFEPESSDALGFGFRCGFLGMLHMEIVQERLEREYDLDLISSAPTVVYEAVTKKGDTIYIDSPSKMPDGSVVEDLREPIAECHILVPQEYLGNVMTLCIERRGVQKDMKFLGNQVSITFEIPMAEVVMDFFDKLKSCSRGFASLDYNFIRFESSSLVKVDVLINGEKVDALAMICHRNDARHRGIALVEKMKDLIPRQMFDVAIQAAIGAQIIARSTVKAMRKNVLAKCYGGDVSRKKKLLAKQKEGKKRMKQVGSVEIPQEAFLAVLKVER

SEQ ID NO: 6321 - protein, 468 aa, Acinetobacter baumannii
AMNKNQKPPFKQNAIALSFTLGVHAIAIVGLLFLGLSKPPEQPKKLTTVLVKPEDLPPPLAKEVEQPTVAENQAEEVLSPIVDETLPQNLPAAPPPPTAQQLAAQKQKAEQAQQAKLAEEKRKAEEAAKVKQAAEQQRLEEAQKQQAEAKRQAEAKARAEAEQKRKAEQNAKAEADAKARQKATEEAKRKAETEARLKREAQKAENAKLQAQQEAKRKAEADAKAKQQKAAEDAKRKAESDAKAKQQAADNAKRKAEADAKAKQQKAAEDAKRKAEADAKAKQQKAAEDAKRKAEADAKAKQQKAAEDAKRKAEADAKAKQQKAAEDAKRKAEADAKAKQQKAAEDARRKAEIEAEEKAASAKKAQEEAAQKKGEAKKIASSAKRDFEQKIRRAWDVPTGSSGKTVSVRFTLSDSGSVSSIVITRSSGDDALDASIKAAIQASAPYPMPSDPDARREARSVTSTFRAQ

SEQ ID NO: 6322 - protein, 443 aa, Acinetobacter baumannii
LCYKITSHKNTFNDFKPMKTSRKHLLALTLLTALSPLAPTAAFAQLHLEIAKAPDQAPKIAIVPFNNDNGLYPIVETDLNRSGRFTSSSKNLPANAAINQIQASDWQAAGIPYVVTGQIKQTADGFEVHYQLYDVQKQQYLLNELLNVPASRIRQAGHMVSDAIYQALTGIPGDFSGRIAYVLRNPATPAERYTLQIADTDGEQPKTVLSSRDPILSPAWTPDAKKIAYVSFETKRPAIYLQDLSTGTREVLTSFKGLNGAPSFSPDGKSMLFTASMNGNPEIYQMDLSTRQVKRMTNDSGIDTEARYTPDGKAFIFTSDRGGSPQIYRYDFGNGSVKRLTFKGSFNARGTLSADGKKIALVHRPSGSNYKVAIQDINTGIVNILTPTSLDESPSFSPNGQMVVYATREGNRGLLSIMSTDGRFRMNLPSEQGEVREPAWAPK

SEQ ID NO: 6323 - protein, 101 aa, Acinetobacter baumannii
ECRKIKIILLYLCCIYAYKPHFTWYVVCITKECRFRRIEMTTKKFDATPTAGEPINLEEISKESVQEAWKDYEAKPEYKAFNKHDLIESMQHSEEEQNKSS

SEQ ID NO: 6324 - protein, 153 aa, Acinetobacter baumannii
SGCFVSSIFDLHIQVQPQHIDALGHVNNVMYVQWMQDVAAAHVETLGVGVTKYLELKHAMVAVEHHVQYRKAAFEGEEIVLRTWLDDINALYSFRQYAFFRPSDQAILFVGNTKWACIEIASGRPKRMSPTFTQAYKPLDSSINPLDFTVSYA

SEQ ID NO: 6325 - protein, 265 aa, Acinetobacter baumannii
VQLKQLIISKDIRMLALVTGASAGFGYSISKKLIESGYKVIGCGRRAEKLEELQKQLGENFYPLVFDMTDTAENINKLFKELPNEFQIDQIDLLVNNAGLALGLEPADKADLDDWYTMIDTNVKGLVTVTRLILPSMVKKKSGLIINMGSIAGTYPYPGGNVYGATKAFVEQFSLNLRADLAGTGVRVTNIEPGLCGGTEFSLVRFKGDQEKANSLYDKKNPILPEDIANTVAWIASQPPHININRIEMMPTTQTFNPLKVVEVE

SEQ ID NO: 6326 - protein, 60 aa, Acinetobacter baumannii
ARVKPNDRPNPGSTRDRCDMIFPQREKPAETSKRINKDKWRGIKLGIKQISKRNVSLPNQ

SEQ ID NO: 6327 - protein, 197 aa, Acinetobacter baumannii
NNSNSGIAMNLLKVCTLLPCSLVIAACSVNSSSTPPTLSSSTPQVQKSSIEISCQDLQNPAYRQAVLNAINEIRQHPRQCGQQYFSAAKPLSWNNNLYQGASAHSKDMANNNFLGHVGSTGLDLRARLKKYHMLSKANGENVASGQKTLNEVMAKWIASPLHCSNIMNPRYTEYAIACASDQSAKQRSYWTQQFAGF

SEQ ID NO: 6328 - protein, 231 aa, Acinetobacter baumannii
IIPNMEKNMRPRAIVLLSGGLDSTTCLAWAQARYECIAISFMYGQRSTTELDAAKALAQRAGVEHRVINIDLANLGGSALTDHNIAVPEQLQEGIPVTYVPARNTIFLSYALAAAEVFNAEAIVIGINAVDYSGYPDCRPEFIDAFANMARLATKAGVEGKPLKFETPLLHLSKANIIRLGIEHGVDYSQTVSCYQADAQGRACGKCDSCRLRKEGFIDAGVTDPTRYIPQ

SEQ ID NO: 6329 - protein, 359 aa, Acinetobacter baumannii
FVRNEIMSIQVKNIEKHFGAFHALKNISLDFPEGELVALLGPSGCGKTTLLRIIAGLESADGGQVLLEGEDATNVHVRERQVGFVFQHYALFRHMTVFDNIAFGLRVRPRATRPSEAEIKKRVTRLLDLVQLGFLADRYPAQLSGGQRQRIALARALAVEPRVLLLDEPFGALDAKVRKELRRWLRNLHDELHITSIFVTHDQEEALEVADQIIVMNKGNVEQIGSPREVYEKPATPFVFDFLGQANRFEGEHASGIIRIGNDRIELPTTVQAPQGKVIAFARPDELHIHAQPQANTIEATFVREVWIAGKVVAELQDRNGRLIEIALSSEAAKQHAFKPNQTVWVSASQLHLFADQVA

SEQ ID NO: 6330 - protein, 154 aa, Acinetobacter baumannii
EMSENIHLPNQVFPTTHGEVNLAEVDNEWLIIYFYPKDSTPGCTTQAVGFSCLKDQFDALGARIFGVSRDSVKAHQNFTEKQALTIDLISDKEEVLCKHFDVIKEKNMYGKKVMGIERSTFIFHNKALVKSYRKVKAAGHAEQVLEDLKALQTA

SEQ ID NO: 6331 - protein, 342 aa, Acinetobacter baumannii
INDEVNTPMQDRLISGTEKPEDHFDRAIRPTSLADYIGQPVVREQMEIFIGAARGRGEALDHTLIFGPPGLGKTTLANIIAREMGGNLKSTSGPVLERAGDLAAMLTNLEEGDVLFIDEIHRLSPVIEEILYPAMEDYQLDIMIGEGPAARSIKLDLPPFTLVAATTRAGLLTSPLRDRFGIVQRLEFYSVEDLTHIVSRSANLMDVPITVEGAEEVARRSRGTPRIANRLLRRVRDYAQVKGTGEVNHEMAQRALDMLNVDKAGLDTLDRRYLSMLLERFDGGPAGVEALAAAMAEDSGTLEDVIEPYLIQQGYVMRTARGRIATNQSYLQFGMTPPEPKN

SEQ ID NO: 6332 - protein, 238 aa, Acinetobacter baumannii
KIADCCQPPTSFQRYIRDILKIRWARPMTGFSISMDLAPKKSRSETSSAHASTAEQRLKVFMQDVTGRALVMMESATQGQQGIAMDLVQEAFIALHKSYADRSTEEWYPLFYTILNNKLQDWRRKEARRANPFSFFKKVSLDNDDEEIIDIVDEKAINPADFLDQAVTIEEIQEAIAKLPVRQQQAFMLRAWEGFDTHTTAQIMNCTEGSVKTHYHRAIQGLREYLAHLNPMGGSNES

SEQ ID NO: 6333 - protein, 186 aa, Acinetobacter baumannii
AMQDQWKTNAHNRPSIVSFSGGKDSSLALYHAMQTGNVIGLIVMLEEQGQRSRSHAMPLDIIRAQAQAIGLPVFMASSSWNDYENKFINLLNEAKQKGAEVLVTGDLDMPEHGCWHDRVTQSVGLKLGMPLWLRPHREVVEEFIQLGFQSVVVTVNLKLGMKVEDLGQVLSLEYIQELENRGIDPC

SEQ ID NO: 6334 - protein, 277 aa, Acinetobacter baumannii
GPVDFDFNLILVPVTLILFAVWLLDKLVFKQRANKGRENENFVITWAYDFWPVLAVVLVLRSFLYEPFNIPSDSMVPTLETGDFILVNKFDYGVRLPIVNKKVIDIGEPKRGDVIVFRYPPQPTISYIKRVIGLPGDHIVYDHGQLIINGQKIPKVPTQFSREKDALDTPTSIYHKETIGDHTFTMRELEGVNVARQAPFINYVDNGKYANQDGLYWEVTVPKGHYFAMGDNRDQSADSRFWGFVPEENLTGRAFYVWMHKEPGFHLPSFNRNGKID

SEQ ID NO: 6335 - protein, 112 aa, Acinetobacter baumannii
IPWEVPMNHDDFTKKVTSKLDSLAHHHKNKTVVMNHVLDHIQQKPASYYSVWKMTGFALAAAITGFVILPNSVDMLDKPQNQVVVNPKLSPQMVEDLEMLMVLGEDKVQHGS

SEQ ID NO: 6336 - protein, 139 aa, Acinetobacter baumannii
PKWENRLKTTIRKTKMRKAQQGTSYLAILFGVVIFAIAVKAVLAVWPAYWDDRVINNQITELMQQSSADITPQKFMTQMDQRLEMNNIRDLHFKEIAEVFNQPSLTVKKKYEVRKPFLLNIDLVLTFEKSFDKTSVQAK

SEQ ID NO: 6337 - protein, 381 aa, Acinetobacter baumannii
DDTCITLDQRGLIRSVTNKLYYQSGIKNSCDIGSIELMKLTAGDIKDLGNDSFTDRISTYQTRYDNVQENLKNQAFSYLWPVLKIRSVEYKNLLDQTKANAKYRAIYIDLKAKGLPLPNEGANHTLKFFNTTDYNINVETIGTGLIDDKVYNIKDKEEDILKCEWNSALQQIIFYRLDDRITQAGDYNYCKYTVSTKDGSIQSTGLLEARFDNIAPVATNETVSFKYLANEIIPINLLKYANDDGDGPANTLQTKPNKPQFWVNDKGVELPIYLPSKSSKDGIFKVVKADREGPCPNNDKDNTCYGGNIYIQASNVFNTFNDTLTYYVYDADGKISNEGTIKLISTATTTDDSRGGGGGGSIGILSIASLLSLIAYRRYRK

SEQ ID NO: 6338 - protein, 179 aa, Acinetobacter baumannii
DLVCNLLNCPVFKSRCMALDRTDILFNSHILNIKLYSELKRNTLMANHFEFNIRVYIEDTDAGGIVYHANHIRYMERTRTEWLRAAGVDHYWHQKDYNFVVYKIDVKYMRPILMDDLITVTARVVSCKAASFVLQQNIYRGEILLASGEVELACLSKDLMPRRLPEEIRDLIRKELEQD

SEQ ID NO: 6339 - protein, 141 aa, Acinetobacter baumannii
KCSWCWVRIKFNMVAKKLALILCSLSFLQTSFAGFERFWIFSKDANTQVDDTWNALSEEEQRAVIKRYQSLKELPSNQSANLQQRMDWFNQLPDAEKQKMREAWQKMSTQERNDLRQRMLKASADERTAIREEYINKYLEH

SEQ ID NO: 6340 - protein, 342 aa, Acinetobacter baumannii
NMPRIYLTHFDACAQERFFMSNLTLSQFLQQEKGNLTPELAQVIDTIAATCKTIDQALQKGALAGILGSAGNENVQGETQKKLDVISNDYLIDALKVHPHVGGLASEELDDFTPAQENGEYLVLFDPLDGSSNIDINMCVGTIFSILPAKNAVTQAQDFMQAGIQQVAAGYVLYGPSTMMALTVGNGVAFFTLDPETQTFLLTTENVQVSADTQEFAINASNQRHWEQPVKQYIEELLAGKTSVREKDFNMRWVACMVGDVHRILCRGGIFLYPYDLKDPKKAGRLRLMYEANPMSMLIEQAGGASTTGRVRILEIEPTELHQRVPVIIGSKNEVERVTSYH

SEQ ID NO: 6341 - protein, 355 aa, Acinetobacter baumannii
RLALFCVHVLNISYFLRGYLMRFSQLKVGVIAALLSVSSFAAQEFLNVSYDPTRELYTDFNKQFGTYWKQRTGQDIEFKQSHGGSGKQARAVIDGLNADVVTLALAADIDEIAEKAKLLPTDWQKKLPQNSTPYTSTIVFLVRKGNPKQIKDWGDLIKPGVEIITPNPKTSGGARWNYLAAWAWAKHQAGGNDAKAQEFVRQIYKHTKVLDSGARGATTTFAERGIGDVLLAWENEAHLAIREQPGKFEIVTPSLSILAEPPVAIVEKNAAKKGNLTIAKGYLNYLYSPAGQEIAARNFYRPRNAAVLKKYSNVFKPLKLVTIDKEFGGWTKVQKQHFDNGGVFDQIVKINSAEK

SEQ ID NO: 6342 - protein, 280 aa, Acinetobacter baumannii
NVKLKKLKTLNFKHNKKLNEKPKQMLKPNSKKLPKTPNVKLNQMLRLSNKQLITRNVKPRPMRKLNSKKQLKMLNVKLRLMQKPSSKKQLKMLSAKLRPMRKLNSKKRLKMLNAKLRPMRKLNSKKQQKTLNVKLRLMQKPNNKKQQKMLDVKPKLRPKKKLHLLKKLKKKLPRKKVKLKKLHLRLNVILSRKFVVLGMFLQEAVVKLLALDLPCLTQVVLARLLLHGQVEMMHWMQVSKLQFRRLLPTQCHRILMQDEKREALPLLSEHNNFVRVTCFK

SEQ ID NO: 6343 - protein, 271 aa, Acinetobacter baumannii
SKDSTMTLSCIQQPHQHLQANLEGGVLTLAINRPEAKNALYGELYLWIAKALDEADQNKDVRVIILRGAEHDFTAGNDMKDFMGFVQNPNAGPAGQVPPFVLLKSAARLSKPLIIAVKGVAIGIGVTILLQADLVFADNTALFQIPFVSLGLSPEGGASQLLVKQAGYHKAAELLFTAKKFNAETAVQAGLVNEIVEDAYATAQATAQHLTALPLASLKQTKALMKHDLDQIIECIDHEAEIFMQRVQSPEMLEAVQAFMQKRKPDFSQFN

SEQ ID NO: 6344 - protein, 309 aa, Acinetobacter baumannii
LTSSMGKPSYREKCHMNLHTDSNALALKLQSRDATREPTWVRYTLITIALIFFLSCLMLPLILVFVEAFKQGLEVYVQALIDPDTLSAVKLTLLTAAIAVPINVIFGVAAAWAVSKFQFKGKAILTTIIDMPFSVSPVIAGLMIVLIFGAQGWLGGWLMEHDIKILYAVPAIVLATIFITVPFVARELIPLMEAQGTEEEEAAIVLGASGWQTFWKVTLPNIKWGLIYGVILCNARAMGEFGAVSVVSGHIRGETNTLPLHVEILYNEYTFSAAFAVSSLLAFLALLTLILKTWLELHQDKPEPHSTDS

SEQ ID NO: 6345 - protein, 142 aa, Acinetobacter baumannii
RITRMKSSKEEIVAFLEKEFPQSLEHCTIESVTSKAAVVYYHVDQRHQRPGGTISGPTMMTLADFALYIAILGEIGIIGLAVTTNFNINFLRKPAGDQDLRSECKLMKVGKSLVVGEVWIYSVGQEEPVAHVTATYSIPPRP

SEQ ID NO: 6346 - protein, 235 aa, Acinetobacter baumannii
HLRRVLTKHQFKLSDPRLLSRIGYQFKQPELLQLALTHRSVSHKYNYERLEFLGDSLLGMIIANYLYHAYPHENEGRLTRMRATLVRQEALGKIATDLQLSRCLILSTGELKSGGHHRESILADTVEAIIGAIYLDSSDLNLLKDIVLKWYTPYLDHIEPTDQLKDPKSRLQEYLQARKKPLPVYEVVDIQGDAPHQHFKVECLVDGLSKIHGEGSSRRFAEQAAAAEILKLLEQ

SEQ ID NO: 6347 - protein, 265 aa, Acinetobacter baumannii
RPFGYFLMAVIFLESKDNAKIKHLRGLIELNSARKKHQQTVLEGTHLCLAWLQQQKKLFSLFTTEQALEHPDLKKIIELHQGHVFIISEVLYKDLSTLGNTLPCLAIIDLPKTASTIDYSVDTLILENVQDPGNVGTLLRSAAAANIKQIICTQGSASLWSPRVLRAGMGAHFSLSCFENFQLTDILPKFDIPVFVTSSHRSTSLYSKDLSKPCVWILGNEGQGASDYALEHAQSVTIPQPGGQESLNVAIAGSICFFEMVRQRQ

SEQ ID NO: 6348 - protein, 276 aa, Acinetobacter baumannii
IKDGLSMWCFKNGQPVETIPLLDRAFHYGDGCFTTIRVFQNKIELKARHWERLKLACQKLSLVADFELIEQSLQHLQNQNLVLNGTLKIVISRGEGDRGYSLPKHAADIYIWFYPKALEQFQPDFIQCGVLNQTLGLTMPSLVGLKSLNRLEQVLLKKEADQQGWVEALVTDVQGYIVEGVSSNCFIRLNDRWITPELRYNGVHGVMRAEILARMQHYGIACEVRIIELDEVPQIQSLFFRNALHPMRVVTQISEQILESQACLNLFHTLNLNQIH

SEQ ID NO: 6349 - protein, 104 aa, Acinetobacter baumannii
VKRGVISGRFKLMRMDMPNQQTIHHFDVIIVGSGGAGLSLALSLPSHFNIAVLAKAALTEASTFYAQGGVAAVLDETDSIQQHINDTMIAGAHLCEMDAVQHTV

SEQ ID NO: 6350 - protein, 244 aa, Acinetobacter baumannii
DFFMAALLGVNIDHVATLRQARGTAYPDPVEAALICEQAGAEGITLHLREDRRHIQDDDVRRMRPLLKTRMNLEMAVTDEMVEFAKEIQPQHVCFVPERRQEVTTEGGLDVVGNFEKVKAATQALATIGCDVSLFIDADFAQIDAAIACGAPTIELHTGAYADATTEQEQQEELARIVKGVEYAASKGLVVNAGHGLNLKNIAPIAAIPQIHELNIGHSIIAESVFVGLVQAVKDMKTAIQAAG

SEQ ID NO: 6351 - protein, 141 aa, Acinetobacter baumannii
VKFMKLLKSNLILSSLFSAAALMAGSAQAAENPVQAAYKSTNVKGALINVCKDQTAKGGKLSSAEVSKFCSCQVEAQGKVTEAQKWEIQSAINAKKSPSSLAFVQQQNRDLKACFGPQLTTKLEKLTEEAMKAAQQQAPKK

SEQ ID NO: 6352 - protein, 175 aa, Acinetobacter baumannii
SCIICRRDDCFIATSICGFVTGRCIMAIQRSGRFERIKKPLKSDMNVVPYIDVMLVLLVIFMVTAPMITSGIKVDLPQANNHPIESKDMPAMVTIGKDGNIYLQYEDYKDNEPLSLEKLESVLSEAQKQAEQENKQLTVLVNGDKTRPYGEVVSLMASLQEAGLTQVGLLTEPLK

SEQ ID NO: 6353 - protein, 62 aa, Acinetobacter baumannii
VRVILIFLSYAKLKWLSNLCACKKASIQLAFLLLKLIKLFVMLLNLLKPVQHGQLLSPYGNF

SEQ ID NO: 6354 - protein, 202 aa, Acinetobacter baumannii
NYAMIGCLIGEVFALEAPTVLLNVNGVGYEIDTPLSTFCQLQKGQKVTLWTHLVVREDAQQLYGFSDAQEKTIFRTLLKVNGVGPKMALGILSTLSVELLVHTIEHDDVNTLVKVPGVGKKTAERLMIELRDRFKTLAQGTSSAAALPQIQFVSNSPVAEAEAALQSLGYKPLEAQKAVAAVKADYTESADIIRAALKSMMK

SEQ ID NO: 6355 - protein, 230 aa, Acinetobacter baumannii
HGYMIHHRKYREKSHIVHLFTQEYGRVDGILRQTPPPQYQPIRLQATGKSELKNFTKLEILNQPVFFFGDAFFAGFYLNEIVLRLCPLEEAMPQTFEQYQLTLLQLQQLSSHENPDLFLRQILRQFEHILLAELGYAIDFSIDSSQKEILPQQFYQFQVNEGFAPIVQASRSSLSGKAILSMLDYEQGQDFSHEQLQLLGKLYRQMITSLLGDRPLKSRQLWIQNTQTQS

SEQ ID NO: 6356 - protein, 447 aa, Acinetobacter baumannii
DKDMYKKAALIFPLALISQLSLADWVKDATQQNENQVIQLRQHIHEYPELGNMEFKTSALVQKELKSYGIQVKTGYAKTGVIGILKGNNPGPIIALRADMDALPMEEKSGVPFASKQKAIYQGKETYVMHACGHDAHTAMLLGAAKILAANKDKISGTVVFVFQPAEEGGADIDNFTHGDQIGSRKMIADGAFKDYKPEAIFGMHVMSGMKSGHLYYKDGAILNSADHLRIQVNGKQVHGSTPWLGRDPIYASAQMINNLQSLISRRTDLTQGMGVISIGNIQGGTAGNVIPEQVNMIGTIRSNNEQIRENILKSLPALVEHNAQANEVTAKVEIAPYAPVTMNNKALTQLIQPTLAKTVGDSNLHVLDHNASASEDFAYYGKLMPSFFVFLGATPENQDLSQAAPNHNPSFIVDDKALKTGTELHIRFVLDYPNIAKQVQAAWKQS

SEQ ID NO: 6357 - protein, 285 aa, Acinetobacter baumannii
CKIFKIFYGRKIMSQLSTIIEQAFEDRANFTAADCPSEIRQAVEEAIAGLDNGTLRVAEKINGEWVVHQWLKKAVLLSFKLNDNKPIESCDLRFYDKVETKFSGWTEEQFKAAGVRVVPPAVARRGSFQAKNVVLMPSYVNIGAYVDEGTMVDTWATVGSCAQIGKNVHLSGGVGIGGVLEPLQANPTIIEDNCFIGARSEIVEGVIVEEGSVISMGVYIGQSTRIYDRETGEIHYGRVPAGSVVVPGNLPSADGKYSLYAAIIVKKVDAQTRAKTSLNDLLRAD

SEQ ID NO: 6358 - protein, 361 aa, Acinetobacter baumannii
IRFINMPKPPVNAKAKNAKKKGKKTASNFPKKLVLIGCFIVLISIFAILWSSLFKAYPIEGKKQMLSITSGETYSGFIDRLAKENKIHFPIVLKLYQKFMIHDSMKAGVYEIEQGMSVRQVLEMLSDADNAQMNRVLVIEGTTFKQLITALKNDKNVKNTILDLPDDQLMKALGIPYHHPEGLFAPNTYFFAKGETDKKILTDLYHRQMKALDTAWAKRAPNLPYKDKYEALIMASIVEKETSLDSELTQVSGVFVRRLKLGMRLQTDPTVIYGMGANYKGNITREDLRTPTPYNTYTINGLPPTPIALPSQKAIEAALHPDDSNNIYFVATGNGGHKFTADLQAHNQAVQEYLSVLRSKK

SEQ ID NO: 6359 - protein, 280 aa, Acinetobacter baumannii
GNIMSQRSRVLPGFGLSLGFTLAYVSFIVLIPLAAVFIKSFGIGWDGLWEILTSERILKSLQLSFSSALIAAFINVVFGLLLAWCLVRYNFPGKRLVDALVDLPFALPTAVAGIALTSLYAPTGWIGQYLEPLGIQVAYTPIGITLALVFIGIPFIVRTVQPVLSDIETELEEAASALGANRWQTITKIILPILLPALFTGFALAFARGVGEYGSVIFIAGNQPFKTEIAPLMIISRLEEYDYAGATTIAAVMLVLSFIILFVINLLQAWANRRTGRNVT

SEQ ID NO: 6360 - protein, 446 aa, Acinetobacter baumannii
MEQMRWLELLSAVRLGSKKSSTELARSPFHKDYDRIIFSQSFRQLNRKTQVHPLAQHDGIHTRLTHSLEVSCIGRSMGMLAAEKIKDELPVWISPADVGAIIQAACLAHDIGNPPFGHAGEYAIREWFDDASHNDFLKKLTPEEEADVRQFEGNAQGLRLLTRIDYHPDDGGMRLTYATLGAYLKYPWLSKTIASQGDRPSHQRAKFGCYQSEKEILKQIAEQLGLIQLGEYHYCRHPLTYLLEAADDICYALIDLEDGIILNMLNYQEVEPIFLNLIADYGQPEELSLPSSTWQQKISALRGRVMKRLVDEVTTAFAKHHYEIITGQLKGSLLQYCSPDIAAGIETAKNLARAKIFEHPQKSGLEIIAHQSLQTILDAFVPLTMPHKSLSFKEQRLMSILNLYGARFSNNHYSNIMQVLDIISKFSDHQAYSLAQELQGNKIGLF

SEQ ID NO: 6361 - protein, 404 aa, Acinetobacter baumannii
RRKMKSKIHFREFALLMALLMSIVSFSIDAVLPALGEVGRVFELKNNNQTQWVIIGIFSGMTIGQLIAGPLSDAIGRKRILFTGIIIYFLGSLLCFTTQSFEWFLVGRFIQGIGVSGPYVASISIVRDKYSGAQMARIMSLIMMVFMVAPAIAPSLGQLIIHFFGWRDIFVLYMIYATVVGAWVALRLEETLLPENRLPMRLQAFQDGFKEVVSNKTTMSYLLCAGFCFGGFIGYLGTSQQIFMQQFGKTGQEFSAYFAVLAGVMGIASFTNSKIVMKFGMRPICIYGFLGLCLISLIFLGIQLIGVTVAFWMFMLYACILFLLFGTLFGNLNAIAMEPMGHVAGMASAIIGAASSVLSLILASIIGQLYNGTLIPMTCGFVILCGLAFMMTVYENRYLKKSNV

SEQ ID NO: 6362 - protein, 202 aa, Acinetobacter baumannii
GKEMFISFEGTEGVGKTTLIRKIHQHFEEQGKQVVLTREPGGTSLAEQIRSMLLAVNHDENMSHDTELLLIYAARAQHLQQVILPALESNKIVLSDRFTDASYAYQCSGRGLSQDKLQLLNQNFVSRMPEVTFWLDAPIELGMNRARERGALDRFEQEKLSFFTKVREGYETLWKAEPERIKRLDATQSPDQVFEQALQYLA

SEQ ID NO: 6363 - protein, 109 aa, Acinetobacter baumannii
VILFMLKLIYYVPESHLESTKQSIFAAGAGGIGNYEQCAWQVKGIGQFKPVKGADPYIGELGELEQVDEWRVETIVLEEKASAVAKALKASHPYEEPAFEFIQIIEVDF

SEQ ID NO: 6364 - protein, 241 aa, Acinetobacter baumannii
CGISRMASLRSSAIPVSDPASGLRITEIFYSLQGEANASGLPTVFIRLTGCPLRCSYCDTTYSFEGGERLSLEHIIETAEKYQTPYICVTGGEPLAQPNCLILLQRLCDAGFDVSLETSGALDVSRVDPRVSKVLDLKTPTSGEEHRNLISNLDHLTPRDQIKFVICNREDYEWSKQQVEQYQLQTKVSTVWFSPAFAVEKGAVGLPRLARDLAQWILDDKLPVRFQLQLHKLLWNDESGR

SEQ ID NO: 6365 - protein, 511 aa, Acinetobacter baumannii
GIGSKNHLLLFQIACIYMFVFVYTKMDLIIEKLLKDKESVMDSSAGKSKSGFVENRSIDFIPENERHGSIFAQFTLWFGANLQITAIVTGALAVVLGGDVFWSIIGLFIGQCFGAAVMALHAAQGPKLGLPQMISSRVQFGVYGACIPIILVCLMYIGFTATGEVLAGKAIAHLAQVSNTTGILIYACFIIIFATIGYRLIHWVGKVASVIGLIAFVIILTQILALSNISELLAVRHFSWSSFLLAVSLSASWQISFGPYVADYSRYLPTKTSSTRVFWAVGLGSLIGSQISMMLGVFIAQVSNGGFVGNEVQYVVGMNPIALVITFLYFSIAFGKVTLSTLNAYGSFMCIATIWNSFKPSAQISKLTRLTIVLAMVIISTFIAVVGEHTFLSAFKSFILFLLTFFIPWSAINLVDYYFISKEECDVNALYDPNGKYGRWNTIGIACYCIGILLQLPFIDSKFYKGQIAEMLGGVDLSWLVGLLSTAVLYYVLAKRAQIKISKALQLERVK

SEQ ID NO: 6366 - protein, 90 aa, Acinetobacter baumannii
RIGSPSAICPAIIASLIYLTITSDTEGIAPRFDTLKDGSVTNILLTSKYDTNKRMIILVIHHNEIIALKASFSVRLILHIKLLKTIFISL

SEQ ID NO: 6367 - protein, 160 aa, Acinetobacter baumannii
QLRLRRVKMPKYLAVAEKVYKNIKKDDLFTNDLTQNLNCLISQIRKAIKGTEFKLKFNYIDFDEQLTKPLSECKVKVDLSVMPKFENEGEYLLWLASFIERITDGGKPKFPPISQLIPHGFKISKESFPVTVAPPKEEHADMIIKYFKSEDFMKTNKTPS

SEQ ID NO: 6368 - protein, 165 aa, Acinetobacter baumannii
GNLSMSNIYQFEAELLEGDIKQFADYKGKVLLIVNTASKCGFTPQFAGLEKLYEKYKDQGLEVLGFPCNQFGGQDPGSNKEIGTFCQRNYGVKFPMFAKVDVKGPEAHVIFRYLTREAKGILGSSTIKWNFTKFLVGKDGSVLNRYAPTTKPEALEADIEKALAS

SEQ ID NO: 6369 - protein, 441 aa, Acinetobacter baumannii
FSRFFITVRFYYLFILKLLQILRFGQIFFWFIHDANLIFIFKRRKILLFKHSQILKKTLITTSLITFSLSSHAALTFGNAEEGQLKVSGTVRAKYIYDFDSEPSTSKFSFNDAVLWLDYNSPKWIGRLDYRVYEYYGHLGDANWLTDAWLGYKINDKSKIIAGLNPVPFGLGRFWGNTYYLGIANSTGWEDVHNLGVKYDFNDGTNEAQLAFYPTDGGTYRGKSKDSSRFSINPVNADDSVPQGTNTKEKNSIVVRGAHTFKNILGQENFSTQLGASAWYSTIENKRSGQDGDRQVYSVFSNTNYNQWNLQLLAGYQDIDNADTQYKDHLTLGGFDYSFNSATKGQIYSAELSYLFPQQFGPITSVRPYLNYSSYRKEQDGFKDSTRFIPGIAFNYQKLTVQAELLMGKHDPYLGDSEGLAAGGSNDKWNKKAFVIFAYYF

SEQ ID NO: 6370 - protein, 298 aa, Acinetobacter baumannii
CIGFIPKRSFSIFVISGNLMSLFDDTAVSKQLAQVRIVMVNTTLPANIGSALRAMKTMGLSKLVLVSPKTYPHPDIQALAAGAQDLLEQVEIVETLEEAIKDCHLVFGTSARSRTIPWPLLDVRPASKEAIKAAAQGQQIAIVFGREDRGLTNEELALANYHLTIPVNSDYGVLNVAQAIQVVCYELRMSVLEQKEVASDAGQMPLAQGQSMQWDEPLVTQQQMEEFYPHLEKMLTEIEFLDPENPRLLPLRLRRLFGRIQLDRMEYHLLRGIFSRVQALTSGKWKKASSDKEDQSNA

SEQ ID NO: 6371 - protein, 501 aa, Acinetobacter baumannii
GHTSIMSYFDPTLIMFMVYIVAMVLIGLFAYRATSDFSDYILGGRSLGSFVTALSAGASDMSGWLLMGLPGAIYLSGLSEAWIAIGLIIGAWLNWLLVAGRLRVHTEIQNNALTLPDYFTSRFDDQKKILRIFSAVIILVFFAIYCASGMVAGARLFENLFGMSYTTAIWLSAIATISYVCIGGFLAISWTDTFQAGLMIFALLLTPIVTYLAIGDTTQFVTLIETARPHAFNIISDLSVVAVLSSMAWGLGYFGQPHILVRFMAADSVKSIPAARRIGMTWMILCLVGAVGAGFFGIAYFQQHPELAGVVSKNPETVFMELTKILFNPWIVGIILAAILAAVMSTLSCQLLVCSSALTEDLYKGFIRKNASQKELVWVGRIMVLAIAVLAIVLAGNPDSKVLGLVAYAWAGFGAAFGPLIILSLFWKRMTLEGALAGMIVGAVVVIGWKNLFASTGVYEIIPGFICAFISIIVVSLISKAPNSDVTGRFEQADKLYKEST

SEQ ID NO: 6372 - protein, 180 aa, Acinetobacter baumannii
SMASYALLEQARHLQALVLDVDGILSDGFVTLTNTGDEIKSFDIRDGLGMKLAQQAGMKVIIITGRKSNIVEKRMSDLGVDLVFQGREDKGSALREACAQFNILPSDCLYMGDDWPDLSAFAIAGMSVTVPNGHEEVRRRADLVTQAMGGRGAVREVCDMLLIAKGIYQELLEKYLAVPH

SEQ ID NO: 6373 - protein, 1297 aa, Acinetobacter baumannii
NRGLLNFQENLSVLNGLNIDQWVMARDRYRLNRLRKDKKANTAEIEKLFEQSNAKVRQRLERLPKIKLNQELPVTQYADRLIEAIQKHQVIIVAGETGSGKTTQLPQIAMLAGRGLTGMIGHTQPRRLAARSVSQRIAEEVGEKLGESIGFKIRFNEQGSQDSIVRLMTDGILLAELGNDRFLSKYDTIIIDEAHERSLNIDFIMGYLKQLLPKRPDLKVIVTSATLDVNRFSNYFNNAPIFEVEGRSYPVEVRYRPISEMNIGGSDDDEFDDFEENLPRAVVQAVEECFADAEEKGHPEHADILIFSSTEQEIRELQETLQKYGPRHTEILPLYARLAVSEQQKIFSPSGKGRRIIIATNVAETALTVPNIRYVIDSGFARISRYNYRSRVQRLPIEAISQAAANQRKGRCGRVAPGVCIRLYSEEDFLSRPEFTEPEIKRTNLASVILQMQSLGLGELENFDFIEPPDFRLVNDGRKLLIELGALNEKKNELTKVGQMMARMPIDSRLARMIVGGAHFGVLKEILVVVSALAVQDPRERPADKQMQADQKHALFKEADSDFLFYLKLWDTLNPKGEAGMSENKRRQFAKQHFLSWLRLREWKQTHQQLVELAEGLKLSFNEKPANYENLHRALLTGLLSFIANKTDERNTFMAVRQQKAKVFPASTLHKTNTAWVMAFEMVETSQVYLRTLAKIDPEWILLAARDLLKYHYFEPHWSKKAGIVNAYAQISLFGLIIEPKRLVNFEKVDQPAAHEIFLRDALTTGNLGTVPPFLKHNLLKLEEVERVEDKLRRRDLVVDEETIYQFYAAKIPEEIASRRSFEDWRATVEAKNPRYLYVEDDALWLNDRPTTQQFPDHLHNGQLRLATTYRFDPSHDEDGATVQIPVQALPQVDENIWSWGIPGWRLDLIEALLKALPKDKRRNLVPIPDTARKLMQGIDAVHLRQHIFSYLAFALRGEQITEKDFSFERIDPYLVPFIKVIDEKGKLIAKGRDLAELKARCRVETHRPVKQQKGEFKTFPENFTFEASQKVTGVVVKQYQALVSTKTFAELEAKDESGVVIQTFNDQAEAIKQHREGIIRLVHMQLGDLVRQLKKQISKPLALAYSPLGDKAKLEQMLVYATLQMAITTLPINADEFNQLLEQVKKQFLSYGQQALEQLSDIYIQWQQIRRQLLVLDPDVFGRSIDDIEDQLDLMSLGNFVYCQPVDLWQEYPRYLKALLLRLDRLPNNLQRDHAAIDDVDPWMDKVFKFKNDPRIKELYLMLEELRISLFSQPMKTKMPISPTRLQKLWDRLGIS

SEQ ID NO: 6374 - protein, 145 aa, Acinetobacter baumannii
RTKSMCECQNVGEFFVCPDSFSNIFSNNYEMKNRFPHYIIEEAPCEETHPKFDYSEFYYACSECEQAWYFECYPDTPTAPVFGIKLSDVNQTLSQNRINSIKQFLVVLAHEGFSENKCIHKGCTDYSLNGINVCLNHFGYKLSTR

SEQ ID NO: 6375 - protein, 358 aa, Acinetobacter baumannii
IRKSAMSQFVPLKVKSITPQTDQAICIAFDVVPEQQEQFQFQPGQHLTIRHLTEAGEIRRCYSICSYAGKEDISIAVKKIDQGQFSNWANDHLKVGDVLEVMPPQGVFFQKAAKMGGQNYLGVAAGSGITPILSIIKQVLFEQPEANFTLLYGNRSWKQTMFAEQIMDLKDQFKERFQLINIFSREFNDSELMNGRIDAEKLKQLFDYEVLETNFDHVFACGPDEMMNAVENTLPNFGIAKERIHTERFHTGQARKRSVEADANRKEEKVNIILDGRELIVSVAQDDESILDAALRAGADLPYACKGGVCATCRCKVLSGEVDMFLNYSLEEDEVEKGYVLSCQTLPKGSNVRLSFDE

SEQ ID NO: 6376 - protein, 179 aa, Acinetobacter baumannii
QSESKIRIYSMNAKLNTETPQSFISNGSNTSFSAEDILAKAQQYAQEHELNFRGSLSPVDAWQLVQQGEAVLVDVRTNEERKFVGYVPESIHVAWATGTSFNRNPRFLKELESKVGKDKTILLLCRSGNRSAQAAEAAFNAGFEHIYNVLEGFEGDLNEQQQRNQKNGWRIHQLPWQQD

SEQ ID NO: 6377 - protein, 80 aa, Acinetobacter baumannii
STESPKIVEISEVPLKVSFFTTESIICCIFALILMSWRLVSGYRFYTLNDLDVKQSDAYRLPALPYLPNEVRSLLSQPLQ

SEQ ID NO: 6378 - protein, 342 aa, Acinetobacter baumannii
NHRSQPEIRSIILSQTRMPNPTDFQSSALATLRIEQQAIDVLATQIDDRFNRACEILLQCKGRVVITGMGKSGHIGRKMAATFASTGTPSFFMHPGEAGHGDLGMLVRGDVLIAISNSGKSDEIMMLMPLIKHLGVPLITISRDDKGPMPQNADIALTLGESDEACPLGLAPTSSTTATLVLGDALAVALLEARGFTADDFARSHPAGALGKRLLLHVKHLMHTGDELPKVSPETPMNQVLYEISNKRLGLTTIVDEQDHLLGIFTDGDLRRLIDKQQGFDVNLPVSEVMTKKPSTISQEARAVEALQQLNQKKISQFVVVDDQNKVIGVISMHDLIQAGVN

SEQ ID NO: 6379 - protein, 161 aa, Acinetobacter baumannii
SCRSRRATKHGITEAVSRANGYKGNMKDLPIDVAKAIYRKQYWIEPRFDQVNSISLAVAEELLDTGVNCGINFAKPLLQRALNLLNNQGKAGYADLKVDGVYGSNTLGALKTYLAKRGKEGEKVLVRVLNIMQGQRYIEICERNPKQEQFFYGWIANRILL

SEQ ID NO: 6380 - protein, 389 aa, Acinetobacter baumannii
KGRSQMIRDEGMLEQLLSTIRDFVKNELIPRENEVVEKDKIPDDIVQQMRELGLFGLTIPEEYGGLGITMEEEVRVAFELGQTSPAFRSLIGTNNGIGSSAILIDGTEEQKQKYLPRYASGEIIGSFCLTEPESGSDAASLKTSAVKDGDFYVLNGTKRFITNAPHAATFTVMARTNPEIKGSGGISAFLVEANTPGITLGKIDQKMGQKGSHTCDVIFENCRVPASALIGGVEGVGFKTAMKVLDKGRLHIGAYSVGVAERMLNDALNYAIERKQFGQPIANFQLIQAMLADSKAEIYAAKCMVLDAARRRDNGENISTEASCAKMFATEMCGRVADRCVQIHGGAGYISEYAIERFYRDVRLFRLYEGTTQVQQLIIAKNMIREATA

SEQ ID NO: 6381 - protein, 209 aa, Acinetobacter baumannii
ENMSTRKPRQARAKVTVDTIIEAGFIAVALHGPSGTTTRHIAEIAGVSVGSLYEYFKNKEEIYDAMNHYFVSEILDMIKELTPTILELELEPVIEMIFYTFSDLLKKNNDRYLTVLRYAGELQYDKYIPKIEQALMEVIMKYMMHNPKYLKINNLPVITYICINSGIFNVARHLILPNPFISFDEMVQGLTTMIMSYINTEMARSEDQS

SEQ ID NO: 6382 - protein, 264 aa, Acinetobacter baumannii
VMMSKTLQLSNNRIAHYFEQGEGEPLVLIHGVGMQAAAWYPQIEYFSKHYHVISVDMPGHGQSTKLPADAKLQDFVEWTIEFITALNLGPVNLAGHSMGSLITTGVSVTRPDLVKRMAVLNGVYKRTPQARHAVIQRAEELKTGRIDVETPLQRWFGESEVERIAAAKVKTWLENVDLSGYTTAYSAFAQGDETYADDWSKITCPALVLTGTDDPNSTAEMALQMAKQAKHGTAIVIENERHMVNLTAPDKVNNAMQAWLETNV

SEQ ID NO: 6383 - protein, 317 aa, Acinetobacter baumannii
CKMSDNINMYGNLQMDALELKNIISDGLLSFPVTDFDQNGDFNKSSYAKRLEWLAPYGASALFAAGGTGEFFSLTGNEYSEVIKTAVDTCRGSVPIIAGAGGPTRQAIEQAKEAERLGAHGILLMPHYLTEASQEGLIEHVKQVCNSVDFGVIFYNRSVSRLNLDSIQKLAEMCPNLIGFKDSSGQIDMMTAVTQTIGDRLSYLGGLPTAEVFAAPYKALGCPVYSSAVFNFIPKTAMEFYNALRSDDFETTNRLIKDFFLPLIKIRDRKSGYAVSMIKAGAKIVGHDAGPVRPPLSDLTQADYEDLAALIATLGPQ

SEQ ID NO: 6384 - protein, 81 aa, Acinetobacter baumannii
VDTLEAIFNENNGYCAHFSLTVRSIFFISFFTVLIAVFHIKVLLVIHFTNKNYNLLIFNIFLYLYLYIKNQKKCFAFLFIS

SEQ ID NO: 6385 - protein, 528 aa, Acinetobacter baumannii
ALWSLFKCIQGTIMLKPLLIRISPLDNVAIVVNDGGLPSSTYIEEYQLTLVDEVPQGHKVLLEPLKQGEAIVRYGEIIGYANKDLTAGSWVNEAVTQMPEAPELDDLELATRPDPKLPPLTGYTFKGYKNKDGSVGTKNILGITTSVNCVEGIVDYVVKIIERDLLPKYPNVDGVVGLNHLYGCGVAIDAPAAIVPIRTIHNLALNPNFGGEIMVVSLGCEKMQPERLLNIPKENKYIPLANEDIIQLQDERHNGFESMVNHILTVAEQHLEKLNQRTREEVPASELVVGMQCGGSDAFSGVTSNPAVGFAADLIVQCGGTVMFSEVTEVRDGIHLLTPRAANEQVAKDLIREMKWYDDYLAAGQVDRSANTTPGNKKGGLNNIVEKAMGSIAKSGRSPIVEVLAPGQRPTKKGLIFAATPSSDFICGTQQMASGITVQVFTTGRGTPYGLAAVPVIKMASRNNIANRWYDLIDISAGDIAIGKKTIEEVGWELFELILRVASGEKQTWSDRWGIHNSLAVFNPAPVT

SEQ ID NO: 6386 - protein, 399 aa, Acinetobacter baumannii
RSTFIMTIGMMRNALYTPTIILMAIAAGICTGGNYFSQPLIHSISLSLNLTETTTAWVPTLAQITYACGLLFLMPLGDIIEKRKLLFIFMLLASSGLIISGFSHNIYLLLLGTIITGLFSSAAQLLLPLAASLVPIQQSGRVVGFLLSGLMMGVLLARSLSGLMSTLFAWNIIYLVSGFLLLVIAFILHRNIGLFPPTKSENYAKTIRSLPQIFIQNRRLRTRTYIGGFTFACVSLTFTTMSLLLAPAPYFFSDFTIGLFGFVGVLGTFVANFSGKFIDQGYIHKISIYCGVGLILSWVLFSLLPYHFAFYIIALLILYASLSAVHVTNQSIVFKLNQELRSRFNAIYMTGYFAGGALGTTAGSYAWKHYGWTGVCILGLIFAIVCLYYCVRDAKNQHN

SEQ ID NO: 6387 - protein, 333 aa, Acinetobacter baumannii
LTLFFVYRKIDLRVMPTGNERMENNYQKFEQNIANEITIEAKDQMPDAYRKTLIRQIGQHGHSEIVGMLPEGNWITRAPTLKRKAVLLAKVQDEAGHGLYLYSAAETLGADRDDMMEKLINGKMKYSSIFNYPTLTWADVAAIGWLVDGAAIVNQVALCRTSYGPYARAMVRICKEESFHQRQGFEAMMALANGTPEQKQMAQDAVNRFWWPALMMFGPSDEHSPNSAQSMAWKIKRFSNDELRQKFVDNTVPQVLQLGLEVPDPDLKFNEETGHYEFGEIDWHEFNEVIAGRGPCNHERIEARRKAWENGKWVRDAAVVYAKKQQLEANKVA

SEQ ID NO: 6388 - protein, 226 aa, Acinetobacter baumannii
YYLLEFSLNWQYIHSVLPQFFSATLTTLKISIISIILAIIVGLICSILITYRVRVLNRIAQFYIELSRNTPLLIQLFFLYYGLPKLGIKIDGFTCGVIGLTFLGGSYMAEAFRAGLQSVAKGQIDSAKSIGLQPTQIFRYVIFPQALAISIPAIGANCLFLIKESSVVSAIAVVELLFVTKDLIGMDYKTTEALFLLIIAYLIILLPVSILTSYLEHRSRKVSHGT

SEQ ID NO: 6389 - protein, 218 aa, Acinetobacter baumannii
THLFITRTITMNNEHFKLYTDSQFLSPYAFTVFVGLHEKQIPFEIATIDLGQQGQFETSFVEKSLTAKVPVLEHNDFALSESSAILEYLEELYPDTAIFPKDIQARARARQIQAWLRSDLVALRTERPTDVIFIQPTSTPLSEEGKKTAEKLFFVAEKLLVSDAEFLFGSWSIVDAELALMLQRLIQNGDAVSERLKNYVLQQWQRPSVQKWLALRHK

SEQ ID NO: 6390 - protein, 251 aa, Acinetobacter baumannii
LMTLVQIPKLTTTLEDFLKNLESIEPLFDALSSVVFFIKNTEARYVFVNQTLVNRCGLKDKTAILGKTSSEVFPHSLGKIYTSQDLQVIRRGKKLTEQLELHLYAKNQSGWCLTYKEPLFDADGKLVGIAGISNDLNVPENTHPAFYKMVQVEEYIKKNYAETITLAHLTAIAGVSVAQLERYCKKIYHLTPRQMISKIRLQVATELLATDLPITQIGLRCGYTDHSAFCRQFKLHTGMSPTLYRASIKNI

SEQ ID NO: 6391 - protein, 317 aa, Acinetobacter baumannii
TEDPMNFKPLAYILLATSSLTACTMAPVKEQKIEPFVFKEPELTPPFYALNPFNYDAPPAFEVALKEAAAQPVTKMVVTRQDDPTKTLTLDTDKLIVRTVNNSQRSMKYAVLAGDNEIDVTEIDDFLQLVEGKARHYPPRFTDRQERKGFESKLKEVTQRLDTLAANPDASFDILIRAFKASVLARNLDLGTAHTTKSLEYAQRLLKINPDDAEANFWFGFGLSEGGGQREAIPYLDKAIKGNVQEAYLAAANNYIAMEQKKNAIQTLKNYKVKYPDEAEVADRLIQEIEKQGRWNVWQVLTNPAMSSATPSAATKK

SEQ ID NO: 6392 - protein, 66 aa, Acinetobacter baumannii
AISPCVMAVPSRPTASIPVKRTIVEWAKATINNADIKAINCIAINRRRFTRSPNGTKNTRASAQPI

SEQ ID NO: 6393 - protein, 456 aa, Acinetobacter baumannii
RDMFKAEKVLWGEGLFLRPQHFQIQDTYHEQRLNHTVRAVVPFSYGVQKLSFDEAQLSTHILALESVEMIWQDGEIYQAPAYDLLPEPILLDELNLRGEMVIYLALPVLQANKQNLIDQNQSQKGRYQSHLVETHDLFTNATEADISLLRRRAVFKLLDAHSNPDHNLDGFLYLPIGKIKRQSSGAFEIDRKFIPPILHVDASETLVSNLKRTLNVIKAKIKTIQTNNRENEQKLIEFRSGDIVSFWLVNALNTAHAGLSHFLQYPQIHPERLFFELLRLAGSLLTFSTAYEVDQLPAYKHHNLQESFTQLDTILRDLLDTIISSRYISIALKEIRPSYWVGSLETDKITRDTRLYIAVSSSAMQTHELIQIVPLRFKIGSTLDVEQRVVAALPAIPLHHLIQVPTAIPVRSGVSYFEIEPHHELYQRMLDSETICIYVPAGFQDISIELIAVMNA

SEQ ID NO: 6394 - protein, 523 aa, Acinetobacter baumannii
KQMLDQNIKTQLKAYLERLESPIELVAALDESDKAAQIKELVTEIAELSDKVTARFDGNNTRRPSFGVAKAGEQPRVFFAGLPMGHEFTSLILALLQVSGYAPKVSDEVLNQIKGLNLKANFDVFVSLSCHNCPDVVQALNLIAIYNPNTTATMIDGAFFQDEVEQRKIMAVPMVFQDNEHIGQGRMTLEEIVAKLDTNSAEKDAAALNAKDAFDVLVIGGGPAGATAAIYAARKGINTGIVAERFGGQVMDTMDIENFTSVQKTQGPKFAAEMEAHVREYDVDIMNLQRVSKITGADQTANGLVEVELENGAKLESKTVILSTGARWREMNVPGEAEYRTRGVAYCPHCDGPLFKGKRVAVIGGGNSGVEAAIDLAGIVEHVTLVEFDTKLRADQVLQNKLNSLPNTTVIMNALSTEVLGDGSQVTGLKYKDRATDEEHVVELAGIFVQIGLLPNTDFLKDSEVELTNRGEIIVNDRNETNVKGVFAAGDCTTVPYKQIIIATGEGAKASLSAFDYIIRSGQ

SEQ ID NO: 6395 - protein, 523 aa, Acinetobacter baumannii
KQMLDQNIKTQLKAYLERLESPIELVAALDESDKAAQIKELVTEIAELSDKVTARFDGNNTRRPSFGVAKAGEQPRVFFAGLPMGHEFTSLILALLQVSGYAPKVSDEVLNQIKGLNLKANFDVFVSLSCHNCPDVVQALNLIAIYNSNTTATMIDGAFFQDEVEQRKIMAVPMVFQDNEHIGQGRMTLEEIVAKLDTNSAEKDAAALNAKDAFDVLVIGGGPAGATAAIYAARKGINTGIVAERFGGQVMDTMDIENFTSVQKTQGPKFAAEMEAHVREYDVDIMNLQRVSKITGADQTANGLVEVELENGAKLESKTVILSTGARWREMNVPGEAEYRTRGVAYCPHCDGPLFKGKRVAVIGGGNSGVEAAIDLAGIVEHVTLVEFDTKLRADQVLQNKLNSLPNTTVIMNALSTEVLGDGSQVTGLKYKDRATDEEHVVELAGIFVQIGLLPNTDFLKDSEVELTNRGEIIVNDRNETNVKGVFAAGDCTTVPYKQIIIATGEGAKASLSAFDYIIRSGQ

SEQ ID NO: 6396 - protein, 461 aa, Acinetobacter baumannii
DHVFISVFDLFKIGIGPSSSHTVGPMRAAYSFVEDLLKQNDLQATVRVQVKLYGSLSATGVGHATDKAVLLGLMGFDPEHIDTQVSTSLIEDVLENKAIQLNQQKTISFDYKHDVLFLDESLPYHPNAMELIAYNGAQEILYAETYYSVGGGFIVSQRQLATTQTETNDVKVPYPFHSAAELLSLCRTHHLSVSELMLENEKSWRSEAEIRSKIMEIWKVMQQCIHNGLINEGILPGGLNVKRRAKKIHDKLLNKKNLNLIVTTFHAMEWVNLFALAVNEENAAGGRVVTAPTNGAAGIIPAVLYYYVTFSKDFSEDKVVRFFLSAAAVGILCKLNASISGAEVGCQGEVGSACAMASAGLAEILGASPEQVEHAAEIGLEHNLGLTCDPIGGLVQVPCIERNAIAAVKAINAAQMALHDDDEHFVTLDKVIQTMKETGKDMSEKYKETSKGGLAVNAIEC

SEQ ID NO: 6397 - protein, 245 aa, Acinetobacter baumannii
IVYPIRNISSMTSNFSQLSTDALSPGQLPESVKALLKRAHINRYPKRTTIVDAGTESKSLYLILKGSVSIILREDDEREIVVAYLNPGDFFGEMGLFEPNPQRTAEVRTRDVCEIAEISYDNFHELSKQYPDLSYAVFAQLVRRLKNTTRKMTDLAFIDVSGRIARCLIDLSSQPEAMILPNGRQIRITRQEIGRIVGCSREMVGRVLKTLEDQGMIQTDGKAILIFDTSLEETPVTDEDYDDEE

SEQ ID NO: 6398 - protein, 315 aa, Acinetobacter baumannii
STYPIKKIFSVMNSPVYLNALRAFEASARHKSFSAAATELNVTPAAVGQLVRTLEDWLGFPLFHRQTNGKNRLIATELAESVLPDIRAGFDKLTLALEKLKQDSLSGVLNIAVSPAFAEKWLLPRIDHFQKQYPDIDIRLDINLKTVDFLEQKVDVGVRYGQGQWQGLEAVKLMDEEVYPVCSPAFLNEHSSLLTPSDLKNITLIHDLSMEKHQQFPGWQSWLKSVGLNDINISRGMQINSSSAVLQAAMEGHGVALARSVMVQKDIQTGRLIRLFPQINFSSPFSYYLVYRSQYANLPKVKICLDWFFEEIHRI

SEQ ID NO: 6399 - protein, 291 aa, Acinetobacter baumannii
ADYPSTSSSFVSRRASMNIAVDTLKASTRGAHWFKALTQGFKTVEGFPASIWVADGQIDQQVVRVITVVQDTNNLFPRAKQGEVGLLEGWSLAKVVDDVIQADAQAETKRAILCLVDVPSQAYGRREELLGIHQALAGAVDSYARARLAGHPIVSLLVGKSMSGAFLAHGYQANRIIALKDSGVMVHAMGKESAARVTLRSVDELEQLASSIPPMAYDIESYATLGLLSELLSVENPEQPTNDDLLLAKQAIAQAFKEINAEQSRGLEQRLHGQNRQMSKKVRELLREQWS

SEQ ID NO: 6400 - protein, 331 aa, Acinetobacter baumannii
NLYPETKRQDMSMSAKIQQIIDSVVKNETLSGTSLISTIFGDSVLHRGGNISLASLIQLLELFGFNDRAVRTSVFRLVKNDWLCSDKIGRTSFYRITDSSRSTYLQAEQRIYNDQMKEWDHYWDLILMSSLDTENKALLKKELEWLGFANISTNLMAYPGCNRIELQRLLVDLNMSEQVVVFKAETLQLFNNSVDTIGRMLRTNWPIDELRQRYLQFLDIFREIGVLLMQENEQLEPVQAFQIRTLLIHYYRRILLKDPALPLELLPTDWPAISARTLSMNIYKKVFEPADEYFLSVAATAEGPMPNATAHYWRRFGGLVATNERLNHALL

SEQ ID NO: 6401 - protein, 229 aa, Acinetobacter baumannii
RHLPFDLNVELTTDYIGFRMAKTPQTREELKKHLRENLAFLNVSNKSFDEGLHAEAKRLATTIRVLVHDTLKSKSLLEQLGVKNDLKFLNTSYEYSPTNLMPHTGLVMMRMTSNGTSYLAPLHDGPPDRYTQPGLEFSQWWDQLVIDDKSGGVFTRKNLILFMANQDGGAHVDPSLDSSYAALKRDNSVGWVYSDGISEHPITDIELHSVRQIAYELIETLKPLDINSL

SEQ ID NO: 6402 - protein, 98 aa, Acinetobacter baumannii
VRLPIYSFLVKFDLFHLKNNVELLIETYLKLNVFNVFILLKSTNIKYCKLHQPPLRTVDRYKLKVIEGNFYNITRGYCAAFTPTINWLQLEPSEALPN

SEQ ID NO: 6403 - protein, 74 aa, Acinetobacter baumannii
NFSFISVLNASLKRSIFYPIFILIRIILHPFSIVILKKFISLFIKIRCIHFNSWRNIFFYPIQPCACFGINKMA

SEQ ID NO: 6404 - protein, 319 aa, Acinetobacter baumannii
ISIPLDIYNMTKPEAQYQSGQFQFSFLSLKYWGIWFTAFILMFLAYLPWAIQWRLAKLFSKIAWTLLGSRRKTTLRNLGACFPEKTPEQIEAKAKSVFTDTMIGIFEALNAWYCPAWFKKRVHIEGLEHLNDNRDRGILLLGTHSTLLDAGGAACTLFFDMDVVYRPQNNPFMDFLIHRSRARVYKNQIAKDNMRSLIEKLKNGHAIWYSPDQDFGLKQGVMASFFGIQAATVTAHRRLMDISNAVAIPLYFYRSGDIRDPQYNVLVEPKLENFPSECEVNDAERVNKIIENQIRIAPTQYMWFHRRFKTRPAGEAKFY

SEQ ID NO: 6405 - protein, 482 aa, Acinetobacter baumannii
KVAFAALGRVDLKNMRERLSCERKANFKGSILDRYITKRMSRLLRLLKGLKENFMMKILNTTVQKSLLAVSVTLLMSSAFAGQVNPEIEQLRQEIKELRAMLQTNMEAQKSLAQKRVEQAATVVTQAPQPIKQTLTKSGAEFNLYGYIRADASYQIKGASTMYNNISGVPLENTPEESAQKDQLHSTVYVTRFGLNFKTPTAVGDVGGKLEMDFFGAATRDQFRIRHAYLTFDKWLIGQTWSTFIAPEYYPETIDAGTFVGSALLRSPLVRYSDNLTANTSFAVSVEDPKYTAVTDPDNKMRLPALVGRLNHKFANGLMLSGRSFVAEKRTNNDSEWAWGVGLGGKYQITPDTLLKADYYHVKGDGRFLLWSNSGYAIDDQNNMHSNEFDTVSLGITHQFTPQIRSTLGYGYMKAKDDNRFAELQRTSTTQNKQLWQGWVNALYNPYKPITLGIEYVYGERETFDNRNGIDNRFNMIASYDF

SEQ ID NO: 6406 - protein, 529 aa, Acinetobacter baumannii
AKSPNPIFPFNFKYRSIIRMIDMTYDIKSMAVIGVGVMGSGIAQIAAQSGHTTYLYDAKAGAAEQAKEKLAATFQKLVDKNKITSEQAAAANNHLIVAHQIEDLKNCDLIVEAIVERLDIKQSLMQQLEDIVSDNTILASNTSSLSITAIAANCKKPERVVGYHFFNPVPLMKVVEVIRGLKTDPLIIDALNDLSRAFGHRPVVAKDTPGFIINHAGRAYGTEALKILNENVCDISEIDRILRDGVGFRMGPFELLDLTGLDVSHPVMESIYHQYYEEARYKPNPLTKQMLDAKQLGRKVNQGFYNYETGSKTGEQPAKFVERLAKYPKVWIAADFLDDKKQLEDYLTQQNITLDTNSEPQTDSLCLLACYGEDTTQAATRLGVNPEQAVAIDMLYGIAKHRTLMPSLITKPEYRQAAHSIFNLDGNLVSMINESIGFVAQRVLAMVINLGCDIAQQNIATVDDINAAVRLGLGYPFGPIEWGDQVGSEKILLILNRITALTHDPRYRPSPWLQRRVALHLPLTFTHES

SEQ ID NO: 6407 - protein, 137 aa, Acinetobacter baumannii
RRKPMSKQMDQAIQSVIDLHVLIENVFTGQNAEQSLTPLLNSFDQNFKMVTVQGQSIGLAEVKNLFSQNIGKKPSLKITILKSIALYEFENYCWVQYQEYQQTSETETVRTSTACIKVEGEKCYWVYLHETLVPSSS

SEQ ID NO: 6408 - protein, 129 aa, Acinetobacter baumannii
RLRPRPRPPERPRSSSSSSSSRRLRPRLRPPERPRSSSSSSSSRRLRPRPRPPERPRSSSSSSSSRRLRPRPRPPERPRSSSSSSSSRLRPRPRPPERPRSSPSSSSSRLRPRPRPPERPRSSSSSSSS

SEQ ID NO: 6409 - protein, 201 aa, Acinetobacter baumannii
SFLPMVSFLFIGLVVTILLTPGPTNTLLASAGIQAGVKHSLKLIPAEVIGYLIAITSWGVLLESVSHFIPWLPAILKLMSAGFILYLAFKLWMTSSEDINLDQPLITPKALFLATLLNPKALLFASAIFPHAAWEVPHLYFIHIVVFLSLITPIAFLWIMFGTVLISNKVTWLNQRNLQRIAAFILTFFAMPIGYSAISSF

SEQ ID NO: 6410 - protein, 498 aa, Acinetobacter baumannii
VRRPIMNNTQSAAMPLVENEEVNLLDSIVEQSRIARNEEEHSRAKSLIGELAKEVMAGTITVSENMTLSIDKRIAEIDALISKQLSQIMHNEQFQKIESTWRGLYYFCQETPSNPLIKIRMLNTTKKELVKDFQGATDFDQSTLFKKIYEEEYGSFGGAPYSALIGDFEFDRTPSDMYLLEQISHVAAAAHAPFISAASPSILGLESFTDIDRPRDVSKIFETAEYVQWRSFRDSEDSRYVALTLPHVLGRLPYHPKEGTATEGFNFIEDVSGENHNEYLWMNAAYAFGTRLTNAFDMHGWCAAIRGVEGGGLVEGLPVHTFKTQDGEVVFKCPTEIAITDRREKELSDLGFIPLVHCKNTDYAAFFGAQSTQKPKKYDNDTANANSALSSQIQYIMAVSRIAHYLKAMMRDKVGSFASAGNVEAFLNEWLSQYVLLDDGASQEAKAQYPLREASVKVVEDPAQPGHYKSVVFLRPHFQLDELSVSLRLVTELPQSSN

SEQ ID NO: 6411 - protein, 398 aa, Acinetobacter baumannii
AIGPKVMKQSGAFLARPMLILTVALVGLNLRPFMTSIGPLVSKIRAGTGLSLQGIALLTLLPMMLMGLIAFIGPIVQSIVGERRVVLGALLTICIGCALRFLFPTAEGVIASAIIIGLGVALIQAAFPGIIKREFSQHIGPMMGLYSAMLMGGGALGAWLAPVISNITGLWSLGLAFFTIPAVLALVSTFIFLPSIVSSTAHLSPVKTLLKKPRTWLLMLCFGLVNGGYSSVVAWLAPSFQDHGWSISQSGKLLALLALSQAASALSLPILARKYKDRRPWLWFTLFMQFAGFAGLAFIPEFASVLWAICLGIGLGGCFALTLIVALDHFEEPNNAGALSALMQGGGFLLAAIPPWFVAALHDFTGTYKAGWIFHLCSVILVIVLVVRLAPRSYNKIH

SEQ ID NO: 6412 - protein, 426 aa, Acinetobacter baumannii
GHQLTRIIQFNGLDKMNNFAVSRGDFNEWMVPVFAPANFIPVRGEGSRIWDQENKEYIDFAGGIAVNALGHAHPVAVNALTEQAKKLWHVGNGYTNEPVLRLAKQLTENTFADKVFFCNSGAEANEAALKLARKVGLDSGVAGKSGIVAFNNAFHGRTLFTVSAGGQPKYSQDFAPLPNGINHVAFNDLEAAKAVINEQTCAVIVEPVQGEGGVIPADIEFLKGLRELCDQFGALLIFDEVQTGVGRTGALYAYMNYGVIPDVLTTAKALGGGFPVGAMLTTDKFAPHFSVGTHGTTYGGNPLASAVAGAVFEFINTPEVLEGVKERHDYYKNALNQLNEKYEVFKAIRGSGLLLGCVLKDEFAGKAKDINNLAGEEGLLSLIAGPNVVRFTPSLIIPFADIDEGLKRFERALARFVEIQKDEQAA

SEQ ID NO: 6413 - protein, 315 aa, Acinetobacter baumannii
AVFTLVTKTVFSLVWSAVVVKKMNTVVANLNIEVIKPTIGAIIHDIDLNALNEQTTQQIQQALLDHQVIFFRKQQLAPQAQADLARSFGTLHVHPIYPSIEDVPEVMVLDSWKQDLRDNELWHTDVTFSKTPPLGCVLQAIKIPPVGGDTLWSSNIAAFKGLPLELQRKLRGLTATHDIRKSFPLERFAHNEEEREKLLQTFKRNPPVVHPVVRTHPVTGEPLLFVSEGFTTHINELPEQESEQLLNFLFEHATQEQFHLRWKWQDGDVAIWDNRCTQHKALFDYGDAHRIMHRATINGDVPFYKEEQQPELAET

SEQ ID NO: 6414 - protein, 255 aa, Acinetobacter baumannii
AILTQTGNLKMNISRKTALVTGASRGIGRAIAERLAQDGFYVIINYAGNKAHAQATVEHIIEQGGQASAIQADVANEHEVSRLFQEAKAINGQLDVVVHSAGIMPMAKITPESLPDFDKVIHTNLRGAFLILAHAAETVPDGGRIIALSTSVIAKSFPAYGPYIASKAGVEGLVHVLANELRGRNITVNAVAPGPTGTDLFYNGKTEEQVAAIAKLAPLERIGTPDEIAGVIAMLAGPDGRWVNSQVIRVNGGFA

SEQ ID NO: 6415 - protein, 294 aa, Acinetobacter baumannii
GGVTYMNTKDNVYEYDKAELKPELNVQTENASFLSLFFEKHRTLAVSIISVGSVVALWFLITALHVVPELFLPSPQAVWQKFISVSQEGFMKATLWQHLAASISRVFLALIAAVVIGVPLGLWMGLNKWVRAVLDPLVELLRPIPPLAYLPLLVIWFGIGETTKVLLIFFSILAPVIISSAHGVLSHQLNRERAALSLGASQSQVFWHVILPTALPHIITGIRIGLGVGWSTLVAAELVAADRGIGFMVQSAAQFLITDTVILGIIVIAIVAVSFELFLRWLQKQFSPWYGQQL

SEQ ID NO: 6416 - protein, 426 aa, Acinetobacter baumannii
PMVTASCRTSFTTYFYSRVLKRNFSMLNAYIYDGLRSPFGRHAGELTSIRPDDLAATVIQKLLEKTGVPGADIEDVILGDTNQAGEDSRNVARNALLLAGLPVTVPGQTVNRLCASGLGAVIDSARAITCGEGELYIAGGVESMSRAPFVMGKAESAYSRDAKIYDTTIGSRFPNKKIIAQYGGHSMPETGDNVAAEFGISREQADLFAAQSQAKYQKAKEEGFFANEITPIEVFQGKKLPPKLVSEDEHPRPSSTVEALTKLKPLFEGGVVTAGNASGINDGAAALLIGSEAAGQKYGLKPMAKILSAAAAGIEPRIMGAGPIEAIKKAVARAGLTLDDMDIIEINEAFASQVLSCLKGLNVDFNDPRVNPNGGAIAVGHPLGASGARLALTVARELIRRKKKYAVVSLCIGVGQGLAMVIENVS

SEQ ID NO: 6417 - protein, 273 aa, Acinetobacter baumannii
RCSTTSSGDIVMADFKAKEILLNAFDMNCVGHINHGLWTHPRDESHRFNELSYWTEQAKTLENGLFDGLFIADITGVYDVYQNGIDLTLKESIQLPSHDPSTLISAMAAVTQNLSFGVTVNLSYEHPYQFARRFASLDHLTQGRIGWNIVTGYLDSAERLIGQKGLKDHDARYEQAEEFLELCYKYWEGSWENDAVKKDKARRVFTDPSKVHTIHHHGKYYQSEGVFFRYLLLCNALQPYFKQVLHLKVCSLQHVMLNVYLLAVTNPKKFANK

SEQ ID NO: 6418 - protein, 255 aa, Acinetobacter baumannii
FLEFTSMAGHSKWANIKHRKAKQDASRGKVFTKYIREIVTAAKLGGADPASNPRLRAVVEKALSVNMTRDTINRAIQRGVGGEDNDDLKEVTYEGYGVGGVAVLVETMTDNLNRTVPDVRHCFSKTNGNLGTAGSVAYLFTKRGEITFDDVSLEDKIMDVALEAGAEDIEVSEDEILVITSPETFGEVQDALAAAGLKSDNAEVVMSPSTKAEITDIDQAKQVMKLIDMLEDLDDVQNVYTNVEFSDEVLAQLDA

SEQ ID NO: 6419 - protein, 195 aa, Acinetobacter baumannii
MPNTIFLQRVADLYDTFKQHDSQQSDRLQRYRNIEVESAQLISQLIRMQQAKSILEIGTSTGYSTLWLAEAAQATGGQVITVEIDAKRSAEAKRHVAELELSEIVQFWVGDAADYLKAAQEKFDFILLDAERDAYENYWPDLKRLMKPKGGVLVVDNVISHAAEVNRFIALIKKDPDYMSSILPVGAGLCLVVTK

SEQ ID NO: 6420 - protein, 573 aa, Acinetobacter baumannii
MMNTEKLLIANRGEIAVRIIHACRDMGISSVALYADDDTGSMHVELADEAWGLAGATASETYLNIPAIIEVAKKSKATMVHPGYGFLSERAEFAQAVIDAGLKWVGPSPGAIEKLGDKIEARKIAASVGAPLVQGTQDPLNNADEALAFAKQYGLPIAIKAAFGGGGRGLKVAWKLEEVKELYESAVREAKAAFGRGECFVEQYLDKPRHVEAQVIADQHGNIVVLGTRDCSLQRRNQKLVEEAPAPFISDEIYQQILSSAKNICQAANYVGAGTVEYLLSRDGKLSFLEVNTRLQVEHPVTEETSKVDLVVEQIRVAQGHELSIKETPKAQGHTIEFRINAEDPARGFIPAFGVLSLFEAPFGHGVRVDTGVRTGSLVSSHFDSLMAKLIVTGPTREVAIARAKRALKQFKIEGVASVLDFHRAVLNEPDFTDKFNVHTRWIENDFKQELMPTKRGIPNHQQPMLLSYIEIDGKLHRLGLPAGMFAQGPATAVQAQTAEPEVSAAHLLAPINGVISAWKVENGEQVTEGQVVAIMEAMKMEVQVLAHRSGVIQIGAEKGATCHAETAIASIH

SEQ ID NO: 6421 - protein, 248 aa, Acinetobacter baumannii
GKSTMKIKIINPNTTQSMTDKIAASAKIVANSDTQIIAVSPQMGPATIESYYDEALSAVGVLKEIRQGEFLDVDAYVIACFGDPALYAAREMTSAPVIGIAEAAMRTASYVSTGFSVVTTLQRTVNMSWHLAHRYGATPFCKNIRACDIAVEELELPDSDAYRTIRDECKKALAEDKSDAIVLGCAGMSDLCLKLQNELGVIVIDGVAAAVKQTEMLVQLNLKTSKVGDWASPPVKNYTGILSGFGVR

SEQ ID NO: 6422 - protein, 583 aa, Acinetobacter baumannii
MNYTNNKRILTHSTLVLAMLGALAGCGSDNDDTTAPSTNKPPQLSPAVGVKMTGSCSDLLGFQYNNTVISSATLQEAGTLTVANKPIGAHCLVKGYMDQRVSPVDGQTYQIGFEMRLPVDWNGRFLYQGNGGTDGNLVPATGQVGSGGPLTNALHDGFAVISSDAGHNASQNPMFGLDPQARINYGYGAITKLTPMAKNLIKAAYGKLPDRSYAGGTSNGGRHAMIAATRLGDQYDGILASTPGFHLPRAAAAQLYTAQQLRRVATDENDLSTALTLSERKVLAKAILDRCDALDGVADGLVQDVESCRTAFDIHKHVPVCSNTRDGTCLSTEQIDVLANIYRGPVNSAGQALYATQPFDPGLIGSNWASWKFESSVGTARDPVAVGILFQVPPDPTVTQNSRQFAFNFNFDTDYPKLSATNDVYTESSMSFMMPPDELNLDKLRNHGGKMIVVQGTADGVFSVDDTQNWYDQLLQHYKNDAKGTAPEFARFFRVPGMNHTRDGIATDQFDALTALVNWVEYGQAPDKIIATARGAGNPSGQVNTELPQDWAPDRTRPLCPYPLIARYNGQGDSEKAENFSCK

SEQ ID NO: 6423 - protein, 150 aa, Acinetobacter baumannii
EKDTSTNTVFYPHIDFALFTASLNDERQENFMEKTLQCPKCGSTEIETRDHDKLLKTTGGVLLTAAGTTAGTVGGAATGATVGAAIGTVAGPLGVIVGGTVGTFVGAISAGITGGVVGNIFGKKAGVMIDKNIFQDYRCLKCKYRFKQKK

SEQ ID NO: 6424 - protein, 411 aa, Acinetobacter baumannii
LMSTSRVKLTKSFIDQLELTPAIYRDSEIIGFAIRVNNSYKTYIVEKKVKGKSIRCKLGDYEKITLEDARILAQQKLKELTDSNPLSIKNNKILKNSLNEKIDQPYLKEAFQVYINHHELKERTLADYREVIEKYLIDLSELKLIDITEQRIEEKYIQLSQYSYAKANLSMRVLRAVYRFSIKYYQNKNCEVIIPRINPVNLLKKKQLWEEIPPRRNYIDVDNLTKWVQAIIEYKGRGQENETNKDFLLTLILTGLFRNECESLHWKNIDLEEGTLSFLNPYNNVYYKIYMGNFLWHLMKKRRIQNKGEWVFPSVKSESGHIINISKFRKKINEQCNLSFTFQDLRRTFYFVLNHLTNKPLVSKRTEGYEEKLDVKNIAHAQDMRNRMNKVEQIILGPYRDELIKSININL

SEQ ID NO: 6425 - protein, 183 aa, Acinetobacter baumannii
FKGTLMALLILAHPYYAQSIANKTIVNELVKTYPDLEVRDIFQLYPDYKIDVSAEQEALLHHDTIILQYPMFWFNMPAILKLWFDEVFTYQFAYGSQGDKLKDKKVIISMTVGQKEANMVNDQENLIDSFLKAVQHSIQYTQMQLSGTFLLYDVSPLSGNPESKIKLEAVEHGHKVLKHLTEA

SEQ ID NO: 6426 - protein, 585 aa, Acinetobacter baumannii
RYRLIDRNSIKRFYRFRTKLRSIGKYMEGSVQNKERLWTKRRHAKQLKLEMANQYTDGVVIPTQDIIKVLETLITPGDKVVLEGNNQKQADFLSRSLAQTNPDVLHDLHMIMPSVGRSEHLDLFEKGIARKLDFSFAGPQSLRISQLIEDGLLEIGAIHTYIELYSRLIVDLIPNVVLSAGFMADRQGNIYTGPSTEDSPALIEPAAFSDGIVIVQVNELVDDVSELPRVDIPASWVDYVVVADQPFYIEPLFTRDPKHIKPVHVLMAMMAIRGIYEKHNVQSLNHGIGFNTAAIELILPTYGESLGLKGKICRNWTLNPHPTLIPAIETGWVESVHCFGTELGMEKYVAARSDVFFTGRDGALRSNRMMCQLAGQYAVDLFIGATLQVDGMGHSSTVTKGRLAGFGGAPNMGHDPRGRRHDTPAWLDMRLQGANETETYLARGKKLVVQMVETFQEGGKPTFVDRLDAIDVAKTAGLPLAPIMIYGDDVTHLLTEEGIAYLYKASSQEERQAMIVAVAGVTSIGLTQDPKTTARLRHEGLVVFPEDLGIRRTDATRELLAAKNIADLVTWSDGLYQPPAKFRSW

SEQ ID NO: 6427 - protein, 296 aa, Acinetobacter baumannii
KNRLKMKEGQSSRTAEAAAALRANHFKNTTNPVFSDPYAFEMTSKGWKKLLSTPLIVKLMNSPILNRTLGLLSGQVVGRSRYAEDLLNQAVQHNIEQYILVGAGLDSFVLRKSQHYPTLKIFEVDHPDTQAAKQSKLKKLGELPSTVEFVSINFEKESISEALARSRYVRKTPAFFSWLGTTHYLKPDTTLQTLKSIAEFAANGSEVVLDYSTDFQELNGIERLGSMGVAQFTHLLKEPLLGQFKPSDLHQAVEKMGFEVVEDLSGEAITERYFYNRADNIRHTSATRLLHLRLKK

SEQ ID NO: 6428 - protein, 314 aa, Acinetobacter baumannii
RNITMSEMDTINKMRELRDAFGSFMTGVTVVTTCKEDGTPLGFTANSFASVSLDPALLLVSIAKTSSNYHNFANTTHFAINILAEEQKDVSNTFARPSEDRFANLSWSKSACQNPLIDHVSAWFDCTTYQVVDAGDHAILIGKVEDFASTGFAGLGYYRGGYFTPAKLSAEVISGPKVVMSAIIGHENTILLEETADHKWTIPHVMVDKDGADKALEKIFAQYQPDASANFIYSVYENVENQQQYISFLCNTPVAQATKGQFVDLNDLEKLEFVDSALESMLMRYRKENHLKTYGVYYGNQTTGTVRQIVKEEV

SEQ ID NO: 6429 - protein, 151 aa, Acinetobacter baumannii
FDITNNNNFRMNMMNNKQGCVLGILSCIAVLPTNLWAAQPMNESALATQTGAVTAALPVIIAKAQDDAKKPEIEQRQVRQTLGDNYLQQVRWNSLRTSVLSPYQEQKQNQVIDGKEKKKLEMVALPERADRFTRYDFESKNVHGEVIITVK

SEQ ID NO: 6430 - protein, 415 aa, Acinetobacter baumannii
EDITMANTRYEDDNNSSGTSNRGFASMDPERVREIASKGGRAAHASGNAHEFTSEEAREAGRAAHASGNAHEFTSEEAREAGALSHKNDDRNGRGRSRYDDDEDDDGGRSSGRGRGRSRYDDDDEDDDRGRSGGRGRGRNRDDDDEGDDRGRSGGRGRGRSRDDDDEDDDRGRSGGRGRGRSRRDDDDEDDDRGRSGGRGRGRSRRDDDDEDDDRGRSGGRSRGRSRRDDDDEDDDRGRSGGRGRGRSRYDDDDEDDDRGRSGGRGRGRSRYDDDDEDDDRGRSGGRGRGRSRRDDDDEDDDRGRSGGRGRGRSRYDDDDEDDDRGRSGGRGRGRSRRDDDDEDDDRGRSGGRGRGRSRYDDDDEDDDRGRSGGRGRGRSRRDDDDDDDDRRGRSDGRGQNSRNQKRDAYGRFTS

SEQ ID NO: 6431 - protein, 137 aa, Acinetobacter baumannii
KKITIFVFLIIAFQKENIKMNSSQEPNQSLFNQASTSIQACFECMFACKHCASACLQEEHVHMMRECIKHCLTCVETCQLCTSLELRHSELAEQAMQLCANACQLCAAECSKHEHEHCQVCAKACLACAQACQAYRA

SEQ ID NO: 6432 - protein, 327 aa, Acinetobacter baumannii
TGATIRNLGKDIYVMRKNLDGGLLHAMHAFLKVIDSGSFTAAAEQMDLTTAQVSRLISELETRLGTKLIQRSTRQQALTDIGATYAERCRQVISMVDEAEAEVTGTASKPKGRLRVLSMGSFGHHYVFPVMAEFCKHYPELTVEYTTSQYVPDLLAKGVDVSLYLTESLTDSRFVARRIGTIFSVLCASSAYLEKHGVPKSPEDLKNHACLRLVNPSITPDWHLLNANGESCQIDIGGQLIADNPELLLDVVQQDMGVALLPMFSALDAVQNGRLCHILPEWRSPDIGVYTLLPSRHFIDAKTRAWLDWVEEYISPRIEMDASYFYK

SEQ ID NO: 6433 - protein, 244 aa, Acinetobacter baumannii
NLATTKLEMCQAQSLRLCCAFFSPKKGTGFFISTYNKNFYNGKTMPNLVLPTRTLYVVNKAIDLFHHRGFHLIGVDRIVKESEITKATFYNYFHSKERLIEICLMVQKEKLQEQVVAMVEYDLSTPAIDKLKKLYYLHTDLEGPYYLLFKAIFEIKNSYSKAYQTAMRYRTWLKNEIYSQLRVLNADASFNDAKLFVYMVEGTIIQLLSSDGAIEREKMLDYFLNSFVRNFSPCMFTHVDASKC

SEQ ID NO: 6434 - protein, 115 aa, Acinetobacter baumannii
FKGFMEYIKLSYHHLNFEDRTALMLESRKEGFSARKFAELIKRHPSTIYRELKRNSINDVYQAQYASDNTFARRRRGHRKLKIDSILWKFIVEAIRCLWSPQQLAIFITRRRHPR

SEQ ID NO: 6435 - protein, 113 aa, Acinetobacter baumannii
FKGFMEYIKLSYHHLNFEDRTALMLESRKEGFSARKFAELIKRHPSTIYRELKRNSINDVYQAQYASDNTFARRRRGHRKLKIDSILWKFIVEAIRCLWSPQQIAKRLKTLPD

SEQ ID NO: 6436 - protein, 198 aa, Acinetobacter baumannii
IIKTRGSVTHRTSFYFGKFIMKKVVTLLCGICLIGLTHAATQYNPPPIQLEPLAKFSVDLNAPVWELGTTSDAGKRRIIPITGGTFEGKSLKGRILNNGADWQIVDSKGLAIIDTRYLLETDDGALIYLQTKGYRHGSAETLKQLAQGKDVDPKNYYFKITMQFETSSPKYSWLNQTVAVGSAMRLGKAVIYDAYTLK

SEQ ID NO: 6437 - protein, 604 aa, Acinetobacter baumannii
KEKTMPLYKAPLRDMQFVLHEMLQTEQNYQGLSKYQESVNRELIDQYLEAAVDFCENELAPINQNGDQEGCHLNQGVVTTPKGFKEAYQKYAELGFTSLTADPEYGGQGLPTLLRIAISEMLCGSNWAWAMYPGLSHGAMRTIEHHGTEQQKQKFLTKLISGVWTGTMCLTESHAGSDLGLIRTKAEPNSDGSYSITGEKIFISAGEHDLSENIIHIVLARLPQAPAGTKGISLFIVPKFNVSDDGQVLDRNKVVCSAIEHKMGIHGNATCVLNFDGAKGYLIGPENRGLNCMFTFMNTARIGTAVQGLAASEISFQGALSYAKERLAMRSLSGPQYPQKNADPIIVHPAVRSMLMIQKAFSEGGRALAYFLAQHVDIVESSNDQEQQKHSDELLAFLTPIAKAFLTESGNESAKHGVQVFGGHGFIVEHGMEQIVRDARISTLYEGTTEIQSLDLLARKVLKSEGKLLKNMTDLIDQFISQHQSNEVLKPYLEKLAELKQQWLSLTKLIAEKAKHNPEEIGAASVDYLYFSSYVVFAYLWARMAQVAHEKLESGTQEEDFYKAKLTTAKFFYQKLLHRTQSHAASIESGAESVMELDQDAFAF

SEQ ID NO: 6438 - protein, 82 aa, Acinetobacter baumannii
PPLTKPKHSINNHVLGFFNNVFTGDRWAVELTMEGKKINVDTNANTAGIVKKASPSDHRPVILEITGANHAPSAPPPISIAE

SEQ ID NO: 6439 - protein, 465 aa, Acinetobacter baumannii
YFMTKKISFNAFEMNCIAHQSPGLWRHPQDRSVEYKDLEYWTDLAQILERGFFDGIFIADVLGIYDVYHQSAEHALTGAVQVPVNDPLQIMPAMAAVTKHLGFGVTTSISFEHPYPFARRISTLDHLTKGRVGWNIVTSYLESGSKNLGLKTQVNHDNRYDIADEYLEVLYKLWEGSWEEGSVLRDRESGIFADHKKVHPIQHEGKYFTVPGIHICEPSPQRTPVLYQAGASSRGQKFASQNAECVFIAAPSKIATKKVVQGIRQKLAQEGRDPYSVKIYALLSIVTDETDAKAQAKFKEYQSYGSYDGALTLLSGWSGVDFSQYQPTDKVEYIQTNAIQSLLDSYVNADPERVWTIEEIANWNSLGGNGPVLVGSAETVSDALEQWVEDTDVDGFNLAYILAHQTFADVVEFIVPELQKRGVYQTSYTQGTLREKLFGAGPYLPENHRGAKYRNLKELKLAEAS

SEQ ID NO: 6440 - protein, 253 aa, Acinetobacter baumannii
NYPTGVAMNTASYHNNQAIWTELLPGGHHWSGRIQKGTILKFTSLGAQANVSLFCVNAADVLERFNMPDSLKGQHTAYLKASNVLYSDLGRVMASIVRDDHGWNDALCGPSRPEQIERQFGIRTFQDARNDMYQNGLDSLLIEMCKYGLASQDLSATVNLFSKVAPDENGALSYVSSDNTNQSIELRFEMDCLVFLSAAPHGLDTSPSYQPADIQLSLFKANSLTDSDICRDACSQNQRAFQNTARYYALSNI

SEQ ID NO: 6441 - protein, 663 aa, Acinetobacter baumannii
SMTTPLNERRIANAIRVLAMDAVQQANSGHPGAPMGMADIADVVWREFLNHNPNNPQWANRDRFVLSNGHGSMLQYALLHLTGYDLSIEDLKQFRQLHSKTPGHPEYGYAPGIETTTGPLGQGIANAVGFALAEKTLAAQFNKDDLKVVDHFTYCFLGDGCLMEGISHEVCSLAGTLQLGKLIAYYDDNGISIDGEVEGWFSDDTEERFKSYGWQVLRVDGHDADAIRQATVEAKAETQKPTIIICKTIIGLGSPNKQGKEDCHGAPLGKDEITLTREALGWTEEAFVIPADVYAAWDAKAKGNEAEAAWNEVFAQYQAKYPTEAAELLRRISGDLPAEFSAQADAFIRETNAKAETVATRKASQNTLQAFGPLLPELLGGSADLAGSNLTLWKGCQGVQENPAGNYVYYGVREFGMTAIANGVALHGGFIPYVATFLMFMEYARNAVRMSALMKQRVIHVYTHDSIGLGEDGPTHQPIEQIASLRGTPNLNTWRPADTVETAIAWKSALERKDGPTALIFSRQNLPFQTRTEEQIQNAAKGGYVLAQEKGELKAIIIATGSEVSLAMEAYAQLEGVRVVSMPCAEEFMKQDAAYREAVLPAHIRARVAVEATHVDYWWKFVGLDGKVIGMTTYGESAPAKDLFQFFGITTEAVVAAVKELTA

SEQ ID NO: 6442 - protein, 387 aa, Acinetobacter baumannii
KDETMIRDQETLNQLVDMIRQFVEGVLIPHENEVAETDEIPPDIVEQMKALGLFGLTIPEEYEGLGLTMEEEVYVAFELGRTSPAFRSLIGTNNGIGSSGLIIDGTEAQKSFFLPRLARGEVISSFCLTEPDAGSDAASLKTSAVKDGDFYVLNGTKRFITNAPHAGVFTVMARTNFDIKGASGISAFIVDSQTPGISLGKRDKKMGQKGVHTCDVIFENCRIPASALIGGVEGVGFKTAMKVLDKGRLHIAALSVGAATRMLDDSLNYAIERKQFGQPIAEFQLIQAMLADSKAEIYAAKCMVLDAARLRDAGQNVSTEASCAKMFATEMCGRVADRCVQIHGGAGYISEYAIERFYRDVRLFRLYEGTTQIQQVIIARNMIRAAS

SEQ ID NO: 6443 - protein, 256 aa, Acinetobacter baumannii
KEETLIKMEKSMSSNAPKKAVEMSNDEIDDHIYNAIVDAILNRQLAPGARLVEAPLCEAFGVTRGVLRRVFVKLAHDKVIEIQPNRGALIAKHSTNETKEVFEARSMLEIATVKKLAQKSHRLDLSELRSLVDQESHERLAGNWAEWIKLSGQFHLKLIEANQNTIMTSYLQTLIARTSLLIGLYEIPKHNNCSVDEHRAILDAIEQGDEKRATQLMEEHLEHYATTFIEENSAVSAEQNLLNLFKNKRIETPQTN

SEQ ID NO: 6444 - protein, 67 aa, Acinetobacter baumannii
EIRTFVKTVYRTNFYAILVFTFNTIFSDNKGHGDSYLKNMVSFRIAYFRQKRGKQTIAFIDIVYLYI

SEQ ID NO: 6445 - protein, 305 aa, Acinetobacter baumannii
INFAMSYFDINRSGELAIFIRVVELGSFSAVARACNMTPSAVSKLISRLEKRLGVRLLNRSTRQFQLTSEGCQFYEQGIQILNDLDELEQAVTANHIPKGRIRIHTSFSYWTHFLLPCISLFNQRYPEIELEAHLSDEVINLVEQRIDVAIRTGPLKSSNLVARSLGSTYKHYVCSPVYIEKYGCPEHPDELHEHQLLDVSYQRQNKTWLFKKATQEISLTPSKVLKVNHGEAILQLALAGAGIAQLNEFQIRNALQQKQLVKILEDWNIHASEEFHAVWIGHDKYVPNRVRTFLDFLVEHASIN

SEQ ID NO: 6446 - protein, 227 aa, Acinetobacter baumannii
QTLAFFSVCIMVYHNTNDKIIYLQGRAMELIRKTVLHVETTYVDGGKEAAKPLKMVAAAAVIKNPWAGQGYVENLTPEIRRIAPILSEHLTKLILDEVGSGEAVEAFGKSAVVGLNGELEHASALIHTLHFGNTYRSAVGAKSYLAFNNTRGPANAPILIPMMDKNDEGRRSHYLTLQFAIPDAPAADELVVVIGAATGGRPHHRIGDRYKDLEELGHDVKNPAAVK

SEQ ID NO: 6447 - protein, 358 aa, Acinetobacter baumannii
VWVAISGGANWGGCNVWASLDNTTYEMIGTIYGSARYGQLVTPIDADDSTLQVELNTASQIFSGTLEDAQADQTLCKVGDEYFNYQVATLNGSGLYTLSDVLRGRFDDAQSHNAGEPFVRLDKAIFKYPYNDGLVEKQIFLKFTSFNGLERKEQALDEVTAYSYTLSGGRPAGVKGLSLQSPFVGTTFKVQWQTSTGADGYRVQVWSNGAMIRQVDTTNTDYSYSIEEAKQDGLGRAYTIRVASKNGDQVSTFAELSISNPVPPVLLNVYTAATVDSITVNWAPSEVPDLKEYAVWLSATPNFDPTQVPPSWTGTETTTTFGGLQPTTPYYIRVAARDVWENTVWNYTNQITQSTSEA

SEQ ID NO: 6448 - protein, 258 aa, Acinetobacter baumannii
RNNAMFVDLNSDLGESFGSWKMGNDDQILPVVTSANIACGFHAGDPLGILKTVRKAVELGVTIGAHVSYPDLVGFGRRNMDLSRDELIADVLYQISALDGLVKVAGSKVQYVKPHGALYNTIAHDQAQAAAVIDAIKMYNPELVLVALAGSNLVEQARAAGLKVVSEAFADRAYNSDGSLVSRRLEGAVLHDSAFVASRVVSMLKNGGVDSIDGVFTPIQADTICLHGDTDGALEMSAAIKAELVKNNIEIRPFVNKA

SEQ ID NO: 6449 - protein, 101 aa, Acinetobacter baumannii
FFYFLNKNSEIFISSYINQSFIFAIDPPQCSAYDARADQFCQSVLADRLPKCTKNTFFGVTPLVPLMEEREWDTLGCAGFLGISLLTLFRFATIIMSNEWA

SEQ ID NO: 6450 - protein, 111 aa, Acinetobacter baumannii
VAVAMTFVVTENCIKCKYQDCVEVCPVDCFYEGPNFLVINPDECIDCALCEPECPANAIFSEDELPEGQEVFIELNAELSQKWPNITQIGEQPADREEWNGKPDKLQYLEK

SEQ ID NO: 6451 - protein, 419 aa, Acinetobacter baumannii
LTHAALSQASIISRVWGEGPSERYDELASNFRPTFARIKEGALIREQQHILPYEQLQWLKDIGFTRLRLPKTHGGFDATIPELFALLVELAEADSNLPQALRVHFGFTEDVLVSKDKTFQQRWLSRIANGETVGSAWSEGGKESIDQFETHLYRDSDGKIRVKGKKYYTTGSLYADWVDVGVTDLKGESGSVVVRREDEGVEIVDDWNGFGQQLTASGTAYFHDVLVDEAEILPDDDRFKYSAAYYQLVQLAIITGLGRAATYDVSQAVAKRTRNYTHANAQFVKQDPQILQVVGQIRGAAYSAGAIVEKVAQSLQRAYLAAFQNNEQLEEEQNALAELESAQSQTVITDLILNASTILFDALGASATDKDLGLDRYWRNVRTLASHNPRVFKNRIVGDFSVNGTLPPYQWRIGNVAKQ

SEQ ID NO: 6452 - protein, 496 aa, Acinetobacter baumannii
TPDAFMRFIDILGYQDLLNRSEGLDDFHPLESRRTDMPRIPVINTSHLDRIDELLVDNIDTGEFKLHRSVFTDEALFDLEMKYIFEGNWVYLAHESQIPNNNDYYTTYIGRQPIIIARNRNGELNAMINACSHRGAQLCRYKRGNKATYTCPFHGWTFNNSGKLLKVKDPTDAGYSDCFNQDGSHDLKKVARFESYKGFLFGSLNPDVPSLEEFLGETTKIIDMIVDQSEHGLEVLRGSSTYTYEGNWKLTAENGADGYHVSAVHWNYAATTQHRKETQAADNIRAMSAGSWGKQGGGSYGFENGHMLLWTQWANPEDRPNFPKADEYTEKYGEAMSKWMIERSRNLCLYPNVYLMDQFGSQIRVLRPLSVNRTEVTIYCIAPKGEAPEARARRIRQYEDFFNASGMATPDDLEEFRACQAGYAGIALEWNDMCRGSKHWIYGPDDAANEIGLKPMLSGIKTEDEGLYLAQHQYWLKTMKHAIATEKEIADQGETA

SEQ ID NO: 6453 - protein, 388 aa, Acinetobacter baumannii
QMRALTYHGAEDVRVETVADPIIQEPDDIILRVTATAICGSDLHLYRGKIPKTEHGDIFGHEFMGIVEEVGPAVTAVKKGDRVIVPFVIACGECFFCQLDLTAACETTNTGRGAIINKKQIPPGAALFGYSHLYGGIPGGQAEYVRVPKANKGPFKVPGSLSDEKVLFLTDILPTAWQAVTNAQVKRGSTVAIYGAGPVGLLSAACAKMLGAEKIFMVDHNEYRLNYAAATYDAIPVNFDEVDAAEFIIQNTDNYRGVDAVIDAIGFEAKGSVIETVLTNLKLEGSSGAALRQCIAAVRRGGVVSVPGVYAGPIHGFLFGDAFDKGLTFKMGQTHVHQYLPQLLELIERGELTPETIITHRMKLEDAAEGYRIFNEREEDCRKVILLP

SEQ ID NO: 6454 - protein, 116 aa, Acinetobacter baumannii
RIYFVEDMINQVDFFKCLSDQTRLNILKLVLNKQNICVCELTEQLELSQPKISRHLALLRTHGVLLDERKGQWVYYSLNPDLPVWALDILKVIENDESGTNVKQQDQPFITTTCCD

SEQ ID NO: 6455 - protein, 674 aa, Acinetobacter baumannii
STYLTIMFVRKRNSALFTVILLGSILSGCQVVNVKQQALNVTIANERNSILTQDKLSEASLNVLSMSGQEAKACTDSPDTCVNQLKNLPQILDEQLLSAASEMYLAKAMALSDSSECKISRFTKHKPTEEQKVIQNKYDECLDQQLSLLDKSIRYSYAYLFSTKRQPTDRIFDNRQVQIRDFYNQAIAKMVSVYDLRYPQKNVVEPQIHIGKSVYSIDFEFHRQLSGQKLEKLISSYNLNFSGLRTINRRDGFGSEFVAVFPSSGKEDINEYILDPLNYSYKNGVNPNIHHARYLAATIVAEPKHAKTIQEIINDPEFVIRVYDPYRTDNINVAGKQYPLAANFSAPYGLWLAENNLGVAAYLSLIDRDQHLTMPHLYMLEPYNPNKKIIVLVHGLASSPEAWIALTNDVMGDTVLRDNYQVWQVFYSTNMPILESRFQIYALLKQAFGSLNPSDPAAHDAVLVGHSMGGIISRLLVSDADITKPALEMMTIRQQNRFKKHPMVTERLQMHSISNFDRAIFLASPHRGTDYADRWFTLAARKIIRLPGAFLSAVATSLTTENLDIKDFLNNIDNGLIQNGPSDLSHQSKFMELTENINPHQGLIFHSIMGNITKSDDPNVITDGIVPYKSAHLEGAKSEKVLPGGHSIQLTPQAVLELRRILREHLVEHGLYKP

SEQ ID NO: 6456 - protein, 98 aa, Acinetobacter baumannii
PVLAKRLTILNSIYSHAELSTPSFIINSPRQQDIDSDNYHHMLNILISNTPDDVQLIIAGVQNNFINSIKGNFEEINPESTLLTAEEYELANFLILHS

SEQ ID NO: 6457 - protein, 1160 aa, Acinetobacter baumannii
MNIATKVTPNIIATKDVSLEDKYVSDNGTAFMTGIQALVRLPLAQTRRDAINGYHTAGFISGYRGSPIGNYDNFLWQVEGLLKSHNVVFQPGVNEDLAATAIWGTQQANLSGQGKYDGVSSWWYGKGPGVDRSGDVLRHANLAGTSERGGVVALFGDDHSCKSSTVPHQSEHVMIGCGIPIFYPTSVQQILDFGVHAIAVSRFSGLWTSMKLVSEIVETSASVHVDLDRVTPVIPEDVNFPEGGVNIRWPDHGIQQEERLYKYRLPAVLAYARANKINTVTWPCENARIGIAASGKGYLDTIEALRILGIEDETAQQLGLRVYQVGLIWPLEPQGIREFAKGLEELIVIEEKRPILETQIKDELYSLPDDQRPRVIGKATDGKGEWSTSIEEAPLIGHYEYQPEPIAKMLAARFLKLDIPESLKVQIQSRIDLLLKAEQESKRVIDLAERKPYFCSGCPHNSSTVVPEGSRALGGIGCHYIAVSLDRGTETFSQMGGEGVSWVGASPFTNEKHIFANLGDGTYFHSGYLAIRQSIAAKTNITYKILYNDAVAMTGGQHVDGHLSVAQLTRQLDAEGIKKQVIVTDEIKLLNEEDGIAPGVEIRHRNELDAVQRELREISGVTALIYVQTCASEKRRRRKRDAYPDPAERLFINTDICEGCGDCSKKSNCLSIEPVETALGTKRQINQSSCNKDFTCAEGFCPSFVTVHTRDMKRPAKFEGISAGWPTSPIIPQLYDVPSRIMVGGIGGTGVVTIGALLGMAAHLEGKATRVMDMAGLAQKGGTVYSYVQLAASDEQISSTKIPAGQCELLIGADAVVAGSGAALSRLKEDALVIVNEDSTPTSEFIKSRDWYAPITDLIDRLRGRVRQGQLVSLPAARIATQLLGDSIYTNQLLLGMAWQSGRIPLLRESIEKAIRLNGTAVEKNIEAFRVGCHLASDPTLAARLLAAMPKTKTPQTLAELVEDRSARLTDYWNEAYAAKYRTLVELAAKKLPEELTGTIATQLYRVMAYKDEYEVARLLTGKSFKESIETQFGKGLRLTYHLAPPALLGGLKNVRKRAFGYWMRFPMMMLARLQWLRETFLDPFARQEERQHEQAWRDRYIAFVEALVEAPDNHNLAVAEQIAKLPAEVRGYGHIKMKAMDAAKQRWDELTPTLLKVRN

SEQ ID NO: 6458 - protein, 229 aa, Acinetobacter baumannii
KIIATTKLEMCQAQSLRLCCAFFSPKKGTGFFISTYNKNFYNGKIMPNLALPTRALYVVNKAIDLFHHRGFHLIGVDRIVKESEITKATFYNYFHSKERLIEICLMVQKEKLQEQVVAMVEYDQDSSVRDKLNKLYYLHTDLEGQYYLLFKAIFETKNTYSNAYQTAIRYRTWLTNEIYSQLRSLKADSSFHDAKLLLHVIEGTIIQRLSYNDVDERDKQFEYFIAMLS

SEQ ID NO: 6459 - protein, 304 aa, Acinetobacter baumannii
ELYFSMQNQTASNLPSTQLGKALLCLMTSALLFSIMGVCIRFASQTVDNATVVFFRNAVGLFIFIPMLFKQGLDFIKTDKLWMHTWRSIVGLAAMYGFFYAIANLKLSNAMVFSYSSPIFIPLIAWLFLKEKITKSMIFAAMIGLIGVLFVAKPDQGLFNALSFIGLGACFLSAMAFVTVRALTSTEPPERIVFYFCVFGSLISSIPMFWHWRIFTWHELALLIAAGLLANISQLFMSYAYSLAPAGQIGPMNYIAIIFAGIWGFVFWHELPDLFSIIGIFIILFAILLCNPFLQKKLLSLFKV

SEQ ID NO: 6460 - protein, 61 aa, Acinetobacter baumannii
KVYLLRVTVLLYRTSRSLLLQVKALKHHSLRLITSFVLGSKTGQITIIFNSSLALQNARLF

SEQ ID NO: 6461 - protein, 418 aa, Acinetobacter baumannii
WIMATNYKDGLSRIQPHTWKIAFIFAFLALLVDGADLMLLSYSLNSIKADFGLSSVQAGMLGSFTLAGMAVGGIFGGWACDKFGRVRIVVISILTFSLLTCGLGFTQSFLQFGILRFFASLGLGSLYIACNTLMAEYVPTRYRTTVLGTLQAGWTVGYIVATLLAGWIIPDHGWRMLFYVAIIPVVIAVLMHVLVPEPEAWQKSRLQQPVVTQNASKTSAFKLIFQDKRNRNMFILWALTAGFLQFGYYGVNNWMPSYLESELGMKFKEMTAYMVGTYTAMILGKVLAGMMADKLGRRFTYAFGAIGTAIFLPLIVFYNSPSNILYLLVTFGFLYGIPYGVNATYMTESFATAIRGTAIGGAYNVGRLGAALAPATIGFLASGGSIGLGFVVMGAAYLICGVIPALFIKEKIYDPQKS

SEQ ID NO: 6462 - protein, 374 aa, Acinetobacter baumannii
EKQAYSANFILRHFIRIFSMLTKTVKSFGLAMGLLACSLPLYAKNNVVVVATGGTIAGAGASSANSATYTAAKVPVDALINAVPQIQDLANVSGIQALQVASESITDKELLQIARQVNELVKKPTVNGVVITHGTDTLEETAFFLNLVVHTDKPIVLVGSMRPSTALSADGPLNLYSAVALAASDDAKNKGVMVLMNDSIFAARDVTKGINIHTNAFVSQWGALGTLVEGKPYWFRQSVKRHTNASEFNIENIKGDALPTVQIVYGSDSMLPDAYEAYAKAGAKAIIHAGTGNGSVAKYIVPTLQNLHDKNGIQIIRSSRVPQGFVLRDAEQPDSKYGWVAAHDLNPQKARLLAALALTKTNDAKEIQRMFWQY

SEQ ID NO: 6463 - protein, 444 aa, Acinetobacter baumannii
CNEAIMGKNVVVLGTQWGDEGKGKIVDLLTDQAAAVVRYQGGHNAGHTLVVGGKKTVLHLIPSGILRENVLCLIGNGVVLSPAALIEEMGILEAEGVPVKERLRISPNCPLILPNHIALDQAREKKRGNAKIGTTGRGIGPAYEDKVARRAVRVADLVRGGAALEEKLAEMLELHNFQLTQFYGVEAVKFEDVLALCNQWREVLAPLVIDVTKVLHDYRKEGKAVMFEGAQGSLLDIDHGTYPYVTSSNTTAGGVSSGSGMGPLHLDYVLGITKAYTTRVGAGPFPTELVYDAASDSGDPIGKHLGTVGHEFGASTGRQRRCGWFDAEILRRSVDVNSLSGICLTKLDVLDGLEEVKICVGYENTDSGCVGSSDAVSFECLKPIYETMPGWSESTVGLTSIDQLPANALAYVKRIEQLIECPIDIVSTGPDRAETIILRHPFSA
